United States Patent 8,119,385 (NUCLEIC ACIDS AND PROTEINS AND METHODS FOR MAKING AND USING THEM) - sequence listing, part 3

SEQ ID NO: 10178 - protein, 128 aa, Unknown
  Obtained from environmental sample
  misc_feature (1)..(128): Xaa is any amino acid
MKKTNNNNVFYDPSLAKRHRKAKVFKGLALSALVISLLFLAIFLSDMVIKGKSAFLQTYIQVEVTYNESTVKSYRKAIERKYLNLVSRSDIRDIPLKMEHDPSLMGNKKLQWILADDQVDMYLKEKYY

SEQ ID NO: 10179 - DNA, 663 bp, Unknown
  Obtained from environmental sample
  misc_feature (1)..(663): n is a, c, g, or t
gtgatagttgcacaatgggatccatatgcaaatccaactattgcacaagaagctggtaaggtatcatttgatgatattatccctggtattacagtaagtgaagcgtatgacgagttaacaggtacctcaaaattagttgttaatgagtatattcctgctaattacaagccatctattaatattcaatgtaaagatggaaatgttataaattatgtactagaacctaaaacttctttatttgtaagtgttggtgatgaagtagctattgcagatattattggtaaaacaccaaaagctgtttcaaaatcttcagatattacagggggtcttccaagagtttctgagttatttgaagcgaggcgacctaaaaatattgcagtacttgcaacttttgatggtgttgtatcttttggtaaaccattaagaaataaacaaagattgactatttctgataatattggaaacaaagatgagttcttgattaccaaagatagaacaattctagtgagagatggtgagtttgttcatgcgggtgagaaattaacagatggtcaaatagcttctcatgatattcttaaaattttaggaacaaaagcattaaatgagtttattgttgctgaagtttcaggtgtatatcgaggacaaggtgttaaatattgctga

SEQ ID NO: 10180 - protein, 220 aa, Unknown
  Obtained from environmental sample
  misc_feature (1)..(220): Xaa is any amino acid
MIVAQWDPYANPTIAQEAGKVSFDDIIPGITVSEAYDELTGTSKLVVNEYIPANYKPSINIQCKDGNVINYVLEPKTSLFVSVGDEVAIADIIGKTPKAVSKSSDITGGLPRVSELFEARRPKNIAVLATFDGVVSFGKPLRNKQRLTISDNIGNKDEFLITKDRTILVRDGEFVHAGEKLTDGQIASHDILKILGTKALNEFIVAEVSGVYRGQGVKYC

SEQ ID NO: 10181 - DNA, 735 bp, Unknown
  Obtained from environmental sample
  misc_feature (1)..(735): n is a, c, g, or t
ttgaaaataaaagtgggactccaaaaaaatatagagtttttttnctttgatataaaacaaaataaaaaagatattatcaaaaatagttcaagaggaaaagaaacatatagttttgaagtgccaaataatggatactataatctttttgcagtagcacaaagtacaaaagatgataaaaaattttacaatgtagcaaaactagagtatcttcaagggaaacatggtattgaagatatttatgatgaagaacttaaaaaaaatcttgaacaaaacctgactaaaattgacttaataagaataaaaaacgaagatgaaaatagctttttttataaatttaaaatgggtgaaactttaaaatttcaagcaatatttgatcaaaaacccttagcaaatacaaaaatacatatcaaactccaaagtggttgggaaaaaacttcaattacaaatgataaaggtgaagtagaatttacaattataagagattatttcccctcttggaataagtttgaaaaacgatttaaacaagatttattaataactttagaatataatactgctcatacaaaatatacgctgacataccctgcatctttttacccaaatggaagtgactacaaatcatacgcttatgcattgctactaataactcttacacttcttgtatctggtatagttatctatagatttagagaaaatagaactgcacctttttcagaggtaaagttcaatgagtaa

SEQ ID NO: 10182 - protein, 244 aa, Unknown
  Obtained from environmental sample
  misc_feature (1)..(244): Xaa is any amino acid
MKIKVGLQKNIEFFXFDIKQNKKDIIKNSSRGKETYSFEVPNNGYYNLFAVAQSTKDDKKFYNVAKLEYLQGKHGIEDIYDEELKKNLEQNLTKIDLIRIKNEDENSFFYKFKMGETLKFQAIFDQKPLANTKIHIKLQSGWEKTSITNDKGEVEFTIIRDYFPSWNKFEKRFKQDLLITLEYNTAHTKYTLTYPASFYPNGSDYKSYAYALLLITLTLLVSGIVIYRFRENRTAPFSEVKFNE

SEQ ID NO: 10183 - DNA, 783 bp, Unknown
  Obtained from environmental sample
  misc_feature (1)..(783): n is a, c, g, or t
ttgatcaggaaacaatacttaaaaaatgaaataaatttacttcaaaataaaacacacaaacacgataatattttgatgaagatatctaaaaactatgcagtatatgattatgatattaaagctttaggcttaaatacaaatgattttaattttgaaaaagaaaatataaatacagctgctcttttattagatcatacagataaaaatatcgtgttaaaagagatagcacaatcaaatcaaaatgaagtacttaaaaaatttgttattaatcaaatcaaaaataaagatattgtttatgaataccaattagattctttaaaaattgataaatcaaatttactattaaatattaataaagatttttcatctattgatattgaaaaaaataaacttaattatgaagcaacttataatgatagattaaatgatggaactatatcaagtataaaatacaaagatatagattatttaaaaggtcttgaagagatagaaaatttggattttgataaattatctattacagatgacatcgatagttttattaaacttgatgcaataaaagaacaagcaataaaaaacaaagatatagatgcattagaccaggtgtataaaaaagagaaaccgattatcttatcagagactattaaagaatatggttatgctttaaatgttaattcaaaagatataaataaagagttatggaatgagtttaacggaacagtaaaagattatgatggctttggtgaacatcatgtaaaanacatacctgattataaaagatag

SEQ ID NO: 10184 - protein, 260 aa, Unknown
  Obtained from environmental sample
  misc_feature (1)..(260): Xaa is any amino acid
MIRKQYLKNEINLLQNKTHKHDNILMKISKNYAVYDYDIKALGLNTNDFNFEKENINTAALLLDHTDKNIVLKEIAQSNQNEVLKKFVINQIKNKDIVYEYQLDSLKIDKSNLLLNINKDFSSIDIEKNKLNYEATYNDRLNDGTISSIKYKDIDYLKGLEEIENLDFDKLSITDDIDSFIKLDAIKEQAIKNKDIDALDQVYKKEKPIILSETIKEYGYALNVNSKDINKELWNEFNGTVKDYDGFGEHHVKXIPDYKR

SEQ ID NO: 10185 - DNA, 768 bp, Unknown
  Obtained from environmental sample
  misc_feature (1)..(768): n is a, c, g, or t
atgttgaatcaagataaattggcatatctgagaaaaaaatattccattattattttagaagattgcgctcatgctataggagctaaatataacgatattaaagcaggatcttgtacaaatagcgactgctctattttttcatttcacccagtcaagcatataactacaggtgagggtggtgcaattactaccaactctaaagagatatatgaaaaattacttcttcttagaggtcatggcatgcgtaagcgtgaaggtttatctccatgggaatatgagatggttgagttgggatttaatggcagaataacagattttcagtgtgctttaggaatttcacaacttaaaaaacttccatcattcataaaaagaagatttgaaatagccaaaagatatgataaagtttttgaaaatactattataaagccactttatacatttgatggaacatcttcatatcatctatatgtcgtttgtgtagattttactaagttatctataacaaaagtagatctatataatagactgcacgactttaaaataggattacaaattcactatatgccaataaacaaacagccatattacaaagaattaggctatggaagtgaattaacaccaaatatggacagatactacggagagtgtttttcactgcctatgtatccacttttacgtgatanagaacaagagtatgttataaaaactctttttgagattttaaatgggctaagctgttgccataattccagcacgtggaggaagtaa

SEQ ID NO: 10186 - protein, 255 aa, Unknown
  Obtained from environmental sample
  DOMAIN (1)...(238): DegT/DnrJ/EryC1/StrS aminotransferase family
  misc_feature (1)..(255): Xaa is any amino acid
MLNQDKLAYLRKKYSIIILEDCAHAIGAKYNDIKAGSCTNSDCSIFSFHPVKHITTGEGGAITTNSKEIYEKLLLLRGHGMRKREGLSPWEYEMVELGFNGRITDFQCALGISQLKKLPSFIKRRFEIAKRYDKVFENTIIKPLYTFDGTSSYHLYVVCVDFTKLSITKVDLYNRLHDFKIGLQIHYMPINKQPYYKELGYGSELTPNMDRYYGECFSLPMYPLLRDXEQEYVIKTLFEILNGLSCCHNSSTWRK

SEQ ID NO: 10187 - DNA, 453 bp, Unknown
  Obtained from environmental sample
  misc_feature (1)..(453): n is a, c, g, or t
ttgaggccctttattaccaaagttgcttttaaaaattgtttgttactgattattttcctgattgacttgattttttattactggagcggcttaatggacgtcttggaattacattcatataaaaaaattatcatgaccgcccatcaacttggtgaaaccaatatattatcccaaacaagtagaaatctttgccagtatcttgggcttccaaccaaattcgtacataatgacataatttattttttaccattttcaagcgtacccgtattcgatgagatttatatccaaaactataattgtgatattttttggtattgtattgtaaatcaatccgaaggtatagatccaaattgcaagccgaattgtggctacgatcaaaaaaattgtccgatattaaaaagtgcaaaaacaaagaactattcattattaaaaataatagaaataaaatattaa

SEQ ID NO: 10188 - protein, 150 aa, Unknown
  Obtained from environmental sample
  misc_feature (1)..(150): Xaa is any amino acid
MRPFITKVAFKNCLLLIIFLIDLIFYYWSGLMDVLELHSYKKIIMTAHQLGETNILSQTSRNLCQYLGLPTKFVHNDIIYFLPFSSVPVFDEIYIQNYNCDIFWYCIVNQSEGIDPNCKPNCGYDQKNCPILKSAKTKNYSLLKIIEIKY

SEQ ID NO: 10189 - DNA, 792 bp, Unknown
  Obtained from environmental sample
  misc_feature (1)..(792): n is a, c, g, or t
atgtcagaaaaaatccaaaacaaaaaaataaatatcggtgaagtaaatacattaaaaatagagcgtgatacagactttggttactaccttactgcagaagattttaatgaagtacttcttccaaatgtttatataatggaagatgaaatgcctatggggtcactcctggatgtatttatctatacagattcggaagaccgccccgtggctacaacgaagatgccttatgcaaagttgggtgagtatgggtattttacagtggtagactacaaatcatatggtgcctttatgaactggggattgcctaaagacctttttgtgccactttcacagcaaaaagagcattttaccattgggaagaagtatcttttacgtgtctgtctggatgagcagacaggacgtttgtttgccacacagaagataggtaaatattttaacagagatatgaaaggtctgcaccaaaataaagtcttggatgttattgttctggctaaaacaccgttgggttataaagtcgtagcagataatcagtatgaaggtatgctatttaacaatgagatctttgaaaacattaaaataggtgaccgtaaaaaaacctatattaaatctgtaagaaaagattttaaattggacttgtctttacaacccatagggatcaaggcaaagatagatgaagctgaaggtacagtgatccaactcttaaaagaggcggatggtgtcttgccttttacctataaaagtgatgcagatgatataaagaaagtctttggaatgagtaaaaagaatttttaa

SEQ ID NO: 10190 - protein, 263 aa, Unknown
  Obtained from environmental sample
  misc_feature (1)..(263): Xaa is any amino acid
MSEKIQNKKINIGEVNTLKIERDTDFGYYLTAEDFNEVLLPNVYIMEDEMPMGSLLDVFIYTDSEDRPVATTKMPYAKLGEYGYFTVVDYKSYGAFMNWGLPKDLFVPLSQQKEHFTIGKKYLLRVCLDEQTGRLFATQKIGKYFNRDMKGLHQNKVLDVIVLAKTPLGYKVVADNQYEGMLFNNEIFENIKIGDRKKTYIKSVRKDFKLDLSLQPIGIKAKIDEAEGTVIQLLKEADGVLPFTYKSDADDIKKVFGMSKKNF

SEQ ID NO: 10191 - DNA, 450 bp, Unknown
  Obtained from environmental sample
  misc_feature (1)..(450): n is a, c, g, or t
ttgaaagatgtagcagttatttttaaacgtggcagatatgctgtggtaaagcagacagcagatggacgaggtatttttttgtatggctgtgttaatggtttaaaagagggaaaaaaatatgaccttttagtacaggacatcacaagctataaagggcttaaagaaattacggacttggtaaagcttaaagataaaggaaccgttgacttaaattctttttaccgttctctaaaaataatgagacaaaatgaagttctaagagatcttgaggctacctataaaaatagaaatttatacatagatggtaacaaaattcctgtttattttaaaaataaaaaattaacgccaaagaatggctcaaagctaaagatacactatgcacatcttggatattataagaaattacagttagttatttacagcaaaaaagattttgaaattattgaatga

SEQ ID NO: 10192 - protein, 149 aa, Unknown
  Obtained from environmental sample
  misc_feature (1)..(149): Xaa is any amino acid
MKDVAVIFKRGRYAVVKQTADGRGIFLYGCVNGLKEGKKYDLLVQDITSYKGLKEITDLVKLKDKGTVDLNSFYRSLKIMRQNEVLRDLEATYKNRNLYIDGNKIPVYFKNKKLTPKNGSKLKIHYAHLGYYKKLQLVIYSKKDFEIIE

SEQ ID NO: 10193 - DNA, 615 bp, Unknown
  Obtained from environmental sample
  misc_feature (1)..(615): n is a, c, g, or t
gtgtatggctcaggatgcctagaattagtactagaaaaatttgaaaaaaattttagtaaatatttttctcaacttcaatggctcaattttggtggaggtcatcatattacaagagatgattatgatgttgaaaaattaataactgtcttaaaaaactttaaatccaaatatccccatctaacaatctatatggaaccaggtgaagctgtagggtggcaaacaggatatttagaagcgacagtacttgatatagtacataatggtatggatatagctattcttgatacaagtgctgaatgtcatatgccggatactcttgctatgccttacaaagcacaaatacgagatgctgctgaaccatttgaaaaagcatatacctatagacttggtggaaacacttgtcttgctggagatattataggagattactcttttgataaaaaactagaggttggtgataaaattatattagaggatatgatacattatactatggtaaaaactactacatttaatggtattaatttaccatcaatagctattaaaaaacctgatggtagttttaaaattataagaaactatgattaccaaagctataaagatagattgtcataa

SEQ ID NO: 10194 - protein, 204 aa, Unknown
  Obtained from environmental sample
  DOMAIN (76)...(183): Pyridoxal-dependent decarboxylase, C-terminal sheet domain
  misc_feature (1)..(204): Xaa is any amino acid
MYGSGCLELVLEKFEKNFSKYFSQLQWLNFGGGHHITRDDYDVEKLITVLKNFKSKYPHLTIYMEPGEAVGWQTGYLEATVLDIVHNGMDIAILDTSAECHMPDTLAMPYKAQIRDAAEPFEKAYTYRLGGNTCLAGDIIGDYSFDKKLEVGDKIILEDMIHYTMVKTTTFNGINLPSIAIKKPDGSFKIIRNYDYQSYKDRLS

SEQ ID NO: 10195 - DNA, 549 bp, Unknown
  Obtained from environmental sample
  misc_feature (1)..(549): n is a, c, g, or t
ttggattatttaaaaaagatatatgaagagcagactaaacctatagtaaagttagtagatgagcaatatattttaaatagtaaatacaaaataggaactataattcttattaatgataatgccatactgaatcttacaaacaatagttctcaaaaaatatatatagaccatgataaccttaatggtgcatacaatcatgatattgttttagtacaagttatcttcaatccaaaagggagaacaaaagcaaaagtgattcaaatacttgagcgttcaaatcatagtattctttgttttgtaaaaaattcgaatctttatacagtaaaagaaaatgcttttatagattgtgaggttgtaaacaatagagatggggatattgttctttttgaaaaaggaaaaatcatcaaagtatttggaaatatcgctgatgcttcaattgatgaaaaaatatctttgtatctttataatgagttttatagactagacccaatggagtctttagagtttataaacttgataatttctatagagttgacttactcatcttga

SEQ ID NO: 10196 - protein, 182 aa, Unknown
  Obtained from environmental sample
  misc_feature (1)..(182): Xaa is any amino acid
MDYLKKIYEEQTKPIVKLVDEQYILNSKYKIGTIILINDNAILNLTNNSSQKIYIDHDNLNGAYNHDIVLVQVIFNPKGRTKAKVIQILERSNHSILCFVKNSNLYTVKENAFIDCEVVNNRDGDIVLFEKGKIIKVFGNIADASIDEKISLYLYNEFYRLDPMESLEFINLIISIELTYSS

SEQ ID NO: 10197 - DNA, 534 bp, Unknown
  Obtained from environmental sample
  misc_feature (1)..(534): n is a, c, g, or t
ttgccaattaatttaatgaaatttcaagcaaatttaatatcagatggaaatgtgttgataaattggcaaacagctagtgaaataaataatgattatttcacagttgagcgttctagcgatacaaaaaaatgggaagaaatagaatttgttactggagctggaaactctacattagttctagattatactataattgataaaaatcctttgaaaggtcaatcatattatagactcaagcaaacagattttgacgacatattttcttattcaaaaataattgctcttaataatgttagtaatgaatcatcaattacgataaactacaattcccaaataaagcaattaacagttcaatcaattacaaaagaactgacagaagtatatatatattcttcaaccggattgttagtaaattctaatacgaataatatttccaaagaatataaaaagagtgtgtttgatttgagccaacttccggcaggtgtatatattataaaagccggacaatttgctaagcagttcgtagttttataa

SEQ ID NO: 10198 - protein, 177 aa, Unknown
  Obtained from environmental sample
  misc_feature (1)..(177): Xaa is any amino acid
MPINLMKFQANLISDGNVLINWQTASEINNDYFTVERSSDTKKWEEIEFVTGAGNSTLVLDYTIIDKNPLKGQSYYRLKQTDFDDIFSYSKIIALNNVSNESSITINYNSQIKQLTVQSITKELTEVYIYSSTGLLVNSNTNNISKEYKKSVFDLSQLPAGVYIIKAGQFAKQFVVL

SEQ ID NO: 10199 - DNA, 336 bp, Unknown
  Obtained from environmental sample
  misc_feature (1)..(336): n is a, c, g, or t
gtgccgaatggttccaataagagtaactcaattataaattcgattgagaacttcttgaagactgattttccgaaagagctgcttaagaggctaatagaacgtggatttatgggatgtggagagtgtataaagcttgaacatggatatttttttccgcaatcgccgtataaacactctaaagatctttttgttgctatctctaatgatgttaaatttcatcaaggtgcacctgctctattgttacgttcaaacgatactgacataaatcaattttgtgacacaggtgtgtttataggtaagcccccagcgatcagcgaaactattaatgtatcttaa

SEQ ID NO: 10200 - protein, 111 aa, Unknown
  Obtained from environmental sample
  misc_feature (1)..(111): Xaa is any amino acid
MPNGSNKSNSIINSIENFLKTDFPKELLKRLIERGFMGCGECIKLEHGYFFPQSPYKHSKDLFVAISNDVKFHQGAPALLLRSNDTDINQFCDTGVFIGKPPAISETINVS

SEQ ID NO: 10201 - DNA, 537 bp, Unknown
  Obtained from environmental sample
  misc_feature (1)..(537): n is a, c, g, or t
atgtcattagatcaagttcaacaaaaagcgctacaaacttacgagaaaaatctagaatactttaaacaaaatcatcctgatatatacaaaaacctagaactttatgctgctgcaattgacttgggacaaataacacctcaatttgagcttcaatacttaaatacacactttgatatcgtaaatcctaaaacaaaacaatttttatatacacaaaattcaaatgaagtatccaaaaaaatagctgatgatataagttatgatgctactataaatagttttaaagcatattatgaatttaagtacaatgatgctgttgcaaaaaaagcacttgaacaagatattttagcaccacatactatagggaatgctcctgtttataattttgtagataaaaattttaccaatcctcaaaacctaaatgaaattcataaagttattatttttggagttttacttggaattcatattccactgatacattcaaaaataaattccaaagtttattttatagttgaacccaatttagaatttttttaa

SEQ ID NO: 10202 - protein, 178 aa, Unknown
  Obtained from environmental sample
  misc_feature (1)..(178): Xaa is any amino acid
MSLDQVQQKALQTYEKNLEYFKQNHPDIYKNLELYAAAIDLGQITPQFELQYLNTHFDIVNPKTKQFLYTQNSNEVSKKIADDISYDATINSFKAYYEFKYNDAVAKKALEQDILAPHTIGNAPVYNFVDKNFTNPQNLNEIHKVIIFGVLLGIHIPLIHSKINSKVYFIVEPNLEFF

SEQ ID NO: 10203 - DNA, 567 bp, Unknown
  Obtained from environmental sample
  misc_feature (1)..(567): n is a, c, g, or t
ttgcaagctattctaatcaactattcatcacataatctccatcatattttctatctttttgatttggcaacagataatgataaaaagaaatatatctatgaagtaaataaaaacttactcacacaactaaataaaatagttgacacatatgtaatttcaatctcatactcaagtgatgagaatagccttacattaaaaaaattaaataaatatctaaaagaatattcaataaaaaagagtatctattccgaaccattttttaaagagttggtagagacatcaaaaagaggttaccaatatgaatttgaaacaaactcaattggtttttttgttattgaagataacctttcaaataaagattttataaattacataaaagaaatcctgaaaagattccctgatgtacgattaaaacttttttacttttttgattttcaaaaaactcaagcacaatttgtatttaaacaagagttaagtagagttgaattattaattccacacaacattgatgatataactaacagtgtagaactatggcttgagacatatgacaatacaataaattaa

SEQ ID NO: 10204 - protein, 188 aa, Unknown
  Obtained from environmental sample
  misc_feature (1)..(188): Xaa is any amino acid
MQAILINYSSHNLHHIFYLFDLATDNDKKKYIYEVNKNLLTQLNKIVDTYVISISYSSDENSLTLKKLNKYLKEYSIKKSIYSEPFFKELVETSKRGYQYEFETNSIGFFVIEDNLSNKDFINYIKEILKRFPDVRLKLFYFFDFQKTQAQFVFKQELSRVELLIPHNIDDITNSVELWLETYDNTIN

SEQ ID NO: 10205 - DNA, 588 bp, Unknown
  Obtained from environmental sample
  misc_feature (1)..(588): n is a, c, g, or t
ttgtggagggaagtaggcataaataaacgacctgtcggggacacatttccctttacggtgggggccgaagatgcaaaccccttgctcgcactgattggccaatttgcagatatgtcgtttatggatgaaattaaaagcgaggtaatccgggtgagtcaaattctgaaaaatcaggagggtatcagtaatgtggaatttaccgaaaaccaaagaatgggtaacatggagctgtccttcgacttcgaaaatgataaaaagctaaataatgccttgtatgcttctgcaggctacgataaaacaatttttcaacccaagctttataaaattaagaaacacaaatttgtacgtaaaaacaccaccgcctggattatcaaactcatggagcaggaaaaggaaaacataccggatgaagtggttttcgatttggtaaaaatgaaatctgtggttcatttcccacaagaagcgcgaagtattcgtggcccaaaaaacatgcgatcgtccaataacagccaaacctttagcagctcaaatttcctttccttcctcatcgaaaacaaaacgaatacccgaattaaaatcaagtattga

SEQ ID NO: 10206 - protein, 195 aa, Unknown
  Obtained from environmental sample
  misc_feature (1)..(195): Xaa is any amino acid
MWREVGINKRPVGDTFPFTVGAEDANPLLALIGQFADMSFMDEIKSEVIRVSQILKNQEGISNVEFTENQRMGNMELSFDFENDKKLNNALYASAGYDKTIFQPKLYKIKKHKFVRKNTTAWIIKLMEQEKENIPDEVVFDLVKMKSVVHFPQEARSIRGPKNMRSSNNSQTFSSSNFLSFLIENKTNTRIKIKY

SEQ ID NO: 10207 - DNA, 315 bp, Unknown
  Obtained from environmental sample
  misc_feature (1)..(315): n is a, c, g, or t
atgaatattagaaaaaatgaaagtcagttggtatgtattgccaaatttatggctgtacctggcgaagttgatcagttaattaagagcctacatgctttgattcctatgaccatgcaagaaggtggtaatattcgatacgaattgaatcagtgtattgatgatgagaatagaattacttttattgagaaatggtttgatcaaaagacttttgatgcacattgtggtacgccatatattactgaattctttaatgaggggaaacctcttcatgttaaggaatttgaagtaactcttcataaggagttattgccataa

SEQ ID NO: 10208 - protein, 104 aa, Unknown
  Obtained from environmental sample
  DOMAIN (18)...(81): Antibiotic biosynthesis monooxygenase
  misc_feature (1)..(104): Xaa is any amino acid
MNIRKNESQLVCIAKFMAVPGEVDQLIKSLHALIPMTMQEGGNIRYELNQCIDDENRITFIEKWFDQKTFDAHCGTPYITEFFNEGKPLHVKEFEVTLHKELLP

SEQ ID NO: 10209 - DNA, 768 bp, Unknown
  Obtained from environmental sample
  misc_feature (1)..(768): n is a, c, g, or t
atgctacaggaaaagaaacaagtacaaatgaacttgaatatattgccaaagagctcaaaaaatttattgaaagtctttaaaatgagcaaaaatattttttatacaaagtttagtgaacttgaaaataggttagacccacagttctataaaactgaatatgaagatatactgaataaaataaaaaaagtgaatttcaaaaagctttcacaatgtgtacttttttcttcagaagtttggaatcaaaaagatttttttaatcaaacttttccatatatagaaattagtgagatagatttaatttctgggaaaattcataatgttaaacaaattaatattttagaagctccaagtagagcaaaaatgatagtacgaaatcaagatattttaatttcaaccacaagaccaaacagaggtgcaatttcattaattgattcggataatattcttatcgcttcaactggttttgctgtcattagaaattgttctgagcaaatatctaaaaaatatctttttatcgttcttaaaatggattttattttaaaacaatttgaacaaagaagtagcggaggaaattatccagctattacattagaagaattatcgaatataattattcctattccatcaagagatgttcaaaatccaattattttaaagatggaacaagcctaccaactaaaagaacaaaaagaaaaagaagcctcaaataaatttagatttgcattgataagtatccttttaaaagaactggaaatacagccattttag

SEQ ID NO: 10210 - protein, 255 aa, Unknown
  Obtained from environmental sample
  DOMAIN (63)...(225): Type I restriction modification DNA specificity domain
  misc_feature (1)..(255): Xaa is any amino acid
MLQEKKQVQMNLNILPKSSKNLLKVFKMSKNIFYTKFSELENRLDPQFYKTEYEDILNKIKKVNFKKLSQCVLFSSEVWNQKDFFNQTFPYIEISEIDLISGKIHNVKQINILEAPSRAKMIVRNQDILISTTRPNRGAISLIDSDNILIASTGFAVIRNCSEQISKKYLFIVLKMDFILKQFEQRSSGGNYPAITLEELSNIIIPIPSRDVQNPIILKMEQAYQLKEQKEKEASNKFRFALISILLKELEIQPF

SEQ ID NO: 10211 - DNA, 843 bp, Unknown
  Obtained from environmental sample
  misc_feature (1)..(843): n is a, c, g, or t
atgataaaacttcaaggactactcggacaaactttcggtggatatattacgataagaggaacttcaaaattttctgatatagtgaatcattctgaggcaaaagcgtatcaaagagagaccatacaaaaacatcttcaagagattagtgattattatgaagagcgagaaaatctattttttccagaagttattttatctcttgagttgaaatatgattttgatactcctgatgcaaaaagtggtgtaaatcctatccaagatatagttggtggaaaatggtttaaatcaaatgtagatgcagtaaatattcaaccgttagctaaaagacatgaaaatgatttgttaaaagttgtaaatattcatttaaattctaatgataaagtgtttggaaggatagatggaaatcacagattaaccgctacaaataccggaaatatttataatgcagagatacctttttgtgtagtgttgtttgatagtgaaaatatacaaaaacaagaaaaaatgcttttttttaatataaattcaaaggcaattcctcttactacagaagaatctttaaagtcaatttttgaagatgaaataaatttttcaaatgaacttttaaaaaataatagctcttttggttgggagtattattttgcaaaacagattaaaaaagaagagcttaatagttattttcctaatcttcataacttatttaacaataattttttaactacatttttaaaattatttaaacttcttatcgttaaagatattattcaacaaaatgataatgagattagtaaaattcgtagtgcattaactgaaataaatacaaatatctcgagccgattctga

SEQ ID NO: 10212 - protein, 280 aa, Unknown
  Obtained from environmental sample
  misc_feature (1)..(280): Xaa is any amino acid
MIKLQGLLGQTFGGYITIRGTSKFSDIVNHSEAKAYQRETIQKHLQEISDYYEERENLFFPEVILSLELKYDFDTPDAKSGVNPIQDIVGGKWFKSNVDAVNIQPLAKRHENDLLKVVNIHLNSNDKVFGRIDGNHRLTATNTGNIYNAEIPFCVVLFDSENIQKQEKMLFFNINSKAIPLTTEESLKSIFEDEINFSNELLKNNSSFGWEYYFAKQIKKEELNSYFPNLHNLFNNNFLTTFLKLFKLLIVKDIIQQNDNEISKIRSALTEINTNISSRF

SEQ ID NO: 10213 - DNA, 495 bp, Unknown
  Obtained from environmental sample
  misc_feature (1)..(495): n is a, c, g, or t
ttgccaaattctgcaatagatttattagatggagtaataaataatactcataagatacacaattatataaacaaagatttttacaataaattactggaaattaaatcaatagtggatcatatacaaaatagacttatatctattgcttttgaaacgcataaaaaacttggagaagcaagaaaaaaagatggtttctatttgactataaatgaatcaataataaagtatggagaattagcaaaatcaggggcatcattggatgtttttgttagcaaaatggtaacaccactacttaagattgtttttgatcagtatagtaataatctatatgctgacgagataggaatgctttgcaaaaaagctcgtacaaaattgtgtgattttcacaagggagtgactgattcgttgaatgacttcaaaaaagtgaaaggaaaagtaaaagtatcaatagacattttaaagataattattgaaaagataaaaatcgtactctaa

SEQ ID NO: 10214 - protein, 164 aa, Unknown
  Obtained from environmental sample
  misc_feature (1)..(164): Xaa is any amino acid
MPNSAIDLLDGVINNTHKIHNYINKDFYNKLLEIKSIVDHIQNRLISIAFETHKKLGEARKKDGFYLTINESIIKYGELAKSGASLDVFVSKMVTPLLKIVFDQYSNNLYADEIGMLCKKARTKLCDFHKGVTDSLNDFKKVKGKVKVSIDILKIIIEKIKIVL

SEQ ID NO: 10215 - DNA, 300 bp, Unknown
  Obtained from environmental sample
  misc_feature (1)..(300): n is a, c, g, or t
ttgcagccatttttctggatatccaagcaatgggacagctatgatatttgctaccaaaacccactaataaaatcgatagagagcaggtatatagggcttgatactgatgatcctaaaacttttctgatcccgatctctttggtccttcgttctgccaaaaatgaggataatcggacaatccctaaacaggaaattagaatagccaatgcggcaaaggagttgaagagagtggcaaatttcttctcatcaatatacatcctgttgtatctctcatccaaaaaagatagggaaatagggtag

SEQ ID NO: 10216 - protein, 99 aa, Unknown
  Obtained from environmental sample
  misc_feature (1)..(99): Xaa is any amino acid
MQPFFWISKQWDSYDICYQNPLIKSIESRYIGLDTDDPKTFLIPISLVLRSAKNEDNRTIPKQEIRIANAAKELKRVANFFSSIYILLYLSSKKDREIG

SEQ ID NO: 10217 - DNA, 669 bp, Unknown
  Obtained from environmental sample
  misc_feature (1)..(669): n is a, c, g, or t
atgaaaaaaatatcaattttaataattttcatattaagtacacttacactaagtgcaacaaacttaagaatagaaccaaatgaactatcaaaagatatcacaagttataaaatattagatgtaagagatagtgaagcttttcaagaaggtcatattaaaaatgctttaaactttcctattagtctaacttatgaacataaatctgtaaatggaaaaattacacaaccagctaagatgcaaagtatattaagagatttaggacttaatgttcatgataaagttgtagtgtatgacgatggtacattttttgatgctgctaggcttttttggacacttgaagtgtatggatttacgaatgtaaaacttttaaatgcaggtttccaagagtgggaagtagataatcttcctgtatctacaactacattaacacctgtaaaaagtgactatatagctaccataaataataaaagacttgctacaaaatttataacacagatagcgacaaaaagtcctactcaagtgattattgatgcaagaggaattaatgcttatgtggggaaagtatcatctgccaaacgatatgggcatattccaaaagctattaacatccctggcaaccacaatataaatgggaagtatacagtccttaaagtaaaaaccacccaatga

SEQ ID NO: 10218 - protein, 222 aa, Unknown
  Obtained from environmental sample
  SIGNAL (1)...(18)
  DOMAIN (25)...(133): Rhodanese-like domain
  misc_feature (1)..(222): Xaa is any amino acid
MKKISILIIFILSTLTLSATNLRIEPNELSKDITSYKILDVRDSEAFQEGHIKNALNFPISLTYEHKSVNGKITQPAKMQSILRDLGLNVHDKVVVYDDGTFFDAARLFWTLEVYGFTNVKLLNAGFQEWEVDNLPVSTTTLTPVKSDYIATINNKRLATKFITQIATKSPTQVIIDARGINAYVGKVSSAKRYGHIPKAINIPGNHNINGKYTVLKVKTTQ

SEQ ID NO: 10219 - DNA, 639 bp, Unknown
  Obtained from environmental sample
  misc_feature (1)..(639): n is a, c, g, or t
atgattgtaagtgattatcaaaatatattgcctaggaatggtatttttggaagagttgatggtgatggttttatggtattacttaaaaataatactttagaagatggtaagaagtttttagaggaaagtttagagaggcttagtgattttagattttcccataataatgaaacatatagtatctcagcatctatttcgttaatatattttaaaccatttcaatacactttaaaagagctactaaaagcgagtaatagtgcgctttatagtgcaaaaagtaaaggtagaaacaagtcacatatctatgatattgatgataatatcactcaaagatttaatactgagatacaaacagcaaaatttataaaagaagcactaggggaggggccttctcgatttgaacttttcgcacaagatatagtaccattgcaacatgaaacagacaaagtaggttatgagatacttatacggatgtgggatagagatggaaactttatctctcctgatgattttttaccagcagcttcaagatatcaacttatggcagagatagatgtttttgtactttggacatatttagaaagtgtcacaaaagataaaaatcatatagaaaaacttcattcagcccacaaaatctag

SEQ ID NO: 10220 - protein, 212 aa, Unknown
  Obtained from environmental sample
  DOMAIN (1)...(98): GGDEF domain
  misc_feature (1)..(212): Xaa is any amino acid
MIVSDYQNILPRNGIFGRVDGDGFMVLLKNNTLEDGKKFLEESLERLSDFRFSHNNETYSISASISLIYFKPFQYTLKELLKASNSALYSAKSKGRNKSHIYDIDDNITQRFNTEIQTAKFIKEALGEGPSRFELFAQDIVPLQHETDKVGYEILIRMWDRDGNFISPDDFLPAASRYQLMAEIDVFVLWTYLESVTKDKNHIEKLHSAHKI

SEQ ID NO: 10221 - DNA, 321 bp, Unknown
  Obtained from environmental sample
  misc_feature (1)..(321): n is a, c, g, or t
atgaaatcggagaagattgggggtgcaaatcgccaaacgatcccggatttacggattttggcagaaaagatttttaatttaccatcaaaaacacatctttcaaggaaatatttaaagagtgtaaattttaatttttccaaaatgaagacctataaatatgaaatggaaatcgtgattgacgaaaagatacttttaaaaaagtatccgaattttcattttaaccacaaagatacgaaacagtttgcggattcgacggctttcgcaaaagcagaaaatgagcttcaaaaatttggattttctgttcagataaagcaaaagtag

SEQ ID NO: 10222 - protein, 106 aa, Unknown
  Obtained from environmental sample
  misc_feature (1)..(106): Xaa is any amino acid
MKSEKIGGANRQTIPDLRILAEKIFNLPSKTHLSRKYLKSVNFNFSKMKTYKYEMEIVIDEKILLKKYPNFHFNHKDTKQFADSTAFAKAENELQKFGFSVQIKQK

SEQ ID NO: 10223 - DNA, 639 bp, Unknown
  Obtained from environmental sample
  misc_feature (1)..(639): n is a, c, g, or t
atgcaaagcaatgctgtaaaagaaactaactttaattttaaaggtcaaaaaagtttttataaaggaaaagttagagatgtatataacattaatgatgaactattgataatggtagtttccgatagaatttcagcgtttgatgtggtacttcctaaagccattccttttaaaggtcaggtattgaatcaaatagccgctaaatttttaaaagctacagcagatattttaccgaattgggtggtagcaacaccagatcctaatgttactataggtagaatttgtgagccttttagagtagaaatggtaattagaggttatttatccggacatgcttggcgtgagtataaagctggtaaaagaattttgtgtggcgttgagatgcctgatggaatgaaagaaaatgataaatttccgcagccaattattacaccatctaccaaagcttacgaaggacatgatgaagatatttctcgtgaagaaattattaagcaaggtatcgtttctgaagcagattatatacaattagaagattatactcgtaagatttttcaacgaggaacagaaatggctgctaacatggggttgattttggttgataccaaatatgagttggaaaaattgatgacaccatctatttaa

SEQ ID NO: 10224 - protein, 212 aa, Unknown
  Obtained from environmental sample
  DOMAIN (15)...(212): SAICAR synthetase
  misc_feature (1)..(212): Xaa is any amino acid
MQSNAVKETNFNFKGQKSFYKGKVRDVYNINDELLIMVVSDRISAFDVVLPKAIPFKGQVLNQIAAKFLKATADILPNWVVATPDPNVTIGRICEPFRVEMVIRGYLSGHAWREYKAGKRILCGVEMPDGMKENDKFPQPIITPSTKAYEGHDEDISREEIIKQGIVSEADYIQLEDYTRKIFQRGTEMAANMGLILVDTKYELEKLMTPSI

SEQ ID NO: 10225 - DNA, 480 bp, Unknown
  Obtained from environmental sample
  misc_feature (1)..(480): n is a, c, g, or t
ttgtatttttctcgcaaaggaaaaaacggaaaatggaaaacaataataaatacagacttgtcttcaaattttaataaaacaatagaaatatatcagttgcgttggagtatagaagtgttttttaaagaagcaaaacaattattaaatttgggaaaaagtgagagtcaagactttgatgcacaaattgcagatgcaacaataacaatgacacaatatatatttctatcaattcgtaacaaaattgaaaaatacgaaagtatagggaaactatacgaaaacacaaaagctgaaacgcttgaaatacaattacacgagaggttaattttattactaattgcagttcttgaaataatagaagaattatttgaagatgctgatgctgataaattatttattagaatgataaatgatgaaactgtttttgatagaataaaattgctattaccacctctgcaaaatgacattaatcaagcagcgtaa

SEQ ID NO: 10226 - protein, 159 aa, Unknown
  Obtained from environmental sample
  misc_feature (1)..(159): Xaa is any amino acid
MYFSRKGKNGKWKTIINTDLSSNFNKTIEIYQLRWSIEVFFKEAKQLLNLGKSESQDFDAQIADATITMTQYIFLSIRNKIEKYESIGKLYENTKAETLEIQLHERLILLLIAVLEIIEELFEDADADKLFIRMINDETVFDRIKLLLPPLQNDINQAA

SEQ ID NO: 10227 - DNA, 654 bp, Unknown
  Obtained from environmental sample
  misc_feature (1)..(654): n is a, c, g, or t
ttggataaaaataatttagaaaaatatgtgaaaattgacaacaatataattcagaataaacacattacaattcaagcactttcagatattattagagtaaatttgcttaatcaacatggcggaatttgggtagatgccacatgctactgcatgaaaccaattaattcatggcttaacaaatacatgaaaaatggtttttttgcattctctaatccgagtagagatcgtttaatttctagctggttcatggcctctgagcctaacaatataattaccagagaattcgcaaaaatcgtaaataattactggttagagaatcctaaaatgttcaaaataaataatttaaatttaattaaacgttttattctgaaaatttacttagtttttactggacatatgaataactctattgacacaagttattggttctctaattttacaagtaaaatattaaagatatatccttacttttggtttcattatctattttataaattatatacaaaatacagtgaatgtaaattactttgggacaaacacataaattttcagcagacatacctcacaaaatgcaatttttccggtctaaataatacaattacctctaaaccttcaaaaggacctggatgcttggtgaagacccttttattataa

SEQ ID NO: 10228 - protein, 217 aa, Unknown
  Obtained from environmental sample
  misc_feature (1)..(217): Xaa is any amino acid
MDKNNLEKYVKIDNNIIQNKHITIQALSDIIRVNLLNQHGGIWVDATCYCMKPINSWLNKYMKNGFFAFSNPSRDRLISSWFMASEPNNIITREFAKIVNNYWLENPKMFKINNLNLIKRFILKIYLVFTGHMNNSIDTSYWFSNFTSKILKIYPYFWFHYLFYKLYTKYSECKLLWDKHINFQQTYLTKCNFSGLNNTITSKPSKGPGCLVKTLLL

SEQ ID NO: 10229 - DNA, 606 bp, Unknown
  Obtained from environmental sample
  misc_feature (1)..(606): n is a, c, g, or t
atgaagttattaaatattttaaaaaaaataatctataaaaactattttatacttagattaaaagccagggttaataatataaataaccaaaaactatttttacaattttcaggtgtttcgggtttttatttaccttataaatctaggtttgatattgattggaggcaacttgtaatggtatctagaggtttaagtaattggttactagaaaaatacaccacttctcaaattcagttggaaaaatctgatatagtaattgattgtggtgcatttgtaggaggtttctctatagccgcagctaaatttggtattaaaaaaatttatagcatagaaccatctcttaaaaattttgattgtcttaaatcaaatattaaacattataattttgaagatattataacgccaataaatattggtttagacgttaatccaggaaggaaaaaattaaacttatcaaaatctggatgcgatgatagctttttagaacctgatgaaggtgatttaaaatcatcagaaattgttgaagtaacaacattaaaaaaattgatagatgactatcaaattaatcttaacaacctttatttaaaagtagaagcagaaggttag

SEQ ID NO: 10230 - protein, 201 aa, Unknown
  Obtained from environmental sample
  misc_feature (1)..(201): Xaa is any amino acid
MKLLNILKKIIYKNYFILRLKARVNNINNQKLFLQFSGVSGFYLPYKSRFDIDWRQLVMVSRGLSNWLLEKYTTSQIQLEKSDIVIDCGAFVGGFSIAAAKFGIKKIYSIEPSLKNFDCLKSNIKHYNFEDIITPINIGLDVNPGRKKLNLSKSGCDDSFLEPDEGDLKSSEIVEVTTLKKLIDDYQINLNNLYLKVEAEG

SEQ ID NO: 10231 - DNA, 594 bp, Unknown
  Obtained from environmental sample
  misc_feature (1)..(594): n is a, c, g, or t
ttgaaagagttggcacctattggcttaacagtatatggaagattggagcatactaaaaaagctgtagaagcattacagaaaaatactttagctaaggaaagtaaattatatattttttcagacgggccaaaatatggtgatgaagaaaaagtaaaagctatgagagagtatcttaaaactatagatggttttaaggaaattgagattatagaaagactagataataatagaattaagaacaatagaggtggacaaaaataccttttagaaaaatatgataagatgatatggatggctgaagatatagttacagcatcaggttatttgcaatttatgaatgatgggttagaaatatataaagacaaaaatgagattttaagcataacaggatatggactaccaattattattcataatattgaatatgattcttatgttttgcaaagatttaatgcttggggtattggcatatggaaaaaaaaatatgatcaagtcaaatatataagcttggaagaatacattgagtttataaatgataatcagcaagtaaaagaatttgtaaaaagtggtgctgacatgcttaacatgctttga

SEQ ID NO: 10232 - protein, 197 aa, Unknown
  Obtained from environmental sample
  misc_feature (1)..(197): Xaa is any amino acid
MKELAPIGLTVYGRLEHTKKAVEALQKNTLAKESKLYIFSDGPKYGDEEKVKAMREYLKTIDGFKEIEIIERLDNNRIKNNRGGQKYLLEKYDKMIWMAEDIVTASGYLQFMNDGLEIYKDKNEILSITGYGLPIIIHNIEYDSYVLQRFNAWGIGIWKKKYDQVKYISLEEYIEFINDNQQVKEFVKSGADMLNML

SEQ ID NO: 10233 - DNA, 606 bp, Unknown
  Obtained from environmental sample
  misc_feature (1)..(606): n is a, c, g, or t
ttgatgttttggacattagagcgatgtattggtcaatttaaaaataatatgtatactgtttatccattaaaatcaatggtccaaaatataggtcatgatggtagtggtgtgcattgtggagtaactgataagtttaatcataaagagttatgggataaaactgataattttgtatttagtgaggatataaagctaaaccaacatatcgtaaaagaaaattttgattttagatttagtatgaataaatatacaaaagagttaatcattaatgatttagtaagtaagatagagagtcttgatgcagatagcttttccatatatggtatcggcgagttgacaaacctactgatagcaagattattcgtgatcggtagtaataaaaagataacatattttattgattcagatgcagataaaaagcaaatatttgtttatgaaaaacaggctgttactcctaagcaagctattgaaaatggtgaacatagttttgttatactatcttggaatcatagggagttactgaaaaatagtttattaaatcttgtagataatatttcagcaataaatgtgttagtaccagagattttaaagttggagaatatatga

SEQ ID NO: 10234 - protein, 201 aa, Unknown
  Obtained from environmental sample
  misc_feature (1)..(201): Xaa is any amino acid
MMFWTLERCIGQFKNNMYTVYPLKSMVQNIGHDGSGVHCGVTDKFNHKELWDKTDNFVFSEDIKLNQHIVKENFDFRFSMNKYTKELIINDLVSKIESLDADSFSIYGIGELTNLLIARLFVIGSNKKITYFIDSDADKKQIFVYEKQAVTPKQAIENGEHSFVILSWNHRELLKNSLLNLVDNISAINVLVPEILKLENI

SEQ ID NO: 10235 - DNA, 405 bp, Unknown
  Obtained from environmental sample
  misc_feature (1)..(405): n is a, c, g, or t
atgaaaacagtaaccctacgagataatcaaactaaaaaagagatagatttaaatatctatgattcaacattaggaagtggtgttattgacatatctcctttaaataaagagtttggactttggacttatgacaatggttttggtatgaccgcaggatgtacctctgacataacttatattgatggtgcaaaaggggaacttcttcatcgagggtatcctatagagtacttagcaaaaaaccatagttatttagaagtttgttatttattacttgagggagaacttccaacaaaagaggagtttatagcatatgagcaagatatgcgaataaaaagatatccaaatgagggtatcaagaagatatttgaagcatttcctgataatgcacatccgatgtctgtgtaa

SEQ ID NO: 10236 - protein, 134 aa, Unknown
  Obtained from environmental sample
  misc_feature (1)..(134): Xaa is any amino acid
MKTVTLRDNQTKKEIDLNIYDSTLGSGVIDISPLNKEFGLWTYDNGFGMTAGCTSDITYIDGAKGELLHRGYPIEYLAKNHSYLEVCYLLLEGELPTKEEFIAYEQDMRIKRYPNEGIKKIFEAFPDNAHPMSV

SEQ ID NO: 10237 - DNA, 546 bp, Unknown
  Obtained from environmental sample
  misc_feature (1)..(546): n is a, c, g, or t
atgggtattacaacgcaagagataaataataaaatatatattattcgtggtgttcaagttatgctagatagtgatttagcaaaactttacaatatagaaacaaaaacttttaatcagtcaataagaagaaatataaaaagatttccagaagattttagatttcagcttaatgatgatgaaaaaaatgaactggtaacaaattgttaccagttgcaaaacttaaaacactcatatataaatccacatgtttttactgagcaaggtgtatcaatgttaagtgctattttaaaaagtgatatagcaataaacagaagtgtacaaataatgagagctttcgtaaatatgaagcaatttatatcatcaaataatgatctttttaaaaagatagatactattgaaaaaagacaaataggatacgagataaaatcagatgaaaagtttgataaacttttcaatgctcttgaagataaatcacttaaatcaactcaaggtatatttttcgatggtcaaatttttgatgcatataattttgtatctgattgttaa

SEQ ID NO: 10238 - protein, 181 aa, Unknown
  Obtained from environmental sample
  misc_feature (1)..(181): Xaa is any amino acid
MGITTQEINNKIYIIRGVQVMLDSDLAKLYNIETKTFNQSIRRNIKRFPEDFRFQLNDDEKNELVTNCYQLQNLKHSYINPHVFTEQGVSMLSAILKSDIAINRSVQIMRAFVNMKQFISSNNDLFKKIDTIEKRQIGYEIKSDEKFDKLFNALEDKSLKSTQGIFFDGQIFDAYNFVSDC

SEQ ID NO: 10239 - DNA, 702 bp, Unknown
  Obtained from environmental sample
  misc_feature (1)..(702): n is a, c, g, or t
ttgaatatcttaagagggcttttagccctcataatcacactgacaattacgacttcactaaatgcacagtacttatatcaagatgaagtgataaaaaatccagattttacaaatgagataaataaactaggaactgaactgtttgaaaagacaggaatacatttatatttaatcacaaaaagaacactggaaaataaccaaagtatctctaattatgaaaaagagatattagatgagctaaaagaaccagctattttactgacttttatcgagttagatacaaaagtagatgttatagctagacctacatctttatatgaagattttgataaacgtcaagttttaagtccatatatatctttagcatcgaaaataatgacagcagttctttttgctagaagttttgatgatgtaaaagagattcttagtacgccaaatggtgtaatgttaccgattttgggtgaacgtgctaaaggaaaagatattgtttcaaaatatgctgttgctacatatcaaggttatagtgatatagctgagcagatagcagaaaaacgtggtgtcgtgctagataatgcaccaggccatacaaattcaactatgattacacttttgaagtaccttttttatgcaatgattgtttatggtctttatagatatgctatgatcattataagaaaaaagggagaaaaaaaagatgattaa

SEQ ID NO: 10240 - protein, 233 aa, Unknown
  Obtained from environmental sample
  misc_feature (1)..(233): Xaa is any amino acid
MNILRGLLALIITLTITTSLNAQYLYQDEVIKNPDFTNEINKLGTELFEKTGIHLYLITKRTLENNQSISNYEKEILDELKEPAILLTFIELDTKVDVIARPTSLYEDFDKRQVLSPYISLASKIMTAVLFARSFDDVKEILSTPNGVMLPILGERAKGKDIVSKYAVATYQGYSDIAEQIAEKRGVVLDNAPGHTNSTMITLLKYLFYAMIVYGLYRYAMIIIRKKGEKKDD

SEQ ID NO: 10241 - DNA, 405 bp, Unknown
  Obtained from environmental sample
  misc_feature (1)..(405): n is a, c, g, or t
atgaaggagatgttcaaaacgagcaagggcaaatacatttccccagcgcccattgagaaccgcctgatggcacatcagtcaatcgagatggtgtgtgtgtccggggctaatcagactcagcccttcgccatcatccagctggctgagggactacggccgaaagtcggtgatggaggcttccgaaaggaacttgaaacgagtttcgccgaactggtaaccagtgtgaacaaaacggtagatcctcacgagcaattggcttttgttattatcgtcagtgatgaatggacgatcgagaacagctttctgaccccaacgcttaagctcaagcgaaacgttgtggaagacgcctacgaagataaggttaacgagtggtatgcgaagcgccagaaggttctctggcagtaa

SEQ ID NO: 10242 - protein, 134 aa, Unknown
  Obtained from environmental sample
  misc_feature (1)..(134): Xaa is any amino acid
MKEMFKTSKGKYISPAPIENRLMAHQSIEMVCVSGANQTQPFAIIQLAEGLRPKVGDGGFRKELETSFAELVTSVNKTVDPHEQLAFVIIVSDEWTIENSFLTPTLKLKRNVVEDAYEDKVNEWYAKRQKVLWQ

SEQ ID NO: 10243 - DNA, 519 bp, Unknown
  Obtained from environmental sample
  misc_feature (1)..(519): n is a, c, g, or t
atgggaacaaaagtaaatagaatttttgcagaacatggtgaatttttaaatgatgttaaaacttttaaaaaagctctaaatagaacagaaatagtaacttctcataaacaaagaaaagaaattgctaaaattcaagatccaatgataattattacaactgcaggtatgcttgaaggcggacctataatgttttatttaaaagaatttggaagcaatatagataataaattaatacttacaggttatcaagtagaaggaactaacggagatagacttttacaaactggaaaactatatattgataaagaattatttaaagtaaattgtgaagtaagacatataagtatttcaggacatttagatcaaaaaaatcttttaaatattgtaaatattgtaaaacctcaaaaagttatttgtatacatggggatccaaaaacaatagaagtatttgaaaatgaattaagaaaaaagaaaatagaatatatttctccaaaagttggagatgtatacgaaatttaa

SEQ ID NO: 10244 - protein, 172 aa, Unknown
  Obtained from environmental sample
  DOMAIN (103)...(145): RNA-metabolising metallo-beta-lactamase
  misc_feature (1)..(172): Xaa is any amino acid
MGTKVNRIFAEHGEFLNDVKTFKKALNRTEIVTSHKQRKEIAKIQDPMIIITTAGMLEGGPIMFYLKEFGSNIDNKLILTGYQVEGTNGDRLLQTGKLYIDKELFKVNCEVRHISISGHLDQKNLLNIVNIVKPQKVICIHGDPKTIEVFENELRKKKIEYISPKVGDVYEI

SEQ ID NO: 10245 - DNA, 522 bp, Unknown
  Obtained from environmental sample
  misc_feature (1)..(522): n is a, c, g, or t
atgatacgcaaaaaccatagtgcagacaaaatcactttacgcgttgatgcaaatggcgccttttctcctttggatgcgctggaaaagttaaaagaacttgctaaatacgacatccattcgatagaacaacccataaaacaaggtcagtgggatgaaatgagtgaattatgccaaaaaacacctttgccaattgctttagatgaggaactgattggacattacggtttaaaagagaaacaagcggtattagacaaaataaaaccccaatatatcattctaaaaccaagtttaatcggtggtttcaaaggaacacaagaatggattgacctcgctgaatcaatgaatactccctggtggattaccagcgctttagaatcaaatattgggttggatgccattgctcaatttacgagtcagtttgatattcaacttccacaagggttgggaacgggatcgctttatacgaataatgttttgagtgatttggttgttgagaatggggagattaggaagaagggatga

SEQ ID NO: 10246 - protein, 173 aa, Unknown
  Obtained from environmental sample
  misc_feature (1)..(173): Xaa is any amino acid
MIRKNHSADKITLRVDANGAFSPLDALEKLKELAKYDIHSIEQPIKQGQWDEMSELCQKTPLPIALDEELIGHYGLKEKQAVLDKIKPQYIILKPSLIGGFKGTQEWIDLAESMNTPWWITSALESNIGLDAIAQFTSQFDIQLPQGLGTGSLYTNNVLSDLVVENGEIRKKG

SEQ ID NO: 10247 - DNA, 387 bp, Unknown
  Obtained from environmental sample
  misc_feature (1)..(387): n is a, c, g, or t
ttgaagaatatttataaaattattttactttcactattaattatatcgataattttaggtggaattcttttctctatgaatattttaaaaagtgaagcgattaaaaatcatatagaaattgcgaagtttcactcaaatattttttcagaacaattaacacaaacttttaatagtatcgaacatacagtaagtggattgtcattatttttagaaaatacaaatagtaaggtattggaaaaaaagatggatgatattttagcctcgaatccatacattcgttccttgaatatagtcgatgaaaacattataataataaaaagtttctatagtaaaaacacaggttacaaaatagatattagggattactaccccactccccgtgtttga

SEQ ID NO: 10248 - protein, 128 aa, Unknown
  Obtained from environmental sample
  misc_feature (1)..(128): Xaa is any amino acid
MKNIYKIILLSLLIISIILGGILFSMNILKSEAIKNHIEIAKFHSNIFSEQLTQTFNSIEHTVSGLSLFLENTNSKVLEKKMDDILASNPYIRSLNIVDENIIIIKSFYSKNTGYKIDIRDYYPTPRV

SEQ ID NO: 10249 - DNA, 696 bp, Unknown
  Obtained from environmental sample
  misc_feature (1)..(696): n is a, c, g, or t
atggctgcaatgggggagatgcttgagaatatagcacaccaatggcgacaacctttatctgtaatatcaacagctgcaagtggtattcagatgcaaaaagagtttaatatacttgatgagaaagtgatggacgaatctttacaacttattgtaacaactacagaacatctttcaagtaccatagatgattttagaaacttttttaagcaggataaagaagaggttgagtttttgttagctcacgctattgaaaagtctttaaatattgtaatctcaaaatttagaaacagaagtattgtaattgaaaaagaactgacgggtattacaatattaggttttgaaaatgagttagtacaagtgataatgaatatcttaaataactcaaaagatgttttagaaaaaaaagatattgacgatagagttatcctaataaaaacttttatggaaaatcaaaaagcctatttaactatacaagatagtggaggggggatacctgaagatattattgataaagtatttgaaccatattttacaaccaaacaccaagcacaaggtactggaataggactttatatgtctgctgagattatctccaaacatatgaatggtacagtatccgtagaaaataaaatatttcaatataaagagaaaaaatataaaggagcttgttttataattacatttcctttaagttga

SEQ ID NO: 10250 - protein, 231 aa, Unknown
  Obtained from environmental sample
  DOMAIN (3)...(73): His Kinase A (phosphoacceptor) domain
  misc_feature (1)..(231): Xaa is any amino acid
MAAMGEMLENIAHQWRQPLSVISTAASGIQMQKEFNILDEKVMDESLQLIVTTTEHLSSTIDDFRNFFKQDKEEVEFLLAHAIEKSLNIVISKFRNRSIVIEKELTGITILGFENELVQVIMNILNNSKDVLEKKDIDDRVILIKTFMENQKAYLTIQDSGGGIPEDIIDKVFEPYFTTKHQAQGTGIGLYMSAEIISKHMNGTVSVENKIFQYKEKKYKGACFIITFPLS

SEQ ID NO: 10251 - DNA, 405 bp, Unknown
  Obtained from environmental sample
  misc_feature (1)..(405): n is a, c, g, or t
ttgatggctcngntccagaggagaacagcccgnntatacactttcttaaataataaaaaaattgcattagctcatggagatatctatacaccaactttatataatatctattgtgggattatccgtaatccatattttttaaattttttaaatttaattgatatgaataattggctttcaaaaaaagtagagtataaattacaaaaaaaatatctttgcaaaaaacaaaaaaactttgaacagtttgcaaaaaaaagggtagaaaattatgcagttgatttagttattgagggacattatcatcaaaattttttaattgaacaatatataaatcttccatcatttgcttgtgataaacaatatatacaatatgttgatgacgagtttaaattttttaaggtataa

SEQ ID NO: 10252 - protein, 134 aa, Unknown
  Obtained from environmental sample
  misc_feature (1)..(134): Xaa is any amino acid
MMAXXQRRTARXYTFLNNKKIALAHGDIYTPTLYNIYCGIIRNPYFLNFLNLIDMNNWLSKKVEYKLQKKYLCKKQKNFEQFAKKRVENYAVDLVIEGHYHQNFLIEQYINLPSFACDKQYIQYVDDEFKFFKV

SEQ ID NO: 10253 - DNA, 483 bp, Unknown
  Obtained from environmental sample
  misc_feature (1)..(483): n is a, c, g, or t
atggataattatgaatatacacaacttttaaaaatattaaatcaaaaaatacaaaatattgaatctatattaaagccaaatgagatagaaaaaagacttgaagagattacaactttagagcaagaaccggaattttggaccaatcaagagaatgctacaaaaatagcacaagagaagaatagacttttaagtaaattatcaaaatttgaaaaagcaaatagtgcaataacagatgccaatgaactttatgagatggcagttgaagagaaagatgaagatactataaatacactttttgaagaatcaaatgttttggaagatattgtacaaaaaacagagatagaggttatgcttagtaatccagaagatggaaataatgcaattgtatctatccaccctggtgctggaggtactgagtcttgtgattgggctagtatgttatatcgtatgtatttacgatgggcagagagaaagggattttaa

SEQ ID NO: 10254 - protein, 160 aa, Unknown
  Obtained from environmental sample
  DOMAIN (84)...(160): PCRF domain
  misc_feature (1)..(160): Xaa is any amino acid
MDNYEYTQLLKILNQKIQNIESILKPNEIEKRLEEITTLEQEPEFWTNQENATKIAQEKNRLLSKLSKFEKANSAITDANELYEMAVEEKDEDTINTLFEESNVLEDIVQKTEIEVMLSNPEDGNNAIVSIHPGAGGTESCDWASMLYRMYLRWAERKGF

SEQ ID NO: 10255 - DNA, 786 bp, Unknown
  Obtained from environmental sample
  misc_feature (1)..(786): n is a, c, g, or t
ttggaagaatttgttccaaaaaacagggattggggttttgttttagtaatccggaagatggaaataaaggcaatgtatttattccaccctggtgctggagggtatgagttttgtgattgggctagtatgttatatcgtaagtatttacgatgggcagagagaaagggatttaaagtagaggttttagatcatcaagctggagatgaagctggtataaaagatgtgagttttattatctctggaattaatgcttacgggtatttaaaaactgaaaatggtatccatagacttgtgaggataagtccttttgatagtaatgcaaaaagacacacttcatttgcttcagtgatggtaagtccagagattgatgataatatcgatattgagatagaagataaagatattagagtagatacttacagagctagtggagctgggggtcagcatgttaataaaactgaaagtgctataagaattacacatatagaaacaaatattgttgtacagtgtcaaaatgatagaagccaacataaaaataaagcaagtgctatgaagatgttaaaatctcgtctttatgaactagaattagagaagcaagcagctgaaaaaaaaggtatttcaaaaagtgaaatagggtggggacatcaaattagaagttatgtgatgcaaccataccaacaaataaaggatacaagaagtaatataggttatagtaatgtggatgctatacttgatggtgatttagataaaatgatagaagatgttctaatcgcccaaagtcaataa

SEQ ID NO: 10256 - protein, 261 aa, Unknown
  Obtained from environmental sample
  DOMAIN (2)...(91): PCRF domain
  misc_feature (1)..(261): Xaa is any amino acid
MEEFVPKNRDWGFVLVIRKMEIKAMYLFHPGAGGYEFCDWASMLYRKYLRWAERKGFKVEVLDHQAGDEAGIKDVSFIISGINAYGYLKTENGIHRLVRISPFDSNAKRHTSFASVMVSPEIDDNIDIEIEDKDIRVDTYRASGAGGQHVNKTESAIRITHIETNIVVQCQNDRSQHKNKASAMKMLKSRLYELELEKQAAEKKGISKSEIGWGHQIRSYVMQPYQQIKDTRSNIGYSNVDAILDGDLDKMIEDVLIAQSQ

SEQ ID NO: 10257 - DNA, 720 bp, Unknown
  Obtained from environmental sample
  misc_feature (1)..(720): n is a, c, g, or t
atgtccatattcaaatatattcttccaattctgtttttactgaacgttttacaatgcaaaagccaggtaaccttaagcgaaataaattttaataaggtaacacaaaaaaaggtacgtgaatttttgattggtcagcaaaacaatcatattctgtcgtttacagacatcaaaccatcgttattctcaaattcgaaaatagagggttacaggaatcatgttaaagagtatttttttaaagacagtttggctaaagtttggcaacattatttagttaccaatcccggcgattcatggaacggaaaaaaagtttcttttggaatactattttcaaaaaaagacaaaagaattgtgtatcgcaatgaatcggtttcacatatagataccggccagatagtctatttaaatttgaaattgatgaagggaatagctaacctggcggctgtttttgaatttatcaccatcgacaaaaataagcgaattatagagtttagttatattgacggaaatataactaaaggaaaacaacgtttacaattcatcgaaactccacggggttatacacgaatcctgcatactagttattacaaaagtagctcttcattgcgcgaccggtttttgtatcctttttttcatgataaggtatcaaatgaattccatcgtaacatgaaaaaactataccataaaaatcatttgacccagccggagaacctggaaacatag

SEQ ID NO: 10258 - protein, 239 aa, Unknown
  Obtained from environmental sample
  misc_feature (1)..(239): Xaa is any amino acid
MSIFKYILPILFLLNVLQCKSQVTLSEINFNKVTQKKVREFLIGQQNNHILSFTDIKPSLFSNSKIEGYRNHVKEYFFKDSLAKVWQHYLVTNPGDSWNGKKVSFGILFSKKDKRIVYRNESVSHIDTGQIVYLNLKLMKGIANLAAVFEFITIDKNKRIIEFSYIDGNITKGKQRLQFIETPRGYTRILHTSYYKSSSSLRDRFLYPFFHDKVSNEFHRNMKKLYHKNHLTQPENLET

SEQ ID NO: 10259 - DNA, 651 bp, Unknown
  Obtained from environmental sample
  misc_feature (1)..(651): n is a, c, g, or t
atgtgtgaatcttataacttgcaatataatacaaattttatatcagtaatgccaacaaacctttatgggccaaatgataatttcgatcttgaaaagtcacatgtacttccagctatgataagaaaaattcattgtgcaaaacttttaaatgaaaaaaagtatgatgaagttttaaaagatttgaatgtctctactttagaagatgcaaaagtatatttatcaaagtttggtgtggatgaaaacagagttgagatatggggcagtggaaatccaagaagagaatttttatactctgaagatatggcagatgcatgtatatatctgctggaaaatagaaattttaaagatacttatgagagtgtaaatagctcaaatgatagctgtacaccaaatagtatgcaacataatgagataagaaatacacatataaatataggtacaggaattgatataactataaaagatttagcatatttaattagagagatcataggttttcaaggtgaattatattttaatactgaaaaacctgatggcaccatggttaaacttacagatgtatcaaaacttcatagtttgggttggaagcataaggttgaacttgaaaatggtataaaaattatgtatgaatggtatttgaataaaaagtag

SEQ ID NO: 10260 - protein, 216 aa, Unknown
  Obtained from environmental sample
  misc_feature (1)..(216): Xaa is any amino acid
MCESYNLQYNTNFISVMPTNLYGPNDNFDLEKSHVLPAMIRKIHCAKLLNEKKYDEVLKDLNVSTLEDAKVYLSKFGVDENRVEIWGSGNPRREFLYSEDMADACIYLLENRNFKDTYESVNSSNDSCTPNSMQHNEIRNTHINIGTGIDITIKDLAYLIREIIGFQGELYFNTEKPDGTMVKLTDVSKLHSLGWKHKVELENGIKIMYEWYLNKK

SEQ ID NO: 10261 - DNA, 375 bp, Unknown
  Obtained from environmental sample
  misc_feature (1)..(375): n is a, c, g, or t
gtgaaaataagagtctattacgaagatacagatattggtggagtggtttatcactcgaactatttaaatttttgtgagcgtgctaggagtgaactattttttaaagttggggagtctcctattttagagcatggtcattttgttgcaaaacatattgatgcgaattttattaagagtgcaaaatttgctgatcttcttgatgttgaaacagagttgttagagatgaaaaatgcctcttttaaacttttgcagagtgtatataaagatggtgaaaaaatatttgagatgaagattacactggcatatttagatcataacgggcgattgtcaaaattagatgatgatgttaaagagctcttaaagaagatactctaa

SEQ ID NO: 10262 - protein, 124 aa, Unknown
  Obtained from environmental sample
  DOMAIN (13)...(95): Thioesterase superfamily
  misc_feature (1)..(124): Xaa is any amino acid
MKIRVYYEDTDIGGVVYHSNYLNFCERARSELFFKVGESPILEHGHFVAKHIDANFIKSAKFADLLDVETELLEMKNASFKLLQSVYKDGEKIFEMKITLAYLDHNGRLSKLDDDVKELLKKIL

SEQ ID NO: 10263 - DNA, 993 bp, Unknown
  Obtained from environmental sample
  misc_feature (1)..(993): n is a, c, g, or t
atggctcggagactttatggagatgatttaacaaatatcagatacagtgttaaatatgttaataaattcaaaaaaccaattgatggtcttgaagaggggagagttattcatggatttcgatttgtatttccattgttttcaacgactaatcagtacttaggaagtgttgagacatcagtattctctgaagcttttaaagagcaaattaaaaaaaattttgatgttaatttacgatttttaatcaaaaaagatgttgcattaaaaaaacttttagaagtgccaaaagatacttaccaacaaagtagtgaagatgaaagatatttttatgttttaagcaataatacttctcctattgaaaatctttctattcaaacaaaacaacttatcaaacaaaaaattgataccaaaaaagcttttagtatcgcttgttgcaaccaatctgataaacttgtagttacatttttaccaatcaaagatattgaaacacaaaaaaatattgcttattttgtagcctataaaaaaagtaactatttagaggaaatcaacataacatatctaataaccttaataatttttaccttattaaatcttttcttctcctattttgtttataaaataaccgataaaaaaagatttttagaaaaaaaaattttacaaagtaaaaaagaacttcggcaattaaataaaaaattaaaatctcaaatccaacttgaagttcaaaaaaataaagaaaatgaacaaattattctccatcaaancaaaatggcaactatgggtgagatgatggaaaacattgcacatcaatggaaacaaccactcaactctatttcaattgcnaacagcaatatgattcttgaaagtgaactaggtttactaacaaatgaatcagcactccaagaggctaatcttatcttagatagtagtaattttcctgccaatacaatttcagattttaaagaatattttaaaactgataatccacttgaaaaataa

SEQ ID NO: 10264 - protein, 330 aa, Unknown
  Obtained from environmental sample
  misc_feature (1)..(330): Xaa is any amino acid
MARRLYGDDLTNIRYSVKYVNKFKKPIDGLEEGRVIHGFRFVFPLFSTTNQYLGSVETSVFSEAFKEQIKKNFDVNLRFLIKKDVALKKLLEVPKDTYQQSSEDERYFYVLSNNTSPIENLSIQTKQLIKQKIDTKKAFSIACCNQSDKLVVTFLPIKDIETQKNIAYFVAYKKSNYLEEINITYLITLIIFTLLNLFFSYFVYKITDKKRFLEKKILQSKKELRQLNKKLKSQIQLEVQKNKENEQIILHQXKMATMGEMMENIAHQWKQPLNSISIANSNMILESELGLLTNESALQEANLILDSSNFPANTISDFKEYFKTDNPLEK

SEQ ID NO: 10265 - DNA, 717 bp, Unknown
  Obtained from environmental sample
  misc_feature (1)..(717): n is a, c, g, or t
atggcaactatgggtgagatgatggaaaacattgcacatcaatggaaacaaccactcaactctatntcaattgcaacaagcaatatgattcttgaaagtgaactaggtttactaacaaatgaatcagcactccaagaggctaatcttatcttagatagtagtaaatttcttgcaaatacaattcaagattttaaagaatattttaaaactgataatcaacttgaaaaaataaatcttcaagaatgtatagacaaaactgttaagcttgttttagcaacactgcatcaaaaagggatcgaagtaattattcacactagtgatcaagatatttatctagtcaaaggtttatttacacaagttttacttaaccttataaataatgcaaaagatgctcttattgaaaataaaaattttaacaatcgttatatttttatcaaaacaattattacaaaagataccgttgatatcaaaataaaagacaatgcaggtggaatatcagaagatattatggaacatatctttgagcaatattttacaaccaaagaattagatggtacgggtattggtcttcatatgtcaaggaaaattattcaagaaaatatgaacggtaccatttatgctcaaaatgtagaatttcatgtgaataacatactcaataaaggagctgaattttgtatatcatttcaaataaacaacaaaccaataaaatgtatttaa

SEQ ID NO: 10266 - protein, 238 aa, Unknown
  Obtained from environmental sample
  DOMAIN (112)...(231): Histidine kinase-, DNA gyrase B-, and HSP90-like ATPase
  misc_feature (1)..(238): Xaa is any amino acid
MATMGEMMENIAHQWKQPLNSXSIATSNMILESELGLLTNESALQEANLILDSSKFLANTIQDFKEYFKTDNQLEKINLQECIDKTVKLVLATLHQKGIEVIIHTSDQDIYLVKGLFTQVLLNLINNAKDALIENKNFNNRYIFIKTIITKDTVDIKIKDNAGGISEDIMEHIFEQYFTTKELDGTGIGLHMSRKIIQENMNGTIYAQNVEFHVNNILNKGAEFCISFQINNKPIKCI

SEQ ID NO: 10267 - DNA, 864 bp, Unknown
  Obtained from environmental sample
  misc_feature (1)..(864): n is a, c, g, or t
atggacaatcatcaggaaggcaaagcaataggactttcgtattntaaagaacgtggtttctcaaaagaaataatcgaaaaatttcaattgggttattgccttgaacaacgagatgcttttaccaatgaagcactaaaaaatggatataaattaaagtatttgacagaaacaggtctaagcattgataaaaataattaccggtttgaccggtttgccggcagggtgatgtttccaatacatggtctttcgggaagtactattggttttggtgggcggattttgaaaactgacaaaaaagcggcaaaatacctgaattcccctgaatcagatatttaccataaaagtaacatcctgtatgggatatattttgctaagaagagcattgtaaagcatactaaatgttatatggttgagggttacacggatgtgctttcactgcatcaggccggaattgagaatgtagtggcttcttccggcacatccttaactgaaaaccaaataagccaggtaaaaaggtttactgaaaaccttaccattctatatgatggtgatgatgccgggataaaagcctcttttaggggaattgatatgatactggaacaggggatgaacgtaaaagtagttctttttccggaaggtgaagaccctgattcatttgcccggaaaatgagcaaatcagaactaaaagactttattaatgaaaatgagcaagactttattcgatttaaaacctctctattattaaaagatgcccagaacgatccggtaaaaagagccggtttagtttcaaatattgtagcatctattgccataatccctgatgcgataacccgtagcatgtatatacgctcgagccgattctga

SEQ ID NO: 10268 - protein, 287 aa, Unknown
  Obtained from environmental sample
  DOMAIN (133)...(211): Toprim domain
  misc_feature (1)..(287): Xaa is any amino acid
MDNHQEGKAIGLSYXKERGFSKEIIEKFQLGYCLEQRDAFTNEALKNGYKLKYLTETGLSIDKNNYRFDRFAGRVMFPIHGLSGSTIGFGGRILKTDKKAAKYLNSPESDIYHKSNILYGIYFAKKSIVKHTKCYMVEGYTDVLSLHQAGIENVVASSGTSLTENQISQVKRFTENLTILYDGDDAGIKASFRGIDMILEQGMNVKVVLFPEGEDPDSFARKMSKSELKDFINENEQDFIRFKTSLLLKDAQNDPVKRAGLVSNIVASIAIIPDAITRSMYIRSSRF

SEQ ID NO: 10269 - DNA, 915 bp, Unknown
  Obtained from environmental sample
  misc_feature (1)..(915): n is a, c, g, or t
atggttattgttgattcagacgataattttctctttgctaatccagctgctttagaaatttttggtgcaacaagatcacagatattaggtagaaatttccgtgaatttatacataagaaagattatcttgatcttgaaaaacagaatgatatgagacgcaaagggttatcttctaggtatgaaacagtagtcataagatctgatgggaatgagcggataattaatgtcagtggaagtcccttgtttgaagagggtgttttggtcggttcaattgcagtgtttattgacagaacagaacaaaaacgtacagaaaatttacattcagttctctataatatctctaatgctgttaataaatcaacaacccttgatcagcttttcaagaaaattcataaagatctaagtataataattgatacgaccaacatttacattgcactgtatgaaaaaaagacaaacataatttcagcaccatactatgtcgatactatgaataatatacttcctgaaccgcagcaattaggggatggacttacagcatatataattaactcagggaaaccgctatttttaaatgaagataaacgtgaagagatgataaataagggattgattcccagaagagagtggaaatctaaaatttggttaggtgtaccattgatcctcaatgaagatactatcggtgttttagctattcaaagttacacaaatccagacccattcagtagaaatgatttaggcattcttgaattcgtatctgaacagattgccatagctatcagtaataaaagatctgaaaaagctcttccaaaaagtgaaaaatttaaccgtgctatttatgataattcacccattggaatatctgccaggaaaaaatttggaaaaattgattattgcccatcccgcccgggttga

SEQ ID NO: 10270 - protein, 304 aa, Unknown
  Obtained from environmental sample
  DOMAIN (59)...(100): PAC motif
  misc_feature (1)..(304): Xaa is any amino acid
MVIVDSDDNFLFANPAALEIFGATRSQILGRNFREFIHKKDYLDLEKQNDMRRKGLSSRYETVVIRSDGNERIINVSGSPLFEEGVLVGSIAVFIDRTEQKRTENLHSVLYNISNAVNKSTTLDQLFKKIHKDLSIIIDTTNIYIALYEKKTNIISAPYYVDTMNNILPEPQQLGDGLTAYIINSGKPLFLNEDKREEMINKGLIPRREWKSKIWLGVPLILNEDTIGVLAIQSYTNPDPFSRNDLGILEFVSEQIAIAISNKRSEKALPKSEKFNRAIYDNSPIGISARKKFGKIDYCPSRPG

SEQ ID NO: 10271 - DNA, 573 bp, Unknown
  Obtained from environmental sample
  misc_feature (1)..(573): n is a, c, g, or t
atgcctggtgaatacctattaacttttgaatacttagattctaaaggtaaaacaaaacaaaaagaagctattgcttatgttataggcaaaattgagctgactaacaaccagcttgattttggcaaattaaccaaagaaggcattgcaaaacaagcattaaatgttggttccgaactaaaattaactactctgcctttaattatagatataaacaaagtagatttttactctgaagactttaaaaacagggatgtaagatttagttataaatcaaacatcattattaaaggctctaaatactctgacacaattacattaagcttacctaatagtatattcaaaaaacttcaagatcctattttaagcaatacgtataatggttcaataaatcttcttatctacagtaaagagaatgaggtactatcagaaaaaagcattcccataaaattcactgtaggtagctatttagaatataatcttttactcatagcaggtattatcttgttattatcaagtactattggttcaattatatattttagaaagaaacataaaaataagaaaatgaattga

SEQ ID NO: 10272 - protein, 190 aa, Unknown
  Obtained from environmental sample
  misc_feature (1)..(190): Xaa is any amino acid
MPGEYLLTFEYLDSKGKTKQKEAIAYVIGKIELTNNQLDFGKLTKEGIAKQALNVGSELKLTTLPLIIDINKVDFYSEDFKNRDVRFSYKSNIIIKGSKYSDTITLSLPNSIFKKLQDPILSNTYNGSINLLIYSKENEVLSEKSIPIKFTVGSYLEYNLLLIAGIILLLSSTIGSIIYFRKKHKNKKMN

SEQ ID NO: 10273 - DNA, 717 bp, Unknown
  Obtained from environmental sample
  misc_feature (1)..(717): n is a, c, g, or t
atgtttaagtttattacagatttatttacaaaagagaaagccaataattcagaaaaaaacgctgatatgaagtacttaattgtcggacttggaaatattggaccagaatactttcacacccgtcataatattggtttcagaattttggatgcactagctgaaacagcaaaaatcgaattcaaagatggacgctatggtgcaattgctgaatacaaattcaaaggacgacagtttattctagtgaaacctagcacctatatgaatctcagtggcaaagcagtaaactattggttacagaaagagaatattcctctagagaatatgatgatattagtagatgatttagctctcccatttggaacacttcgtctgcgacctaaaggaagcgatgcaggtcacaatggtttgaagcatatcaacgaaaccttaggtcaccagaactacacaagacttcgttttgggattggtgctgattttagtaaaggaaaacaaattgattacgtactgggaaaatggtctgaagaagaattggaaaagttacctgagctttacaaggtgtgtatcaacatgattaaaggtattagtacaattggcgtacaacgtacaatgacagcctataataccaaaaaggaacctaagaagcctaanagtgaatcaactgaaatagtacttagaatatttataagtttaaagttaatgaactgtgtaatatactaa

SEQ ID NO: 10274 - protein, 238 aa, Unknown
  Obtained from environmental sample
  DOMAIN (26)...(207): Peptidyl-tRNA hydrolase
  misc_feature (1)..(238): Xaa is any amino acid
MFKFITDLFTKEKANNSEKNADMKYLIVGLGNIGPEYFHTRHNIGFRILDALAETAKIEFKDGRYGAIAEYKFKGRQFILVKPSTYMNLSGKAVNYWLQKENIPLENMMILVDDLALPFGTLRLRPKGSDAGHNGLKHINETLGHQNYTRLRFGIGADFSKGKQIDYVLGKWSEEELEKLPELYKVCINMIKGISTIGVQRTMTAYNTKKEPKKPXSESTEIVLRIFISLKLMNCVIY

SEQ ID NO: 10275 - DNA, 633 bp, Unknown
  Obtained from environmental sample
  misc_feature (1)..(633): n is a, c, g, or t
atgaataatatctataaaatttatactttactttttgaacattatggagcgcaaggttggtggccatttttaggagtaggctatcatccaaatgattatagctatccaaaaaatagtgaccaaatatttgaggttgccttggggtcaattttgactcaaaatactacttttgtatctgtaacaaaagctatgaataatctcaaagaacataattgtactacaagtgaaagtataaaaaatatggatatagataaactcaaagagcttataaaaccagcgggatattttaatcaaaaagcaaactatattttagagtttataaagttttatgatagtttagatggaactattccaacacgcgaggagcttttaaaagtaaagggaataggggaagaaactgctgattctatccttttatatggttataatcaagctcaatttaaagtagatgcatatactaaaagattgcttttagagttgaatttgattgatgaaaagactaagtataaagatatgaaaaaactatttgaagatgctttagaaaaagagatacaagataaagaaaaactacgaataatatatcaagagtttcatgctttgattgtggagcatgggaaacataattacntctaa

SEQ ID NO: 10276 - protein, 210 aa, Unknown
  Obtained from environmental sample
  DOMAIN (112)...(140): Helix-hairpin-helix motif
  misc_feature (1)..(210): Xaa is any amino acid
MNNIYKIYTLLFEHYGAQGWWPFLGVGYHPNDYSYPKNSDQIFEVALGSILTQNTTFVSVTKAMNNLKEHNCTTSESIKNMDIDKLKELIKPAGYFNQKANYILEFIKFYDSLDGTIPTREELLKVKGIGEETADSILLYGYNQAQFKVDAYTKRLLLELNLIDEKTKYKDMKKLFEDALEKEIQDKEKLRIIYQEFHALIVEHGKHNYX

SEQ ID NO: 10277 - DNA, 315 bp, Unknown
  Obtained from environmental sample
  misc_feature (1)..(315): n is a, c, g, or t
gtgccgccaaccgccgatagcgtcatcctcataaagaccaaggtccaacgcttcctctcggccatgttcatgaactcgctcaaacatatcaaaaaatccggcctcgatgaccgtcggaaaaaggtctctaaggtacctgcccaagacatcctcttttttgatttgctcactcttttgagccatcttgttaaggtcaatgcatataaaatcactatccgcataacggaacacagcaatattaacaggaatgtcatcaataccgatctgcaaaaaatcttgtgcgggcatgcttatacccttcctcaatatttatag

SEQ ID NO: 10278 - protein, 104 aa, Unknown
  Obtained from environmental sample
  misc_feature (1)..(104): Xaa is any amino acid
MPPTADSVILIKTKVQRFLSAMFMNSLKHIKKSGLDDRRKKVSKVPAQDILFFDLLTLLSHLVKVNAYKITIRITEHSNINRNVINTDLQKILCGHAYTLPQYL

SEQ ID NO: 10279 - DNA, 918 bp, Unknown
  Obtained from environmental sample
  misc_feature (1)..(918): n is a, c, g, or t
ttgtttttaagcgggttaaaaaacaacaaaattccgaagcaattccaacattttatggatacttatcctaatgctaatgaagttagtattgcaaaaagtattttagacaccttaatttacaaagaatttacccaacccaataccatagaaaacaacctaaaatttattcagcagcatcctaacaatccatttgtgccacaagccgaaagaaccatttacgagctttctacagctgataaaaaaattacttcttactacaattttataaaatctaattctaaaaacccttacacagcaagtgcttggagaaatatttataacttatccatcattaattatacttctgataatattaaaacatttttaagaacatatcccgaatatccttttaaagatgaactagtaaaagattttcagttagcaaaaactgctttctatccttttatgaaaaacaataaatggggatttataaatgagcatttgcaagaagtaattccaccaacttacgattttgcaaacgactttaaagaggggcttgctttggtaggattaaacggaaaaataggttttatagacaaaactaatcagctcattattccttttaaatatgaggaagctgaagattttgcaaacggattagcagttgttgggataaacgataaatatgggataattaatcgcttgggagaggaaatagtcccattaatgtatgacgaaattggaacaaccaaaaacaaatttattgctgttggattaaatgagaaatacggatttataaatacaagcggcaatcttgtaattggtttagaatacgagtctgttggttactttaataatggaattgcttttgtttttaaagacaataaatatggtattatagataccaacttgtattatgttttaaaccttttacgatga

SEQ ID NO: 10280 - protein, 305 aa, Unknown
  Obtained from environmental sample
  DOMAIN (153)...(169): KWG Leptospira
  misc_feature (1)..(305): Xaa is any amino acid
MFLSGLKNNKIPKQFQHFMDTYPNANEVSIAKSILDTLIYKEFTQPNTIENNLKFIQQHPNNPFVPQAERTIYELSTADKKITSYYNFIKSNSKNPYTASAWRNIYNLSIINYTSDNIKTFLRTYPEYPFKDELVKDFQLAKTAFYPFMKNNKWGFINEHLQEVIPPTYDFANDFKEGLALVGLNGKIGFIDKTNQLIIPFKYEEAEDFANGLAVVGINDKYGIINRLGEEIVPLMYDEIGTTKNKFIAVGLNEKYGFINTSGNLVIGLEYESVGYFNNGIAFVFKDNKYGIIDTNLYYVLNLLR

SEQ ID NO: 10281 - DNA, 465 bp, Unknown
  Obtained from environmental sample
  misc_feature (1)..(465): n is a, c, g, or t
atgaaagatattatagctaaaagacaaggtggaaatatccttggatttaatcaagataaaaaaacaaaacaagagcaagataatattatggaacttattgaagctgatgacttagtaaaatatggtttaatacctgaacttattggtcgtcttcacatgacagcagttcttcaagagattgatgaagatgcgatgatgcatatattaaaggaaccaaaaaattctttagtaaaacagtatacaaaattatttaaaatagatggtgtaaacttagagtttgaagaggactctttaaaagagatagcaaaagcagctaaaatgcgaaaaacaggtgctagaggattgcgatctattttagaagatattatgcttgatgtgatgtatgaattacctgagtataaaggtaaaacagtaacaattacaaaagatgtggtaaataaaacagaactaccaaaagtagcttaa

SEQ ID NO: 10282 - protein, 154 aa, Unknown
  Obtained from environmental sample
  misc_feature (1)..(154): Xaa is any amino acid
MKDIIAKRQGGNILGFNQDKKTKQEQDNIMELIEADDLVKYGLIPELIGRLHMTAVLQEIDEDAMMHILKEPKNSLVKQYTKLFKIDGVNLEFEEDSLKEIAKAAKMRKTGARGLRSILEDIMLDVMYELPEYKGKTVTITKDVVNKTELPKVA

SEQ ID NO: 10283 - DNA, 927 bp, Unknown
  Obtained from environmental sample
  misc_feature (1)..(927): n is a, c, g, or t
ttggggtttatggccggaagaggttatgctatacttgaaattttaaaatcaaatatcaacagactttcaaaacttaatccaaaatttcctgcggatttaatcaaaacaattcaagaaagcagcgaccctgttagaattgctgatttagtttcctctgtaatacaaatcactaataaagatgcgtatactttgtttaaagagacaaatattagtacacggcttttaggtattatagagcatatcaaacaagatattgaaacttttaaacttaaaaatgaaattaatcaaaaagtaaatacaaacctagataaacaccaaaaagattatgtattaagagagcagttacgaactatccaaaaagagctaggtggtgatacaagtaaagataaagagatacttgagtttagaaaaaaactcaaagctttgaaaccacatatgccaaaagctggatataaagagacaaaaaaacaaatagataaactcagtcgaatacatccagatagtggtgatgcttctacacttcagtcatatatagaagctgttttagagataccttttggagaaaaagtaaaagagaagtttgatgtagcacatgtggaagagcaacttaatattgatcactatgcacttaaagagccaaaagatagaatcatagagtattttgcagtgaaacaacttcttgaacaaagagggataaaaacagataaagacaatagtacagttctttgttttgtaggacctcctggagttggtaaaacaagtctagcaaactcaatagcaagtgcccttgacagaccacttgtgagaatagctcttggtgngatggaagatgtaaatgagcttcgaggacatagaagaacttatgtgggcgcaatgccaggacgaatagtacatgggtttacaactgcaaaaaaaatgaatcagtga

SEQ ID NO: 10284 - protein, 308 aa, Unknown
  Obtained from environmental sample
  misc_feature (1)..(308): Xaa is any amino acid
MGFMAGRGYAILEILKSNINRLSKLNPKFPADLIKTIQESSDPVRIADLVSSVIQITNKDAYTLFKETNISTRLLGIIEHIKQDIETFKLKNEINQKVNTNLDKHQKDYVLREQLRTIQKELGGDTSKDKEILEFRKKLKALKPHMPKAGYKETKKQIDKLSRIHPDSGDASTLQSYIEAVLEIPFGEKVKEKFDVAHVEEQLNIDHYALKEPKDRIIEYFAVKQLLEQRGIKTDKDNSTVLCFVGPPGVGKTSLANSIASALDRPLVRIALGXMEDVNELRGHRRTYVGAMPGRIVHGFTTAKKMNQ

SEQ ID NO: 10285 - DNA, 834 bp, Unknown
  Obtained from environmental sample
  misc_feature (1)..(834): n is a, c, g, or t
gtgagaatagctcttgtggggatggaagatgtaaatgagcttcgaggacatagaagaacttatgtgggcgcaatgccaggacgaatagtacatgggtttacaactgcaaaaaaaatgaatccagtgatagttctagatgagatagataaaattggagcaaaccatagaggagatcctagtgcagttatgctagagattttagaccctgaacaaaaccatgcttttagagacttatatcttaactttgagatagatttaagttcatgtatctttatagcaacagcaaacaatgctggtaaaattccagcacctcttagagatagaatggaatttataaatataagcagttatacaccaaatgagaagtttcatatagcatcaaattatcttataccacaagagttaaaaaaacatggtatgaaaaaatctgaagtgaacttaagtgatccaactattgaacttatcattgaaaagttcacaagagaagctggggtaagaaacctacgaagagtatttagcaaactgtatcgaaaagcagcaaaagaacttgtatacgataaagagttaaaaaaagtatcaatcaatacaaaaaatatagaagagtatcttgatagtcctatctttgaaatagacccagcagataaaacaaatagtgtaggtattgttaatggacttgcgtggacaagtgttggtggagatgttcttaaaatagaaactgtaaaatttgcaggaaaagggaacttatcgcttacaggaaatatgggtgatgttatgaaagaggagtgcccgaattgctcacagtgttgtaaaaggttaatctcgagccgattctga

SEQ ID NO: 10286 - protein, 277 aa, Unknown
  Obtained from environmental sample
  DOMAIN (193)...(275): Lon protease (S16) C-terminal proteolytic domain
  misc_feature (1)..(277): Xaa is any amino acid
MRIALVGMEDVNELRGHRRTYVGAMPGRIVHGFTTAKKMNPVIVLDEIDKIGANHRGDPSAVMLEILDPEQNHAFRDLYLNFEIDLSSCIFIATANNAGKIPAPLRDRMEFINISSYTPNEKFHIASNYLIPQELKKHGMKKSEVNLSDPTIELIIEKFTREAGVRNLRRVFSKLYRKAAKELVYDKELKKVSINTKNIEEYLDSPIFEIDPADKTNSVGIVNGLAWTSVGGDVLKIETVKFAGKGNLSLTGNMGDVMKEECPNCSQCCKRLISSRF

SEQ ID NO: 10287 - DNA, 666 bp, Unknown
  Obtained from environmental sample
  misc_feature (1)..(666): n is a, c, g, or t
ttggatgagaagaaattgcaattacgtgagttaaaggatattttggatagaaattttgctgagagtgagcagtggcgctatcagttcatttataaaactcctaagtatgggaatgatgatgattatgctgatgaacagacattgaaaattttcaattatttcttcgaagcaattgatggaaagccaacaccgttgggtgcaacctatcggattaatctgttgccgactacttctcatgtttatttcggcagtgttataggagctaccgcagatggccggttagctggagaacctctttccgagggcattagccctgttcagggagcggatattaaaggccctacggcggttatcaaatctgctgctaaaatagatcatatcagaacaggcggcacgcttctgaatcagaaatttgctccagaatttttcaaggatgatgagagtattgagaagctcactaagttgatcagggcttattttacgatgatgggacatcatatccagttcaatgttgtaaatattgaaaccctcaaagatgctcaattgcatccagaaaaatatcgtgatctaatagttcgggttgccggttatagtgattattttaatgatctaggagttgatcttcagaatgagataattcgtcgcaccgaacataaaggattctga

SEQ ID NO: 10288 - protein, 221 aa, Unknown
  Obtained from environmental sample
  DOMAIN (99)...(202): Glycine radical
  misc_feature (1)..(221): Xaa is any amino acid
MDEKKLQLRELKDILDRNFAESEQWRYQFIYKTPKYGNDDDYADEQTLKIFNYFFEAIDGKPTPLGATYRINLLPTTSHVYFGSVIGATADGRLAGEPLSEGISPVQGADIKGPTAVIKSAAKIDHIRTGGTLLNQKFAPEFFKDDESIEKLTKLIRAYFTMMGHHIQFNVVNIETLKDAQLHPEKYRDLIVRVAGYSDYFNDLGVDLQNEIIRRTEHKGF

SEQ ID NO: 10289 - DNA, 348 bp, Unknown
  Obtained from environmental sample
  misc_feature (1)..(348): n is a, c, g, or t
atgaaaaaagaaaatttattgataataatatcaactgataatgttgattctatattaaaatttccacttttatatggtggagtatcaatacctaggggatattggaaacgagtacatattatattttggggagcttctattacagtggttcaaacaaatgaagatgtaagaaaaaaagttcaagagatgcaaaaagatggtgtgcagtttagttcttgcatagtttgtgccaaagaatataatgcagtagaacaactacaaaatatagggataccttgtaatcacacaggggaacttttaaatgaagctttacaaaatgataaattatgggcaacattaacggtataa

SEQ ID NO: 10290 - protein, 115 aa, Unknown
  Obtained from environmental sample
  DOMAIN (1)...(115): Protein of unknown function (DUF1291)
  misc_feature (1)..(115): Xaa is any amino acid
MKKENLLIIISTDNVDSILKFPLLYGGVSIPRGYWKRVHIIFWGASITVVQTNEDVRKKVQEMQKDGVQFSSCIVCAKEYNAVEQLQNIGIPCNHTGELLNEALQNDKLWATLTV

SEQ ID NO: 10291 - DNA, 348 bp, Unknown
  Obtained from environmental sample
  misc_feature (1)..(348): n is a, c, g, or t
atggctcagatctatagacgagatagaaaaaaagaaagttctgctgcaaaactatacaaagatgagagtggttttgtgtttggtatcattgaaccttatgatgatagtttttgtaaaagttgtaatagaatacgccttagtgctgagggagatttaatcccttgtttgtattttgaagattcgttaaatataaaaagtgctataaaatctgatgaaagattagaagaagttttaaaaacagttgtaaaaaataaaccagaaaaaaataagtggtcatataatacaaataataatatagatacaacttctgaagtctccagtagagctttttattttacgggagggtga

SEQ ID NO: 10292 - protein, 115 aa, Unknown
  Obtained from environmental sample
  DOMAIN (2)...(91): Molybdenum Cofactor Synthesis C
  misc_feature (1)..(115): Xaa is any amino acid
MAQIYRRDRKKESSAAKLYKDESGFVFGIIEPYDDSFCKSCNRIRLSAEGDLIPCLYFEDSLNIKSAIKSDERLEEVLKTVVKNKPEKNKWSYNTNNNIDTTSEVSSRAFYFTGG

SEQ ID NO: 10293 - DNA, 429 bp, Unknown
  Obtained from environmental sample
  misc_feature (1)..(429): n is a, c, g, or t
atggatataaaatcattatataaattaaatgtggtagctgttgatgatgaggagatgatacttaaacatttggataatcatatctcaaggtattgtaataagtttgaaaaatttacaagtacaattgaagcatatgaatatatatctacttctacagttgatattgttataagtgatataagaatgccattaatgaatggaatagaattctcaaaaaaagtcaaagattataagaaagatataattgttattttgctttcggcttctaatgatgctgactacttaatggaagctattaatgttggagttgataggtttttgccaaaaccctatagcataaaagaactcatagagattttagaaaattatgcaactcanattgagagtataaaagaagttaaattatacaatgagtttatagtnncataa

SEQ ID NO: 10294 - protein, 142 aa, Unknown
  Obtained from environmental sample
  DOMAIN (9)...(128): Response regulator receiver domain
  misc_feature (1)..(142): Xaa is any amino acid
MDIKSLYKLNVVAVDDEEMILKHLDNHISRYCNKFEKFTSTIEAYEYISTSTVDIVISDIRMPLMNGIEFSKKVKDYKKDIIVILLSASNDADYLMEAINVGVDRFLPKPYSIKELIEILENYATXIESIKEVKLYNEFIVX

SEQ ID NO: 10295 - DNA, 909 bp, Unknown
  Obtained from environmental sample
  misc_feature (1)..(909): n is a, c, g, or t
atgttggagtttgataggtttttgccaaacccctatagcataaaagaactcatagagattttagaaaattatgcaactcaaattgagagtataaaagaagttaatttatacaatgagtttatagtcaataaacttaatataaaagaaaataatttcaaggatatattatattatcttgaacaatacaatgatgcaattaatcaaacaaatctagttagaaaatttgattcaaatggaaaaataataaatacaaataataagtttataaaaactttaggaatgtattctttagcaaaccaattaaaagagataaattcttttgatgttataaaaaatacaacatcttcaagtgataaattttttaacaatttaattatttatgaaaatcaaaaccaaaaaagctatattgaatctacatatatacccatatataagtatgatcaaacactattagaagtattagaaataagttatgatgtttctgaagtctataaactcaatgaagagatacaaaaaacacaagaaacggttatatatatgttaggaacattgatagagagtcgttcaaaagagacctcaaatcatctaaaaagagtagctttatatggagaaataatagggaaagcttatgggcttgatgacaaacaaatggagcttatgaaaatctcttcacctttacatgatataggtaaaattggtattcctgatcatattttaaataaaccatcatcactaagtgatgaagaatatagagttgtaaaagagcattctaaaataggctatgagatacttaaaaactcaaatagagatattttacaaatagcagcagttattgcttattcacatcatgagaattgggatggaacaggttatccntcaaaattaaaaggggaagctgagccgatctga

SEQ ID NO: 10296 - protein, 302 aa, Unknown
  Obtained from environmental sample
  DOMAIN (192)...(302): HD domain
  misc_feature (1)..(302): Xaa is any amino acid
MLEFDRFLPNPYSIKELIEILENYATQIESIKEVNLYNEFIVNKLNIKENNFKDILYYLEQYNDAINQTNLVRKFDSNGKIINTNNKFIKTLGMYSLANQLKEINSFDVIKNTTSSSDKFFNNLIIYENQNQKSYIESTYIPIYKYDQTLLEVLEISYDVSEVYKLNEEIQKTQETVIYMLGTLIESRSKETSNHLKRVALYGEIIGKAYGLDDKQMELMKISSPLHDIGKIGIPDHILNKPSSLSDEEYRVVKEHSKIGYEILKNSNRDILQIAAVIAYSHHENWDGTGYPSKLKGEAEPI

SEQ ID NO: 10297 - DNA, 642 bp, Unknown
  Obtained from environmental sample
  misc_feature (1)..(642): n is a, c, g, or t
ttgagtgagatttcagataattttgaggaactatacatcagaacaagtgacctaaaaagtagcgaaatatatcatctagaaaacacacccgaaaaaaaagaaaaaaatccattcatgggacttcatggaattagatatgggctaaaatatccagatattttaaaatcagaattatacgcaataaaaagaatagcaaaagaaaataaaaccgttggaatcattttgccacaaataacatctgtaaaagaattcaaaaaagtaaaagaatacacaaaagaattagaaatggacaacataaaagttgggatcatgattgaaacaccggcagcagttcagttgataaaagattttgcagaagagcaaatagattttatactaatagagacagacgatttaatgcaatcattattagtattagataaaactaacccagaaacaaaagaattctttgaggaaactcatcctgcattgatatatcaattagaatatattattcgtgtttgtaaaagaaggaatattgaaaccacactatcagggaacataacccaaaatgacgaaatactgaaattactaatacaaaaggggattagttcgatagtaattcccccagaacaagcaaaagaaacttctgagaaaatatag

SEQ ID NO: 10298 - protein, 213 aa, Unknown
  Obtained from environmental sample
  DOMAIN (1)...(211): PEP-utilising enzyme, TIM barrel domain
  misc_feature (1)..(213): Xaa is any amino acid
MSEISDNFEELYIRTSDLKSSEIYHLENTPEKKEKNPFMGLHGIRYGLKYPDILKSELYAIKRIAKENKTVGIILPQITSVKEFKKVKEYTKELEMDNIKVGIMIETPAAVQLIKDFAEEQIDFILIETDDLMQSLLVLDKTNPETKEFFEETHPALIYQLEYIIRVCKRRNIETTLSGNITQNDEILKLLIQKGISSIVIPPEQAKETSEKI

SEQ ID NO: 10299 - DNA, 756 bp, Unknown
  Obtained from environmental sample
  misc_feature (1)..(756): n is a, c, g, or t
atggaagaggataacaaaaagatatcagaaaattttgtacaatggttttcaaacttaaacaaagaagaaataaataagactggtgaaaagggtgcatatttatcagaactttacaataataaattcccagtaccaaatggatttataataacaactcaatgctataacaaattcatggaatctgcaaatctaaaagaaaaaatattcgcattattaaataatttagatataaaggatatagagagaataaaggaaatctcagaaaaaataagaaaattaataataagtacagaattgccagaagatatcaaagaaaacatattggagtcttatgaggcactaagtactgataaattagaaattgagaaaggaacagccctagacattttaaacaatgcaacagaaccagcattcgtagcaattagaagtagcttaaaaaatccagtaaaaacaaaaataagagaacaagatacctacttgaatattaaaggaaatgatcaattgctacaccatacaaaaaaatgctttgcatccctattcagagaagaaacaataattagggctattcaacataaaaatatcaataaactagaaatggcaattgttatccaaaaaatgatacaatctgataaatctgggaaaatatattctacaaataataaaggattaaccacaataaagagtatatggggaattgggagaaagaatgttattagaaaacaacattcccgacacgcatctgatatccaaaagtcc

SEQ ID NO: 10300 - protein, 252 aa, Unknown
  Obtained from environmental sample
  DOMAIN (11)...(252): Pyruvate phosphate dikinase, PEP/pyruvate binding domain
  misc_feature (1)..(252): Xaa is any amino acid
MEEDNKKISENFVQWFSNLNKEEINKTGEKGAYLSELYNNKFPVPNGFIITTQCYNKFMESANLKEKIFALLNNLDIKDIERIKEISEKIRKLIISTELPEDIKENILESYEALSTDKLEIEKGTALDILNNATEPAFVAIRSSLKNPVKTKIREQDTYLNIKGNDQLLHHTKKCFASLFREETIIRAIQHKNINKLEMAIVIQKMIQSDKSGKIYSTNNKGLTTIKSIWGIGRKNVIRKQHSRHASDIQKS

SEQ ID NO: 10301 - DNA, 702 bp, Unknown
  Obtained from environmental sample
  misc_feature (1)..(702): n is a, c, g, or t
atgaatacatatatcagcaaaacagaaaagaaaaaagaattcaccattatgttagacgctcacttagacgaagtaggttttatggtccaaagtattacatcaaagggactaataaagctcttagctcttggagggtgggttccacataatgtcccagcacatttagtagccattaaaaccaatgatggtagctatataaatggtattgttacttcaaagccaccacactttatgaccagcgatgaaaaaaataaaaaattagatatagaagatttaaccattgatgtaggcgcctctacaagagaagaagttctagaggtatataacatcagtattggtgcacctattgtaccgtttacaaactttgaatataataaaaaaactaacatcatgatgggcaaagcctttgataaccgattaggatgtgcagcggttatttcagtcataaaaaatattccagaattagaacacattaatgtcatcggtgctttagctgttcaagaagaagtcggtacaagaggtgccatggttacagctagaaaagtaaagcccgatttggcaatcgtttttgaaggtactccagcagatgatgtctacttagatgattctttggctcaaggtattttaggaaaaagacctcaaattagatttagagatagctcttatgttgctcatcataaattcattgatttgcccatatag

SEQ ID NO: 10302 - protein, 233 aa, Unknown
  Obtained from environmental sample
  DOMAIN (2)...(233): M42 glutamyl aminopeptidase
  misc_feature (1)..(233): Xaa is any amino acid
MNTYISKTEKKKEFTIMLDAHLDEVGFMVQSITSKGLIKLLALGGWVPHNVPAHLVAIKTNDGSYINGIVTSKPPHFMTSDEKNKKLDIEDLTIDVGASTREEVLEVYNISIGAPIVPFTNFEYNKKTNIMMGKAFDNRLGCAAVISVIKNIPELEHINVIGALAVQEEVGTRGAMVTARKVKPDLAIVFEGTPADDVYLDDSLAQGILGKRPQIRFRDSSYVAHHKFIDLPI

SEQ ID NO: 10303 - DNA, 705 bp, Unknown
  Obtained from environmental sample
  misc_feature (1)..(705): n is a, c, g, or t
gtgggaaaagctataaatattaaaaaaagggtgctaagtcatttttatagtaagactaaaaaatcacaagatatggtacgcgaaactgccgatattgattttgaagattcaggcagtgagttaatcgctttacttatggaagatgccgctataaaacaccactttcctgtctataataaagtggctaagcgtaccgtgcaatcttttgctatattctcttaccaagaccgcaaaggggttttacatttagcaagcaacaaagggcgtttagtcccaaatcctattgtaacactatttagtattagagaagtccgtgcttatttagaaaaaatctgtgagacacataatttatgcccaaaatactgccacttgcaagagtcggtagctgagtgttctcattttagtattaaaaattgtaaaggtatttgcagagacgaggaagctgtagaagcctataacgacagagttttagaagccataaaggatatggcagatcagaaaaccgatatggtgctgagagaaaaaggccgacaccagaatgaagaagcctttataatggtgaaaaatggcgaatatttaggatatggttttgtagatatagaagaaaccataaaccatatcgatgatttggagacgttccttattccccaaaaaaacaatatggatattcaaaagattttaaaatcccgcttactagaattgtag

SEQ ID NO: 10304 - protein, 234 aa, Unknown
  Obtained from environmental sample
  misc_feature (1)..(234): Xaa is any amino acid
MGKAINIKKRVLSHFYSKTKKSQDMVRETADIDFEDSGSELIALLMEDAAIKHHFPVYNKVAKRTVQSFAIFSYQDRKGVLHLASNKGRLVPNPIVTLFSIREVRAYLEKICETHNLCPKYCHLQESVAECSHFSIKNCKGICRDEEAVEAYNDRVLEAIKDMADQKTDMVLREKGRHQNEEAFIMVKNGEYLGYGFVDIEETINHIDDLETFLIPQKNNMDIQKILKSRLLEL

SEQ ID NO: 10305 - DNA, 930 bp, Unknown
  Obtained from environmental sample
  misc_feature (1)..(930): n is a, c, g, or t
ttgacaagaatcggctcgagaggtttattagatagtgctgccatacagcataaaattaatatagagtttactaaaagcctcaactatatttaccatccttctgccttaaataattatggcctatttttctattggtacaaaaaggacttagactccgctatgtatttttttgatggtgcttataagcttacccaaactaaatttccgaaccacacattaataggaagtattcgcgataatattgctgatttgtatacagaacaacaagcctacgataaagcactacccttataccaacaaaactttgagttttacaaaacagcgatcaatgaggaaaccttgattaaagatgtgcctcgcttaatcagtgctggtgcgcaattaattaccacaaacacatacttacatcgctttaaagccgcccaacaacactttacggaactagagcatattgtagttacagaaactgcaaataataatgtttcgacgccgtctcaattagaatttttaagagcgaaagaacagttattaagaaccactaatcaaatttcagaggcgtacctaacagtgaaagacattgaaaagctttccgatagtttacaaaccttattaaatcatgcagacaagcggtggcaagaggaattaaatgatataacgatagataaaattgaattaaattttaaaatagaccgtattcaaaaggaaaacatgattaaaaaccaacgtacaaaactctggtttataggtctcttgtcgtcgttatttattatcttacttgttgcgctcattatgaatagaagacagcatcttttaaatgctaagaataagcagttgcttgcagagcaaaagcttgaaaacacggcttttaaagtagaacaactaaattcagaaaataaatctaaggagcgggatttatctgattttgctata

SEQ ID NO: 10306 - protein, 310 aa, Unknown
  Obtained from environmental sample
  misc_feature (1)..(310): Xaa is any amino acid
MTRIGSRGLLDSAAIQHKINIEFTKSLNYIYHPSALNNYGLFFYWYKKDLDSAMYFFDGAYKLTQTKFPNHTLIGSIRDNIADLYTEQQAYDKALPLYQQNFEFYKTAINEETLIKDVPRLISAGAQLITTNTYLHRFKAAQQHFTELEHIVVTETANNNVSTPSQLEFLRAKEQLLRTTNQISEAYLTVKDIEKLSDSLQTLLNHADKRWQEELNDITIDKIELNFKIDRIQKENMIKNQRTKLWFIGLLSSLFIILLVALIMNRRQHLLNAKNKQLLAEQKLENTAFKVEQLNSENKSKERDLSDFAI

SEQ ID NO: 10307 - DNA, 756 bp, Unknown
  Obtained from environmental sample
  misc_feature (1)..(756): n is a, c, g, or t
atgcaaagagcactctatgatgatgagtttcatatctactttcaccccaagatagacatcaaaagtggtaaaattatgggagctgaagcactgctacgatgggtacataaggagaaaggatttatcagtcctgctcttttcattcctctagcagaaagtactggatttatcttaagtcttggaaaacttgttatagaaaaaacccttcactccatacaaaagatttcaaatatggggtatacagagttagtaatctctttaaatgtttctacaagacagtttcaaaatagtgacctctataacgaccttaaagcagaactcaaaaaaagaactattaacccgtatcaagttgctatagagataaccgaaagcgttatgatgaaacatgtaaacaaaacacttattactctacaaaatataaaagagcttggaatttccatagatattgatgattttggaacaggctactcctcgctctcctatcttcaaaaatttccaattgatgttctcaaaatagataagatttttgtagatgagataaacaccaagaacgataaggagctactcatagacacgattttagcaatgggaagagcgcttaaactcaaagtagtggcagagggtgttgagacaaaagagcagtatgagtttttaaaacacagaaagtgtgatgtcatccaaggttattactttgaaaagcctatggatgaagcaagttttattcagcttttaaaaagtgataaaacttactcttag

SEQ ID NO: 10308 - protein, 251 aa, Unknown
  Obtained from environmental sample
  DOMAIN (1)...(234): EAL domain
  misc_feature (1)..(251): Xaa is any amino acid
MQRALYDDEFHIYFHPKIDIKSGKIMGAEALLRWVHKEKGFISPALFIPLAESTGFILSLGKLVIEKTLHSIQKISNMGYTELVISLNVSTRQFQNSDLYNDLKAELKKRTINPYQVAIEITESVMMKHVNKTLITLQNIKELGISIDIDDFGTGYSSLSYLQKFPIDVLKIDKIFVDEINTKNDKELLIDTILAMGRALKLKVVAEGVETKEQYEFLKHRKCDVIQGYYFEKPMDEASFIQLLKSDKTYS

SEQ ID NO: 10309 - DNA, 585 bp, Unknown
  Obtained from environmental sample
  misc_feature (1)..(585): n is a, c, g, or t
ttgagagctaatctaaaaaagtcctacctaattggattactgctactattctctttagctgttccgctcttacaatctctcctctttagtacaaaaacagagggtgccattaaaatagataaagaaataaaagcagattttcttctgagtaaaaaaaaataccttctcgtctattttggatatgtcggctgtagtgatgtatgcaccccttttttacaaaaactaagtcaactctatgactcaaaaaagtttcaaaacatcaaagaggatacggatgttttctttatcaatcttactccggaggtagaagaagctcttccccagagatttgcaaaatttttccacaaagattttataggtgttcatctctcaaaaaaaaagatttactctttagacagaacgtttgacctcttttttgctgaagatttaagagataaaacagagcttaatcatactgacaatctattttttctaacaaactacagtggtatcaaaacgctcaaaagcatacattttacccatccattaagtactgaaaagcttatagacgctattatatatgaaaaaaagaatccaatacaatga

SEQ ID NO: 10310 - protein, 194 aa, Unknown
  Obtained from environmental sample
  SIGNAL (1)...(20)
  misc_feature (1)..(194): Xaa is any amino acid
MRANLKKSYLIGLLLLFSLAVPLLQSLLFSTKTEGAIKIDKEIKADFLLSKKKYLLVYFGYVGCSDVCTPFLQKLSQLYDSKKFQNIKEDTDVFFINLTPEVEEALPQRFAKFFHKDFIGVHLSKKKIYSLDRTFDLFFAEDLRDKTELNHTDNLFFLTNYSGIKTLKSIHFTHPLSTEKLIDAIIYEKKNPIQ

SEQ ID NO: 10311 - DNA, 582 bp, Unknown
  Obtained from environmental sample
  misc_feature (1)..(582): n is a, c, g, or t
atgggtggatgtattttagcttctaaccatcctttaggtggagtagatgccttggcaattgttactgctttaaaagattatcgtaaggatgtacagtttgttgtaaatgatattctgttacacctaaaaaatttaaatggactttttgttggagtaaataaacacggtagcaattctaaaaaatcgcttaatagtgttaatgaacttttttcttctgatagagcagtttttgtttttcctgctggtttggtaagtagaaaggttaacggaaaaattagagatttagaatggaaaaaaacctttatcacccaagcaaaaagacatcataaagaagttatacctatttatgtagatggtaaactatctaactttttttacagattagctaattttagaaagtttttaggcataaaagctaatatagaaatgctatttttggcaaaagaaacgtttaaacaaaaaaataaaacgattaccataacttttggaaaacctatttcatacaccaaatttgacaatgataaacccgataaatattgggcagaatgggtgaaaaagaaagtgtatgaattgaaggattag

SEQ ID NO: 10312 - protein, 193 aa, Unknown
  Obtained from environmental sample
  misc_feature (1)..(193): Xaa is any amino acid
MGGCILASNHPLGGVDALAIVTALKDYRKDVQFVVNDILLHLKNLNGLFVGVNKHGSNSKKSLNSVNELFSSDRAVFVFPAGLVSRKVNGKIRDLEWKKTFITQAKRHHKEVIPIYVDGKLSNFFYRLANFRKFLGIKANIEMLFLAKETFKQKNKTITITFGKPISYTKFDNDKPDKYWAEWVKKKVYELKD

SEQ ID NO: 10313 - DNA, 474 bp, Unknown
  Obtained from environmental sample
  misc_feature (1)..(474): n is a, c, g, or t
atgggtaataataacgatgatggtttaaaaatttctaaaagctttaagcaaagtgttagacttgtaataatatcaatttttatatttttattggcatatatagttcttcttggaattgcgggaggtttagcaatagctgctttttattttggaattttattagtaagtattaagataaatttttacacaattattgcagggcttggattaatatctcttggagtaatgttttttttcttcttaataaagtttctattttccgtaactaaagatgagaaccttttaagaatagaaataaaagagagtgaagaacctaaattattcgaatttttgagagatatctctaaacaaactaacacgaaatttccagtaagagtatttgtatcaccagaagtaaatgcctacgtattttataattctagtttttggagtcttatttttccagtaaagaaaaatttaaatataggggtggga

SEQ ID NO: 10314 - protein, 158 aa, Unknown
  Obtained from environmental sample
  misc_feature (1)..(158): Xaa is any amino acid
MGNNNDDGLKISKSFKQSVRLVIISIFIFLLAYIVLLGIAGGLAIAAFYFGILLVSIKINFYTIIAGLGLISLGVMFFFFLIKFLFSVTKDENLLRIEIKESEEPKLFEFLRDISKQTNTKFPVRVFVSPEVNAYVFYNSSFWSLIFPVKKNLNIGVG

SEQ ID NO: 10315 - DNA, 435 bp, Unknown
  Obtained from environmental sample
  misc_feature (1)..(435): n is a, c, g, or t
atgaatttaatgaaactattacttataaattttattatctgctcaactcttttagctgatcataagggtgctccgcagcttctatctgctaaagacacacttatttcacttgagcctataaagagtgatgctattgtatttggtgagggaaaaaaagagattcatgcttttatagatccgctttgttctctgtctcagaggtatctatctttcgtatttgcgaaaaaagagttaatgtttaaaaagtataaattctacttctacctttatgagctccctagtaaaaattccaaagagcttatctcaacaatactctcatcagagtataaaaacacaatgcttaaaaccgttatgttaaatcatcaagatgttattattgatgaaggtgaaggagaagatatagctgataaaattgaagaggtgcaaaaaagatag

SEQ ID NO: 10316 - protein, 144 aa, Unknown
  Obtained from environmental sample
  misc_feature (1)..(144): Xaa is any amino acid
MNLMKLLLINFIICSTLLADHKGAPQLLSAKDTLISLEPIKSDAIVFGEGKKEIHAFIDPLCSLSQRYLSFVFAKKELMFKKYKFYFYLYELPSKNSKELISTILSSEYKNTMLKTVMLNHQDVIIDEGEGEDIADKIEEVQKR

SEQ ID NO: 10317 - DNA, 834 bp, Unknown
  Obtained from environmental sample
  misc_feature (1)..(834): n is a, c, g, or t
ttggaagtgattgagttgggcggagaaaagaaaataacttattttgtgaattttggtaatgaagaagtggtttcacagaatttgaattatatcaatcatgcccgtcggcatattgatctggaaattattgaactcagagcaaaactagcagaacttgatggcattgttaccaattttaaaggtgttgttgaggataaaattgcaattttacaaaccagagatcctcttaaaattacattgatagatcgcaaagtcagcaattattttaaaggaatcgaaccttttttttcgagaattttggaaaattcataccgtcttcactttacaagtcaacaggaaacgaaacgtattcaagagatcaatgacaagttcagtaaaacttatatcaggcttgaaaacacattaacaacttgttttgtagtctttgttctcctgatggggtgggtggttctaagatcaagtaaaaagattattctagaacggcagaattatcaacaagagttgcaaaaaacaaatgaaaacctcgaaagtattgtgcataaacgaacctcagcgttaaagaaggaaatctctgatcgtaaaagtgctgagcttcaggtaaagaaacatgctgattttttacacaatattatcgaatctttggcccaccccttttatgttattgacgcagaaaattatatgattgttttagccaattcagccgctatggatagtgttaataggtcatgcacgacctgtcatgcactcactcaccgtanggagaagccctgcgacggctcagatcatccctgcccactacagcaagtaaaagaaaccctgtctcctgtgatggtg

SEQ ID NO: 10318 - protein, 278 aa, Unknown
  Obtained from environmental sample
  misc_feature (1)..(278): Xaa is any amino acid
MEVIELGGEKKITYFVNFGNEEVVSQNLNYINHARRHIDLEIIELRAKLAELDGIVTNFKGVVEDKIAILQTRDPLKITLIDRKVSNYFKGIEPFFSRILENSYRLHFTSQQETKRIQEINDKFSKTYIRLENTLTTCFVVFVLLMGWVVLRSSKKIILERQNYQQELQKTNENLESIVHKRTSALKKEISDRKSAELQVKKHADFLHNIIESLAHPFYVIDAENYMIVLANSAAMDSVNRSCTTCHALTHRXEKPCDGSDHPCPLQQVKETLSPVMV

SEQ ID NO: 10319 - DNA, 840 bp, Unknown
  Obtained from environmental sample
  misc_feature (1)..(840): n is a, c, g, or t
atggaagaggttagtataaacgctgatttgcaaaaaaaacttgcgattcaagcttgcccaatgagtgcaagtgtacattgggacccaaaagatgataagaaagatgacactacggggtggtatgaaatatacaacaagttaccatgtcaagtaagattaggattgattgatgaggtgacagagcgacggataattgaaattgcgaagaaatacaatatatataaaataggggagttaggtgagatttctagaattattagagactcttttgttaccaacacctttagtgcgagtgttgtgcaaaaaaggattgttgaaaaattaaaagtaaacgaagctcaggcgaaagaattgttcatgaaactagttaatttaaggggcaaaattgtgagtgtggaggaggaaacgagtttgataatagagaagcttccaataattaccgctcttaagaaattccccaacctcaatgaccagcgacttggagagaagaaaatcaagatttcaggagaaaatgaatttaaaatccctacaatcaaaaattggcttaatgactatactcttcaaaaaggagctcaatcacacaataatctagaaagaagtgactatgtctttaattcagaaaacgtcggcagactttcatttcaagagaaaagaaaactatcttttatattagaatcatacgatgaagacactgatttaagtgttgatataaataaaaaagaggttttgtttaatattttcaatgatgagtcaatggaattattgagagagggaatgcgaaaagaggaagagtccattaaaaaggaacaaactagaanaagtgatatattaggagatctc

SEQ ID NO: 10320 - protein, 280 aa, Unknown
  Obtained from environmental sample
  misc_feature (1)..(280): Xaa is any amino acid
MEEVSINADLQKKLAIQACPMSASVHWDPKDDKKDDTTGWYEIYNKLPCQVRLGLIDEVTERRIIEIAKKYNIYKIGELGEISRIIRDSFVTNTFSASVVQKRIVEKLKVNEAQAKELFMKLVNLRGKIVSVEEETSLIIEKLPIITALKKFPNLNDQRLGEKKIKISGENEFKIPTIKNWLNDYTLQKGAQSHNNLERSDYVFNSENVGRLSFQEKRKLSFILESYDEDTDLSVDINKKEVLFNIFNDESMELLREGMRKEEESIKKEQTRXSDILGDL

SEQ ID NO: 10321 - DNA, 780 bp, Unknown
  Obtained from environmental sample
  misc_feature (1)..(780): n is a, c, g, or t
gtggctcttatagatggactacataatccatatgaagatattgaaaagataacacctctctatctgcctctttatctttttaaaatagattctaccgtcttagactctttggattttaataaagatcatgagagtacaatggctgaaaataagatattcagatttaatgcaaaagttttagtagcagaagataatgaggcaaataaagagcttatcaaaaccatactagagagatatggtattgtcacaaacattgtttcaaacggtttagaagcttttaagttgtgtaaagagagagagtttgatcttatcctcatggatgagcagatgcctgttatgaatggtacagaggcaacgcagaaaattatggagtctcaaaaaaagagatcagcagtaaaaactcctatagtttcactcactgcaaatatgataaaaggcgcaaaagagagagccttaatgtctggatatgatgaatttttgggaaaacctattgtcataaaagagttagaagtgattttacaaaaatatctgaaagaggatgaacgttctcagattgaacttatttctactaataaaaaagcattggtggagggagtagatcttgattatttaaaagaggaactgcaactcgattttgatgatttgattacacttttgaagatatttaaaacccaaagtagctctattttggctcagttaaaagtggcacaaaaagataatgatataaaagctctctcaaagcttatacactcccttaaaaggttcaagtgcaaactttaa

SEQ ID NO: 10322 - protein, 259 aa, Unknown
  Obtained from environmental sample
  DOMAIN (57)...(181): Response regulator receiver domain
  misc_feature (1)..(259): Xaa is any amino acid
MALIDGLHNPYEDIEKITPLYLPLYLFKIDSTVLDSLDFNKDHESTMAENKIFRFNAKVLVAEDNEANKELIKTILERYGIVTNIVSNGLEAFKLCKEREFDLILMDEQMPVMNGTEATQKIMESQKKRSAVKTPIVSLTANMIKGAKERALMSGYDEFLGKPIVIKELEVILQKYLKEDERSQIELISTNKKALVEGVDLDYLKEELQLDFDDLITLLKIFKTQSSSILAQLKVAQKDNDIKALSKLIHSLKRFKCKL

SEQ ID NO: 10323 - DNA, 861 bp, Unknown
  Obtained from environmental sample
  misc_feature (1)..(861): n is a, c, g, or t
atgagctaccgctcaagcagaggttatgatcacttaaaagtcgctctttcagtcggtgttcagaagatggtcagaagcgataagagctgtagtggaaccatgttcagcattgatacagagagtggatcacgagatctgatcttaataaactcaggttggggtcttggtgaaaacattgtggggggtatgataaaccctgatgaatttttaatatttaaacctactttgaaaaataatgtttcaaccatactcaaaaaagagcttggaagtaaaaagcttaagatgatctactcgaaaaatggcggtagtgaaaatatcgagagtacaaaagaggagagagaaactttctcattaagtgatgaagatatttttacacttgcatccgccgcactaaagatagagacacactactctgagcttgcagatgaataccgtgccatggatatagagtgggcaaaagatggagagacgagtgaaatatttattttgcagtcacgaccagaaacaattcactcaaagaagagtactcaagaaaacaatattaaacaatataaactttcaactgaacaaaaaactcttatcaccaaaggtgtagccataggagataaaataggttctggaaaagtaagaatcatcaactctccatcagagtttcactttttttgtgatggtgaagtcttagtcgcagatattaccgatcctgattgggaacctatcatgaaacgcgcatctgcacttattacaaacagaggtggaagaacttgtcatgctgccatagtagcacgagaaataggagttcctgcagtagttggaacttcaaacgctatgcagattttaagtgatggaaaagagttacggtaa

SEQ ID NO: 10324 - protein, 286 aa, Unknown
  Obtained from environmental sample
  DOMAIN (1)...(201): Pyruvate phosphate dikinase, PEP/pyruvate binding domain
  misc_feature (1)..(286): Xaa is any amino acid
MSYRSSRGYDHLKVALSVGVQKMVRSDKSCSGTMFSIDTESGSRDLILINSGWGLGENIVGGMINPDEFLIFKPTLKNNVSTILKKELGSKKLKMIYSKNGGSENIESTKEERETFSLSDEDIFTLASAALKIETHYSELADEYRAMDIEWAKDGETSEIFILQSRPETIHSKKSTQENNIKQYKLSTEQKTLITKGVAIGDKIGSGKVRIINSPSEFHFFCDGEVLVADITDPDWEPIMKRASALITNRGGRTCHAAIVAREIGVPAVVGTSNAMQILSDGKELR

SEQ ID NO: 10325 - DNA, 789 bp, Unknown
  Obtained from environmental sample
  misc_feature (1)..(789): n is a, c, g, or t
atgtctatcgatattgagttcattcatttaaaggatgaactccatgagcagtatgttatggcacattctgaacttattgaattaaaggctatccaaaccattaacatcgatgtggtacctaaacatgaccgagagtatttagagggagaaaataccaaattaattgctaatcgatttgagtatttcctttatcgtaaagccgaacaattatttcacagtaatagcttaacggtgaaagaaagcgttaataaccgtagtttaacgtcagatcttatacaacctaaagaatggcagcaaaaagagacaatcattgaaaacactggccttgataagctggcaacaccgattaaccaaacactcgcagataagagccaacaattagaagttaagctgaaggaagcaagcgagcatatctttagtggtgataataagtatgttgagtttattcctggcaaagccgaactcaagtggtcaattcctaacagccgttggcaacaaacaattgaaaacccgctctacaatcaaattcaacacatgggtatcgttgaactcatgttgtttgttgatcaaaagacaggttacttaaattcatttacacacatatcagcaactaaagaaaaatcacccgtaaataaagaagatctgatcgcctgtatattggcaaacggcaccaattaccgcctatataaaatggcgaatatctctgaacgttcaatgggtaaattacgcagtgtagatgatagttatgtcagatatgaaacactcaaaacgtctaaggatcaggtttct

SEQ ID NO: 10326 - protein, 263 aa, Unknown
  Obtained from environmental sample
  misc_feature (1)..(263): Xaa is any amino acid
MSIDIEFIHLKDELHEQYVMAHSELIELKAIQTINIDVVPKHDREYLEGENTKLIANRFEYFLYRKAEQLFHSNSLTVKESVNNRSLTSDLIQPKEWQQKETIIENTGLDKLATPINQTLADKSQQLEVKLKEASEHIFSGDNKYVEFIPGKAELKWSIPNSRWQQTIENPLYNQIQHMGIVELMLFVDQKTGYLNSFTHISATKEKSPVNKEDLIACILANGTNYRLYKMANISERSMGKLRSVDDSYVRYETLKTSKDQVS

SEQ ID NO: 10327 - DNA, 699 bp, Unknown
  Obtained from environmental sample
  misc_feature (1)..(699): n is a, c, g, or t
atgagatatctattttccctttttatcttcactacattaatttttgcagaagtaaaaatcaatctttctcacacaaatataaaacacggtacatcgtttgctgtgatacttcaaagtgataaaaacttatcacaagctccaaatgtgatttttaaagataaaacttatcagatgtttactatcaatggaagtattcaaaactatgaggtttttctccctgttgattatcataatccaaaacaaaaagagaatgtacaggtaagatacttagaagatgagcagttagtaaagaaaaatacctctataaatatcattgatggaaaatatcgacaaaatgagattataaaagttgccaaagggaaagtaacactttcttcaaaaaacaaagaaaaaacagccaaagagtacaatcaagtttttaaaaatgtttactcagtggttactttatatgatttaacaaacaactcaacttttcaacttcctatggatagtaaaattacaagtgcttttggaaatgctagagtttataatggtgttgcaaaaagttatcatactggaactgattttagagcaagtgtaggggatgaagtaaaagcttcaaatgatgggaaagtggttcttactatggatagattttatctaggtcgtgttatctacatagaccatggaagaggagcttatacctactactctcactga

SEQ ID NO: 10328 - protein, 232 aa, Unknown
  Obtained from environmental sample
  SIGNAL (1)...(16)
  misc_feature (1)..(232): Xaa is any amino acid
MRYLFSLFIFTTLIFAEVKINLSHTNIKHGTSFAVILQSDKNLSQAPNVIFKDKTYQMFTINGSIQNYEVFLPVDYHNPKQKENVQVRYLEDEQLVKKNTSINIIDGKYRQNEIIKVAKGKVTLSSKNKEKTAKEYNQVFKNVYSVVTLYDLTNNSTFQLPMDSKITSAFGNARVYNGVAKSYHTGTDFRASVGDEVKASNDGKVVLTMDRFYLGRVIYIDHGRGAYTYYSH

SEQ ID NO: 10329 - DNA, 588 bp, Unknown
  Obtained from environmental sample
  misc_feature (1)..(588): n is a, c, g, or t
ttggggtttgtatggctcgagaaaacgctcacaacgtttaaacataaaaaaggctatgaagtacatttgcatcaattgcctgaggttgatcttttagatattgccaagcgcagccagtataaaagcatctctgctccagaaggtgtggtatcagccaatagtctcaacaaagtgaacagcgattttcattacctaacaaactttcgaaaactgactgccgaattgtttaatggttgttcactaagttccatgataaataaaatattaccctacaacggtttatttccccgactatattgggggaaggtaccaactagccaacttatagataaaattggagtagtggatgccgaattcattattatttccataaatgtcagtgataccagtaatccaaaacttaggtattacttccaaaaaagcttaaaaggtgtctttgaggtttgcaaaaaaccgacaaggttacataacaaaaagctcagtgttgtcgaaattttggctttaaccaaaagtatgcctgtaagaaatagagcagagctagtaacacttgaagctgaaatagcacaatgtgcgcccccagtgtgctaa

SEQ ID NO: 10330 - protein, 195 aa, Unknown
  Obtained from environmental sample
  misc_feature (1)..(195): Xaa is any amino acid
MGFVWLEKTLTTFKHKKGYEVHLHQLPEVDLLDIAKRSQYKSISAPEGVVSANSLNKVNSDFHYLTNFRKLTAELFNGCSLSSMINKILPYNGLFPRLYWGKVPTSQLIDKIGVVDAEFIIISINVSDTSNPKLRYYFQKSLKGVFEVCKKPTRLHNKKLSVVEILALTKSMPVRNRAELVTLEAEIAQCAPPVC

SEQ ID NO: 10331 - DNA, 321 bp, Unknown
  Obtained from environmental sample
  misc_feature (1)..(321): n is a, c, g, or t
ttgataataactatcaggcctaacgaaaatattccattgatgacctataaaaatgctctacttccgagcaaaaaatctcaatttactagcaagtatcattaccgtaaagtgctaaagtacctaggtttactgtcgaattgtaccgagtttcataaagtagctatgattaacctcatcataaaacgcatggacctgaaaggttacaattgtattagcacactgggggcgcacattgtgctatttcagcttcaagtgttactagctctgctctatttcttacaggcatacttttggttaaagccaaaatttcgacaacactga

SEQ ID NO: 10332 - protein, 106 aa, Unknown
  Obtained from environmental sample
  misc_feature (1)..(106): Xaa is any amino acid
MIITIRPNENIPLMTYKNALLPSKKSQFTSKYHYRKVLKYLGLLSNCTEFHKVAMINLIIKRMDLKGYNCISTLGAHIVLFQLQVLLALLYFLQAYFWLKPKFRQH

SEQ ID NO: 10333 - DNA, 615 bp, Unknown
  Obtained from environmental sample
  misc_feature (1)..(615): n is a, c, g, or t
gtgttatgtatattatatttatattttgaaggaatgttagagatgaatattttattactaagtaatgactatactataaaaagttatttagaaattggacaaaacaagttgaactactcttttgtaaattctaatcaaccgatggtagactatgaaaaaaacaattttgatattgtaattgtcgatatttcaactcataaaaaaaaccttcttcaaatactagaactaacccctaaacaaaaaataatagttatctctgacaacttagattgtattaacgaaattggatgtgatatttgtccagtaaaatataataaacatagacttttaaaacctattcaaattaatactcttcttgatttaattattgattttaatagccatgagtgtaaatatttacaaacagactgttttaaaaatattaaaccaatcctttcagatatcacaaagcgttttaacacctacgatttttgttctgatagcaatataatttataaaaaagaaaatgctcgttcaaatagttttgtattagatttattagaaattactggtatattagataatcataatacaaaatatgaaataatcaacggaagagatatacaaataatttaa

SEQ ID NO: 10334 - protein, 204 aa, Unknown
  Obtained from environmental sample
  misc_feature (1)..(204): Xaa is any amino acid
MLCILYLYFEGMLEMNILLLSNDYTIKSYLEIGQNKLNYSFVNSNQPMVDYEKNNFDIVIVDISTHKKNLLQILELTPKQKIIVISDNLDCINEIGCDICPVKYNKHRLLKPIQINTLLDLIIDFNSHECKYLQTDCFKNIKPILSDITKRFNTYDFCSDSNIIYKKENARSNSFVLDLLEITGILDNHNTKYEIINGRDIQII

SEQ ID NO: 10335 - DNA, 597 bp, Unknown
  Obtained from environmental sample
  misc_feature (1)..(597): n is a, c, g, or t
atgaaagaacatggagtattagatgatcaaagtttttttaaaaatttaaatcacatagaacatactgctcaatatctctctgaaactatagatatatttaaaaacttcctaaaagataaaaaagaatacaaagaggatatcttgcaaaatagagtaaataatgctttatgtattgtaaatgcaactttaacaaataattatatacaacttaaaaataacattgagaaagtagaatctttaaaagtaaaaataataacaggtgaactagaacaagttattataaacattataaataatgctaaagatgcaattttagaaaaaaaagtaaaagatccttggattgaaattaatttaaaaaaatgtaatggtttcgcaattttgacaatagaagataatgggcttggaattccagaagatgttttacccaaaatatttgaatcttatttcacaacaaaaaatgaagacaaaggtacagggcttggtcttcatatgagttttaaaattatcaaagaaagtttaaatggtaatatttatgctaaaaacagtcataagggtgcaattttttatattgaattaccattatctgaatctagctaa

SEQ ID NO: 10336 - protein, 198 aa, Unknown
  Obtained from environmental sample
  DOMAIN (84)...(195): Histidine kinase-, DNA gyrase B-, and HSP90-like ATPase
  misc_feature (1)..(198): Xaa is any amino acid
MKEHGVLDDQSFFKNLNHIEHTAQYLSETIDIFKNFLKDKKEYKEDILQNRVNNALCIVNATLTNNYIQLKNNIEKVESLKVKIITGELEQVIINIINNAKDAILEKKVKDPWIEINLKKCNGFAILTIEDNGLGIPEDVLPKIFESYFTTKNEDKGTGLGLHMSFKIIKESLNGNIYAKNSHKGAIFYIELPLSESS

SEQ ID NO: 10337 - DNA, 564 bp, Unknown
  Obtained from environmental sample
  misc_feature (1)..(564): n is a, c, g, or t
atgaatttatcaatattaaaatcatattctattatatttataatattagtattttgtacttctattgcttattacaccatgaatgcacttatagactcgcaaagttattatgcaaagttgattaatatgagtggtaaacaaagaatgttttctcaaaaaagtgcttttcttacatctaaatttattcaagacaatcaattaaattatattaaagaactcaaaaaaatcattaaagtttttgaaaaaaatcataaatatatagttaaaaatttatcatcagatgcaaaaaagttatattttggaaaaaatgatagtattgataagaatgtaatgaattatatagatttaattaattcttttttagaaaatcctactgaacaacaatcaaatataatttatgaaaaatcacaaataattttaatacaacttgatacagctgttaacctttttcaaaaagaaagcgaagataaaacaaaagaattacccagaagagaattatttattttaaattggaaccatcttaactatactttttgtagcacattttttttgcaaacccggtaa

SEQ ID NO: 10338 - protein, 187 aa, Unknown
  Obtained from environmental sample
  misc_feature (1)..(187): Xaa is any amino acid
MNLSILKSYSIIFIILVFCTSIAYYTMNALIDSQSYYAKLINMSGKQRMFSQKSAFLTSKFIQDNQLNYIKELKKIIKVFEKNHKYIVKNLSSDAKKLYFGKNDSIDKNVMNYIDLINSFLENPTEQQSNIIYEKSQIILIQLDTAVNLFQKESEDKTKELPRRELFILNWNHLNYTFCSTFFLQTR

SEQ ID NO: 10339 - DNA, 621 bp, Unknown
  Obtained from environmental sample
  misc_feature (1)..(621): n is a, c, g, or t
gtgatagtgattacaaggttgggcagcgatgaaggagtaagaaatgatttgttaaatggttacaaactaataaatgaaggaattaaattgtatgataaaaattgtattgtagtaaaatatgaagatattatagataatccaaataaagagattaaaaaaattactgaatacatagatgttgattttgaggaagacatgcttaattataaaagcaatataggtgttttaaaaggaaagctagttgaccctaaaagtattcactcccatgacacacctgttaaagattataaagaagaatggaaaaataagttagataccaatcaaaaaaaaatattggctaaaagttttattgagcatttggataaagatttaattgaaagtttaggatattcatacgatgaattaatcagtttttttaaagataaaaaattaaataataatcgttttaatgatgtaagttggaatgatttaatgtcgcctagtggtacaaggacagaattgcaaaaaaataggttgtatttaattaataggaagaataatgcggattatttttctattatgaaatttttagtgaagcatccaattagttttatacgcgtattaacaactttaaaaagttaa

SEQ ID NO: 10340 - protein, 206 aa, Unknown
  Obtained from environmental sample
  misc_feature (1)..(206): Xaa is any amino acid
MIVITRLGSDEGVRNDLLNGYKLINEGIKLYDKNCIVVKYEDIIDNPNKEIKKITEYIDVDFEEDMLNYKSNIGVLKGKLVDPKSIHSHDTPVKDYKEEWKNKLDTNQKKILAKSFIEHLDKDLIESLGYSYDELISFFKDKKLNNNRFNDVSWNDLMSPSGTRTELQKNRLYLINRKNNADYFSIMKFLVKHPISFIRVLTTLKS

SEQ ID NO: 10341 - DNA, 318 bp, Unknown
  Obtained from environmental sample
  misc_feature (1)..(318): n is a, c, g, or t
atgaaaaaactaaaaaaaatagtaaggctattaattcctcccattattatcaggttaataaaggttgtcatttctaaaaagaaacccaacaataacaataaaagtttaggtggatggtttggtaattataactcttgggaagatgcagaaagaaatagcttaggatatcatgaagacaacatacttaatgttgtgaagaatgctgttttaaaagttaaaataggagaagctgtttaccaaagagattctgttttattttccaaaaagaatactcatggccatttgctttcaaatttgtatgggtggctagaattaata

SEQ ID NO: 10342 - protein, 106 aa, Unknown
  Obtained from environmental sample
  misc_feature (1)..(106): Xaa is any amino acid
MKKLKKIVRLLIPPIIIRLIKVVISKKKPNNNNKSLGGWFGNYNSWEDAERNSLGYHEDNILNVVKNAVLKVKIGEAVYQRDSVLFSKKNTHGHLLSNLYGWLELI

SEQ ID NO: 10343 - DNA, 531 bp, Unknown
  Obtained from environmental sample
  misc_feature (1)..(531): n is a, c, g, or t
gtgaaatggtgttatgatattcttgaagatgataaatttgctgatcaaaaatacctagatacttggtgtgatgattataagaatgttttgataattaaaggagaagggttaggtgtagccccctggaatgtatctaaatacaaacttgaagaaataaatggacaactatattgcaattctcacaagcttgttttttaccactttcatggattaagatttattacaaaaaaaattataagaaacggattaaaagaatataaagtaacttctaataagttaattaaaaatgctatttataaaaaatatattttagaattatcaaagctacagactaaggtaccttttagagaaagaaatatccaaagaataaataatttaattgtatctaatgatatttttaaaaacttatcaaaagactcatattataatttctgtaatttatttcttttagaatttaacttttcattattaaataaaatcattagtaagttaaaaagaatatttataatttcgattttctttaattattaa

SEQ ID NO: 10344 - protein, 176 aa, Unknown
  Obtained from environmental sample
  misc_feature (1)..(176): Xaa is any amino acid
MKWCYDILEDDKFADQKYLDTWCDDYKNVLIIKGEGLGVAPWNVSKYKLEEINGQLYCNSHKLVFYHFHGLRFITKKIIRNGLKEYKVTSNKLIKNAIYKKYILELSKLQTKVPFRERNIQRINNLIVSNDIFKNLSKDSYYNFCNLFLLEFNFSLLNKIISKLKRIFIISIFFNY

SEQ ID NO: 10345 - DNA, 792 bp, Unknown
  Obtained from environmental sample
  misc_feature (1)..(792): n is a, c, g, or t
atgggagaattgggtataagtcaagccgttattcaacttaattccacagttatatctttatatatgttaattacccctattatcatatatagaaaaggttttaaacccgcaaaatattttattgctgcctggagtgtattccttcttggtgtttttgtatttgtactaaaagacatggaagttcttcctttcaacaacctaactcgatataccatgcaaataggttctgcaattgaaactatacttctttcttttgctctagcaaacagaataagtatcattcgaaaggaaaacgaacacctcataaaagaacaaaatgtaatcttagagcaaaaagtaaaagaacgtactgccgaattaaacaaagctattgaagatttaaaacaagctcaatcgcaattggtagaatctgagaaaatggcttctcttggtcagcttactgcaggaattgcccatgaaattaataatcctattaattttgtttcttcaaacgtatttccactaaagcaagatattgatgacctaaaaagtatcctaaataaatatgcagaaattaccgaaagtgttgacctgaaaagtaaactcaaagaagttaatgaacttaaagaagaactagattatgaagtgttactggaagaactcaataccatcattcatggtattgaagatggtgcaaaaagaactgccgaaaatgttagtggactaagaaacttttccagattagatgaaagcgaatcccaagtgctaatgttaacgattgcattaatacactttaaaaatcatcaaaactaa

SEQ ID NO: 10346 - protein, 263 aa, Unknown
  Obtained from environmental sample
  misc_feature (1)..(263): Xaa is any amino acid
MGELGISQAVIQLNSTVISLYMLITPIIIYRKGFKPAKYFIAAWSVFLLGVFVFVLKDMEVLPFNNLTRYTMQIGSAIETILLSFALANRISIIRKENEHLIKEQNVILEQKVKERTAELNKAIEDLKQAQSQLVESEKMASLGQLTAGIAHEINNPINFVSSNVFPLKQDIDDLKSILNKYAEITESVDLKSKLKEVNELKEELDYEVLLEELNTIIHGIEDGAKRTAENVSGLRNFSRLDESESQVLMLTIALIHFKNHQN

SEQ ID NO: 10347 - DNA, 696 bp, Unknown
  Obtained from environmental sample
  misc_feature (1)..(696): n is a, c, g, or t
atggtggccttaaaaagtttcttaaataaatatgcagaaattaccgaaagtgttgacctgaaaagtaaactcaaagaagttaatgaacttaaggaagaactagattatgaagtgttactggaagaactcaataccatcattcatggtattgaagatggtgcaaaaagaactgccgaaattgttagtggactaagaaacttttccagattagatgaaagcgaattccaaagtgctaatgttaacgattgcattaataccactttaaaaatcatccaaactaaattagcagatataaccgtaaaaacagaacttggagacattcctgctattgactgctatcctggaaaattaaatcaattcttcttaaacactatagacaatgctatatatgctgttaatgtagtaaaaacacctaattataaaggtgaaattacaattaaaacagcattggaaaacaaacatattgtggttacaataaaagacaacggtattggtatggatgaaaccactaagaataaaatttttgaaccttttttcaccactaaagatgttggtgaaggtactggtctaggtatgtctattgctcatggaattctcgaaatgcatcatgcaaaaattgaaattgaatcagaaattaacaaaggaacccaaataaaaatatttttacccttaactttaccaacatggaaagaataa

SEQ ID NO: 10348 - protein, 231 aa, Unknown
  Obtained from environmental sample
  DOMAIN (112)...(225): Histidine kinase-, DNA gyrase B-, and HSP90-like ATPase
  misc_feature (1)..(231): Xaa is any amino acid
MVALKSFLNKYAEITESVDLKSKLKEVNELKEELDYEVLLEELNTIIHGIEDGAKRTAEIVSGLRNFSRLDESEFQSANVNDCINTTLKIIQTKLADITVKTELGDIPAIDCYPGKLNQFFLNTIDNAIYAVNVVKTPNYKGEITIKTALENKHIVVTIKDNGIGMDETTKNKIFEPFFTTKDVGEGTGLGMSIAHGILEMHHAKIEIESEINKGTQIKIFLPLTLPTWKE

SEQ ID NO: 10349 - DNA, 420 bp, Unknown
  Obtained from environmental sample
  misc_feature (1)..(420): n is a, c, g, or t
atgatatttagtaaaaaacaagcaaaaatattaagtgatataatcctacaccgccgcgatgtacgagggaataacttcttatctaagaagattaaaaagaaagatataactgctatcttaagtgctggtattcatgcaccctcagtaggtttttctcagccttggaagtttatggttatagaagatgcaaagattaaaaataaaatctacaataactttaaaaaatcctatgaaaaaagcaaaaaacacttcaaagatagagaactttataactctttaaaactagaaggtattaaagaaacaccgctaaatatagcagtattttataaaaaacctacaaaanaggttttagggcaaacaggctctaaaagaatgggtgagtataggtgttgtttgtgctattcaaaatatgtgggctaa

SEQ ID NO: 10350 - protein, 139 aa, Unknown
  Obtained from environmental sample
  DOMAIN (15)...(134): Nitroreductase family
  misc_feature (1)..(139): Xaa is any amino acid
MIFSKKQAKILSDIILHRRDVRGNNFLSKKIKKKDITAILSAGIHAPSVGFSQPWKFMVIEDAKIKNKIYNNFKKSYEKSKKHFKDRELYNSLKLEGIKETPLNIAVFYKKPTKXVLGQTGSKRMGEYRCCLCYSKYVG

SEQ ID NO: 10351 - DNA, 678 bp, Unknown
  Obtained from environmental sample
  misc_feature (1)..(678): n is a, c, g, or t
ttgggggataagtatgtactaaagatttatgatgaacctcactataatatagaggatgaaataaagctgttaaatacaattagggaattaagtgttatacaatatgtagaacatattatactcaaagggtataaatgtatattttatgaacaaataattggtaatagtatatacaaaccagagataaaacatataaggcagactgccctctttcttaaggacttacatacaaaaacagctaaattagtatcaaataacactgctttatttgataaaaatagcctaaaagatgtattgtataaaaggggtataagtatattacaaaattatcttgagaatatagatatagaattaaaaaatgatggtattatccacggagacatttttcctgataatgtaaaatggaaagatgataagttaagtggtgtgtatgattttagtgaagcttgtaatggtgattttagatttgatttagctgtgatagcatcttcttggtgttttgatgataatatccctaactatgataaaattgatgccctactttgttcttatggattagatatgccaatagaggaatttaaagaatatataaaatatgctttggtatattatgctacaacaagatacttaaatagtagaaactataaagagttgatagatagattggaaaatatatga

SEQ ID NO: 10352 - protein, 225 aa, Unknown
  Obtained from environmental sample
  misc_feature (1)..(225): Xaa is any amino acid
MGDKYVLKIYDEPHYNIEDEIKLLNTIRELSVIQYVEHIILKGYKCIFYEQIIGNSIYKPEIKHIRQTALFLKDLHTKTAKLVSNNTALFDKNSLKDVLYKRGISILQNYLENIDIELKNDGIIHGDIFPDNVKWKDDKLSGVYDFSEACNGDFRFDLAVIASSWCFDDNIPNYDKIDALLCSYGLDMPIEEFKEYIKYALVYYATTRYLNSRNYKELIDRLENI

SEQ ID NO: 10353 - DNA, 786 bp, Unknown
  Obtained from environmental sample
  misc_feature (1)..(786): n is a, c, g, or t
ttgattttatatgaggagagctcatttaccctcgatattgatggggtgcactacagttgtcccccacaatcatatattataatccccagtggtacctggcatagtgaggtcaatagtggtggaaaaaaatctaaaagacgctggtgccattttagctggagctaccaagacagttactctcaacttccggtgatagcttttgcacctgcacttcctgattacgggcggtgtctattggcacctctctgtgtccccactgatattcttagtggggaaataactgattggaaaggttctattgtactctttgatcgccttaaggagttgatgcactcaaactctcccaaaaagtggagtatagccaacgctgtactaaaagaacttcttatcgaattgctctatgggcaaaacgaggggagtgagttgcaaacaaaagagaaaattctttctgtcgaaataccgttggcaaaaaaaatgcgacaaaaactcgatgtatcgataagccttggcaaaaatgataattcgatgaagtcaattttttctgatttcaattacgcctatgagtacctctctcgaaaatttaaagagacatatggtatctcacctctgcgctatttacactcaaagcaaatagggagggctcaaatattattgactaatagcgaaatgactattgctgaaataggccaccaggtaggttttgcatctgcggcatattttataaagatatttcgaagggcaatgaatatgacgccaggtgaatatagaaaaaagagtaacgggtaa

SEQ ID NO: 10354 - protein, 261 aa, Unknown
  Obtained from environmental sample
  DOMAIN (213)...(257): Bacterial regulatory helix-turn-helix proteins, AraC family
  misc_feature (1)..(261): Xaa is any amino acid
MILYEESSFTLDIDGVHYSCPPQSYIIIPSGTWHSEVNSGGKKSKRRWCHFSWSYQDSYSQLPVIAFAPALPDYGRCLLAPLCVPTDILSGEITDWKGSIVLFDRLKELMHSNSPKKWSIANAVLKELLIELLYGQNEGSELQTKEKILSVEIPLAKKMRQKLDVSISLGKNDNSMKSIFSDFNYAYEYLSRKFKETYGISPLRYLHSKQIGRAQILLTNSEMTIAEIGHQVGFASAAYFIKIFRRAMNMTPGEYRKKSNG

SEQ ID NO: 10355 - DNA, 678 bp, Unknown
  Obtained from environmental sample
  misc_feature (1)..(678): n is a, c, g, or t
atgactaaaaaagtaattgtattaagcttaattatactgttgttcataaatagttcttgcacaaaatacgatattgaagatgaacaacatattgataccaaggctttagctatagagaatattcaaactgatttaaatgtaatcaatataaaggctgatttagggttgctcgactcaatgatgaatcactgtgatgaaaacataaaaatagatgcactcttttcatattattctcagaaagaaagtttgatagaagacaaaaaaattgaacttaaaataaagggtagttccactgtgtattatcccctaaaaagcttgatggttaaatttaaaaaaaaggtaaagaattcatctactcctattttagaaatagacgaattgcttccttggcatagtattgatgaattgaaaaagataagcctgaggaattctggaaatgatttttatggcacgttaatcaaagatatctcatttactgatttggctattcaactgggtctcgatctggaattaagttatcaccaaccggttcatgtgtttctaaataactcatactatggccttctgaatattcgcaccgaaaaagatgacaatagtttgggaaagctgttgggtgtagataatgatgatgtaaacattctaaagatttcacatacaggagaaagacaagaaaactag

SEQ ID NO: 10356 - protein, 225 aa, Unknown
  Obtained from environmental sample
  SIGNAL (1)...(19)
  misc_feature (1)..(225): Xaa is any amino acid
MTKKVIVLSLIILLFINSSCTKYDIEDEQHIDTKALAIENIQTDLNVINIKADLGLLDSMMNHCDENIKIDALFSYYSQKESLIEDKKIELKIKGSSTVYYPLKSLMVKFKKKVKNSSTPILEIDELLPWHSIDELKKISLRNSGNDFYGTLIKDISFTDLAIQLGLDLELSYHQPVHVFLNNSYYGLLNIRTEKDDNSLGKLLGVDNDDVNILKISHTGERQEN

SEQ ID NO: 10357 - DNA, 798 bp, Unknown
  Obtained from environmental sample
  misc_feature (1)..(798): n is a, c, g, or t
ttgttagacaactctagaaaatctagtgctgttaaaactgatgctaacagagcattaaaatctttatcagatagtttaaaaggaaaatcaggtagattccgtcaaaacttattggggaaacgtgtagattattctgctcgttctgtaattgttgttggtccagatttgaaactacacgaatgtggtatccctaaagacatggctgctgaattatacaaaccatttatcatcagaaaattgattgaaagaggtattgtaaaaacagttaaatcagctaaaaaaatagttgataaaaaagagcctgttgtttgggatattttagaaaatatattaaaaggacatcctgtattacttaaccgtgcacctactttgcaccgtttaggtattcaggctttccaaccaaaattaattgaaggtaaagctattcgtttgcacccattagtatgtactgcatttaatgcggattttgatggtgaccaaatggcagttcatttacctttaggtaatgctgcaattttagaagctcagttattaatgttgtcttcgcataatattcttaatcctgcaaatggtactccagtaacacttccttctcaggatatggttcttgggttatattatataactaaagaaagaaaatctactaaagatcatccagtaaacggagaaggtaaaatgttctactctccagaagaagtaattattgctcttaatgaaggtaaacttaatgttcatgctaacattaaagtaaaaactactgatattgaaaacggagaaacagtattaaaaaccatttga

SEQ ID NO: 10358 - protein, 265 aa, Unknown
  Obtained from environmental sample
  DOMAIN (39)...(181): RNA polymerase Rpb1, domain 2
  misc_feature (1)..(265): Xaa is any amino acid
MLDNSRKSSAVKTDANRALKSLSDSLKGKSGRFRQNLLGKRVDYSARSVIVVGPDLKLHECGIPKDMAAELYKPFIIRKLIERGIVKTVKSAKKIVDKKEPVVWDILENILKGHPVLLNRAPTLHRLGIQAFQPKLIEGKAIRLHPLVCTAFNADFDGDQMAVHLPLGNAAILEAQLLMLSSHNILNPANGTPVTLPSQDMVLGLYYITKERKSTKDHPVNGEGKMFYSPEEVIIALNEGKLNVHANIKVKTTDIENGETVLKTI

SEQ ID NO: 10359 - DNA, 591 bp, Unknown
  Obtained from environmental sample
  misc_feature (1)..(591): n is a, c, g, or t
ttggagcaatcgctaaaaaaaaggtgcaaatgtttacaaatgggggtggtaaaagatgacaaggaatctataacaaacctacttaaaaatgcactaacaagtgctgatatagtggtaactactgtgggggttagtgttggggattatgattttgtaaaagatgttatcaaagaagatttacaatgtgaagtcctcttccaaggtgtagatatcaaaccggggcaacatatcttatttgccaaaaaagatgaaaagtttattataggacttccagggtttgcatactctagtactgtgacatttttactgtatgttttaccacttatttataaactcaaaggtgcagatgaaaaactcaatatagtagaagctatctgtgatgaaaactttcctaaaaaaggaaataaaactacttttacagcttgtaatgtagaatttaaagatggaaactatcatattgactttgatggaaagaaaagtggaagtagtgctattttgacaaatatgcttgaaaattgtggcttgttatttcaagaagctgatagtgacaatatctctacaggagatagagttaaggttattttactttaa

SEQ ID NO: 10360 - protein, 196 aa, Unknown
  Obtained from environmental sample
  DOMAIN (1)...(104): Probable molybdopterin binding domain
  misc_feature (1)..(196): Xaa is any amino acid
MEQSLKKRCKCLQMGVVKDDKESITNLLKNALTSADIVVTTVGVSVGDYDFVKDVIKEDLQCEVLFQGVDIKPGQHILFAKKDEKFIIGLPGFAYSSTVTFLLYVLPLIYKLKGADEKLNIVEAICDENFPKKGNKTTFTACNVEFKDGNYHIDFDGKKSGSSAILTNMLENCGLLFQEADSDNISTGDRVKVILL

SEQ ID NO: 10361 - DNA, 852 bp, Unknown
  Obtained from environmental sample
  misc_feature (1)..(852): n is a, c, g, or t
ttgactgaattattagagatatatccgtttataaaagatgcaaaagatagttttgaacaacagaataaaaatctaaacaaggtaacacttacaggtaagatcagctctctagatattgcggagaatctttttatatttattgaagagactatgaataattttattagtttaaaagataaatttattttaagtcttgtagaagagaacctcaaaaagagtaaaagtgaattaggctctaaagcccaagtagcaatagatattttgattcgtaacctttttgaaagaactgcagatgtgggctttttggctacagataatgtaattattgattttttaaataaaaaagtagaaaaaaaaaatattgtagatagattagtcgaatatacaaaaaagtacagtgtatacaatgagatagtgatattttatcctgatggaaaagtcgctacaaatatgaattcaaataatcagatcaaattctctaatgacccaataatagcacaatctttagcgactgatgaatatattgagcaatactcatatacagatatattcaagtcacaaaagcagactctggtttatgcacaaagaatagtagaaaaccgtgacattataggagtattgtgtttatgttttaagtttgatgatgaactcaatcttatctataaaaatcttataagtgattctcanaaggtgatattgttagaaaattctcaagtaattgcgacaaacagtaaaaactttgcctcattgggtagcacattgcaatnaaaaaataaaatatcatatcatctttataaaaaacatgtaggtatttgtgcaaaaacaagggttatcaaggttacagtgggctga

SEQ ID NO: 10362 - protein, 283 aa, Unknown
  Obtained from environmental sample
  misc_feature (1)..(283): Xaa is any amino acid
MTELLEIYPFIKDAKDSFEQQNKNLNKVTLTGKISSLDIAENLFIFIEETMNNFISLKDKFILSLVEENLKKSKSELGSKAQVAIDILIRNLFERTADVGFLATDNVIIDFLNKKVEKKNIVDRLVEYTKKYSVYNEIVIFYPDGKVATNMNSNNQIKFSNDPIIAQSLATDEYIEQYSYTDIFKSQKQTLVYAQRIVENRDIIGVLCLCFKFDDELNLIYKNLISDSXKVILLENSQVIATNSKNFASLGSTLQXKNKISYHLYKKHVGICAKTRVIKVTVG

SEQ ID NO: 10363 - DNA, 417 bp, Unknown
  Obtained from environmental sample
  misc_feature (1)..(417): n is a, c, g, or t
gtgctcggcaaatattgtcaggaggttagaatgcgcataagagtattggtggaaaatacaacccagtcagatcactaccagtgtgagcccgggttatctttgtatattgaaacaaaacagcataaaattttatttgatgttggaacgactgcgtctttcattgaaaatgcaaaaaaaatgaaaattgatttgaccaaagttgattctgtttttatctcccatggacataatgaccatggngggggattaggagcgtttttagaaatgaatcagaaggctaaaatatacatttccaagagagcttttggggagtattactctttccggaaaaatacaaaaaacgtatatatcggattaaatccgtctttatcaaataatgaacaagttatttttgtgtctggagacctgacccattga

SEQ ID NO: 10364 - protein, 138 aa, Unknown
  Obtained from environmental sample
  DOMAIN (30)...(138): Metallo-beta-lactamase superfamily
  misc_feature (1)..(138): Xaa is any amino acid
MLGKYCQEVRMRIRVLVENTTQSDHYQCEPGLSLYIETKQHKILFDVGTTASFIENAKKMKIDLTKVDSVFISHGHNDHGGGLGAFLEMNQKAKIYISKRAFGEYYSFRKNTKNVYIGLNPSLSNNEQVIFVSGDLTH

SEQ ID NO: 10365 - DNA, 795 bp, Unknown
  Obtained from environmental sample
  misc_feature (1)..(795): n is a, c, g, or t
atggcacttggtctagcttacccttttcatgatgtgttttatgtaaatggaggaatgggaagtttaatagagcagatagtaaaagatatagaagtgaaaaaaaatgaagagatcaaaaaaataatacaagatgggaaaaactatgtaattcaatcttctaaaaatgaatacaaaacaaaacaacttgttttgaactcctctatatatcaaagtgctaaactttttgaaaataaagagattcaaaactactacaaaagttttagttttagtgatcaaagtgcttttgttatctatcttactttggataaacaatatgattttttagagcattatcaatttatctataaagagtttttacctaactgtatctccaactctttttttgtctctttttcaaaaagtgatgatgaatttttaagtaaaaatggtacgagtgtaactatctcaacccacacaaaagcaaatttctggagatatttagctaattataatgaaataaaagaggaaacacaagagtttattataaagagatttttagagtattttacaagtttaaaaaaagaaaatatatccaaaattcatagtgctacctcctttacttttaatagatacataaatagatataattgtggtggaaaagcaataaagtttaaaaatatcaccgaattacctagttgtaatacaccatttgatggactttacaatgtgggtgatactgtttttgcaggtcaaggctggcctggagttgcacttggagttgatgtactaaataaggaactaaatggaaacagttga

SEQ ID NO: 10366 - protein, 264 aa, Unknown
  Obtained from environmental sample
  misc_feature (1)..(264): Xaa is any amino acid
MALGLAYPFHDVFYVNGGMGSLIEQIVKDIEVKKNEEIKKIIQDGKNYVIQSSKNEYKTKQLVLNSSIYQSAKLFENKEIQNYYKSFSFSDQSAFVIYLTLDKQYDFLEHYQFIYKEFLPNCISNSFFVSFSKSDDEFLSKNGTSVTISTHTKANFWRYLANYNEIKEETQEFIIKRFLEYFTSLKKENISKIHSATSFTFNRYINRYNCGGKAIKFKNITELPSCNTPFDGLYNVGDTVFAGQGWPGVALGVDVLNKELNGNS

SEQ ID NO: 10367 - DNA, 342 bp, Unknown
  Obtained from environmental sample
  misc_feature (1)..(342): n is a, c, g, or t
atgcctaaactacaaaagttgttttttattattggttttatgcttattttatctggatgtactcaaaaaaacaatatatcaaatgtggaaaaaaataaagaatctcttactcaaaaacaaaaaaagtgtaatcaacatataaaaattatgcagtatgcattgtcttatgttacaaaagaatttgagaagggatattttcatcaaaatgatttaataggtgctaaagcacaactatttttaattgaaaatagatcacccaatatatttgcacaaaatattaatgaagcacaaaaagcatacgatacagaatataatttagcacaaaaaataattgtgatatag

SEQ ID NO: 10368 - protein, 113 aa, Unknown
  Obtained from environmental sample
  misc_feature (1)..(113): Xaa is any amino acid
MPKLQKLFFIIGFMLILSGCTQKNNISNVEKNKESLTQKQKKCNQHIKIMQYALSYVTKEFEKGYFHQNDLIGAKAQLFLIENRSPNIFAQNINEAQKAYDTEYNLAQKIIVI

SEQ ID NO: 10369 - DNA, 639 bp, Unknown
  Obtained from environmental sample
  misc_feature (1)..(639): n is a, c, g, or t
atgaaagtagcatttattggacaaaaaggcattccaacactacaaggaggggtcgaaaggcacgtagaggaactatcagttcgcttggcttcacagggcgtcgaagctcttgtttatacacgaccacaatatgtagataaaaaattgaaaaaatataaaggagtaaacctggttagtttgccgactattgcatcaaaacatcttgatgcacttgtgcacactttcttggtctgtttaaatgtgagaaagcagaatgtggatgtaattcattttcattcgattggaccatctcttttgatttggttagctaagattttaaacccaagaacgccaattatagcaacatttcattctcaatgttatcgacataaaaaatggggttcttttgccacgatatcactaaaattgggcgaatcaatctgttgtgtgatgtcagatcatctaattgtcatttccagaaatttaaaagaaatagttttgaaaaaatacaaaagaattggagaatacatccctaatggagttccagaatacaaaaaaattggattaaaaaatgctaaaaagtgggggatttacgagaaagaatacattttatatgctggaagactagtgaaagcaaaggagctcatatctcagccataa

SEQ ID NO: 10370 - protein, 212 aa, Unknown
  Obtained from environmental sample
  misc_feature (1)..(212): Xaa is any amino acid
MKVAFIGQKGIPTLQGGVERHVEELSVRLASQGVEALVYTRPQYVDKKLKKYKGVNLVSLPTIASKHLDALVHTFLVCLNVRKQNVDVIHFHSIGPSLLIWLAKILNPRTPIIATFHSQCYRHKKWGSFATISLKLGESICCVMSDHLIVISRNLKEIVLKKYKRIGEYIPNGVPEYKKIGLKNAKKWGIYEKEYILYAGRLVKAKELISQP

SEQ ID NO: 10371 - DNA, 555 bp, Unknown
  Obtained from environmental sample
  misc_feature (1)..(555): n is a, c, g, or t
ttggatattttttatgaacaagggtggagtaagactactgtttctcagatagcttcagccgctggcgtaggaaaggggactgtttatctctactttaaatcaaaagaggagatagtcatagagatcatcaactatgtgatagaaaaacatattaaacacatagagacagttgatcaaaagggtactacaaacagagataaaattttgcactatttcaattttgaatcttttttggaagaagatatcagatctaaacttctaaaactgtttcaagagtacctcggagccattttgacttcaccggcgcagatgtatgtagataagtttcataacatcataggcagagatatagagcatattagtaaatatttaagtaatggtgtagttgatggtgagtttaaagaggtagatattgagacttctgctatgcttattgccagtactacaaaaggtattatcactatatctaaggctttgaatgaagaccattttgctacgcaaaagaagattcaaaagtctttaatactatttttagatctaataagaaaggattaa

SEQ ID NO: 10372 - protein, 184 aa, Unknown
  Obtained from environmental sample
  DOMAIN (1)...(42): Bacterial regulatory proteins, tetR family
  misc_feature (1)..(184): Xaa is any amino acid
MDIFYEQGWSKTTVSQIASAAGVGKGTVYLYFKSKEEIVIEIINYVIEKHIKHIETVDQKGTTNRDKILHYFNFESFLEEDIRSKLLKLFQEYLGAILTSPAQMYVDKFHNIIGRDIEHISKYLSNGVVDGEFKEVDIETSAMLIASTTKGIITISKALNEDHFATQKKIQKSLILFLDLIRKD

SEQ ID NO: 10373 - DNA, 312 bp, Unknown
  Obtained from environmental sample
  misc_feature (1)..(312): n is a, c, g, or t
atggctgataaaaaagtttgtgatgaatgcaccgagcacagtggagtggtagaaaggttgaatgctggcgataaaataatggagagatttgagaagtttatgaattatcaaaataaaagatcggaccatattttcattagtgttattttaattcttctcacatctctttcttcaatatttttagctttctatcttgatcaaaaaaagagcatatcactaaataaacccaagcatatagaacaaaaggctgaaatagccaaaatatataaggagaaaaaatgtcttatagaggatatacagacgaacaggtag

SEQ ID NO: 10374 - protein, 103 aa, Unknown
  Obtained from environmental sample
  misc_feature (1)..(103): Xaa is any amino acid
MADKKVCDECTEHSGVVERLNAGDKIMERFEKFMNYQNKRSDHIFISVILILLTSLSSIFLAFYLDQKKSISLNKPKHIEQKAEIAKIYKEKKCLIEDIQTNR

SEQ ID NO: 10375 - DNA, 321 bp, Unknown
  Obtained from environmental sample
  misc_feature (1)..(321): n is a, c, g, or t
atgaacttagtagaatatattaaaaaacaaaaacgatttggattaaaaacttttgggccaggggttggaacaagtgactttgatgcagggttgattgatcatatagaatcagaactgacagaaattaaagaatctccgggtgatctggaagaatggattgatgttattatacttgcccttgaaggttgttggagaaatggccataatccaaaacaaatagtagaatgccttgaatataaacaacaaaagaatatacatagaaaatggcctgattggaaaactgcagagccagggaaggcgatttttcacataaaagaatag

SEQ ID NO: 10376 - protein, 106 aa, Unknown
  Obtained from environmental sample
  misc_feature (1)..(106): Xaa is any amino acid
MNLVEYIKKQKRFGLKTFGPGVGTSDFDAGLIDHIESELTEIKESPGDLEEWIDVIILALEGCWRNGHNPKQIVECLEYKQQKNIHRKWPDWKTAEPGKAIFHIKE

SEQ ID NO: 10377 - DNA, 459 bp, Unknown
  Obtained from environmental sample
  misc_feature (1)..(459): n is a, c, g, or t
ttggttgatcagaatcaaactgatgtgaggattggtaaagatactaaaactaatttaaatcatttcaatgctctggtttattataatttatatgaacatggcttggaaacgtcagataccaggtttctttatttgcaatgccctgtcgtccgtaagaccttcgtaagtcgtattaagcctgcagaggataaaccaaataatggcaagagcaaattcgtatactatacagtagatactgaaactttgaagaaagaggtgatagatccagggttttataaatttctatctcttcctaacgacaatgtacccaaacttagtaatgatttccctatgtcaggtacagtcagcgaacactttgatatggaaatcatgtgtataaagatacgaattatctatgcttactatggtatagctgaagcacatagaagagctgttctgaaaaatttggaacttgattag

SEQ ID NO: 10378 - protein, 152 aa, Unknown
  Obtained from environmental sample
  misc_feature (1)..(152): Xaa is any amino acid
MVDQNQTDVRIGKDTKTNLNHFNALVYYNLYEHGLETSDTRFLYLQCPVVRKTFVSRIKPAEDKPNNGKSKFVYYTVDTETLKKEVIDPGFYKFLSLPNDNVPKLSNDFPMSGTVSEHFDMEIMCIKIRIIYAYYGIAEAHRRAVLKNLELD

SEQ ID NO: 10379 - DNA, 369 bp, Unknown
  Obtained from environmental sample
  misc_feature (1)..(369): n is a, c, g, or t
tctgttttttgtgatgttcgccgatgccataaacggctcgatggcgtagtaattgaaaattcgaattttaccgagattctcaaacgctacgaccgaaagcagacagttttcttttgtgatcctccatatctggatacagcccaataccagcaagtattcggatatgatcagcatcaactcctggccgagaagcttctggccataaaaggtaaattcctgctgactataaatgatcacaagaaaatcaggcagctatataaaggctgctcgatccgaaactataaaataaaatatacagtagctggcaaagatgccaaagattttggcgaacttataattgctaattatccgcttcccaggaagtggtaa

SEQ ID NO: 10380 - protein, 122 aa, Unknown
  Obtained from environmental sample
  misc_feature (1)..(122): Xaa is any amino acid
MVFCDVRRCHKRLDGVVIENSNFTEILKRYDRKQTVFFCDPPYLDTAQYQQVFGYDQHQLLAEKLLAIKGKFLLTINDHKKIRQLYKGCSIRNYKIKYTVAGKDAKDFGELIIANYPLPRKW

SEQ ID NO: 10381 - DNA, 627 bp, Unknown
  Obtained from environmental sample
  misc_feature (1)..(627): n is a, c, g, or t
atgcgtaatatacttttaaagcatagcaaaaacagtgcatatattttaaaagatgatgtactctcatttaagttaaataagagctcatcgatatctcatgaagatgaaacagggattaaatcatacgatagagagattctatcaaaaacacactttgacaagataaccgcaaaagagtatgtagatatgactgcaataggattcatggataagatagaatcactagaggttatagaagataaattagatatctctttaattgattttgagcaaaaaactacaactgaaaatttgaaaaatattacgaatctattttcagagtatatagaagtgattgaacaactcatcgagtttgagcatctatactatgctatagcaacacttgcagaatttttgaatcaattagaagagtctcaattagatgagatcaaggtgaaaaaatttataactttaactattagtcttatatcagatctaagtagttggagagtaaatctttttataaaacaagaggctaacgatattcactatcttgactcttctcttcttagttcatgtctacagatcgagtcaatttttcaagaagagaagataagcgaagatgaagataatttagaatttttctaa

SEQ ID NO: 10382 - protein, 208 aa, Unknown
  Obtained from environmental sample
  misc_feature (1)..(208): Xaa is any amino acid
MRNILLKHSKNSAYILKDDVLSFKLNKSSSISHEDETGIKSYDREILSKTHFDKITAKEYVDMTAIGFMDKIESLEVIEDKLDISLIDFEQKTTTENLKNITNLFSEYIEVIEQLIEFEHLYYAIATLAEFLNQLEESQLDEIKVKKFITLTISLISDLSSWRVNLFIKQEANDIHYLDSSLLSSCLQIESIFQEEKISEDEDNLEFF

SEQ ID NO: 10383 - DNA, 783 bp, Unknown
  Obtained from environmental sample
  misc_feature (1)..(783): n is a, c, g, or t
atgttcgccttagatactctttttgataataaatctgggtgcattaatactctagaagaacttgagcctataaaaaatagaaatagagtatctatctccatggaggtaggaagaaacatttttgaaattttagtcaatgatattccatatatcgatgatacagttgcaaaaatgtatacatttaataatattactttagtagagtatcaaaaattaaagataagacactataacgaaagattagaagattttattaaaaaacttaataagaataagtatgaaaacagagattctcttgttaaagatgatgaaaaaatcaaaagagttcttaactcaaaagagaaagaagttttaaaaagatctcgtgataatgtacaaattagctcagctgagtatagtcaagatatagatgcctatatattagaggagatagaagagctctctgaaatagagatagagataaatgagttaattagactattcaacaacgagaaaagtgttgactttttaggtgttatttctataaaattttttaaatatgcatctactgtttcactattgatagattttgaagatctctcttttgcaataaaatctttaggagatttactgcaaacaattaaagtagatgatcttgatgatacaaaatataaaaaaatagagttatatttgttaaatattttgcttgatctatcaaattggagacgaactatatttatcgatagaagagcgaatgatattcactatttagatagttcactatttagtacaatatgcaattga

SEQ ID NO: 10384 - protein, 260 aa, Unknown
  Obtained from environmental sample
  misc_feature (1)..(260): Xaa is any amino acid
MFALDTLFDNKSGCINTLEELEPIKNRNRVSISMEVGRNIFEILVNDIPYIDDTVAKMYTFNNITLVEYQKLKIRHYNERLEDFIKKLNKNKYENRDSLVKDDEKIKRVLNSKEKEVLKRSRDNVQISSAEYSQDIDAYILEEIEELSEIEIEINELIRLFNNEKSVDFLGVISIKFFKYASTVSLLIDFEDLSFAIKSLGDLLQTIKVDDLDDTKYKKIELYLLNILLDLSNWRRTIFIDRRANDIHYLDSSLFSTICN

SEQ ID NO: 10385 - DNA, 543 bp, Unknown; identical to SEQ ID NO: 9245
  Obtained from environmental sample
  misc_feature (1)..(543): n is a, c, g, or t

SEQ ID NO: 10386 - protein, 180 aa, Unknown; identical to SEQ ID NO: 9246
  Obtained from environmental sample
  DOMAIN (5)...(178): Protein of unknown function (DUF1234)
  misc_feature (1)..(180): Xaa is any amino acid

SEQ ID NO: 10387 - DNA, 795 bp, Unknown
  Obtained from environmental sample
  misc_feature (1)..(795): n is a, c, g, or t
ttggcctattttcatttaatcttcaatgtggcgaccagtttaatttttctcatgctgattactccattcacacgattggtcgatgtgatgatgggtgaggggaaaatggactttgagcggctggttttacccgtgtatgacaaggatgatgagtttgaacaagtgaaagaaaatttggatggcggtatgcataaactcttttgttttcttaaagaaaattacagtctggtcactttgagtatcgaaacaaattatcaaggtgtttatgatgcggcggacaagcgcattgactatgtcaactttgttaaaaaagagtacatgagttacttttcacgaattattacagccgtggacgaggaacatcagtccagagaattgatgagaattatcaatcaatatgattatctttttcagatacatgattcaattaacgatctatttcatagcaagaaggtgataaaggaaaagtttgttgatctgaaaagtgatgttctgactatggttagagagctgtcagggaaaacattaggtttatttggcgctattgacagctacctgtccacggctgaaaaatcagatataaagccgtcggctgctgagttgcaggaacacatcgacgaggtaaacaaagatttattgcgaatgtttgccgatccccttcgacatgatgtcggtgccctaaccaactttattacgtactcgcaaaggctaaaggacaagctgttgaatttttatgagagaaagaaagtttctggtgtgtctattgaaactggggtctctggaagtggtgtacca

SEQ ID NO: 10388 - protein, 265 aa, Unknown
  Obtained from environmental sample
  misc_feature (1)..(265): Xaa is any amino acid
MAYFHLIFNVATSLIFLMLITPFTRLVDVMMGEGKMDFERLVLPVYDKDDEFEQVKENLDGGMHKLFCFLKENYSLVTLSIETNYQGVYDAADKRIDYVNFVKKEYMSYFSRIITAVDEEHQSRELMRIINQYDYLFQIHDSINDLFHSKKVIKEKFVDLKSDVLTMVRELSGKTLGLFGAIDSYLSTAEKSDIKPSAAELQEHIDEVNKDLLRMFADPLRHDVGALTNFITYSQRLKDKLLNFYERKKVSGVSIETGVSGSGVP

SEQ ID NO: 10389 - DNA, 588 bp, Unknown
  Obtained from environmental sample
  misc_feature (1)..(588): n is a, c, g, or t
atgaaagtggattctttntatgatgggcaagaggctttagatactttatacgatgaaagttttgatttgttgcttcttgatgtgggcgttccctctttagatggttttagtgtattaaaaagtattaaagaggctaaaattgatattcctgcaatatttataacttcattgaacacaacggatgatttacaaaaaggttttgatgtgggttgtgatgattatataaaaaaaccttttgaactcaaagagttagagataagaataaatcatattaaaaagataaaacatatcgagtcttctgatactgtaaagatttatgaaaatatccaatatgacttttcaaatcataaaatcaaaaaagagaatgaaacaatagagttatctaataaagaagcaaaaatatttgagtattttataaaaaataaaaatagaattataagcacagaagagttggtatcaaatatttgggaatatgatgcaacaccatccaatgcaactataagaacttatatcaaaaatttacgaaagattttaaataatgatatgatagtaacagtaaaagggataggatatcgttttgagaactga

SEQ ID NO: 10390 - protein, 195 aa, Unknown
  Obtained from environmental sample
  DOMAIN (1)...(96): Response regulator receiver domain
  misc_feature (1)..(195): Xaa is any amino acid
MKVDSXYDGQEALDTLYDESFDLLLLDVGVPSLDGFSVLKSIKEAKIDIPAIFITSLNTTDDLQKGFDVGCDDYIKKPFELKELEIRINHIKKIKHIESSDTVKIYENIQYDFSNHKIKKENETIELSNKEAKIFEYFIKNKNRIISTEELVSNIWEYDATPSNATIRTYIKNLRKILNNDMIVTVKGIGYRFEN

SEQ ID NO: 10391 - DNA, 675 bp, Unknown
  Obtained from environmental sample
  misc_feature (1)..(675): n is a, c, g, or t
atgatgaaacaagcactagacaaaaaatgcaaaaacttgacaatactttttattgaggattatattccgttacaaaaaaaaatagcatctgttttaagtgattattttgaaaatgttgaaatagcttcagatggaaaagaaggtattgaaaagtataaaaagatttatgaaaaaaatggaaagttttatgatattgtcataacagattatgaaatgccaaaaattaatggtattgaattaatcaaaacagttaaaaagttaaatgataaacaaatttttattgttatatctgcgcatcaaaattctgaatatcttatagaatatataaatcttggaattgagtattttattccaaaaccaattggtccagataatttattaaatattttggataaagtaagtgacaaatttatatttaaaaataatgaactattttatctaaatgattctcttatatgggataaaaagaataaattattattttacaataatgaatcattaaaactatctaaatacgatctgttattatttgagatacttgtagatagttacggttcactttgcaatatagatagaatattaagccatttttatataaataatgaagatattcaacaagaaaatatacgaaacatggttgttcgtttacgaaagaaataccaaaagtacaattga

SEQ ID NO: 10392 - protein, 224 aa, Unknown
  Obtained from environmental sample
  DOMAIN (13)...(138): Response regulator receiver domain
  misc_feature (1)..(224): Xaa is any amino acid
MMKQALDKKCKNLTILFIEDYIPLQKKIASVLSDYFENVEIASDGKEGIEKYKKIYEKNGKFYDIVITDYEMPKINGIELIKTVKKLNDKQIFIVISAHQNSEYLIEYINLGIEYFIPKPIGPDNLLNILDKVSDKFIFKNNELFYLNDSLIWDKKNKLLFYNNESLKLSKYDLLLFEILVDSYGSLCNIDRILSHFYINNEDIQQENIRNMVVRLRKKYQKYN

SEQ ID NO: 10393 - DNA, 378 bp, Unknown
  Obtained from environmental sample
  misc_feature (1)..(378): n is a, c, g, or t
gtgctgccaaagataaaaggttttaaaaaagtagttctaaatggaaagttaaaagatagtgaatctgaaaatattttcattatggatgttaatagtgagttattagaaggtcttaatgatgtctattttaaaattactgacaaacaaacaaaacaagtgtacttaaatcataatacctgtttgtataatactattgaaaattttatatataaagttgatttagaactctcaggaaatgatgttttatgtagcgttagtgaagatagaaaacttgaagaaagtgctcaaggtcttatgataaaatcgaagttgagcgattccataaaaagtacatttttaaatatgaactctaaagctgttaagccttcagtaaaataa

SEQ ID NO: 10394 - protein, 125 aa, Unknown
  Obtained from environmental sample
  misc_feature (1)..(125): Xaa is any amino acid
MLPKIKGFKKVVLNGKLKDSESENIFIMDVNSELLEGLNDVYFKITDKQTKQVYLNHNTCLYNTIENFIYKVDLELSGNDVLCSVSEDRKLEESAQGLMIKSKLSDSIKSTFLNMNSKAVKPSVK

SEQ ID NO: 10395 - DNA, 675 bp, Unknown
  Obtained from environmental sample
  misc_feature (1)..(675): n is a, c, g, or t
atggaatttaataaagatcatttgatctatctcttgtctacgatagttattttactcttggggtatatagcgtttgaagagcctacagttaaagaggtagagaagatcaaatacaagacagtaactgaagaggagacagtctatgtagataaaatcatctatagagataaagagtgtgaaaaaaatattatagaagagaaaaagccctcagaagagcctctgcaagaagagataaaagagtataccatcgcttccacatctgatgttagtcgtagatatagcattactctgttttcacatgatgtgctgccaaagataaaaggttttaaaaaagtagttctaaatggaaagttaaaagatagtgaatctgaaaatattttcattatggatgttaatagtgagttattagaaggtcttaatgatgtctattttaaaattactgacaaacaaacaaaacaagtgtacttaaatcataatacctgtttgtataatactattgaaaattttatatataaagttgatttagaactctcaggaaatgatgttttatgtagcgttagtgaagatagaaaacttgaagaaagtgctcaaggtcttatgataaaatcgaaagtgagcgattccataaaaagtacatttttaaatatgaactctaaagctgttaagcctcagtaa

SEQ ID NO: 10396 - protein, 224 aa, Unknown
  Obtained from environmental sample
  misc_feature (1)..(224): Xaa is any amino acid
MEFNKDHLIYLLSTIVILLLGYIAFEEPTVKEVEKIKYKTVTEEETVYVDKIIYRDKECEKNIIEEKKPSEEPLQEEIKEYTIASTSDVSRRYSITLFSHDVLPKIKGFKKVVLNGKLKDSESENIFIMDVNSELLEGLNDVYFKITDKQTKQVYLNHNTCLYNTIENFIYKVDLELSGNDVLCSVSEDRKLEESAQGLMIKSKVSDSIKSTFLNMNSKAVKPQ

SEQ ID NO: 10397 - DNA, 669 bp, Unknown
  Obtained from environmental sample
  misc_feature (1)..(669): n is a, c, g, or t
ttggctcggatgctgacagtctttatcaatgttggtacccatagaaaaaatatggatctcaatgtttttgttcatacggtttttgttaatctcatgcttagaatactgcgattagagattccgcaaaaaagtgccaaacagatcatgaaatcttataatgaccaagccatctttgctaaaaccaaatcacgaagccttctcggaaacctcactactgttcttaaagatattgatgcaatggtggaatatcatgaagatattgctaaggcaaatgaattagaccttgtacgcttggaatacaaaacaaatgattcgccgagaacccttaatggcaaatatgtttggccgcttaaaattttctatggctgtatacgcaagatatgccctgaactgccaatgagaattcctttgccattggagaggtgctcaagacgagaacatgtagtaatgatgggaatattcaaaggcagagttcctgaaaagctgttgctcaagttagagggatcagttctcggtgcagaggttctgtttaactatatggaagtccaggcgttgctaaaagcggttaatggctcgcaacagcaatcttctggcatttctgacgaattatatgtcgatcttaatcgtatactcagtttcaagattcatgagtttgaaactgaagcttga

SEQ ID NO: 10398 - protein, 222 aa, Unknown
  Obtained from environmental sample
  misc_feature (1)..(222): Xaa is any amino acid
MARMLTVFINVGTHRKNMDLNVFVHTVFVNLMLRILRLEIPQKSAKQIMKSYNDQAIFAKTKSRSLLGNLTTVLKDIDAMVEYHEDIAKANELDLVRLEYKTNDSPRTLNGKYVWPLKIFYGCIRKICPELPMRIPLPLERCSRREHVVMMGIFKGRVPEKLLLKLEGSVLGAEVLFNYMEVQALLKAVNGSQQQSSGISDELYVDLNRILSFKIHEFETEA

SEQ ID NO: 10399 - DNA, 780 bp, Unknown
  Obtained from environmental sample
  misc_feature (1)..(780): n is a, c, g, or t
ttgaaggtacctgtcatagtttctagaggtaaaaattctggaccagttattttgctaaatgcaggaattcatgttgatgaggtaaatggagttgaaatagtcagacaaattattgctaaaaattatcataaaccaactaacggaacagtaatttgtattccggttttaaatgttttcggatttttacatcaacnaagagaatttccagatggacgtgatttaaatagggttttccctggttctaaagaaggctctttaggaagtaggtttgcttattttttcatgaaagaaattgttcctaaaattgattattgtattgattatcatacaggagcgagtaaacgatttaattatactcacattagaattgaaggtgttgataaagaaacgattgagttagctcaagtttttggagcaccttttattatgttgtctaaagtattgccaaaatcattaagaagtgaagcggcaaagaaaggggttaaggttttattgtttgaaggaggtaaagcactcgatttggatagagcagttacaaaagtgggcgttaccggagcattaaaagtgatgcataaaattgggttaagagatttttcaaaagaaattgccgcttacccgaaaactgaaaccattacgttggcagactcaagctggacgagagcgaggtattcaggcatgtttagaacctatgtaagtattggaagttatgttaaaaaaggtaccgttttaggcactatttctgatccttttggagagtttgaaaaaagaggtaatttctaa

SEQ ID NO: 10400 - protein, 259 aa, Unknown
  Obtained from environmental sample
  DOMAIN (13)...(259): Succinylglutamate desuccinylase / Aspartoacylase family
  misc_feature (1)..(259): Xaa is any amino acid
MKVPVIVSRGKNSGPVILLNAGIHVDEVNGVEIVRQIIAKNYHKPTNGTVICIPVLNVFGFLHQXREFPDGRDLNRVFPGSKEGSLGSRFAYFFMKEIVPKIDYCIDYHTGASKRFNYTHIRIEGVDKETIELAQVFGAPFIMLSKVLPKSLRSEAAKKGVKVLLFEGGKALDLDRAVTKVGVTGALKVMHKIGLRDFSKEIAAYPKTETITLADSSWTRARYSGMFRTYVSIGSYVKKGTVLGTISDPFGEFEKRGNF

SEQ ID NO: 10401 - DNA, 948 bp, Unknown
  Obtained from environmental sample
  misc_feature (1)..(948): n is a, c, g, or t
atgaccacacaggnatttatacgaagtagtaacctttgtacagagatattccaaaacacaaatccaaatcactatttagtaaaaatagaactagaagatggagagattctaacttatgaagaagatgatacagttactgtagatagtggtatggtaaaaaaagcaaacaaaatcacagcgcttgatagcttaaatggtaaaaaaatctttattgtagaaaaagagaaaattgatggagatacagctgtttgtaacttagctagtgtaaacttaagtaaaatcaatacaaatgaagatattcaaagagttcttcctacagcaattagaatgcttgacaatgtaattgacctaaacttctacccacttagaaaagtaaaagcaacaaatctaaaaacaagagcaataggtctgggagttatgggtgaatcacaaatggttgcagagtctggacttgtttggggaagtgatgatcaccttaaaaagatagattctatcatggaggcagtaagctacaatgctattagtgcctcagctgatttagcgcttgaaaaagggatatatcctacttatgagggttcaaaatggtcaaaagggattatgccaatggatcatgcaacaccagcagtaaatgcacttatccaaagagatctctttgatacaggatatgattgggatgccttaagggaaaaagtaaaaaaacaggggatgagaaatggttacctaatggcaatagctccaacatcatctatctcaattctcgttggtactacacaagcgattgagccagtctataaaagaaaatggtttgaagagaacttaagtggtcaaatccctgtagttgtcccaaacttatcctctgatacttggaatttctatacaccagcttatgaggtggaaccaaaagatatcctaaaaagcgctgccattagaccaaaatggatcgaccca

SEQ ID NO: 10402 - protein, 316 aa, Unknown
  Obtained from environmental sample
  DOMAIN (1)...(316): Ribonucleotide reductase, barrel domain
  misc_feature (1)..(316): Xaa is any amino acid
MTTQXFIRSSNLCTEIFQNTNPNHYLVKIELEDGEILTYEEDDTVTVDSGMVKKANKITALDSLNGKKIFIVEKEKIDGDTAVCNLASVNLSKINTNEDIQRVLPTAIRMLDNVIDLNFYPLRKVKATNLKTRAIGLGVMGESQMVAESGLVWGSDDHLKKIDSIMEAVSYNAISASADLALEKGIYPTYEGSKWSKGIMPMDHATPAVNALIQRDLFDTGYDWDALREKVKKQGMRNGYLMAIAPTSSISILVGTTQAIEPVYKRKWFEENLSGQIPVVVPNLSSDTWNFYTPAYEVEPKDILKSAAIRPKWIDP

SEQ ID NO: 10403 - DNA, 942 bp, Unknown
  Obtained from environmental sample
  misc_feature (1)..(942): n is a, c, g, or t
ttgataattttctgttttaatgacctttatggagaggaatttggagataaaatacttttaagttttacagaacaaattaaaaatacctttcaaaaattttataaaatttatcgagtaggttcagatagatttgttgtattgtgttcttgtgatgatgatattagttgtcagagtgattttaaagaattagcaaatcaattttctaatatcattgataaggatgggattaatgttgatgatacaaatatagatattaatatcactattggagttgctcaatcaaaagataaacatgcctttgaatatgcacaaagagctatgcaaaaagctcgaaagaagtatttacagattttagaatatgatgaatcattatttgaacaaaagaaagatattcaagaaaatatcacatggataaaaaagataaaaagtggaattgcagataatagtttccactctttcttgcaaccaatagttgatgctcaaactcaagagatttataaatatgaagcacttattagatacataggggaagatggtaaagaggtggctcctttttgtttcttacctattgcaaaaaaagctaaactatttccaataattataaaagtgatgcttacaaatgttatctctataattcaagaaaaaaatattcgagttgctattaatttatcttttgatgatattatcaataaagaaacacataattttatttttactactctagaagaacacccccaagaagcaaaactaatagagtttgagatactagaaagtgaagagattgaggattttgatatagtaagagaatttattgctaaaataagaaaatttgggtgtaaaataggtgttgatgattttggtgctggttattctaattttaatatgctagaagctttaaacattgactatgtaaaggatgatggctcctttattaagagataa

SEQ ID NO: 10404 - protein, 313 aa, Unknown
  Obtained from environmental sample
  DOMAIN (133)...(313): EAL domain
  misc_feature (1)..(313): Xaa is any amino acid
MIIFCFNDLYGEEFGDKILLSFTEQIKNTFQKFYKIYRVGSDRFVVLCSCDDDISCQSDFKELANQFSNIIDKDGINVDDTNIDINITIGVAQSKDKHAFEYAQRAMQKARKKYLQILEYDESLFEQKKDIQENITWIKKIKSGIADNSFHSFLQPIVDAQTQEIYKYEALIRYIGEDGKEVAPFCFLPIAKKAKLFPIIIKVMLTNVISIIQEKNIRVAINLSFDDIINKETHNFIFTTLEEHPQEAKLIEFEILESEEIEDFDIVREFIAKIRKFGCKIGVDDFGAGYSNFNMLEALNIDYVKDDGSFIKR

SEQ ID NO: 10405 - DNA, 336 bp, Unknown
  Obtained from environmental sample
  misc_feature (1)..(336): n is a, c, g, or t
atgataaatagtcttttgaataagggtgctatacttctaatatctggtcctagtggatgtgggaaaagttcccttttaaagaagctttatgcggtaatagataattattatttttctatctcaacaactacacgaagtccgagaattggtgaaactgacggagttgattatttttttgttacaaaagaggaatttgaacaagatattaaagataatagctttttagaatgggcagaagttcatggaaactattacggtacatctttaaagccaatttataaagcattggatgagggaaaacttgtaatatttgatattgatgttccagggttttga

SEQ ID NO: 10406 - protein, 111 aa, Unknown
  Obtained from environmental sample
  DOMAIN (44)...(110): Guanylate kinase
  misc_feature (1)..(111): Xaa is any amino acid
MINSLLNKGAILLISGPSGCGKSSLLKKLYAVIDNYYFSISTTTRSPRIGETDGVDYFFVTKEEFEQDIKDNSFLEWAEVHGNYYGTSLKPIYKALDEGKLVIFDIDVPGF

SEQ ID NO: 10407 - DNA, 645 bp, Unknown
  Obtained from environmental sample
  misc_feature (1)..(645): n is a, c, g, or t
gtgattattgtagacgcaaaagcgggaagtggtaaaacacttttagcacttagtggagctataaaaaaagtacgaagaaaacaataccaaaagataatctatgtaagaaattctatagagtcattggacaaaggtgaggatgtaggatatctccctggatatgaagaaaagtttgctatttataatcatcctttagtagatagtttaaactatatggtacgaagtgaacataagaaaaaatccaataataaacaaaaagctttcgaagaacttgatgaacaagaggtagttatgcgtgttcaaaatatgatggataactatagtattcaaactatgtgggtaggagagatgagaggaagaactctttccaatgcatttataatcatagatgaagctcaaaatatgtcaaataaaactatgcagatggttttaagtagaattgatagtagttgtaaagtggtgattttaggaagtaataatcaaatagataacttttatgtaaataaatatacaaatgccctaactacccttttaaaatcaacaaaaaataaaacagacttagtaaatagttttgcaatcaatcttgaaaaagttctaagaggtcctattactcagtgggctgaggatatatttacaaagaagtag

SEQ ID NO: 10408 - protein, 214 aa, Unknown
  Obtained from environmental sample
  DOMAIN (3)...(212): PhoH-like protein
  misc_feature (1)..(214): Xaa is any amino acid
MIIVDAKAGSGKTLLALSGAIKKVRRKQYQKIIYVRNSIESLDKGEDVGYLPGYEEKFAIYNHPLVDSLNYMVRSEHKKKSNNKQKAFEELDEQEVVMRVQNMMDNYSIQTMWVGEMRGRTLSNAFIIIDEAQNMSNKTMQMVLSRIDSSCKVVILGSNNQIDNFYVNKYTNALTTLLKSTKNKTDLVNSFAINLEKVLRGPITQWAEDIFTKK

SEQ ID NO: 10409 - DNA, 729 bp, Unknown
  Obtained from environmental sample
  misc_feature (1)..(729): n is a, c, g, or t
ttggatgaagtttgttcttcctggagtggacttgggtattattcaagggctagaaatctccataaaacagctcaaatttgccaaaacaaactaccagatagtatgggagaacttcaaaagcttcctgggattggaaaatataccgcaagtgcaatttgtagttttggatatcatcaagaggtatctgtagtagatacaaatattgctcgtgtattaaaacgatattttgctactttagatgtttcagatatagaagtttgggaaagtgcgaataaatttttgaatacaaaagaaccaacaaaacacaaccttgcccttatggatttaggttcaatagtttgtactcctacaaatcctttatgtgagaattgtcctttatctataagttgtttagggaaagaaaatccagaactgtacacacaaaaaaagaaaaaagcgtatgagtcattagaattattttacggcatctatggaaaagaagataagatagcccttgttaaaacaacaggaaaaatgtataaaggaatgttagagttacctactgttgatcctatagaggaaaattttattggacagtttaaacatagttatacaaaataccgattaagtgtaaagctttataaaatagataatttaagtgatgaagttatttggattgatttagataaaattgattcaacacctatctcatcattgacaaaaaaggcgttgaaaaattttttattgtaa

SEQ ID NO: 10410 - protein, 242 aa, Unknown
  Obtained from environmental sample
  DOMAIN (26)...(55): Helix-hairpin-helix motif
  misc_feature (1)..(242): Xaa is any amino acid
MDEVCSSWSGLGYYSRARNLHKTAQICQNKLPDSMGELQKLPGIGKYTASAICSFGYHQEVSVVDTNIARVLKRYFATLDVSDIEVWESANKFLNTKEPTKHNLALMDLGSIVCTPTNPLCENCPLSISCLGKENPELYTQKKKKAYESLELFYGIYGKEDKIALVKTTGKMYKGMLELPTVDPIEENFIGQFKHSYTKYRLSVKLYKIDNLSDEVIWIDLDKIDSTPISSLTKKALKNFLL

SEQ ID NO: 10411 - DNA, 483 bp, Unknown
  Obtained from environmental sample
  misc_feature (1)..(483): n is a, c, g, or t
gtgtatatccaatatagagataaaattaattctaatgaaactcaaaaacacaatattatattacttaaatcacttataaatatccctattattatcaacgataaattagaacttttagagtttgcagatggattgcatttaggacaagaagattttgatactcttaaaaataaagtgttaaaaataaaaaatgatgagttagttttgaaacttttacgaaaaaaatatccaaataaaatttttggactttcaactcataatgaattagagatactagaagctaataagttagatttagattatattggattgggtgcatatcgagccacttctacaaaagatgtatctaatatgttaggagaaaatatctcttatctagcaaaaatatcgaaacatccagttggtgcaataggtggagttaaaattgaagataatataccaaatatctcctataatgtaattggaagtggactcttaatataa

SEQ ID NO: 10412 - protein, 160 aa, Unknown
  Obtained from environmental sample
  DOMAIN (1)...(159): Thiamine monophosphate synthase/TENI
  misc_feature (1)..(160): Xaa is any amino acid
MYIQYRDKINSNETQKHNIILLKSLINIPIIINDKLELLEFADGLHLGQEDFDTLKNKVLKIKNDELVLKLLRKKYPNKIFGLSTHNELEILEANKLDLDYIGLGAYRATSTKDVSNMLGENISYLAKISKHPVGAIGGVKIEDNIPNISYNVIGSGLLI

SEQ ID NO: 10413 - DNA, 402 bp, Unknown
  Obtained from environmental sample
  misc_feature (1)..(402): n is a, c, g, or t
atgggtaatgcactaaatataattgctgaaatccaaatactaaaatggtattttttggtccatttaataaaaagcctttgtaatacgcctctaaataatagctcttccccaactgctggcaatatggcaaccaaaaaaaagataaaaaagaaatctatagggttatccattttagaaaaagatgaggttaataatatagcttcttcttcactntgcttcatccattcttcaatagcagacatatactcaggtaatattaattttgaatttatatctatggtaaaagataaaaaaggcattactaccaacataataagtacagttaatataatacttttaaagttagttgttgctttaataccaagttcaacaaaagggttttcgtatataagtttagcataa

SEQ ID NO: 10414 - protein, 133 aa, Unknown
  Obtained from environmental sample
  misc_feature (1)..(133): Xaa is any amino acid
MGNALNIIAEIQILKWYFLVHLIKSLCNTPLNNSSSPTAGNMATKKKIKKKSIGLSILEKDEVNNIASSSLCFIHSSIADIYSGNINFEFISMVKDKKGITTNIISTVNIILLKLVVALIPSSTKGFSYISLA

SEQ ID NO: 10415 - DNA, 753 bp, Unknown
  Obtained from environmental sample
  misc_feature (1)..(753): n is a, c, g, or t
atgatagatgtatgtgtggtaggtattggtgaatatgtcacaggattaagtggagataaaaaagcaaattctgataaaagtttaggggtgattgctttaagtttatttgacttaaaagagcaaggttttataaaaaatattaaactagctggtagagatggcgataaatttactactataaaagaacattttgataccaacatgaaagctttttatcctacactcaataccacatttgaaggttttccacaaaaaaacactcaaagtgatactgcctacaaagatgcaatagatagtttaaaaaaaggctcatgcgttctcatctttaccccagatgatacacactttgagatagcacagtatgcactaaaatctggaatgcacacacttgtagctaagccactagtgaaaacaacaaaagagcataaaaaacttcaaaaactagctacaaaaaacaatcttttattgatgttagaagttcataaaaggtttgatccaatctatgcagatgcgagagataatattagaacttttggtgatttttcctattttaatagctatatgtcacaaccaaaatcacaacttgatactttcgcttcttgggctgggataagtagtgatattagttactatcttaattctcatcatatagattttttatgttggacacttaaaggtattgcaaaaccaaaaagtgtgtatgctctagcttcaacaggtgttgcagacaaaaaacttcaaagaggaggttga

SEQ ID NO: 10416 - protein, 250 aa, Unknown
  Obtained from environmental sample
  DOMAIN (2)...(160): Oxidoreductase family, NAD-binding Rossmann fold
  misc_feature (1)..(250): Xaa is any amino acid
MIDVCVVGIGEYVTGLSGDKKANSDKSLGVIALSLFDLKEQGFIKNIKLAGRDGDKFTTIKEHFDTNMKAFYPTLNTTFEGFPQKNTQSDTAYKDAIDSLKKGSCVLIFTPDDTHFEIAQYALKSGMHTLVAKPLVKTTKEHKKLQKLATKNNLLLMLEVHKRFDPIYADARDNIRTFGDFSYFNSYMSQPKSQLDTFASWAGISSDISYYLNSHHIDFLCWTLKGIAKPKSVYALASTGVADKKLQRGG

SEQ ID NO: 10417 - DNA, 531 bp, Unknown
  Obtained from environmental sample
  misc_feature (1)..(531): n is a, c, g, or t
atgatgggatttttaaataccatattcaataaaataaaaagcgctgcaagggaaagatttatcctcaacaaagagacaaattcgatacaaatactacttgatagttcccatgaacaatattttacactcacctttgataatatgaatataaaaactttatacgatccaaatatctttagaagtactgtcatagatgcaaatagtttagatttaggagagctttacatagaggtgattgagctagattatcaacacgattggaatggaagtgcaggaggttgttttgatctttttatcaaacaagagtttcaaaaatcaaagtttgaatttgtaaaaagttttgatgatgattttggnaagtttactaaataccaagtgaatgataaatatgaggtaggattaatctggttttctttaaacaacaagatatttttatctttgatacaaaaggggaagctttttaatgacctactaaaaatatatgatgtaaaaaatagcttatattttatcaagaagctagattgtgtaagt

SEQ ID NO: 10418 - protein, 177 aa, Unknown
  Obtained from environmental sample
  misc_feature (1)..(177): Xaa is any amino acid
MMGFLNTIFNKIKSAARERFILNKETNSIQILLDSSHEQYFTLTFDNMNIKTLYDPNIFRSTVIDANSLDLGELYIEVIELDYQHDWNGSAGGCFDLFIKQEFQKSKFEFVKSFDDDFGKFTKYQVNDKYEVGLIWFSLNNKIFLSLIQKGKLFNDLLKIYDVKNSLYFIKKLDCVS

SEQ ID NO: 10419 - DNA, 720 bp, Unknown
  Obtained from environmental sample
  misc_feature (1)..(720): n is a, c, g, or t
gtgaaaatgcacacgctgatcgatcttcggggaacgatcccgacttatgtaacagtcacgactggcaaagttcatgatgtcaggatgctcgatgctttgcctgtcaccgaagatgcaatctacaccatggatcgggcttacattgatttttcccgactgcatgcgcttcaccagcagggtgctttctttgtcgtcagagcaaaagacaacttgcgattcagacggttgtattctgcaccaaaggacaagagttctggtatcagagccgatcaaaccgttgccctggtgacctacaaatcgaaaaaagactacccggagaaattacgccgggtcagttatgttgacaaagaacgcggtaagcggctggtatttttaaccaacaacttcacgattccagcactcaccgttgctgagatttacaagcaacgctggcaagttgagctttttttcaaatgggtcaaacaacatttgcggatcaagtcgttttacggaacatcgatcaacgcagtgaagagtcagatctggattgctttgagcatctatctactggttgtgattgccaagaagaagctcaacatcccgtgtcagctctacacttatttacagattctggaggtcaatttgttcgagaaaaagcccatcccatcaatggttgcggacgctcttaaacaaatatccaaccctccaagagataaccagttgaatttattcaactgttaa

SEQ ID NO: 10420 - protein, 239 aa, Unknown
  Obtained from environmental sample
  DOMAIN (1)...(183): Transposase DDE domain
  misc_feature (1)..(239): Xaa is any amino acid
MKMHTLIDLRGTIPTYVTVTTGKVHDVRMLDALPVTEDAIYTMDRAYIDFSRLHALHQQGAFFVVRAKDNLRFRRLYSAPKDKSSGIRADQTVALVTYKSKKDYPEKLRRVSYVDKERGKRLVFLTNNFTIPALTVAEIYKQRWQVELFFKWVKQHLRIKSFYGTSINAVKSQIWIALSIYLLVVIAKKKLNIPCQLYTYLQILEVNLFEKKPIPSMVADALKQISNPPRDNQLNLFNC

SEQ ID NO: 10421 - DNA, 417 bp, Unknown
  Obtained from environmental sample
  misc_feature (1)..(417): n is a, c, g, or t
atggtttgcagtttgtttaatgaagaaaaaaaagcatgggaatatcaagaagacaatataggtaaaactatttactctaaaaatgataaatcaaaattaaaagttgattatttaggtttattaaaagaggaacatactcttttagtacctaaagaatttgataagtgggatgaagagacaaagagttggattgaaaatagtgttgaaaaagagaaaaacagaattgtaaatattaaagaagaagctgggaagattatactagaaagatacccattattcaaacaaactaatgcacaacttctaatatatgggcaagagtatttagatgatatgatagcttttattacagatattaaatctcaatcagatgatttagaattagatgcaacaaaaacaaaagatgattttgtaatatag

SEQ ID NO: 10422 - protein, 138 aa, Unknown
  Obtained from environmental sample
  misc_feature (1)..(138): Xaa is any amino acid
MVCSLFNEEKKAWEYQEDNIGKTIYSKNDKSKLKVDYLGLLKEEHTLLVPKEFDKWDEETKSWIENSVEKEKNRIVNIKEEAGKIILERYPLFKQTNAQLLIYGQEYLDDMIAFITDIKSQSDDLELDATKTKDDFVI

SEQ ID NO: 10423 - DNA, 540 bp, Unknown
  Obtained from environmental sample
  misc_feature (1)..(540): n is a, c, g, or t
atgaaagaaaaattttataaatacttaaaagagttttgtgagtatttattggatttaaaaaactattctcaacttacagtcaaaacatataatacccctatagcagaagctataaaaatcagtgaaatatatgaagaaaatggcaaaataatttttgatataacaaaatttagaatccaaattgcctctttaaatccaaaaacaatcaataaaaaaatatcaagtatcaatagttttataaaatatttagaatcaaaaaatatagctataaagcttgttggaaataatactattaaatcaccacaaactcttccaaaaccaatacaaacaaaaaatatttttgaaagtttagaagaggcaactatccaagaaaaactcatcatcgtatttatatactcttttggactgcgtatttcagaactagcttcgttaaagttagaagatattaaaactacttctatacaagttacaggaaaagggaataaacaaagagagataccagctactaatattattcaagtattattacaagagtattag

SEQ ID NO: 10424 - protein, 179 aa, Unknown
  Obtained from environmental sample
  misc_feature (1)..(179): Xaa is any amino acid
MKEKFYKYLKEFCEYLLDLKNYSQLTVKTYNTPIAEAIKISEIYEENGKIIFDITKFRIQIASLNPKTINKKISSINSFIKYLESKNIAIKLVGNNTIKSPQTLPKPIQTKNIFESLEEATIQEKLIIVFIYSFGLRISELASLKLEDIKTTSIQVTGKGNKQREIPATNIIQVLLQEY

SEQ ID NO: 10425 - DNA, 441 bp, Unknown
  Obtained from environmental sample
  misc_feature (1)..(441): n is a, c, g, or t
atgatcagaccagcccaaataaatgaatatgacgccctaacccaaatttccttcaaatcgaaaggatattggaattatccaaagcactatttcgatatctgggaaaaagagctgactattagtccagagtatatcaagaaaaacacggtttttgttatagaaaaagatggtttaccaattggtttttattcaatcctcaaccttgaaactgatgttaaaatttcagatattcttattccaaaaggctattggctggaccacatgttcattttacctgaatttatcggaaaaggtttcgggaaaatgttgttcaggcatctaaaagaaacatctcaggaattaaaaattgaggtcttgaacattttagcagatccaaattcaaaaaaattctatgaaaaaatggggtgtatatatataaaaggagtatccctcaactattga

SEQ ID NO: 10426 - protein, 146 aa, Unknown
  Obtained from environmental sample
  DOMAIN (51)...(137): Acetyltransferase (GNAT) family
  misc_feature (1)..(146): Xaa is any amino acid
MIRPAQINEYDALTQISFKSKGYWNYPKHYFDIWEKELTISPEYIKKNTVFVIEKDGLPIGFYSILNLETDVKISDILIPKGYWLDHMFILPEFIGKGFGKMLFRHLKETSQELKIEVLNILADPNSKKFYEKMGCIYIKGVSLNY

SEQ ID NO: 10427 - DNA, 831 bp, Unknown
  Obtained from environmental sample
  misc_feature (1)..(831): n is a, c, g, or t
atgttttttctttttgtacttattacgataagttctttttttactatctatattacggtagtacaaatagaaaaaagcaatattgcgtcaactactaagtatctaggtatgctgaatgattcaatctttcaaagcttacgaagtgcaatgaatacaggtgacccaatacaaatagcaaaagccgcttctaatgcgagaacaatagagggtgtaaaatctctaaatgtagccaaaggtaaagccttgattgagctttattctccagaaactatttatacaaaagacaaagatattcttaatgctttttttacaaagcaaacagatgtaatagaatacaatgacaaatctcatgatataagaatgttaaaacctatgatagctacacaagagtgtcttatgtgtcatgcaaatcaaaaagagggagatgttattggtgttatagatttaactttttcacttgaagactccgatagccaacttttagatattctatttaaagtttttgttatctcaactattttgggatggatcacccttataattatatgtattattttaagaaaaagtacacaaccaatagagaaacttcatgatgcaattaaaagtttaaaaaaacagaaaaatggaaacaatactattgatatcgtatcaagtgatgagataggtgaagttgctaaagaattcaatgagtatatagaatctatcaataaaggtttagaagaagatagagttcttatagatgaagcaaaaattgttatcagcaaaattacccatggatggtattcacaaactatacaagtacaaacttcaaataaaagcttgaagagttaa

SEQ ID NO: 10428 - protein, 276 aa, Unknown
  Obtained from environmental sample
  DOMAIN (168)...(237): HAMP domain
  misc_feature (1)..(276): Xaa is any amino acid
MFFLFVLITISSFFTIYITVVQIEKSNIASTTKYLGMLNDSIFQSLRSAMNTGDPIQIAKAASNARTIEGVKSLNVAKGKALIELYSPETIYTKDKDILNAFFTKQTDVIEYNDKSHDIRMLKPMIATQECLMCHANQKEGDVIGVIDLTFSLEDSDSQLLDILFKVFVISTILGWITLIIICIILRKSTQPIEKLHDAIKSLKKQKNGNNTIDIVSSDEIGEVAKEFNEYIESINKGLEEDRVLIDEAKIVISKITHGWYSQTIQVQTSNKSLKS

SEQ ID NO: 10429 - DNA, 681 bp, Unknown
  Obtained from environmental sample
  misc_feature (1)..(681): n is a, c, g, or t
atgtatgaaaacttacagtttatacttgatttcgcaattaatcaagaagaaatttcttttagcttagatgattcaaaatataaaaatattaatgctattttaatgaaaatcggtacacatacagatcatataattttatataaacatcattatccgattaatgtcttaaaaaaacaatctactatcaatatttttaaagaaggtgatacatttaaagagatcattgatgatatttttaaaattgatataaattttgatctaatacttgttggagagcatttaataataaataagttaaaaactttagaaagcaagcttggttatactgatgtaatttatgcaaaagcatataaaaacattgaaataattaacacattaaacttcatagaaaatttagatattttgaaagaagctattaaaacaaatagcttggcaaaaaaattaaacaaagtacaaaattcacccgttatcaatattattcaaaatgatatagacagggttattaagtttattcaaggacacccaacgcttaaacaaattaaatttaatggtgataataagctaaagctagatagcaaggtatctgtagaaagatttttaaaattattagatgatgattatttatattctcaattgacagatatgctttatgatacaaatagtaaagatactttaaaataa

SEQ ID NO: 10430 - protein, 226 aa, Unknown
  Obtained from environmental sample
  misc_feature (1)..(226): Xaa is any amino acid
MYENLQFILDFAINQEEISFSLDDSKYKNINAILMKIGTHTDHIILYKHHYPINVLKKQSTINIFKEGDTFKEIIDDIFKIDINFDLILVGEHLIINKLKTLESKLGYTDVIYAKAYKNIEIINTLNFIENLDILKEAIKTNSLAKKLNKVQNSPVINIIQNDIDRVIKFIQGHPTLKQIKFNGDNKLKLDSKVSVERFLKLLDDDYLYSQLTDMLYDTNSKDTLK

SEQ ID NO: 10431 - DNA, 720 bp, Unknown
  Obtained from environmental sample
  misc_feature (1)..(720): n is a, c, g, or t
atgtattgggctagtcgtagatgttttcattttatttgtgtttctcaaaataccaaaaaagatttattaaatattttccctaaaatcgatccaaaaaaaataactgttatatatgaagctgctgaagataagtttaataatttcttaaagttatctaaaaaagatcaaagtaaaaaaattgaaaaaattcaaaaacaatatggtttgaaaaactttattttagctcaaggaactagagaaccacgaaagaatttagatcgtttaattgaagcctttattttatttaaaaaagaccatccaaaaaataaaactgaattagctatcactggtaaatatggttggggagaagatgttaaaagtaaacatcctaatgttaaggttcttggttttatccctgaaaaagatatggttgctcttcatgctagtgccttagttttggcttatacctcactctatgaaggttttggtcttccattaattaaatcttttaaaactgccactcctgttattactagtaacaactcttcacttgctgaaatagcaaagaattctgctctcttagttaacccaagatctgttcaagatatttctaaagctattgaaaaaattgttagatatccaaaacttagaaaaaaactagttgataaagctatcgaaaaatcaaaaagttttacttggactaaaactgctcaacaaactcttaaaatttataactgttaa

SEQ ID NO: 10432 - protein, 239 aa, Unknown
  Obtained from environmental sample
  DOMAIN (60)...(220): Glycosyl transferases group 1
  misc_feature (1)..(239): Xaa is any amino acid
MYWASRRCFHFICVSQNTKKDLLNIFPKIDPKKITVIYEAAEDKFNNFLKLSKKDQSKKIEKIQKQYGLKNFILAQGTREPRKNLDRLIEAFILFKKDHPKNKTELAITGKYGWGEDVKSKHPNVKVLGFIPEKDMVALHASALVLAYTSLYEGFGLPLIKSFKTATPVITSNNSSLAEIAKNSALLVNPRSVQDISKAIEKIVRYPKLRKKLVDKAIEKSKSFTWTKTAQQTLKIYNC

SEQ ID NO: 10433 - DNA, 759 bp, Unknown
  Obtained from environmental sample
  misc_feature (1)..(759): n is a, c, g, or t
atggggtataaggttgctttaatagatttagacccacaatgcaatttatccaaactagcactaggacctacttttgaagaaaatttattttcaattaatcaacaaactatatatacagttttagaaggcataataaaaggcggtagtgatattgacacaaaagtactctttgaatcaattaataaaaatttatcaattttaccaggcagtttactactatctgaatatgaaaattctcttatatcagcctatggtgatgctgctcaaggtgtcgaaagaggattttttacaaccagtgctattgatagattcttaacagaaaaagggttagaaaatgaaattgatctttttataatagatacttctccaaacttaaatttattaaatagaataatatttttaggttctgattatttcataacccctttaatgccagatgcattctctgttcaaggaatagaaaatttaggtacaacttttgaaaaatggaaagacaattggaaaaaaacagctaaagttttagcaagagataaacaaatttctcataataaagtattagacggcgaaggtttatttattggatatatcattaactcatataatcaatactcaaaaaaaccaataaaaagtaatgaagagtggattaaaaaagtaccaactttcataaaaacgtatctatcagaaaaacattgtagaaatggtttagtggaaacatctggaaaaaagaaattcataattaagatatctgagccgatctga

SEQ ID NO: 10434 - protein, 252 aa, Unknown
  Obtained from environmental sample
  DOMAIN (2)...(193): CobQ/CobB/MinD/ParA nucleotide binding domain
  misc_feature (1)..(252): Xaa is any amino acid
MGYKVALIDLDPQCNLSKLALGPTFEENLFSINQQTIYTVLEGIIKGGSDIDTKVLFESINKNLSILPGSLLLSEYENSLISAYGDAAQGVERGFFTTSAIDRFLTEKGLENEIDLFIIDTSPNLNLLNRIIFLGSDYFITPLMPDAFSVQGIENLGTTFEKWKDNWKKTAKVLARDKQISHNKVLDGEGLFIGYIINSYNQYSKKPIKSNEEWIKKVPTFIKTYLSEKHCRNGLVETSGKKKFIIKISEPI

SEQ ID NO: 10435 - DNA, 675 bp, Unknown
  Obtained from environmental sample
  misc_feature (1)..(675): n is a, c, g, or t
atgtcaggtgatattgcaatttcaaggatagaaaaagagcaacatctatattctgctagacctcgagaaatcacattaatttctcatgctggagtacctttattagaaaaagaaattatagattttttaaaatcaaacaaggttatggttgtagtagatgaggcacatagaattaaaaatgcaaatggaatttggggtaatagtgtagttgaaatttcaaaagaagcaacatcaagaatcatattaacaggaacacctgtaccaaatggatatgaagatatattcaatttatacagatttttatacccttttaaatataaagatattttacaaatacattatgatcaactaaaagagatgacaaagaattcactctcttttgaagatgaaagggtaaaaacttttattcaaaatatttcaccatattttataagaattaagaaaaaagatttaaaagatagattacctttaactactactgaaaatattttagaagttgagatggatgactaccagaaagagatttatgaatttatagaagacaaatacattaaaacatttcaacataattcatctgggacaattcaagatgtactgaataaagcaaaactaatacgtttacgccaagcttcaactaacccatctttacttattaagccattaaaagactcatag

SEQ ID NO: 10436 - protein, 224 aa, Unknown
  Obtained from environmental sample
  DOMAIN (7)...(217): SNF2 family N-terminal domain
  misc_feature (1)..(224): Xaa is any amino acid
MSGDIAISRIEKEQHLYSARPREITLISHAGVPLLEKEIIDFLKSNKVMVVVDEAHRIKNANGIWGNSVVEISKEATSRIILTGTPVPNGYEDIFNLYRFLYPFKYKDILQIHYDQLKEMTKNSLSFEDERVKTFIQNISPYFIRIKKKDLKDRLPLTTTENILEVEMDDYQKEIYEFIEDKYIKTFQHNSSGTIQDVLNKAKLIRLRQASTNPSLLIKPLKDS

SEQ ID NO: 10437 - DNA, 924 bp, Unknown
  Obtained from environmental sample
  misc_feature (1)..(924): n is a, c, g, or t
atgagtaataaagaagacttcaatttagttgctaaattattatgggagtcaagtaaatcaagaaacaatcaaacaataaaagatattaatcataaaggacaattaaaaactggaataattactacagatggtgtaataatagatggtaatagacgtgccatgcttttaaataaattagataaaaaagtttttagagccattgtattgccaatatcatttgatgagaaccctttgaaaatagaagaattagaaactacttatcaaatgggtgaagatgaaaagcttggatataaccctatagaaaagtacttaaaagcacagcaactatttaacaaactaattgaaaaatacacagaagacgaagcaattgataaaattaaagattggatgggagagtcaaaagaaaagataaaagactatcttaaaattgtagagttaattgatgaatatttagcataccttgaatatgatggaatatatgctatggctgatacacctagtgatggtaaagaagacctatttttacatctaaaaaaatggatactgaaatattttgataaacaaagttcagatggatttgatggatatactaattttgatgtagaagaattaaaattcatatgttttgattacattagagcgaaaattggaagatcctacgatggtaaactatttagggaaattgctgatggaagaaaagggaatcatttttttggtgacaaagagatttggaaagagtttaaagaaaaacataataatattgtaacttctcatattaaaagaattgatactgaaatgcctatagattctagttcaaaaaatattgaaagtcatttatcctcaagagatactgaatttaagaattctgttattgacgaattagaagataacatagctcaatataaaacagaactttgttataaa

SEQ ID NO: 10438 - protein, 308 aa, Unknown
  Obtained from environmental sample
  misc_feature (1)..(308): Xaa is any amino acid
MSNKEDFNLVAKLLWESSKSRNNQTIKDINHKGQLKTGIITTDGVIIDGNRRAMLLNKLDKKVFRAIVLPISFDENPLKIEELETTYQMGEDEKLGYNPIEKYLKAQQLFNKLIEKYTEDEAIDKIKDWMGESKEKIKDYLKIVELIDEYLAYLEYDGIYAMADTPSDGKEDLFLHLKKWILKYFDKQSSDGFDGYTNFDVEELKFICFDYIRAKIGRSYDGKLFREIADGRKGNHFFGDKEIWKEFKEKHNNIVTSHIKRIDTEMPIDSSSKNIESHLSSRDTEFKNSVIDELEDNIAQYKTELCYK

SEQ ID NO: 10439 - DNA, 759 bp, Unknown
  Obtained from environmental sample
  misc_feature (1)..(759): n is a, c, g, or t
atgaaaaaagatgaagagaacaactatatacaaagtagttttatggatcatgataaaaaagctgggatgttactaggtaccacagcaattagtgataataacacctttaacaaagctatttttaatatagctagaaaaattgatgatgaaaagatacttgaaacatttatgtatgatatgacagggactaagtggagtgacaaacttatggcttatccagaatttcaagagattgactattcaaaaaaagatgtaaaagaatatttagcagacaaattagcaagttatcaaattaaactagatacagcaacagataaagaatcaaaagaattttatcaagatatgattaatcgtttgcaaggattaacaaaccattacaaatctctacaaggggaaagtatccatgacaatacagacccatttgagagaatccgagctttagttaaagatttaatctctgtaataaaaactggctttacacttgaagaacttgaatatattgaaaaacttattgaagagattcgtaaacttcttaaagaaagagcagatgctgataaggcaacttctaatgaagatatagacaaacagataaaagccatagaagatgctcttttagcactagagaaaagaatacatggagtagctatcatagagatggatggtnggaacacgcaacaccaagaaacaatgatagcgatattccaccagaagatgggtttcattttgaagagagacttnatgcaattgaaaaaagaatga

SEQ ID NO: 10440 - protein, 252 aa, Unknown
  Obtained from environmental sample
  misc_feature (1)..(252): Xaa is any amino acid
MKKDEENNYIQSSFMDHDKKAGMLLGTTAISDNNTFNKAIFNIARKIDDEKILETFMYDMTGTKWSDKLMAYPEFQEIDYSKKDVKEYLADKLASYQIKLDTATDKESKEFYQDMINRLQGLTNHYKSLQGESIHDNTDPFERIRALVKDLISVIKTGFTLEELEYIEKLIEEIRKLLKERADADKATSNEDIDKQIKAIEDALLALEKRIHGVAIIEMDGXNTQHQETMIAIFHQKMGFILKRDXMQLKKE

SEQ ID NO: 10441 - DNA, 453 bp, Unknown
  Obtained from environmental sample
  misc_feature (1)..(453): n is a, c, g, or t
atgaaaagaacttttctaacaattacagcagcagcattcattctagttggatgcaacaattctgaaaaagcagaaaatactgaaaatcaacctacagaaaaagcagagcaagaagtggaagaatctgaagatattaaagaagttaaagaagaaatgacaacggaacagcttgttctaggtgattgggcttatgagtatgaaattgaaggtgataacatagaggttttacttacattaagagaagacggaacctattcacaatcgatggctggaaacccagttgatgggacatgggagtttatcgatgaggaacatatcgttgtaaaaaatgaacatataaagagtgaagaaggacaaaagtggaaaatagagaagtctacagaagatgagcttcacattgactggaacgttgcaaaaggagacgctaaaattctcgagtttaagcgccaatag

SEQ ID NO: 10442 - protein, 150 aa, Unknown
  Obtained from environmental sample
  SIGNAL (1)...(17)
  misc_feature (1)..(150): Xaa is any amino acid
MKRTFLTITAAAFILVGCNNSEKAENTENQPTEKAEQEVEESEDIKEVKEEMTTEQLVLGDWAYEYEIEGDNIEVLLTLREDGTYSQSMAGNPVDGTWEFIDEEHIVVKNEHIKSEEGQKWKIEKSTEDELHIDWNVAKGDAKILEFKRQ

SEQ ID NO: 10443 - DNA, 621 bp, Unknown
  Obtained from environmental sample
  misc_feature (1)..(621): n is a, c, g, or t
atgagtaaactatttaaaattttattatcaccatttacttttgtaactatttatgggttttttattctctacatatattatcaagagcatagtttaaaggtatctgttgaaaagttcaaaaatagctactttaaaacttatgagatagctacagataacagtattttactagatgatattgcaaatcatctgacttcagcagtaaattcaaaagaacttgattcattgttacatacatttgatagttttaagagagtaaaaaataattttgagcagatgaaactgatagatagctcaaatgaaagttattctatagccttgcaagactttaaaaattattataaattagctgagaatgttgcaaaaagtatgatttcaggtgatgaagagtcaatattgattgtatatccaaaagccgaaatagttgtagagttatataatttggtaaaaaaagagtttaatgatattaagattagttcaaaagataatttatttaatcaattaaatataattgacttaagagttaaagatatactcttttacggtgctgtattgcttctttttcatacctctttgatcatattattgtttattacaaatagaaaaaaatgggatatttag

SEQ ID NO: 10444 - protein, 206 aa, Unknown
  Obtained from environmental sample
  misc_feature (1)..(206): Xaa is any amino acid
MSKLFKILLSPFTFVTIYGFFILYIYYQEHSLKVSVEKFKNSYFKTYEIATDNSILLDDIANHLTSAVNSKELDSLLHTFDSFKRVKNNFEQMKLIDSSNESYSIALQDFKNYYKLAENVAKSMISGDEESILIVYPKAEIVVELYNLVKKEFNDIKISSKDNLFNQLNIIDLRVKDILFYGAVLLLFHTSLIILLFITNRKKWDI

SEQ ID NO: 10445 - DNA, 471 bp, Unknown
  Obtained from environmental sample
  misc_feature (1)..(471): n is a, c, g, or t
gtgctttatgatcttttgggatttgagcgtacaaaagagttaatgcatgaactagatacaaataaattttatgagttaagtgaagatgaacttagtaaacttcaagagatgttttcagctgattggtgtagtggagatgagggtaaaaaatatattaaagagacatttgaaagtggttatttgatggatcctcacactgctacatgttttaaagcttatgagagttgtgctacaaaaaatcttgtaactatagcttactctactgctgagtggacaaaattttctccaactattgctaatgcgcttacaggtgaagttgatgctcaagatattgatgcacttgaatctatatcaaaagaggcaaaagtagagatcccttttatgattaaagaactttttaacaaagagataacacaatcaactgtaattgaaaaagagaatatagaagaggaaattttgacctttatttaa

SEQ ID NO: 10446 - protein, 156 aa, Unknown
  Obtained from environmental sample
  misc_feature (1)..(156): Xaa is any amino acid
MLYDLLGFERTKELMHELDTNKFYELSEDELSKLQEMFSADWCSGDEGKKYIKETFESGYLMDPHTATCFKAYESCATKNLVTIAYSTAEWTKFSPTIANALTGEVDAQDIDALESISKEAKVEIPFMIKELFNKEITQSTVIEKENIEEEILTFI

SEQ ID NO: 10447 - DNA, 660 bp, Unknown
  Obtained from environmental sample
  misc_feature (1)..(660): n is a, c, g, or t
atgaaaaataaattaattatactctttatattttcattgtttcttttagcaaattatattatttataatataactgccatcaatcaacaacaaagaattaatgtcactttagaaagtatttcaaatcaacttcaaacacattatgaactacaaatatatcatcaaactattacagcagatgctgcgtataaagccactattatgaaaaaaggtgttattgatattttaaaaaaagttcaaacagcctcaaaaaaagagaaagagactttacgaaaagaactttacgatttacttcttgaagagtatatccctttaaaaattcaaggtgttttacaatatcagtttaaccttaaagataataccgcttttttacgactccacaaaccatctaagtttgatgatgacttaacaaatataagatatagttacaactatgtgaataaataccataaaataatcagaggattagaacaaggganaactacccatggatttagaaatgtatatccaatttttgatgaaaataaaaactatctgtgtgcagtggaaatatcttactctagtgaccttattcaacaaatgttaacagatgttagtaaaatacacacacactttattgtgaacaaaaaagttatagatgccagagcttggaaaagtatg

SEQ ID NO: 10448 - protein, 220 aa, Unknown
  Obtained from environmental sample
  SIGNAL (1)...(17)
  misc_feature (1)..(220): Xaa is any amino acid
MKNKLIILFIFSLFLLANYIIYNITAINQQQRINVTLESISNQLQTHYELQIYHQTITADAAYKATIMKKGVIDILKKVQTASKKEKETLRKELYDLLLEEYIPLKIQGVLQYQFNLKDNTAFLRLHKPSKFDDDLTNIRYSYNYVNKYHKIIRGLEQGXTTHGFRNVYPIFDENKNYLCAVEISYSSDLIQQMLTDVSKIHTHFIVNKKVIDARAWKSM

SEQ ID NO: 10449 - DNA, 756 bp, Unknown
  Obtained from environmental sample
  misc_feature (1)..(756): n is a, c, g, or t
atgaatacagtaaacaccaatgcatccggcaatacaacaattattttttcatcaccaaatatttatgcaaaacttagcggtactttaagaagtgccaaaaatgttaaaactccggttggtgaattagagaacagtcaattcagagataacaatctttcattcaggttgggcataaccccaattgcaggaaacgaaattaaatttaattttcaaaaatttcacgcaacagatgttggcataccgggcggagatgcattccctacaaacgctgttgcacgctacccgattgagactagaactctttaccagggagaatataaaatttcagccgtaacagattggtggaaaaacttaagtgtaaaatattactatcaggaaattaacagagaagttgaattaaagccaaacgcaatggtagttgttaatcctaaagctgatcataaaacacatggtgcaagtttgcagtcaaactttttggttaataattccaatcttatagtttttggaattgatggatggcaaagaacttatgatgggaaaagaactaaaacaattggcggcggtaaaacaataattgttgatatcccagttccaaaatcggaatacagaagcattggagtttttgctcatgatgaggttagtctgatcaagaataaatttaaggttactttcggcggacgttatgattttattagggttactaatgaggaaactaataatccggtatcaattacaaagggcggagtaacaaaattt

SEQ ID NO: 10450 - protein, 252 aa, Unknown
  Obtained from environmental sample
  misc_feature (1)..(252): Xaa is any amino acid
MNTVNTNASGNTTIIFSSPNIYAKLSGTLRSAKNVKTPVGELENSQFRDNNLSFRLGITPIAGNEIKFNFQKFHATDVGIPGGDAFPTNAVARYPIETRTLYQGEYKISAVTDWWKNLSVKYYYQEINREVELKPNAMVVVNPKADHKTHGASLQSNFLVNNSNLIVFGIDGWQRTYDGKRTKTIGGGKTIIVDIPVPKSEYRSIGVFAHDEVSLIKNKFKVTFGGRYDFIRVTNEETNNPVSITKGGVTKF

SEQ ID NO: 10451 - DNA, 858 bp, Unknown
  Obtained from environmental sample
  misc_feature (1)..(858): n is a, c, g, or t
gtgatgacaacacccagcggttatatcgtatattcccaggttactatggatgttttgaatgatgtctgtcaggcggaaggttttaatgtgaatattccctggaaggatcttacagaggatcagaaacatattatcctgcgcggctcaactaaacttatggtaccttttggaaaacatactttggaatcacgacttaaatggagtggtataacagcaaaaccccgtgaagagggttattatacaggcatcttaactatcatggaagatatcctgaaacgtgatagaaacgataacattctgcgttttgccagatctataaaatgtacggaatgcaaaggaaataggcttaatagtgatgctttaagtgttttgtttcataagaagaatattgcagaattatcaaatttgagtttaaagaaattgagcaaattcataaaagatatcaaattattggataatgaatcaaaggtagcttcggctattttcagcgatattcaaaaacggttgaaaatcctttctgagcttggtttaggttacctctccctcgatcgcgaatccaccagcttaagtggtggtgaagctcaaagattgcggttagcagggcaaactttagggactttgcaaaatgttctatatgttttggatgaaccttcaattggacttcatcccgtgcataaccgggcgatgataaatgctttgcgaaatctccaaaatgagggtaacactctgttggctgtggaacacgatgaagagtttattcgtcagagtgactatctggtggatatcggccccaaagctggaactgaaggtggaaaattaatatacaatggagcaacatcatattttttccaaaaataa

SEQ ID NO: 10452 - protein, 285 aa, Unknown
  Obtained from environmental sample
  DOMAIN (78)...(263): ABC transporter
  misc_feature (1)..(285): Xaa is any amino acid
MMTTPSGYIVYSQVTMDVLNDVCQAEGFNVNIPWKDLTEDQKHIILRGSTKLMVPFGKHTLESRLKWSGITAKPREEGYYTGILTIMEDILKRDRNDNILRFARSIKCTECKGNRLNSDALSVLFHKKNIAELSNLSLKKLSKFIKDIKLLDNESKVASAIFSDIQKRLKILSELGLGYLSLDRESTSLSGGEAQRLRLAGQTLGTLQNVLYVLDEPSIGLHPVHNRAMINALRNLQNEGNTLLAVEHDEEFIRQSDYLVDIGPKAGTEGGKLIYNGATSYFFQK

SEQ ID NO: 10453 - DNA, 762 bp, Unknown
  Obtained from environmental sample
  misc_feature (1)..(762): n is a, c, g, or t
atgaaagatataaatataaaatttaatctcaataattttatacgtgcatcagaatattttgcaataataccagcttcttcaaatttttataccgaaacaataaaaattctagaaagtttcttcgcctcagattctgtttattttgttcaaaaaaacgaacaactggaaatttttcataaaactccaaataacaaaaactgcataaaaaagtttttaagcatagcaggcgattatattgaagatgtattagtcagtggctttttaagcgtagaaaaaatacagttaaaagagtgtggagatacaacatttatttttttacctattaatatatttaatcagactaagtctgtattgtgtattggatattttagtgatagcgatatggataaagagactttaaatattcttcttgcaatatctacgcttcttggtacattattggaaaaacaatctacagagaactcttttgagattttacttaaagagaatcaaagaattctttcagttgccggtgaaggtattatggggatagatatagatggtcaccacacctttgttaatcccgaagctgcgcaactattgggctatgatgctaaagagatgctaggacgtgaaagccatgagctatggcattataaacacacagatggatcaaacttcaaaaaagatgagtgcaaagttcattcagtttatacccaaggagtaacatatagtagtagtgaagagttttttgtgcgtaaagacggtcctcagccgatctga

SEQ ID NO: 10454 - protein, 253 aa, Unknown
  Obtained from environmental sample
  DOMAIN (161)...(224): PAS domain
  misc_feature (1)..(253): Xaa is any amino acid
MKDINIKFNLNNFIRASEYFAIIPASSNFYTETIKILESFFASDSVYFVQKNEQLEIFHKTPNNKNCIKKFLSIAGDYIEDVLVSGFLSVEKIQLKECGDTTFIFLPINIFNQTKSVLCIGYFSDSDMDKETLNILLAISTLLGTLLEKQSTENSFEILLKENQRILSVAGEGIMGIDIDGHHTFVNPEAAQLLGYDAKEMLGRESHELWHYKHTDGSNFKKDECKVHSVYTQGVTYSSSEEFFVRKDGPQPI

SEQ ID NO: 10455 - DNA, 609 bp, Unknown
  Obtained from environmental sample
  misc_feature (1)..(609): n is a, c, g, or t
gtggctggcttgacgattttagcttttggagagaacagctactttaatagtgcaaaatcgacaaagaccagagtaactaaaaatatagatctgaaatatgtaaaagagtttataaataaaaattcgtttgcaaaaaatgtgaaatatagagatgagttttatgaagtagggccactctctcgtgctatgataaataagattccgcttatcaaagattcacatagaaaataccaagatagtatttttagcagaatcttagctcgcatccatgagataccacaactgcttattcactcaaaaaaacttttaaatgagatagacctgagtgagccatcatatataaaaccctcaatagacatatcagctttaaactcctcaggaatcggctctgttgaagctgcaagaggttcattaatacataaagtaaagatagaaaacagtcgtatatcagattatcagattataactcccactcaatggaacttaagtaacggctcaaaagatgaccttggagtctctcaaaaagcgatgataggacttaatgatagctctttagcacaacttgtatttaagagttttgatgtctgttcagtctgtactacacactaa

SEQ ID NO: 10456 - protein, 202 aa, Unknown
  Obtained from environmental sample
  misc_feature (1)..(202): Xaa is any amino acid
MAGLTILAFGENSYFNSAKSTKTRVTKNIDLKYVKEFINKNSFAKNVKYRDEFYEVGPLSRAMINKIPLIKDSHRKYQDSIFSRILARIHEIPQLLIHSKKLLNEIDLSEPSYIKPSIDISALNSSGIGSVEAARGSLIHKVKIENSRISDYQIITPTQWNLSNGSKDDLGVSQKAMIGLNDSSLAQLVFKSFDVCSVCTTH

SEQ ID NO: 10457 - DNA, 429 bp, Unknown
  Obtained from environmental sample
  misc_feature (1)..(429): n is a, c, g, or t
ttggaaggagtggtaaataaaacaagcataatagtttttctagtcctgctgataatgtcttgtgctaagcaagagttagcaaccatagacttaacaacaaaaaatccttcacaaataaaccttaaactaaacaaaggagagcgaatacagttctactccgacttacagttgacgtataatgtaaaaccagatatagtttatgcctttgaattttatcaagccaaccaattactttttagtggaggtgttgacccgtttaatgttactgccgaaacaaataataataccccaaatgctattaaaggaaagttagaaggagagtttactgctcagtatgatgataattactccatagtggtaaccttaattaaaaataacacgcttgggttaaaaattcatcatgcaaaaattagtgttgtaaaagattag

SEQ ID NO: 10458 - protein, 142 aa, Unknown
  Obtained from environmental sample
  misc_feature (1)..(142): Xaa is any amino acid
MEGVVNKTSIIVFLVLLIMSCAKQELATIDLTTKNPSQINLKLNKGERIQFYSDLQLTYNVKPDIVYAFEFYQANQLLFSGGVDPFNVTAETNNNTPNAIKGKLEGEFTAQYDDNYSIVVTLIKNNTLGLKIHHAKISVVKD

SEQ ID NO: 10459 - DNA, 459 bp, Unknown
  Obtained from environmental sample
  misc_feature (1)..(459): n is a, c, g, or t
atggtagataattcagcactagaacaactaattcgagctaaaaacaaaataaatttttttaaagacttaacagattatcaaatacaaacactcataaaagatattgtatttaaaaaattaaatcgtcatgaaaccatatttcgacaaggtgagacacgagacccttatatatactatgtattagcaggaagtgtaaaagtaaatctaagagacgactatggtgttacaaaaacagttacaactttacctgtgggatcaattataggggagatgcaaatagttctaaatcaagaaagaacagctggctgtgttgcaaataatgaagaaaatatccttataggatttacaattaatgaataccaactaggacaacatggaaatatatatgctgttttttatagaaatattgccgaagtcttagctagaaaaattgaagatacaaataagaaaataaaataa

SEQ ID NO: 10460 - protein, 152 aa, Unknown
  Obtained from environmental sample
  DOMAIN (34)...(127): Cyclic nucleotide-binding domain
  misc_feature (1)..(152): Xaa is any amino acid
MVDNSALEQLIRAKNKINFFKDLTDYQIQTLIKDIVFKKLNRHETIFRQGETRDPYIYYVLAGSVKVNLRDDYGVTKTVTTLPVGSIIGEMQIVLNQERTAGCVANNEENILIGFTINEYQLGQHGNIYAVFYRNIAEVLARKIEDTNKKIK

SEQ ID NO: 10461 - DNA, 897 bp, Unknown
  Obtained from environmental sample
  misc_feature (1)..(897): n is a, c, g, or t
atgatgtcaaaagttactttaaatgatacaaatataatagaacaaaatagtcaagcaactttctatttaaaaaatagatacagtggttttaataagttttatctctatgcaacacaatacttaagtacacaatttgaacaattagaatttattaagtcttttgataaaaaatataatgaagatttaataaataactatccaaatcctttatggatataccctcccctctcttctaaaaataaaaaaaacactcaagagagcgaagaggaggagttacaaagagctaaagagaaagaaagaacagatactttagagatgaaaaaacaaacaaatcaaatagatgacacaaaagagacaaatggctttttggcttttttaccagaatctttgatgagtatttttgaacaagtaaatgttgatagaatggaagatgatagttttgatgacaatgctttgtatcatgctgaagatttagatgagataactttagggaaaaaacaagccaacttagcttctagaattaagatggatttggatttacaacctgatatgagagaaatatatcctttaggtaaaggacatttgattgatgaatgggattatagaataaataattatttgataaattatgttcgtataaaaccacaagttacgataaatgttataccaacagagttaccaaaacgattgaaaaagactgtaaaaaaaatccaatcagaacttgatttactagaacttgatagaatcaaaaatgataggttgccttatggtgatgagatccatataaatacatggatagattataaggggcatccaaataaatccacacatcatcaaaatttttatacaacctatgagagaaaaaccagagatatggctacccttaattttagctga

SEQ ID NO: 10462 - protein, 298 aa, Unknown
  Obtained from environmental sample
  misc_feature (1)..(298): Xaa is any amino acid
MMSKVTLNDTNIIEQNSQATFYLKNRYSGFNKFYLYATQYLSTQFEQLEFIKSFDKKYNEDLINNYPNPLWIYPPLSSKNKKNTQESEEEELQRAKEKERTDTLEMKKQTNQIDDTKETNGFLAFLPESLMSIFEQVNVDRMEDDSFDDNALYHAEDLDEITLGKKQANLASRIKMDLDLQPDMREIYPLGKGHLIDEWDYRINNYLINYVRIKPQVTINVIPTELPKRLKKTVKKIQSELDLLELDRIKNDRLPYGDEIHINTWIDYKGHPNKSTHHQNFYTTYERKTRDMATLNFS

SEQ ID NO: 10463 - DNA, 411 bp, Unknown
  Obtained from environmental sample
  misc_feature (1)..(411): n is a, c, g, or t
atgaaagataaactcattcaaaatttaaaaaactatgaaaaagctttaatctcactagagaccaacattataaagatacgaaacatggatgagaagtttgaagattttgacatctatagagacagcactattcaacggtttgagtacagcatggagatagccaaaaaacttatggcaaactatattgagtttgtagatgcaaaaataaatgggcaaaagctgattttaaaaaaagcttttgagtttgacatgatagatgatgatatctggtttgaaatggtagatgacaggaacataacatcacatgagtatgatgaaacactagcgatagaactcttgaaaaaaatctatatctatgcgattaagcttagaatatttcacgatactataaaacagatgatagaagcgtag

SEQ ID NO: 10464 - protein, 136 aa, Unknown
  Obtained from environmental sample
  misc_feature (1)..(136): Xaa is any amino acid
MKDKLIQNLKNYEKALISLETNIIKIRNMDEKFEDFDIYRDSTIQRFEYSMEIAKKLMANYIEFVDAKINGQKLILKKAFEFDMIDDDIWFEMVDDRNITSHEYDETLAIELLKKIYIYAIKLRIFHDTIKQMIEA

SEQ ID NO: 10465 - DNA, 507 bp, Unknown
  Obtained from environmental sample
  misc_feature (1)..(507): n is a, c, g, or t
ttgttcttgaggagttttgttggttctacaaaatcgcatcaagagataggaagtgaaatagtctcaaaccaacagctagatgctatcatctccatgcaagcgggtgtatttaaaccttatgcgggtgtcagcacggctatcatgatttttacaaaaacaaacggacataaaaatgacaaagtttggttttatgacatgcaaaatgacggatacactcttaatgacaacagacaagagtgtgatggttctgacattccagacatactggctaggtttaaaaatttcgatgctgagaaaaaacgagagagaacggacaaaagcttttttgttcccgtgagtgagatagaagcaaataattatgacctaagtatcaacagatacaaagagatagtttacgaaactataaatcatgctaagccgatagagatcataatagatatagaaaaaatagataagaaaatctcacaagggcttaaagagttaaaagggatgatacatgaaagataa

SEQ ID NO: 10466 - protein, 168 aa, Unknown
  Obtained from environmental sample
  DOMAIN (4)...(121): N-6 DNA Methylase
  misc_feature (1)..(168): Xaa is any amino acid
MFLRSFVGSTKSHQEIGSEIVSNQQLDAIISMQAGVFKPYAGVSTAIMIFTKTNGHKNDKVWFYDMQNDGYTLNDNRQECDGSDIPDILARFKNFDAEKKRERTDKSFFVPVSEIEANNYDLSINRYKEIVYETINHAKPIEIIIDIEKIDKKISQGLKELKGMIHER

SEQ ID NO: 10467 - DNA, 603 bp, Unknown
  Obtained from environmental sample
  misc_feature (1)..(603): n is a, c, g, or t
atgaatagtgtattaaaaaagtatttaaataaaacatactcagatacattctttcctatttttttaactctttatacgataacttcaattatctttttagtaaaaattgcatcacttacttcggtgatacagattaatttctttgaactattagagttgtattcgtataatattgcaactattttattttatactatacctatttcattatttatatcattagggttatctttagcaaagttatcaagtgagtatgagttaatagtaattacaagttttggcttaacacctttaaaaatactaaggatgtttttacctcttttattattatcttctgttgtagttctaattatatctttagcattaatcccaaagtcaagttttttaaaaagttccttcatgaataataaaaaagtagaagcacagtttaatattaaagctagtgaatatgggcaagaatttggtaaatggctcatttatgttgaaaaagaaaaaaatggcttatatgaagatgttgtgctctatcaacaaaatgataatgaagatgtttttattattgctaaatatgcaaaattaataaatttaagtagctctttaagttaa

SEQ ID NO: 10468 - protein, 200 aa, Unknown
  Obtained from environmental sample
  misc_feature (1)..(200): Xaa is any amino acid
MNSVLKKYLNKTYSDTFFPIFLTLYTITSIIFLVKIASLTSVIQINFFELLELYSYNIATILFYTIPISLFISLGLSLAKLSSEYELIVITSFGLTPLKILRMFLPLLLLSSVVVLIISLALIPKSSFLKSSFMNNKKVEAQFNIKASEYGQEFGKWLIYVEKEKNGLYEDVVLYQQNDNEDVFIIAKYAKLINLSSSLS

SEQ ID NO: 10469 - DNA, 723 bp, Unknown
  Obtained from environmental sample
  misc_feature (1)..(723): n is a, c, g, or t
atgaaaataaaatttacagtaagttatgatggctcattgtattatggttctcaaatacaacctaatcatgtaacaatccaatctaaagttgaagaggtatttaaattacttaatatagatacttcgttagaatttagtggaagaacagatagaggtgtacacgcatttagacaagttatatcatgtgttttacctgatttttggagtgatttagtaaagtttaaaatggcacttaataagatgttaccaaattctatatatgttagaaatgtatcttatgtaaatgatgattttcatgcaagatttagcgcaaaaaaaagagaatacagatatattgttacaacaaaagaacttaccccatttaatcaaaattatgtagagtattatgaaagtatcaatgtagaaaagataagagatgctctgaaaattttaaaaggtgtacatgattttgaatactttagtaaaactggcagtgaaccagcttcaacagtgcgagagatttacgatataaagttttataaatataaagagttatatattttcagatttaaagctaattcttatttaagaagccaaatacgaatgatggttgattttattatgaaaatatcaagtggtaagttaactattgaagatttaaaaaaacagcttaataaagagaagttgatatcttggactctagctagcccaaatgggctgtatttaagtaagattagttactag

SEQ ID NO: 10470 - protein, 240 aa, Unknown
  Obtained from environmental sample
  DOMAIN (140)...(240): tRNA pseudouridine synthase
  misc_feature (1)..(240): Xaa is any amino acid
MKIKFTVSYDGSLYYGSQIQPNHVTIQSKVEEVFKLLNIDTSLEFSGRTDRGVHAFRQVISCVLPDFWSDLVKFKMALNKMLPNSIYVRNVSYVNDDFHARFSAKKREYRYIVTTKELTPFNQNYVEYYESINVEKIRDALKILKGVHDFEYFSKTGSEPASTVREIYDIKFYKYKELYIFRFKANSYLRSQIRMMVDFIMKISSGKLTIEDLKKQLNKEKLISWTLASPNGLYLSKISY

SEQ ID NO: 10471 - DNA, 591 bp, Unknown
  Obtained from environmental sample
  misc_feature (1)..(591): n is a, c, g, or t
atgttagaaacagagatttattatcaacagttaagagaggtttgtaaagaatattatgactttagtgataaaagttttgatgcttttaagaaaatatgttttgtgaaaaatataaaaaaaggggagattctccaagatagttattctcctgcaaaatatatctattttatctataaaggtattttacgaacatattttttaaatgaaaaaggggcaatttatacaaaaaatctttttagtgaaaattatttttctgcttcaaaagtttctcttatcacaaaagaagactcttatttaaatatcgatgctttagaagatagtattttgatttatattaattttgatggatataagaatttaatagatactaacatagaatttaaaaacttttatataaattatttggaaaaaaattgggttatagtaaaggagaaaaatgaaatatctttgatacttgatgatgcaaaaacaagatatgaaaactttatacaaaataatccagatattgaaaaaagaataccattacatcatattgcaaatcatttaggtattacacctactcagttaagtagaataagaaaaagagtgtaa

SEQ ID NO: 10472 - protein, 196 aa, Unknown
  Obtained from environmental sample
  misc_feature (1)..(196): Xaa is any amino acid
MLETEIYYQQLREVCKEYYDFSDKSFDAFKKICFVKNIKKGEILQDSYSPAKYIYFIYKGILRTYFLNEKGAIYTKNLFSENYFSASKVSLITKEDSYLNIDALEDSILIYINFDGYKNLIDTNIEFKNFYINYLEKNWVIVKEKNEISLILDDAKTRYENFIQNNPDIEKRIPLHHIANHLGITPTQLSRIRKRV

SEQ ID NO: 10473 - DNA, 642 bp, Unknown
  Obtained from environmental sample
  misc_feature (1)..(642): n is a, c, g, or t
atgactaaaaatgaaaatataaaagagttttacaaaagaaataaactcgaatttatacccatagaacaaaaaaatgatattggtcattttaatatttttaaaagagacagtacacgaaaaaaacctatcacttttaatagacgtgaatactataaaatcacccttttaaaaggtaaaataaaaatagactatgcagataaaagtataataagcgataaatatgctttaatgttttctgatcctctcgttccatatagttgggaacctttagatatagaacaagatggctatttttgcatttttactgaaacattttttcataaatttggactccttaaaagctatccagtatttcaagcaaatggagataaagtctttatcttaaataaattaaatgtacaagatatagaaaaaatatataaaaaaatgtttgaagagataaactcagattacacatataaatatgatgttttaaaaaacttagtatttgaacttatccattatgctatgaaaacaaaaccagcacttgtatgcgctcaagagaaagatagaacaaataaaatagctactctgtttatggagcttgtagagagacaatttcctattaaatcaccttaccaacccctctcgagccgatcctga

SEQ ID NO: 10474 - protein, 213 aa, Unknown
  Obtained from environmental sample
  misc_feature (1)..(213): Xaa is any amino acid
MTKNENIKEFYKRNKLEFIPIEQKNDIGHFNIFKRDSTRKKPITFNRREYYKITLLKGKIKIDYADKSIISDKYALMFSDPLVPYSWEPLDIEQDGYFCIFTETFFHKFGLLKSYPVFQANGDKVFILNKLNVQDIEKIYKKMFEEINSDYTYKYDVLKNLVFELIHYAMKTKPALVCAQEKDRTNKIATLFMELVERQFPIKSPYQPLSSRS

SEQ ID NO: 10475 - DNA, 693 bp, Unknown
  Obtained from environmental sample
  misc_feature (1)..(693): n is a, c, g, or t
atgaaagtagcaacaccagaaaatacattagaatttgccaaaaaattttcacactataaagatttttatactcaaagcaatgggttgatattttcaaaactaggtttaggtacatttaataaagaaccatacaaagaggaaaactatgtttttcattatattgcaggggttaaagaagccgttaaaaatggaattaacttaatagatacagcaagtaactatagatatggacaaagtgaaaaagagataggcgttgcattagaagagctatatgaagaagattcagtaaaaagggaagatttaattatatgttcaaaaggtggttttatacagttagattatccatttccagagaatccatatacttggatagatgaaaatattgttagtaaaaaattagcaactaaagatgaaatcgagttagatcaacactgtatgacaccagattatttagaatggtcttgtagaagaagtttagaaaatcttggagttgaaagtttagatatctattatcttcataacccagagatgcaggttttaaaattaggtgagaaaaacttttataaacaaatagagaaaatattcaaaaggtttgaaaagttagctgatgagggactatttaaatattatggtgtggctgtttggaatggttttatgtctgaaataaatgaaaatattgagatagaaaattag

SEQ ID NO: 10476 - protein, 230 aa, Unknown
  Obtained from environmental sample
  misc_feature (1)..(230): Xaa is any amino acid
MKVATPENTLEFAKKFSHYKDFYTQSNGLIFSKLGLGTFNKEPYKEENYVFHYIAGVKEAVKNGINLIDTASNYRYGQSEKEIGVALEELYEEDSVKREDLIICSKGGFIQLDYPFPENPYTWIDENIVSKKLATKDEIELDQHCMTPDYLEWSCRRSLENLGVESLDIYYLHNPEMQVLKLGEKNFYKQIEKIFKRFEKLADEGLFKYYGVAVWNGFMSEINENIEIEN

SEQ ID NO: 10477 - DNA, 507 bp, Unknown
  Obtained from environmental sample
  misc_feature (1)..(507): n is a, c, g, or t
atgaagctgagtttcaacaccaataacaatgatgagattctggaaatggacaatattgcaggtaatagctttagatttatctataataatgagcattttgaagtttatattgtagatcaggataaaaaatctattgagctattaatcggcgaaaaaaccttcaaatcatatatttcttcagataacacaggaaaatatcatataaatttagatggatcaatattagaaattgcacgaaatgactttctcggaaatggtgatgggctatatcaaaatcataatgatgatgaaggcagcctatttgccccaatgcctggaaaagtaattaaagtaaattgttccgtgggagataaagttaagcgaggtagtattcttttggttgtggaagccatgaagatggaaaacaatattgttgcttcacatgatgccattgttgaaaaaattccagttaaggaaggtgatatggttgataccgatgtacaacttgtagtattggaagaattgtaa

SEQ ID NO: 10478 - protein, 168 aa, Unknown
  Obtained from environmental sample
  DOMAIN (98)...(165): Biotin-requiring enzyme
  misc_feature (1)..(168): Xaa is any amino acid
MKLSFNTNNNDEILEMDNIAGNSFRFIYNNEHFEVYIVDQDKKSIELLIGEKTFKSYISSDNTGKYHINLDGSILEIARNDFLGNGDGLYQNHNDDEGSLFAPMPGKVIKVNCSVGDKVKRGSILLVVEAMKMENNIVASHDAIVEKIPVKEGDMVDTDVQLVVLEEL

SEQ ID NO: 10479 - DNA, 345 bp, Unknown
  Obtained from environmental sample
  misc_feature (1)..(345): n is a, c, g, or t
ttgttggcatacttgcaggattccgtcatgtgcgaattcaatgttttctttttgcaaagtagcgatgaaatgattcgcaatatcgcaaaggccatcatcacgagagaagaacacgttcaatttgtcaccaagataatcggtcataccttgcttaaaagttttttcatgatgagaaaacctttcaatatgtccgttgtagaaatcatcgcgttgaaatataggtttccatgttttgagaagatctctgtaacgcaatggacttgtggttcgaaaacgatattgttcaaaaagggcttcaattgtaatgatttttgtgttttcaggaaaatttataatcgttcctga

SEQ ID NO: 10480 - protein, 114 aa, Unknown
  Obtained from environmental sample
  misc_feature (1)..(114): Xaa is any amino acid
MLAYLQDSVMCEFNVFFLQSSDEMIRNIAKAIITREEHVQFVTKIIGHTLLKSFFMMRKPFNMSVVEIIALKYRFPCFEKISVTQWTCGSKTILFKKGFNCNDFCVFRKIYNRS

SEQ ID NO: 10481 - DNA, 939 bp, Unknown
  Obtained from environmental sample
  misc_feature (1)..(939): n is a, c, g, or t
ttgattnggctcgagtggcccgagggctcgagaagatttttttcatctattgtggaagatagaatggtaacagaagaagaatttagtactttaacatatgaacaaacaaaaaaaatcaaacaatttacttcaagaagtgatttagagggaaattatataccagatacttctattggctttgaaaaactatctatggctccactattatctgcacaaaatataagtgatgatgaagagtacaatgaagctatttttaatacttttaaaaaactgaatctttcacaagatgatggaatatctatgttaaacgaacttggtggatatattaatcaagaagaaaaaatcatctttgaagactcattgactgatgaacaatatgattcaggggtaagatataaaacctatataggtttagatatgaaggagttagttagtaaacgtttagaagagcttaaccaaggacttttagaaacaagtgatgaagatgtaaaaagtgattataaaaatatgatttctgtttatagggaaatagaaacccaatacaataatatacaagataaaaatagagtagaaaatgaagcacaacttgaacaatatactagaaatacaaaaccaaatccattgtataacgctgacgttgtagaactttataataatataacacatgaatatgaagaaaaagagaaaaaagagtttaatgagttaatggataaattagatatcagtaatttaaataatagagaaaaagaactttttagaactatcttggaagacaaagagatttcanatatagaaatggacaaactctcttatgaagnaatgaaaaaaatctatcagtttatctttaaaaaagatgaaaatggagaaagtatagatgatactctaattagaacaaacagtagaatcaatgctttactaaaacctccgaatcacagatga

SEQ ID NO: 10482 - protein, 312 aa, Unknown
  Obtained from environmental sample
  misc_feature (1)..(312): Xaa is any amino acid
MIXLEWPEGSRRFFSSIVEDRMVTEEEFSTLTYEQTKKIKQFTSRSDLEGNYIPDTSIGFEKLSMAPLLSAQNISDDEEYNEAIFNTFKKLNLSQDDGISMLNELGGYINQEEKIIFEDSLTDEQYDSGVRYKTYIGLDMKELVSKRLEELNQGLLETSDEDVKSDYKNMISVYREIETQYNNIQDKNRVENEAQLEQYTRNTKPNPLYNADVVELYNNITHEYEEKEKKEFNELMDKLDISNLNNREKELFRTILEDKEISXIEMDKLSYEXMKKIYQFIFKKDENGESIDDTLIRTNSRINALLKPPNHR

SEQ ID NO: 10483 - DNA, 513 bp, Unknown
  Obtained from environmental sample
  misc_feature (1)..(513): n is a, c, g, or t
atgataagagaagtaataacttatccaaacaaactgcttagaacaaaatcaaaagatgtagtgaagttcgatgaagaacttcatactcttttggatgatatgtacgacactatggttgctcaaagtggagtaggtttagctgctattcaagtatctattcctctaaacgtacttattatcttaattccagatgagaatgatattcaagaaaaagactctttaatagaagcaataaatccaaaaataacacataaagatggcattcaagtttttacagagggttgtttaagtgttccaggatttaacgaagatgtaaagagagctcaacatataattgttgaatatcaagatagatatggaaataatctaaaaatggaaactgaagattttccagcagttgcttggcaacatgaaatggaccaccttgaaggtcacctttttatagaaaagctttctttaatgaaaagaaagaaattcgaaaaagagtataaaaaagctcaaaagagtaaataa

SEQ ID NO: 10484 - protein, 170 aa, Unknown
  Obtained from environmental sample
  DOMAIN (2)...(157): Polypeptide deformylase
  misc_feature (1)..(170): Xaa is any amino acid
MIREVITYPNKLLRTKSKDVVKFDEELHTLLDDMYDTMVAQSGVGLAAIQVSIPLNVLIILIPDENDIQEKDSLIEAINPKITHKDGIQVFTEGCLSVPGFNEDVKRAQHIIVEYQDRYGNNLKMETEDFPAVAWQHEMDHLEGHLFIEKLSLMKRKKFEKEYKKAQKSK

SEQ ID NO: 10485 - DNA, 549 bp, Unknown
  Obtained from environmental sample
  misc_feature (1)..(549): n is a, c, g, or t
ttgacaacttacgatggatataaaagtttaatatttggcataaaatataacgaaatactcaaattctatgaaacatataaagataagtttggaatgagaggattcagtgatatgagcttagatgaagttatgaacttaactggacttgatgcaaacagtgcaacgctatcaagacaaagagacttcagtgagccatttattgtaaaaaataactcaatgatagatgatttaaacaaacttgcatatgaaaatggaatgaaaattacgcaaggtggcagattttttcatcttataggtcttaaccaagataaaggtatagctgtaaaaaagacatctgaactcttttcaaagctttttgtacaagatattttatctattggtttaggtgatggcataaatgatattgcgatgtttgaaaatgttgacaagcctattgttattaagaatcattatggcgaatatgttaaatcagatatagactctattcagctctcttcacataaaggcagtgctggatttaatgaaatggtattaaaaaatgtctcataa

SEQ ID NO: 10486 - protein, 182 aa, Unknown
  Obtained from environmental sample
  misc_feature (1)..(182): Xaa is any amino acid
MTTYDGYKSLIFGIKYNEILKFYETYKDKFGMRGFSDMSLDEVMNLTGLDANSATLSRQRDFSEPFIVKNNSMIDDLNKLAYENGMKITQGGRFFHLIGLNQDKGIAVKKTSELFSKLFVQDILSIGLGDGINDIAMFENVDKPIVIKNHYGEYVKSDIDSIQLSSHKGSAGFNEMVLKNVS

SEQ ID NO: 10487 - DNA, 738 bp, Unknown
  Obtained from environmental sample
  misc_feature (1)..(738): n is a, c, g, or t
atgtatatttatttttttgatgcagataaaaatgaaattgaaaaaaaagagttaagaaaaatactttcattgcaagagtttttagaagataatagtatgttatatcacgttgttgaaaattttatagaactagaaaagcattttttaaagcaaattaaaaatttaaatcataataaaaaagaatattttaaagttcaagtcataaatgattattttataggtaggttagaggaaaagaaacaagtagaatactgtcttactaagagtgatatacccatatatggtatatatggagaagcaggtattggaaaaacagctttaattagagaggtagttcatgacctacaaaatcaaaataaatttttaggtggtgacatatggattgattttgaatataaaagaagtttaaaagattatataacttatatttcagaacaattaaatcatgatttgacagtttatattaataataaaaaatatctacataaggcaataagtgaattattattaaataaggattttctagtagtttttgatagttgtgaacaagatactgaaaattttaaacttctttatgaattttttagagattcttgctcaatacttattggtagtagacaatcatttgattttattcctaatcaattatctgtaaaaccttttaatgttgaagaagttcaaaagttttttgattttaattttcaacataatactcttgataaaaacaattacatataa

SEQ ID NO: 10488 - protein, 245 aa, Unknown
  Obtained from environmental sample
  misc_feature (1)..(245): Xaa is any amino acid
MYIYFFDADKNEIEKKELRKILSLQEFLEDNSMLYHVVENFIELEKHFLKQIKNLNHNKKEYFKVQVINDYFIGRLEEKKQVEYCLTKSDIPIYGIYGEAGIGKTALIREVVHDLQNQNKFLGGDIWIDFEYKRSLKDYITYISEQLNHDLTVYINNKKYLHKAISELLLNKDFLVVFDSCEQDTENFKLLYEFFRDSCSILIGSRQSFDFIPNQLSVKPFNVEEVQKFFDFNFQHNTLDKNNYI

SEQ ID NO: 10489 - DNA, 552 bp, Unknown
  Obtained from environmental sample
  misc_feature (1)..(552): n is a, c, g, or t
gtgaatacaattatagaacttaacaatgatcaagtaaactcaaaaaaagactatattaatatttcaaaagatatagatgctttagcaaaattaatagcttacaaaaaattgcaaacacctctttcaatagcactattaggtaaatggggaagtggaaaaagtacttttatggacatgcttgatgataagatacagaatttatctaatctaaatgaaccaatgttttgtagaagtgtagtaccgataaagtttaatgcatggcattattcagatacaaatctatgggctagtttagttagtcatatttttaaagaattgaataagtatcttaataatggcaaagatgaaaaagataaaatctcaatatatactcaactactcgattctcaaaaagaaaagttaaaagaaaaagaaattcaacaaaataaaatagaaatagagataaaaaagtataaaaaaaatatcaatgaaattgaaaacgaaaaagtagagacatttaaagaaatcaaaaaattagaatttgatgatataaaaaagagagattttagatga

SEQ ID NO: 10490 - protein, 183 aa, Unknown
  Obtained from environmental sample
  misc_feature (1)..(183): Xaa is any amino acid
MNTIIELNNDQVNSKKDYINISKDIDALAKLIAYKKLQTPLSIALLGKWGSGKSTFMDMLDDKIQNLSNLNEPMFCRSVVPIKFNAWHYSDTNLWASLVSHIFKELNKYLNNGKDEKDKISIYTQLLDSQKEKLKEKEIQQNKIEIEIKKYKKNINEIENEKVETFKEIKKLEFDDIKKRDFR

SEQ ID NO: 10491 - DNA, 759 bp, Unknown
  Obtained from environmental sample
  misc_feature (1)..(759): n is a, c, g, or t
ttgcttataaagagtgttaaaactatccctaaaaaagaggtggatgctcttcttgatatttgttcaacaaatagtgatagcaaagtgattttttgctgtatcggggaaacagattttaaaaatatggcaaaaagctttactaaaaaaacaaaaagtgtagaggtgaggttttttaccccaacggataaagaggcaatacacatattaaatgaagaggtaaaaaagagaaatcttcaatgtggctttggagagttacaatatctttacaatatgcaccaaaaagatttaagtcttagtgctaatgatcttaataaactagcaattttagaccaaccaataagtgtcaatataataaatagtcaatgttttggtatgggtgctgttattatagatgatttttttaataaactttttggtggtggaaatatcaatcgtgatttatatatgttgcttgaagaggggatgaatgagatataccttatcaatcaaacaacttcatttattcaacaactttttaatattaatagttattttagactttatggaagattagatattgtggaaatttggggatttaaacttcctacaaatattgcaaatgctcgagcatctcttgctcaaaggtataagcaagagcaatttttagagttcctagagttctttttacagctagaattagagctaaaaactaaaactcatcttgatacaaatagttatactcaagcttgttttagaaaattttcagctagtttaagataa

SEQ ID NO: 10492 - protein, 252 aa, Unknown
  Obtained from environmental sample
  misc_feature (1)..(252): Xaa is any amino acid
MLIKSVKTIPKKEVDALLDICSTNSDSKVIFCCIGETDFKNMAKSFTKKTKSVEVRFFTPTDKEAIHILNEEVKKRNLQCGFGELQYLYNMHQKDLSLSANDLNKLAILDQPISVNIINSQCFGMGAVIIDDFFNKLFGGGNINRDLYMLLEEGMNEIYLINQTTSFIQQLFNINSYFRLYGRLDIVEIWGFKLPTNIANARASLAQRYKQEQFLEFLEFFLQLELELKTKTHLDTNSYTQACFRKFSASLR

SEQ ID NO: 10493 - DNA, 942 bp, Unknown
  Obtained from environmental sample
  misc_feature (1)..(942): n is a, c, g, or t
gtgatgacactttgggactttacaccttatctatctaatccaacacaaagtggaagaatagattttaataaacatattaaaaataaatcattaattattgattctaaaaaaattatctttttactaatggtatttaatcatggtaacacagggggaagtcttgctattagtacaattaaacatacttattcagatttaattgtgcctattacacaatttgcaaactcaaaaaatatttcactatctaatctattttcaaataatatttttatagaagaatatatcgaccataataacttaaataaggagaggagactaatgcaactatcctcttttttagtatttttagacagaatgaggaatgatataacaggcataaactttaaaagagacaaaaaattatttagtaaattaaattctatgataataggtctaaaaaaacatcataggcaaacagtgataatccctttttctattctaaatgatagtatcaagcaaagatgggaacaagtcaaagaacttgaaaataatataaataatttatcattatttttaaaagaatatcttaaaactgaacaatttgcagctggagagtacagacatacaaattataattggcataaaaacaaaaatgcttataaatggaaagatgcagttgaaaaatatgaacttactaatattttcgataagtataatataaataagcgtcaagattttaaaaagtttattaaagacatcaatggaacgtgtaaacatttaattcatgcatatacaggaatgagaagtggtgaagtttttagcttaacatcaaattgtttagaaaagggtaataataataaaacaagaattattggttatacaacaaagctagaaggtactaagaaaaacagtaaaatgggtcactaccaaagaaaattgaaaatagttagtaaaaatatttaa

SEQ ID NO: 10494 - protein, 313 aa, Unknown
  Obtained from environmental sample
  misc_feature (1)..(313): Xaa is any amino acid
MMTLWDFTPYLSNPTQSGRIDFNKHIKNKSLIIDSKKIIFLLMVFNHGNTGGSLAISTIKHTYSDLIVPITQFANSKNISLSNLFSNNIFIEEYIDHNNLNKERRLMQLSSFLVFLDRMRNDITGINFKRDKKLFSKLNSMIIGLKKHHRQTVIIPFSILNDSIKQRWEQVKELENNINNLSLFLKEYLKTEQFAAGEYRHTNYNWHKNKNAYKWKDAVEKYELTNIFDKYNINKRQDFKKFIKDINGTCKHLIHAYTGMRSGEVFSLTSNCLEKGNNNKTRIIGYTTKLEGTKKNSKMGHYQRKLKIVSKNI

SEQ ID NO: 10495 - DNA, 705 bp, Unknown
  Obtained from environmental sample
  misc_feature (1)..(705): n is a, c, g, or t
gtgcgtgaaattgttcaggggcttcctaccgtgattcaatcatttgatgtggctaacgccaaaaaggcctatgaactaaagagtacctttattaataaaaactccgacactttacttcaggatatcagaactttcatctcacatcatcttggttttggggattttgtttatagggatgctggcggaaaaaagattgctgaagcaaaatctttgaaggagtttgaacagcatattgagactatacctgtggaatcattgctttatcatggaaaaagaaatcatttttccttgtggctgatggcaagaggagagctgaagattgcaaagatgctacatccggtgaaggtgaccgattttggtacgccaaatgaattcaggtcatatctgaagcatgtgattaagaagtaccgtaacgaatcgaatactggaaagattatcaattttgaagagtcggctctgctcgatgagaccaatattgtgagtttgggtgccggccctttggggggtaaaggtagggggtgtgcttttattaatacgttgatttataacctgaacttgccggatatcatacccgatttgaatatcagagctccgcgtacctgcattattggaaccgatgagttcgatatatttatggagcgaaataatcttcatgatacgattcaaaaagacgaagattttatagagttgaggaaaagtttatag

SEQ ID NO: 10496 - protein, 234 aa, Unknown
  Obtained from environmental sample
  misc_feature (1)..(234): Xaa is any amino acid
MREIVQGLPTVIQSFDVANAKKAYELKSTFINKNSDTLLQDIRTFISHHLGFGDFVYRDAGGKKIAEAKSLKEFEQHIETIPVESLLYHGKRNHFSLWLMARGELKIAKMLHPVKVTDFGTPNEFRSYLKHVIKKYRNESNTGKIINFEESALLDETNIVSLGAGPLGGKGRGCAFINTLIYNLNLPDIIPDLNIRAPRTCIIGTDEFDIFMERNNLHDTIQKDEDFIELRKSL

SEQ ID NO: 10497 - DNA, 447 bp, Unknown
  Obtained from environmental sample
  misc_feature (1)..(447): n is a, c, g, or t
ttgattgataaatttgatgataatatttatttcccaacaagtattaaagaaaaactgtttttaanagcagtagaaacaaatgcggatattaaaataaaactaaaaatgtttaaggatttttctcagagatattgggaagaagatgaaaaattaaaaaaagctgttgcaagtttatattcttccgaattagataaatatacaaaaaacagtcttattccttatctgacatctgaaactgtatttgaactatatatttctgttcaaaatcaagaagataagttgtatgttattcgtaattgtgataatgatacaaaaacaaaattatggaaagaatttcataaacaatatcctgaatgggaggcggaagaagctaaacgaattaaagaaaatgaggaatatagcgatagaatggataaaatgcaagatgcttatgataatatgttataa

SEQ ID NO: 10498 - protein, 148 aa, Unknown
  Obtained from environmental sample
  misc_feature (1)..(148): Xaa is any amino acid
MIDKFDDNIYFPTSIKEKLFLXAVETNADIKIKLKMFKDFSQRYWEEDEKLKKAVASLYSSELDKYTKNSLIPYLTSETVFELYISVQNQEDKLYVIRNCDNDTKTKLWKEFHKQYPEWEAEEAKRIKENEEYSDRMDKMQDAYDNML

SEQ ID NO: 10499 - DNA, 405 bp, Unknown
  Obtained from environmental sample
  misc_feature (1)..(405): n is a, c, g, or t
atggcattaaaagacttgtttaagccaaaatggcaatcggaaaatattaacaaagcaattgaagcacttgaaaaaataaaaaaacaagaagatatctgcgatgccgcagttagattttattatttaaacagagaatttataaaactgtttgataaacttaatgaaactgaattaattgaaaaaagtggaactgaatttttacttgggaaatttaaaaatgatgctttaagtgattccgagtttaaatattgtactccagttatgtccaaattggaggataacaatttgctcgaaaatgtattactaaatttagaaatttaccagaaaaacagtcgatatcttttttttatcaattttaaaaagttttatttagaaaataacttaataagctttgtaaagtgctaa

SEQ ID NO: 10500 - protein, 134 aa, Unknown
  Obtained from environmental sample
  misc_feature (1)..(134): Xaa is any amino acid
MALKDLFKPKWQSENINKAIEALEKIKKQEDICDAAVRFYYLNREFIKLFDKLNETELIEKSGTEFLLGKFKNDALSDSEFKYCTPVMSKLEDNNLLENVLLNLEIYQKNSRYLFFINFKKFYLENNLISFVKC

SEQ ID NO: 10501 - DNA, 336 bp, Unknown
  Obtained from environmental sample
  misc_feature (1)..(336): n is a, c, g, or t
ttgaaactttctgttattatggctttaaatcaaacaaaaagagtagataaaataactttaggtcaagatgtttattatgattcttacagagaaagattttatgataaattaggtgaactatcttttacaaaatttgaatttcaggtattgaaattgttactacaaaatcatgctcgaataacaacttatgatgaaataaaagagaaagtttggaaagataaaaaaatgagtatctttacaatgcgaaatattattaataaaattaggaataaaacatattatgatattattaaaaatatctcatcaaatgggtatcaaatagatacaccaaaataa

SEQ ID NO: 10502 - protein, 111 aa, Unknown
  Obtained from environmental sample
  misc_feature (1)..(111): Xaa is any amino acid
MKLSVIMALNQTKRVDKITLGQDVYYDSYRERFYDKLGELSFTKFEFQVLKLLLQNHARITTYDEIKEKVWKDKKMSIFTMRNIINKIRNKTYYDIIKNISSNGYQIDTPK

SEQ ID NO: 10503 - DNA, 801 bp, Unknown
  Obtained from environmental sample
  misc_feature (1)..(801): n is a, c, g, or t
ttgagtatatccaaagctgatatattacaaccaattattgctatctcaatatttatcacttttattttaatagtcttacaagcaaccccccttgcatactcagttgaaaacaaaaacaaaattttagataatagttattttgtgaatgaaaaatcaaatatctttttaaaatataatgactattttatctactttaaaaagctctatcctttagaaaaaaaggctgaagatatccatatttttaaaactaaaaaccatgatattgttgaaatcatagtagcaaaaaaagcatactttcaaaataatagatggtatgtaatagatacaaaaattacaaaaaaaccagaagttattaactggagtcaatcaaaaataactacaactaatgaaaagtttttatacacactagaaggttttgaaccaaaaattataaacaatgtatataaaggagaaacacaattttccattatagatgcagtaagaaccatactactacttgagaatcaagactttaatacaaataagataaaaactatactttattctcaaatctttatgcctttttttgttatacctttgattgtaataatatttttatttacaaatcctagtagtagatttttcaatactgctgcttttacctctgtaacaatttttactacactgataacttggggagtgttatttttacttcaaaagcttgcatatggaggaatagttttaggtgaatttgctataataatgccattggttatcttatttgttataacctattatatttataataaaaaagtcatataa

SEQ ID NO: 10504 - protein, 266 aa, Unknown
  Obtained from environmental sample
  misc_feature (1)..(266): Xaa is any amino acid
MSISKADILQPIIAISIFITFILIVLQATPLAYSVENKNKILDNSYFVNEKSNIFLKYNDYFIYFKKLYPLEKKAEDIHIFKTKNHDIVEIIVAKKAYFQNNRWYVIDTKITKKPEVINWSQSKITTTNEKFLYTLEGFEPKIINNVYKGETQFSIIDAVRTILLLENQDFNTNKIKTILYSQIFMPFFVIPLIVIIFLFTNPSSRFFNTAAFTSVTIFTTLITWGVLFLLQKLAYGGIVLGEFAIIMPLVILFVITYYIYNKKVI

SEQ ID NO: 10505 - DNA, 402 bp, Unknown
  Obtained from environmental sample
  misc_feature (1)..(402): n is a, c, g, or t
ttgtataaagtggagaaaaatagcattaaaatcttactttgtaaatcaataaccagtaaaaaccgttggggatttttaaaaggtgttcaagaaaaaggggaatctgatttccaaactgcgataagagagtttagagaagagtcttcaataaacattgaaaaaagatatcttgaaaaatattttgaacaaaaaaatagtgaaaaagatataggtacttatctcgttaattataataatattcatagtattgaaaaatatttcaacgatgatatattacacaaaaaatatctttcatgggaaaataatgatgttaaattttttaatattaataccttaccaaatataaagaaaaaacaaaatagtctaatacaggatgttataaaatatttacaaaaggggtaa

SEQ ID NO: 10506 - protein, 133 aa, Unknown
  Obtained from environmental sample
  misc_feature (1)..(133): Xaa is any amino acid
MYKVEKNSIKILLCKSITSKNRWGFLKGVQEKGESDFQTAIREFREESSINIEKRYLEKYFEQKNSEKDIGTYLVNYNNIHSIEKYFNDDILHKKYLSWENNDVKFFNINTLPNIKKKQNSLIQDVIKYLQKG

SEQ ID NO: 10507 - DNA, 900 bp, Unknown
  Obtained from environmental sample
  misc_feature (1)..(900): n is a, c, g, or t
atggtagatacacttcctaaaaaccttactatgtttttggataatattgtactgcatggtggtaagccaattgttgtaggtggaagtgtgagggattatttattgaatatttcttgcagtgattacgatattgaagtttatggtatatctactcttgagatattagaaaagatattaaaaaactttggaaccgtaaattttgtaggaaaaagttttggtatattgaaactcattataagagatgttgtatatgatttttcatttccaagaactgaaaataagataggattaggacacaaagagttttctgtaatagtgaatagtgatttaagctttgaagatgcatctagaagaagagattttactatgaattcaattgggtatgattatactaaaaaagagtttttagacccatataatggtacaaaagatataaaaaataaactattaaaacatatagatgataaaagttttattgaagatccattacgagtatatagagcaattcaattttgtggaagatttgaacttacaatagataaaaatacacaaaaactttgtgataatttagttaaaagtgaagagtttaaaacactctcaaaagaaagagtttttaatgaatatgaaaaattacttctttattcaaaaaaaccatccataggattacaacttttagttcaattaaatatcataaatatatctgctgaaatgatgaataatattgattatatggtaaagtataaaacgaaaaattataaagaaaatcttgtattaatgttttattttttatttgacactttgcttgatatatctgaaaataaacaacttctaaaagatattaaaaaacttcaaaaatttaaagtacctgagatatataaaaaggagttaataggatattaa

SEQ ID NO: 10508 - protein, 299 aa, Unknown
  Obtained from environmental sample
  DOMAIN (86)...(240): Poly A polymerase family
  misc_feature (1)..(299): Xaa is any amino acid
MVDTLPKNLTMFLDNIVLHGGKPIVVGGSVRDYLLNISCSDYDIEVYGISTLEILEKILKNFGTVNFVGKSFGILKLIIRDVVYDFSFPRTENKIGLGHKEFSVIVNSDLSFEDASRRRDFTMNSIGYDYTKKEFLDPYNGTKDIKNKLLKHIDDKSFIEDPLRVYRAIQFCGRFELTIDKNTQKLCDNLVKSEEFKTLSKERVFNEYEKLLLYSKKPSIGLQLLVQLNIINISAEMMNNIDYMVKYKTKNYKENLVLMFYFLFDTLLDISENKQLLKDIKKLQKFKVPEIYKKELIGY

SEQ ID NO: 10509 - DNA, 501 bp, Unknown
  Obtained from environmental sample
  misc_feature (1)..(501): n is a, c, g, or t
atggtagatacacttcctaaaaaccttactattgttttggataatattgtactgcatggtggtaagccaattgttgtaggtggaagtgtgagggattatttattgaatatttcttgcagtgattacgatattgaagtttatggtatatctactcttgagatattagaaaagatattaaaaaactttggaaccgtaaattttgtaggaaaaagttttggtatattgaaactcattataagagatgttgtatatgatttttcatttccaagaactgaaaataagataggattaggacacaaagagttttctgtaatagtgaatagtgatttaagctttgaagatgcatctagaagaagagattttactatgaattcaattgggtatgattatactaaaaaagagtttttagacccatantatggtacaaaagatataaaaaataaactattaaaccntatagatgataaaagttttattgaagatcccttaacgagtatatag

SEQ ID NO: 10510 - protein, 166 aa, Unknown
  Obtained from environmental sample
  misc_feature (1)..(166): Xaa is any amino acid
MVDTLPKNLTIVLDNIVLHGGKPIVVGGSVRDYLLNISCSDYDIEVYGISTLEILEKILKNFGTVNFVGKSFGILKLIIRDVVYDFSFPRTENKIGLGHKEFSVIVNSDLSFEDASRRRDFTMNSIGYDYTKKEFLDPXYGTKDIKNKLLNXIDDKSFIEDPLTSI

SEQ ID NO: 10511 - DNA, 360 bp, Unknown
  Obtained from environmental sample
  misc_feature (1)..(360): n is a, c, g, or t
ttgagtatttcaattcgagaaccaattaaaagtgatgcaaaacatatttataagttagtaaaagatacaaatgttttagatgttaattctgaatatttatatcttttacaaacaactcattttagagagttttgtagtgttgctttattagaagagaaagttgtcggttttacttcagggtaccttataccaaatcaagaggatactttgtttatatggcaagttgctgttgatagcaagatgcgaggagaaggacttgctggaaaaatgattatggatatattacaaagggagtctgcaaaaaatgtaaaaactatacatacaactattagtccaagtaatagctcatctcaaaactgt

SEQ ID NO: 10512 - protein, 120 aa, Unknown
  Obtained from environmental sample
  DOMAIN (46)...(116): Acetyltransferase (GNAT) family
  misc_feature (1)..(120): Xaa is any amino acid
MSISIREPIKSDAKHIYKLVKDTNVLDVNSEYLYLLQTTHFREFCSVALLEEKVVGFTSGYLIPNQEDTLFIWQVAVDSKMRGEGLAGKMIMDILQRESAKNVKTIHTTISPSNSSSQNC

SEQ ID NO: 10513 - DNA, 372 bp, Unknown
  Obtained from environmental sample
  misc_feature (1)..(372): n is a, c, g, or t
gtgagtttagagaattactggcaaaacgatgacttgtcaaatgctgtattttataaagaaaaaatattaaaagagactttagaaaaaattgcacaaaaacataaagatacctatactattgatgtacgaggaagagggctagcatatggttttgagattaaagatgataaaacaatagctggagaaatatcagaatatgcttttaaagaaaatcttattatagaaacttgtggtagtgactctcaagttgtaaaatttcttccaccattagttatagatgaagatactttaagagaaggactaaaaagatttgaaacagctgtagataaactatttgctgataaaaaagataagttaagtgaggagttttaa

SEQ ID NO: 10514 - protein, 123 aa, Unknown
  Obtained from environmental sample
  misc_feature (1)..(123): Xaa is any amino acid
MSLENYWQNDDLSNAVFYKEKILKETLEKIAQKHKDTYTIDVRGRGLAYGFEIKDDKTIAGEISEYAFKENLIIETCGSDSQVVKFLPPLVIDEDTLREGLKRFETAVDKLFADKKDKLSEEF

SEQ ID NO: 10515 - DNA, 729 bp, Unknown
  Obtained from environmental sample
  misc_feature (1)..(729): n is a, c, g, or t
atgttgttggaaaattatagaaatgaatatgtatacaaaaaccttttaacttcttctataaaatcaaaagaaactacaaacaattatgcactattttcagaaatggacatcggaacaaattcacgattagatatagctcatttttcttctactaatcatgcatatgaaattaaaacagagttggattctttagctagattggaaaaacagttatccgactataaaaaaggttttgagtgtgtatggactgtaattccagaatccaaactaaataaactattactttcagttagtagcgatattggaataaaaattttagatgataacaacaacttacatacttacagagaagcgaagtctgagcttggtaatgtaacacacggagggttatttagcctattgagagaaaaagagtttctattattgttgcaaattcactatggtcacgagtttaactgccaatcgcatgaaacacaaaaaattctaatgagcatgtttgaagccattaatatagaacaagcccataaatattccgttaatattatcaagcagcggattttgcaacgtaagttttcattactaatcaataattctccaaatagcttattgtcaattggattgaacccctctatacaaaaagatgctaagaaatttttgtcttttttggattcatctattagtaactttgagaatcatattaatatggtgtgtcatggaaaactgttttaa

SEQ ID NO: 10516 - protein, 242 aa, Unknown
  Obtained from environmental sample
  misc_feature (1)..(242): Xaa is any amino acid
MLLENYRNEYVYKNLLTSSIKSKETTNNYALFSEMDIGTNSRLDIAHFSSTNHAYEIKTELDSLARLEKQLSDYKKGFECVWTVIPESKLNKLLLSVSSDIGIKILDDNNNLHTYREAKSELGNVTHGGLFSLLREKEFLLLLQIHYGHEFNCQSHETQKILMSMFEAINIEQAHKYSVNIIKQRILQRKFSLLINNSPNSLLSIGLNPSIQKDAKKFLSFLDSSISNFENHINMVCHGKLF

SEQ ID NO: 10517 - DNA, 768 bp, Unknown
  Obtained from environmental sample
  misc_feature (1)..(768): n is a, c, g, or t
atgaaaggatatgtgtttgttaaaaacagtgcaattgttttagactcaataaatccgctaaaagctgataattacagactctgtacattttgctcacaacctgataatttcataagttctgttttaccacaactaaagatggatcagaatcactatagagttcatgtagatcataaaacataccacgtcattaacaaaccaatttatgacggatttcaaaaagtaataggcgagatggtgctatttaaagaggttactgtttttgaaaatcaactttcaatactatttttaaatagcctaatactctattttttatctattttaatcatatatctaatatttaatagatatatgggacaacttctaaaacggctaaacagatcaaattttatcctcaataacattaatgactcagttattttactaaaaccaaatagtggaaagattattgatgcaaatgagagagctgaagctattttgggatacacacatgaagagttacttactaaaaatattgatgatattaagaagagtatctctgatgatgaatataacaactggcaagataatatatccaaattaaaattaacgcactatataacaaataaggcactctctataaaaaaagatggctcatatctgcctgtcgaatctaacttaacctatttaaataatgaaaatgaggagattgttgtatcagtcggtcgggatatctcccttcaggttgcccaagaagagcagttggcaaaaacaccacaacgaaatggg

SEQ ID NO: 10518 - protein, 256 aa, Unknown
  Obtained from environmental sample
  misc_feature (1)..(256): Xaa is any amino acid
MKGYVFVKNSAIVLDSINPLKADNYRLCTFCSQPDNFISSVLPQLKMDQNHYRVHVDHKTYHVINKPIYDGFQKVIGEMVLFKEVTVFENQLSILFLNSLILYFLSILIIYLIFNRYMGQLLKRLNRSNFILNNINDSVILLKPNSGKIIDANERAEAILGYTHEELLTKNIDDIKKSISDDEYNNWQDNISKLKLTHYITNKALSIKKDGSYLPVESNLTYLNNENEEIVVSVGRDISLQVAQEEQLAKTPQRNG

SEQ ID NO: 10519 - DNA, 639 bp, Unknown
  Obtained from environmental sample
  misc_feature (1)..(639): n is a, c, g, or t
gtgtttttaacacttccatcaaaagaggatagattaaaaatactgaatctttatctaaaagataaaaaatataactttgatatagaaaaattatcatcagatacaagtggatttagtagtgctgcactagcaacacttgtaaatgagtcgttactaaatatgataaaaagagatgggaatacagttttagaagaagatatagcaattgcaaaacaaaaaatacaacatggtaaaaagcagatacatatactcaatgaggaacaaaaagatattttagcaacttaccaagcgggtaaagcatttattacaaaagcaaaagtgaatctttttgaaaatgggatagtacaagaggatttaatatatccatcacttacacagttacaaaatcaaattaaaaaatatttagctggcagtatcgctttagagataattaaaggtgaatcttatattgtatttgaagatgagataaaagaagcttataaaatagctcataatctagtagaagtatacaagatgaaaacttcacaagagagtgtgatacaaaaagcaaaagatgatttaaaagatgaaatatctgcaaatattgaagttgtaaaagagttaaaaaggaagcttttaaaggatgaaattgtattttag

SEQ ID NO: 10520 - protein, 212 aa, Unknown
  Obtained from environmental sample
  misc_feature (1)..(212): Xaa is any amino acid
MFLTLPSKEDRLKILNLYLKDKKYNFDIEKLSSDTSGFSSAALATLVNESLLNMIKRDGNTVLEEDIAIAKQKIQHGKKQIHILNEEQKDILATYQAGKAFITKAKVNLFENGIVQEDLIYPSLTQLQNQIKKYLAGSIALEIIKGESYIVFEDEIKEAYKIAHNLVEVYKMKTSQESVIQKAKDDLKDEISANIEVVKELKRKLLKDEIVF

SEQ ID NO: 10521 - DNA, 357 bp, Unknown
  Obtained from environmental sample
  misc_feature (1)..(357): n is a, c, g, or t
atgctaacagacatcaatccaaaattacccatgcgtgataaaaaagtgactcgagaattttactcaaaccaattgggttttaaggaatttggtagcactgattatgaaggttatttaatgatggaaaaagatcgcgttcaaattcatttctttgaatttaaagaaattgacccgaaagaaaattatggacaagtttatattagaacgaaccatattgacgcattttataaatcattattggaaaaacggacaaaaattcaccctaatggaacattggaaattaaaccttggggacaaaaagaattttctattcttgatcccgacagtaatttattgacatttggccaagctatctaa

SEQ ID NO: 10522 - protein, 118 aa, Unknown
  Obtained from environmental sample
  misc_feature (1)..(118): Xaa is any amino acid
MLTDINPKLPMRDKKVTREFYSNQLGFKEFGSTDYEGYLMMEKDRVQIHFFEFKEIDPKENYGQVYIRTNHIDAFYKSLLEKRTKIHPNGTLEIKPWGQKEFSILDPDSNLLTFGQAI

SEQ ID NO: 10523 - DNA, 381 bp, Unknown
  Obtained from environmental sample
  misc_feature (1)..(381): n is a, c, g, or t
ttgctgttaaaaataaataccacgttgattacatacgattatattattttaggtgcaggtgcgtctgggttgcttttagcataccgaatgtctcaagatgctttttttgatgataaatctattttaatcatagaccaagtaaaaaataagggcaacgacagaacttggtgttattgggaaaacggagtaggagaatgggatgcacttgtgtgtaaacaatggtctaagatttattttggtagtgcatggttttctaaaatcattgctataatgccgtttcagtataaaatgataaggagtggtatcttttatgatacattatggactaaaataaacgctaaatcaaatattagttttgtgaaggaagccgagccaatctga

SEQ ID NO: 10524 - protein, 126 aa, Unknown
  Obtained from environmental sample
  misc_feature (1)..(126): Xaa is any amino acid
MLLKINTTLITYDYIILGAGASGLLLAYRMSQDAFFDDKSILIIDQVKNKGNDRTWCYWENGVGEWDALVCKQWSKIYFGSAWFSKIIAIMPFQYKMIRSGIFYDTLWTKINAKSNISFVKEAEPI

SEQ ID NO: 10525 - DNA, 741 bp, Unknown
  Obtained from environmental sample
  misc_feature (1)..(741): n is a, c, g, or t
atgagagttctattttttatatttatctctttaactactctttttgctgaaaatgtagtacctcttttagagaataatattacacaagaacagataaaagagcaagagaagaagatagagctagatagagaacttacagctcatgtcgcagagttgaaagctgtaaatgaaagtataaatcaagatagtgtatggcttaaaagttataatacatatttgacttcaatcggaattggagataatttaaaagatctccaaaaaaagattaaggaactatctagaaagaagaaaaagagcgatgcagttcttgaagagatatcagcacttaaagcaaaagagaaaattcttgcagatcaggttgatctgttaaagggtgatgcaaaaataccatttgctaaactacttacacctgagagtatagatgatattcctacgataaacacaccttttgatatttttaccggtatatcttttgtaaaagtacttgatcaaaaatatgatgaatactcaaaacgtagagataatctcaaagtaattagtaagcttatagctcaaaaagtgaaaattttaaaagctattttagcattaaataaagatgataaagaagtagaagatgatctgaaaaaatcttcacttatgtatganaagtttaaacttgctcttgatacagttgaatctacttcagaggtatatattcagcgtataaagcagatagaagagggtataaataagagtattang

SEQ ID NO: 10526 - protein, 247 aa, Unknown
  Obtained from environmental sample
  SIGNAL (1)...(16)
  misc_feature (1)..(247): Xaa is any amino acid
MRVLFFIFISLTTLFAENVVPLLENNITQEQIKEQEKKIELDRELTAHVAELKAVNESINQDSVWLKSYNTYLTSIGIGDNLKDLQKKIKELSRKKKKSDAVLEEISALKAKEKILADQVDLLKGDAKIPFAKLLTPESIDDIPTINTPFDIFTGISFVKVLDQKYDEYSKRRDNLKVISKLIAQKVKILKAILALNKDDKEVEDDLKKSSLMYXKFKLALDTVESTSEVYIQRIKQIEEGINKSIX

SEQ ID NO: 10527 - DNA, 720 bp, Unknown
  Obtained from environmental sample
  misc_feature (1)..(720): n is a, c, g, or t
atggctttaaaagaggcagcacttgtgtttgagcatactcatgaaggaattatgattacagatgaaaaagccaaaatcattagaatcaacagtacatttacagagataacaggttttactcttgaagatgtatatggcaaaaacccaagtatattacaatctggcaatcatgacaaagaattttacaaagatgtatgggaaacgttaaataataatggcacttggtgcggagagtttaaaaatagacgtaaaacaggagaatacttcgctacatttcagagtattacagctgttaagaatgaagatggaacagtaagcggctatgtatctgtattttctgatataagtgaacgtaaaaacaacgagatacagttggcttatcttgctactcatgattcgctaacatcgctgccaaacagaatgtattttcatgacaatcttcataaatcgatacaagttgcaaaaagaaacagatataaaattgccgtacttttcttagacctgaatcattttaaagatgtaaatgacacatttggacatgaggttggtgatcatcttttaaaagaggtagccgacaggttaaaaagttgtgtaagagaagaggacacaatagccagacttggcggagatgaatttgcagtcatacttcctgagctngaaattgctgaagatgcactcattattgctcaaaaaatcatagagaaggtaggtgaaactctg

SEQ ID NO: 10528 - protein, 240 aa, Unknown
  Obtained from environmental sample
  DOMAIN (4)...(67): PAS domain
  misc_feature (1)..(240): Xaa is any amino acid
MALKEAALVFEHTHEGIMITDEKAKIIRINSTFTEITGFTLEDVYGKNPSILQSGNHDKEFYKDVWETLNNNGTWCGEFKNRRKTGEYFATFQSITAVKNEDGTVSGYVSVFSDISERKNNEIQLAYLATHDSLTSLPNRMYFHDNLHKSIQVAKRNRYKIAVLFLDLNHFKDVNDTFGHEVGDHLLKEVADRLKSCVREEDTIARLGGDEFAVILPELEIAEDALIIAQKIIEKVGETL

SEQ ID NO: 10529 - DNA, 696 bp, Unknown
  Obtained from environmental sample
  misc_feature (1)..(696): n is a, c, g, or t
ttgggtgcattagatgctctttgcttactaaagcttgttagcagtgttagaaaagatgtgagaatcgttgcaaatgattttttagcaggtattgactctttaaactctctatttattaaaattgataactacaaaacaaaacaatcaaaagagaatatcaaaaaaatatatacagctttagacaatgaagaggcggtaattatatttccagctggtgaagtgagtcgtgtatctcctacaggtataaaagatggtaagtggcaaaaaggttttttaaagtttgctaaaaaatcaaatagccctattttaccaatacttgttgatgcaaaaaactctaaaactttttatactgtttctattttaaataaaacattttcaactatccttttatctgatgagatgtttaaacaaagagataaaaatgtcacaataaaagttggaaaacttatagcaaatgagcatatacttcatagcacctcagataaacttagtattgtagatcaatataaaaaacacctctatggtcttaaaaaagggaaaaaacaatattttgaaactatcaatactattgcccgtgaagaaaatagacaaagtctcaaaaaagaattaaaatcttcacagcttataggacaaacagctgatggtaaaaaaatttacctttatgattatgttgataacagtgcacgtgatgaatga

SEQ ID NO: 10530 - protein, 231 aa, Unknown
  Obtained from environmental sample
  misc_feature (1)..(231): Xaa is any amino acid
MGALDALCLLKLVSSVRKDVRIVANDFLAGIDSLNSLFIKIDNYKTKQSKENIKKIYTALDNEEAVIIFPAGEVSRVSPTGIKDGKWQKGFLKFAKKSNSPILPILVDAKNSKTFYTVSILNKTFSTILLSDEMFKQRDKNVTIKVGKLIANEHILHSTSDKLSIVDQYKKHLYGLKKGKKQYFETINTIAREENRQSLKKELKSSQLIGQTADGKKIYLYDYVDNSARDE

SEQ ID NO: 10531 - DNA, 591 bp, Unknown
  Obtained from environmental sample
  misc_feature (1)..(591): n is a, c, g, or t
ttgttgaaaaaatacgcaattattatagagtatgcaaaaggtagtgacaaaagttttgatggatttagaccagatacgaaacctattttaaagtcactaaaaaatatagcaaatattgatggtgaagttgttttttataatccaaaaagaaaacaagagttatttaaatatatcaaaaatacagcttcgattgttataagtagaatcaatcctggaaatctcaaagagatagatgagtattttatttttttaaaatctttaagtgatggtggtattaatatacatactcatcctgatgtgatgataaatcttgattttaaagatatcttagaaaagctcaaaaactcccttgtaggagacaaaggaactatgtttttccacacttacaaagagttcaaaaaagaatttcctcaaatccttgaaaaatatagagtacgagttctcaaaacaaactatggttcaactggagaaggagtttatcttataaatttaagagatgatgaaagtattgtatgtactgaggctgttgataatatcaaatatttttatagcaatatggacgaatttatcaaaagtttaaagaaaaattaa

SEQ ID NO: 10532 - protein, 196 aa, Unknown
  Obtained from environmental sample
  misc_feature (1)..(196): Xaa is any amino acid
MLKKYAIIIEYAKGSDKSFDGFRPDTKPILKSLKNIANIDGEVVFYNPKRKQELFKYIKNTASIVISRINPGNLKEIDEYFIFLKSLSDGGINIHTHPDVMINLDFKDILEKLKNSLVGDKGTMFFHTYKEFKKEFPQILEKYRVRVLKTNYGSTGEGVYLINLRDDESIVCTEAVDNIKYFYSNMDEFIKSLKKN

SEQ ID NO: 10533 - DNA, 792 bp, Unknown
  Obtained from environmental sample
  misc_feature (1)..(792): n is a, c, g, or t
atgccagatattgatatggatttttgtcaagcaagacggcaagaggtcatagactatgttgttgaaaaatatggtcgagcaaatgtagctcaaattatcacttttgggaaacttcttgcaaaaggtgttattcgagatgttgctagagttcttgatatgccttattctcaagcagatgcaatggcaaaacttataccagatgaattagggataaatttaaaagatagttgggaaaaagagcctaagataaaagagttgtgcgaatctgatccaaaagctgcaagggtatgggagtatgctttggcattagagggattaaatagaaatgctggaacacacgcagcaggtgttgttatctcaaatgaagctttatggaaaaaaacaccactttttaaaccatcaggactggatacattagctacgcagtacaatggaaaatatgtagaggatgtagatttaatcaagtttgacttcttaggattaaaaactcttactgttatagagggtgcattacaacttattgaaaaaagagatgggaggagaataaactttattgaagaagatgtaaatgataaaggtgtttatgaactaattcaaacagggcatacaatagggttgtttcaaatagagtcttcaggtatgcaagatttaaatagacgactaaagccctctaactttgaagatattatccccgtactttgcctttatagaccaggtcctatggagtctgggatgcttgatgacttttttgataaaaaacagggaccaactgaaaaaaaactatttttatga

SEQ ID NO: 10534 - protein, 263 aa, Unknown
  Obtained from environmental sample
  misc_feature (1)..(263): Xaa is any amino acid
MPDIDMDFCQARRQEVIDYVVEKYGRANVAQIITFGKLLAKGVIRDVARVLDMPYSQADAMAKLIPDELGINLKDSWEKEPKIKELCESDPKAARVWEYALALEGLNRNAGTHAAGVVISNEALWKKTPLFKPSGLDTLATQYNGKYVEDVDLIKFDFLGLKTLTVIEGALQLIEKRDGRRINFIEEDVNDKGVYELIQTGHTIGLFQIESSGMQDLNRRLKPSNFEDIIPVLCLYRPGPMESGMLDDFFDKKQGPTEKKLFL

SEQ ID NO: 10535 - DNA, 744 bp, Unknown
  Obtained from environmental sample
  misc_feature (1)..(744): n is a, c, g, or t
atgattgcaggtgtcaaattaaagaaatctaaagggaacagaatggcaaatgtcattttaactggcggaagtggtctcgcctccttgccccaaaaagttgcccatggtttagatgttgctttctcaaaacaaacatcagaatcaggagaaaacctaattattcttcttcaaaataaaattcgattcgcaagacctgcatatgagagaagtaaaaaatgtcttggtaacacagttaatattgagcttgatgaaattattttatctactgttttagaggtgttagaagaaacggtaggtgttgaaatataccagcaaggcacctaccttgtcccatttgaggaagctgtgcagatagtcaaaaaattacaagaattatttccccataaagataagccgaaaaataaacaaaaaataacgcgaccaggcaaaaacatatttttcatagttttgatcataggtatcttagttatcgcaactccatttctttttaggtacgcagaattgcaatattattatttaaagggtaatgatttctacagtcatggcaaaaaaggaaaagctttagctgcatatgataaaatgttggagattaactcaaatgatatagatgcatggatcggaaagggacgcacttaccaagctctcgacccacagcataagacattagaatcctttgataaagcgttggaaattaaacccaataatgtgacatggtattataaggggcgcgccctctatctttga

SEQ ID NO: 10536 - protein, 247 aa, Unknown
  Obtained from environmental sample
  DOMAIN (202)...(235): TPR Domain
  misc_feature (1)..(247): Xaa is any amino acid
MIAGVKLKKSKGNRMANVILTGGSGLASLPQKVAHGLDVAFSKQTSESGENLIILLQNKIRFARPAYERSKKCLGNTVNIELDEIILSTVLEVLEETVGVEIYQQGTYLVPFEEAVQIVKKLQELFPHKDKPKNKQKITRPGKNIFFIVLIIGILVIATPFLFRYAELQYYYLKGNDFYSHGKKGKALAAYDKMLEINSNDIDAWIGKGRTYQALDPQHKTLESFDKALEIKPNNVTWYYKGRALYL

SEQ ID NO: 10537 - DNA, 507 bp, Unknown
  Obtained from environmental sample
  misc_feature (1)..(507): n is a, c, g, or t
ttgaaaaaaatcattctactttctactttactatttttagcacttaatgctagagaaaatcctttttttgcttcatcatctcaagagaacatgccagtaagttcaaatttagttgagagttttgaacctctgaaacgtgcttcagttacacttccggatagttcaagaattttacaagaggtaacatttaaatatcaaaatttagatggttcagtagatgaaaaagtgttaaaactagatcaaagtatagactggcatcttccaatattcatatctcaaaacatgcaagtttctcaaaaagatgaaaatttaatgacaaatatggagctgaaaaaagatataanaaaagatctcaaaatagttaaaaactctttattggcagatttttcatttataaaaatttttacagctaacaaaaataatatgaaaattggataccggatgaaaaattggaacctccattttggaacaaaaaaacccgcaaaagaaaaaatttataatttttaa

SEQ ID NO: 10538 - protein, 168 aa, Unknown
  Obtained from environmental sample
  SIGNAL (1)...(17)
  misc_feature (1)..(168): Xaa is any amino acid
MKKIILLSTLLFLALNARENPFFASSSQENMPVSSNLVESFEPLKRASVTLPDSSRILQEVTFKYQNLDGSVDEKVLKLDQSIDWHLPIFISQNMQVSQKDENLMTNMELKKDIXKDLKIVKNSLLADFSFIKIFTANKNNMKIGYRMKNWNLHFGTKKPAKEKIYNF

SEQ ID NO: 10539 - DNA, 792 bp, Unknown
  Obtained from environmental sample
  misc_feature (1)..(792): n is a, c, g, or t
atggatcagaatcggctcgagaaatacgatatagagataagtctcagtggagataatgacaaagagttaagtgaggctataaaaactatcaaaacagaactagaaaatataaaaggggtaaaaaatatcgccgatgatatacttttaggaaaccttgatttgaaattttctatcaatccttatgggcaatctttagggtttagtgaaactgatgttgtgaacttacttaaaccttattatttcaaagggagtttctctaaaatgtatgatgatacgggtgtggttgatatagtgtttcaaagtgtcaataaagatatcaaaaaatctcttgataattttgaaattctaataccaaatagtgacaaaaaagtccttctaaacgatatagtagatttcaaaacaaaatcaagccttagtcaaatcttcaaagaggatggagtagcgatacaaactatcacagcttcattagatgggatcacaagtacagagctttatactcaacttaatcctgttttagatagtttaaaagataaagtgactatagatatcaaaggggaacaaaaagaaaaccaaaaagtacagatggagatgggacaagcttttatcatagcacttattcttatctttatctctttggtatggatgtttgatagtttagtaaaatctctcatcatcctaagtaccatccctctttcagttttaggtggtctggttggacattttatcatgggattgaatcctacaatgcctggacttataggtatggttggacttgctgggggtaattggtaa

SEQ ID NO: 10540 - protein, 263 aa, Unknown
  Obtained from environmental sample
  misc_feature (1)..(263): Xaa is any amino acid
MDQNRLEKYDIEISLSGDNDKELSEAIKTIKTELENIKGVKNIADDILLGNLDLKFSINPYGQSLGFSETDVVNLLKPYYFKGSFSKMYDDTGVVDIVFQSVNKDIKKSLDNFEILIPNSDKKVLLNDIVDFKTKSSLSQIFKEDGVAIQTITASLDGITSTELYTQLNPVLDSLKDKVTIDIKGEQKENQKVQMEMGQAFIIALILIFISLVWMFDSLVKSLIILSTIPLSVLGGLVGHFIMGLNPTMPGLIGMVGLAGGNW

SEQ ID NO: 10541 - DNA, 456 bp, Unknown
  Obtained from environmental sample
  misc_feature (1)..(456): n is a, c, g, or t
ttggggtgtatcgctgagagcgacacccactatctttatacggcgtttcatgatacaaaatacctcaaggctgcatttgaatcaggagccaatgattttatcaaaaaaccttttgatcttgaagaactctcacaacgaatagaaaatattaaacgccagtttggacttgacagtattatagagatagataaaaacactacttttgatgtcaaaacacatactataaggacagaatcaacctgctttgtaacaacacgaaaagagagtgactttttacactatctctacaaaaatcgtgctcgtgtagtaagtagtgaagaactcttgcaaaatatctgggaattttatgagatgccaagcgatgatgccgttagaacagtcgtaaaaaacttacgtaaatatattggtaaagagcacattgtaaatatccgagggatgggttataaatatgaatga

SEQ ID NO: 10542 - protein, 151 aa, Unknown
  Obtained from environmental sample
  DOMAIN (79)...(150): Transcriptional regulatory protein, C terminal
  misc_feature (1)..(151): Xaa is any amino acid
MGCIAESDTHYLYTAFHDTKYLKAAFESGANDFIKKPFDLEELSQRIENIKRQFGLDSIIEIDKNTTFDVKTHTIRTESTCFVTTRKESDFLHYLYKNRARVVSSEELLQNIWEFYEMPSDDAVRTVVKNLRKYIGKEHIVNIRGMGYKYE

SEQ ID NO: 10543 - DNA, 543 bp, Unknown
  Obtained from environmental sample
  misc_feature (1)..(543): n is a, c, g, or t
atgaaaagaaaatggtttatttttattttaactgcattggtaactattgctgctacaatctattcatttacacaggcatcagtgtatgaagctaaagcagtagtagaagttggaagttttagtaatagtaatagtaatagtaatagtaatagtaatagtaattatatcgaaaacccacaaaatcttgttaaaaaactagaagttgtcaatatagaaaatgaaacagataaaacagaagcttttatcacatcaatttcagttgtgaaatcaacttcaaatcttattgaaatagtgagtaatggtaactcaaaagaaacagctgtaagtgttttagataaacttgtaagtgctcttcaattaaaacataaaagcttagttgatagttacaagtctttggttattgctaatattaataatcttaaatcacaaaaagatttattagagaagaaagaaaacccgttcgatggaagtttagctgtgaaatttgacttgatttcaaacatcaatgcacttggactaagtatatccaatataatattatag

SEQ ID NO: 10544 - protein, 180 aa, Unknown
  Obtained from environmental sample
  SIGNAL (1)...(17)
  DOMAIN (2)...(117): Chain length determinant protein
  misc_feature (1)..(180): Xaa is any amino acid
MKRKWFIFILTALVTIAATIYSFTQASVYEAKAVVEVGSFSNSNSNSNSNSNSNYIENPQNLVKKLEVVNIENETDKTEAFITSISVVKSTSNLIEIVSNGNSKETAVSVLDKLVSALQLKHKSLVDSYKSLVIANINNLKSQKDLLEKKENPFDGSLAVKFDLISNINALGLSISNIIL

SEQ ID NO: 10545 - DNA, 675 bp, Unknown
  Obtained from environmental sample
  misc_feature (1)..(675): n is a, c, g, or t
atggatattttattgacagattcaactgaagcagaagttattaatttattggggaatacatatttagcaatgagagttgcgtattttaatgaactagattcttatgcacaatcacataatcttgatacaaaacagattattgaaggagttggactagacccaagaattggaaaacactataataacccaagctttggctatggtggttattgtcttcctaaagatacaaaacaacttttagcaaattatgcagatgtaccatccaatttgatagaagcaattgtaaaatcaaatagtacaagaaaagattttatagcagatagtattttagcaaaattagaacctctgtcactaaatgccgatactcccgtcgttaaaacgaaagaggggtgcaaagtagtagggatatatcgacttacaatgaagacagatagtgataattttagaagtagtgcaattcaaggtattatgaaacgaatcaaagcaaaaggtattgaagtagttatttatgaaccggtcttacaagaaaaagagttttttcattcaaaagtaattgaagatcttgatgagtttaaaaatatcagtgatgtgatagttgcaaatagattaagtgaaaatatggtagatgtaaaagagaaagtttacacaagagatatctttaatagtgatagttaa

SEQ ID NO: 10546 - protein, 224 aa, Unknown
  Obtained from environmental sample
  DOMAIN (135)...(222): UDP-glucose/GDP-mannose dehydrogenase family, UDP binding domain
  misc_feature (1)..(224): Xaa is any amino acid
MDILLTDSTEAEVINLLGNTYLAMRVAYFNELDSYAQSHNLDTKQIIEGVGLDPRIGKHYNNPSFGYGGYCLPKDTKQLLANYADVPSNLIEAIVKSNSTRKDFIADSILAKLEPLSLNADTPVVKTKEGCKVVGIYRLTMKTDSDNFRSSAIQGIMKRIKAKGIEVVIYEPVLQEKEFFHSKVIEDLDEFKNISDVIVANRLSENMVDVKEKVYTRDIFNSDS

SEQ ID NO: 10547 - DNA, 414 bp, Unknown
  Obtained from environmental sample
  misc_feature (1)..(414): n is a, c, g, or t
atgtttaaaacaataaattttaaaaaatacacctctattcatattggtggagagcataatgtaaaagttataaatgaggtaggtgaatattcacaattccgaattttaggtcgtggaaataatattcttatctcaactactccacccccaatggcactcttaggcgaaaagtttgattatctgaaccaagtggcgcaccaactctcagtcggcgcacctacatctagtggtaaacttcttacatattgtagaaaaaatgatatagcacattttgagcttcttgcaaaactccgtggaaatatgggtggtttagtgaagatgaatgcagggcttaaagagtgggagatctttaactatctttattctataaaaactcaagatggggagatattaaaaaaaggatacccctcatag

SEQ ID NO: 10548 - protein, 137 aa, Unknown
  Obtained from environmental sample
  misc_feature (1)..(137): Xaa is any amino acid
MFKTINFKKYTSIHIGGEHNVKVINEVGEYSQFRILGRGNNILISTTPPPMALLGEKFDYLNQVAHQLSVGAPTSSGKLLTYCRKNDIAHFELLAKLRGNMGGLVKMNAGLKEWEIFNYLYSIKTQDGEILKKGYPS

SEQ ID NO: 10549 - DNA, 414 bp, Unknown
  Obtained from environmental sample
  misc_feature (1)..(414): n is a, c, g, or t
atgacaaaggctataaagcatattttttttgacttggatcatacactttgggattttgataaaaattctggattaacttttgaaaagatatttaaaacaaataatattgatatcgatttaaatgactttttacaagtttatgaacctattaatttcgaatactggaaactttatagagaagagaaagtaaccaaatcggcattgcgttacggaagattaaaaaaatccttcgatggaataggtgttagtgtagaagatgatcttataaaccttttatctaacgcttatattgatgagttaacctcatttaaccatgtgtttgaagggacgtatganatcttagattatttaaaagaaagatatcaattgcatatcactaccaatggatttgaagaagcacaagagaaaaattag

SEQ ID NO: 10550 - protein, 137 aa, Unknown
  Obtained from environmental sample
  misc_feature (1)..(137): Xaa is any amino acid
MTKAIKHIFFDLDHTLWDFDKNSGLTFEKIFKTNNIDIDLNDFLQVYEPINFEYWKLYREEKVTKSALRYGRLKKSFDGIGVSVEDDLINLLSNAYIDELTSFNHVFEGTYXILDYLKERYQLHITTNGFEEAQEKN

SEQ ID NO: 10551 - DNA, 477 bp, Unknown
  Obtained from environmental sample
  misc_feature (1)..(477): n is a, c, g, or t
ttgtnnttggcttatgctcggatattgggttttgtttttgttggtgctgtaagtggtgcaacaaatatcttaaatcctctagaaaagtttacttcaggtaaaactatttcaatgcaacaaaatgaattagtatttaaaagtgttaaaaatatagctgaactagaagaggcaataaagagttctgataagccagttatgttagatttttatgctgattggtgtgtctcttgtaaagagcttgaagagataacatttaaagatgaacaagttattcaaaagctaaaaggttttactttacttcgagctgatgtaacggcaaacaatcaagatgataaagagttacaaaaaagatttgatatagttggacctccaggattgattttctgggatgaaaacaaaaaagagataaatgcagcaaaaatagttggatataaaaatccaaaagattttttagaaatagttaataaatatttttag

SEQ ID NO: 10552 - protein, 158 aa, Unknown
  Obtained from environmental sample
  DOMAIN (45)...(158): Thioredoxin
  misc_feature (1)..(158): Xaa is any amino acid
MXLAYARILGFVFVGAVSGATNILNPLEKFTSGKTISMQQNELVFKSVKNIAELEEAIKSSDKPVMLDFYADWCVSCKELEEITFKDEQVIQKLKGFTLLRADVTANNQDDKELQKRFDIVGPPGLIFWDENKKEINAAKIVGYKNPKDFLEIVNKYF

SEQ ID NO: 10553 - DNA, 678 bp, Unknown
  Obtained from environmental sample
  misc_feature (1)..(678): n is a, c, g, or t
atgggagagtatgatctgatattaatggatctacaaatgcctattttggatggatttaaagctagtaaaattattaattcatttagtagaaatattccaatagtagcacttagtgcagcagttatgcaagaggataaagcaagaacaaaagaggcaggtatggtcgcacatcttgctaaaccgattgatcagaatgaacttattaagacattaatatcttttattaaaccaaaagttgatatacataagccaaaaaaagttgttgaaacaaataagaaaaatgagagtgagctcaacgagttgtatggagttgatttagaggagctaaagtcaagagttgtagataatccagatgtgattaaaaaaataattttaagtttttgtgacaattataaagatgttgacaagatgttagatattgaagatgtcgatagtgatgagtttaaaagggtaattcactctttaaaaggtgtcagcggcaatgtttcacttaaagatatatatcacctctctaaagagattcatgactgtaatgatttagataaaaagagagagctatctccaaagcttgtagagatggttaaagagacggtatatcatctaagagagcagttgaacgatctgagtaagactaaagttgttaatagttatgatccaaaagaggtaactattatatga

SEQ ID NO: 10554 - protein, 225 aa, Unknown
  Obtained from environmental sample
  DOMAIN (1)...(79): Response regulator receiver domain
  misc_feature (1)..(225): Xaa is any amino acid
MGEYDLILMDLQMPILDGFKASKIINSFSRNIPIVALSAAVMQEDKARTKEAGMVAHLAKPIDQNELIKTLISFIKPKVDIHKPKKVVETNKKNESELNELYGVDLEELKSRVVDNPDVIKKIILSFCDNYKDVDKMLDIEDVDSDEFKRVIHSLKGVSGNVSLKDIYHLSKEIHDCNDLDKKRELSPKLVEMVKETVYHLREQLNDLSKTKVVNSYDPKEVTII

SEQ ID NO: 10555 - DNA, 630 bp, Unknown
  Obtained from environmental sample
  misc_feature (1)..(630): n is a, c, g, or t
atgcataatattgataaaaattatagtaccacaagacttttgatacaggaaaaaccttcaatagtaagcaattctaaagataagtttgaaacttttttatttatgccagagtgccaaaatagaaaaggtgaaggtggacttagaacaaaagactattttaagaaatcttctatagataaagctttgataagggtagtaacagttgtttacaatggagaaaaatatttagaagaaacaatccaaagtatcataaatcaaacttacgaaaatatagaatatattattattgatggtggaagtagtgatacaactatagatattatcaagaaatatgaagataggatcgattattgggtcagtgaaaaagatagtggtatttatgatgctatgaataagggtattaaactttgtagtggagatattatagggattgttaatgctgatgattatttgtataagaatacaattagtcagttgattgatatatatttgaaagataagtttgactatacatatggttttttggactgtattagtgaaaatggtgataaattgaacactattgagtctcttggtacttcacattttaaatataattttttcaagcatatgncctcgagccgattctga

SEQ ID NO: 10556 - protein, 209 aa, Unknown
  Obtained from environmental sample
  DOMAIN (64)...(208): Glycosyl transferase
  misc_feature (1)..(209): Xaa is any amino acid
MHNIDKNYSTTRLLIQEKPSIVSNSKDKFETFLFMPECQNRKGEGGLRTKDYFKKSSIDKALIRVVTVVYNGEKYLEETIQSIINQTYENIEYIIIDGGSSDTTIDIIKKYEDRIDYWVSEKDSGIYDAMNKGIKLCSGDIIGIVNADDYLYKNTISQLIDIYLKDKFDYTYGFLDCISENGDKLNTIESLGTSHFKYNFFKHMXSSRF

SEQ ID NO: 10557 - DNA, 336 bp, Unknown
  Obtained from environmental sample
  misc_feature (1)..(336): n is a, c, g, or t
ttggtggaattggaaagaaggttttttgggttgattaaaatttttctaaaggaggtcgtcagttcattcttatttggaagggaggaagttcttctgttgaaggagtgtaaaaagtgttggaaaaagggatggttattttcagacttgagtgttcataaaagaacaatattttttcagctacattttttgaaaaaaaatcatgtggaatcttttaaaccatattttaggaaaattattataatttttgagggacaaataatagaaagtgaagaaataagaacaaaattatttgcaaataaatatgttaaaatcgtaaaagagctcaataatgcataa

SEQ ID NO: 10558 - protein, 111 aa, Unknown
  Obtained from environmental sample
  misc_feature (1)..(111): Xaa is any amino acid
MVELERRFFGLIKIFLKEVVSSFLFGREEVLLLKECKKCWKKGWLFSDLSVHKRTIFFQLHFLKKNHVESFKPYFRKIIIIFEGQIIESEEIRTKLFANKYVKIVKELNNA

SEQ ID NO: 10559 - DNA, 444 bp, Unknown
  Obtained from environmental sample
  misc_feature (1)..(444): n is a, c, g, or t
ttgagaattatttcaggttatgatttgggaattgatgcagggggggccattagagccgaccgactagaaatgggaactaatttaaaagttaaaggtaataagaatctttatgcattttggggcgatattattactaaacaactcaataaagaactaaaagcaatagatgaaaacacacttattaatcttgcctccaaagaatatttcaaaagtataaatccgaatattttagaggccaacattattacacctgtttttaaagaaaataaattaggcaattacaaaataataagcatttttgctaaaaaagcaagaggtcttatgacaaggtacataatgcaaaatcaaattacaaaacctaaagatttgattcattttgataaggaaggatattattataatccaaatcttagttcaaaatcagaatttgtatttatacgttaa

SEQ ID NO: 10560 - protein, 147 aa, Unknown
  Obtained from environmental sample
  DOMAIN (1)...(147): Protein of unknown function (DUF328)
  misc_feature (1)..(147): Xaa is any amino acid
MRIISGYDLGIDAGGAIRADRLEMGTNLKVKGNKNLYAFWGDIITKQLNKELKAIDENTLINLASKEYFKSINPNILEANIITPVFKENKLGNYKIISIFAKKARGLMTRYIMQNQITKPKDLIHFDKEGYYYNPNLSSKSEFVFIR

SEQ ID NO: 10561 - DNA, 318 bp, Unknown
  Obtained from environmental sample
  misc_feature (1)..(318): n is a, c, g, or t
ttgaatacaaaattaataaactttataataagaaaatatcttaaatttgataaaaaaaatccacttatctctataagtgctattttggcatttgtgggagttagtgttggggtgatggttttaattgtcgctatggctattatgaatggaactgctaaagagttcaaagataaactttttactatgaattatcctctaagtatctatcctcaaatagatgggacactaaatgaaggacttctatataagttagagaaaaaatttcccgaattaaagttttcaccctatttaacttctcaagtgatgattcaacagtga

SEQ ID NO: 10562 - protein, 105 aa, Unknown
  Obtained from environmental sample
  misc_feature (1)..(105): Xaa is any amino acid
MNTKLINFIIRKYLKFDKKNPLISISAILAFVGVSVGVMVLIVAMAIMNGTAKEFKDKLFTMNYPLSIYPQIDGTLNEGLLYKLEKKFPELKFSPYLTSQVMIQQ

SEQ ID NO: 10563 - DNA, 468 bp, Unknown
  Obtained from environmental sample
  misc_feature (1)..(468): n is a, c, g, or t
ttgaactggtcgacgtattttcctccgtctgagcctcaaccgcaaaacgatctgcagcaggagagaagtccatggaagatcgatattgccaaagtcgatatacgaacggaccggctgagctatgaagagaactacgcgcaagctcctttcagaacagatgtagagcatcttgtctttggggtgcaagatgtccgtatggatggagaaaatattaaagtagatcattttgataccaacatttctaacttttcattgacacatacggcttcaaaaaagcagtggctaaacgttaaaacatttgcacttgacgggcagctgcagaagagggagaaaatagacctggagatacagcaggccagtatgaatgccttagatatctatgccctgatggacaaatcaggtgtgatcaactttagccgactgctgccgaagcaagaggctaagaaagagatcgtcgcaagaggctga

SEQ ID NO: 10564 - protein, 155 aa, Unknown
  Obtained from environmental sample
  misc_feature (1)..(155): Xaa is any amino acid
MNWSTYFPPSEPQPQNDLQQERSPWKIDIAKVDIRTDRLSYEENYAQAPFRTDVEHLVFGVQDVRMDGENIKVDHFDTNISNFSLTHTASKKQWLNVKTFALDGQLQKREKIDLEIQQASMNALDIYALMDKSGVINFSRLLPKQEAKKEIVARG

SEQ ID NO: 10565 - DNA, 513 bp, Unknown
  Obtained from environmental sample
  misc_feature (1)..(513): n is a, c, g, or t
atgacactcatccatacagcacttttaagtgaagcacaaatttttatcgaaaaatataaactcacaaaagtgaactccactcctaaaatctatgctaatgaaaatataatcgtacttataggtggtattggaaaagaaaacactgatagttcattagagtatatatttgaaaaatatactataacaaaagcttttaatattgggattgctggttgtagtgatacaactatagagataggggagttattttgtaccaataggaagttagatgatataaagtttatggattgtaaaacagtagatactccccaacttccatctaatgtaacaccaaataccctttatgatatggaagcttcttattatttagaaatagtaaacgaacacttaaagcaaaaagatatctatatattcaaaatagtatctgaccatcttgatagtaccatcccaaaaaaagactttataaaaaaacttatcaatgacaaatttactcaaatctcaaaatacctctaa

SEQ ID NO: 10566 - protein, 170 aa, Unknown
  Obtained from environmental sample
  misc_feature (1)..(170): Xaa is any amino acid
MTLIHTALLSEAQIFIEKYKLTKVNSTPKIYANENIIVLIGGIGKENTDSSLEYIFEKYTITKAFNIGIAGCSDTTIEIGELFCTNRKLDDIKFMDCKTVDTPQLPSNVTPNTLYDMEASYYLEIVNEHLKQKDIYIFKIVSDHLDSTIPKKDFIKKLINDKFTQISKYL

SEQ ID NO: 10567 - DNA, 357 bp, Unknown
  Obtained from environmental sample
  misc_feature (1)..(357): n is a, c, g, or t
ttgatgtttagaaatgagagaaaactatataaaagaaaatgtgacgttacaggtgaaactataatttctatatatagccctgataaagatattaaagtttggaattcaaattatcgatggtcagataaaatgagtgggggtgattttcctattgaatataatatcaataaaacaattactcaacatttaaaagaaataaataatttggtaccaaaaatgtctttacttgttaaaatgaatgaaaattgtgcatatgttaataatgtgggtaattcgaaaaaatgttatttaatatttgatagtgatttttgtgaagattcatatcatagctcaattataaacactcaaaagatatag

SEQ ID NO: 10568 - protein, 118 aa, Unknown
  Obtained from environmental sample
  misc_feature (1)..(118): Xaa is any amino acid
MMFRNERKLYKRKCDVTGETIISIYSPDKDIKVWNSNYRWSDKMSGGDFPIEYNINKTITQHLKEINNLVPKMSLLVKMNENCAYVNNVGNSKKCYLIFDSDFCEDSYHSSIINTQKI

SEQ ID NO: 10569 - DNA, 630 bp, Unknown
  Obtained from environmental sample
  misc_feature (1)..(630): n is a, c, g, or t
ttgactgctgtggctgaacttaaggaaaaagatatggaaagtttgattattgatttaagaggaaatggagggggtattctatcttctgctataagtattgctgatgaaatgttagataaaaatcaaatgattgtttatacaaaaggaagggcaagaaaaaaaacagaatattattccacctcaaaaggaatattaaaaggagttaagatagctattttaattaatgaaaattcagcttcggcaagtgaaatactagcaggggcaattcaggataatgatagaggaattattttaggaagacgttcatttggaaaaggattggttcaagaacaaataccttggccagatggttcagcaattagacttactgttgctcgatattatacgccatctggaagatcaattcaaaaaccttatgaaaacggcttagatgattataatttagaacccttaccgccgctcgaaaatggtgaattattggaagctgatagtattcattttcctgattcgttgaaatattttaccaaaaaaggtaaggttgtttatggtggtggaggaattatgcccgatatttttattccgtcgagatactgtaagaggaacagattatttgtatcaactaaggtataa

SEQ ID NO: 10570 - protein, 209 aa, Unknown
  Obtained from environmental sample
  DOMAIN (2)...(148): Peptidase family S41
  misc_feature (1)..(209): Xaa is any amino acid
MTAVAELKEKDMESLIIDLRGNGGGILSSAISIADEMLDKNQMIVYTKGRARKKTEYYSTSKGILKGVKIAILINENSASASEILAGAIQDNDRGIILGRRSFGKGLVQEQIPWPDGSAIRLTVARYYTPSGRSIQKPYENGLDDYNLEPLPPLENGELLEADSIHFPDSLKYFTKKGKVVYGGGGIMPDIFIPSRYCKRNRLFVSTKV

SEQ ID NO: 10571 - DNA, 393 bp, Unknown
  Obtained from environmental sample
  misc_feature (1)..(393): n is a, c, g, or t
atgataaaagatattcctcaggaaaaagttaccaatgtagctattgctgttgttcaagaaggcgaagattggaatgtatatttggttaatttaaaagatactccattagaaaatgtattagtatcatcaaaagggtacattactcacgaaaatggtgctcaaacaaaaacatctgaattacgacatgctttaggtaatgttccgcctaaaagttacgctaaaatagaacctattatcgaaaatgtttttgggttgcataatcaatattgggtaacttatttttcagaaaatcagctgttagacaaaaaatatatttttttagcagaaacgattaaatcagagaactttgtaactattcccattattaataaaaaaggtgtgatgatattataa

SEQ ID NO: 10572 - protein, 130 aa, Unknown
  Obtained from environmental sample
  misc_feature (1)..(130): Xaa is any amino acid
MIKDIPQEKVTNVAIAVVQEGEDWNVYLVNLKDTPLENVLVSSKGYITHENGAQTKTSELRHALGNVPPKSYAKIEPIIENVFGLHNQYWVTYFSENQLLDKKYIFLAETIKSENFVTIPIINKKGVMIL

SEQ ID NO: 10573 - DNA, 597 bp, Unknown
  Obtained from environmental sample
  misc_feature (1)..(597): n is a, c, g, or t
ttgagaggttcagccattttcggggcaatatataaaaagggaatgtgtcgtgatataacagataatgtatctcccttcaaaatggttttagggttaacactgcttaatgagatatatcactttcgcgaaggggagaagatgcgcaaaggaaatgcgctatcagaaattatcccgccgggttatactgatttttttgttgcccctccagagagttatgaagataattactatcggcaaggcttatttttattaggtacaatagtatctcgcataaagtatgcccaaaaagaaaagagttccaatattctaagaaagatgaatttaaccggaatatccgtaagaaaggtgcctttatttatcactcaggtacgtgaatttgccgaaatatataagaagaaagtttataatatacacgatatctgggcaaatatcactgaccgtttgcaaaacatcgaaaattcaggattgaagaatgaggaggttgtcttttatatcttaacaggactgtcatatcacgattacttaggcataaagtatggtgaagaaaaaaaagataaagatgcacaaaagacactggaggaggaaaatgaaagttga

SEQ ID NO: 10574 - protein, 198 aa, Unknown
  Obtained from environmental sample
  misc_feature (1)..(198): Xaa is any amino acid
MRGSAIFGAIYKKGMCRDITDNVSPFKMVLGLTLLNEIYHFREGEKMRKGNALSEIIPPGYTDFFVAPPESYEDNYYRQGLFLLGTIVSRIKYAQKEKSSNILRKMNLTGISVRKVPLFITQVREFAEIYKKKVYNIHDIWANITDRLQNIENSGLKNEEVVFYILTGLSYHDYLGIKYGEEKKDKDAQKTLEEENES

SEQ ID NO: 10575 - DNA, 504 bp, Unknown
  Obtained from environmental sample
  misc_feature (1)..(504): n is a, c, g, or t
atgatcagaatcggctcgagatgtgattgtcttgaaattaatggtaattttgaatgtataaacaaagtagagatatttagtaaatttgattggaaaaaagacaataatctttcttcatatactaaactgtttttcaaagatgggacttacaggtataatgaatattttgataatattgcaaaattaaggaacagatacctgcatgatggatttgtaactgagaaaaagcttaaaaacattagttctgatatcaattgcttcatgaatgtttcacaaaatattgctgctgttagacattctgttattaataatcagataaacgaagatgttatagagtttgaaaacagtttcacaggcagatcatcattcttttcagaaatcgtgaatatgatttataaacaaaatgagttcaaatttgaactacgtaataaagttgataatattatcaatctattgctaaaatgtccgatgaaaaaggttgattttaagaataatgaaaagtaa

SEQ ID NO: 10576 - protein, 167 aa, Unknown
  Obtained from environmental sample
  misc_feature (1)..(167): Xaa is any amino acid
MIRIGSRCDCLEINGNFECINKVEIFSKFDWKKDNNLSSYTKLFFKDGTYRYNEYFDNIAKLRNRYLHDGFVTEKKLKNISSDINCFMNVSQNIAAVRHSVINNQINEDVIEFENSFTGRSSFFSEIVNMIYKQNEFKFELRNKVDNIINLLLKCPMKKVDFKNNEK

SEQ ID NO: 10577 - DNA, 729 bp, Unknown
  Obtained from environmental sample
  misc_feature (1)..(729): n is a, c, g, or t
atgaatagtttaaaaaagatagcgtacatatttgtaatgcagatgattgttttagttcacttaaatgagttgcatgcatctgcttcagagaagataaattacaatgagtccaatatatccgtgggaaattataagatacataaatttagttttcaaaaaaaggttaagggctcattcaaaggtaaagcgaatcatataacatatacgggttatctatttgatgaactgaaatttacagatttgattcctgaaccatctgcacttaaaggtgtagatgaactttttttggaagatgttctgtttgcagtttgtgaaaatccctcaaaaagtgatataaaaaaaggaaaaattcctgcagatatatgtaaaaaaccgtctaatataaaacttactaaaaaagatttaccacctgaaattttcaaatcttttagatcaggcagactcgtaaagtgggaagatataccaattacgcaaaaagtttcacttagagctaatttaaatattgagaaaaattcacttattttgaaaactctgcaaaatataggggtaacatcgaaagatttaatggttgaagcttctctctctgtggctcctattaaattactaaaaagtagagtgaaaaaggatcaaaattgtacgatgcaagattttttaacagatctctcatttacgatagatattccctcccctaaaataccgaacattagttctcaatttcaatttagcgat

SEQ ID NO: 10578 - protein, 243 aa, Unknown
  Obtained from environmental sample
  misc_feature (1)..(243): Xaa is any amino acid
MNSLKKIAYIFVMQMIVLVHLNELHASASEKINYNESNISVGNYKIHKFSFQKKVKGSFKGKANHITYTGYLFDELKFTDLIPEPSALKGVDELFLEDVLFAVCENPSKSDIKKGKIPADICKKPSNIKLTKKDLPPEIFKSFRSGRLVKWEDIPITQKVSLRANLNIEKNSLILKTLQNIGVTSKDLMVEASLSVAPIKLLKSRVKKDQNCTMQDFLTDLSFTIDIPSPKIPNISSQFQFSD

SEQ ID NO: 10579 - DNA, 321 bp, Unknown
  Obtained from environmental sample
  misc_feature (1)..(321): n is a, c, g, or t
ttggctcgagtggacgtgggacttctgtctttacaagacgacgtacttttagctctgaatcttacagagcttcatgcagtcacacaaagcagtgatgaaaaaagtgttaccatagaactttccaaagaagagcttgctatagatgggaagaaatataattttaaaaattccaagggactatttgcaaattatgaaaaagatataaagatattgattagaatagataaaaaagttgaatatgagagagtcatgaagctctttaacatacttcaagaaaataagttgacttccttttcattggtggcacaaaagactaaatag

SEQ ID NO: 10580 - protein, 106 aa, Unknown
  Obtained from environmental sample
  DOMAIN (1)...(105): Biopolymer transport protein ExbD/TolR
  misc_feature (1)..(106): Xaa is any amino acid
MARVDVGLLSLQDDVLLALNLTELHAVTQSSDEKSVTIELSKEELAIDGKKYNFKNSKGLFANYEKDIKILIRIDKKVEYERVMKLFNILQENKLTSFSLVAQKTK

SEQ ID NO: 10581 - DNA, 654 bp, Unknown
  Obtained from environmental sample
  misc_feature (1)..(654): n is a, c, g, or t
gtggaattttggatttttttagcggattcctccccgggtaaaaaattttttcttttttcaattaaacaattatatttaatttttttaacggacattatttttcccaaaataggtcatgatgaaaatattccagaagttgatatcgatgagaataaagagatacccccaaaagttttcatttcttattcttgggatagtgaagatcataaagattgggtattgaatttagcacataaattagctgaaaatggtgtaaatcctatattagatagatatgagttacgaggaggttctaacgcaccatattttatggaaacagcattgaaagaatcagataaagtacttataatatttactgagaattatcaaataaaagcaatgaaacgaagtggtggtgtgggatatgaatactcaattttaaatgcagagatttgtaaaaatattacggataataaaaaatatattccaatattaagaagtggcacaaatgagacgagtatcccttcatttcttcaacaattaatttcaatatatatgaaagatgactctaagtataccgaacaaattaaagaagtattacattgtatttttgataaacctttaattaataaaccaaaaataggaaaaagacctgattatttaaaattaaactaa

SEQ ID NO: 10582 - protein, 217 aa, Unknown
  Obtained from environmental sample
  misc_feature (1)..(217): Xaa is any amino acid
MEFWIFLADSSPGKKFFLFSIKQLYLIFLTDIIFPKIGHDENIPEVDIDENKEIPPKVFISYSWDSEDHKDWVLNLAHKLAENGVNPILDRYELRGGSNAPYFMETALKESDKVLIIFTENYQIKAMKRSGGVGYEYSILNAEICKNITDNKKYIPILRSGTNETSIPSFLQQLISIYMKDDSKYTEQIKEVLHCIFDKPLINKPKIGKRPDYLKLN

SEQ ID NO: 10583 - DNA, 819 bp, Unknown
  Obtained from environmental sample
  misc_feature (1)..(819): n is a, c, g, or t
gtgttgcctataaaaaatatcaataagaaaaatcagttatatgatttaattaaattttttgaaagatttgattttattgcagatactagtaatgaagttaaagaaagtgaactcgcattcgatagggaacaaaataactttctagagttttctttaaaagcaaaaaaaataagaaatgatgaatttgatacagaaccagaattattagaaaactttaaaaattttaaaagtgttttagaaaaaaatatgtcacgatctctttatccattgcaattactctcatcttttcatatggcattttctcaaaatagttgtaattttgctgttccaggagctggtaaaacatcaattgtttatggtgcatatgcctatctaaaaagtcttccccaagataatcctaaatacgttgataaacttcttgtaatcggtcctctttcatcttttgctccatgggaaaatgaatacaaagagtgttttaataaaaaagctgacagccaaagaatgtcaggtgatattgcaatttcaaggatagaaaaagagcaacatctatattctgctagacctcgagaaatcacattaatttctcatgctggagtacctttattagaaaaagaaattatagattttttaaaatcaaacaaggttatggttgtagtagatgaggcacatagaattaaaaatgcaaatggaatttggggtaatagtgtagttgaaatttcaaaagaagcaacatcaagaatcatattaacaggaacacctgtaccaaatggatatgaagatatattcaatttatacagatttttatacccttttaaataa

SEQ ID NO: 10584 - protein, 272 aa, Unknown
  Obtained from environmental sample
  misc_feature (1)..(272): Xaa is any amino acid
MLPIKNINKKNQLYDLIKFFERFDFIADTSNEVKESELAFDREQNNFLEFSLKAKKIRNDEFDTEPELLENFKNFKSVLEKNMSRSLYPLQLLSSFHMAFSQNSCNFAVPGAGKTSIVYGAYAYLKSLPQDNPKYVDKLLVIGPLSSFAPWENEYKECFNKKADSQRMSGDIAISRIEKEQHLYSARPREITLISHAGVPLLEKEIIDFLKSNKVMVVVDEAHRIKNANGIWGNSVVEISKEATSRIILTGTPVPNGYEDIFNLYRFLYPFK

SEQ ID NO: 10585 - DNA, 657 bp, Unknown
  Obtained from environmental sample
  misc_feature (1)..(657): n is a, c, g, or t
atgataggttacgcaaatgaaatggttggtaaaattaatgcacaaaagaattcactccaagagatgaacttaggtctagaagacagagtgaagactaagacagcggcactacagctaataaataaaaatttagaaaaagagaaaaagttttctcaagacttattaaaatcacaaaaagatttcttaaagtacacagtacatgaaacaaatacacctcttagcgtaattttaacttcgatagaattgtatgtaatgaagcatccaaaagacagacaactctcaaagatagaagcggctgttaaaaatatatttagcatctatgatgatttgagttatttagtgaaacaaaatcaggttgagtatccgaaaattatgattaatcttgaagattatataagcagtagaatagatttcttttcagaagttgcacagcactcacgcatagcatttgactacgctccggatgctaaaggtttgcatatttattttaatgaaacaaaacttcagcgtatagtggacaacacaattacaaatgccataaaatacactttgccaaatgaaaaagttaatgttcgattaggacaggtgggtgcaaatattgagttttccatgggttctaagtcaaaaatcattaaaaatacagatcaagttttttga

SEQ ID NO: 10586 - protein, 218 aa, Unknown
  Obtained from environmental sample
  DOMAIN (57)...(119): His Kinase A (phosphoacceptor) domain
  misc_feature (1)..(218): Xaa is any amino acid
MIGYANEMVGKINAQKNSLQEMNLGLEDRVKTKTAALQLINKNLEKEKKFSQDLLKSQKDFLKYTVHETNTPLSVILTSIELYVMKHPKDRQLSKIEAAVKNIFSIYDDLSYLVKQNQVEYPKIMINLEDYISSRIDFFSEVAQHSRIAFDYAPDAKGLHIYFNETKLQRIVDNTITNAIKYTLPNEKVNVRLGQVGANIEFSMGSKSKIIKNTDQVF

SEQ ID NO: 10587 - DNA, 627 bp, Unknown
  Obtained from environmental sample
  misc_feature (1)..(627): n is a, c, g, or t
atggactcgttcattttgcgttcaattaggagatgtgtgatgattatcagaaaaaaatttaaatttgaaaatgcacatatagttagaggatgtagctctgttaagtgccgcgaatctattcatggacactcatataaagtagaacttctgcttgaatctaattttctagatcatggacagatggtttatgattttggacttatgaagcaaaatatgaaagatatcatagagagtttcgatcatgcaataacactatggagtggagatgatcagagttatatcgatgatatgattagacactcttctcgctatgttatcttgccgatatcgccatcagcagagcagttttgtcgtgtaatatatattttaatagatcagcttttaaaacagacaactacagtaaacggtgaaaaagaggtcaagttacatagtatcatcgttcatgagacagatagtggctatgcgcaaggctttagtgacgacgcatacagtattcaaatgggtgagatagagcttgataaaataattttttctgatgagatagttaattcatggagtgatagtgaactatttgaaaagttgaaaaatagagaaaaatttataaatccaaaaaatattgacaagtaa

SEQ ID NO: 10588 - protein, 208 aa, Unknown
  Obtained from environmental sample
  misc_feature (1)..(208): Xaa is any amino acid
MDSFILRSIRRCVMIIRKKFKFENAHIVRGCSSVKCRESIHGHSYKVELLLESNFLDHGQMVYDFGLMKQNMKDIIESFDHAITLWSGDDQSYIDDMIRHSSRYVILPISPSAEQFCRVIYILIDQLLKQTTTVNGEKEVKLHSIIVHETDSGYAQGFSDDAYSIQMGEIELDKIIFSDEIVNSWSDSELFEKLKNREKFINPKNIDK

SEQ ID NO: 10589 - DNA, 345 bp, Unknown
  Obtained from environmental sample
  misc_feature (1)..(345): n is a, c, g, or t
gtgcctacactatactcacgtgctgatttgcaaaatactgtaattagtgtaaaaaaaataacagatataaataaaaatgctaaagtagttgttgtaataaacagagtcagaagcggtgatactaaaatacttgatgagacaaaagagatactgtttaagtatattaaacatggagtagaatattgcactataagagattctaaagctatgcttcaatcgataaatagtaacagatcagtttttgacatacataaagagtcaggtttaaataggcatatttattctggaatagtaaatgatttttataatttagtaactattatagaaaattatattgataactag

SEQ ID NO: 10590 - protein, 114 aa, Unknown
  Obtained from environmental sample
  misc_feature (1)..(114): Xaa is any amino acid
MPTLYSRADLQNTVISVKKITDINKNAKVVVVINRVRSGDTKILDETKEILFKYIKHGVEYCTIRDSKAMLQSINSNRSVFDIHKESGLNRHIYSGIVNDFYNLVTIIENYIDN

SEQ ID NO: 10591 - DNA, 378 bp, Unknown
  Obtained from environmental sample
  misc_feature (1)..(378): n is a, c, g, or t
atgttcaaattattaataggtatatttatattcatatcagttgcttatagctcaaattcattgctagtgaaagctccaatgaattatcaaatggactacactaaggaaactaggtgtttagtgagaaacttttttatctataaagatccacaatgggcagccaaaatagaactaaataatggtaaaaaaatcttttttttcagtccgaaatctttaatagagttttatcatagacctggaaagtggtttgatattggtgtaaaaaatgaaaaagattttaaagatattattgtaactgattatgtaacaatgaaactaatcaatgcaaaagatgccttttatattttatgggaatcgggccatttcccccctcggtga

SEQ ID NO: 10592 - protein, 125 aa, Unknown
  Obtained from environmental sample
  SIGNAL (1)...(17)
  misc_feature (1)..(125): Xaa is any amino acid
MFKLLIGIFIFISVAYSSNSLLVKAPMNYQMDYTKETRCLVRNFFIYKDPQWAAKIELNNGKKIFFFSPKSLIEFYHRPGKWFDIGVKNEKDFKDIIVTDYVTMKLINAKDAFYILWESGHFPPR

SEQ ID NO: 10593 - DNA, 465 bp, Unknown
  Obtained from environmental sample
  misc_feature (1)..(465): n is a, c, g, or t
ttgctaatgattagaaatattcaatttaaattaatatttttattgctttttactcttcctttgttattcactggttgtgaaaaaaaagtagatgatggtattaccaaagtacactgggatagagatatgtgtgcaagatgtgttatggttgttagtgatagaaagaatacagttcaaatcaaaaatcccaatacagggaaaacatatatgtttgatgatattggctgcactattttatggtttaatgaggaacaaattatgtggaaagataaagcagttatttggattactgatgtaaatagtggcgaatggatagatgcacgaactgcattttatgatactgaaaacataacacctatggcttacggattttcagcacataaaacaaaagatacaatcaaacaaaatcaagaaataattaattttgaggaagtttcaagaagagttttactaatcgggaaataa

SEQ ID NO: 10594 - protein, 154 aa, Unknown
  Obtained from environmental sample
  misc_feature (1)..(154): Xaa is any amino acid
MLMIRNIQFKLIFLLLFTLPLLFTGCEKKVDDGITKVHWDRDMCARCVMVVSDRKNTVQIKNPNTGKTYMFDDIGCTILWFNEEQIMWKDKAVIWITDVNSGEWIDARTAFYDTENITPMAYGFSAHKTKDTIKQNQEIINFEEVSRRVLLIGK

SEQ ID NO: 10595 - DNA, 378 bp, Unknown
  Obtained from environmental sample
  misc_feature (1)..(378): n is a, c, g, or t
atggattttaataacttaatcatctgctcttttggcagagaaaatgacattttaaaaaatttaaaaataaaaaaagaggaaataataataccacaaaaggttcttaattttgattctataaatttttcaaaaaatattactattcttaccagaacattaaaatatgcatattttacaaatttaaaacaagatgtggaaatttttatatccaatatagatgaacgtattgctaaatattgtcatagctatatgatgctaaataattttaaaccattaaaattgtctaaaaataaaatccaaattgacaaacaaggcatcgtatttatcgccagatttaaagatgaatcatctatagaaataccattttatttgtcataa

SEQ ID NO: 10596 - protein, 125 aa, Unknown
  Obtained from environmental sample
  misc_feature (1)..(125): Xaa is any amino acid
MDFNNLIICSFGRENDILKNLKIKKEEIIIPQKVLNFDSINFSKNITILTRTLKYAYFTNLKQDVEIFISNIDERIAKYCHSYMMLNNFKPLKLSKNKIQIDKQGIVFIARFKDESSIEIPFYLS

SEQ ID NO: 10597 - DNA, 804 bp, Unknown
  Obtained from environmental sample
  misc_feature (1)..(804): n is a, c, g, or t
atgaactatctgaaaaacagtagtagttttaacatctcatggggtggcgctgttaatgactggtactatcctgaggatatcatcgagagtgtatacaacctgaacaaaaagggttatgatataaaacttatttttcctgctatgaaacagtatgatactttcatgccaaaaaaagccaaatatgtcatagatgaaattaaaaaattagataaagataataaaatattctcttttctctcagataattggctaagtttaaaagagtacaacgataccgtgattaatactcatctaggtattagtgcgattgagaacaagtacgaacttgaagattggttctctactagaaacagatatagaagctttgccagctcatttacaccactactaaataacggttatgatattggctcagatgatctggatgactttttgctaaactatcatggtaaaaaagagctgcaatctctaatagtaaaatttatgacaaataaaaaaacatataaaaaatatatggaaaaaagtttttacactcttactaactggaagagaaaaattccattaaagccaaatatctatctgcctgaatttaaccaaaaagatgagaattctaaaactaattttgacaatcaaacttttttcacaaagctcaactccgttgtaaaacacctaaatagtgtagatggtagtttgtccatttatggagcaggaagtgtagcaaatatcttaattccatctataaaagataagatagagtttgtgtatgataataatccaaatcaaatagggcttcaaaatatttga

SEQ ID NO: 10598 - protein, 267 aa, Unknown
  Obtained from environmental sample
  misc_feature (1)..(267): Xaa is any amino acid
MNYLKNSSSFNISWGGAVNDWYYPEDIIESVYNLNKKGYDIKLIFPAMKQYDTFMPKKAKYVIDEIKKLDKDNKIFSFLSDNWLSLKEYNDTVINTHLGISAIENKYELEDWFSTRNRYRSFASSFTPLLNNGYDIGSDDLDDFLLNYHGKKELQSLIVKFMTNKKTYKKYMEKSFYTLTNWKRKIPLKPNIYLPEFNQKDENSKTNFDNQTFFTKLNSVVKHLNSVDGSLSIYGAGSVANILIPSIKDKIEFVYDNNPNQIGLQNI

SEQ ID NO: 10599 - DNA, 426 bp, Unknown
  Obtained from environmental sample
  misc_feature (1)..(426): n is a, c, g, or t
ttggcgttctggacgttgggatatttgggatttatgactcagtcggctttacaatcaaacaaagtaatttttaaagcgatgatctccggttatgaaaacctacaattgttaaacgatctgcaaaaagaaaaatcccaggtcatggatttaaacgaacagctggctcttgatattgaacagcgaaaattaacggaaaaagaaaatgaacgcctgatctgtgaacttcaaaaagcattaaataaagttaaaacattaagcggcctgattccgatatgtgcacaatgcaagaaagtcagggatgacagcggatactggaaccagattgaaacttatattcacaaacattcaaacgctgatttcagccactgcatttgcccggattgtgctaaaaaattgtacccggacatagatctttatgatgattaa

SEQ ID NO: 10600 - protein, 141 aa, Unknown
  Obtained from environmental sample
  misc_feature (1)..(141): Xaa is any amino acid
MAFWTLGYLGFMTQSALQSNKVIFKAMISGYENLQLLNDLQKEKSQVMDLNEQLALDIEQRKLTEKENERLICELQKALNKVKTLSGLIPICAQCKKVRDDSGYWNQIETYIHKHSNADFSHCICPDCAKKLYPDIDLYDD

SEQ ID NO: 10601 - DNA, 663 bp, Unknown
  Obtained from environmental sample
  misc_feature (1)..(663): n is a, c, g, or t
atgaatcttcctgtttttgaatttgtaaaccagttttttgatattgataattttcatccaattcttaccaataacaaagttcaagatggatatagcagaaagatatttttcgacaaaaatgaattaaaggaagcccttgatttttatcttgattttcagcattcattttcgtgcgttattcaagcagataaagctgatgccgcaaaatttgacaattttattgataagcagaaaagtgaagttggcactttctctggaatttttctaaaccagctcaatacctatttagcgaaactcaaacaaaactcggaattaaataaacttcgaacatctattcgcgagcacgcagtaagaaacattaaagaaggtttgaaaaatgaagaatacatttttgaactaactgctccaactggttcgggaaagacattcatgatgccttctttggcttctgagataattcgaaccaaaggggctaaaagaattatttatggcttaccgtttctatcaatcactgaacaagtggaatcagaagtgttaaaaatatttgaaggggaaggaacagtttgttccacgtatccgattcaaaatcagaaaataaacgcttcgaagcccttacaagaaggaaatagattccaaaccctactgcggcaaaattattcttga

SEQ ID NO: 10602 - protein, 220 aa, Unknown
  Obtained from environmental sample
  misc_feature (1)..(220): Xaa is any amino acid
MNLPVFEFVNQFFDIDNFHPILTNNKVQDGYSRKIFFDKNELKEALDFYLDFQHSFSCVIQADKADAAKFDNFIDKQKSEVGTFSGIFLNQLNTYLAKLKQNSELNKLRTSIREHAVRNIKEGLKNEEYIFELTAPTGSGKTFMMPSLASEIIRTKGAKRIIYGLPFLSITEQVESEVLKIFEGEGTVCSTYPIQNQKINASKPLQEGNRFQTLLRQNYS

SEQ ID NO: 10603 - DNA, 939 bp, Unknown
  Obtained from environmental sample
  misc_feature (1)..(939): n is a, c, g, or t
atggatttagcttatgatgagatagtattagtaactccatcagatcatcttatcaaagatgaaacagaatatgaaaaagttttaagtaaagcaaaagagtttacaaaggatgataagttagtaacgtttggaataagacctacatttcctgaaactggatttgggtatattcaggcagtgcctgaaaatgatgaatgtttgattttaaatgttgaattatttaaagaaaaaccaaattttgaaacggctactcaatatatagaagaaaattcaaaattaagcattcaaaatttaccattaaaatactactggaactctggaatgtttatgtttaaagcaggtgtttttctagaagaacttcaaaaatactctcctgaaatatttgatacttctaaacaagctttagaaaatgcctcaaaagagggaatgattagaataaaatatgaagatatgataaatatccctgaagatagtatagactatgcagtgatggaaaaatcttcaaaagttaaagtgataccatcagatataaattggtcagatgtcggaagttttgattctctttatgatgagttaccaaaagatgaaaatggtaatactcaaaataaaaatcatattagtataaatagtaaaaataatttcatctatggaagtgaaagaaaaatagcaacaatagatatagaagatatgattatagtcgatacaggagatgcacttttagtttctaaaaaaggaagctctcaaaaagtaaaaaaggttgtagaaaccctaaaaaatagagattcagaattacataatattcatcttacaggtcatagaccttggggtacatatactgtattagaagatagtataggatataaaattaagcggatagaagtaaaaccaggtaaaagacttagtttacaaaacattttcatagaaatgaacattggatag

SEQ ID NO: 10604 - protein, 312 aa, Unknown
  Obtained from environmental sample
  DOMAIN (1)...(198): Nucleotidyl transferase
  misc_feature (1)..(312): Xaa is any amino acid
MDLAYDEIVLVTPSDHLIKDETEYEKVLSKAKEFTKDDKLVTFGIRPTFPETGFGYIQAVPENDECLILNVELFKEKPNFETATQYIEENSKLSIQNLPLKYYWNSGMFMFKAGVFLEELQKYSPEIFDTSKQALENASKEGMIRIKYEDMINIPEDSIDYAVMEKSSKVKVIPSDINWSDVGSFDSLYDELPKDENGNTQNKNHISINSKNNFIYGSERKIATIDIEDMIIVDTGDALLVSKKGSSQKVKKVVETLKNRDSELHNIHLTGHRPWGTYTVLEDSIGYKIKRIEVKPGKRLSLQNIFIEMNIG

SEQ ID NO: 10605 - DNA, 507 bp, Unknown
  Obtained from environmental sample
  misc_feature (1)..(507): n is a, c, g, or t
atgtatgacaccatcaatagttacggaaaagctattatgtataaaacagggcatagtaacctaaaagtaaaaattaacgaaacaaatgcctcatttgctgcggaggtatcaggacatatatttttcaatgacaggtactttggatatgatgatgcgatatactcaacattacgagcactagagcttttaaatgatggttttgattacgataaagagtatgaaaaacttccacaacttttctcaacagatgagataaatatagatacaacagaagagaaaaaatttaaaatcattgatgaattaaaagataaattatcaaacccacctgctgattttccaatcataaaagatattattacagtagacggtgttagagtcgtatttgaaaatggttggggtttggtgcgtgcatctaatactactccaaaattagtaacacgattcgaagcaaatgatgaggacacagcaatgatgtatcaaaaaaaacttttaaccatgattaaataa

SEQ ID NO: 10606 - protein, 168 aa, Unknown
  Obtained from environmental sample
  DOMAIN (84)...(168): Phosphoglucomutase/phosphomannomutase, C-terminal domain
  misc_feature (1)..(168): Xaa is any amino acid
MYDTINSYGKAIMYKTGHSNLKVKINETNASFAAEVSGHIFFNDRYFGYDDAIYSTLRALELLNDGFDYDKEYEKLPQLFSTDEINIDTTEEKKFKIIDELKDKLSNPPADFPIIKDIITVDGVRVVFENGWGLVRASNTTPKLVTRFEANDEDTAMMYQKKLLTMIK

SEQ ID NO: 10607 - DNA, 693 bp, Unknown
  Obtained from environmental sample
  misc_feature (1)..(693): n is a, c, g, or t
gtggttatcattggttcagaagcaagggggtgggaatatttgtgtgctgaggcgccttttaattttggtgtgggattggtaagcgtgataaatcataaagaatatcagcttccataccatattatgcaaagtcataaatttccaaaaaatacaacagctattgcaattggcatggggcttggtaattatgaacaaaatgagattttagagatattaaacaaagatattctgaaagtaattgatgcagatatgttttatggaaaagatataaaaatagtgttaaataaagagaatattgtactaactccacatccaaaagagttttgttctcttttaaaaattactgctattgatgatatttctgttgaaactttacaaaaaaatagatttaaatatgtggaaaagttttgcaataagtatccaaaagtagtattagttttaaaaggtgcaaacacaataatagctcaaaataaaaaagtgtatataaatccacatggaagcagtaaacttagttttggtggaagtggtgatattttaagtggattggtagggtcgctacttgcacaagggtatagttgtattgatgctgctataaatggaagtttagcacatactatatctgcattgcagtatacgggtaatgattattccatgacacctgatgatttaataagtggtattaaaatattatga

SEQ ID NO: 10608 - protein, 230 aa, Unknown
  Obtained from environmental sample
  DOMAIN (1)...(229): Carbohydrate kinase
  misc_feature (1)..(230): Xaa is any amino acid
MVIIGSEARGWEYLCAEAPFNFGVGLVSVINHKEYQLPYHIMQSHKFPKNTTAIAIGMGLGNYEQNEILEILNKDILKVIDADMFYGKDIKIVLNKENIVLTPHPKEFCSLLKITAIDDISVETLQKNRFKYVEKFCNKYPKVVLVLKGANTIIAQNKKVYINPHGSSKLSFGGSGDILSGLVGSLLAQGYSCIDAAINGSLAHTISALQYTGNDYSMTPDDLISGIKIL

SEQ ID NO: 10609 - DNA, 555 bp, Unknown
  Obtained from environmental sample
  misc_feature (1)..(555): n is a, c, g, or t
ttgcaaaaagtttttgatgaagtaaactctttagatagaaaatgttacgaaaaatatcttttaagtgaagatatattaatggagcatgcggccatatctatgatgagctatatagagaaaaagtttgtaaaaaatagtaaaattttaatagtatgtggaagtggtaataatggtgcagatggcattactctagctcgccttttgtatggattatatgatgtatcattatatttagttaaaaagccaaaaactcaaattggaaaactacaactcaaacgggctgtaaaagttggtgttcaatatttagaaacaaaagatcttctaactaaagagtacgatgtagttgtagatgcattgttcggaagtggctttgacaaagagatgacaaaagagtatcgtgagttaatagaacatctcaatagtattagtggttacaaaattgcatgtgatattccaagtggtattaataaaaaagggcagataaatcagatagcctttaaagccgaatggacaatccacaaggggagctttgaaaaaatcactttttttagatga

SEQ ID NO: 10610 - protein, 184 aa, Unknown
  Obtained from environmental sample
  DOMAIN (19)...(175): YjeF-related protein N-terminus
  misc_feature (1)..(184): Xaa is any amino acid
MQKVFDEVNSLDRKCYEKYLLSEDILMEHAAISMMSYIEKKFVKNSKILIVCGSGNNGADGITLARLLYGLYDVSLYLVKKPKTQIGKLQLKRAVKVGVQYLETKDLLTKEYDVVVDALFGSGFDKEMTKEYRELIEHLNSISGYKIACDIPSGINKKGQINQIAFKAEWTIHKGSFEKITFFR

SEQ ID NO: 10611 - DNA, 561 bp, Unknown
  Obtained from environmental sample
  misc_feature (1)..(561): n is a, c, g, or t
gtggacatgactcatttttcaaatggagcagtaaaagttcctaacttgggggttaatatagcctatatttcactagcctacacatactatttcaaagaactcgatcagaaatcaaaagcaagcatacctagatttgaaagtgagaacccttctaggtggagaatctattcagagttagttatgtcaacgaagcaaatttacccaacaggaggaagaaattacggtatcattggagtttctaattttgtccaatatcaaatcaaaccaaagtgtgttattgaaggtggagtggatgcagtgtacaaccaatcaattattgaggaaaaagaaggtgactttacaacaaaagacaactttcaattgggagcctacgctgcctacgttttaccaattcataaattacaattaattttgggtatgggaggatatgttgtgaaccccgtcaacccaaatggctctgtttatcacagatttggatcaaggtttaaaattggcaaaaacctttatgcaaacatcacaataaaatcacattgggctaagctgacatccgagccgatctga

SEQ ID NO: 10612 - protein, 186 aa, Unknown
  Obtained from environmental sample
  misc_feature (1)..(186): Xaa is any amino acid
MDMTHFSNGAVKVPNLGVNIAYISLAYTYYFKELDQKSKASIPRFESENPSRWRIYSELVMSTKQIYPTGGRNYGIIGVSNFVQYQIKPKCVIEGGVDAVYNQSIIEEKEGDFTTKDNFQLGAYAAYVLPIHKLQLILGMGGYVVNPVNPNGSVYHRFGSRFKIGKNLYANITIKSHWAKLTSEPI

SEQ ID NO: 10613 - DNA, 354 bp, Unknown
  Obtained from environmental sample
  misc_feature (1)..(354): n is a, c, g, or t
atgctaggagaagcttctatcaatacaggtgaagggatagtatttaatatgaccccatcaccgggggctactagctgtttgggaaatgcaaaaagggatgtaataaatgtaacaaaatacttaaataaaaactttgatattaaaaagtttgaagatgagttagttgaagaaaatatctctcaaagtgctattgatgcaaatgaacaaaaacaatatgttagtaaaataagagaagagataaaagctcacgaagaggagtattatcaaaatataaatgatggacaagagttgcctagctattggaataaaccttacagtccatggagaaataagagagaccatccgcctttttaa

SEQ ID NO: 10614 - protein, 117 aa, Unknown
  Obtained from environmental sample
  misc_feature (1)..(117): Xaa is any amino acid
MLGEASINTGEGIVFNMTPSPGATSCLGNAKRDVINVTKYLNKNFDIKKFEDELVEENISQSAIDANEQKQYVSKIREEIKAHEEEYYQNINDGQELPSYWNKPYSPWRNKRDHPPF

SEQ ID NO: 10615 - DNA, 465 bp, Unknown
  Obtained from environmental sample
  misc_feature (1)..(465): n is a, c, g, or t
ttggcctacactaaaccaatacaaattgaagtcgttatgaatcgaaaattaaatatctcagattgcttcgatatgttttcagacacctttaccccaaaagtacttttagatgttaacgattctaggattatgctggtcaaaattataggcgataagataccttggcactgccacgctaacgaagacgagttactttgggtaatgaaaggaaatatcgtcgtgcacactcgaaccgagtcagtgcatctctgctctggagaattgtacatggtagcgaaagggatagagcacaaagtgactacaaatgaattggcccaagtgttgttgattgaatcaaagtcatttaagcatactggtgagactgaaagcgatataactcaagacgcttttgaatatttgctaaaaaataatatcgcccaccccctcatcatgatatattcattcatcggaactaaagtacgttaa

SEQ ID NO: 10616 - protein, 154 aa, Unknown
  Obtained from environmental sample
  misc_feature (1)..(154): Xaa is any amino acid
MAYTKPIQIEVVMNRKLNISDCFDMFSDTFTPKVLLDVNDSRIMLVKIIGDKIPWHCHANEDELLWVMKGNIVVHTRTESVHLCSGELYMVAKGIEHKVTTNELAQVLLIESKSFKHTGETESDITQDAFEYLLKNNIAHPLIMIYSFIGTKVR

SEQ ID NO: 10617 - DNA, 954 bp, Unknown
  Obtained from environmental sample
  misc_feature (1)..(954): n is a, c, g, or t
ttggctggggggatctgtgacagtaaattcaaaggaaacagcacaattattgaaggggaatataaaacatcagtacagtttcttcctctaacatacccaatgggagctattgcaaaatataaaaataacaaattagaaattacaacaacctctcaatggccattccatgtacagaaaactgtatcagatgtatgtggaatactcaaaaaagaaattcaggttaatattgaaccctaccatcatacttatgatgaaaaactgattattccttcaatatattcagcaattgcagctctgcttgcagttaaatcgggaaaacaggtaagaattgtagaagatccttttcaagtaattaagtttagtataaaacgtccacagattaaaataaaaagaaagtctgcactaaatagtgcaggtaaaataattgcagaagatatagaaattgatgttgatactggtgcttaccctctatttacagatgaaatactaagccaattaattcttggagcagcatcaatttatgctgtaaccaatctaagaattaaagctaaatctattactacatcttcaccaccgatgaatgtatttaaaggttgtggtataggtatgggagttttttctgcagaaacacaatattccagaattgctgcgttcaggcagataaatccaatagagataagacaggagcatcttcctaaaacaaatcaaaaacttccatctggaggaattcttaagcaaatttctcaaaaagatctgttgaataaagtatgtgaaatatctgattttaatagaaaatattcagcttatgaagttctgaaaaaacagacaaaaagaaaatatgagcaacaggaaatattaaaaggaattggaattgccattggatatgcaggaaatggatttacaagaaaagagagaacagagaagcctattcaatggaagtacgactggatctaa

SEQ ID NO: 10618 - protein, 317 aa, Unknown
  Obtained from environmental sample
  misc_feature (1)..(317): Xaa is any amino acid
MAGGICDSKFKGNSTIIEGEYKTSVQFLPLTYPMGAIAKYKNNKLEITTTSQWPFHVQKTVSDVCGILKKEIQVNIEPYHHTYDEKLIIPSIYSAIAALLAVKSGKQVRIVEDPFQVIKFSIKRPQIKIKRKSALNSAGKIIAEDIEIDVDTGAYPLFTDEILSQLILGAASIYAVTNLRIKAKSITTSSPPMNVFKGCGIGMGVFSAETQYSRIAAFRQINPIEIRQEHLPKTNQKLPSGGILKQISQKDLLNKVCEISDFNRKYSAYEVLKKQTKRKYEQQEILKGIGIAIGYAGNGFTRKERTEKPIQWKYDWI

SEQ ID NO: 10619 - DNA, 684 bp, Unknown
  Obtained from environmental sample
  misc_feature (1)..(684): n is a, c, g, or t
atggaagctggatgtgatgtaatggcagttattacaggacgaggtaaacgagctattacagatcactttgatatctcttatgagttagagcatcaaatcaaagggagtgctaaagaggagcttttaggagatatcagaaatatcatggataagtgtacttttacctatacaagacaaaatgagatgagaggtttaggagatgcaatttataaaggaaatgttcttgtaggctttcaaaatccatttgctgttatccttgcagatgatttatgtgtaaatcctgatggagatggtatcttaaaacagatggtagatctttatcacaaatataaatgttgtgttgtagcaactatggaagtacctaatgaagatgtacataaatatggagttattgaaggtaaagagatagaagatggagtatttatggtatcaaatatggtagaaaaaccagataatgataaagcaccgtcaaatttagctgtaattggaagatatattttaactccagatatttttgatatgattaaaaatacaaaccctgggaaaaatggggagttacaaactactgatgctttatgtgaacaagcaaaaaaagggatggtaatagcctataaatttacgggtaaaaggtttgattgtggctcacttgatggattttggaaaagctccaaattatttttatga

SEQ ID NO: 10620 - protein, 227 aa, Unknown
  Obtained from environmental sample
  DOMAIN (8)...(227): Nucleotidyl transferase
  misc_feature (1)..(227): Xaa is any amino acid
MEAGCDVMAVITGRGKRAITDHFDISYELEHQIKGSAKEELLGDIRNIMDKCTFTYTRQNEMRGLGDAIYKGNVLVGFQNPFAVILADDLCVNPDGDGILKQMVDLYHKYKCCVVATMEVPNEDVHKYGVIEGKEIEDGVFMVSNMVEKPDNDKAPSNLAVIGRYILTPDIFDMIKNTNPGKNGELQTTDALCEQAKKGMVIAYKFTGKRFDCGSLDGFWKSSKLFL

SEQ ID NO: 10621 - DNA, 486 bp, Unknown
  Obtained from environmental sample
  misc_feature (1)..(486): n is a, c, g, or t
atgaatttttataataaaactctatttttagatcaatttacacctgtatcaatatatcaaaaagtaaaagagatttttacaaatgagataacttttctttttgaatctgttgtaaatggagatgatgggaattttagttatatttttgtaggtgatagagaaagagtatggcacaaagattctcaaagtttttataaagatgaagagggaaaagttaaagagatagataaaaacccttttgtttttctcagagagtattataaaaatatagataaaagcttttatcatgacaaaggcaaagagctaggaattggactcattgatggttttataggaaatatgggttatgatatggttgccacttttgaacccacactacataaatcgatgggtggattaaaagatgattttgggaattcaaattgtgacctttttccccccaaagaaggttttaagtccccccacataaaaacatcaccagctgac

SEQ ID NO: 10622 - protein, 162 aa, Unknown
  Obtained from environmental sample
  DOMAIN (4)...(159): Anthranilate synthase component I, N terminal region
  misc_feature (1)..(162): Xaa is any amino acid
MNFYNKTLFLDQFTPVSIYQKVKEIFTNEITFLFESVVNGDDGNFSYIFVGDRERVWHKDSQSFYKDEEGKVKEIDKNPFVFLREYYKNIDKSFYHDKGKELGIGLIDGFIGNMGYDMVATFEPTLHKSMGGLKDDFGNSNCDLFPPKEGFKSPHIKTSPAD

SEQ ID NO: 10623 - DNA, 501 bp, Unknown
  Obtained from environmental sample
  misc_feature (1)..(501): n is a, c, g, or t
atgtctaaactaagctctttatttaacagttttttaaaaagccccatacttctcaaactcttttttgcccttttatttgtcttatttgccattatgattgctactatatcttttgcagtacattataattatgaaaataattatatcaaaaaagatatacatcataaagctatctcttttatagaaactaaaactaatattttaaaacatcaaattgataaaaataaacaatatttatattcacttaaaaataacgctattttgcaatcctacataaaaacaggtgaaaataaagcaactactgttgcactatttgaacaaatcatctcagcagataaagatattatgcaaatacgatatatagatgaacgtggaatggaaattattcgacttgaaagaaatgaacaaaatgaaaagtatcgtattgtcaatgaaactgctcttcaaaataaaaaagatagatcctatttccaagagacatcaaaactcaatgagaggtag

SEQ ID NO: 10624 - protein, 166 aa, Unknown
  Obtained from environmental sample
  misc_feature (1)..(166): Xaa is any amino acid
MSKLSSLFNSFLKSPILLKLFFALLFVLFAIMIATISFAVHYNYENNYIKKDIHHKAISFIETKTNILKHQIDKNKQYLYSLKNNAILQSYIKTGENKATTVALFEQIISADKDIMQIRYIDERGMEIIRLERNEQNEKYRIVNETALQNKKDRSYFQETSKLNER

SEQ ID NO: 10625 - DNA, 606 bp, Unknown
  Obtained from environmental sample
  misc_feature (1)..(606): n is a, c, g, or t
gtgagaatggaaacaaaattgaaaattataagagctgctctcaggttatttctgcagaaaggaattgaaaaaacatctatgaatgatattgcaaaatctattgggattacaaaacccgcgatctattatcactttgaaaacaaggaagctgtaattctcggcgtccttgaactttttaaaaaagagatgaaaaaatggacttctaatttgcataaaacaaatacttctgctaaagattatatcgaaaaaacatttcaatctgtaaaaattttctcagatgtaaccgtaattcttttaggtaaaattcctgataactgcatgtataattttgatgaattactttcgcaattcagtaaaagaaatcttttagtgaaagaagatatggaaaggatttttatccaaacaagagaatcaataagtgcaagaataataataggtcaatcaaataatcatattagaaaagatttggatccagaacttctggcattgcaaattcataccattattgaaggaataaactatattgccacattagattcgacagttgaccttacaacgggaggtcaaaaactgttccatgaattttggaaaactattgaaccataa

SEQ ID NO: 10626 - protein, 201 aa, Unknown
  Obtained from environmental sample
  DOMAIN (9)...(55): Bacterial regulatory proteins, tetR family
  misc_feature (1)..(201): Xaa is any amino acid
MRMETKLKIIRAALRLFLQKGIEKTSMNDIAKSIGITKPAIYYHFENKEAVILGVLELFKKEMKKWTSNLHKTNTSAKDYIEKTFQSVKIFSDVTVILLGKIPDNCMYNFDELLSQFSKRNLLVKEDMERIFIQTRESISARIIIGQSNNHIRKDLDPELLALQIHTIIEGINYIATLDSTVDLTTGGQKLFHEFWKTIEP

SEQ ID NO: 10627 - DNA, 309 bp, Unknown
  Obtained from environmental sample
  misc_feature (1)..(309): n is a, c, g, or t
atgactcaaggattatataaaaatggaactcttcaaagtgttggcgactttagtgctaaatcaagatatttaagtttagaacaaaatataggtggacaaagtgcagtaacattctacttcacttcaaatgaaaatgaggcttatcaaaaagtaaatattttaagtggatttatcgctcaaatcatatatctaaaatcagaactcaaacaggtaggttgtagtggtattggagcttattatgatcaagagaccaaaaagtttttaaagacagaaaataacattctttacctacttgctattggcaagtaa

SEQ ID NO: 10628 - protein, 102 aa, Unknown
  Obtained from environmental sample
  misc_feature (1)..(102): Xaa is any amino acid
MTQGLYKNGTLQSVGDFSAKSRYLSLEQNIGGQSAVTFYFTSNENEAYQKVNILSGFIAQIIYLKSELKQVGCSGIGAYYDQETKKFLKTENNILYLLAIGK

SEQ ID NO: 10629 - DNA, 429 bp, Unknown
  Obtained from environmental sample
  misc_feature (1)..(429): n is a, c, g, or t
ttgattaaatcttttttcaaccttattaatatattaaaatatgtttttatcataacaaggaggttataccttttcatctgtattatgagtttatcacataagatgatatcactgacaattactcagggtgcattggattttcaatcaataaaaatgattttaacagatggcttatttaccttaattgttatagctattgtgaaaacattatttattaaaaatggatatgattatgccttgacttttttagagattggatttgttgttgttatacgaaagctaattcttttagatgcagcaccagaagaagctatgatgactctaactttagggttaacatcagcggtattttttgtcctaatagtctatattcataatataaaaaataaagcaaaaaaagaggaagagttacttgccaatagcaagtag

SEQ ID NO: 10630 - protein, 142 aa, Unknown
  Obtained from environmental sample
  misc_feature (1)..(142): Xaa is any amino acid
MIKSFFNLINILKYVFIITRRLYLFICIMSLSHKMISLTITQGALDFQSIKMILTDGLFTLIVIAIVKTLFIKNGYDYALTFLEIGFVVVIRKLILLDAAPEEAMMTLTLGLTSAVFFVLIVYIHNIKNKAKKEEELLANSK

SEQ ID NO: 10631 - DNA, 321 bp, Unknown
  Obtained from environmental sample
  misc_feature (1)..(321): n is a, c, g, or t
atgaaaaaaacagaaaaaacaaatacaagtaatcttatcgatagaacatttaaaaaactaagcaatttagataaaattttagaaaataaaattgataaaatcttattacaacttattaatatattaaaatatgtttgtatcataacaatgatgttataccttttcatctgtattatgagtttatcacataagatgatatcactgacaattactcagggtgcattggattttcaatcaataaaaatgatttttacagagcgcttatttaccttaatttgtaatgctatttgtgaaaacattatttataaaaaatggatatga

SEQ ID NO: 10632 - protein, 106 aa, Unknown
  Obtained from environmental sample
  misc_feature (1)..(106): Xaa is any amino acid
MKKTEKTNTSNLIDRTFKKLSNLDKILENKIDKILLQLINILKYVCIITMMLYLFICIMSLSHKMISLTITQGALDFQSIKMIFTERLFTLICNAICENIIYKKWI

SEQ ID NO: 10633 - DNA, 672 bp, Unknown
  Obtained from environmental sample
  misc_feature (1)..(672): n is a, c, g, or t
atgggatgtttttttgaaacacaaggtggggtgatgattagagctgatagagttgaaaaactcaaatctaatcaacctataaaaataacaaccccagcagcaaatgaagtaaccaataaaataggatttgagatactcaaaagatatgccaaaaaagagaaatttgagctatctagagaaaaggttacttttgtagagactgatttttggcatattaacaatatggaacaagatggaagttttgatggagcatggctttgtttttataattttgagggcattgaagcagaatttaagggctttgagagtctttttatagaccagaatctatctccttatccaaatttctctgctctagagtttatgactacagatgcagttataaaagaaaaaagtgaatctttgtgtaaatttctcgaagtaacaaatgagatggcaaaatatcttcaagggaatattgaagatggcaaaaagatgttttatcaatacagtggtgaggaaaagtctgcacttatggataagattatagaagatacaatcctaagacttaaaaccgatataaaagcagatgaaaaaaaatggctagaactttataagttccttgaggagttggagttagtaaaactcacagataaacaatataatacaatatgggaaattaaaggacattag

SEQ ID NO: 10634 - protein, 223 aa, Unknown
  Obtained from environmental sample
  misc_feature (1)..(223): Xaa is any amino acid
MGCFFETQGGVMIRADRVEKLKSNQPIKITTPAANEVTNKIGFEILKRYAKKEKFELSREKVTFVETDFWHINNMEQDGSFDGAWLCFYNFEGIEAEFKGFESLFIDQNLSPYPNFSALEFMTTDAVIKEKSESLCKFLEVTNEMAKYLQGNIEDGKKMFYQYSGEEKSALMDKIIEDTILRLKTDIKADEKKWLELYKFLEELELVKLTDKQYNTIWEIKGH

SEQ ID NO: 10635 - DNA, 474 bp, Unknown
  Obtained from environmental sample
  misc_feature (1)..(474): n is a, c, g, or t
atgactttaaacaaagcagttgtaaaagttacaaatagtggtgcttttattaatttagaagaaggtattgacggtttcttacacattgatgatatttcttggacaaagaaaatcaaaagtatgtcttctttctgtaaagaaggtgatttaattgatgttgcaataacaagagttgaatccgataacagaagaattcgtttaagtgttaaaaaacttgaagataatccttggtcagtacttaaaaaagattacccaaaatatagcaagatttcaggtacagtttcaaacgttactgatttcggaatatttgttaaggtagttggtgaagttgaaggactaattagtaaatataatttaattggcccagatgaagaattcactgaagaagtattagctaaatacactgttggtgatgctattacagctatggttattgaatgtaattctaatactcaaaaactatcacttcaataa

SEQ ID NO: 10636 - protein, 157 aa, Unknown
  Obtained from environmental sample
  DOMAIN (2)...(70): S1 RNA binding domain
  misc_feature (1)..(157): Xaa is any amino acid
MTLNKAVVKVTNSGAFINLEEGIDGFLHIDDISWTKKIKSMSSFCKEGDLIDVAITRVESDNRRIRLSVKKLEDNPWSVLKKDYPKYSKISGTVSNVTDFGIFVKVVGEVEGLISKYNLIGPDEEFTEEVLAKYTVGDAITAMVIECNSNTQKLSLQ

SEQ ID NO: 10637 - DNA, 603 bp, Unknown
  Obtained from environmental sample
  misc_feature (1)..(603): n is a, c, g, or t
ttgaaaaatatagagtacgagttcttaaaacaaactatggttcaactggagaagagtttatcttataaattaagagatgatgaaagtattgtttgtactgaggctgttgataatatcaaatatttttatagcaatatggatgaatttatcaaaagttttaaagaaaaatttgaacatgatgattcaaatgagatttattttaaaggaaaaagtggttttgtaggttgcagatatctgccaagaataaatgaaggtgagataagagctctgcttgtcaatgacaaaatagtaagtattgtacacaaaaaaccacaaaatggagagttttcggcaacactctttagtggagcaaagtatgaatataacaaaccagataatccacaatacaaagatatggttgagattacaaataaagcattgaaagatataaaaaaacatcttaataatcaaaactatcccctactttggactatggactatatccttgattatgataaaaagggaaaagacaaactagtcttaagtgaaataaactgctcttgtgtagggatatctacacaactagaacttagcgatgagattgctaaagtatttttgcagtaa

SEQ ID NO: 10638 - protein, 200 aa, Unknown
  Obtained from environmental sample
  misc_feature (1)..(200): Xaa is any amino acid
MKNIEYEFLKQTMVQLEKSLSYKLRDDESIVCTEAVDNIKYFYSNMDEFIKSFKEKFEHDDSNEIYFKGKSGFVGCRYLPRINEGEIRALLVNDKIVSIVHKKPQNGEFSATLFSGAKYEYNKPDNPQYKDMVEITNKALKDIKKHLNNQNYPLLWTMDYILDYDKKGKDKLVLSEINCSCVGISTQLELSDEIAKVFLQ

SEQ ID NO: 10639 - DNA, 960 bp, Unknown
  Obtained from environmental sample
  misc_feature (1)..(960): n is a, c, g, or t
ttgttgaaaaaatacgcgataattatagagtatgcaaaaggtagtgacaaaagttttgatggatttagaccagatacgaaacctattttaaagtcactaaaaaatatagcaaatattgatggtgaagttgttttttataatccaaaaagaaaaaaagagttatttaaatatataaaatctactgcaactatagttataagtagaatcaatccaggaaatctcaaagaggtagatgagtattttgtttttttaaaatctttaagtgatgttggtattgatatacatactcaccctgatgtgatgataaatcttgattttaaggatatcttagaaaaactcaaaaattcccttgtaggggacaaaggaactatgtttttccacacctacaaagagtttaaaaaagagtttccacagatccttgaaaaatatagagtacgagttcttaaaacaaactatggttcaactggagaaggagtttatcttataaatttaagagatgatgaaagtattgtttgtactgaggctgttgataatatcaaatatttttatagcaatatggatgaatttatcaaaagttttaaagaaaaatttgaacatgatgattcaaatgagatttattttaaaggaaaaagtggttttgtaggttgcagatatctgccaagaataaatgaaggtgagataagagctctgcttgtcaatgacaaaatagtaagtattgtacacaaaaaaccacaaaatggagagttttcggcaacactctttagtggagcaaagtatgaatataacaaaccagataatccacaatacaaagatatggttgagattacaaataaagcattgaaagatataaaaaaacatcttaataatcaaactatcccctactttggactatggacctatatccttgatatgaataaaagggaaaagacaaacctatccttaattgaaaataaactgctt

SEQ ID NO: 10640 - protein, 320 aa, Unknown
  Obtained from environmental sample
  misc_feature (1)..(320): Xaa is any amino acid
MLKKYAIIIEYAKGSDKSFDGFRPDTKPILKSLKNIANIDGEVVFYNPKRKKELFKYIKSTATIVISRINPGNLKEVDEYFVFLKSLSDVGIDIHTHPDVMINLDFKDILEKLKNSLVGDKGTMFFHTYKEFKKEFPQILEKYRVRVLKTNYGSTGEGVYLINLRDDESIVCTEAVDNIKYFYSNMDEFIKSFKEKFEHDDSNEIYFKGKSGFVGCRYLPRINEGEIRALLVNDKIVSIVHKKPQNGEFSATLFSGAKYEYNKPDNPQYKDMVEITNKALKDIKKHLNNQTIPYFGLWTYILDMNKREKTNLSLIENKLL

SEQ ID NO: 10641 - DNA, 369 bp, Unknown
  Obtained from environmental sample
  misc_feature (1)..(369): n is a, c, g, or t
gtgatgaataaaaaaagagaattaaccgtaagagctatcgaaagcggcacagtaatagatcatataccatcagcaaacttatttaaagtattatcgattattgaggttgaaaaaatggatactcaagtattgattggaaataattttgaaagcaaaaggttaggaaaaaaaggtattattaaaattgaaaaaagatttccttcaatagaggacattaataaaatagctctattagctcctaatgctgcaataaacattattaaggattataaagttattgaaaaaaaaacggtagaagtacctaaatatgtcgatggtattgcaaaatgtgttaatcccaagtgtattactaatccccaaaaacgttaa

SEQ ID NO: 10642 - protein, 122 aa, Unknown
  Obtained from environmental sample
  DOMAIN (3)...(100): Aspartate carbamoyltransferase regulatory chain, allosteric domain
  misc_feature (1)..(122): Xaa is any amino acid
MMNKKRELTVRAIESGTVIDHIPSANLFKVLSIIEVEKMDTQVLIGNNFESKRLGKKGIIKIEKRFPSIEDINKIALLAPNAAINIIKDYKVIEKKTVEVPKYVDGIAKCVNPKCITNPQKR

SEQ ID NO: 10643 - DNA, 351 bp, Unknown
  Obtained from environmental sample
  misc_feature (1)..(351): n is a, c, g, or t
atggatactcaagtattgattggacgtaattttgaaagcaaaaggttaggaaaaaaaggtattattaaaattgaaaaaagatttccttcaatagaggacattaataaaatagctctattagctcctaatgctgcaataaacattattaaggattataaagttattgaaaagaaatcggtagaagtacctaaatatgtcgatggtattgcaaaatgtgttaatcccaagtgtattactaatcacgaaaacgttaaaactcattttgaagtaatcgaaaaagattctaatattaatttgaagtgttattattgcgaaaaaataactgaacagaagaatataactataatttag

SEQ ID NO: 10644 - protein, 116 aa, Unknown
  Obtained from environmental sample
  DOMAIN (2)...(62): Aspartate carbamoyltransferase regulatory chain, allosteric domain
  misc_feature (1)..(116): Xaa is any amino acid
MDTQVLIGRNFESKRLGKKGIIKIEKRFPSIEDINKIALLAPNAAINIIKDYKVIEKKSVEVPKYVDGIAKCVNPKCITNHENVKTHFEVIEKDSNINLKCYYCEKITEQKNITII

SEQ ID NO: 10645 - DNA, 420 bp, Unknown
  Obtained from environmental sample
  misc_feature (1)..(420): n is a, c, g, or t
ttgacaaaaataatcgataatatatttgataatgttaagtattggcaagagaaaaaactcttactacaagctatcccttatgactactactcaaacaaacatattatgatacgactcttaggggttacatctcatagtatctcatctaaaaatgaagcaaaaaaagatatgtggaatcaccatataaataatggtatgggtgatgatatcttaaataatatcaataaagagcttttaagtgattttgaatttgcgagagatgccatagcaaaatataatagaacctatatctatctagataaaaatttacaagctagtagagacttagcactgcttgcagcctcaaaagaggaaaacttagatgacccatcaaagtttagaccagcaatattacaacatatgccagagattaccaactga

SEQ ID NO: 10646 - protein, 139 aa, Unknown
  Obtained from environmental sample
  misc_feature (1)..(139): Xaa is any amino acid
MTKIIDNIFDNVKYWQEKKLLLQAIPYDYYSNKHIMIRLLGVTSHSISSKNEAKKDMWNHHINNGMGDDILNNINKELLSDFEFARDAIAKYNRTYIYLDKNLQASRDLALLAASKEENLDDPSKFRPAILQHMPEITN

SEQ ID NO: 10647 - DNA, 345 bp, Unknown
  Obtained from environmental sample
  misc_feature (1)..(345): n is a, c, g, or t
ttgaaaaagagggagagaataggaaaactgatacatctgatttgcataataataacaattcttcatctattttctctcttcaatgacgatagcttgatcatcttttttaaagtcccaggtttttactggtattcgccaatcaccatatctataggtgagataaccatcataatcctctggaacagaatagtcccgctccttaaatttaaattttgtaagattctcataatagcttgcaggagcagatttcagacacggtttcttaattccgacagtccaaaagaaatcttgttcaatttttctttttacaaagagatctaccattacccgacctctgaaaaataa

SEQ ID NO: 10648 - protein, 114 aa, Unknown
  Obtained from environmental sample
  misc_feature (1)..(114): Xaa is any amino acid
MKKRERIGKLIHLICIIITILHLFSLFNDDSLIIFFKVPGFYWYSPITISIGEITIIILWNRIVPLLKFKFCKILIIACRSRFQTRFLNSDSPKEILFNFSFYKEIYHYPTSEK

SEQ ID NO: 10649 - DNA, 651 bp, Unknown
  Obtained from environmental sample
  misc_feature (1)..(651): n is a, c, g, or t
gtgatcctacagggacgtattttgtccatccacgtccaactagttttaaataaatcagaaattaacaaagatatgaaaatagacccatataaacacaaagaatgctacctcgcttggaaagaaaaagtcaaagacggaattcaaaatatcagcaagaaaaattctaacatactcctaaaatatctagaagatatggaatacggactcaacgtatccctaaaaagcaaaaagggttccagaagttatccaagagtcaacacactcagacaaaaattaaatttcatattcaaggaattcgaagaaaggtacagcctatatgatattacactaactccagaacagcatctacatagtcacttcacaggaatgcgaaatggcaccatcaaaaatagacatggaaaccaatacaaatccaccggagactacgtaaaaatcttcaaatctttttggcattggcatcaaaaggttaatagaaaagttggtatcaaaattcttgacattactatagacctagatactcatagagataagcccaaatggatctatttaacccgagaagagattaagagactatatgatgcagccaacccaggctataaaatattgataatgttcctatttgaaacagggataagagcaccaaccgaataa

SEQ ID NO: 10650 - protein, 216 aa, Unknown
  Obtained from environmental sample
  misc_feature (1)..(216): Xaa is any amino acid
MILQGRILSIHVQLVLNKSEINKDMKIDPYKHKECYLAWKEKVKDGIQNISKKNSNILLKYLEDMEYGLNVSLKSKKGSRSYPRVNTLRQKLNFIFKEFEERYSLYDITLTPEQHLHSHFTGMRNGTIKNRHGNQYKSTGDYVKIFKSFWHWHQKVNRKVGIKILDITIDLDTHRDKPKWIYLTREEIKRLYDAANPGYKILIMFLFETGIRAPTE

SEQ ID NO: 10651 - DNA, 552 bp, Unknown
  Obtained from environmental sample
  misc_feature (1)..(552): n is a, c, g, or t
ttgtgtggctggggtgtcgtggtttatgtaacgtccaaagcgattattgaaagtcatcttgttgaatttacagattttgccggtgaaatcggccgcttgggcggggtgaaaaactttccggttcatattgagctgagaagagatagtgatggaactttattgccgatagaggtaaatccgatgcgctttgggggttggtgcaccacggcagatatctcttttctcgcatatgaattcaatccctacttatactattacaagcaacagacacccgactggtctcagttgttgcagggaaaagaggggaagcttttcagtattgttgtgctggacaattcaaccggtgtcgaaatcggaaaaatcaaatcatttgcttatgacctgttgttgaaaaggtttaagaagcctctggaattgcgaaaaacaagttttcaggagtctccggtgtttggttttctgtttaccgaaaacggaaagcggtataactttggtgaactcaaagatatcctcgattcaaaattgcgtgaatttatcacgtggcgcgaaaattaa

SEQ ID NO: 10652 - protein, 183 aa, Unknown
  Obtained from environmental sample
  misc_feature (1)..(183): Xaa is any amino acid
MCGWGVVVYVTSKAIIESHLVEFTDFAGEIGRLGGVKNFPVHIELRRDSDGTLLPIEVNPMRFGGWCTTADISFLAYEFNPYLYYYKQQTPDWSQLLQGKEGKLFSIVVLDNSTGVEIGKIKSFAYDLLLKRFKKPLELRKTSFQESPVFGFLFTENGKRYNFGELKDILDSKLREFITWREN

SEQ ID NO: 10653 - DNA, 465 bp, Unknown
  Obtained from environmental sample
  misc_feature (1)..(465): n is a, c, g, or t
atgaataaatggatgaaacgatatattgctgacctgaaaaatcaagaagctaagaaggcggtttatttatttaatgatgaatttactaattataacgataccgatataggaattaaaactgttcaattacttacacgattgggttatgaagtgattattcctaaacatattgatagtggtagaacatatttatcgaaaggattaattcgtaaagctcagaaaatagcaataaagaatgttaattatttaaaagatatcattaattctgactcacgtttggtgggcatagaaccttctgctattttaacttttagagatgaatatcctgatttagtgggacaagaactgaaacaaactgcaattgaattaggaaagaatgctttaatgattgacgaatttctgaagcaagaaatagaaaatgggaatattactaaagataagtttcacaagaaaaacagtatataa

SEQ ID NO: 10654 - protein, 154 aa, Unknown
  Obtained from environmental sample
  misc_feature (1)..(154): Xaa is any amino acid
MNKWMKRYIADLKNQEAKKAVYLFNDEFTNYNDTDIGIKTVQLLTRLGYEVIIPKHIDSGRTYLSKGLIRKAQKIAIKNVNYLKDIINSDSRLVGIEPSAILTFRDEYPDLVGQELKQTAIELGKNALMIDEFLKQEIENGNITKDKFHKKNSI

SEQ ID NO: 10655 - DNA, 684 bp, Unknown
  Obtained from environmental sample
  misc_feature (1)..(684): n is a, c, g, or t
atggctgagaccgaaatgggggatcatggttttggagatatgtgggtagacgctagaatcggtcaatctaccgattactttgccatgtgcgaaggtgttgatgagcaaattggaaaagtgttgcaaaccttaaaagatcaggggctggacaaaaacacgattgtaattttcacatccgatcatggtgaaatgttaggaagccagggtatgatgcataaaaacatttggtttagtgaggctttcgatattcctttcattatccgctggcccgaaaaaattaccgcaggcggaaccgataacttacttttaagtgttccagatataatgcctactcttttgggtttaatgggcttagataaagagattccagaggaagtagaaggaaatgattactcaggcatattccgcaacgagaaaataaatagaccagaagcagctctatacttctttgctaaacctgaaaatgatacagaaaaacgccgtggagttaaaacgcatacacacacatacgtaattgcatacgacaacaaaggagaaaaaatgcattttctgtatgatgacaagaacgatccttatcagactaagaatatatatggtgagaattcagaattggaacaagacttaacagaaaagcttcgcaaaattctaataaaaacaaatgatccatttataaactacttataa

SEQ ID NO: 10656 - protein, 227 aa, Unknown
  Obtained from environmental sample
  misc_feature (1)..(227): Xaa is any amino acid
MAETEMGDHGFGDMWVDARIGQSTDYFAMCEGVDEQIGKVLQTLKDQGLDKNTIVIFTSDHGEMLGSQGMMHKNIWFSEAFDIPFIIRWPEKITAGGTDNLLLSVPDIMPTLLGLMGLDKEIPEEVEGNDYSGIFRNEKINRPEAALYFFAKPENDTEKRRGVKTHTHTYVIAYDNKGEKMHFLYDDKNDPYQTKNIYGENSELEQDLTEKLRKILIKTNDPFINYL

SEQ ID NO: 10657 - DNA, 432 bp, Unknown
  Obtained from environmental sample
  misc_feature (1)..(432): n is a, c, g, or t
atgaatgaacaaaaattaaaatcattgcttcaatataaatcaaatgagatgataccatcaactcaactcataagaaaaagtaaacaagtatttgatgccatacaatacaatgatatagaaaaagctgtaatattaagagatggtaaaccttcatttttgttaatggattttgctaaatatgaagaactaattaatttttttatctcaaataacttattaattgataaagagttatctatgttagaaactcttgagataaaagagactgaaaaaatagataattcaacaaatgataaagtaataaataaagaagtgaatacaggacttaaaacaaaaaagaatgatcttcttgataaactagataatattgaaggcataataaataacgataaaacagtaattcaagataatttaaaagacttttgggagtaa

SEQ ID NO: 10658 - protein, 143 aa, Unknown
  Obtained from environmental sample
  misc_feature (1)..(143): Xaa is any amino acid
MNEQKLKSLLQYKSNEMIPSTQLIRKSKQVFDAIQYNDIEKAVILRDGKPSFLLMDFAKYEELINFFISNNLLIDKELSMLETLEIKETEKIDNSTNDKVINKEVNTGLKTKKNDLLDKLDNIEGIINNDKTVIQDNLKDFWE

SEQ ID NO: 10659 - DNA, 474 bp, Unknown
  Obtained from environmental sample
  misc_feature (1)..(474): n is a, c, g, or t
atgaaagatgtaattataataggtgcaggaggtgcagggttaagtgcagggttaagtgctaaagagaattcagataaagtcttgataatctctaaaacatttcctactcactctcaaacagtgcaagctcaaggtggaataaactgtgtacttgatactaaaaatgactctatagaaaatcatataacagatacatataattcatcaaaatatttatctgacaaaaagagtattgaaaccatgtgtgcaaatgcaaaagagactataacatggcttgacaaaataggtgtaccctttagtagagatttagaaggtaatatcaaacaaagatactttggcggaacaaaatacaaaagaacttgttacagtgcagactacacagggctgaagatacttcatacactatatgacaactgtattaaaaatgatattgattttttatatgaacacattttagtagatataatttattga

SEQ ID NO: 10660 - protein, 157 aa, Unknown
  Obtained from environmental sample
  SIGNAL (1)...(20)
  misc_feature (1)..(157): Xaa is any amino acid
MKDVIIIGAGGAGLSAGLSAKENSDKVLIISKTFPTHSQTVQAQGGINCVLDTKNDSIENHITDTYNSSKYLSDKKSIETMCANAKETITWLDKIGVPFSRDLEGNIKQRYFGGTKYKRTCYSADYTGLKILHTLYDNCIKNDIDFLYEHILVDIIY

SEQ ID NO: 10661 - DNA, 663 bp, Unknown
  Obtained from environmental sample
  misc_feature (1)..(663): n is a, c, g, or t
gtgattggggctattcctcttcggtcgcccagatcccaaaaaggggtgggggtggacattgagcccgaagcacaacactgggaagatgaagatcagaaaaaacaccccgaattactcaacaggaactttgtggttgaaaaagaaaaaatagtcgggaaaagcattcgggacctaaaggttcgtgccacgactcaggctaatattacgcgtattatgcataatgataaaactatcgttcctagtcctgataccactctttacaaaaatgatatcatcaaacttattggaagtgatcaagctcttgaaaaagcaaagattctaattggtgaagaaactcaagaaaaaatccctcttagtgttgagtacgttgtggaaagcattttggtcacaaacaaagaagttgtcaataagaccataggccaactaaacgtattgtcgaactataatgcaagaatcacacgaattagaagagctggtattgatatagctcctagttctaaatcaattattcgatttggggataaattaattgtagcctgtggaacagggaatataaacaacgttcgtcatctctttggcaacgatgtaaaaaaactatcagataccgacttcttcctctattgcgacgggaatagtcttaggtgttttggttggaaaacttaa

SEQ ID NO: 10662 - protein, 220 aa, Unknown
  Obtained from environmental sample
  DOMAIN (39)...(109): TrkA-C domain
  misc_feature (1)..(220): Xaa is any amino acid
MIGAIPLRSPRSQKGVGVDIEPEAQHWEDEDQKKHPELLNRNFVVEKEKIVGKSIRDLKVRATTQANITRIMHNDKTIVPSPDTTLYKNDIIKLIGSDQALEKAKILIGEETQEKIPLSVEYVVESILVTNKEVVNKTIGQLNVLSNYNARITRIRRAGIDIAPSSKSIIRFGDKLIVACGTGNINNVRHLFGNDVKKLSDTDFFLYCDGNSLRCFGWKT

SEQ ID NO: 10663 - DNA, 306 bp, Unknown
  Obtained from environmental sample
  misc_feature (1)..(306): n is a, c, g, or t
atgataaatgaatgtgtacaaagacatttaccattgcctaattataatgtggactattctggttttattgtagaattcagaaggtttaacgaagaatatttaaaatcattgggactaaatgattcttatgtaaaaatcatcttatttgttcagaaaaaaggggaaataacaaatacagatgttcaggaaatatgcaaagtatcaaagcgcactgcatccaactatttaacagaattggaaaaggaatatctggacaaaataggggtaactggaaaaggaactttctatactttaaaggggcaataa

SEQ ID NO: 10664 - protein, 101 aa, Unknown
  Obtained from environmental sample
  misc_feature (1)..(101): Xaa is any amino acid
MINECVQRHLPLPNYNVDYSGFIVEFRRFNEEYLKSLGLNDSYVKIILFVQKKGEITNTDVQEICKVSKRTASNYLTELEKEYLDKIGVTGKGTFYTLKGQ

SEQ ID NO: 10665 - DNA, 801 bp, Unknown
  Obtained from environmental sample
  misc_feature (1)..(801): n is a, c, g, or t
ttgctgtatgctagagtagctaacgcttattcgtataatacgggtgaattaatggtaaaatttaccactaaccaaattgtagatttaattgtagagcaatatcagggaaagaaggttttattactagcacctattattaaaggtagaaaaggacattataaagaattgtttgctcagtttatgaagcaagggtatttaaaagttcgaattgatggcgaattaatggaaatgcatcctaaaatgcaactcgataggtataaaattcatgatattgaattggtagtagatcagcttaaagttaaaaatgaagattaccaacgcatattggcttctgtagaaactacccttaagttgggcgatgatagcttaatggtttatgagtttcaagcaactgaagataaaaagaaccctcctaaatttaggttgttgagtaagaaattaatgtgccctactacaggaatttcgtacaacgaacccgaaccaaatttgttttcttttaactcgccttatggagcatgtaaaaaatgtagtggtttaggtcagatttctgaaattgacattaaaaaagtgatacccaaccctaaattgagcattaaaaaaggcggcattgctcctttgggagattacaaaaacaattgggcatttaaacaagttgaagctattgctgcgaattttggatttaccgtaaacacacctcttagcgaaattgaagaagaagcgttagattgtttgctttatggttcttcggaacctattaatatgacgcatgaggtagatggtcagacaaaaattaccaattag

SEQ ID NO: 10666 - protein, 266 aa, Unknown
  Obtained from environmental sample
  misc_feature (1)..(266): Xaa is any amino acid
MLYARVANAYSYNTGELMVKFTTNQIVDLIVEQYQGKKVLLLAPIIKGRKGHYKELFAQFMKQGYLKVRIDGELMEMHPKMQLDRYKIHDIELVVDQLKVKNEDYQRILASVETTLKLGDDSLMVYEFQATEDKKNPPKFRLLSKKLMCPTTGISYNEPEPNLFSFNSPYGACKKCSGLGQISEIDIKKVIPNPKLSIKKGGIAPLGDYKNNWAFKQVEAIAANFGFTVNTPLSEIEEEALDCLLYGSSEPINMTHEVDGQTKITN

SEQ ID NO: 10667 - DNA, 675 bp, Unknown
  Obtained from environmental sample
  misc_feature (1)..(675): n is a, c, g, or t
ttgccagaagctaaaataagaggttacaaaccaggcaggttttcttttaatgtaaaaggcggaaggtgcgaaagttgtcaaggggcgggagtaaaaaccatagagatgaattttttacccgatgtttatgtaatgtgtgatgagtgtaatggaaaaagatataatagagaaacattagaagtaaggtataaaggaaaatctattagtgatgtgttgaatatgagtattgaacaagcagtagttttctttgaaaatcatcctaatattttacagaaaataaaaactcttaatgacgttggtttggggtatattaatttaggacaaccatcaacaacactttcgggtggagaagcacaacgagtgaaattagctgccgaattagctaaacgacaaacaggtaaaacattgtatattttagatgaaccatcaacaggtttgcattttgaagatattaaagtattgttggacgttttaaataaattagttgatattggtaatacggtgctggtggtagaacataatttagatattattaaagtagcagattatattgtagatgttggtccggaaggcggacaagaaggaggaaagattgttgccgaaggaacaccagaacaattggctaaaaacaaaaaaagttatacggctagttttttaaaagaagagttgaaatag

SEQ ID NO: 10668 - protein, 224 aa, Unknown
  Obtained from environmental sample
  DOMAIN (51)...(188): ABC transporter
  misc_feature (1)..(224): Xaa is any amino acid
MPEAKIRGYKPGRFSFNVKGGRCESCQGAGVKTIEMNFLPDVYVMCDECNGKRYNRETLEVRYKGKSISDVLNMSIEQAVVFFENHPNILQKIKTLNDVGLGYINLGQPSTTLSGGEAQRVKLAAELAKRQTGKTLYILDEPSTGLHFEDIKVLLDVLNKLVDIGNTVLVVEHNLDIIKVADYIVDVGPEGGQEGGKIVAEGTPEQLAKNKKSYTASFLKEELK

SEQ ID NO: 10669 - DNA, 339 bp, Unknown
  Obtained from environmental sample
  misc_feature (1)..(339): n is a, c, g, or t
atgaataataaaaatatattagaagtatatgaaatcttaaaagaagaacttaaatattttacaatacctcttgcagaacaaatacaagttaaaacaaaaaaacctttctttgtattaataggaacaattctttctgcaagaacaaaagatgaaataactgcaaaggtatgtaataaattatttcaaaaaataaaaaactttaatgatcttgaaaaaatagatagtaaaaaattagaaaaattattataccctgtaggattttataaacaaaaaacagaatatctaaaacaaattcctaaaattattaaaaatgattttgaaaacacaattccttcctga

SEQ ID NO: 10670 - protein, 112 aa, Unknown
  Obtained from environmental sample
  misc_feature (1)..(112): Xaa is any amino acid
MNNKNILEVYEILKEELKYFTIPLAEQIQVKTKKPFFVLIGTILSARTKDEITAKVCNKLFQKIKNFNDLEKIDSKKLEKLLYPVGFYKQKTEYLKQIPKIIKNDFENTIPS

SEQ ID NO: 10671 - DNA, 816 bp, Unknown
  Obtained from environmental sample
  misc_feature (1)..(816): n is a, c, g, or t
atggatggaaatttttctgatacttctaatgattcttatgtaagtgcaacacaaatcaaaaagtttgcacttagaactggggatattgtaacaggacaagttagacctccaaacaaagatagtgaaaaatactatgctttacttaaaatagaagcaataaactatctaccaatacatgaatcaaaaaacagaccactttttgataacttaacacctttatattcaactgagagatttaaatttgaatatgaatcaactaaaatgacaggaagaatcttagaccttttttctcctatgggtaaaggtcaaaggggacttatcgttgctcctccaaaaacaggtaaaacagaacttttaaaagaactagcgcatggaatttcaagaaatcatccagaagctcatttgatggttttactaatagatgaaagaccagaagaagttacagatatgcaaagaagtgtaaagggtgatgtttactcttctacatttgatttacctgctcaaaatcatgttagagttgctgaaattgttattgaaaaagcaaaaagaatggttgagatgaaaaaagatgtagttatcttacttgactcaatcacaagacttgcacgtgcatacaatacagtaacaccaagtagtggaaaagtactttcaggtggggttgatgcaaatgcactacacaaaccaaaaagattttttggggctgctagaaatatagaagaggggggaagtttaactatcatctcaactgcacttataaaaacaggttcaaaaatgggacaaagttattttcaaagagttcaaaggaacaggaaatag

SEQ ID NO: 10672 - protein, 271 aa, Unknown
  Obtained from environmental sample
  DOMAIN (102)...(262): ATP synthase alpha/beta family, nucleotide-binding domain
  misc_feature (1)..(271): Xaa is any amino acid
MDGNFSDTSNDSYVSATQIKKFALRTGDIVTGQVRPPNKDSEKYYALLKIEAINYLPIHESKNRPLFDNLTPLYSTERFKFEYESTKMTGRILDLFSPMGKGQRGLIVAPPKTGKTELLKELAHGISRNHPEAHLMVLLIDERPEEVTDMQRSVKGDVYSSTFDLPAQNHVRVAEIVIEKAKRMVEMKKDVVILLDSITRLARAYNTVTPSSGKVLSGGVDANALHKPKRFFGAARNIEEGGSLTIISTALIKTGSKMGQSYFQRVQRNRK

SEQ ID NO: 10673 - DNA, 591 bp, Unknown
  Obtained from environmental sample
  misc_feature (1)..(591): n is a, c, g, or t
atgaaaatatggtcaacaataaaacttgtttttataagtcttgtagcacttgttgcacttacttttttaacagtagatgcacccaaaaagatagaaaaagttgctataaatcttgaaaatttaccagatacagtggagttaataggttttgaagagcaaaaattcaatacaaatagtataataaaaccagaatctataatatttgtaggaaatcatgaatcaattatgttagcaaaaacacttgatgagatgttggatttggatgcaggggattttattattgtatcaagtgtttcagatgaaccttggtttataaaaagatggcaagcgcacactcaaaatacaaaacttaaaggggataaacagttagcgtggatttatgatagagatggaagtataagaaattttttgcaagtaccaacatctgatgcattaaaatattttgtttataatgtaaaaaaagatgggataatagaaaatatctatattggtaaaataaaagttggagcaagtaatggtactatgagtgaaaaagagataaaagaaaacctacaagaggttgtcaaaagagtaaaagaattagaatattaa

SEQ ID NO: 10674 - protein, 196 aa, Unknown
  Obtained from environmental sample
  SIGNAL (1)...(19)
  misc_feature (1)..(196): Xaa is any amino acid
MKIWSTIKLVFISLVALVALTFLTVDAPKKIEKVAINLENLPDTVELIGFEEQKFNTNSIIKPESIIFVGNHESIMLAKTLDEMLDLDAGDFIIVSSVSDEPWFIKRWQAHTQNTKLKGDKQLAWIYDRDGSIRNFLQVPTSDALKYFVYNVKKDGIIENIYIGKIKVGASNGTMSEKEIKENLQEVVKRVKELEY

SEQ ID NO: 10675 - DNA, 714 bp, Unknown
  Obtained from environmental sample
  misc_feature (1)..(714): n is a, c, g, or t
ttgaaagtacatcaaaaaactgttattgtagttttaacagaatataattttattgataatgttgctccaattattgatttgttagtagaaaatgattataaggtcatattaatagaaacaaattatacttataattataaaaatgataataatttaatatatttacatagtaaacacaaaaatatagtaagtcttaaattatatgaatcaattttaggctttaaaatcaaaaattttactaaaatagaaaaaaaattaaatagacatgtagatggtaatttttctgatactatatgtgtaatagatcattcttctggagatgataataaggctaacaattatttaaagaagattattatgcaacacaatattaaatgtattgcatttaatcatggcttagaaataaccacaaatgtattagttagtatttataatttaacatttaatattgaaaaagataaaaacttaacattcgcgcaaaaaaatgctcttaaattagtagtttacaatgaacaaaataaaaaaggtcaaagtgagtatatatccaaaaagtataacgataaaattgttgtattacctactttaagatattcttcatattggttatctgaaattcaaaaaagttatgctaagtttgagtttgaaactactaaactgaagctagtctatcttaatagttcagaaaatttaatgggtggaccgaggaaaatatag

SEQ ID NO: 10676 - protein, 237 aa, Unknown
  Obtained from environmental sample
  misc_feature (1)..(237): Xaa is any amino acid
MKVHQKTVIVVLTEYNFIDNVAPIIDLLVENDYKVILIETNYTYNYKNDNNLIYLHSKHKNIVSLKLYESILGFKIKNFTKIEKKLNRHVDGNFSDTICVIDHSSGDDNKANNYLKKIIMQHNIKCIAFNHGLEITTNVLVSIYNLTFNIEKDKNLTFAQKNALKLVVYNEQNKKGQSEYISKKYNDKIVVLPTLRYSSYWLSEIQKSYAKFEFETTKLKLVYLNSSENLMGGPRKI

SEQ ID NO: 10677 - DNA, 684 bp, Unknown
  Obtained from environmental sample
  misc_feature (1)..(684): n is a, c, g, or t
gtgatagatgataataagcaaaccactaaagcggatatgtttgtcaagcgtaccataaagccaaccaaaatggtagaccatgccgatacctctgctgaagcacttaccatatccattaacgaaaaaggcagcatagatattgaatatatggcgaagctcacaaggcaggaaaaggatatagtaatcaaagatttagagggcgtaatattcagaaaccctgctacctttgaccaagaaaatccatatgataattttgaaacagcggatgaatatttaagcggtaatgtcagaaacaagttgaaattggcactagaattctctaaaactgatgaaaagtacaatattaatgtttccatgctaaatgaagtacaaccagaagatttagaagctggcgaaatcgaagtaaggcttggtgcaacatggataccgactcgtgatgtgctggacttcataaccgatacattagagccaagttaccatgcaacgcagtatcttgatattgaatacagcagtaaactgggtgtatggaagatcaaaggaaagccttttgccaacaactcttttgaagcacgagaagtacacggaacaagcagaatggacgcatatacaattatagagaacacattgaatctaaaaagacttactattaatgattatgatagtgatggctcagccgaattctga

SEQ ID NO: 10678 - protein, 227 aa, Unknown
  Obtained from environmental sample
  misc_feature (1)..(227): Xaa is any amino acid
MIDDNKQTTKADMFVKRTIKPTKMVDHADTSAEALTISINEKGSIDIEYMAKLTRQEKDIVIKDLEGVIFRNPATFDQENPYDNFETADEYLSGNVRNKLKLALEFSKTDEKYNINVSMLNEVQPEDLEAGEIEVRLGATWIPTRDVLDFITDTLEPSYHATQYLDIEYSSKLGVWKIKGKPFANNSFEAREVHGTSRMDAYTIIENTLNLKRLTINDYDSDGSAEF

SEQ ID NO: 10679 - DNA, 387 bp, Unknown
  Obtained from environmental sample
  misc_feature (1)..(387): n is a, c, g, or t
ttgatcccagatattggtttttgtggagaggatagaaataagcatatgcatagaataggacacctaatcaagacactgcaacacaactcgatctctactgttgcatcgtttgtatctccatacagagagtcacgtaaagctatacgagagatggtaaagaataatattgtagtatatgtaaaagcggatattgaaacttgcaaaagcagagacactaaaggcaaatatgaaaaagctctaagaggcgaatatcaaaactttacaggagtgaatgatacatatgaagagccagagcacgctgagatcattatagatagtgataaaacaagtgtagatgaagcaactaaaataatcatacaatttattaaaaagaagtatatcagatga

SEQ ID NO: 10680 - protein, 128 aa, Unknown
  Obtained from environmental sample
  DOMAIN (3)...(111): Adenylylsulphate kinase
  misc_feature (1)..(128): Xaa is any amino acid
MIPDIGFCGEDRNKHMHRIGHLIKTLQHNSISTVASFVSPYRESRKAIREMVKNNIVVYVKADIETCKSRDTKGKYEKALRGEYQNFTGVNDTYEEPEHAEIIIDSDKTSVDEATKIIIQFIKKKYIR

SEQ ID NO: 10681 - DNA, 609 bp, Unknown
  Obtained from environmental sample
  misc_feature (1)..(609): n is a, c, g, or t
ttgtttgagtcatcggcactaaatgatagtcaagtacctgattggattatgaaaaatgtaaaagaaaacggatttcagatacaaaaagaaattgctttaatgttaggtgaatttttaggaaaagatttaaccaaaataaataacgaattaaaaaagctatatttaaatttaaaaaaaggagacgaaatcacttccgatttaatcaactctaatataggaataagtaaggactataatatatttgaattacaaagggtgctgtcaaataaagacgttttcaaagcaaataaaattataaactatttcatagcaaaccctaaagaaaaccctcttataagaatcattaattttctttatggattctattcaaaagtattaatataccgttatttgatggaaacaaaggataaaaacatatcaataaagatgaaaatgccagattggatgttaaaagattatgctgaagctgctaaacgaaactctttcgataaaataacaaatataattacagaaataaaagaatatgaccttcgttctaagggagttaataataattccacagaacacggagaattattaaaagaattgatttttaaaattctacattag

SEQ ID NO: 10682 - protein, 202 aa, Unknown
  Obtained from environmental sample
  misc_feature (1)..(202): Xaa is any amino acid
MFESSALNDSQVPDWIMKNVKENGFQIQKEIALMLGEFLGKDLTKINNELKKLYLNLKKGDEITSDLINSNIGISKDYNIFELQRVLSNKDVFKANKIINYFIANPKENPLIRIINFLYGFYSKVLIYRYLMETKDKNISIKMKMPDWMLKDYAEAAKRNSFDKITNIITEIKEYDLRSKGVNNNSTEHGELLKELIFKILH

SEQ ID NO: 10683 - DNA, 417 bp, Unknown
  Obtained from environmental sample
  misc_feature (1)..(417): n is a, c, g, or t
gtggaggggggtgccaccttcactgtggcaaaaggtagggggaccagccttctttacgtgtgttttcggttccttgtctttcgtgttggtaagatcgcggatcgacttactgggaaagatttttttacttccagatggtggggaagcgtcatcaacaaatgcggtataatctgggttagtaagaaaggattgatggtcttttatttcaatattgttttcctgagcccaaagttcataggtaagtgtgtcttttacacgttgattttccatctaaatacttgccgggtttatttaggttatccaaaattaagcgtaaacttaccgcaaaaacagtggttaataaataaataccgagcgtttttgcaccaactctacctaaacgttttatatctgataagcctgaaataccaccgataa

SEQ ID NO: 10684 - protein, 138 aa, Unknown
  Obtained from environmental sample
  misc_feature (1)..(138): Xaa is any amino acid
MEGGATFTVAKGRGTSLLYVCFRFLVFRVGKIADRLTGKDFFTSRWWGSVINKCGIIWVSKKGLMVFYFNIVFLSPKFIGKCVFYTLIFHLNTCRVYLGYPKLSVNLPQKQWLINKYRAFLHQLYLNVLYLISLKYHR

SEQ ID NO: 10685 - DNA, 417 bp, Unknown
  Obtained from environmental sample
  misc_feature (1)..(417): n is a, c, g, or t
ttgatttcagcatgttctaatgcagaaaaagagcaacaagtaaatgaagaagtaataacagaggtagttgacaatcatccgaacaaagatagtgagttggctttgctaatgcgaaaaatgtataatgatgccgatagtattaaacagcttattgtaaacgatgagggaaatatttctaaagaatatattgatgcgcttgaaagaatacataccgcaacaccaacagatgcagatgtaaaaacacctgaatttaaagcctataccgaattaatggtaaatgaggcaaatgcacttttctctagcgaaactaataaaaaagaaggctttaataatttggtaaacaaatgtgtggaatgtcaccaatctttttgtccaggaccaataaaaaagattaaaaaattagaaattaaagattag

SEQ ID NO: 10686 - protein, 138 aa, Unknown
  Obtained from environmental sample
  misc_feature (1)..(138): Xaa is any amino acid
MISACSNAEKEQQVNEEVITEVVDNHPNKDSELALLMRKMYNDADSIKQLIVNDEGNISKEYIDALERIHTATPTDADVKTPEFKAYTELMVNEANALFSSETNKKEGFNNLVNKCVECHQSFCPGPIKKIKKLEIKD

SEQ ID NO: 10687 - DNA, 489 bp, Unknown
  Obtained from environmental sample
  misc_feature (1)..(489): n is a, c, g, or t
gtgtatggttttgttgttgaagaaattcctgctcaagatattcaacaaataaatgtgagttcaacaaaaattagaacttctttacttgctggggaaattcatgcagccacacaatttttggggtatccttattttattaatggaacagtggtaaagggagataaaattgggagagaaataggatttcctacagccaatataaatcctgatgaaacatataaacttattccaaaaaatggtgtgtatgcagtaaaagttgttgttaatgaaaaagagtacgaaggaatgcttaatattggcaatagaccaacgctgaaaggaacgaatgaaaccatagaagtaaatatttttgattttgatgaaaagatttacgggacaaaaattcaggtaaaattttacgaaaggattcgtgatgaacagccttttgaaaacttaaacgaacttaaagaccaattgaatattgataaaagaaaaaccaacattttttag

SEQ ID NO: 10688 - protein, 162 aa, Unknown
  Obtained from environmental sample
  DOMAIN (39)...(162): Riboflavin kinase / FAD synthetase
  misc_feature (1)..(162): Xaa is any amino acid
MYGFVVEEIPAQDIQQINVSSTKIRTSLLAGEIHAATQFLGYPYFINGTVVKGDKIGREIGFPTANINPDETYKLIPKNGVYAVKVVVNEKEYEGMLNIGNRPTLKGTNETIEVNIFDFDEKIYGTKIQVKFYERIRDEQPFENLNELKDQLNIDKRKTNIF

SEQ ID NO: 10689 - DNA, 630 bp, Unknown
  Obtained from environmental sample
  misc_feature (1)..(630): n is a, c, g, or t
ttgaaatacataaataaaaaaattagtactaaaataatcttttggatgttcattcttatgacactgagtagtttagctgttttatattctactgtaacaaaagtaagtgaagacaatattaccaaaacaaaagccaatttagagatgcttaatagtgcaatgtttcaaagcttaagaaatgcaatgaatacaggagatcccgtacagataaaaaaagcagaagatgaggcacgctcaattaaaggtgttcaaaacttaacaattgcaaaaagcaaagctcttatggagatgtatggagacactagtccttatacaaaagatcaaaaagtactagaaacatttgacacaaagaaagagcacattatcgagattgatgatgacaatgaacacaacttgagaatgataaaaccaatgattgcaacgcctgagtgtattatgtgtcatgtgaaccaaaaagagggagatattgttggtgtaatggatttaacattctctttaaaagatgcagatgatagtttaaaaagtattatcttaaatattatcatggcatcaactattttgggatggatcactattggtattattttttatgttgtaagaaaagctacaaagccctatagatggttttaa

SEQ ID NO: 10690 - protein, 209 aa, Unknown
  Obtained from environmental sample
  misc_feature (1)..(209): Xaa is any amino acid
MKYINKKISTKIIFWMFILMTLSSLAVLYSTVTKVSEDNITKTKANLEMLNSAMFQSLRNAMNTGDPVQIKKAEDEARSIKGVQNLTIAKSKALMEMYGDTSPYTKDQKVLETFDTKKEHIIEIDDDNEHNLRMIKPMIATPECIMCHVNQKEGDIVGVMDLTFSLKDADDSLKSIILNIIMASTILGWITIGIIFYVVRKATKPYRWF

SEQ ID NO: 10691 - DNA, 852 bp, Unknown
  Obtained from environmental sample
  misc_feature (1)..(852): n is a, c, g, or t
ttgataaagagatacttaccaaaactttcggaatgcgaaagcagagaacccgacttttcggttattcattacttggatggagtgaaagataattttcttataaatccaattgttggtgatgctcgaactgatattacaacgcaattattatctgagaaaggttattctgttttgaaatttggtgaaaataatgaagaagaggaacaagtattttatcaacgccattttgagaaaaaattcttttccgaaagaactaacaaagttttatgtaaaacatttcttgagaatgctcttcgcgatccggtaagtggagaaataggaaaatcaattatgttctgcgtcagccagaatcacgcagctaaaattacgcaaatcttaaatgaaatggcagataaaatgttcccaaataaatacaattcagattttgcaattcaagttacttccagaattacagatgcaaaacaatttaccattaatttcaccaataacaatttaaatggttcagccaatattatagattcttacaaaaccggtaaaacgagaatttgcgttactgtgggaatgatgacaacaggttatgattgtccggatcttttaaatttatgtttgatgagaccgattttttcaccaacagattttatccaaatgaaaggaaggggaacaagaaaacataatttcctacaagaactttttgatgaggatataaaagaaattgtaaaagaaccagataaaacaaaatataaactttttgatttctttgcaaattgcgaatacttcgaaaaaacatttaattatgatgaagttctcacattacaagcggaatcatctgataatgcctcagccgaattctga

SEQ ID NO: 10692 - protein, 283 aa, Unknown
  Obtained from environmental sample
  misc_feature (1)..(283): Xaa is any amino acid
MIKRYLPKLSECESREPDFSVIHYLDGVKDNFLINPIVGDARTDITTQLLSEKGYSVLKFGENNEEEEQVFYQRHFEKKFFSERTNKVLCKTFLENALRDPVSGEIGKSIMFCVSQNHAAKITQILNEMADKMFPNKYNSDFAIQVTSRITDAKQFTINFTNNNLNGSANIIDSYKTGKTRICVTVGMMTTGYDCPDLLNLCLMRPIFSPTDFIQMKGRGTRKHNFLQELFDEDIKEIVKEPDKTKYKLFDFFANCEYFEKTFNYDEVLTLQAESSDNASAEF

SEQ ID NO: 10693 - DNA, 546 bp, Unknown
  Obtained from environmental sample
  misc_feature (1)..(546): n is a, c, g, or t
atgcattacgtgtttattaaaccatacaaggtaattaacaagcacgcacaaaaaattagaatccctgagcaaatagaagattccggtctgataaaaaacgaaatcctgctgctgtcttcaaattttacaatcttatttcaatatcaacgtgaaacggataacgatgacaggctgattgcaacgataaatgatcttacgaatgcaatagaattatactttaatatttcgcaaaagtgttatgatcctaaagaagagaaagtgcttaacttctttcataaaatatgcgaacacctctccgaaagtgaggataaacgctgcttctcgcaaaaggaaatccgtgaagcttttagtgtttccaaaactaaaacatcataccttatcaaggaacttcttttcagaggtttgattaccattgatcatggttctagaaataagggcttcctctatgcagtccaaaaacaggatggtatatcaaaaaaacaaataagcttaaaagaacatcttttaaatcaggtacgtggtttttctgttcaagatgacccatga

SEQ ID NO: 10694 - protein, 181 aa, Unknown
  Obtained from environmental sample
  misc_feature (1)..(181): Xaa is any amino acid
MHYVFIKPYKVINKHAQKIRIPEQIEDSGLIKNEILLLSSNFTILFQYQRETDNDDRLIATINDLTNAIELYFNISQKCYDPKEEKVLNFFHKICEHLSESEDKRCFSQKEIREAFSVSKTKTSYLIKELLFRGLITIDHGSRNKGFLYAVQKQDGISKKQISLKEHLLNQVRGFSVQDDP

SEQ ID NO: 10695 - DNA, 369 bp, Unknown
  Obtained from environmental sample
  misc_feature (1)..(369): n is a, c, g, or t
ttgatgtgtttttttcatttggaattttggaaaatgtattacagaatcaactttaccggattgaagcagaaattcattcaacaagctgatagcgaaaagatgattttttatactgctctcagacagaaagccttttgttctctggtttggtcgggtaatgagataggaaaagtaatcggagaatgtatttgttcctacctcactaaaactgaaaatgagattgttttccaaccacaaaatatactcggcaaccgcaaaaagatacttatctatacccttgtaattttcagctatcaggaatacttcgtactgatcaaatatttgcttaaagtagtccgtatttatattggtgtaatgtatcatgtttga

SEQ ID NO: 10696 - protein, 122 aa, Unknown
  Obtained from environmental sample
  misc_feature (1)..(122): Xaa is any amino acid
MMCFFHLEFWKMYYRINFTGLKQKFIQQADSEKMIFYTALRQKAFCSLVWSGNEIGKVIGECICSYLTKTENEIVFQPQNILGNRKKILIYTLVIFSYQEYFVLIKYLLKVVRIYIGVMYHV

SEQ ID NO: 10697 - DNA, 897 bp, Unknown
  Obtained from environmental sample
  misc_feature (1)..(897): n is a, c, g, or t
ttggggcgggtcaccttcccgcaaattgggtttcagttatttccccagatcaaaggacctgctgaggaagttttacatcttttggaatcaaaaattcagcatccaaaaattgagattaaaccagttacccggataattgacattaaattgaatgaacagaagagaattcttgatcaaaacaatcacctctatagtgtagatgccattgttcttgcaagtggttttgacttatttaatgcacatttaaaagaagaatatggacatgggatttataaaaatgtaatcacctccgttgagctggaagaagtttttaaatcagggaaaatcacaaatcccattgaaaaaacacctaaacgtataggttttgtgcattgcgttggttcaagggatgaaaaatgcgggaatcatcactgttcaaaagtatgttgtgtaacggccgtcaaacaagccatggaagttcgaatgatgagtccggagacagaagttttttgtttttatatggatatgcggatgtttggaattaactatgaagaaatgtatcgcgaatcgcaagaaactcatgagattaaatatatccgtggaaaagtatctgaagctgccgaaaatttagatgatactgttcaaataaaagtggaagacactctcaccggacaacctttaaaaatgaatgtcgatttattggttttaatgatcgggatgcttccttccgaagaaaccacggagctaggaaatcggatgaatttaaaatttgagaaaaatggttttatcaaaagaaaagatgctcattacaattcaaatctcacaaataaagagggtgtttttatagcaggaactgctaatggtccaatgaatattacagatacaattagccatgccagagcctcgagccgattctga

SEQ ID NO: 10698 - protein, 298 aa, Unknown
  Obtained from environmental sample
  misc_feature (1)..(298): Xaa is any amino acid
MGRVTFPQIGFQLFPQIKGPAEEVLHLLESKIQHPKIEIKPVTRIIDIKLNEQKRILDQNNHLYSVDAIVLASGFDLFNAHLKEEYGHGIYKNVITSVELEEVFKSGKITNPIEKTPKRIGFVHCVGSRDEKCGNHHCSKVCCVTAVKQAMEVRMMSPETEVFCFYMDMRMFGINYEEMYRESQETHEIKYIRGKVSEAAENLDDTVQIKVEDTLTGQPLKMNVDLLVLMIGMLPSEETTELGNRMNLKFEKNGFIKRKDAHYNSNLTNKEGVFIAGTANGPMNITDTISHARASSRF

SEQ ID NO: 10699 - DNA, 372 bp, Unknown
  Obtained from environmental sample
  misc_feature (1)..(372): n is a, c, g, or t
ttgccatctttttctatagtgggtatggttagtactgcaattacggagtctaaagagcgtgtaaaatctgctctgcttagtaatgacattaagctacctccaaaacgaatcacgataaatttatctccatcagacatatcaaaagttggaagtcattttgaccttagcattgcactgcttattgctttatatagtgatgatatcaatttagataattggtttatttttggtgaattaagacttgatggtagtgtaaaagagaatgatctgctctatcctcttattttatcaataagtaaagagttgagtaataaaaaggttatcataccgccaattctaaaaataagtgcaattttttctaatagagtataa

SEQ ID NO: 10700 - protein, 123 aa, Unknown
  Obtained from environmental sample
  misc_feature (1)..(123): Xaa is any amino acid
MPSFSIVGMVSTAITESKERVKSALLSNDIKLPPKRITINLSPSDISKVGSHFDLSIALLIALYSDDINLDNWFIFGELRLDGSVKENDLLYPLILSISKELSNKKVIIPPILKISAIFSNRV

SEQ ID NO: 10701 - DNA, 453 bp, Unknown
  Obtained from environmental sample
  misc_feature (1)..(453): n is a, c, g, or t
gtgatctgtcagggacagtacgcaatatcatccgttgtaagaaagttcagaaacgataaaaatgcgactcttcttgcaacagacacattttgggaaggaattgacatgaagggtgaaacactacgaaaccttgttctgataaagcttccctttaaattccccagccatccttttgtaaaaagatacgtcgcaaaacttgaagcagagagtggaaaaagtggatttatgctctacacccttcccaacgcaatacttaagttcaagcagggtttcggcagactcataagaacaaagacagacaccggctccatcacaatacttgacaaaagaattattgaaaaaagatatggaaaagatttccttgatgcagctccttccggagttacatttcaaatgctaccttcacaaaaaatagctgaaaaaataaaagaatttcacctaaataactcttaa

SEQ ID NO: 10702 - protein, 150 aa, Unknown
  Obtained from environmental sample
  misc_feature (1)..(150): Xaa is any amino acid
MICQGQYAISSVVRKFRNDKNATLLATDTFWEGIDMKGETLRNLVLIKLPFKFPSHPFVKRYVAKLEAESGKSGFMLYTLPNAILKFKQGFGRLIRTKTDTGSITILDKRIIEKRYGKDFLDAAPSGVTFQMLPSQKIAEKIKEFHLNNS

SEQ ID NO: 10703 - DNA, 486 bp, Unknown
  Obtained from environmental sample
  misc_feature (1)..(486): n is a, c, g, or t
atgataggtgtttatccaagtggtataggctttggaaatataagtaaaagaatctgtgaaaaagctttcgtaataaccggtacacaaacgggtgatttagaacaattatcaaatgaacattatagtttagttgaagagtttgatgatagtaaattttatttaaaatcaaaaggtgcaataaaggcgagtagtgaagctttaacgcgtggtacaatatataatttaagtgatgatattagtgctgttattcatatacatagtttaaatttatggaaatttatgattgcaaataagtatttagtaaccaacgatgtaccatatggatcacgagagatgatagatgatattaaaaaattatatacaaaaaatagtttattaaattcaaagtttgcaatgttaggacatgaagaggggattataatatttggaaaaaatataaaagaagctgaagggaatcttttagaattagtgtggagagtttattaa

SEQ ID NO: 10704 - protein, 161 aa, Unknown
  Obtained from environmental sample
  misc_feature (1)..(161): Xaa is any amino acid
MIGVYPSGIGFGNISKRICEKAFVITGTQTGDLEQLSNEHYSLVEEFDDSKFYLKSKGAIKASSEALTRGTIYNLSDDISAVIHIHSLNLWKFMIANKYLVTNDVPYGSREMIDDIKKLYTKNSLLNSKFAMLGHEEGIIIFGKNIKEAEGNLLELVWRVY

SEQ ID NO: 10705 - DNA, 519 bp, Unknown
  Obtained from environmental sample
  misc_feature (1)..(519): n is a, c, g, or t
atgaagaaaaaatctacaaataaaattttatgcttctctaataaaattaataccaaatatatattattaataatatttggttttattcaattaagtgttttcggacaaaacaatactattacaggagaagttgttgataatgaaggtaatactttgccaggagctacaattatggcaaagggaactaacattggaactatttgcgactttgaaggaaaatattcaattgagataaatgaaaaagttgaaatattgatctttagtttcgttggtttcaataaaaaagaagaaattattggaacacgaaaagtaattgatgttattcttaaacctcaggatattcttgatgaaattattgttgttggttatggtattcaaagaaaaagtgatgtaaccggagcaatagtttccgttaattcagatgacattgaacttagtcattctcaatcaattggatcaataatgcaggggcgaacatcaggtgttgaagtaataagcaacagcgggtcccccgggtag

SEQ ID NO: 10706 - protein, 172 aa, Unknown
  Obtained from environmental sample
  misc_feature (1)..(172): Xaa is any amino acid
MKKKSTNKILCFSNKINTKYILLIIFGFIQLSVFGQNNTITGEVVDNEGNTLPGATIMAKGTNIGTICDFEGKYSIEINEKVEILIFSFVGFNKKEEIIGTRKVIDVILKPQDILDEIIVVGYGIQRKSDVTGAIVSVNSDDIELSHSQSIGSIMQGRTSGVEVISNSGSPG

SEQ ID NO: 10707 - DNA, 318 bp, Unknown
  Obtained from environmental sample
  misc_feature (1)..(318): n is a, c, g, or t
atgtgtataaaaacgagaggcattaaaaatatcttttccgtaaactccataaagcgaaatcatgaaatcaaaacctttgtattcgccgctaatattaagtccggctgtaaaatcaggaaacggacttcccagaatttccatatcgaggttgccatctttgtcggcatcaatatatcttatatctccgggttgcgcatttggttgtatcagcactccatcattatcaacatgagcatcaatttcagtctgattttgaaaaagaccatcggttacataaccataaaaagaagctgcaggctgtcctatcatagtatgtga

SEQ ID NO: 10708 - protein, 105 aa, Unknown
  Obtained from environmental sample
  misc_feature (1)..(105): Xaa is any amino acid
MCIKTRGIKNIFSVNSIKRNHEIKTFVFAANIKSGCKIRKRTSQNFHIEVAIFVGINISYISGLRIWLYQHSIIINMSINFSLILKKTIGYITIKRSCRLSYHSM

SEQ ID NO: 10709 - DNA, 459 bp, Unknown
  Obtained from environmental sample
  misc_feature (1)..(459): n is a, c, g, or t
atggcaatttcagtagtagttatatcaatctcatcaccaattcgtataggtatttataaagaagatattctaatagatacaatacaaaatgaggggaaaacaagtgatgtactcccttggatatttgatttgttattagcaaaatatgatattgaaaatatatattatgtaaatggtccaggtagttatatggcaattaaaatatcgtatatctttttaaaaacattatcaataacaaaaaatataccactaaaagctgcaagtggatttttgtttaatgaaaatagcccaattaaagcattgggaaaaaaatatttttttaatggacaagatgataaaataactatagattttatagaagatttagaagagttgaaaaattttaaactcccaaatgatatatctaacatatcgtttagtgaagatactttacctaattatcatctaccagttgtgtaa

SEQ ID NO: 10710 - protein, 152 aa, Unknown
  Obtained from environmental sample
  DOMAIN (23)...(98): Glycoprotease family
  misc_feature (1)..(152): Xaa is any amino acid
MAISVVVISISSPIRIGIYKEDILIDTIQNEGKTSDVLPWIFDLLLAKYDIENIYYVNGPGSYMAIKISYIFLKTLSITKNIPLKAASGFLFNENSPIKALGKKYFFNGQDDKITIDFIEDLEELKNFKLPNDISNISFSEDTLPNYHLPVV

SEQ ID NO: 10711 - DNA, 591 bp, Unknown
  Obtained from environmental sample
  misc_feature (1)..(591): n is a, c, g, or t
atgatgaaaggaatttcgcccggtgccgccttggtatttctgatggctggtccggcaactaatgcagcaaccattactgtactaaataaagttctgggtaaaaaaacaatgtggtcctacttaatctcaattattttgggagcattgcttttcggactattaattgataatgtttttccaagggaatggtttactattgggcctttacatgatcacatgggagcacatgaaggacactggatgcttcctaaatggctgcagtgggctagcagtatctcattagttttattaataattaatggctatttacaaaagtatatttctggaaaaagtgaacttaaagctgtccaaaccgagacaattattaatgaaaaattacttatcgtaaatggaatgagttgtaatcattgtaaaaatagtgtggaaaaacacattggcactttaaaaaacattacgactgccgaagtaaatctagagcaaaaacgtttacgaatagaaggcgaaaacatcaaactggaaaccattaaaaaagaaatagaaagccttggtttcgaatattggtggagaagtaaaaaaggattaaaaaattag

SEQ ID NO: 10712 - protein, 196 aa, Unknown
  Obtained from environmental sample
  SIGNAL (1)...(16)
  DOMAIN (126)...(188): Heavy-metal-associated domain
  misc_feature (1)..(196): Xaa is any amino acid
MMKGISPGAALVFLMAGPATNAATITVLNKVLGKKTMWSYLISIILGALLFGLLIDNVFPREWFTIGPLHDHMGAHEGHWMLPKWLQWASSISLVLLIINGYLQKYISGKSELKAVQTETIINEKLLIVNGMSCNHCKNSVEKHIGTLKNITTAEVNLEQKRLRIEGENIKLETIKKEIESLGFEYWWRSKKGLKN

SEQ ID NO: 10713 - DNA, 573 bp, Unknown
  Obtained from environmental sample
  misc_feature (1)..(573): n is a, c, g, or t
atgtataaaaatgtttttgataaagaattagccagtggtataacttataatggatatatgttttatggtcaatgtgactatttagtagaacaatattcaaataatatagcactacaactagcaaatggtgaggatatccaaaaaatatattttgatgaatatgattttaaagagtgtagtaattttttatctcaatcatctttatttagtgcaaataatatcttgcttataaagagtgttaaaactatccctaaaaaagaggtggatgctcttcttgatatttgttcaacaaatagtgatagcaaagtgattttttgctgtatcggggaaacagattttaaaaatatggcaaaaagctttactaaaaaaacaaaaagtgtagaggtgaggttttttaccccaacggataaagaggcaatacacatattaaatgaagaggtaaaaaagagaaatcttcaatgtggctttggagagttacaatatctttacaatatgcaccaaaaagatttaagtcttagtgctaatgatcttaataaactagcaattttagaccaaccaataagtgtcaaataa

SEQ ID NO: 10714 - protein, 190 aa, Unknown
  Obtained from environmental sample
  misc_feature (1)..(190): Xaa is any amino acid
MYKNVFDKELASGITYNGYMFYGQCDYLVEQYSNNIALQLANGEDIQKIYFDEYDFKECSNFLSQSSLFSANNILLIKSVKTIPKKEVDALLDICSTNSDSKVIFCCIGETDFKNMAKSFTKKTKSVEVRFFTPTDKEAIHILNEEVKKRNLQCGFGELQYLYNMHQKDLSLSANDLNKLAILDQPISVK

SEQ ID NO: 10715 - DNA, 594 bp, Unknown
  Obtained from environmental sample
  misc_feature (1)..(594): n is a, c, g, or t
gtggaggattatggttttaaaaaaacaacggttatacaaagaaatcacgataaggtttgtactgacaaggctaaagtaaatggtggagatcctgatgtagtttggggtggagattatgcaaaaagtagtgttccaggcaaatgtaaaaaaactttcataacaactattggtaaaatctctccaataaaaatagctgatggtattgaaacatacggtgagttagaagtaattgagttcatgaagaaaaagcaaactgataaaagtttagtattagttgatgcaagaatgaaaccttggtatgcaaaaggtacaattcctggggcagtaaatcttccttttaaatcatttgatccaacacattatgattttgagatagttatggatacagctggggtagtatatgaagagggtgaatatgactttaaaaatgcaaaaacacttcttttgttttgtaatggagtatggtgtccacaatcaacttgggcgatagaaaatcttcttaaaattgggtatccaaaagaaaaactactttggtatagaggtggaatgtatagctggaaaatgttaaatcttacaacaatagttccacaataa

SEQ ID NO: 10716 - protein, 197 aa, Unknown
  Obtained from environmental sample
  misc_feature (1)..(197): Xaa is any amino acid
MEDYGFKKTTVIQRNHDKVCTDKAKVNGGDPDVVWGGDYAKSSVPGKCKKTFITTIGKISPIKIADGIETYGELEVIEFMKKKQTDKSLVLVDARMKPWYAKGTIPGAVNLPFKSFDPTHYDFEIVMDTAGVVYEEGEYDFKNAKTLLLFCNGVWCPQSTWAIENLLKIGYPKEKLLWYRGGMYSWKMLNLTTIVPQ

SEQ ID NO: 10717 - DNA, 786 bp, Unknown
  Obtained from environmental sample
  misc_feature (1)..(786): n is a, c, g, or t
atgaagaaaggtattggtctattttttttagtcgcttgttgtatttgcttcactctgtatccgatttatgcgaacagtaatgatttgcctgaattttttggtaattatttaaaaagcaaagatggaactatcacagaaatacctcaaagtgatgtaggtattacaggatggtttgtgaaaaaaaaagctcctaaatcaaatgatatgaatgcgatgtcacaatacatatcatctggtggtgatgctagttcggcgtttaacgcccatttaaacaaaaaaatatttgttagtagtttgtctgggcttcaaatgagtagcaatgaacttaatggttttattgtttacggtgaaaatgacgttaatgatatcaaaatagtgaaattatcgaataaacttataccaagcaatgcgacatttgcttcatatgagggaccaaaaccaattaatagaaaaaacatgtggttgccatatcagtcatatgagtttcaaatgaagcctttgaaagataacatgtattatttaaaaaccagagagaaactttcttgtggtcgttatgcaataaaaaatggaaatcaattttccgaatttcaaattatgtctagcgtgggacaattaaacaaacaagatttaataggtgattggatatccaaaacatatgcaaatagaaaagatggtactgtaaaaaaaatactttttttagtcactgaaatgaaaatcaatgatgttgatgcaaacgggtacatggggggatcatatgttggtgaaaggggctactggaaaatctaa

SEQ ID NO: 10718 - protein, 261 aa, Unknown
  Obtained from environmental sample
  misc_feature (1)..(261): Xaa is any amino acid
MKKGIGLFFLVACCICFTLYPIYANSNDLPEFFGNYLKSKDGTITEIPQSDVGITGWFVKKKAPKSNDMNAMSQYISSGGDASSAFNAHLNKKIFVSSLSGLQMSSNELNGFIVYGENDVNDIKIVKLSNKLIPSNATFASYEGPKPINRKNMWLPYQSYEFQMKPLKDNMYYLKTREKLSCGRYAIKNGNQFSEFQIMSSVGQLNKQDLIGDWISKTYANRKDGTVKKILFLVTEMKINDVDANGYMGGSYVGERGYWKI

SEQ ID NO: 10719 - DNA, 708 bp, Unknown
  Obtained from environmental sample
  misc_feature (1)..(708): n is a, c, g, or t
atggatatcaaaattagtgaaattattggaataaacttatcccaggcaatgcgacattgctttcatatgagggaccaaaaaccaattaatagaaaaaacatgtggttgccatatcagtcatatgagtttcaaatgaagcctttgaaagataacatgtattatttaaaaaccagagagaaactttcttgtggtcgttatgcaataaaaaatggaaatcaattttccgaatttcaaattatgtctagcgtgggacaattaaacaaacaagatttaataggtgattggatatccaaaacatatgcaaatagaaaagatggtactgtaaaaaaaataccttttttagtcactgaaatgaaaatcaatgatgttgatgcaaacggttacattgtgggatcatatgttgtgaaaggggctactggaaaatctaagggtaaggtgcgtgaaaaaggtaattacatacaaggaaaaggtggttggcaatttgatttagaaaaaaagacactcacttcagtggatgaagataaaggggaccctaatgcgatatatggtatttcaaaaggtaaaattgttatgctcggcgatgattgtgaatacgagaagatcatcataaggggcgcatggacaccttataataaattccacagtactcaactatgtaaagaatatgatatattttgggaaatagcgaaaaaaggtgaactgctttaa

SEQ ID NO: 10720 - protein, 235 aa, Unknown
  Obtained from environmental sample
  misc_feature (1)..(235): Xaa is any amino acid
MDIKISEIIGINLSQAMRHCFHMRDQKPINRKNMWLPYQSYEFQMKPLKDNMYYLKTREKLSCGRYAIKNGNQFSEFQIMSSVGQLNKQDLIGDWISKTYANRKDGTVKKIPFLVTEMKINDVDANGYIVGSYVVKGATGKSKGKVREKGNYIQGKGGWQFDLEKKTLTSVDEDKGDPNAIYGISKGKIVMLGDDCEYEKIIIRGAWTPYNKFHSTQLCKEYDIFWEIAKKGELL

SEQ ID NO: 10721 - DNA, 585 bp, Unknown
  Obtained from environmental sample
  misc_feature (1)..(585): n is a, c, g, or t
ttgagtaaattgatacaaaaatatccagatatcaattatatatttacaggtcttaaaaggcatctccttacagaactattttctaaaagaaaatcacctctatatgatacagttagtttattggaattaaagccaattccaatagagttattttataaatttgtcaatgaaaagttcaacggaagacttgattttgtacattttgagtatatatataatatgacagatggggaatctaagcttatacaagaattttgttattatctttatcatgatgaatcaaataataaaaatcacaagattactcaagaagatatagacaaagtatgtcaggttcatcttgagagtaaaagtggttattttagaatgcttttggatcgtttgagtttacctcaaaaagtagctttaaaagctgtaattatttgtgatgccaccgacctatatacaaaagagaccctttttaaacttcaaacaactaaatcatcgcttcatactgcaataagaaatttatacaaagatgagataattgataaagagaataataagtattatattacaaacagatgttttgaaactttggtgtag

SEQ ID NO: 10722 - protein, 194 aa, Unknown
  Obtained from environmental sample
  misc_feature (1)..(194): Xaa is any amino acid
MSKLIQKYPDINYIFTGLKRHLLTELFSKRKSPLYDTVSLLELKPIPIELFYKFVNEKFNGRLDFVHFEYIYNMTDGESKLIQEFCYYLYHDESNNKNHKITQEDIDKVCQVHLESKSGYFRMLLDRLSLPQKVALKAVIICDATDLYTKETLFKLQTTKSSLHTAIRNLYKDEIIDKENNKYYITNRCFETLV

SEQ ID NO: 10723 - DNA, 504 bp, Unknown
  Obtained from environmental sample
  misc_feature (1)..(504): n is a, c, g, or t
atgaatctttatattgattttggtggtactcattttagatatcaactcaatgactctaaaatcaaaacactcaatagtgataatatagatttaaaaaaatttcttgatgagatgatacaaaaacattcagatatatcatatattggtatatcttttgcaggaattgtacaaaatgggaaaatcatctcttctccaaacacaaatacacaaaactttgctgtgaaaaaatatataaaagaaacatataatatccccttagctattgacaatgatttaaattgtgcagctttggctgaacataatgctttacaagtaagttctctagcagttttttatataggaacaggttgtggcagtgcctttattgataataatagattaatcaaaggtgcaaataataaaagcggagagatgcgacatatcccttttaaaaaatccccttttaaatggggctggggtaaaaagcactgtttagaactctatgtggagtggaaacgctattga

SEQ ID NO: 10724 - protein, 167 aa, Unknown
  Obtained from environmental sample
  DOMAIN (5)...(162): ROK family
  misc_feature (1)..(167): Xaa is any amino acid
MNLYIDFGGTHFRYQLNDSKIKTLNSDNIDLKKFLDEMIQKHSDISYIGISFAGIVQNGKIISSPNTNTQNFAVKKYIKETYNIPLAIDNDLNCAALAEHNALQVSSLAVFYIGTGCGSAFIDNNRLIKGANNKSGEMRHIPFKKSPFKWGWGKKHCLELYVEWKRY

SEQ ID NO: 10725 - DNA, 300 bp, Unknown
  Obtained from environmental sample
  misc_feature (1)..(300): n is a, c, g, or t
atgattgatggtaccaagacaagtttagaatacgataaaaatcttattatgaaaaacagtgaccaatatgaggctgtattttatggacttggaagtgatgggacagtaggtgcaaataaaaactctataaaaattatagggatggaaacagagaattatgcacaaggatattttgtctatgattcaaaaaaatctggttctatgacaacttcccatttacgatttggggcaaaacctattaaatcaagttatctgattcaaaaagcagatttcgtaggtgtacatcaagcggtcttttag

SEQ ID NO: 10726 - protein, 99 aa, Unknown
  Obtained from environmental sample
  misc_feature (1)..(99): Xaa is any amino acid
MIDGTKTSLEYDKNLIMKNSDQYEAVFYGLGSDGTVGANKNSIKIIGMETENYAQGYFVYDSKKSGSMTTSHLRFGAKPIKSSYLIQKADFVGVHQAVF

SEQ ID NO: 10727 - DNA, 741 bp, Unknown
  Obtained from environmental sample
  misc_feature (1)..(741): n is a, c, g, or t
ttgtcttttaaaaacaactgtttagaattgccaatggtaaatatatgggcagaaaaaattgcaaataatttaacaggttattttaaggattataagtttccagaaagaaaatttgaatttttaagcaccatagatatagacaacgcttttgcaattaaacacaaaggcttttggagaactgttggtggtttagcaaaatctttagctaagcctcaaaccttaaaacacagagtagatgtgttgtgggacaaaacttcagatccatatgatacttatgattatcaggatgaaatacaccataaatacaatgttcgtccgacttatttttttttaataggaaattatgcttcatttgataaaaatatagcttttgataatgaaagttttcagcatttaattaaaaaaataactataacaaatactgttggtttacacccttcatacaaatctaatagtaatattgaattactaaaagaagaaaaattacgattggaaaacattgtggaacagaaaataacaaaaagccgaccacactttttaaagttaagctttccactcacgtacagaaatttaattgccttgggaattaatgaggattataccgtgggatatgcagaaaataggggttttagagcaagtatttgctccccattttattttttttggggcgaaaaaaaaaataaagccacgggctttaaaaaaaaaattccttttttggggcgaaggaaccccggtttataa

SEQ ID NO: 10728 - protein, 246 aa, Unknown
  Obtained from environmental sample
  misc_feature (1)..(246): Xaa is any amino acid
MSFKNNCLELPMVNIWAEKIANNLTGYFKDYKFPERKFEFLSTIDIDNAFAIKHKGFWRTVGGLAKSLAKPQTLKHRVDVLWDKTSDPYDTYDYQDEIHHKYNVRPTYFFLIGNYASFDKNIAFDNESFQHLIKKITITNTVGLHPSYKSNSNIELLKEEKLRLENIVEQKITKSRPHFLKLSFPLTYRNLIALGINEDYTVGYAENRGFRASICSPFYFFWGEKKNKATGFKKKIPFLGRRNPGL

SEQ ID NO: 10729 - DNA, 711 bp, Unknown
  Obtained from environmental sample
  misc_feature (1)..(711): n is a, c, g, or t
atgaaaataaaatttacagtaagttatgatggctcattgtattatggttctcaaatacaacctaatcatgtaacaatccaatctaaagttgaagaggtatttaaattacttaatatagatacttcgttagaatttagtggaagaacagatagaggtgtacacgcatttagacaagttatatcatgtgttttacctgatttttggagtgatttagtaaagtttaaaatggcacttaataagatgttaccaaattctatatatgttagaaatgtatcttatgtaaatgatgattttcatgcaagatttagcgcaaaaaaaagagaatacagatatattgttacaacaaaagaacttaccccatttaatcaaaattatgtagagtattatgaaagtatcaatgtagaaaagataagagatgctctgaaaattttaaaaggtgtacatgattttgaatactttagtaaaactggcagtgaaccagcttcaacagtgcgagagatttacgatataaagttttataaatataaagagttatatattttcagatttaaagctaattcttatttaagaaagcaaatacgaatgatggttgattttattatgaaaatatcaagtggtaagttaactattgaagatttaaaaaaacagcttaataaagagaagttgatatcttggactctagctagcccaaatgggcttgtattaaagtaa

SEQ ID NO: 10730 - protein, 236 aa, Unknown
  Obtained from environmental sample
  DOMAIN (140)...(236): tRNA pseudouridine synthase
  misc_feature (1)..(236): Xaa is any amino acid
MKIKFTVSYDGSLYYGSQIQPNHVTIQSKVEEVFKLLNIDTSLEFSGRTDRGVHAFRQVISCVLPDFWSDLVKFKMALNKMLPNSIYVRNVSYVNDDFHARFSAKKREYRYIVTTKELTPFNQNYVEYYESINVEKIRDALKILKGVHDFEYFSKTGSEPASTVREIYDIKFYKYKELYIFRFKANSYLRKQIRMMVDFIMKISSGKLTIEDLKKQLNKEKLISWTLASPNGLVLK

SEQ ID NO: 10731 - DNA, 846 bp, Unknown
  Obtained from environmental sample
  misc_feature (1)..(846): n is a, c, g, or t
atgttgaaattattgatgataacaatactattaagcactagtggagttgcaaatagtaatttagagaaaaaacttataaaatttgaaaagcaaagagttgctaagtcattacaaagagttggagggaaccttcaaaatgttgatttagtattaaaaaaagatctaaatcaagatggttgggtagggtatacttttaatttagaatttgaggtacaaaacaaaaagctttctcaaaaagatacactttttagtgatggtaaaaatgttactatggacttaataaacttagaaaataaaagatcatttaaaactgttatgtatccaacattaggaaaagaatttttcagtaaaaaacattttatagagggaaatattgatgcaaaacattcacttgtaatatttagtgatcctttatgtccaatctgtgtagatgagatcccctatgtattaaaaaatatcattgataatccacaaaatatagctgtatactattatcatcttccactcgatatgcatccaacagcaaaagtactctcaaaagcctctatactagctaaagagcaagggattaaaaatgtagactatagaatctataaagctaatttttcagaaaaatataaatttgatgcatatgaagagaaagatgaaaaaaaagtattaggattttttaataaagagtttggtacaaatataacaatggaacagataaataatcctaaactagaaaaaatgatacaagatgatattaaaatgtctgaagatgcatttgtatcaggaactccaactctgttttttgatggagagtacgattacacaagatcacaatttgaaaaatatttaaaatag

SEQ ID NO: 10732 - protein, 281 aa, Unknown
  Obtained from environmental sample
  SIGNAL (1)...(19)
  DOMAIN (130)...(281): DSBA-like thioredoxin domain
  misc_feature (1)..(281): Xaa is any amino acid
MLKLLMITILLSTSGVANSNLEKKLIKFEKQRVAKSLQRVGGNLQNVDLVLKKDLNQDGWVGYTFNLEFEVQNKKLSQKDTLFSDGKNVTMDLINLENKRSFKTVMYPTLGKEFFSKKHFIEGNIDAKHSLVIFSDPLCPICVDEIPYVLKNIIDNPQNIAVYYYHLPLDMHPTAKVLSKASILAKEQGIKNVDYRIYKANFSEKYKFDAYEEKDEKKVLGFFNKEFGTNITMEQINNPKLEKMIQDDIKMSEDAFVSGTPTLFFDGEYDYTRSQFEKYLK

SEQ ID NO: 10733 - DNA, 681 bp, Unknown
  Obtained from environmental sample
  misc_feature (1)..(681): n is a, c, g, or t
ttgaatcacatttgcatttatgaaaaaaatttaagtagcaaaccaattaaagcttacgatatagacttaaaacaatttagaaaatataaagatggtgaaaatttttcacttgatttatttgataagatttatattaaagagtatgtaaaatatttatttgagcgggaattaaaagcaaaaagtattaaacgtaaagttggaactttaaaaacattttttaattttttagaatttgaagagtttattgagtttagtccatttaagaagatgcaactatcaataaaattacccaagagacttccaaaaactattgataaaaaagatttacgacgtttttttaaatttatatatgcatataaaaaaaatattgaagataaaaattcatatacttattatgcagcagtaagagatattgcagtagcagaattactatttgcaacaggaatgagagtttcagaactttgtcatttaaaaccaactgatattaatatacaaagagggattgtcaatatttttggaaaaggatcaaaagaaagagctattcagatttgcgacccagaagtaaaacaatctcttgtagaatattataaactatttacgaaaaaaatttacgaaaaaaacttcttctttatcaatagacttaataacatgctttctgaagattcagtaaggcatatgtaa

SEQ ID NO: 10734 - protein, 226 aa, Unknown
  Obtained from environmental sample
  misc_feature (1)..(226): Xaa is any amino acid
MNHICIYEKNLSSKPIKAYDIDLKQFRKYKDGENFSLDLFDKIYIKEYVKYLFERELKAKSIKRKVGTLKTFFNFLEFEEFIEFSPFKKMQLSIKLPKRLPKTIDKKDLRRFFKFIYAYKKNIEDKNSYTYYAAVRDIAVAELLFATGMRVSELCHLKPTDINIQRGIVNIFGKGSKERAIQICDPEVKQSLVEYYKLFTKKIYEKNFFFINRLNNMLSEDSVRHM

SEQ ID NO: 10735 - DNA, 309 bp, Unknown
  Obtained from environmental sample
  misc_feature (1)..(309): n is a, c, g, or t
ttgtgcccacaatttaaagagttgaatgattacataaaagagcagataatcatcgaagcaaaatattacagatatgttgaaaaacaacaaaaacaaatagagaaaatgaaaaaaatgcttcaattaaaaataccagataattttgactatagagtaatccctggtttatcaaacgaagctgtggaaaagctagaaaagtttaaaccacctacacttttcaacgcaggagaaatttcaggtataacaccagcagccgttgatgttatacatttatacataaatttacatgtcagaagcaagaaaaaatga

SEQ ID NO: 10736 - protein, 102 aa, Unknown
  Obtained from environmental sample
  misc_feature (1)..(102): Xaa is any amino acid
MCPQFKELNDYIKEQIIIEAKYYRYVEKQQKQIEKMKKMLQLKIPDNFDYRVIPGLSNEAVEKLEKFKPPTLFNAGEISGITPAAVDVIHLYINLHVRSKKK

SEQ ID NO: 10737 - DNA, 423 bp, Unknown
  Obtained from environmental sample
  misc_feature (1)..(423): n is a, c, g, or t
atgtcacgaggtaaaagtatcattccagaatttatggctaaaaatcctgaggatacatttaaactacttttacctttaaaattaaaacttgatgaagataaacctgggaatagtcattttgaagttgtaataaaaaacatgactaaaaatgaagtgttttcatatgaattatctccagaactgctttttactcatttccctattgaaaaatctttttcaaatggtaagaaaaatgactattataaaaataagaatatttctgaaaaaagttttctaattgatacttcaattttaaatgaagaccatatcaaaaaactacataatatagtagatgaaacaagtatagtttctatcattgggtggaaacgaacttttttaaatgaggccaaatatattaactgttatcccaaaagaacaagataa

SEQ ID NO: 10738 - protein, 140 aa, Unknown
  Obtained from environmental sample
  misc_feature (1)..(140): Xaa is any amino acid
MSRGKSIIPEFMAKNPEDTFKLLLPLKLKLDEDKPGNSHFEVVIKNMTKNEVFSYELSPELLFTHFPIEKSFSNGKKNDYYKNKNISEKSFLIDTSILNEDHIKKLHNIVDETSIVSIIGWKRTFLNEAKYINCYPKRTR

SEQ ID NO: 10739 - DNA, 831 bp, Unknown
  Obtained from environmental sample
  misc_feature (1)..(831): n is a, c, g, or t
atggtattatgtcagtacctttcattatattgtgctgtcatgataccgaagatttttaaccgttctaagtctgttgtttctaaacctgcgcgctccaaagtactcccagaacttagcaaaaaacatttgggagacaaggtgcctaagcgtggcaataagtttgcgcctgttattgcatccgcgctgttaaaggcgtcaggttggcgtacggtaggcgagattccaaatatctcacaagctgtagtgcttgcgctgccacatacttctaatgtggatggtatttatgcgattccaagtttgtttgcattagatgttaaaatcagcattatgggcaagcacacgctatttaaagtgcctgtgtttgcacagttattaaattggataggggtcattcctatcgatcgtggtaataaaggctctgtactgcaagccagtattgataagttcaaaactggtgaaccattatttctggggttatcgccagaggggacacggcaatatactgagtcgtggaagacaggtttttattatttagcgatgggtgctggtgtaccgattttgccagtagcgatggactacaatactaaagaaataccgtttatgtcgctggtttatcctacaggtgatatcgaagcagattgccaaaaatatattctcagtataaaaggggtgtgccaagacaccttgagcngttgtcacagccactacaagacatcaataatgcaactgaataagcctaggtntataaatattaggtccaatagttccattaagttagttagcagaactgactgtaatacggttacgcaggctaacagtacctacaactaa

SEQ ID NO: 10740 - protein, 276 aa, Unknown
  Obtained from environmental sample
  DOMAIN (67)...(192): Acyltransferase
  misc_feature (1)..(276): Xaa is any amino acid
MVLCQYLSLYCAVMIPKIFNRSKSVVSKPARSKVLPELSKKHLGDKVPKRGNKFAPVIASALLKASGWRTVGEIPNISQAVVLALPHTSNVDGIYAIPSLFALDVKISIMGKHTLFKVPVFAQLLNWIGVIPIDRGNKGSVLQASIDKFKTGEPLFLGLSPEGTRQYTESWKTGFYYLAMGAGVPILPVAMDYNTKEIPFMSLVYPTGDIEADCQKYILSIKGVCQDTLSXCHSHYKTSIMQLNKPRXINIRSNSSIKLVSRTDCNTVTQANSTYN

SEQ ID NO: 10741 - DNA, 393 bp, Unknown
  Obtained from environmental sample
  misc_feature (1)..(393): n is a, c, g, or t
atgccaaaatatttcatatatggcggttatgtatttgctccactaacaagaaatttattgatgggtacagactcaacacttttacaactaagaacatcatcaggtaaatgggcaaaacaagataaaaaagaagttgttatacttctaaaagttttagcatcaaaaataaacagaggagatcataatttttcactatggagagtagataaggtgaactccaaagagtacaaagattttaaagaatttgtgcagattgtagaagagttcagtggtgaatatttgattttagagaatgaagacggcataaaaatagccatagatcgagaaaaagcaatagatatagaaaatgagattataaaaagatacagtatcaaaagtatcaagagactataa

SEQ ID NO: 10742 - protein, 130 aa, Unknown
  Obtained from environmental sample
  misc_feature (1)..(130): Xaa is any amino acid
MPKYFIYGGYVFAPLTRNLLMGTDSTLLQLRTSSGKWAKQDKKEVVILLKVLASKINRGDHNFSLWRVDKVNSKEYKDFKEFVQIVEEFSGEYLILENEDGIKIAIDREKAIDIENEIIKRYSIKSIKRL

SEQ ID NO: 10743 - DNA, 960 bp, Unknown
  Obtained from environmental sample
  misc_feature (1)..(960): n is a, c, g, or t
ttggcttggtcggtcggacgatcaagatcagaagaactgatagcacaccagcaaaaagaagatacaccagaggcattggcaacaattccactattggaacttgatgacatcggcaaaaaagcagaattctttggaatcaaagaacacgatgttcacggaacaacagttcttcaacatgaaacttttacaaacgatattctatatagcaaattgatgtttgatgttcaggttgttaaacaggaacaattaccttatgttgctttattggcagaaattcttggtgcacttaatactgaaaattattcttttggtgaacttgacaatgaattgaacaaaaacctcggaagtttcaacacttatttatcaacctatttagctgataacaatgatgataaacttcaggcaaaatttattgtgaattctaaggtaatgaatattaaagcgaataaactatttaaccttacagaagaaatattgatgaaatctaaaattgatgacaaagaacgtctcaaagcacttcttactcgtcatcaatcaagaatgcatcgctatgtaatgggacagggcgtcagagttgcgatgacccgattgagttcatattattcaaatgaaggaatggttgatgaacttacaggcggttattcatattatgaatttgtaacggatttgaatgataattttgatgcaaaatatgatgaaattgtaaaaaatctgcagggaggtgctgctgttatttttaataaaaaaaatatggtagcaaatataacctggactaaaaatgacttaacactttacaattctgaactccataatttcattcacaaaattgcagaaacccccccaggaattccagagaagggaattttgattttgcctcctaaaaatggaagggttggaaaaccttccatccccggcttccgtaatgtaaacaaaagggttccaaccttcacaaaaacatag

SEQ ID NO: 10744 - protein, 319 aa, Unknown
  Obtained from environmental sample
  misc_feature (1)..(319): Xaa is any amino acid
MAWSVGRSRSEELIAHQQKEDTPEALATIPLLELDDIGKKAEFFGIKEHDVHGTTVLQHETFTNDILYSKLMFDVQVVKQEQLPYVALLAEILGALNTENYSFGELDNELNKNLGSFNTYLSTYLADNNDDKLQAKFIVNSKVMNIKANKLFNLTEEILMKSKIDDKERLKALLTRHQSRMHRYVMGQGVRVAMTRLSSYYSNEGMVDELTGGYSYYEFVTDLNDNFDAKYDEIVKNLQGGAAVIFNKKNMVANITWTKNDLTLYNSELHNFIHKIAETPPGIPEKGILILPPKNGRVGKPSIPGFRNVNKRVPTFTKT

SEQ ID NO: 10745 - DNA, 765 bp, Unknown
  Obtained from environmental sample
  misc_feature (1)..(765): n is a, c, g, or t
atgagtatcggtactgcacgaccaactgacgaagaattagctcaagtcaaacatcattttattgccaataaatctattttcgactactacaacgcaagcaaatacgaatttgaagtaattgatttaattgatgaattattcaaaaaatacgataatcttgtaattgttggtggttcaggtttgtatattgaagcacttttgaacggaattgatgatttaccagatattgagccagaaattcgtcaaaatttacttgaaaaatatgaaaacgaaggaatcgaaagtttgagattttatttaaaaaaaatagacttagaatcctacaaaaaaatagatcttcgcaatcctcaaagaatcctcaaagcacttgaaattacaattcaaacaggtcaaacttattcttcttttcttactggaaatattaaaaaacgttcgtttgagtcaaatctcatagctctaaatatggatagggaaattctttataacagaatcaacaaacgagtagatttaatgattgaagaaggtttgcttgaagaagcaaaaaaactacaccctcacaaaaacctaacacctttaaaaacatttggttacagagagttatttgattattttgacaaagaaatagataaagaacgagcaattgaactcattaaacgaaattctcgtcgttatgcaaaacgccaaataacttggtttaaacgttatcaagatgcaaaatggattaatattacagacggatttgacgttcgtncaattattcattaa

SEQ ID NO: 10746 - protein, 254 aa, Unknown
  Obtained from environmental sample
  DOMAIN (1)...(244): IPP transferase
  misc_feature (1)..(254): Xaa is any amino acid
MSIGTARPTDEELAQVKHHFIANKSIFDYYNASKYEFEVIDLIDELFKKYDNLVIVGGSGLYIEALLNGIDDLPDIEPEIRQNLLEKYENEGIESLRFYLKKIDLESYKKIDLRNPQRILKALEITIQTGQTYSSFLTGNIKKRSFESNLIALNMDREILYNRINKRVDLMIEEGLLEEAKKLHPHKNLTPLKTFGYRELFDYFDKEIDKERAIELIKRNSRRYAKRQITWFKRYQDAKWINITDGFDVRXIIH

SEQ ID NO: 10747 - DNA, 597 bp, Unknown
  Obtained from environmental sample
  misc_feature (1)..(597): n is a, c, g, or t
gtgaagaagagtttgaaccactcagagcggaattttaacttcgaaaaaaagagtttcgaaactaccgttcagacctggaagaaagatatctatacaaaaaaactgaacttgaagaatcaaaaagcgaccttggagaagagcaaactaacttggaatcaggatattattcaaaaagagaaatccttgtcgaatctagagatagatttgaccacgaacagaacggaattgagcaaagaggaaatgaaatttcaacagaagttgaaaatggctttagagaatcagcagatgagtttgaacgatattatcaaagagaagtcgaagaaattgaaactacacgaacagatatcaataagctcaaagaaagctcaggacagattagagctgatttacgaagtagaattcaagaagtattacgagaggatgctgatagctaccgcattgaaaagggccgaattgaagaagaacaaagccaaactcgaattaaaatcaagcatattactcaagaaaccagaaaagaacaaattcgtcatcgagaaattagatgcgggcgttagagacaaatatctaaaattagtgggacatgaccaagaggactaa

SEQ ID NO: 10748 - protein, 198 aa, Unknown
  Obtained from environmental sample
  misc_feature (1)..(198): Xaa is any amino acid
MKKSLNHSERNFNFEKKSFETTVQTWKKDIYTKKLNLKNQKATLEKSKLTWNQDIIQKEKSLSNLEIDLTTNRTELSKEEMKFQQKLKMALENQQMSLNDIIKEKSKKLKLHEQISISSKKAQDRLELIYEVEFKKYYERMLIATALKRAELKKNKAKLELKSSILLKKPEKNKFVIEKLDAGVRDKYLKLVGHDQED

SEQ ID NO: 10749 - DNA, 432 bp, Unknown
  Obtained from environmental sample
  misc_feature (1)..(432): n is a, c, g, or t
ttgaataatgatggagaaaatgagcttatcccacttttgaaaaaaggttcgggttttttaagtcttgataaaaacaacaatggaaaaatagacaatggtcatgaactttttggacctaaaacagatgagggatttcaagagttagcacaatatgattatgacaacaataactggatagatgaaaatgatgcaatatttaacaaactaaaagtttggcaaatcaatgaagatggagacaacaatcttgtatctcttttagatttgaatattggtgctatatacctaggcagtgtagaaagtggctttgagtatcaaaagaaaatagataaagtagatgcggtacaaagaagcaatggaatttatgtaaaaaatgatggttcaggtattcgtatgataaacgcactcgatatagctttagaaacagccgtttaa

SEQ ID NO: 10750 - protein, 143 aa, Unknown
  Obtained from environmental sample
  misc_feature (1)..(143): Xaa is any amino acid
MNNDGENELIPLLKKGSGFLSLDKNNNGKIDNGHELFGPKTDEGFQELAQYDYDNNNWIDENDAIFNKLKVWQINEDGDNNLVSLLDLNIGAIYLGSVESGFEYQKKIDKVDAVQRSNGIYVKNDGSGIRMINALDIALETAV

SEQ ID NO: 10751 - DNA, 657 bp, Unknown
  Obtained from environmental sample
  misc_feature (1)..(657): n is a, c, g, or t
atgaaacaggtaaatgaggcttacgctgtattgtctgattcaaagaaaaggcaggattacgattctttgcggaatcaatatggttctgctgatgcatatacgcagtttcggcacagttattctgatcaggatatttttaaaggaacagatattcaaaaagtgtttgatgagctggctcagtcttttgggttcagaaattttggcgatatttttcaacaatttgatggtgctggaagtaaaaaatttgagttcaaaggatctaatttttccatgagaggcggattcttttttggaatcatgaattttggcaaatctccatcaaagagttcactgcccggaaaaatgggttgggttacccgaaaattgctgcagaatctatcaaggtccaaaattccgcttcatgggaaagatctccatgatattattcaggttaatcaggatttggcggaaaaaggtggtccttatgcgtattaccacacatggcaatcaaagaagctggtgataactatcccatccaatacccggaatgggcaacagattcgtctgaaaggtatgggggaagaagaccaggggggagggaggccaggagacctgtatctgaaaatagaaacgaatccatctatagttagtaaaattagaaaatttctgccattttga

SEQ ID NO: 10752 - protein, 218 aa, Unknown
  Obtained from environmental sample
  misc_feature (1)..(218): Xaa is any amino acid
MKQVNEAYAVLSDSKKRQDYDSLRNQYGSADAYTQFRHSYSDQDIFKGTDIQKVFDELAQSFGFRNFGDIFQQFDGAGSKKFEFKGSNFSMRGGFFFGIMNFGKSPSKSSLPGKMGWVTRKLLQNLSRSKIPLHGKDLHDIIQVNQDLAEKGGPYAYYHTWQSKKLVITIPSNTRNGQQIRLKGMGEEDQGGGRPGDLYLKIETNPSIVSKIRKFLPF

SEQ ID NO: 10753 - DNA, 363 bp, Unknown
  Obtained from environmental sample
  misc_feature (1)..(363): n is a, c, g, or t
atggttcaaacattgagttatacaaaaatttctttagttgttgattcactaaaagatgaagaagatattagcaacacagtagagcatctgaaatcacactataaaatagaaccaaatattatctctgcaaaagatgagctgattgatgaaaacagtagaatatatctactctatcttagggatgaggagattaagaatttttttgaaacaaatattttaaaagatttacatctatcaatactccccaatgaaaagtgtctaaattctgctaaaagctatagtattttcaaagatatttttgaagccattgatgatgcccttaatccaaagccccctcccaaaaatggatctactattatgtaa

SEQ ID NO: 10754 - protein, 120 aa, Unknown
  Obtained from environmental sample
  misc_feature (1)..(120): Xaa is any amino acid
MVQTLSYTKISLVVDSLKDEEDISNTVEHLKSHYKIEPNIISAKDELIDENSRIYLLYLRDEEIKNFFETNILKDLHLSILPNEKCLNSAKSYSIFKDIFEAIDDALNPKPPPKNGSTIM

SEQ ID NO: 10755 - DNA, 651 bp, Unknown
  Obtained from environmental sample
  misc_feature (1)..(651): n is a, c, g, or t
atgaagctagaatcagcactaaaagagattgcaacacttggaatgccaaattattttggatttcaacgatttggattagatggggataactacaaaaaaggtgaagctcttataaatgggacattaaaagtgcgagatagaaagctaagacagatgtatattaatgcttatcaatcatacttatttaactcttggcttagtaaaagaattgaaataagtaaaattatggataattttgatgcaaaagatataagtgaaaaacttcaacttgatgtggaaacaatcaaagagattcaaaaacaacaacatccatttaaagttttaaaaggggatgtttttagccattatccttatggaaagatatttcatatagaggagcttgaggaagaggctcaaaaattttatgatagagatagagttccaacaggacttttaagtggtaaaaaaacaaaactagcaattgatgatgccttaaaatttgaagaagagtttataaaagagacaaaagaggatggaagtagaagatttgcttggattttcccatctgaaattagtagtgaatacaaagaggagaaagcttggtttgaattaaattttgaattaccaaaaggaagctatgcaacagaatttattagtgaattaactcactaa

SEQ ID NO: 10756 - protein, 216 aa, Unknown
  Obtained from environmental sample
  DOMAIN (1)...(216): tRNA pseudouridine synthase D (TruD)
  misc_feature (1)..(216): Xaa is any amino acid
MKLESALKEIATLGMPNYFGFQRFGLDGDNYKKGEALINGTLKVRDRKLRQMYINAYQSYLFNSWLSKRIEISKIMDNFDAKDISEKLQLDVETIKEIQKQQHPFKVLKGDVFSHYPYGKIFHIEELEEEAQKFYDRDRVPTGLLSGKKTKLAIDDALKFEEEFIKETKEDGSRRFAWIFPSEISSEYKEEKAWFELNFELPKGSYATEFISELTH

SEQ ID NO: 10757 - DNA, 945 bp, Unknown
  Obtained from environmental sample
  misc_feature (1)..(945): n is a, c, g, or t
ttgtcggtggatgaagattacagaagaatcgaactgaatcgtctccatccctttgaattgaattatttgtatgattctttaggaagtatcaaagagatagtaaagtttatggaaaactataactttgtaaaaccaccttgcagtagtgaagatattgagatttttatcaaaactattgaagagacatttgatctttcttgtagtgggaagtttatgttaaaagatattgattctaatatgatagcccgaggaattgatagtaaaatagatgaacttatcaaacaaaatgaacttttagaagagaagcttgatatatttgtagagcatattttaaaatttttaaaaagtgatgataaaaatcttatctctgtaacccgtttagggaaagagggattttttattgggcttacgaaaaatcgttactcttcaatcaagaaagagcttttggaatcacacttaataattgatgatgagttgtatctctttaaagatttttctataaaagtgcaaacttctagtgtcaaaataaccaataaactcacctctacaatctctgatcaatatgtgcataacttacaaaaaatcattgccctaaacaaagtgatatttaaagaaaaaatcgaatattatgagaaacaatttgcttctatgcttttggagctggtttcatttatagctgaaggtgatttaacagtatcaaatataaaaaccgcaaaaaaatacaactttgtacacccaaaaatcatcaaacaagatgaggtgaaaaacaaacttcttagaacttatagatttacgacctccaattatcgaatccaactggggaaaaatgggatcctatgtccccaaatgaatataagggttggggggaatttaaccaaaagtatccaaaagaagcctccgagaaaaaccttaataataaaaaaacgccaggcccggaataaatag

SEQ ID NO: 10758 - protein, 314 aa, Unknown
  Obtained from environmental sample
  misc_feature (1)..(314): Xaa is any amino acid
MSVDEDYRRIELNRLHPFELNYLYDSLGSIKEIVKFMENYNFVKPPCSSEDIEIFIKTIEETFDLSCSGKFMLKDIDSNMIARGIDSKIDELIKQNELLEEKLDIFVEHILKFLKSDDKNLISVTRLGKEGFFIGLTKNRYSSIKKELLESHLIIDDELYLFKDFSIKVQTSSVKITNKLTSTISDQYVHNLQKIIALNKVIFKEKIEYYEKQFASMLLELVSFIAEGDLTVSNIKTAKKYNFVHPKIIKQDEVKNKLLRTYRFTTSNYRIQLGKNGILCPQMNIRVGGNLTKSIQKKPPRKTLIIKKRQARNK

SEQ ID NO: 10759 - DNA, 345 bp, Unknown
  Obtained from environmental sample
  misc_feature (1)..(345): n is a, c, g, or t
atgttattgttatcaaaacaatttttgaaaggttatactatggaaaatatatcaaatattgtactttacaatgatggggaattggaattaaaagtttctctaaatgaagaaacaatctggcttagacaaaatgaaatttcattgctttttaatgtagatagaactactatcacaaagcatatcaataaaattttacaagataatgaagtagaagaaaatagcaatgtgcaaaaaatgcactttgcaaattctgataaaccagtaaaaatttatagtttagatataatacttgccgttggatataggacaaattcatcaaaagcgataaagtttagaaaaagctaa

SEQ ID NO: 10760 - protein, 114 aa, Unknown
  Obtained from environmental sample
  misc_feature (1)..(114): Xaa is any amino acid
MLLLSKQFLKGYTMENISNIVLYNDGELELKVSLNEETIWLRQNEISLLFNVDRTTITKHINKILQDNEVEENSNVQKMHFANSDKPVKIYSLDIILAVGYRTNSSKAIKFRKS

SEQ ID NO: 10761 - DNA, 393 bp, Unknown
  Obtained from environmental sample
  misc_feature (1)..(393): n is a, c, g, or t
atgctacaatataacttaacttttgagactcaagaagaagcttttatacacagtgatgaacatcgtgtaaaacagattatctcagatgtactctctaatgctattaaatacggaaaagatgaaatccatatagaactaacaacaaatcataaagttactgaactgactatagaagacaatggacccggaataaagaataaggaagagattcttaatctttatatacaagaaaatgaagaattattatccagacaaggaaaaggtacaggcattggtctttacttcttaaaactgctttgtcaggacttgaaaataaattacaaaattgaagatacacaacaaaatactggtaccaaattcacgcttatatttaaaaataaacaagagggatag

SEQ ID NO: 10762 - protein, 130 aa, Unknown
  Obtained from environmental sample
  DOMAIN (18)...(127): Histidine kinase-, DNA gyrase B-, and HSP90-like ATPase
  misc_feature (1)..(130): Xaa is any amino acid
MLQYNLTFETQEEAFIHSDEHRVKQIISDVLSNAIKYGKDEIHIELTTNHKVTELTIEDNGPGIKNKEEILNLYIQENEELLSRQGKGTGIGLYFLKLLCQDLKINYKIEDTQQNTGTKFTLIFKNKQEG

SEQ ID NO: 10763 - DNA, 942 bp, Unknown
  Obtained from environmental sample
  misc_feature (1)..(942): n is a, c, g, or t
gtgatgagtagatctatcttaaaaatggaatatcttacaaataatacagtcaaggaacttgatgatgtgactatttatagtgtgaatccctttgttgtatcacaaagtagattagcaaaggctattgagagtattgaaaaagaacttactgaaagattagcctattataaagagaatgaaaaacatgtagagtatcaaagacttaaacaaagagttgagttcgatttagagatgcttgaagctacaggtatgtgtaaagggattgaaaactatgcacgacttttaacagataaaaaacctggagaaacaccttattcacttatagattattttgaagctatgaatcgtccatatttacttatagttgatgagtctcatgtatcactttcacaatttcgaggaatgtatgcagcagataaaagtagaaaagaagtacttgtagattatggttttagactaccaagtgctttagataatagacctttaaaatttgatgaatatatcaataaaaaagcaaactttttatttgtaagtgcaacaccaaatgagttagaattaaacttaagtagtgcagttgctgaacaaatcatacgaccaacaggacttcttgatccagtagttgaagtacttgatagtgagttccaagtggaaaaacttcatgatgagataaaaaaagtggttgctaagaatgaaagagtgctagttactgttcttacaaaaaaaatggcagaagagttagctacatattatgctgatttgggtataaaagtaaaatatatgcatagtgagatagatgctatagagagaaatcaaatcatacgaacacttcgacttgnaaaatttgatgtactaattggaattaaccttttaagagagggattagacctcccagaagcaagtatggttgccatacctgatgctgaaaaagagggttttttagga

SEQ ID NO: 10764 - protein, 314 aa, Unknown
  Obtained from environmental sample
  DOMAIN (249)...(307): Helicase conserved C-terminal domain
  misc_feature (1)..(314): Xaa is any amino acid
MMSRSILKMEYLTNNTVKELDDVTIYSVNPFVVSQSRLAKAIESIEKELTERLAYYKENEKHVEYQRLKQRVEFDLEMLEATGMCKGIENYARLLTDKKPGETPYSLIDYFEAMNRPYLLIVDESHVSLSQFRGMYAADKSRKEVLVDYGFRLPSALDNRPLKFDEYINKKANFLFVSATPNELELNLSSAVAEQIIRPTGLLDPVVEVLDSEFQVEKLHDEIKKVVAKNERVLVTVLTKKMAEELATYYADLGIKVKYMHSEIDAIERNQIIRTLRLXKFDVLIGINLLREGLDLPEASMVAIPDAEKEGFLG

SEQ ID NO: 10765 - DNA, 435 bp, Unknown
  Obtained from environmental sample
  misc_feature (1)..(435): n is a, c, g, or t
atgattcttgatgcgaatttaaaatttgaaaatataaaaatagttcaaagttatgaaaaagatatagaagttacaactattcaaaatgacttagtacaaattttattaaatattataaataatgcagtagatgcatttagagataaaacaataaaagataaatttttatttattgatatttaccaaaaaaaagatatagtttatatatcccttttagattctgcaggtggaattagtgaagatgttatagataaaatattcgaaccatattttacaacaaaacatcaagctcaaggtacaggattagggctttatatgacacatcagattttgtcaaaactagatggtaaaatagaggtaaataacgaatcatatacttatgaaaaaaaagagaatagaggtgctaaatttactatcactttaccagtattttaa

SEQ ID NO: 10766 - protein, 144 aa, Unknown
  Obtained from environmental sample
  DOMAIN (26)...(144): Histidine kinase-, DNA gyrase B-, and HSP90-like ATPase
  misc_feature (1)..(144): Xaa is any amino acid
MILDANLKFENIKIVQSYEKDIEVTTIQNDLVQILLNIINNAVDAFRDKTIKDKFLFIDIYQKKDIVYISLLDSAGGISEDVIDKIFEPYFTTKHQAQGTGLGLYMTHQILSKLDGKIEVNNESYTYEKKENRGAKFTITLPVF

SEQ ID NO: 10767 - DNA, 651 bp, Unknown
  Obtained from environmental sample
  misc_feature (1)..(651): n is a, c, g, or t
ttgaaagttatttttacaggttcgtcattattgcatttgcaacatgcaaaagccgatttaagcagaagaacagtaatgtatcatttacccgggttatcgtttcgagaatttctctattttgaatctaaacaatcttttcctatcctaagtttagaagatattcttaacaatcatgttacacttgctattcaattaattaataaatttaaaccactcagctattttgatgactatttaaagtatgggtactatcctttttataacgaaaataaaaattcatttcacctaaaactaagtgaaacaattttaactgttttagaagttgacatacctcaatttgcttcaatacaaacggctaatattatttatttaaaaaaattattacagattataagtggttcggttccgtttaaacctaatatgaatgccttaagcgaacggacagggattagccttaataccatgaaggtatatttaaaattattaaatgatgcacaattgttgaaattgttgtatgttcagaacaaaggcattaacagtttaaataaacccgaaaaaatatatttgaacaataccaacttaatgtttaatcagggtaacgataatgaaacacaggtaatcttagagaaactttttttctcaatcaattga

SEQ ID NO: 10768 - protein, 216 aa, Unknown
  Obtained from environmental sample
  misc_feature (1)..(216): Xaa is any amino acid
MKVIFTGSSLLHLQHAKADLSRRTVMYHLPGLSFREFLYFESKQSFPILSLEDILNNHVTLAIQLINKFKPLSYFDDYLKYGYYPFYNENKNSFHLKLSETILTVLEVDIPQFASIQTANIIYLKKLLQIISGSVPFKPNMNALSERTGISLNTMKVYLKLLNDAQLLKLLYVQNKGINSLNKPEKIYLNNTNLMFNQGNDNETQVILEKLFFSIN

SEQ ID NO: 10769 - DNA, 567 bp, Unknown
  Obtained from environmental sample
  misc_feature (1)..(567): n is a, c, g, or t
atgggaaaatcaaccggtttaccggaacccatgggattggggaaggtaaatatatggttcaggaatgtttctataaagatgggggtaggccaggacccatgttatgatacgtttactttctttggtgatgaatccgatggcgtgcatcaagatagtattctaattgaaatctatggcactaagtgttatcaagagaatggattagatgttgctggagaagaatgggtagaatataaaacaattcatgtttcaaaatatgaagaagcaacaggaatatcaagagcaaagaaaaaagagattaccgaagtcaaagagccacttgtaaaaaaccctaaggatacagttattaagattaaaccaccgtacaaaaaaggttacatccaaattactgctacaggactaaatggtgataaaattgaatatggttatataaaagctgatggcacttataatataagcggttattcctatatacgttttaacaacaaaactagaaattcacataactactttataaaagagggtgaaatctattatgtttcaaatatccaaaacattgtgagttga

SEQ ID NO: 10770 - protein, 188 aa, Unknown
  Obtained from environmental sample
  misc_feature (1)..(188): Xaa is any amino acid
MGKSTGLPEPMGLGKVNIWFRNVSIKMGVGQDPCYDTFTFFGDESDGVHQDSILIEIYGTKCYQENGLDVAGEEWVEYKTIHVSKYEEATGISRAKKKEITEVKEPLVKNPKDTVIKIKPPYKKGYIQITATGLNGDKIEYGYIKADGTYNISGYSYIRFNNKTRNSHNYFIKEGEIYYVSNIQNIVS

SEQ ID NO: 10771 - DNA, 561 bp, Unknown
  Obtained from environmental sample
  misc_feature (1)..(561): n is a, c, g, or t
atgaaaaaatttagcaaaataatggaaaattattttattgatttactgaaagaattagaaaaaacaaacagtgaaaaaacaattattgaaattgcaaataaccttgattcaaatcaaatattaaaaatgataatttattattttgtgaaatattgtttaaaaaataatattttaataaactcttttgaaatattaaaatctgttgggattagtgatttgggaggtatttattttatgaataaaaaaaataatttaaaaaaagagaataaaaatattggaataattaaaaacaaattaattttttcaaaaggagtattatattcaatgttagaaaaaatgaatttaaaaaaaaccacttcatttttaaaaaaaaaaatgatatttgaagatgaaattgaaacaggtgtaaaatcagtagaaccattagattttatttctaaagaagatataaattttttaaaattacataattttgaagaaattttacaaaaggagctaaaagaaaaatacacaggacaaccaataatacttcataaaacaaaaatagatcataataaataa

SEQ ID NO: 10772 - protein, 186 aa, Unknown
  Obtained from environmental sample
  misc_feature (1)..(186): Xaa is any amino acid
MKKFSKIMENYFIDLLKELEKTNSEKTIIEIANNLDSNQILKMIIYYFVKYCLKNNILINSFEILKSVGISDLGGIYFMNKKNNLKKENKNIGIIKNKLIFSKGVLYSMLEKMNLKKTTSFLKKKMIFEDEIETGVKSVEPLDFISKEDINFLKLHNFEEILQKELKEKYTGQPIILHKTKIDHNK

SEQ ID NO: 10773 - DNA, 684 bp, Unknown
  Obtained from environmental sample
  misc_feature (1)..(684): n is a, c, g, or t
atgttctcatcgcccaaagtcaataaaagagatactatgaaaaaaatattaagtgtagatgcaaatttattatatagtcgaattttaaaacaagatattgaggagtattttaatttacaaggtgaaacaattgagtttcatgcaagtcaaacttctcaacaaacacttgatattattaatactcatcagatagatattatttttttagatatctcttcaaagcagttcgatgggataaaacttcttaaatatattaaacaacaaccagtaaggcaatctaaaatagtaggtgttatggatctttatgatcatacctatagatttcaagctttaaaacaaaaagtgtatagatatatctacaaaccttatgacaaccaagagatacatgcagtattatcaaaattttttaaaaaaaattattacaataaagagattaatagaactgaaaattttataaatgttgaagatatagagcataaagatagtgattttacaaatgaagttgaaaaaacagaatatgaaaaagagttagtacaaacttatatttcagtacatcaaaaaactgatgctaaaagttttctgaaaagttatgaagattgggcttatgatttggatgatttagatgatttagaattggcattaaaaagattgatgaatgatcttattatggaaagtgatttttga

SEQ ID NO: 10774 - protein, 227 aa, Unknown
  Obtained from environmental sample
  DOMAIN (14)...(140): Response regulator receiver domain
  misc_feature (1)..(227): Xaa is any amino acid
MFSSPKVNKRDTMKKILSVDANLLYSRILKQDIEEYFNLQGETIEFHASQTSQQTLDIINTHQIDIIFLDISSKQFDGIKLLKYIKQQPVRQSKIVGVMDLYDHTYRFQALKQKVYRYIYKPYDNQEIHAVLSKFFKKNYYNKEINRTENFINVEDIEHKDSDFTNEVEKTEYEKELVQTYISVHQKTDAKSFLKSYEDWAYDLDDLDDLELALKRLMNDLIMESDF

SEQ ID NO: 10775 - DNA, 873 bp, Unknown
  Obtained from environmental sample
  misc_feature (1)..(873): n is a, c, g, or t
atggtttttggtaattttgctgagaattacgagtttgcagccatgaaatctactggtatttcattgcaacgtgccatgagaagtttaagtgttttcatcgttgctcttggtatagcctgtttctttttttctaataatgttattccttggggagagtacaatttttataatctaagacgaaacatcgctaaaatgaaacctgccttagcaattgcagaaggtcagtttaatgaaattggaaatattaatattaaggttgctaaaaaatctggagatcgagggcaatttttagaaggtgtggtaatccatgaaaaaagcactaccagaagaggaaactataaagttattgtttctaaaaaaggggaactaaaaagtagtacggattctaatattcttcaacttgaattaaaagatggtaatttttatgaagaaattattagcaatgatttaaagaagaataaaaataaaccacacgtcagaagttattttgacacctatgtcactaatgtagatttagaaatcttaaataatgaagatttagacgaaaaaagccaatctaacagatacaacatgttaaatgtaagtcaattgagcaaccaaattgacactttagagcatatgaaaagaaacgattacaacgccttatcatcaaccttatacaatcgtagtacttttgaatcacttaatataaatatagatacttctaagacaagaaaaaatataccagaagactcaataattcctattgaagatccgttgagtttatataacactgctcaaaaaattcagattcttaatttagctgtaaactcttcaaatagtaccagacaaatttttagaattcctaataagaaaaaatttaccaaattaaaa

SEQ ID NO: 10776 - protein, 291 aa, Unknown
  Obtained from environmental sample
  misc_feature (1)..(291): Xaa is any amino acid
MVFGNFAENYEFAAMKSTGISLQRAMRSLSVFIVALGIACFFFSNNVIPWGEYNFYNLRRNIAKMKPALAIAEGQFNEIGNINIKVAKKSGDRGQFLEGVVIHEKSTTRRGNYKVIVSKKGELKSSTDSNILQLELKDGNFYEEIISNDLKKNKNKPHVRSYFDTYVTNVDLEILNNEDLDEKSQSNRYNMLNVSQLSNQIDTLEHMKRNDYNALSSTLYNRSTFESLNINIDTSKTRKNIPEDSIIPIEDPLSLYNTAQKIQILNLAVNSSNSTRQIFRIPNKKKFTKLK

SEQ ID NO: 10777 - DNA, 669 bp, Unknown
  Obtained from environmental sample
  misc_feature (1)..(669): n is a, c, g, or t
atgtaccctctaagtatttatttaattcccggagttactaacgataaaggagtttttcaatttggtcaaattttagttccattaaagcgattattcaatccaaaacaaaggcttcaactttcagagagcgacactaaggtatataatttctattcaaaatattccatcgcagaattaatcgctattataaaaaaacaagatgattttgatatagataaaaagcctaaagagattgcgcttcataatcttctaaaccgtaatatttcattagaaagtttacaaactgaaggattagaaatcccaaacacattagttaaagctagagttttattaagagattataaggattattctaaaacaagcttaataagctatggtattggagttgtattattagtattacattttgtgtttaataacaataagcttcctgaactggcagaaacaggaattactctaagtattattgcctttatcttttttatcatttatgtgattgtaaatgcatatgtgtattcaaagttctataaaaccatcaatcaaaaaggaaagcgtattaatcctttgttattggcattaacacttcctatttatcctttaaaatatatcattgtaagaagtagaatttctcaagacttctatcacagctgtcttcagaatataaaataa

SEQ ID NO: 10778 - protein, 222 aa, Unknown
  Obtained from environmental sample
  misc_feature (1)..(222): Xaa is any amino acid
MYPLSIYLIPGVTNDKGVFQFGQILVPLKRLFNPKQRLQLSESDTKVYNFYSKYSIAELIAIIKKQDDFDIDKKPKEIALHNLLNRNISLESLQTEGLEIPNTLVKARVLLRDYKDYSKTSLISYGIGVVLLVLHFVFNNNKLPELAETGITLSIIAFIFFIIYVIVNAYVYSKFYKTINQKGKRINPLLLALTLPIYPLKYIIVRSRISQDFYHSCLQNIK

SEQ ID NO: 10779 - DNA, 603 bp, Unknown
  Obtained from environmental sample
  misc_feature (1)..(603): n is a, c, g, or t
atgggtgttaagtcattggtatttgcgggtaatggagaaccaacacttcatgtggatactattgaagcaatccagttatctaaagagttaggtttggatgtagcactaagtacaaatggtgcattacttaaagaagaacattttgagattcttgcaaaaaaccttacatggatacgattttcttttaatgcaggaagtagtgaaaattatgcttatgttcatcaaacaaaaagtgatgattttaataaagtagttgaaaatattaaaagattaaaagctactaaagagagattaaaaagtaatattacgattggaacacagtttgttttaatacaagaaaataaagattttgcattagagcatgggaagatgttgaagtctctaggggttgattattttagtgttaagcatttttataatcattcacataatgaatttgaggtaaaagaacaaattgaagataaatttatagaggtattatcaaaagaagcagaaaagctttgtgataaagattttaaatttatagtgagaagtacagcaaatctatcttcaaaaagagattataataaatgttatgggttagagttttatagtatttattga

SEQ ID NO: 10780 - protein, 200 aa, Unknown
  Obtained from environmental sample
  misc_feature (1)..(200): Xaa is any amino acid
MGVKSLVFAGNGEPTLHVDTIEAIQLSKELGLDVALSTNGALLKEEHFEILAKNLTWIRFSFNAGSSENYAYVHQTKSDDFNKVVENIKRLKATKERLKSNITIGTQFVLIQENKDFALEHGKMLKSLGVDYFSVKHFYNHSHNEFEVKEQIEDKFIEVLSKEAEKLCDKDFKFIVRSTANLSSKRDYNKCYGLEFYSIY

SEQ ID NO: 10781 - DNA, 651 bp, Unknown
  Obtained from environmental sample
  misc_feature (1)..(651): n is a, c, g, or t
gtgataataaataaatttatctcccctttttgtaggtatttttttgcgaaactgtactccattatttggaataacattaaagcaaaaaagaaatttggacaaaattttttaaaagatgagtcagtattaattaaaatcatccaatcgatgccccataacaataatcatattgtagaaatcgggcctggattaggtgatttgacaaagaaacttgtcaagtgcaaagatgtaacagcctatgaggttgatagagacttatactctatattgcaaaccgagttttctgatgagttgaaatccaataaattaaagatcattttaggtgatgttttagaaaaatggaacgaaaactcatcattatataatagtagatatgacttaatagcaaacctaccatattatatagctacgaacattatattaaattcatttaacgataataattgtgagaacattatcgttatgatacaaaaagaagttgcggacaaatttacagcacagtgtggagataaagaatactctagcctgagcgtaataacacagttaatctcaaaacaggcacgaacactaattgttgttccgcctattagttttgatccacctccaaaggtggattcaagtgttatctatattcaaaacagatatggataa

SEQ ID NO: 10782 - protein, 216 aa, Unknown
  Obtained from environmental sample
  DOMAIN (25)...(216): Ribosomal RNA adenine dimethylase
  misc_feature (1)..(216): Xaa is any amino acid
MIINKFISPFCRYFFAKLYSIIWNNIKAKKKFGQNFLKDESVLIKIIQSMPHNNNHIVEIGPGLGDLTKKLVKCKDVTAYEVDRDLYSILQTEFSDELKSNKLKIILGDVLEKWNENSSLYNSRYDLIANLPYYIATNIILNSFNDNNCENIIVMIQKEVADKFTAQCGDKEYSSLSVITQLISKQARTLIVVPPISFDPPPKVDSSVIYIQNRYG

SEQ ID NO: 10783 - DNA, 738 bp, Unknown
  Obtained from environmental sample
  misc_feature (1)..(738): n is a, c, g, or t
atgaaatcaatttacttattagtagtaactgctctaacaattactttttctataaacttacaagcacaacaagcttggacattagaagattgtattaatcatgccattgaaaacaatatcacggtaaaacggcaagaactaaatgctaagtctgcagaaaaaaattactttcaatcaaaaatggaagttctgcctagtattaatgcaaacgcaacccatttatataattcaggtcgagcaattgactatgaaacttattcttatgtagatgaagaatttcaaagaggagatttaggggtaacatcggaaataactgtatttaggggattgcaaacattcaatacaattaaaaaatcaaaattagattatttattgcaacttgagaatgtagaaaaagttaaaaatgacattactataaatgtttcaacttcttatttgcaaattttattaaataaggaattaaaagataatgctcaagaacaattagatattactcttgatcaaattgagaaaacaaaaaaattagttgaaataggcaatgctgctaaaggagatttattacaaataaaatctcaagctgctgccgaaaaagcacccttaactaataccgagaataatttaagagttccttatttggatctctctcagttacaaaatctttttgagtcagaaaatttcgaaattggtttatcccggaaaaaaccaaacataaaccattggcgggtaaacattttctaa

SEQ ID NO: 10784 - protein, 245 aa, Unknown
  Obtained from environmental sample
  DOMAIN (28)...(219): Outer membrane efflux protein
  misc_feature (1)..(245): Xaa is any amino acid
MKSIYLLVVTALTITFSINLQAQQAWTLEDCINHAIENNITVKRQELNAKSAEKNYFQSKMEVLPSINANATHLYNSGRAIDYETYSYVDEEFQRGDLGVTSEITVFRGLQTFNTIKKSKLDYLLQLENVEKVKNDITINVSTSYLQILLNKELKDNAQEQLDITLDQIEKTKKLVEIGNAAKGDLLQIKSQAAAEKAPLTNTENNLRVPYLDLSQLQNLFESENFEIGLSRKKPNINHWRVNIF

SEQ ID NO: 10785 - DNA, 378 bp, Unknown
  Obtained from environmental sample
  misc_feature (1)..(378): n is a, c, g, or t
atggaagtatttgaagagatttttagactcttaaaaaaagatggtgagctaattatttcagtagatagttttagtcattttgataaaaagcaaagagagattcatcgaaaaaactttgatgtagtaaaatattttgaaaaagatgaacttcatgaattacttcaaaaaataggcttcaaagagattcagataaaacctattttcaaaagtaagtttgctgaaaaatggtttacaagagtgatgaataatccaagtgaatattttgggtcatttaaacgattatactcttttatcttgtattatcaaataacttatcatgaaaacaaagtcaagcaaaatgatcatggaatttttttaatagttaaatgtaaaaagtaa

SEQ ID NO: 10786 - protein, 125 aa, Unknown
  Obtained from environmental sample
  misc_feature (1)..(125): Xaa is any amino acid
MEVFEEIFRLLKKDGELIISVDSFSHFDKKQREIHRKNFDVVKYFEKDELHELLQKIGFKEIQIKPIFKSKFAEKWFTRVMNNPSEYFGSFKRLYSFILYYQITYHENKVKQNDHGIFLIVKCKK

SEQ ID NO: 10787 - DNA, 606 bp, Unknown
  Obtained from environmental sample
  misc_feature (1)..(606): n is a, c, g, or t
atgcaagaattattcaaaaatctaatagacacaatgcctctaggcatcttagtaaaagatgctaaagatgattttaaatattcaatctgcaatatgtctgcctctataatacttggtaaaagccccgaggaagtaatgggcaaaacagatagtgatatcttttcagaagatattgccagcctacatgaacaattagactatcaagtaattcaaacaaaaaaaattgaacagaataaggttttaattgattttggttatggtggtatttggctacgttctacgcaataccctttattagatgaagctggttcagtatacgctgtaatgagaattcttgagaatataactgacgcagtgaaattagaacaaaaaatgcatcattttcaaaaaatggaagaagttggaaaactcgctggcggtgttgcacatgagtttaacaatctacttcaagtaattgtaggttattctgacctaatagaagaagaagcaactggaaacagcacaattaaacatgtatctcaaattcttaaggcaaccgaagtctggcgcaaagtcctaaacaagaccaactactttacttttttagtaaaaaaaccggggatttag

SEQ ID NO: 10788 - protein, 201 aa, Unknown
  Obtained from environmental sample
  DOMAIN (3)...(67): PAS domain
  misc_feature (1)..(201): Xaa is any amino acid
MQELFKNLIDTMPLGILVKDAKDDFKYSICNMSASIILGKSPEEVMGKTDSDIFSEDIASLHEQLDYQVIQTKKIEQNKVLIDFGYGGIWLRSTQYPLLDEAGSVYAVMRILENITDAVKLEQKMHHFQKMEEVGKLAGGVAHEFNNLLQVIVGYSDLIEEEATGNSTIKHVSQILKATEVWRKVLNKTNYFTFLVKKPGI

SEQ ID NO: 10789 - DNA, 603 bp, Unknown
  Obtained from environmental sample
  misc_feature (1)..(603): n is a, c, g, or t
atgaatctaaatattgaaagtttaaaacaaagttatataaatagtgaagttacagttagagaagttatcacagctataaaagagaaagtacaacaaacaaaaaatcataatatttggatatacattttaagtgatgaacagttagaaccttatttaaaaaacttagagggaaaaaatccaaatgatttacctctatatgggataccatttgccataaaagataatattgatttagtagatattcctacaacagctgggtgtaaagagtatgaatatatcccaaaagattctgcttttgttgttgtaaaattaatccaagcaggagcgataccaattggaaaaacaaatcttgaccaatttgcaacaggacttgtaggtacaagaagcccttatggggagtgtaaaaactcaataaatccagaatatatttcaggtggttcaagctctggaagtgcagtgagtgtggcacttgatatggtaagcttttcccttggaacagataccgctggttcaggaagagtaccagctgcttttaataatctcataggacttaaagcaaccaaaaggggtagtaagtacaagtggtgtagttccagcttgtag

SEQ ID NO: 10790 - protein, 200 aa, Unknown
  Obtained from environmental sample
  DOMAIN (21)...(200): Amidase
  misc_feature (1)..(200): Xaa is any amino acid
MNLNIESLKQSYINSEVTVREVITAIKEKVQQTKNHNIWIYILSDEQLEPYLKNLEGKNPNDLPLYGIPFAIKDNIDLVDIPTTAGCKEYEYIPKDSAFVVVKLIQAGAIPIGKTNLDQFATGLVGTRSPYGECKNSINPEYISGGSSSGSAVSVALDMVSFSLGTDTAGSGRVPAAFNNLIGLKATKRGSKYKWCSSSL

SEQ ID NO: 10791 - DNA, 786 bp, Unknown
  Obtained from environmental sample
  misc_feature (1)..(786): n is a, c, g, or t
ttgaaagaaaatttaaaaaagcttataaatattggaaaaaatttaaaaattctaattgtagaagatgatccacttttaagaagagagattgtgagtatcttaaatgttatttttgatgatataacatttgcagtagatggtcaagatggatttcaaaagtatctagatacaaagtatgattttataattacagatatccatatgccaaatctaaatggtataaatatggcaaaaaaaattcgagaaaaaaatgacagaattcctattattatcctctctgcaaatagtgacccacactattttatagagagtattaaaataggagttgctggctacattttaaagcctcttgattttgaacagatgtatcatgttttgtatgagaccattgaaaatataaaattaaaacatgatgtatttagacaaaagcaacttctctctgaaattaataatgatttagaacaacagatgataggaagaatatctgaaatctactctttaaatgaggagattcaagcaactcaaaaagaggttctctttactatgggaactatttgtgagagtagaagtaaagagactggaaatcatgtaaaaagagttgctttatactcaaaaatattagcaacacattatgggctaagtaatgatgagataactttacttagagaagctagtcctatgcatgatatagggaaaatcgctatccctgatgcgattttaaataaagaagggagactcacagataaagagagagaaattatgaatacccatacaactttagggtaa

SEQ ID NO: 10792 - protein, 261 aa, Unknown
  Obtained from environmental sample
  DOMAIN (15)...(134): Response regulator receiver domain
  misc_feature (1)..(261): Xaa is any amino acid
MKENLKKLINIGKNLKILIVEDDPLLRREIVSILNVIFDDITFAVDGQDGFQKYLDTKYDFIITDIHMPNLNGINMAKKIREKNDRIPIIILSANSDPHYFIESIKIGVAGYILKPLDFEQMYHVLYETIENIKLKHDVFRQKQLLSEINNDLEQQMIGRISEIYSLNEEIQATQKEVLFTMGTICESRSKETGNHVKRVALYSKILATHYGLSNDEITLLREASPMHDIGKIAIPDAILNKEGRLTDKEREIMNTHTTLG

SEQ ID NO: 10793 - DNA, 441 bp, Unknown
  Obtained from environmental sample
  misc_feature (1)..(441): n is a, c, g, or t
gtggaaaacaagggttttgaaagtactttaaatatgaaatataagctcaataaagttgatttaagcataaaaggaaattatgcctataccatctccaaaaatattgagtggcctaagaatactgacaatgctctaaataaacaacttatttatgtacctcaacatcaattcaattccagtataaatatatcctataaaaatacttctntgagttacggctatcaatacactagtttaagatatattagtacagacaataattggtatttgcctgccaactatatatcaaacatagctattagccaaaaaataaaagtaaatcctactacgttaaacgtgcgttttcaggtaaacaatttgtttaaccaaacttaccaatctattgcttggagaccaatgccgttgagaaactacatgttaaccatatctttaaatttatga

SEQ ID NO: 10794 - protein, 146 aa, Unknown
  Obtained from environmental sample
  misc_feature (1)..(146): Xaa is any amino acid
MENKGFESTLNMKYKLNKVDLSIKGNYAYTISKNIEWPKNTDNALNKQLIYVPQHQFNSSINISYKNTSXSYGYQYTSLRYISTDNNWYLPANYISNIAISQKIKVNPTTLNVRFQVNNLFNQTYQSIAWRPMPLRNYMLTISLNL

SEQ ID NO: 10795 - DNA, 855 bp, Unknown
  Obtained from environmental sample
  misc_feature (1)..(855): n is a, c, g, or t
atgttcggattggctgnggtagcagatggttataataacgaacataaaagatttaacaatagttggctgacaggtttttcgggagattttaagcgtttaaattggaccgtttttaatagactgactgttgttgatgattacttcaaacctatagctccaagcgtttcattaggttatcaactgcctaaattagaagatgtaacactaaaagcagctgtaggaataaaccacaattacccaacttttaacgatttatattggactcctggtggaaatcctgatttaaaacccgaagaagctaaaatgagtgaaattggattgaattaccataaagcgtttgggaaaacaagtattaccacagaaaacactttcttttttgcccatgtttccaattggattttatggcagccaagtgcaggaaatatttggagtccaactaatttaaaaaaagtagaaaacaaaggttttgaaagtactttaaatataaaatataagctcaataaagttgatttaagcataaaaggaaattatgcctataccatctccaaaaatattgagttgcctaagaatactgacaatgctctaaataaacaacttatttatgtacctcaacatcaattcaattccagtataaatatatcctataaaaatacttctttgagttacggctatcaatacactagtttaagatatattagtacagacaataattggtatttgcctgccaactatatatcaaacatagctattagccaaaaaataaaagtaaatcctactacgttaaacgtgcgttttcaggtaacaatttgtttaacccaacttaccaatctattgcttggagaccaatgccgttga

SEQ ID NO: 10796 - protein, 284 aa, Unknown
  Obtained from environmental sample
  misc_feature (1)..(284): Xaa is any amino acid
MFGLAXVADGYNNEHKRFNNSWLTGFSGDFKRLNWTVFNRLTVVDDYFKPIAPSVSLGYQLPKLEDVTLKAAVGINHNYPTFNDLYWTPGGNPDLKPEEAKMSEIGLNYHKAFGKTSITTENTFFFAHVSNWILWQPSAGNIWSPTNLKKVENKGFESTLNIKYKLNKVDLSIKGNYAYTISKNIELPKNTDNALNKQLIYVPQHQFNSSINISYKNTSLSYGYQYTSLRYISTDNNWYLPANYISNIAISQKIKVNPTTLNVRFQVTICLTQLTNLLLGDQCR

SEQ ID NO: 10797 - DNA, 828 bp, Unknown
  Obtained from environmental sample
  misc_feature (1)..(828): n is a, c, g, or t
ttgtggagtgaggtttatctttttgatggagctggaactcatgaagagttcttatctcttgtggatgaaaatatatataatttaataatttttgatgagaagggattttgcccaaaattaaaagagagtttaaatgatattattaaagataaatcacatgatatagatacttctataatcgcacttctttctgattataataaagatactttggcttgtctctctgatgctggaatttattactatatttttaaaccgtttaatatgcaagagttagtacttcgtatggaagtattaatggataaaaaagctatgcaaagcttagatgatatcgggctagagcagttaaaaatggatgctgtaggagatatgatagctatgatagcccatcaatggcgtcaacctcttaactctatggctactacaatatcaaatatagaggttgaacttttaatggatatgctcgatcttaatgatcttccaaaatcgttaaatcagatgaaaaaatctattgagtacctttcacaaactatagatgattttagatatttttttatgcctagtaaaacaaaagaggttactactataggtgagatatttgctcattcacaaagtataatcgatatgaaattaccacacaatcgtattatgatgatagcccaagaaccatatgtgtcagaaaagttagaagtatttaaaaatgaaatcgtgcaagttggtataaatataataaataaccctatggatgaaattgtctcaaaagatataaaatctccatgcatatggatatccagtgaaaaaagaaggaagatttcgttttatatttaa

SEQ ID NO: 10798 - protein, 275 aa, Unknown
  Obtained from environmental sample
  DOMAIN (120)...(190): His Kinase A (phosphoacceptor) domain
  misc_feature (1)..(275): Xaa is any amino acid
MWSEVYLFDGAGTHEEFLSLVDENIYNLIIFDEKGFCPKLKESLNDIIKDKSHDIDTSIIALLSDYNKDTLACLSDAGIYYYIFKPFNMQELVLRMEVLMDKKAMQSLDDIGLEQLKMDAVGDMIAMIAHQWRQPLNSMATTISNIEVELLMDMLDLNDLPKSLNQMKKSIEYLSQTIDDFRYFFMPSKTKEVTTIGEIFAHSQSIIDMKLPHNRIMMIAQEPYVSEKLEVFKNEIVQVGINIINNPMDEIVSKDIKSPCIWISSEKRRKISFYI

SEQ ID NO: 10799 - DNA, 324 bp, Unknown
  Obtained from environmental sample
  misc_feature (1)..(324): n is a, c, g, or t
atgccttcacactttgagccttgtggattaaatcagcttattgctatgaattatggtgctatgcctatagtaaatcatgtaggtggtttggttgatacggttcaaaattttgaaaagttcgattcagcttcaaaaaaaggttatggactctattttaaaaaaattaaaagcagatcatttctgcacactctcaagaaagcttttgagatatatgaagataaaaaagagtttaataaaatcattaaacacaacatgaaatgcgatttttcttgggagtttagtgcaaaagagtatattaaactgtataaaagtattgcaaagtga

SEQ ID NO: 10800 - protein, 107 aa, Unknown
  Obtained from environmental sample
  misc_feature (1)..(107): Xaa is any amino acid
MPSHFEPCGLNQLIAMNYGAMPIVNHVGGLVDTVQNFEKFDSASKKGYGLYFKKIKSRSFLHTLKKAFEIYEDKKEFNKIIKHNMKCDFSWEFSAKEYIKLYKSIAK

SEQ ID NO: 10801 - DNA, 795 bp, Unknown
  Obtained from environmental sample
  misc_feature (1)..(795): n is a, c, g, or t
atgaacattatcggtgagttgcttgttgctaaaaactcactgccttatcttgctgacggggtgcacaagatgaacccggatggcataaagcgcgcgatcatggaaaaatatacctttatcaaccgtctttctgaacagttgcaagacctgatcatgtctatgcgtatgcttccgatctcttatgtctttgaccgttatccaaaactggtgcgcgatattaccaaacagcttgataaaaaagtcaagttgacgatggagggaggagagacgaaactggacaagaatatcatcgagatgatggcagacccgatgatccacatcatgcgaaactctctggaccatggaatagaactgcctgaagaacgcgaagccaaaggcaagtcggcagaaggcaatgtgaatctaaaagcgtatgcccagtccgacaagatcattatcgagataaaagatgacggggcggggatcaatgtcgagagggtcgtgcaaaaagtcatcgacaagggtctgatgacaccggagcagatcgatgcccttgatgataacggtagagccgagttggtactcttagcagggctttcaacggcagatacgatcaccgagtttagtggacgcggtgtcggtatggatgttgtgaaaaagtctatcgaaagctttggaggaacgatcagtattcgaaccgcccaagatttgggtaccaccatcactctgggcaattcccgtcctccttggaaggtgacctccctttttacccctagaaaattaaacagttgtttcattaccggtcctgcccaatga

SEQ ID NO: 10802 - protein, 264 aa, Unknown
  Obtained from environmental sample
  DOMAIN (99)...(244): Histidine kinase-, DNA gyrase B-, and HSP90-like ATPase
  misc_feature (1)..(264): Xaa is any amino acid
MNIIGELLVAKNSLPYLADGVHKMNPDGIKRAIMEKYTFINRLSEQLQDLIMSMRMLPISYVFDRYPKLVRDITKQLDKKVKLTMEGGETKLDKNIIEMMADPMIHIMRNSLDHGIELPEEREAKGKSAEGNVNLKAYAQSDKIIIEIKDDGAGINVERVVQKVIDKGLMTPEQIDALDDNGRAELVLLAGLSTADTITEFSGRGVGMDVVKKSIESFGGTISIRTAQDLGTTITLGNSRPPWKVTSLFTPRKLNSCFITGPAQ

SEQ ID NO: 10803 - DNA, 381 bp, Unknown
  Obtained from environmental sample
  misc_feature (1)..(381): n is a, c, g, or t
atgattgaaaatgttcaatcaaaagaagccaaagtggttacagaagctctaatagagatgatacaaccaatcaaaaatataactcatacaatcacaagtgacaatggaaaagagtttgcatatcacaaagagatttcagctgcactagacactaagttttacttcgctaatccatatcattcatgggaaagaggattaaatgaacacaccaatggtttaatacgtcaatacttaccaaagaaaagtgtgtttacaaatgtttctaaggatgaaattattatgattcagaacagacttaatcacagacctagaaaagtgttaggttataaaacaccttatgaagtttttttcaaggagctgagtcgaaaattagctagttaa

SEQ ID NO: 10804 - protein, 126 aa, Unknown
  Obtained from environmental sample
  DOMAIN (1)...(117): Integrase core domain
  misc_feature (1)..(126): Xaa is any amino acid
MIENVQSKEAKVVTEALIEMIQPIKNITHTITSDNGKEFAYHKEISAALDTKFYFANPYHSWERGLNEHTNGLIRQYLPKKSVFTNVSKDEIIMIQNRLNHRPRKVLGYKTPYEVFFKELSRKLAS

SEQ ID NO: 10805 - DNA, 582 bp, Unknown
  Obtained from environmental sample
  misc_feature (1)..(582): n is a, c, g, or t
atgaaaacagaaagaaaaaaagagctattagaggctttaaagaatatcccagattatagagtagatgtaggtaaaatagagtatcccctatacgaagtattatttatgacactatttgcattacttaaaggcaatacaacttttaaagatatttttgtttggatgacatttaacaaagagaatgaaatactcaaagaagtatttgaaaaagagaagataaatgtaccttctcgttctacattgcataccttacttattaacacagataacaatgccttagaagctgtttttagagaatatttttttgagtatattcttcaaaagagtattgcaattgatgggaaatggctcagaggaagtgatgttaatggacaatatacacaagagtcccataaagccatacttaatattttagataaagatatcaaaattgtttttgcacataaatttttagataaaaataaaaagagtgagataagagcacttcaagagatacttgatgataaactttttagtggtgagggtcaaatcttctcatttgatggcctattaacacaatcaaacattcctcatactatcaat

SEQ ID NO: 10806 - protein, 194 aa, Unknown
  Obtained from environmental sample
  misc_feature (1)..(194): Xaa is any amino acid
MKTERKKELLEALKNIPDYRVDVGKIEYPLYEVLFMTLFALLKGNTTFKDIFVWMTFNKENEILKEVFEKEKINVPSRSTLHTLLINTDNNALEAVFREYFFEYILQKSIAIDGKWLRGSDVNGQYTQESHKAILNILDKDIKIVFAHKFLDKNKKSEIRALQEILDDKLFSGEGQIFSFDGLLTQSNIPHTIN

SEQ ID NO: 10807 - DNA, 648 bp, Unknown
  Obtained from environmental sample
  misc_feature (1)..(648): n is a, c, g, or t
ttgtttagcttggggttccaaaaaggattctatttcggtttgatattggatccaaacaccaaagtgttgaaagttgaaaattcaggtggttattcagtagatttaatggatgaagatattgatattccaaatgcggtaaaaagtggattagaagattatgagtatatatttttagatactccatctaactttaagccaggacaagaagattatgagagaataatatctgtattagatcaggttgatttatttcttatacctctacaaactggaagtagaagtgtagaagctacacttacaactttagatatgctttttggaagaggtacgactgcaagaacaagaccagtaaaattattgtttatattaaatgatataattttaactggacttaaagaagatacactaaaaaaagctaaagagtatgttcacaaaaatattattgaagatttaaatactattgagtttacagtaaaaatagaaaaaatatatattgactattttatgcactctaaagctattgatagacttgaagatgaagatatcactatggataaactttatgaatctaatagaggtggttatagagttataaatagtaaaataaatgaaatctcaaaaaatattattgagatattgaaaggttaa

SEQ ID NO: 10808 - protein, 215 aa, Unknown
  Obtained from environmental sample
  misc_feature (1)..(215): Xaa is any amino acid
MFSLGFQKGFYFGLILDPNTKVLKVENSGGYSVDLMDEDIDIPNAVKSGLEDYEYIFLDTPSNFKPGQEDYERIISVLDQVDLFLIPLQTGSRSVEATLTTLDMLFGRGTTARTRPVKLLFILNDIILTGLKEDTLKKAKEYVHKNIIEDLNTIEFTVKIEKIYIDYFMHSKAIDRLEDEDITMDKLYESNRGGYRVINSKINEISKNIIEILKG

SEQ ID NO: 10809 - DNA, 552 bp, Unknown
  Obtained from environmental sample
  misc_feature (1)..(552): n is a, c, g, or t
gtgcaagagtttacaaattggactgtagatactatacgaagtgataagcttttaggtgcttggctagaggagcgtaaatttgattggctccctttagtatctcaaactatcattaatattatagataaaaacaaatcagtacttattatcactgatgatgagcacgactggtttatgagatatattttaattaatattaataaaaagaaactctctcgaccctatttcccattttatgcttttaactctttccattcaaatattgataatataaaaacagaaaatgatatacaactaatacacgatatgcttgataactcttttccaaatggatactttttttggtatataggaaaaagtagaagtaaaagagcaaccttagcaaaaatatcgaaacaaccatttttatggttaatggatgaagagttatcaaatagtttttatttagatagtaatgatgaagctttagatatacgacttttaaatatgtatcgactttttaataaaactcttgacgctgttctttgcgctcaaattgatgtaactaaatga

SEQ ID NO: 10810 - protein, 183 aa, Unknown
  Obtained from environmental sample
  misc_feature (1)..(183): Xaa is any amino acid
MQEFTNWTVDTIRSDKLLGAWLEERKFDWLPLVSQTIINIIDKNKSVLIITDDEHDWFMRYILININKKKLSRPYFPFYAFNSFHSNIDNIKTENDIQLIHDMLDNSFPNGYFFWYIGKSRSKRATLAKISKQPFLWLMDEELSNSFYLDSNDEALDIRLLNMYRLFNKTLDAVLCAQIDVTK

SEQ ID NO: 10811 - DNA, 378 bp, Unknown
  Obtained from environmental sample
  misc_feature (1)..(378): n is a, c, g, or t
atgaaatacatcaaaaatactgatatcatttatacagatctttggtggtggattgatcaagaagttgagaagaacgtacgaaaagaagttttcttcgataaataccaagttgatatggaaatgatcaaaaaagctaaaaatccagatgtaaaatttatgcactgtttaccagctaacagggaaatggaagtaacctcagaagttctagatggtgactattcattggcttatgaattgactgagaatagattgtatattcaaatggctgtgctaagttactacatgttccaacacaaacaacttccttcaaaagaagtgttaaaagaacacaatgataatatatgtaatcaattaaaaagaatgactaatatactttag

SEQ ID NO: 10812 - protein, 125 aa, Unknown
  Obtained from environmental sample
  DOMAIN (1)...(95): Aspartate/ornithine carbamoyltransferase, Asp/Orn binding domain
  misc_feature (1)..(125): Xaa is any amino acid
MKYIKNTDIIYTDLWWWIDQEVEKNVRKEVFFDKYQVDMEMIKKAKNPDVKFMHCLPANREMEVTSEVLDGDYSLAYELTENRLYIQMAVLSYYMFQHKQLPSKEVLKEHNDNICNQLKRMTNIL

SEQ ID NO: 10813 - DNA, 537 bp, Unknown
  Obtained from environmental sample
  misc_feature (1)..(537): n is a, c, g, or t
gtgtttttagataataccaaactgaaagaaataggtgaagaagtaaatatatctctcatgactgtcagcaaaattagaagaaagatctttgatgcattgtattcttctgatcgatttaataagtatttagctaaacatttctatgaccctttcgatacaactacaatttttataccaaacatagattatagtaaactctattattaccagtacaacgaagaatcaattcttgctttcattgaatataagaatggaaaatacttatcttcttcatactcaagaaaagatttcaacactttaatgacaagtatcaattatccgaaattaatattcgtaccctttatagaaattgaaagacaaagtgctataactcatattgaaggactaatagcttttcttaaaacctttagaggaataaaaaaagaattactgtcccagtactcaaatttctacgacttcaaaacaaactatgataatgaatcattagttgataggattattcaccgaatctcaacacataaaaaaaagaatggctaa

SEQ ID NO: 10814 - protein, 178 aa, Unknown
  Obtained from environmental sample
  misc_feature (1)..(178): Xaa is any amino acid
MFLDNTKLKEIGEEVNISLMTVSKIRRKIFDALYSSDRFNKYLAKHFYDPFDTTTIFIPNIDYSKLYYYQYNEESILAFIEYKNGKYLSSSYSRKDFNTLMTSINYPKLIFVPFIEIERQSAITHIEGLIAFLKTFRGIKKELLSQYSNFYDFKTNYDNESLVDRIIHRISTHKKKNG

SEQ ID NO: 10815 - DNA, 555 bp, Unknown
  Obtained from environmental sample
  misc_feature (1)..(555): n is a, c, g, or t
gtgatattatgtttacttgatttgccgactgaaaaaagattaaaaatatttttaccagcatgggctcctgattgtatcgagtataataacttagatatcacgagaggaaaactcaacaacctaaaagctactgacttaagagagtataacttaatagcaactaccgatggacattttgcatttagtgagtttggtttgaatcgagatgcggtattttcaagttttaaaatacttgaactacttcaaaaatctggaaaaacactctctaatataattgcacatatcccatattttgcttataaaggtgaaaatgtagcatgccctagtgaatttaaagggaagatgatgagaaagtttctagaggatgggaaaaataaaaaaactagctctgtagatggtgtgaaaatttggataagtgatgatgaatggattctaatggttccagatgaatacaatgattatttaaatatctatatccaagcagatgatgagaaaaatgctagtaaaatattctggaaataccaagaaaaaattgagaactggattagtgaataa

SEQ ID NO: 10816 - protein, 184 aa, Unknown
  Obtained from environmental sample
  misc_feature (1)..(184): Xaa is any amino acid
MILCLLDLPTEKRLKIFLPAWAPDCIEYNNLDITRGKLNNLKATDLREYNLIATTDGHFAFSEFGLNRDAVFSSFKILELLQKSGKTLSNIIAHIPYFAYKGENVACPSEFKGKMMRKFLEDGKNKKTSSVDGVKIWISDDEWILMVPDEYNDYLNIYIQADDEKNASKIFWKYQEKIENWISE

SEQ ID NO: 10817 - DNA, 621 bp, Unknown
  Obtained from environmental sample
  misc_feature (1)..(621): n is a, c, g, or t
ttgactgtaaaggcgattatgtcatataagtttgaaatagatcaaaactatctacatttagaaaatccactaaaaaatatagaaactatttttagctctcatgatgagagtgtccatgaagccagaaatgtactaaaaattatagatattgatggagtctctacagtagtaaaatattttaaaataccacaccttttaaataagggagtttatactttctttcgtaaatcaaaagcttataaatcttaccacaatgcgcaatacttacgctctcttggagttgaaacccctgaaccaatcgcactgtttgaattttttaaaaactctcttttagatgagagctattttgtagcaaaagagtttaaatatgattttgatattagaaaagtacttcttgaagagcctaaagagaaggttcaaatattaaaagagtttgctcattttacatttgatcttcatcaaaaagggatctggcacagtgactactcccctgagaatatcttgattaaaaaagtaggtgagagttacactttttcctttgtagatataaatagaatgaatttcaaaaatattaccgactatgatggtttagaaaaatttcaacaagctctgggccagtga

SEQ ID NO: 10818 - protein, 206 aa, Unknown
  Obtained from environmental sample
  misc_feature (1)..(206): Xaa is any amino acid
MTVKAIMSYKFEIDQNYLHLENPLKNIETIFSSHDESVHEARNVLKIIDIDGVSTVVKYFKIPHLLNKGVYTFFRKSKAYKSYHNAQYLRSLGVETPEPIALFEFFKNSLLDESYFVAKEFKYDFDIRKVLLEEPKEKVQILKEFAHFTFDLHQKGIWHSDYSPENILIKKVGESYTFSFVDINRMNFKNITDYDGLEKFQQALGQ

SEQ ID NO: 10819 - DNA, 576 bp, Unknown
  Obtained from environmental sample
  misc_feature (1)..(576): n is a, c, g, or t
atgttaaataaattaaaaataaaatatctagttattattataattttaattggattctgtattggcttttttaatattagctggcctagtcttaaactctcaaatcataaagtcacttatatacaagataagcttaaaagcggtgaattatcacctaaaatggtaataataccgccaggtacaggtatcatcggcggtgaaaattttcgctcttttcaagatgaagcacctatttttaaagcgaaaataaaagaaagctatgcactaagtgaaaccgagattacctttgaacaatatgatcagttttgtaaaaccggaattaggtcttgccctgacgacgaaggctggggccgtggtaagcaacctgttgtaaatatatcttggtttgatgctgttgcttacacaaagtggctaagcaaagaaactgataatatttatcgcctgcctagcgaagttgaatgggaatacgcggccagagctaaaacaactagtaagttctggtggggtaatgattatgaacaaggcattgatcactgcgacagagacttaggtggttgccctaaaggttctgattag

SEQ ID NO: 10820 - protein, 191 aa, Unknown
  Obtained from environmental sample
  DOMAIN (50)...(191): Domain of unknown function (DUF323)
  misc_feature (1)..(191): Xaa is any amino acid
MLNKLKIKYLVIIIILIGFCIGFFNISWPSLKLSNHKVTYIQDKLKSGELSPKMVIIPPGTGIIGGENFRSFQDEAPIFKAKIKESYALSETEITFEQYDQFCKTGIRSCPDDEGWGRGKQPVVNISWFDAVAYTKWLSKETDNIYRLPSEVEWEYAARAKTTSKFWWGNDYEQGIDHCDRDLGGCPKGSD

SEQ ID NO: 10821 - DNA, 822 bp, Unknown
  Obtained from environmental sample
  misc_feature (1)..(822): n is a, c, g, or t
atggaggctctcattaagtctttaacaaaaacagatttcaaaactagatacagtacaatttcaaattcttatcatttggataatgatgaatcttattctagcgagaaagttaaagtagctataatcgaactagctgatgaatttattaatgaagaaatttcatgggaatcccatttcccaatattttatactaatcaacaaatatattcctatcactttggtaagaggatttatgaactgattagtgacaatcctaaaaagttaaatgaatttattgacctatccataaaaatagtacttgacttaaaaaaagaagatagaaacgttactgtttttggtggcttcatatctgaagcgaatgatgaaattaaagaggcgttctacaagtcactttcaaataatgaagagctaaattatctactcttttatttcctttcaattgacaataaaggaaaagagtttttctacttattatttgaattaattgatagtggtaaatgtgaactagacaactttaatgtgttcagttatagcaattcacttggtcactgtaatcaaaaagaacttgaaaaattcagcaaaaaactattctattatggggacgaagggtacgccttggtatttgacctatattttaatttaggttataacaatgatgtgttaaaggcttctttgctacccatattcaaagagtgtatttttagattaggagctaacaaaaaagaaataagacaattagataactacaaatggtcacaaaccatctgttctattttgtcttcaaatcaagaattagagtttgctaagttatcaataacctaa

SEQ ID NO: 10822 - protein, 273 aa, Unknown
  Obtained from environmental sample
  misc_feature (1)..(273): Xaa is any amino acid
MEALIKSLTKTDFKTRYSTISNSYHLDNDESYSSEKVKVAIIELADEFINEEISWESHFPIFYTNQQIYSYHFGKRIYELISDNPKKLNEFIDLSIKIVLDLKKEDRNVTVFGGFISEANDEIKEAFYKSLSNNEELNYLLFYFLSIDNKGKEFFYLLFELIDSGKCELDNFNVFSYSNSLGHCNQKELEKFSKKLFYYGDEGYALVFDLYFNLGYNNDVLKASLLPIFKECIFRLGANKKEIRQLDNYKWSQTICSILSSNQELEFAKLSIT

SEQ ID NO: 10823 - DNA, 615 bp, Unknown
  Obtained from environmental sample
  misc_feature (1)..(615): n is a, c, g, or t
ttgtcagtatggcaagactggaaatcattaacaaatacatctcaaaaatatcatgagaatgagataataaataagattaccagtcaaataaaaaacggtattaaaaaaccaaatgaaagtatacgactaattggtttatctggtttaggtaaaaccagaatattacttgaagcatttagagcaaatgaatcggaagaatcaatcaatctaaatagtagagttctttatctaaactgtaattacaattccagtgctgattatcagtcaattttcacaaagctgacaaaagaaaaggaagacaggatagttattttagataattgttcaagaacactgcacagacaacttcttcatttcattcaaaatgagaacaatatcatttcgttaattacaattgattctaatcctgaagagcttgagcaagacaagataaatggagtaaactacattctaattaaaaaagaagatttatcatcaattgttgaacagattttaacagaagattttgaggtactagggaaagacaatatcgagaaaatcaaagaattttctcagggtatacctttaatggcgggtcttattggagagagtataaaaaatggagaaaaatttatt

SEQ ID NO: 10824 - protein, 205 aa, Unknown
  Obtained from environmental sample
  misc_feature (1)..(205): Xaa is any amino acid
MSVWQDWKSLTNTSQKYHENEIINKITSQIKNGIKKPNESIRLIGLSGLGKTRILLEAFRANESEESINLNSRVLYLNCNYNSSADYQSIFTKLTKEKEDRIVILDNCSRTLHRQLLHFIQNENNIISLITIDSNPEELEQDKINGVNYILIKKEDLSSIVEQILTEDFEVLGKDNIEKIKEFSQGIPLMAGLIGESIKNGEKFI

SEQ ID NO: 10825 - DNA, 411 bp, Unknown
  Obtained from environmental sample
  misc_feature (1)..(411): n is a, c, g, or t
gtgaagaatggtgcttttagtacactcctgggtaaatctgaaatagaactcatacaagtactcaacagagaaccaaaagatatttataaggatagaatttggggtgatccaggttttatacatttatgttttgacatgaatgatatggattctttaagagaaaaagctaaagaaaacggattcccttttacggtagatagtgccagagcgatgaatacttttgatatgggagaagctgcaggtaattttgcttatatccaagctccagaaggcacattaatagagtttgtagaaacccataaaatacctttagttaaaaaaattggatggtatatcgattttagaaaacggggcaatcaccccttgcctaattggatgttgaacttgtttcggtttaaacgtgtaaaataa

SEQ ID NO: 10826 - protein, 136 aa, Unknown
  Obtained from environmental sample
  misc_feature (1)..(136): Xaa is any amino acid
MKNGAFSTLLGKSEIELIQVLNREPKDIYKDRIWGDPGFIHLCFDMNDMDSLREKAKENGFPFTVDSARAMNTFDMGEAAGNFAYIQAPEGTLIEFVETHKIPLVKKIGWYIDFRKRGNHPLPNWMLNLFRFKRVK

SEQ ID NO: 10827 - DNA, 678 bp, Unknown
  Obtained from environmental sample
  misc_feature (1)..(678): n is a, c, g, or t
atgaaaacaaaaattttaatcatagaagatgagacaatagttgctcttgatattaaaagtgccttggcaaatctaggttatgtagtaacttcaatagctacaaatcatacagaagcatttatgagtattgaagaaaatatacctaatataattttaacagatatcaacctagaaaatagtatagatgggattgagatagttcaagagatacaaaaaacaaaaaatatccctgtgatatatttaactgcatttagtgatgatgatacaatcaatagagctatccaaaccaatcctgtaggctatctactcaaaccatttcaaacaaatgagttaaaatcaacgattcttttagctatatataaatcaaaacaaccccttacacaaaccacacacaatagatataaatatttgggcaataactacttttatgatgaagagaagaaaaaattatattttaaagaagtggagataaagttaactcanaaagagagtatattattagatattttatacaaagaaaaaggaaatatagtaccatttgaaactattgaatatcttatttgggaagatgctagtgtttctgatagtacccttagaactttaatatatcgtctaagaagtaaattagagtataaacttatagaaaccattcctctaaatggatgtaaacttttataa

SEQ ID NO: 10828 - protein, 225 aa, Unknown
  Obtained from environmental sample
  DOMAIN (154)...(224): Transcriptional regulatory protein, C terminal
  misc_feature (1)..(225): Xaa is any amino acid
MKTKILIIEDETIVALDIKSALANLGYVVTSIATNHTEAFMSIEENIPNIILTDINLENSIDGIEIVQEIQKTKNIPVIYLTAFSDDDTINRAIQTNPVGYLLKPFQTNELKSTILLAIYKSKQPLTQTTHNRYKYLGNNYFYDEEKKKLYFKEVEIKLTXKESILLDILYKEKGNIVPFETIEYLIWEDASVSDSTLRTLIYRLRSKLEYKLIETIPLNGCKLL

SEQ ID NO: 10829 - DNA, 402 bp, Unknown
  Obtained from environmental sample
  misc_feature (1)..(402): n is a, c, g, or t
ttgttctcgcttcctcctccgttagttaatcttggtgagctgataaattatatagtgacaagtgcaaaggtcgataaagagctgattttacattatgctaatgagatgaagcttgatatcaactccaatttatacaaatcattttttaaattgagtggtggcatgaagcagaagatgttgattgcaatcagtttagccaaaaaaagtaaaataatcatatatgatgagccaacggcaaatcttgatccaaaagcaagagatgacttttataaacttctaaaacagaatgaagatgacaaaatcctcttatttgttacacatagactccaagaggttaaagagcttgtaaacagacaggtatatatggatatgggaaaagtagtctcagatgaaagagtttaa

SEQ ID NO: 10830 - protein, 133 aa, Unknown
  Obtained from environmental sample
  DOMAIN (1)...(125): ABC transporter
  misc_feature (1)..(133): Xaa is any amino acid
MFSLPPPLVNLGELINYIVTSAKVDKELILHYANEMKLDINSNLYKSFFKLSGGMKQKMLIAISLAKKSKIIIYDEPTANLDPKARDDFYKLLKQNEDDKILLFVTHRLQEVKELVNRQVYMDMGKVVSDERV

SEQ ID NO: 10831 - DNA, 330 bp, Unknown
  Obtained from environmental sample
  misc_feature (1)..(330): n is a, c, g, or t
atgaaagagtttaaaaatctattttttatctttatatttatgagtatattcataggatgcagctcatctgaaaaaaaagttgaaagcagtgtgaaagtgtgcgtaaagtgtaatatggatcttacaaaatcaaatatctacagtgcaactcttaacagagataatcatcactactattttgatgatataggatgtatgattttatgggcaaaacaagaaaatattgaactttcaaaagttgatgcaaaagtattctcttatgatacaaaaagatatatagatgcttctggcgccaattataaaattgatgagaccccccctatgaattaa

SEQ ID NO: 10832 - protein, 109 aa, Unknown
  Obtained from environmental sample
  misc_feature (1)..(109): Xaa is any amino acid
MKEFKNLFFIFIFMSIFIGCSSSEKKVESSVKVCVKCNMDLTKSNIYSATLNRDNHHYYFDDIGCMILWAKQENIELSKVDAKVFSYDTKRYIDASGANYKIDETPPMN

SEQ ID NO: 10833 - DNA, 528 bp, Unknown
  Obtained from environmental sample
  misc_feature (1)..(528): n is a, c, g, or t
atgggagttaatatgttcagtaaaataggtgtttgtattataaaaaaagtattagttggagctatcttagtctcttgtgtctcatttgcatcagatataggtaactcaaatgagatgagttatgacaaagagacaacttgcatagttaggcatctgaaagtttatgaagagcctagttgggtagcaaagattaatcttagtaacggtaaaaagctatatttttgtagtccgaaatctatgattgagttttatcatcaacctggaaaatggcatgaaattggagtaaaaagtgaagatgattttaaagatatcatcgtaacagactattcgagcaagagagcaattgaagccagaggtgcattttatgtttacggaagtaatataacatcacctgctggagatgacttagtccctttttcaacatatgaagatgcaaaaaagtttgctaaaaaatataatggtaaaagagttcttaattttagtgagattaaagaggctctgataagactcttaaatggaagaatataa

SEQ ID NO: 10834 - protein, 175 aa, Unknown
  Obtained from environmental sample
  DOMAIN (20)...(170): NosL
  misc_feature (1)..(175): Xaa is any amino acid
MGVNMFSKIGVCIIKKVLVGAILVSCVSFASDIGNSNEMSYDKETTCIVRHLKVYEEPSWVAKINLSNGKKLYFCSPKSMIEFYHQPGKWHEIGVKSEDDFKDIIVTDYSSKRAIEARGAFYVYGSNITSPAGDDLVPFSTYEDAKKFAKKYNGKRVLNFSEIKEALIRLLNGRI

SEQ ID NO: 10835 - DNA, 489 bp, Unknown
  Obtained from environmental sample
  misc_feature (1)..(489): n is a, c, g, or t
ttgctgccaaaggtaaaagtgaaattgaaaaagtttcatagtccagatccaggactttcaaatatgacttttgagcaattcttaatattttcagaaacttattattctcaatacattaagtctggcgaagaggaacatctaaacttatttattgcaagtctttacactcgcgaaaaaaatatttttgattcagatctaattgagaaaaatgctaaacttttaagcaaattatctgtaccagaaaaaactgcaattcttttcttttatcaaggaagcagacattatttaggattaaaatttcctgaactttttagcagcaaaaatgaaggaagtgcagaaaaagaatatgattttcttggagttgcagaacttctcaataaggaagatgtatctaaaaataatacaattagaaaaactaatatttacgaaattttcaccagattaactaacctcataaaacaacaaaatgaacgaaaacataataagtaa

SEQ ID NO: 10836 - protein, 162 aa, Unknown
  Obtained from environmental sample
  misc_feature (1)..(162): Xaa is any amino acid
MLPKVKVKLKKFHSPDPGLSNMTFEQFLIFSETYYSQYIKSGEEEHLNLFIASLYTREKNIFDSDLIEKNAKLLSKLSVPEKTAILFFYQGSRHYLGLKFPELFSSKNEGSAEKEYDFLGVAELLNKEDVSKNNTIRKTNIYEIFTRLTNLIKQQNERKHNK

SEQ ID NO: 10837 - DNA, 738 bp, Unknown
  Obtained from environmental sample
  misc_feature (1)..(738): n is a, c, g, or t
ttgggaaaaggtgttacatataagctacttctgcaaaatgaaacacacagacgaatactagtagttgagccagagatagagattatttttatggcgcttcattttaatgactttacaaaagagatagaagagaaccgtttttggattctaaccgaagatcagttagatatatcattagcttctgtatatatttttggtcacgatgaggctaaaatttatgccaaaacataccatttagaagtatttaatgatttttatatgaataattaccacgaaaatatagtagctgttaataagctttttatacgctctatcgagcatgtaattacttcagtcggtaatgactcaacagatgctcttataggactggaacatcaagttgcaaatgttaaaaagatggttgagacaccaactctttttggcatgataaaaaaagttaaaaattctaatactgtagtcatagtctcaactggtccatctttggcaaaacagctttctcttttaaaagagataaaagacagtgtgacaattttttgtatagactctagttttcccattttagaaaaacacggaattaaacctgacttagtattctctttagagagggtggctgcaactggactgttctataaacaagtatctaaagagtttcaagaagatgtgatctctgtaattacatccatagcacacccatcactttttacacatattaaagcatggtacattagtaatttgtga

SEQ ID NO: 10838 - protein, 245 aa, Unknown
  Obtained from environmental sample
  DOMAIN (125)...(245): Protein of unknown function DUF115
  misc_feature (1)..(245): Xaa is any amino acid
MGKGVTYKLLLQNETHRRILVVEPEIEIIFMALHFNDFTKEIEENRFWILTEDQLDISLASVYIFGHDEAKIYAKTYHLEVFNDFYMNNYHENIVAVNKLFIRSIEHVITSVGNDSTDALIGLEHQVANVKKMVETPTLFGMIKKVKNSNTVVIVSTGPSLAKQLSLLKEIKDSVTIFCIDSSFPILEKHGIKPDLVFSLERVAATGLFYKQVSKEFQEDVISVITSIAHPSLFTHIKAWYISNL

SEQ ID NO: 10839 - DNA, 864 bp, Unknown
  Obtained from environmental sample
  misc_feature (1)..(864): n is a, c, g, or t
atggctgagtcagcagacttttacgcgtggatttacggagaggccgaagttgaaggcaaaagaggggaaactgtagcaaaaggaggagtgaaggagttgggattctgtttcaatgcacagctaaactccaatgactttttaacaggagagactcctgaaggtgatttcaagagcactaaagcactcaaaaattatctaagtgcaaaatataaaaaagacttttatgtttgtgataataaaaaagagtatctcatgaagctttatgcatctttcaacaatgaatcctctatgccatatgatgatgcgaaaagtgcagcaaaagcctttgtgaaatatatatatccgacaaaagccgacaatgtaagcagttttgtcaagcaagagctactcgatagaaacaatcttgaggctatcgtaaaggatttacgagagtccatacacacatactcaagaattcaaaaagaagctgagattattgctgagagtgaaaaaaagctggggataatagcaaaagagtgcagaagtgttctcttgcaatggcgagattattacgatcaagagtatatattccttaaaagggagtattacagaaatcttgagcataaaaatgcccaagaggttaaattgagtaaaattgaaaatcagcaaaagaaactcgaaaataatttatataagcttgagcaaacagagtcggggctatctgaagagttgaagcttcttgaggagatgctagaaggtaatgaaaaaattcagaaaagaaacgacctgctaaaaaagatagatgcattaagaacaatcatctctgatatcgagacaaaaataaatcctctttcgaggcattcgcccatgcttacacatacttag

SEQ ID NO: 10840 - protein, 287 aa, Unknown
  Obtained from environmental sample
  misc_feature (1)..(287): Xaa is any amino acid
MAESADFYAWIYGEAEVEGKRGETVAKGGVKELGFCFNAQLNSNDFLTGETPEGDFKSTKALKNYLSAKYKKDFYVCDNKKEYLMKLYASFNNESSMPYDDAKSAAKAFVKYIYPTKADNVSSFVKQELLDRNNLEAIVKDLRESIHTYSRIQKEAEIIAESEKKLGIIAKECRSVLLQWRDYYDQEYIFLKREYYRNLEHKNAQEVKLSKIENQQKKLENNLYKLEQTESGLSEELKLLEEMLEGNEKIQKRNDLLKKIDALRTIISDIETKINPLSRHSPMLTHT

SEQ ID NO: 10841 - DNA, 807 bp, Unknown
  Obtained from environmental sample
  misc_feature (1)..(807): n is a, c, g, or t
ttgagcttctggattttgaattgtattgctggtattgggaaagattttcaaacagattatttaatatttgcactagatagtaaaggggatacttttagaaaagatatctacagtgaatataaatctcatcgtcctgatgcaccagatgatctaaaagcacaattgcctgttgctattgattttatagaaaaaatgggctttataactgcatctaaagtagggtatgaggcagatgatattatagcttcacttgcaactgatggaagagacttgggcttaaatgtacgcattgtaagtcatgataaagacttgtatcaacttattggagagggtatatttatgtttgatcctataaaaaagaaaataataagcagtgatgattgttttaaaaaatatggagtgtatccaaatcaatttatagattaccaatctttacttggagatagtgcagataatgtaccaggtgtaaaaggggtaggggctaaaacagcagaagctttaatccaacaattcagtgacttggataatatttataaaaacatagaatatatagaaaaacctagatggcaaaaacttcttttagaaagtaaagagatggcttatattagtaaacagctcgttactttacatcatgatgcacattgtttaaatagttttggagatttagaaaagattgagctaccaaaagagaatcctattttaaagatagcagatacgcttatagaatacgatatgcataggattataaataaagtacataaaggatggattaaattaccaaaacaactgtcccctaaaggatattga

SEQ ID NO: 10842 - protein, 268 aa, Unknown
  Obtained from environmental sample
  DOMAIN (2)...(132): 5'-3' exonuclease, N-terminal resolvase-like domain
  misc_feature (1)..(268): Xaa is any amino acid
MSFWILNCIAGIGKDFQTDYLIFALDSKGDTFRKDIYSEYKSHRPDAPDDLKAQLPVAIDFIEKMGFITASKVGYEADDIIASLATDGRDLGLNVRIVSHDKDLYQLIGEGIFMFDPIKKKIISSDDCFKKYGVYPNQFIDYQSLLGDSADNVPGVKGVGAKTAEALIQQFSDLDNIYKNIEYIEKPRWQKLLLESKEMAYISKQLVTLHHDAHCLNSFGDLEKIELPKENPILKIADTLIEYDMHRIINKVHKGWIKLPKQLSPKGY

SEQ ID NO: 10843 - DNA, 726 bp, Unknown
  Obtained from environmental sample
  misc_feature (1)..(726): n is a, c, g, or t
atggaaaatataggtataaaagttgatgtggagtttttcaaaggtttacaaacaaaaagtaaagagcatttaaataatttaacacaagagatatatagtttaagtggtgaaacttttaatattaactctccaaagcagttaagtatagttttatttgaaatactcaaactcactcctcctaaaaagactgcaactggatatagtacaaatgaagcagttttagcaaaattaagagatgaccatgaagtgataccaaaactgctagagtatagagaagcttttaaacttcattcaacttatattgagccacttttagagttaggacttaaaaatgaggataatattatctatacatcatttttacaaactggaacagcaacaggaagattaagtagtaaaaatccaaatcttcaaaatatacctgtaagaacagaagctggaagagccataagaaaaggttttattgcaagagatggttataaactagttggtattgattattcacaaattgaattaagactactagcgcactactcaaaagacccagcactactagaagcatttaataataatctagatatccatttacaaactgctgtgaaaatatttggtagtgaggaagcaaaagagaaaagaaatattgcaaaatcaattaactttggtcttttatatgggatgggtagtagaaaacttggagagcagctgggatcctctcagccaatctga

SEQ ID NO: 10844 - protein, 241 aa, Unknown
  Obtained from environmental sample
  DOMAIN (8)...(240): DNA polymerase family A
  misc_feature (1)..(241): Xaa is any amino acid
MENIGIKVDVEFFKGLQTKSKEHLNNLTQEIYSLSGETFNINSPKQLSIVLFEILKLTPPKKTATGYSTNEAVLAKLRDDHEVIPKLLEYREAFKLHSTYIEPLLELGLKNEDNIIYTSFLQTGTATGRLSSKNPNLQNIPVRTEAGRAIRKGFIARDGYKLVGIDYSQIELRLLAHYSKDPALLEAFNNNLDIHLQTAVKIFGSEEAKEKRNIAKSINFGLLYGMGSRKLGEQLGSSQPI

SEQ ID NO: 10845 - DNA, 684 bp, Unknown
  Obtained from environmental sample
  misc_feature (1)..(684): n is a, c, g, or t
ttgactcaatttatgaaatatatctggcaatataaagcttggccccactttacagggaacagtaatgcattgttaaaaccgctgggtaaagtccgattcaaccagggatcattaatcgctcagattgggaatctggaaataacaaactggttgatatggtttcctgaatgcatgaatcggacaattctaaactcaaattcactgctggaacaaataatgattaaagcacgattttggaaaacttttgcccagacactacttaataacaggcaaacaaaaattatcaacagattgcttgatgccggccccaatggttttgaaggtgggttgaaaaacaaaaaatatatgggtatcgctcataccagtcgttctactgtccaaagagaattggctgatctcgttcaaaaaaaagttctggttcgactgcctggtgggggggagaaacaggagataaaggttttcgtcaaaattactcgtggtaacatctactatcggttcagccattatatcatcctcctaacctggcaaacccgggaccaaacctgtttaagatgcgcgcagttccgccataaagaaagtgaacctcttccaaacatttttttgccaacttccggcctctttggtcgatcaaaatccttcaaatggaaaggaaacttgttctttcggcaaatagaattccatctt

SEQ ID NO: 10846 - protein, 228 aa, Unknown
  Obtained from environmental sample
  misc_feature (1)..(228): Xaa is any amino acid
MTQFMKYIWQYKAWPHFTGNSNALLKPLGKVRFNQGSLIAQIGNLEITNWLIWFPECMNRTILNSNSLLEQIMIKARFWKTFAQTLLNNRQTKIINRLLDAGPNGFEGGLKNKKYMGIAHTSRSTVQRELADLVQKKVLVRLPGGGEKQEIKVFVKITRGNIYYRFSHYIILLTWQTRDQTCLRCAQFRHKESEPLPNIFLPTSGLFGRSKSFKWKGNLFFRQIEFHL

SEQ ID NO: 10847 - DNA, 909 bp, Unknown
  Obtained from environmental sample
  misc_feature (1)..(909): n is a, c, g, or t
ttggntgagataaatcgattgaatcttgctcctaatccatcgcatttagaaactgttgggccaatagttcaaggaatagccaaagctaaaatttggaataaatataagcatgactataataaactagctcctattataattcatggagatgctgcaattgctggacaaggagtggtttatgaaaccatacaaatgtcaaaattaaaaggatatagaactggaggaacaattcacttagtaattaacaatcaggttggatttaccacaaattatttagatgcacgttcaagcacatattgtaccgatattggtaaagtaataaaagctcctatttttcatgtaaacggagacgatgttgaagccctagtatatacaattcaactggcaatggaatacagatacactttccataccgatgtatttattgatattctaagctatcgaaaatttggtcataatgagggcgatgaacctagatttacacaaccattactttataaagaaataagtaaacacaaaaatccaagagatatttatggaaattatttagtcgataagggtatttattcaaaagatgaattaaaaaaattggatattgagtacaacgcaatgctcgagaataaacttgaactggcacgaaaagctgagaaattgcatatcanacaatttttagtagaagattggcagaaatttcatcatcctgaanataatgagtttgaagaaactgtaaaaactggagtagataagaaaactattcaaaacgttgccgcaaagctgaataatcctccaaaagatttaaaattcttcaagaaagttgaaaaacttttgactgatcgaaataagatgatcgagaataataaactagattggggctatggcagaattgctagcttaccgaactttggttaa

SEQ ID NO: 10848 - protein, 302 aa, Unknown
  Obtained from environmental sample
  DOMAIN (1)...(221): Dehydrogenase E1 component
  misc_feature (1)..(302): Xaa is any amino acid
MXEINRLNLAPNPSHLETVGPIVQGIAKAKIWNKYKHDYNKLAPIIIHGDAAIAGQGVVYETIQMSKLKGYRTGGTIHLVINNQVGFTTNYLDARSSTYCTDIGKVIKAPIFHVNGDDVEALVYTIQLAMEYRYTFHTDVFIDILSYRKFGHNEGDEPRFTQPLLYKEISKHKNPRDIYGNYLVDKGIYSKDELKKLDIEYNAMLENKLELARKAEKLHIXQFLVEDWQKFHHPEXNEFEETVKTGVDKKTIQNVAAKLNNPPKDLKFFKKVEKLLTDRNKMIENNKLDWGYGRIASLPNFG

SEQ ID NO: 10849 - DNA, 777 bp, Unknown
  Obtained from environmental sample
  misc_feature (1)..(777): n is a, c, g, or t
atgtcagcgacactaaaacatataagttataatgatacaacaatagcacctatatttgaaaagaataaaaatctaccaatatttaacctccaattagtatttacaaacagtggatatataaacgatggagttaatccagggattacgaatattgtttctaaacttcttaacgaagggactaaaaaagatggtgcagtaaactttgctagaaaattagaaaataatgcaatatctataaatacatcaactggatttgaaacttttgttatagaggtaagttgtttaacaagtgaatatgaacttgctttgaactttttaacacaactcttaagtgacccaaatattacacaaaaatcactagataaaatcaaaactttacaatcaagtaaactcaaacaaaaagagaatgattttgactatgttgcatcatcaaatcttaaacaaataacttataaaaacacacctttagcacacacaagtgctggaactgttgatacaatagagaaaataaaacttaaagatgtgaaaaaaagactcaaagatattttaaatatagataaccttatcattgcagttggcggagatataagttttaaagagttttcttcccatagtgagcctattttaaaaaatctgaaatctcaagggaaaacagattttaataaaatagcaatttctagtaaacctaaaaacaaaattatactcaaagaaacagaacaatcatacatatacttttcaagtcctttctatattgattctgatcnaaaagagagctaa

SEQ ID NO: 10850 - protein, 258 aa, Unknown
  Obtained from environmental sample
  DOMAIN (16)...(164): Insulinase (Peptidase family M16)
  misc_feature (1)..(258): Xaa is any amino acid
MSATLKHISYNDTTIAPIFEKNKNLPIFNLQLVFTNSGYINDGVNPGITNIVSKLLNEGTKKDGAVNFARKLENNAISINTSTGFETFVIEVSCLTSEYELALNFLTQLLSDPNITQKSLDKIKTLQSSKLKQKENDFDYVASSNLKQITYKNTPLAHTSAGTVDTIEKIKLKDVKKRLKDILNIDNLIIAVGGDISFKEFSSHSEPILKNLKSQGKTDFNKIAISSKPKNKIILKETEQSYIYFSSPFYIDSDXKES

SEQ ID NO: 10851 - DNA, 708 bp, Unknown
  Obtained from environmental sample
  misc_feature (1)..(708): n is a, c, g, or t
ttgatattgaagtcgataaacttgaaaccagctgggatatgggattggagaaataagatggtaaaagctttaataataactggatttgggataaattgtgaagaagagatggctgcggcatatcaattagctggagccgaaacaagtattgttcatttgaatgatatatttctggggaaggtaaatatccatgattttgatatcctgaatttccccggaggattttcttttggagatgatcttggctcgggcaaagtattggctaataaaatgaaattcaagaaaacagcttccggcaaggtttttcttaaagagatagaggattttattgctgctggaaaatttattatgggcgtttgtaatggctttcaatttttagtaaaaatgggtttattgccggatgtatcaggcaataaatcacaagaggtaactcttactcgaaataactcagctaaatttgaagaccgctggtgcagattgaagattcatccaagtaataatacaccatttcttaaagatattgagatgatttacctccctgtgcggcatggcgaaggtaaattgattattggtgatgttgaaatcaaagaaaagataatagaacagaatctggattgtatgcattactgtgatgctgctggaaatcttacgaatgaatatcctctgaatcctaatggttcaaatcctaactgtgggagggttgtctga

SEQ ID NO: 10852 - protein, 235 aa, Unknown
  Obtained from environmental sample
  misc_feature (1)..(235): Xaa is any amino acid
MILKSINLKPAGIWDWRNKMVKALIITGFGINCEEEMAAAYQLAGAETSIVHLNDIFLGKVNIHDFDILNFPGGFSFGDDLGSGKVLANKMKFKKTASGKVFLKEIEDFIAAGKFIMGVCNGFQFLVKMGLLPDVSGNKSQEVTLTRNNSAKFEDRWCRLKIHPSNNTPFLKDIEMIYLPVRHGEGKLIIGDVEIKEKIIEQNLDCMHYCDAAGNLTNEYPLNPNGSNPNCGRVV

SEQ ID NO: 10853 - DNA, 579 bp, Unknown
  Obtained from environmental sample
  misc_feature (1)..(579): n is a, c, g, or t
ttgaatattttattgctagataatgatgaaagtctaaaagaactgttaaatcactatataactatggaacaagattggaatctattccataacaagttgtacgatgatactagcttcactattgatgatatagatgtgattatagtagattatttaaaagaaaaatatagacaaactatagaagcaattatatcaacaaatagtaaaataaaaactataattataagcgatatattagaggctagttgttccatgggttgtgaatattgtgaaaataactataaaaggaaaagattactaaaaccaattgaacccaaagtgttgtacgaactaattaaaaactttgatataaagaaatgtgactattataaatcttttgaaaatataaaaaatattttaccaaatattttacaaagatttttatatttagaatacgacaaaatgtcacatcaagtaatatcaaaagttcaaaatcaaacaagtagatatactttcgagttagtaagtttcataaatattttagaaaaaaataatataaattatccatcaagagagctcagccatcctaacttgnnntaa

SEQ ID NO: 10854 - protein, 192 aa, Unknown
  Obtained from environmental sample
  misc_feature (1)..(192): Xaa is any amino acid
MNILLLDNDESLKELLNHYITMEQDWNLFHNKLYDDTSFTIDDIDVIIVDYLKEKYRQTIEAIISTNSKIKTIIISDILEASCSMGCEYCENNYKRKRLLKPIEPKVLYELIKNFDIKKCDYYKSFENIKNILPNILQRFLYLEYDKMSHQVISKVQNQTSRYTFELVSFINILEKNNINYPSRELSHPNLX

SEQ ID NO: 10855 - DNA, 387 bp, Unknown
  Obtained from environmental sample
  misc_feature (1)..(387): n is a, c, g, or t
ttgattataatctggcttataattaataaaaggatttataatatgttaaatattccaagtgaagcaactaaaatagaagttgaaggttcaactgttgatttttttgaattagcaaaagatggtgttagtgattactactttgatacttcaaaagagggacctcctcacccaatggtaaatgcaatgtgcggtttaaaacttgttaaaaagacaaataatagtcttgttatgtttaatcataaagctccaggtggactatttgacaagcttggtgctgatattgcttacgaaacagaagatattgaaggtggtttagttaaagttacttttaaagatgttaattcaggttttgatactgacttaaatcaagcttcttgtcacggttaa

SEQ ID NO: 10856 - protein, 128 aa, Unknown
  Obtained from environmental sample
  misc_feature (1)..(128): Xaa is any amino acid
MIIIWLIINKRIYNMLNIPSEATKIEVEGSTVDFFELAKDGVSDYYFDTSKEGPPHPMVNAMCGLKLVKKTNNSLVMFNHKAPGGLFDKLGADIAYETEDIEGGLVKVTFKDVNSGFDTDLNQASCHG

SEQ ID NO: 10857 - DNA, 570 bp, Unknown
  Obtained from environmental sample
  misc_feature (1)..(570): n is a, c, g, or t
atgaaggtattggtttttttctgctgggggaatttccaaaagaaaaaaggtaaaccagaaactaaatttggcaatttggtggcagatttaagtatggaaatagctcaaaaaacatataatggtaatatagatttttgtttatggaattttggtggactgagaacttctttgcctaaaggagaaattacccgtggaaaaatttttgaattaatgccttttgagaatgaattggtagtggttaccttatcagaaactaaatttctggaattaatggaatatttaaaaaatgttggaccacaacctatttcggggctttcatttgattttacaataaatattgaaaatgaaattaagaatttgttttctcaagaaggaacttctgaaatcaaaatcctcacatccgactatctagccaatggaggcgacaacatgactttttttctaaatcctattaaaatagaaaaagtagggataaaattgagagatgccattatacaatattgtgtagaacagcacgcacaaggaaagcaactaaatggaaaaatagaagggaggatagtttatgagtaa

SEQ ID NO: 10858 - protein, 189 aa, Unknown
  Obtained from environmental sample
  DOMAIN (10)...(149): 5'-nucleotidase, C-terminal domain
  misc_feature (1)..(189): Xaa is any amino acid
MKVLVFFCWGNFQKKKGKPETKFGNLVADLSMEIAQKTYNGNIDFCLWNFGGLRTSLPKGEITRGKIFELMPFENELVVVTLSETKFLELMEYLKNVGPQPISGLSFDFTINIENEIKNLFSQEGTSEIKILTSDYLANGGDNMTFFLNPIKIEKVGIKLRDAIIQYCVEQHAQGKQLNGKIEGRIVYE

SEQ ID NO: 10859 - DNA, 372 bp, Unknown
  Obtained from environmental sample
  misc_feature (1)..(372): n is a, c, g, or t
ttgatatccctgcccggaaaaatttacctttttttaaaccaaaccgcgggaacctttttccggttcaaattttatttacaaccttcaaaggttgttattgaagggtactttgcccgaaagtacaattgctttaacaaatataagatccctttttactatcttaccaaaaaaccattttgttatttaaatgcaagccataaaaagcaatttgtggacttaggttttgggaaaggaaatcagatacaaattcatcaagaacatctcattgccgaaaacagaaaaatgatggtgtcgttacgttataaatcttttgaagatattaatgatgccattttaatggaggtgcttaaaaaagtagagtctttgtattaa

SEQ ID NO: 10860 - protein, 123 aa, Unknown
  Obtained from environmental sample
  misc_feature (1)..(123): Xaa is any amino acid
MISLPGKIYLFLNQTAGTFFRFKFYLQPSKVVIEGYFARKYNCFNKYKIPFYYLTKKPFCYLNASHKKQFVDLGFGKGNQIQIHQEHLIAENRKMMVSLRYKSFEDINDAILMEVLKKVESLY

SEQ ID NO: 10861 - DNA, 804 bp, Unknown
  Obtained from environmental sample
  misc_feature (1)..(804): n is a, c, g, or t
ttgttgtggctggtacagtcgcgccgtttatttagattgggtggagtaagagcagagattagaaaaaataatgttcaaaatactaaggctacagatgccctaaatttttatacctctatgaataacagtttacttgaaatactattacttttaacacattatagtgataatgcaaaaacaacagcacaaatcattgcatattataacatcttagcaacaaaagatgatacagaacttataagatcttacggattaaatactataaatgaacttgacaacataacagatgaaaacgataatagtaagaatatattatatggacaaataaaattaaaatctatacttgcatcagaggagttaaagttaacagtatttttaaaaattgctagtaaagatacacttgatttttataataagttaataaaaacagtaaaacttgatgattacaatgaatttgtacgctctttagcaaatgatggggacttagagttgtatcaaggtgagggtgaaaacttttttaaactagctacaaaaaaggtcgttatgtttgaaaaaattgagaaacatgtatctagcaatataaaagagtatattgaaatattaaaaaaagaggctcaagctgtatttatcagtaatgtaatattgggtattattattttacttcttacaatggttttaggattaatgatatatagaagaattgattcagatatgaaacttcttaaaacaaatttattaggattttttgatttcatttccaaaaaacaagatgattttgatataaaagatgtagagggaaagtga

SEQ ID NO: 10862 - protein, 267 aa, Unknown
  Obtained from environmental sample
  misc_feature (1)..(267): Xaa is any amino acid
MLWLVQSRRLFRLGGVRAEIRKNNVQNTKATDALNFYTSMNNSLLEILLLLTHYSDNAKTTAQIIAYYNILATKDDTELIRSYGLNTINELDNITDENDNSKNILYGQIKLKSILASEELKLTVFLKIASKDTLDFYNKLIKTVKLDDYNEFVRSLANDGDLELYQGEGENFFKLATKKVVMFEKIEKHVSSNIKEYIEILKKEAQAVFISNVILGIIILLLTMVLGLMIYRRIDSDMKLLKTNLLGFFDFISKKQDDFDIKDVEGK

SEQ ID NO: 10863 - DNA, 660 bp, Unknown
  Obtained from environmental sample
  misc_feature (1)..(660): n is a, c, g, or t
atggatattgaagatttaaagttgtttcaaagatattttattagtgaagatagagatcctactttaactgaattgaaagttgttgatacttattggagtgatcattgcaggcatactacttttaacactatttttgatgatgtaaaaattgaagatccagaaattaaaaaaatatatgaaagttatttagcaacaaagaaagatcttaattctaataaacctaattgtttaatggaccttgcaaccattgcttctaaagccataaaaaaagaaggttatgcaaaagctactgaagaaagtgaagagattaatgcttgttcaattaatataaaagttgatgtaaataacaaggcggaagattatttactgttgttcaaaaatgaaacacataatcatccgactgagattgaaccttttggtggagctgcaacatgtattggtggggcaattcgggatccactatcatcaagggcctatgtttaccaggctatgagaattagtggggtttctgacccaagagaatctttcgatcaaactctggataataaattaccccagagaacaatagcaaaagtttctgcaaaaggaaatagtagttatggaaatcaaataggacttgccacctctttagtaaaagaattttatcatgaaaggatataa

SEQ ID NO: 10864 - protein, 219 aa, Unknown
  Obtained from environmental sample
  misc_feature (1)..(219): Xaa is any amino acid
MDIEDLKLFQRYFISEDRDPTLTELKVVDTYWSDHCRHTTFNTIFDDVKIEDPEIKKIYESYLATKKDLNSNKPNCLMDLATIASKAIKKEGYAKATEESEEINACSINIKVDVNNKAEDYLLLFKNETHNHPTEIEPFGGAATCIGGAIRDPLSSRAYVYQAMRISGVSDPRESFDQTLDNKLPQRTIAKVSAKGNSSYGNQIGLATSLVKEFYHERI

SEQ ID NO: 10865 - DNA, 669 bp, Unknown
  Obtained from environmental sample
  misc_feature (1)..(669): n is a, c, g, or t
atggaaattaaacaaaacctaattggttttttatccacaattacggataatgttcaactaattgctgtttcaaaaacaaaacctgttgaagatattcaggaagcctatgatgctggtcagagaattatgggcgaaaataaggtacaggatttagtagcaaaaacagaagtattaccggtagatattgattggcattttattggtcatctgcaaacaaacaaggtgaagttaattgctccttttgtgaaactaatacatgctgtcgacagtttaaaactactaaaagaaattaataaacaagctttaaataacaatagagttattgattgtttgcttcagtttcatattgcggaggaatcaacaaaatttgggcttaatgaaatggaagctgaagaaatcctccatagtgaagagttcgatagttacaagaatttgcgaattgttggagtaatgggaatggcaacatatactgatgatgaatcacaaatcaggaatgaatttaaaaagcttgttagaattttcgaactattaaaagataagtatttcaatgataaagaatactttaaagaaatttccatgggaatgtcgggcgattataaaattgcaatcgaagagggcagtactatgattagaataggaacaaaaatatttggcagtcgaaattactag

SEQ ID NO: 10866 - protein, 222 aa, Unknown
  Obtained from environmental sample
  DOMAIN (3)...(222): Alanine racemase, N-terminal domain
  misc_feature (1)..(222): Xaa is any amino acid
MEIKQNLIGFLSTITDNVQLIAVSKTKPVEDIQEAYDAGQRIMGENKVQDLVAKTEVLPVDIDWHFIGHLQTNKVKLIAPFVKLIHAVDSLKLLKEINKQALNNNRVIDCLLQFHIAEESTKFGLNEMEAEEILHSEEFDSYKNLRIVGVMGMATYTDDESQIRNEFKKLVRIFELLKDKYFNDKEYFKEISMGMSGDYKIAIEEGSTMIRIGTKIFGSRNY

SEQ ID NO: 10867 - DNA, 660 bp, Unknown
  Obtained from environmental sample
  misc_feature (1)..(660): n is a, c, g, or t
atgaaaggactaagtcaatacggaagagcactactgattgttttggagattaataaagatcacattttctcacacgaaatagctaaatttcagcatattacaccagttcaagttaggcgcgatctaatgcttattggttactccggaacattaagaaaaggttataatattcaggaactcattgatttaatagctgatattatcgacagcgatgaaggaattaatgttgccatagttggcatgggtaattatggacgggcattaattaattatttttcaggtaaacgttacaaattatgtatagttgctggttttgatgtaaatcctgataaaattggcaaaaaagtaaatggtgtaccatgttacgataccagttcaatgaataaaataattaaggaaaaaaatattgaaattggaattattactgttccttcatcattttcaacaaccactgcaaaccagcttgttgaatcaggaattaagggtatactaaactatacacctaaacctgttgatgttcctgaaggaatataccttgaggaatatgatatgattacaactctcgaaaaagttgccttttatgtaaaaatggaaaatgagaaagctgcagatcttgccattttaagacaaagtcaaggaactgcagcttccgatttttaa

SEQ ID NO: 10868 - protein, 219 aa, Unknown
  Obtained from environmental sample
  DOMAIN (67)...(191): CoA binding domain
  misc_feature (1)..(219): Xaa is any amino acid
MKGLSQYGRALLIVLEINKDHIFSHEIAKFQHITPVQVRRDLMLIGYSGTLRKGYNIQELIDLIADIIDSDEGINVAIVGMGNYGRALINYFSGKRYKLCIVAGFDVNPDKIGKKVNGVPCYDTSSMNKIIKEKNIEIGIITVPSSFSTTTANQLVESGIKGILNYTPKPVDVPEGIYLEEYDMITTLEKVAFYVKMENEKAADLAILRQSQGTAASDF

SEQ ID NO: 10869 - DNA, 666 bp, Unknown
  Obtained from environmental sample
  misc_feature (1)..(666): n is a, c, g, or t
gtggtaaacattactagaaaagttgcaaatgatattcttttatcaagtggtcatagtattgataagctagaatcttcaattattgaatcgaagaaaaatatttcattcgagattcatgaaaaaattgacgtaatgactgaagttgtaaaaagaaaaagcgaagcaaaaaatattgttggggtaattaaggcagaacataaagatgctctagatgaatatatagtaattggtgctcattttgatcatttaggcatgggtggacaaggttctggctcaagaatgccagatacttctgcagtccattatggagctgatgataatgcatctggaacatcttccattatagagattgctggtaaacttaaatctctttcgaaagagctaaaacgccatataataatagtagcatttgacgcagaagaaatgggcttattaggatcaaaacatttcgttaataatcttccttttgaatcgaanaaaatagtaggaatgtttaattttgatatgactggcagactagacacaacaagaaacgaattacaacttggaggaatgggaacttcaactgaaataaaatctttagcaaaaacatactacccagatttaaatctaaaatggcagatgatggattcggtccctcagatcattcttcattttacgcagtaa

SEQ ID NO: 10870 - protein, 221 aa, Unknown
  Obtained from environmental sample
  DOMAIN (73)...(152): Peptidase family M20/M25/M40
  misc_feature (1)..(221): Xaa is any amino acid
MVNITRKVANDILLSSGHSIDKLESSIIESKKNISFEIHEKIDVMTEVVKRKSEAKNIVGVIKAEHKDALDEYIVIGAHFDHLGMGGQGSGSRMPDTSAVHYGADDNASGTSSIIEIAGKLKSLSKELKRHIIIVAFDAEEMGLLGSKHFVNNLPFESXKIVGMFNFDMTGRLDTTRNELQLGGMGTSTEIKSLAKTYYPDLNLKWQMMDSVPQIILHFTQ

SEQ ID NO: 10871 - DNA, 414 bp, Unknown
  Obtained from environmental sample
  misc_feature (1)..(414): n is a, c, g, or t
atgcctaaactacaaaagttgttttttattattggttttatgcttattttatctggatgtactcaaaaaaacaatatatcaaatgtggaaaaaaataaagaatctcttactcaaaaacaaaaaaagtgtaatcaacatataaaaattatgcagtatgcattgtcttatgttacaaaagaatttgagaagggatattttcatcaaaatgatttaataggtgctaaagcacaactatttttaattgaaaatagatcaccaaatatatttgcacaaaatattaatgaagcacaaaaagcatacgatacagaatataatttagcacaaaaaaataattgtgatatagataagtttacagtatctcctatccaaaaagttaaaaatacaataaaaactttatcaaagggtcaaaaatga

SEQ ID NO: 10872 - protein, 137 aa, Unknown
  Obtained from environmental sample
  misc_feature (1)..(137): Xaa is any amino acid
MPKLQKLFFIIGFMLILSGCTQKNNISNVEKNKESLTQKQKKCNQHIKIMQYALSYVTKEFEKGYFHQNDLIGAKAQLFLIENRSPNIFAQNINEAQKAYDTEYNLAQKNNCDIDKFTVSPIQKVKNTIKTLSKGQK

SEQ ID NO: 10873 - DNA, 699 bp, Unknown
  Obtained from environmental sample
  misc_feature (1)..(699): n is a, c, g, or t
atggagtattttaaaactctagataatattaaaaagacgaaattagagcttatgagctcaaagagattggaagctgcatttatacataactcagtaacagatgaagagcactcaaaagtgactttctttggtgataagataacaaatatagattcagatttggatggtacatcttttaatgtagtgattaacagaaaaccttatcaccttgagactaaagttttaggtagctttcaaactatgaatataaatgctgctcttctaatagcaaatagactgaacttttctccagatgagatgattgtagctgttgaatcacttaagagtgtagaacaccgtcttgaaagaatagatgcaggaggaaagataattttagatgatggttataatggaaatatagatggaatgctagaaggtattcgtctgtgttcacttcataatggcagaaaagtgattgtaactcctggacttgttgagagtagtgaagagttaaatatgaaacttattgattccattaataaaaactttgatgtagctatagttacaggagttttaaatgcaaaactatttgataagaatctaaatgtatcacaaaagattttactaaatgataagagtgcattagagagtattttggcaaaagtaacatatagcggtgatattatatattttgcaaatgatgcaccaaactttatatag

SEQ ID NO: 10874 - protein, 232 aa, Unknown
  Obtained from environmental sample
  DOMAIN (110)...(192): Mur ligase family, glutamate ligase domain
  misc_feature (1)..(232): Xaa is any amino acid
MEYFKTLDNIKKTKLELMSSKRLEAAFIHNSVTDEEHSKVTFFGDKITNIDSDLDGTSFNVVINRKPYHLETKVLGSFQTMNINAALLIANRLNFSPDEMIVAVESLKSVEHRLERIDAGGKIILDDGYNGNIDGMLEGIRLCSLHNGRKVIVTPGLVESSEELNMKLIDSINKNFDVAIVTGVLNAKLFDKNLNVSQKILLNDKSALESILAKVTYSGDIIYFANDAPNFI

SEQ ID NO: 10875 - DNA, 606 bp, Unknown
  Obtained from environmental sample
  misc_feature (1)..(606): n is a, c, g, or t
atggaactatgtaaaccattggaagcagagattgatggagatattgttcaatttgaatttatcttcagaaactatttaacaggttcattatttgaagcttgtcaaaatggaaatgacccttatggattaaacttaccatctgatttaaaagagtgggataaatttgaaacaccaattttcacacctactacaaaaggtgtaaaagatataccgttaaactctagtactgtaagagaaaaatttccagaaatcatatctagtttagaaaaactttttaaagactttactgtttttgctcaagacaatggtattattgtagttgatacaaaatttgaaatatttgtaaattctaaaggtgaatggattttaggtgatgagattttaacacctgagagttcgagatttatagcagatgaagattttcaaaaaggtaattatatctcaatggacaaacagattcttcgaaattttgccaaagaaaatagttggaaagagaaagcaaaagatttaaaatctggcgaaaaactagatgttgaagttccagattcaattaaaaatgtaattttagatggatatgaaactatccataatagattacataagtaa

SEQ ID NO: 10876 - protein, 201 aa, Unknown
  Obtained from environmental sample
  DOMAIN (4)...(180): SAICAR synthetase
  misc_feature (1)..(201): Xaa is any amino acid
MELCKPLEAEIDGDIVQFEFIFRNYLTGSLFEACQNGNDPYGLNLPSDLKEWDKFETPIFTPTTKGVKDIPLNSSTVREKFPEIISSLEKLFKDFTVFAQDNGIIVVDTKFEIFVNSKGEWILGDEILTPESSRFIADEDFQKGNYISMDKQILRNFAKENSWKEKAKDLKSGEKLDVEVPDSIKNVILDGYETIHNRLHK

SEQ ID NO: 10877 - DNA, 810 bp, Unknown
  Obtained from environmental sample
  misc_feature (1)..(810): n is a, c, g, or t
gtgattgcaaatgagatacgctgtggacaagtaccgcaatataaagaggagtatgaagattttaaatttatcgatgtttcgatcccaaactattatgtacaaaaagcagttttaagtgactatgagataaataacttacgaagtgaaaataatattaatattctacatactattttaaatacagcttcaaattttatagaacctatgtataagtttattcaagagaaacaaatcgataaatttcttacactctttcaagtaatcacccctataaaaggtggacctcttggtgttgaaaatctaaatataaatctacaaaaacttattaacaatactaaaaataatggtattcaaacaaaaacttatgagtataaactagcagataaagttatccatataaaaaatgaaaatatgaaatcgcaaacaatgaaaacatataaaaatggctcaactgaatatattgaaaaacgggtttttaatggacaactagggatggtaataaaaatcgatcatgagaataaaaaactcttagtactttatccaactgatgatatggtagtattttatgattttgatacacttgatagtttaatctctttagcttattgtttaaccattcataaaacacaaggtatggagtatgaaaatgcacttatacctatgagctttagccactttattatgcacaatacanaactactttatacggcaattaccagagctaaaagtatgtgttatgtaataggagaagatgaggcttttacaagtgcttgtaagaagttagagataacaaacccgccaaactggtaa

SEQ ID NO: 10878 - protein, 269 aa, Unknown
  Obtained from environmental sample
  misc_feature (1)..(269): Xaa is any amino acid
MIANEIRCGQVPQYKEEYEDFKFIDVSIPNYYVQKAVLSDYEINNLRSENNINILHTILNTASNFIEPMYKFIQEKQIDKFLTLFQVITPIKGGPLGVENLNINLQKLINNTKNNGIQTKTYEYKLADKVIHIKNENMKSQTMKTYKNGSTEYIEKRVFNGQLGMVIKIDHENKKLLVLYPTDDMVVFYDFDTLDSLISLAYCLTIHKTQGMEYENALIPMSFSHFIMHNTXLLYTAITRAKSMCYVIGEDEAFTSACKKLEITNPPNW

SEQ ID NO: 10879 - DNA, 516 bp, Unknown
  Obtained from environmental sample
  misc_feature (1)..(516): n is a, c, g, or t
gtgatggaagttttatgtttggttcttgattatgaaaagttattttcagaagtaatacctcaagctatggtagatacagaatctacacctgtaaatttagaaggaatagatgttccaaaaaaattaaaaacaggaacacttttaattgctgaggactctaaaactgcacaaaaacatctaagacgtgtatttgaaagagcaaatttaagttataaaattttcgacaatggtcaattactaatgaattatgtgaattcattagagaatttagacaatattccagctattattacagatatagagatgcctgaaatgtcaggttttacagtacttcaactactaaagaaaaatccagaaactttcaatatcccagttatcgtaaatagctctatgacaggtgaaaataataaacgtgaagctgaggtgttgggtgctgatggttttgtaaataaaactaagtctcaagatataattccacttattattgagttaatgaataagatggaagatagataa

SEQ ID NO: 10880 - protein, 171 aa, Unknown
  Obtained from environmental sample
  DOMAIN (45)...(169): Response regulator receiver domain
  misc_feature (1)..(171): Xaa is any amino acid
MMEVLCLVLDYEKLFSEVIPQAMVDTESTPVNLEGIDVPKKLKTGTLLIAEDSKTAQKHLRRVFERANLSYKIFDNGQLLMNYVNSLENLDNIPAIITDIEMPEMSGFTVLQLLKKNPETFNIPVIVNSSMTGENNKREAEVLGADGFVNKTKSQDIIPLIIELMNKMEDR

SEQ ID NO: 10881 - DNA, 843 bp, Unknown
  Obtained from environmental sample
  misc_feature (1)..(843): n is a, c, g, or t
atgatagaagtttataatgcaataacaaatattgcaaatcaaattgaaaaaaatgtttttatagattacaacaattttactagtgaaacaaaaactgaacagcaaatacatgaagatgtatataaatactgttcagatgttatagaaactgaatttgaatacctaaaaaatgtaaaaagtatcatagggaaagataaaaaacaattttgtagtattaatgaaaatgggaaatatattgttagttttgtagctattgataatattgaacttcttgatttaaacttttctcttggaactatttttggtatctatgaaaatgaatttgaagcagataatttaaaagctgctatttatatcacctatggtccaacttttcaacttgtatttgcttcaaaagatgaaggggtaaaatacttctcaaatgaacatggggaatttatccaacaagatccattactacttaatagttgtggaaagataaactcaactgctggaaaagcaagtgaatttactactgaacataaagcacttttagatagctttttcaatgaagggtatagattaagagtgagtaactctctttgtcttgatacccatcaaattttatttaaaaaaggtggaatttattcaagtccagcaactgtatcaaatgaagatggaactttggaagttatttttgaagcgtttcctatctcatttataatcgaacttgcaaacggtgaagcaatagatggaaaaaatagaatcttagatataaaatctccctctttacatcaaaaaacaccgatttattttggttcaaaagaagagatagcaagagttaaatctacttctaaaaagtag

SEQ ID NO: 10882 - protein, 280 aa, Unknown
  Obtained from environmental sample
  DOMAIN (13)...(280): Fructose-1-6-bisphosphatase
  misc_feature (1)..(280): Xaa is any amino acid
MIEVYNAITNIANQIEKNVFIDYNNFTSETKTEQQIHEDVYKYCSDVIETEFEYLKNVKSIIGKDKKQFCSINENGKYIVSFVAIDNIELLDLNFSLGTIFGIYENEFEADNLKAAIYITYGPTFQLVFASKDEGVKYFSNEHGEFIQQDPLLLNSCGKINSTAGKASEFTTEHKALLDSFFNEGYRLRVSNSLCLDTHQILFKKGGIYSSPATVSNEDGTLEVIFEAFPISFIIELANGEAIDGKNRILDIKSPSLHQKTPIYFGSKEEIARVKSTSKK

SEQ ID NO: 10883 - DNA, 405 bp, Unknown
  Obtained from environmental sample
  misc_feature (1)..(405): n is a, c, g, or t
gtggtttacgccaatatttgtttaaagcaatttttaagttcggttaaatacctgaatgtttatcgctcggtgaaaaaagaaggcgaaaacgatttgttacagaaagtaattgcctttatgaaaaacaacctgcacaaaaatatacgaattgccgagctggctgatacttgcaattgctctagttcgaatatttataagttgttcaaacaaaatttggataattcaccacaagatttttttattcacttaaagatagagcgtgcacgaaaatatttaacccaatctaatttaaaagtaaaagagattgggttaaaactgggttatgaagaccagtattatttttcgcggatattttcaaaacacgtggggctttcgcctgcgaactatcgcaaagaagaaaaataa

SEQ ID NO: 10884 - protein, 134 aa, Unknown
  Obtained from environmental sample
  DOMAIN (35)...(81): Bacterial regulatory helix-turn-helix proteins, AraC family
  misc_feature (1)..(134): Xaa is any amino acid
MVYANICLKQFLSSVKYLNVYRSVKKEGENDLLQKVIAFMKNNLHKNIRIAELADTCNCSSSNIYKLFKQNLDNSPQDFFIHLKIERARKYLTQSNLKVKEIGLKLGYEDQYYFSRIFSKHVGLSPANYRKEEK

SEQ ID NO: 10885 - DNA, 465 bp, Unknown
  Obtained from environmental sample
  misc_feature (1)..(465): n is a, c, g, or t
atgaaaaaaagaaaaaaaattgccttggtggcacacgataaccgtaaacctgatttaatagaatgggtttcatataatagagaaattttattaaagcataaactggtttgtaccggaacaaccggaaaattggtggaagaaacacttattaatgatgaaattgttgagagccataagttaaatataaaaaagttaaaatcaggcccactgggtggcgatcaacaattaggcgctttaattgccgatggcaaaattgatattcttgtttttttctgggatcccatgagttcacaaccccatgatgttgatgttaaagcattgttgcgaatctgtgtcttatacaatgtcccaacggctatgaaccgctcaacagcagattttcttatctcctctcgtctatttaaggaagattatcagcctattcttaaaaattaccaggaatatattgatcgttctattcaataa

SEQ ID NO: 10886 - protein, 154 aa, Unknown
  Obtained from environmental sample
  DOMAIN (18)...(120): MGS-like domain
  misc_feature (1)..(154): Xaa is any amino acid
MKKRKKIALVAHDNRKPDLIEWVSYNREILLKHKLVCTGTTGKLVEETLINDEIVESHKLNIKKLKSGPLGGDQQLGALIADGKIDILVFFWDPMSSQPHDVDVKALLRICVLYNVPTAMNRSTADFLISSRLFKEDYQPILKNYQEYIDRSIQ

SEQ ID NO: 10887 - DNA, 567 bp, Unknown
  Obtained from environmental sample
  misc_feature (1)..(567): n is a, c, g, or t
ttgcttattttaccaatatatactcataattttaaaaatgataaccaattccggtcatttatttcgttgatgaagaattttaaatttagcaattatggtgcagaaattcttaagggggcatatgaaaattctaatgagcggaaggtatatcaaaaggcatatgaagattatattgaacatattagcatagaggattatttttcaaactatccacttatttttgtttgcccgcctgatgaaagagataaaagaataaagatttcacaaattcatactcataaaataagaggggcagatattattcttatagctgaagatgatgaagacttaaggaaagctattgaaggaaaacctgccggacaggaacactattttttcaaattcattaaaattccgaaaacggatgataaatatatctttgtttttgcagcaactttagccttacagcttcttgcgctaaatatgtcaattacaaaaaggaaatatctgaataaaaataaagttgaaaatcatggagtacatccggatgtacccaaaaatgtttcaaaatcaattactgttggatag

SEQ ID NO: 10888 - protein, 188 aa, Unknown
  Obtained from environmental sample
  misc_feature (1)..(188): Xaa is any amino acid
MLILPIYTHNFKNDNQFRSFISLMKNFKFSNYGAEILKGAYENSNERKVYQKAYEDYIEHISIEDYFSNYPLIFVCPPDERDKRIKISQIHTHKIRGADIILIAEDDEDLRKAIEGKPAGQEHYFFKFIKIPKTDDKYIFVFAATLALQLLALNMSITKRKYLNKNKVENHGVHPDVPKNVSKSITVG

SEQ ID NO: 10889 - DNA, 339 bp, Unknown
  Obtained from environmental sample
  misc_feature (1)..(339): n is a, c, g, or t
ttgatttttaggtatcccaataaaactatggaaaagataatagacgaaaacaaacaaggtgaatttctcaccttagatgcaaagaaaggtaatacaaaaaaactttttatcgaaagttatgggtgtgccatgaattttagtgacagcgagattgtagcttctattttagctaacgagggctataacaccacgcaacatttagaagatgccgatttggttttggtaaacacctgctcaatcagagacaaagcagaacaaacccgtagaaagcgtttagaaaaatataatgctgtaaaaaaaataaacccaaaaatgaaagtgggtgttttggggttgtat

SEQ ID NO: 10890 - protein, 113 aa, Unknown
  Obtained from environmental sample
  DOMAIN (34)...(113): Uncharacterized protein family UPF0004
  misc_feature (1)..(113): Xaa is any amino acid
MIFRYPNKTMEKIIDENKQGEFLTLDAKKGNTKKLFIESYGCAMNFSDSEIVASILANEGYNTTQHLEDADLVLVNTCSIRDKAEQTRRKRLEKYNAVKKINPKMKVGVLGLY

SEQ ID NO: 10891 - DNA, 792 bp, Unknown
  Obtained from environmental sample
  misc_feature (1)..(792): n is a, c, g, or t
gtgcaaaaaatctcttctaaaacaataaggaaatatgacactgtagccagatttggtggagatgaatttgttgtacttattgatacccaacatgttgataaaaactctgctgtaaaaagtataagaactgttgcaaataatattttaagacgaatatcacaaccattaaccataaaaaatgtagagtatcaattgactgctagtataggtatatcgatttttaatgacaatattacttttgatgaactaatgaaacgagcagatagtgctatgtaccattcaaaagataaagggaaaaacagttttagtttttttgaccctaaacttcaaaaagagatagaaagaaaaacaattattgcagaaaaactaagaggtgcaataaaaaataacaaaataaaaatacactatcaaaaacagcttaaccaaaatcaaaaagtagttggtgtagaagcacttttaagatggactgacaaaacactaggatatgtaagtcctgttgaatttatagcaatcgcagaagaaagtgatcttattttaaagctaggaaattatgttatagaagaatctataaaacttattagtagttgggaaaaagataaaataaaaaaagattggaaaatatctataaatatcagtatcaaacaatttgaaaaagataattttgctaaaataattgaaaaacacatataccaatataatatagtaccaaataaactaccactagagtttaccgaaagcttgctttttaaaaaatacagaaaaaaactcttcaaaaaaatcaattatccttaa

SEQ ID NO: 10892 - protein, 263 aa, Unknown
  Obtained from environmental sample
  DOMAIN (1)...(101): GGDEF domain
  misc_feature (1)..(263): Xaa is any amino acid
MQKISSKTIRKYDTVARFGGDEFVVLIDTQHVDKNSAVKSIRTVANNILRRISQPLTIKNVEYQLTASIGISIFNDNITFDELMKRADSAMYHSKDKGKNSFSFFDPKLQKEIERKTIIAEKLRGAIKNNKIKIHYQKQLNQNQKVVGVEALLRWTDKTLGYVSPVEFIAIAEESDLILKLGNYVIEESIKLISSWEKDKIKKDWKISINISIKQFEKDNFAKIIEKHIYQYNIVPNKLPLEFTESLLFKKYRKKLFKKINYP

SEQ ID NO: 10893 - DNA, 585 bp, Unknown
  Obtained from environmental sample
  misc_feature (1)..(585): n is a, c, g, or t
atgactaaaatagacagttacttaaatagactaaatttaaacacgaaactccttttccttgtactgattttagcatttacttttatcagtggatcagtcatgctctatatattttctgatagagtaaaacaagccacaaacaacttttatgatcgtcatactttacttgttacacatcttaatgagataaaagatatatactccattaatgttctcgacacagtagatatgctcaaaaaagatattatttctcatgaagatggtatagaaattttaaatattgctgttaagcttgttgaaaaggagtggggaacatactcccaaaaaagtattaaagatgactatttcattaataacaaagactatatttcaaaaacagaagagacacttttatcgctaaacagaattataaaaaatttaacgatctatcttaaatcaagcggacctcaggaattaagaatggagaagtgggaggaaactttttttttaccaaaaacaacgtcttggaaagatgtggagcagccccggaaaaaaaaaaaatggatcctcctcgcaaggaaaaagggggagctagggcccttctag

SEQ ID NO: 10894 - protein, 194 aa, Unknown
  Obtained from environmental sample
  misc_feature (1)..(194): Xaa is any amino acid
MTKIDSYLNRLNLNTKLLFLVLILAFTFISGSVMLYIFSDRVKQATNNFYDRHTLLVTHLNEIKDIYSINVLDTVDMLKKDIISHEDGIEILNIAVKLVEKEWGTYSQKSIKDDYFINNKDYISKTEETLLSLNRIIKNLTIYLKSSGPQELRMEKWEETFFLPKTTSWKDVEQPRKKKKWILLARKKGELGPF

SEQ ID NO: 10895 - DNA, 396 bp, Unknown
  Obtained from environmental sample
  misc_feature (1)..(396): n is a, c, g, or t
gtggctgtctttngctggtgcgnacggacgaattattcacgcgcaggtcatttcgatatagagtctctctatatattcatgaagaataaaaactatagagtaagtagagcaacattatacaataccattgaattattattagagtgtaatcttgtaattaaacatcagtttggtaaaaatatcgctcaattcgagaaggcatatgaatataagcaacacgatcatttaatttgcaccgattgtggaaaagttattgagttttgcgatccaagaattcaggaaattagagcaacagctggtgaattaactgattttaaaatttcttaccattccttatatttttatggaatttgtagcgaatgttcacaaaaaaattccacaaagaaaaccaattag

SEQ ID NO: 10896 - protein, 131 aa, Unknown
  Obtained from environmental sample
  DOMAIN (9)...(115): Ferric uptake regulator family
  misc_feature (1)..(131): Xaa is any amino acid
MAVFXWCXRTNYSRAGHFDIESLYIFMKNKNYRVSRATLYNTIELLLECNLVIKHQFGKNIAQFEKAYEYKQHDHLICTDCGKVIEFCDPRIQEIRATAGELTDFKISYHSLYFYGICSECSQKNSTKKTN

SEQ ID NO: 10897 - DNA, 576 bp, Unknown
  Obtained from environmental sample
  misc_feature (1)..(576): n is a, c, g, or t
gtgtcaaaatctgtacttcttaaaattgcacgagaatccatagaagaggttattcttgctaaaaatagtatagataagagagcactgttagaaacttatcctgtgctgggtgaaaaagttgctacatttgtcaccataaatctaaataataaactaagaggatgtatcggctcacttatagctcaaaaacctctgctagaagatattatctacaatgcaaaagctgcagcatttcatgatcctcgtttttcgccgataacaacttcagactacattcactcttcgatcgaaatttccattttaacagaacctaaagaggttaaatatagttcaatagatgagttaaagtctataattaacgtaggagaagatggtgttatcttgatatatgaagataaacaagcaacattcttaccgcaagtttgggatgagctaccaacatttgaagagtttttttcacatctgcttcaaaaagcaagtttgagcgaaaacactttagctctaagtccagtcatatacacttaccaagtagcaaaagagagggatgaacctattgttaatgaggagaaaaaatga

SEQ ID NO: 10898 - protein, 191 aa, Unknown
  Obtained from environmental sample
  DOMAIN (1)...(190): AMMECR1
  misc_feature (1)..(191): Xaa is any amino acid
MSKSVLLKIARESIEEVILAKNSIDKRALLETYPVLGEKVATFVTINLNNKLRGCIGSLIAQKPLLEDIIYNAKAAAFHDPRFSPITTSDYIHSSIEISILTEPKEVKYSSIDELKSIINVGEDGVILIYEDKQATFLPQVWDELPTFEEFFSHLLQKASLSENTLALSPVIYTYQVAKERDEPIVNEEKK

SEQ ID NO: 10899 - DNA, 720 bp, Unknown
  Obtained from environmental sample
  misc_feature (1)..(720): n is a, c, g, or t
atgtttttttccaataaagctaaagatgaagaatgtgagttgctcaagtccaaagttcatgaacttgaggaaaaactcaaacaagttgaattaagcaaaaaaagtgaaattgaaaagttagtatctaagtatgatagtaaggttgctagtttagaaatcgaaaaagttaatctagaaagaatagctgcattttctacaacagagggtattgttgctatagactctaataaaaatctcttttttatgaatgatagggctaaagaaaatattaaaaatacaaatagtttaatggatgtaatctctcaagagggtgaacggatcatcatagaagattgtgaagctaaattagagtataaaaaatatgataatttaacaattgcttcactagtgaaaacatcaattcatgacaatgcagatgatggattacttcataaacataatcaaaatatcaatgtttctttaacaaatacacaaagtgtgtatcaagagttattagttgaacttgatagtatggcaaaagaatctaaagagacagcaaatggttctaatgaaggtttgtcattaactaaaaacattgttaaggatactgaaaatcttaataatcaaaattgtactgaaaatgagattgtaaataatttagtacaaaaaagtgatgacatacctcaagctatcgttgttattgaaccaaatgcatttccaaacaaatattctttcctttaa

SEQ ID NO: 10900 - protein, 239 aa, Unknown
  Obtained from environmental sample
  misc_feature (1)..(239): Xaa is any amino acid
MFFSNKAKDEECELLKSKVHELEEKLKQVELSKKSEIEKLVSKYDSKVASLEIEKVNLERIAAFSTTEGIVAIDSNKNLFFMNDRAKENIKNTNSLMDVISQEGERIIIEDCEAKLEYKKYDNLTIASLVKTSIHDNADDGLLHKHNQNINVSLTNTQSVYQELLVELDSMAKESKETANGSNEGLSLTKNIVKDTENLNNQNCTENEIVNNLVQKSDDIPQAIVVIEPNAFPNKYSFL

SEQ ID NO: 10901 - DNA, 684 bp, Unknown
  Obtained from environmental sample
  misc_feature (1)..(684): n is a, c, g, or t
atgcggaacgaactttatcttaaagaattactcaccttagacattaaagaaagttgtgatgcccgtgtaagtaatttggtaaaaattaagaagcttgctcctgaaattgatactgtttacataaagcctccagcaaaaagaagcataaaaaaaattgtaaaatatgctgatgctagctttaatacagaatttgaaaccataaaatggctttcagaagaggctgttagacagaataaaattcacaaaatcattattatgattgagttgggtgatttaagagaaggtgttatgggggaagatttgatggatttttatggctccatttttaaattgcctaacataaaagttactggaataggaactaacctcaactgtttacatggtgtttatccctcggaagataaaatggtacaacttagtttgtataaacagttaatcgaatctaaatttaatagaaaaataccttgggttacaggtggaacaagtgtagtaattccattattattaatgaaacaattacctgcggggattaaccattttagagttggtgaagccttgttttttggtaataacttaattactggagaaacttttgaaggtatggaaacagatgtttttacactctttgcagaaattattgaaataacagaaaaacctattacccctatgggtaatagggggtga

SEQ ID NO: 10902 - protein, 227 aa, Unknown
  Obtained from environmental sample
  DOMAIN (7)...(192): Alanine racemase, N-terminal domain
  misc_feature (1)..(227): Xaa is any amino acid
MRNELYLKELLTLDIKESCDARVSNLVKIKKLAPEIDTVYIKPPAKRSIKKIVKYADASFNTEFETIKWLSEEAVRQNKIHKIIIMIELGDLREGVMGEDLMDFYGSIFKLPNIKVTGIGTNLNCLHGVYPSEDKMVQLSLYKQLIESKFNRKIPWVTGGTSVVIPLLLMKQLPAGINHFRVGEALFFGNNLITGETFEGMETDVFTLFAEIIEITEKPITPMGNRG

SEQ ID NO: 10903 - DNA, 516 bp, Unknown
  Obtained from environmental sample
  misc_feature (1)..(516): n is a, c, g, or t
atggaaacgattaatatactactagttgacgatcacacattaattagagaaggacttaaacttatattaaaaaagaataagagttttaaaataattggagaggcatctaatggagtagaagcaattaagtatatagataaaaatgcttcgaaaattcatgtagtaatgttagatattactatgccggaattagatggttttgaagtagcgaagattgttaggcaaaatcatcctgagattaaaattttagcacttaccatgcatagcgaagaatcttacattacaaaaatgatagatgttggtgttcatggatatgtattaaaagattctaatttagaagatttgtcaacagctattaaaactattttagagggtaagccttattatagtagcgatgtatctgctattatgataaacagtttaatgaataaagataaaaagaaaggaaaccaccgaattagaaaatcttacagagagagaaattcaaattatcaattttattaccgaaggttttaa

SEQ ID NO: 10904 - protein, 171 aa, Unknown
  Obtained from environmental sample
  DOMAIN (4)...(127): Response regulator receiver domain
  misc_feature (1)..(171): Xaa is any amino acid
METINILLVDDHTLIREGLKLILKKNKSFKIIGEASNGVEAIKYIDKNASKIHVVMLDITMPELDGFEVAKIVRQNHPEIKILALTMHSEESYITKMIDVGVHGYVLKDSNLEDLSTAIKTILEGKPYYSSDVSAIMINSLMNKDKKKGNHRIRKSYRERNSNYQFYYRRF

SEQ ID NO: 10905 - DNA, 747 bp, Unknown
  Obtained from environmental sample
  misc_feature (1)..(747): n is a, c, g, or t
atgattagtccaacaaataaaattattaaaacaaaagaatttcattcagaaattgtagaatacgttaactctaatgattttattaaaaactatgatggtcatttaccaactcaatactatttttcatttgaaactaatttgcaagaatatctagaagaatatccagaaaaaacagaatcagtttcaattaataaattttatgagtcacagatattgctttcaataaaacttataaaaaatgataaaataagagaagattatattaattacattgttttttcaattggaatgggaggcctaaaaagacatcaagaattttacaatcttattaaaaaagaataccctaaaataagtttgccaaaaatcactaaaaaaattgaagaattaaaaatttttgactcttataaattaaatgaatatgaagtcatagagtttaagtcagtaaaattattcttaaagaaaaatgagccatcaaatattgcttttattaaaaataaaaatgttcaattctttanatttccattcaattcgggtgatttagaaccttactttaaaagagacactaaatcatttttaagatttttatctcaagtaataccagtactaagtggatcaaataaaatattagaaatatccacaatttccgatttactaaactttattaaataccgcaaaaccttaccctggagtacacatatggaaaacagttcaaatctaaattttggccttaaccaatataattcgaaa

SEQ ID NO: 10906 - protein, 249 aa, Unknown
  Obtained from environmental sample
  misc_feature (1)..(249): Xaa is any amino acid
MISPTNKIIKTKEFHSEIVEYVNSNDFIKNYDGHLPTQYYFSFETNLQEYLEEYPEKTESVSINKFYESQILLSIKLIKNDKIREDYINYIVFSIGMGGLKRHQEFYNLIKKEYPKISLPKITKKIEELKIFDSYKLNEYEVIEFKSVKLFLKKNEPSNIAFIKNKNVQFFXFPFNSGDLEPYFKRDTKSFLRFLSQVIPVLSGSNKILEISTISDLLNFIKYRKTLPWSTHMENSSNLNFGLNQYNSK

SEQ ID NO: 10907 - DNA, 768 bp, Unknown
  Obtained from environmental sample
  misc_feature (1)..(768): n is a, c, g, or t
atgttacaaaataactttaagtttttacaaaaattttctgatataaaatattatagtaaggaggtattgtttcaacatagaaatcaagaaacttttgctaaatggagagagaagataaatcttttaatcatagattatccaacgcaagagctaaaaaaatatttaatagttacagataatattggcaagattgttctaaaaattgaagggctaaaaatgaaagaggaggaatttattaaaaaaatttctcgaactatagattcaagcaatacgattaatactcaaataacaaaagagattgaacaactttctttagagttccaaaatactgtatttacaattagtacacttttgtttttactcttaattgtatttattattctattagcatacaaagtcaataaaaatgtctcaatgagtgttgatgagattgaacaagaaattcaaaatggactagaggagataaataatctcaatgaagagattgcagatacccaaaaagaagttgtatttactatgggtgctattggtgaaagccgaagtaaagaaacaggaaatcatgtaagaagagtcgctgaatatagtaagcgtttagctttgttttatggattaagcgaagaggaagctgagatgttaaaacaagccagtcccatgcatgatataggaaaagtagcaatacccgatgctattttgaataaaccagggcgttttaatgaacatgagagattgattatgaatacccatgcacatcttggatatgatatgtaa

SEQ ID NO: 10908 - protein, 255 aa, Unknown
  Obtained from environmental sample
  misc_feature (1)..(255): Xaa is any amino acid
MLQNNFKFLQKFSDIKYYSKEVLFQHRNQETFAKWREKINLLIIDYPTQELKKYLIVTDNIGKIVLKIEGLKMKEEEFIKKISRTIDSSNTINTQITKEIEQLSLEFQNTVFTISTLLFLLLIVFIILLAYKVNKNVSMSVDEIEQEIQNGLEEINNLNEEIADTQKEVVFTMGAIGESRSKETGNHVRRVAEYSKRLALFYGLSEEEAEMLKQASPMHDIGKVAIPDAILNKPGRFNEHERLIMNTHAHLGYDM

SEQ ID NO: 10909 - DNA, 573 bp, Unknown
  Obtained from environmental sample
  misc_feature (1)..(573): n is a, c, g, or t
atgaatataaagaaattagttagatatagttttctaataatatcgatattaatattttttatatttggtattaatagaattattttatatcaattcaaagaaaatgatattattaaagaacatataactactcttctatcaacccaagagaatatgaataaactgataaaaaatattgatagaacatctactcttgaagaattagaaaaaatcaaacagcaattttttacccaagagaaaagatttgaaaatagaaaagatcaattatatttagaaaaatctaatgatatattagatttttttgttattgaaatcaatgaagaagagataattaaaaataacatatcaaaacttattaaaaatgaacatctcgtagaagaatattttgatgctatttttaagattcaatctcanaaaataataaaacaaaaagaattcgaaaagatttatccccaagaaaataatattcgaaaaagtattgaagaaaaaattatgttacaaaataactttaagtttttacaaaaattttctgatataaaatattatagtaagggaggtattgttttcacataa

SEQ ID NO: 10910 - protein, 190 aa, Unknown
  Obtained from environmental sample
  misc_feature (1)..(190): Xaa is any amino acid
MNIKKLVRYSFLIISILIFFIFGINRIILYQFKENDIIKEHITTLLSTQENMNKLIKNIDRTSTLEELEKIKQQFFTQEKRFENRKDQLYLEKSNDILDFFVIEINEEEIIKNNISKLIKNEHLVEEYFDAIFKIQSXKIIKQKEFEKIYPQENNIRKSIEEKIMLQNNFKFLQKFSDIKYYSKGGIVFT

SEQ ID NO: 10911 - DNA, 780 bp, Unknown
  Obtained from environmental sample
  misc_feature (1)..(780): n is a, c, g, or t
atgagcaatgagcagatacagattggagaaaacggatgttttataggtattgaatggtttgattcacctaaatctaaatttcataaggacacagtattttataaagggactacttggcaagacggagatagaaaagacacgatatattctagagtcaggaaaggaaatggtgctgtgctgggtggcatttataaaaagtatagattttccaagaataagctatgggctaaagtagacaatcattggcaaaacagagggaactttgcagaatcaatgatgtatactgctgatacattacctgatggaaacatatatcttagaactcctgataatcattatcaagggtttttgtgtattaacattgacgtttcttttcctaaaaacaaaattgacttaactttcaaagaaccaaaaaagagaaaattgaataagcttgaaaaagtaaaacaagatttatttaaatattctcaaaacaatattcatgaattattttcttccttgattaaagctttcgagaatgacgacatagtttatgtctttaaatatctctgtgtttataaagaagatcaattagatcaaatattatccgagatcgttgatgaagaanatggaaactatatatatgatgaagaaaaagatacaattgtaaaatatttgagaggacttcaatcaaaactagatttggcagtattaacccagattgatgataaacatttcgaactattaattgataataaatcttacaatctaataattttatatgggctgngggaaaattaa

SEQ ID NO: 10912 - protein, 259 aa, Unknown
  Obtained from environmental sample
  misc_feature (1)..(259): Xaa is any amino acid
MSNEQIQIGENGCFIGIEWFDSPKSKFHKDTVFYKGTTWQDGDRKDTIYSRVRKGNGAVLGGIYKKYRFSKNKLWAKVDNHWQNRGNFAESMMYTADTLPDGNIYLRTPDNHYQGFLCINIDVSFPKNKIDLTFKEPKKRKLNKLEKVKQDLFKYSQNNIHELFSSLIKAFENDDIVYVFKYLCVYKEDQLDQILSEIVDEEXGNYIYDEEKDTIVKYLRGLQSKLDLAVLTQIDDKHFELLIDNKSYNLIILYGLXEN

SEQ ID NO: 10913 - DNA, 657 bp, Unknown
  Obtained from environmental sample
  misc_feature (1)..(657): n is a, c, g, or t
ttgaaacatatagtaataattggtggtggatacgcaggtgtttatgctttaaaagaactcataaaaaataaacatattaaaataacacttattgataaacatacttatcataaccttcaaccagaagtttatgacctaattgcaaacaaaggtactattgcagatgtaactattgacttatcttcactttgtagtggatttgatcatccatttttagaatataaaaatttacgcgttactgatattgattataaacaaaagcaaatctctacagcagaacaagaaactattaagtttgattatcttcttctttgtgttggtacgagaacttttttccctcaaaatattgagggtttaaataatacaaatgatttaaaaaaacttcataaagctttatattttaaacaaaactttgagaaacaacttttcaataaaatagaggatgaagcaaaaaaatgtgataaaacacatattgcagtagtgggagcgggtctttctggtgttgagatagcagctgagatggcttactatgcaaatcagtttttcaaaagaggaagttttcattgtgataatttcaaaatctctcttattagttcacgaagtactatattaccagatttcgatcaaaaaatgatacagatgtcaagccaaagataa

SEQ ID NO: 10914 - protein, 218 aa, Unknown
  Obtained from environmental sample
  DOMAIN (3)...(218): Pyridine nucleotide-disulphide oxidoreductase
  misc_feature (1)..(218): Xaa is any amino acid
MKHIVIIGGGYAGVYALKELIKNKHIKITLIDKHTYHNLQPEVYDLIANKGTIADVTIDLSSLCSGFDHPFLEYKNLRVTDIDYKQKQISTAEQETIKFDYLLLCVGTRTFFPQNIEGLNNTNDLKKLHKALYFKQNFEKQLFNKIEDEAKKCDKTHIAVVGAGLSGVEIAAEMAYYANQFFKRGSFHCDNFKISLISSRSTILPDFDQKMIQMSSQR

SEQ ID NO: 10915 - DNA, 522 bp, Unknown
  Obtained from environmental sample
  misc_feature (1)..(522): n is a, c, g, or t
ttgaaaagtcgcttattattaagcggcttttttatttttgtactaatgagcaattcacctattggcatttttgattctggtattggaggtacttctatctttaaggagattcataagttattaccaaacgaaaattgtatctacttagcagatagcaaaaatgcaccttatggtaataagtctaaagcggatattattgagttgagtattaagaatacagaacatctaattaaagaaggctgtaaaattattgttgtagcgtgtaataccgctacaactaatgctatagattatttaagaaaaacctacagtattccatttattggtattgaacctgctataaaacctgcagctttaaatactcagactaaggcgattggtattttagctacaaaaggaaccttaactagtcagctttttcataagactacagatttatattctaaagacataaaaattattgaacaagtaggtgaggggattgtacctttaatagagtcgggtgaactccaatcgaaatag

SEQ ID NO: 10916 - protein, 173 aa, Unknown
  Obtained from environmental sample
  SIGNAL (1)...(17)
  DOMAIN (20)...(169): Asp/Glu/Hydantoin racemase
  misc_feature (1)..(173): Xaa is any amino acid
MKSRLLLSGFFIFVLMSNSPIGIFDSGIGGTSIFKEIHKLLPNENCIYLADSKNAPYGNKSKADIIELSIKNTEHLIKEGCKIIVVACNTATTNAIDYLRKTYSIPFIGIEPAIKPAALNTQTKAIGILATKGTLTSQLFHKTTDLYSKDIKIIEQVGEGIVPLIESGELQSK

SEQ ID NO: 10917 - DNA, 849 bp, Unknown
  Obtained from environmental sample
  misc_feature (1)..(849): n is a, c, g, or t
ttgttagtattattactgctttgggctaagtcaaaattgacaagttcaggaccggtaaaaattaccattaaccatgataaagttttagaagtagaagcagggagtacgctgttaaatacgttgagtaatcaaggaattttcttgccttctgcttgtggtggtggtggaacttgtattcaatgcaagtgtgaggttaaaagcggtggtggcagtattttgccaacagaggaacctcatttttccagaaaggaaattgctcaaggtatgagattaggttgccaagtgaaggtgaaagaagacatggagattgagattgaagaggaaattttaggtattaaagaatgggaagcaacagttgtttctaactataatgtggctacctttattaaagagtttattgtagaaatccctgaagatatggactacaaggctggtgggtatattcaaattaaaattccaccatgtaccatcaagtatgaagaaatggatgttactgctcacccacaagatcatcctggagagccagataaatttaagccagattgggataaatttaaactatggcctttagttatgaaaaatgatgaagaagtaattagagcttattcaatggcttcttaccctgctgaaggaagaaaaattatgttgaatgtacgtattgcaacacctcctttcgatagagataaaggcgacgggatggatgtaaatcccggtgtggcatcctctttattttttcacccaaaaaccagggagataaaggtagtttttttccgggcccttaagggggaaattcttttatcaaatccttttcagaatgctgaaaatggttatataagtggggggggtggg

SEQ ID NO: 10918 - protein, 283 aa, Unknown
  Obtained from environmental sample
  DOMAIN (21)...(99): 2Fe-2S iron-sulfur cluster binding domain
  misc_feature (1)..(283): Xaa is any amino acid
MLVLLLLWAKSKLTSSGPVKITINHDKVLEVEAGSTLLNTLSNQGIFLPSACGGGGTCIQCKCEVKSGGGSILPTEEPHFSRKEIAQGMRLGCQVKVKEDMEIEIEEEILGIKEWEATVVSNYNVATFIKEFIVEIPEDMDYKAGGYIQIKIPPCTIKYEEMDVTAHPQDHPGEPDKFKPDWDKFKLWPLVMKNDEEVIRAYSMASYPAEGRKIMLNVRIATPPFDRDKGDGMDVNPGVASSLFFHPKTREIKVVFFRALKGEILLSNPFQNAENGYISGGGG

SEQ ID NO: 10919 - DNA, 765 bp, Unknown
  Obtained from environmental sample
  misc_feature (1)..(765): n is a, c, g, or t
atgatcaaacgcaccgccaaacgtgatttttatggcaagaaagtcatcgattcgtttcagctaccaaatctgatcgaagtccagctcaatagttacaagtggtttttggacgagggtatcaaagagctcctcgaagaaatcactccgatcaccgacttctcaggcaagaagctcgagcttcactttttagatcacaacttcgacctgccaaagtacgacgcccacaccgcccgtcgcaagaacctcagctacgaaacttcccttaaagccaacattcgcttgatcaacaaagacagtggtgaaatcaaagagcaaaatgttttacttggctcgattccactcatgaccgacaaaggcaccttcatcgtaaacggtatcgagcgcgtcgttatcaatcagctcgtccgtagtccgggtgtatttttctcaaatagcatatccgtcccaggcttctacgacgccaagatgatcccaaagcgtggtgcttggatcgagctcgagaccgacaaacgcggtgtaatctacgtaaaaatcgatcgtcgtcacaaagtctctgcgaccactcttatgcgctgttttggacttgaaaaggaaaaagatctcctaaaggaatttgccgatgtaaatacaaatcttgaaggtgaatacctcctccgcacctctaaaaaaagatccccctccgcacccaaagaaaaaaccttatcagcaaaatctctcgcccccatacgccccgggggaaccttggccctcttccagaaaaatggg

SEQ ID NO: 10920 - protein, 255 aa, Unknown
  Obtained from environmental sample
  DOMAIN (23)...(221): RNA polymerase beta subunit
  misc_feature (1)..(255): Xaa is any amino acid
MIKRTAKRDFYGKKVIDSFQLPNLIEVQLNSYKWFLDEGIKELLEEITPITDFSGKKLELHFLDHNFDLPKYDAHTARRKNLSYETSLKANIRLINKDSGEIKEQNVLLGSIPLMTDKGTFIVNGIERVVINQLVRSPGVFFSNSISVPGFYDAKMIPKRGAWIELETDKRGVIYVKIDRRHKVSATTLMRCFGLEKEKDLLKEFADVNTNLEGEYLLRTSKKRSPSAPKEKTLSAKSLAPIRPGGTLALFQKNG

SEQ ID NO: 10921 - DNA, 801 bp, Unknown
  Obtained from environmental sample
  misc_feature (1)..(801): n is a, c, g, or t
atgaaaaatatctcaaatacaccaattattacagaaacaatccataaacgaaaaaatggttctctatatgatgcatcaattactagtataaaaattgagatggcaggggtggagtatatatattcttctgttagggatataacgaaacaaaaagaggaatcaaaaaatatattagaacaaaaaattgagtttgaaacaattttcaatacttcaaaagatggtatagccatattagatatagaatcaaattttataaatttcaatcaagcgtatttggaaatgacaggatttgcaagagaagagttacttacaaaatcttgtattgaacttacatcacctgaagatagacaaaaatgtatagataccttatctttgattttaaaagtaggatatattgaaaactatcaaaaaatttgtattgtaaaagatgataaaagaatagtaaccaatatgagtatctctttgttaccagataaaaatagaattcttgtggttacaaaagatataacagcgttaaaaatgctagaagagcaatcaaaactagcttcaatgggtgagatgatagggaatatagcacatcaatggagacaaccactctctgttatatctacgggtgcaacgggtatgaaaatacaaaaagagtatggtttattagatgatgcaatcttctacgaaacatgtgatattattgatgaaaatgtacaatatctctcaaaaactattgatgattttagaaactttattagaggtgatgttacatttaaactagttgctattagtgaagtattagaagatacataa

SEQ ID NO: 10922 - protein, 266 aa, Unknown
  Obtained from environmental sample
  DOMAIN (183)...(253): His Kinase A (phosphoacceptor) domain
  misc_feature (1)..(266): Xaa is any amino acid
MKNISNTPIITETIHKRKNGSLYDASITSIKIEMAGVEYIYSSVRDITKQKEESKNILEQKIEFETIFNTSKDGIAILDIESNFINFNQAYLEMTGFAREELLTKSCIELTSPEDRQKCIDTLSLILKVGYIENYQKICIVKDDKRIVTNMSISLLPDKNRILVVTKDITALKMLEEQSKLASMGEMIGNIAHQWRQPLSVISTGATGMKIQKEYGLLDDAIFYETCDIIDENVQYLSKTIDDFRNFIRGDVTFKLVAISEVLEDT

SEQ ID NO: 10923 - DNA, 753 bp, Unknown
  Obtained from environmental sample
  misc_feature (1)..(753): n is a, c, g, or t
ttgtgcttcgagcttcgatggtcagagggcttggacctttacaaagaaaattatatacaaacaaagaaatatcatgatattgtaataagcgatatttatatgccccagatggatggcattgccatgagtaaagcaatattggaaataaataaagaacaaaaaatagtcattatgtctgcaacggaggagagaaggtacttagttgaaattattcatcttggtatagaaagttttattcaaaaacctttcaattctaaacagatggttgaccctttatataaagtatgtatgacatttcaatttaatgatttacaatattttaaagccttgactcaagcttctatagtttctaagacagatacggatggggttataacatatgtaaatagtaatttttgcgatattaccggttatacttatgaagagataatcggtcagactcatcgtatgtttaagcatcccaataatcctccatcgatatataaggagatgtgggaaacaataacttcagggaaaatctggagagaactgatggtaaatcttaacaaagatggctcactcttctatgctgaatcaactatcatcccccttataggtaaagatggtgagattacagagtatatggctattcgcaacgatataactgatattctattgctcagacgtgaaatcaaagataagaaaatatatcagggaaaaagaagaacatataaaagccgccaagaaatcctttttacttgtttttacccctga

SEQ ID NO: 10924 - protein, 250 aa, Unknown
  Obtained from environmental sample
  DOMAIN (2)...(100): Response regulator receiver domain
  misc_feature (1)..(250): Xaa is any amino acid
MCFELRWSEGLDLYKENYIQTKKYHDIVISDIYMPQMDGIAMSKAILEINKEQKIVIMSATEERRYLVEIIHLGIESFIQKPFNSKQMVDPLYKVCMTFQFNDLQYFKALTQASIVSKTDTDGVITYVNSNFCDITGYTYEEIIGQTHRMFKHPNNPPSIYKEMWETITSGKIWRELMVNLNKDGSLFYAESTIIPLIGKDGEITEYMAIRNDITDILLLRREIKDKKIYQGKRRTYKSRQEILFTCFYP

SEQ ID NO: 10925 - DNA, 306 bp, Unknown
  Obtained from environmental sample
  misc_feature (1)..(306): n is a, c, g, or t
ttgtgggtggcatggtatctatataagggctcatggctcacggaacttcttgcccgtcatatattcttcgataaactccctgaacatttcggactgccaaacatcattgccaaaagactcattgttcccgaatgtatccaatggaacttctctgaagaaaaaatactcatgttttccaacaaactcctttgtgatgaagaatatcgaaacactcaaaagactgaactgacagctttgattgagaatctttcaaagtcaggaacatcaagaattgttgctgaaatgaccatgaaactaattaaatga

SEQ ID NO: 10926 - protein, 101 aa, Unknown
  Obtained from environmental sample
  misc_feature (1)..(101): Xaa is any amino acid
MWVAWYLYKGSWLTELLARHIFFDKLPEHFGLPNIIAKRLIVPECIQWNFSEEKILMFSNKLLCDEEYRNTQKTELTALIENLSKSGTSRIVAEMTMKLIK

SEQ ID NO: 10927 - DNA, 339 bp, Unknown
  Obtained from environmental sample
  misc_feature (1)..(339): n is a, c, g, or t
atggggggccacaattttctcgaggcagctgttcatagaaaacccattatcgtaggccctgacattcataatttttcagaggatggtgacagattcattgagaattcagctctcatacaggttgcatcaactgctgaatttacaacgaaagtcatggaacttcttaatactttcatgaccgatgaaacaggtgaaagggccttcaaacttcttatggataatcaaggagcttcaaagctgacgtataatgatattgtagataatttatataaatccagttgtatatctcaagaccgtctgatagaaaagaagaagagcaaggagaaggaaaatgaataa

SEQ ID NO: 10928 - protein, 112 aa, Unknown
  Obtained from environmental sample
  misc_feature (1)..(112): Xaa is any amino acid
MGGHNFLEAAVHRKPIIVGPDIHNFSEDGDRFIENSALIQVASTAEFTTKVMELLNTFMTDETGERAFKLLMDNQGASKLTYNDIVDNLYKSSCISQDRLIEKKKSKEKENE

SEQ ID NO: 10929 - DNA, 528 bp, Unknown
  Obtained from environmental sample
  misc_feature (1)..(528): n is a, c, g, or t
ttgctattatgggtactcacnggcttgaaaagcattaaaaaagctatgaaggtagtaaagaaatttgtgaagattcctttcatccttgtacaaagccctgtaatttttggggaatatgacagaattgtaattcctgttgatgccgacaaaacatcaagaattaaagttcagtgggtaagatacatcaataatttatttgcaagtaaagcatttatcttgtcatataaagtttctgatgaatttagaatgaaatcagtaaatagcaatctaaagtttgctcaaaatatgtttgataaacatcttattgattatgaaattacagttttagattcacctaagaattttgctgaccaactttattcatactcaaacaaagtagaaagtgacattatacttataatgacagaccgatacagatcttatgtaaaagatttgaagagcgccagtaataaagaattatacaagaaaattcctattatgtgcgtaaataaacgtacagatattattaagcttgggaatctcggttag

SEQ ID NO: 10930 - protein, 175 aa, Unknown
  Obtained from environmental sample
  misc_feature (1)..(175): Xaa is any amino acid
MLLWVLTGLKSIKKAMKVVKKFVKIPFILVQSPVIFGEYDRIVIPVDADKTSRIKVQWVRYINNLFASKAFILSYKVSDEFRMKSVNSNLKFAQNMFDKHLIDYEITVLDSPKNFADQLYSYSNKVESDIILIMTDRYRSYVKDLKSASNKELYKKIPIMCVNKRTDIIKLGNLG

SEQ ID NO: 10931 - DNA, 441 bp, Unknown
  Obtained from environmental sample
  misc_feature (1)..(441): n is a, c, g, or t
gtggaaagaatattaaactatataaaagtaagtgatacaatctcaacttctggacaacctttaaaaaagcaatttaaaaaaatagcaaaagagggctttgaagtgattataaatcttggattaaatactcatccagaagctttaaaagaggaagataaaattgtttcaaagaatggaatgatttattttcatattcctatatcatgggaagaaccagaaattgatagacttaaactttttttgatacttcttgaaagtttacaaaaggaaaataaaaaagtttttatacattgtattaaaaattatagagtatctgtctttatctataaatataaaaaagatattttaaaacaaaaagatgcaaaacttgtagccccaaaagaatataaaccaaatgaagtttgggaaaaagttttaaaatctaaaaatataaagaggtaa

SEQ ID NO: 10932 - protein, 146 aa, Unknown
  Obtained from environmental sample
  misc_feature (1)..(146): Xaa is any amino acid
MERILNYIKVSDTISTSGQPLKKQFKKIAKEGFEVIINLGLNTHPEALKEEDKIVSKNGMIYFHIPISWEEPEIDRLKLFLILLESLQKENKKVFIHCIKNYRVSVFIYKYKKDILKQKDAKLVAPKEYKPNEVWEKVLKSKNIKR

SEQ ID NO: 10933 - DNA, 933 bp, Unknown
  Obtained from environmental sample
  misc_feature (1)..(933): n is a, c, g, or t
atgctaggatggctgaggtgcatgatgttacagactgcctcttttgtttctaaatactatgtatgtagtttgggtgaagctttgagtgtttatacaccattttatgatctagaaacaatagaagaaaccccagaaataaagtgtgatatcgaactctcaaatgaacaacaaaaagcgtacaattttatacaaaaaaaccctacaagtttactttttgcaaacacaggaagtgggaaaacagaaatttatattaaagctatagaaaatatactgtctcaaaataaacaaaccctacttttgcttccagaaatttcacttagcccccaaatggaacaaagactgaaaaaagtatttaaagaaagcatcgcaatatggcactcaaaaatacagaaaaaaacaaaacaaacaatcatagaaaatctgcttagtggaaaagtaaaaatcattgcaggtgctaggtctgcactttttttaccttatgataatttagggttaattatcgttgatgaggagcatgatgactcttataaatcagatcaaaaaccacgagttaatataaaagatttatcaatctatatggggaaaaaatttgatattcaagtgatacttggaagtgcgacacctagtttaagtagctttcataaaatcccatacataaggataaaaaaaactttttttgactcagagaaacaaatatcatttgtaaattcgaatttggaactctcagcttcaattatagaaaaaatttcacaaacattagaaaatcaaaaccaagtgatagtttttcttcctactcgtgcaaatttcaaataccagatatgtaaagattgtggaaaatctatcgagtgtcctttctgttcgggtagtttaagtctacacaaaaacataatgcttttacatgccattatggtaactacccccaaccaattgatt

SEQ ID NO: 10934 - protein, 311 aa, Unknown
  Obtained from environmental sample
  DOMAIN (50)...(210): Type III restriction enzyme, res subunit
  misc_feature (1)..(311): Xaa is any amino acid
MLGWLRCMMLQTASFVSKYYVCSLGEALSVYTPFYDLETIEETPEIKCDIELSNEQQKAYNFIQKNPTSLLFANTGSGKTEIYIKAIENILSQNKQTLLLLPEISLSPQMEQRLKKVFKESIAIWHSKIQKKTKQTIIENLLSGKVKIIAGARSALFLPYDNLGLIIVDEEHDDSYKSDQKPRVNIKDLSIYMGKKFDIQVILGSATPSLSSFHKIPYIRIKKTFFDSEKQISFVNSNLELSASIIEKISQTLENQNQVIVFLPTRANFKYQICKDCGKSIECPFCSGSLSLHKNIMLLHAIMVTTPNQLI

SEQ ID NO: 10935 - DNA, 384 bp, Unknown
  Obtained from environmental sample
  misc_feature (1)..(384): n is a, c, g, or t
atgatggatatagacttttttaaacaggtaaacgatgagtttggacatcaaataggcgattatgttttaaaagagattgcagtaattttaaaaaatttaaccagaggactagatattgtcggcagatggggtggagaagagtttatgattatctgtactgacacaaccattgatggtgcgtacttgctggcagaaaatttaagaaaagctatacaagatcacactttcaaagatgtaggtaaaaaaagtgcaagttttggggtagcccaaattaaagataacattactattgataagcttatacaaaatgttgataaagctctctatcttgcaaaaaacaacggtagaaaccagtgtgtaaagagtagtgaactagtgttataa

SEQ ID NO: 10936 - protein, 127 aa, Unknown
  Obtained from environmental sample
  DOMAIN (1)...(118): GGDEF domain
  misc_feature (1)..(127): Xaa is any amino acid
MMDIDFFKQVNDEFGHQIGDYVLKEIAVILKNLTRGLDIVGRWGGEEFMIICTDTTIDGAYLLAENLRKAIQDHTFKDVGKKSASFGVAQIKDNITIDKLIQNVDKALYLAKNNGRNQCVKSSELVL

SEQ ID NO: 10937 - DNA, 750 bp, Unknown
  Obtained from environmental sample
  misc_feature (1)..(750): n is a, c, g, or t
atggacaaaatatcaaaactatcaaaacagcttttaaaatctattttaatcatatattttataattactgcttctgttaccatagtacatttagtagtagattactactatacaaaagctcacataaaagatgaacttcaatccatggctaaaactttcacacctgccattcaaactgcactttgggatttaaacagcgaacagttaaaatccatagcagacggaatgaaaaagattcctcttattttttccgtaatcataaacgattcaaatggaaatgaactcgttaaaagtgaaaaaaactttatgaaaacggatgaactctcctactcatataaaatttatcaaaaatataatgataaaaacatatttttagcagaagtttttatctactcagataacagtgtcatcatagatagattaaaagtcggttttggcatgatatttttaaatgcatttattaaaagtactgcacttgtctttttgtttattttatcttttagaaaataccttgaacgaccacttggtgatttgacatctaaaatttcacacttagattggaaaaataagagaaaaagaaaaatagatataacctttgaaaatcaaaatgaactctatgttttacaaaagatatttaacgaacttttagaaaacatctcaaccgaagaggaaaatagagttaattttattgaaaaaatgaatattaaactggaaaatgatgtaaatacaagaactcaagagctaaaagat

SEQ ID NO: 10938 - protein, 250 aa, Unknown
  Obtained from environmental sample
  misc_feature (1)..(250): Xaa is any amino acid
MDKISKLSKQLLKSILIIYFIITASVTIVHLVVDYYYTKAHIKDELQSMAKTFTPAIQTALWDLNSEQLKSIADGMKKIPLIFSVIINDSNGNELVKSEKNFMKTDELSYSYKIYQKYNDKNIFLAEVFIYSDNSVIIDRLKVGFGMIFLNAFIKSTALVFLFILSFRKYLERPLGDLTSKISHLDWKNKRKRKIDITFENQNELYVLQKIFNELLENISTEEENRVNFIEKMNIKLENDVNTRTQELKD

SEQ ID NO: 10939 - DNA, 438 bp, Unknown
  Obtained from environmental sample
  misc_feature (1)..(438): n is a, c, g, or t
ttgaacaagcaaagaaatccaaggagtttccttagcggcgggaaaagggaggaccaacttaggatcaactgttcgttgaagagatttatccagaaaatggaattgtatatgaaaggtgattcgcctgatgcggatgcaatagatcaaagtaagcggganccgagcttttggtttgtcaagatcacgggcatttatttgatgtcaaatggtattttaaacaaagatgaaaagatcatcatttatgctgagaactttgatccgagaacgacagaagactggtatcatcatttagatgcattaaatgaagaacttgaagatgggtctgattttgttatccctgttggcttaaattggctggatatgtctttaaaagcaaacccagaggcggaatggattgagatagaaattaataaggaacaactagctttaatcctataa

SEQ ID NO: 10940 - protein, 145 aa, Unknown
  Obtained from environmental sample
  misc_feature (1)..(145): Xaa is any amino acid
MNKQRNPRSFLSGGKREDQLRINCSLKRFIQKMELYMKGDSPDADAIDQSKRXPSFWFVKITGIYLMSNGILNKDEKIIIYAENFDPRTTEDWYHHLDALNEELEDGSDFVIPVGLNWLDMSLKANPEAEWIEIEINKEQLALIL

SEQ ID NO: 10941 - DNA, 531 bp, Unknown
  Obtained from environmental sample
  misc_feature (1)..(531): n is a, c, g, or t
atgaaaaaaataaacgaactgacattagacgaaagaacacaattggtttatgatctggttatcaaaaaaacaacaaaaattgaagacttcatgatgaagctaaaattgccggacccgaatgaaatatntgacccgtctttcgacccagctatcttttcatcaaaagcagaaacaatccaagtgccgcaaaaatgcatctactcagaagtgctcaaagaaaaaatatggattggcgaaagtggtagcggcgagttttttgaaatgctcgaattaacagccacaaaggatgatggtaagcagggatttcatatcaacatagaatttttatccatcatcaatgaagaagggggagtccaaaaccttttttacagctatcaaaatattttcaacttcgaagggctcaaagatcttggagaacatgaagacaatatctatctgcagttaattttagaaacgagatactttaataatttcctatccttcctggatccagcaaacttttctaaatcaatgaagtgtgtgttcaaatga

SEQ ID NO: 10942 - protein, 176 aa, Unknown
  Obtained from environmental sample
  misc_feature (1)..(176): Xaa is any amino acid
MKKINELTLDERTQLVYDLVIKKTTKIEDFMMKLKLPDPNEIXDPSFDPAIFSSKAETIQVPQKCIYSEVLKEKIWIGESGSGEFFEMLELTATKDDGKQGFHINIEFLSIINEEGGVQNLFYSYQNIFNFEGLKDLGEHEDNIYLQLILETRYFNNFLSFLDPANFSKSMKCVFK

SEQ ID NO: 10943 - DNA, 558 bp, Unknown
  Obtained from environmental sample
  misc_feature (1)..(558): n is a, c, g, or t
atggaacaaaactatcaaaataataaaacagaaatagtgtattcaaaaaataatattaactattgtgttgaaactattaaaaataatcctgatctatgtagagttgttagaagtactaacgatgtaatgagtgtacaagaccattcagtatgtcctcattttactaataatgaaaaactctattattgtacctcaattgatattggtgaccaatctattttaattattaattttatcttagatacaaaggcagaattagatgaactagtaagaaatataccacttattaaaaattattttatggaagcaacgccatcattaattgtaaaacttctacttgaagctcttaaatcatctgcatttagagatgggttaacaaacctctataatagaaaatttcttgatgaacatttaacgaaacttgttccacaagcattaagagaaaatattaaaattggtgtattaatgcttgatatggatcattttaaatctgtaaatgatgaatatggtcatgatattggtgacttagtattaaaagaaccggggaaaaatttttag

SEQ ID NO: 10944 - protein, 185 aa, Unknown
  Obtained from environmental sample
  DOMAIN (116)...(185): GGDEF domain
  misc_feature (1)..(185): Xaa is any amino acid
MEQNYQNNKTEIVYSKNNINYCVETIKNNPDLCRVVRSTNDVMSVQDHSVCPHFTNNEKLYYCTSIDIGDQSILIINFILDTKAELDELVRNIPLIKNYFMEATPSLIVKLLLEALKSSAFRDGLTNLYNRKFLDEHLTKLVPQALRENIKIGVLMLDMDHFKSVNDEYGHDIGDLVLKEPGKNF

SEQ ID NO: 10945 - DNA, 372 bp, Unknown
  Obtained from environmental sample
  misc_feature (1)..(372): n is a, c, g, or t
atgatattgggtgactttagtattaaaaagaacttggaaaaaattttaagtgaaaatgtaagagaatcagatattgttgtaagatatggaggagaagagtttattatacctcttattggggtagataatgaagaatctgtacttgaagtagcaaataaaatacgaacaaaagtcagtaaaaatgaaatcaatgtatatgctggaaataaattaagaaaaactgtaagtattggtttttctatgtttcctgaagactctacaaactttgatatagtgctaaaaaatgccgatattgcactttatgaggcaaaagagaaagggagagatcaagttataagatttcaagagaaggttcaagtagaactattttaa

SEQ ID NO: 10946 - protein, 123 aa, Unknown
  Obtained from environmental sample
  DOMAIN (2)...(110): GGDEF domain
  misc_feature (1)..(123): Xaa is any amino acid
MILGDFSIKKNLEKILSENVRESDIVVRYGGEEFIIPLIGVDNEESVLEVANKIRTKVSKNEINVYAGNKLRKTVSIGFSMFPEDSTNFDIVLKNADIALYEAKEKGRDQVIRFQEKVQVELF

SEQ ID NO: 10947 - DNA, 759 bp, Unknown
  Obtained from environmental sample
  misc_feature (1)..(759): n is a, c, g, or t
atggacaaaatgactcatgttaaatttaattttaataattttttaatgggttttagtaatgcttttgataaagtgtttaaaaaaaatatctacaatgttgcgtttaattctaaacgaatctcttatatcgctttgaggttatctaattatacaaattttacagcagaacatttttctgatttgtctgcttactcactattgtataagttagatgtacccaatgaacaattaagtaaaatgccttttattgaaaaaactatttatacagataaaaatataaaaaatattttagaattgagttgttatatagaaaataatattaaaattgaatatgatgttataacaaataaagatgatattatagctacaatcaataaaagtgagcagtttagccaaacattaaaagagaactttattgacttgagtgaagatatgactttttggttagacttagcaaataataatcaattaccattctttatatacaattttttgcaagattttactatagagattgaatatacacaattgataaaattatctgaaattattaatgagatagtgtatgcatatactaataatacaaatacaaatacaattggtaccctatgtaaagagatgtgtccagtttatagtttaaataataaaagatatttcgaggaagatttatcctcaccaaaacttatatttgtatttgggaaaaactattttatccccccaccgaagaatattccttataaaaaagccaattatttttaa

SEQ ID NO: 10948 - protein, 252 aa, Unknown
  Obtained from environmental sample
  misc_feature (1)..(252): Xaa is any amino acid
MDKMTHVKFNFNNFLMGFSNAFDKVFKKNIYNVAFNSKRISYIALRLSNYTNFTAEHFSDLSAYSLLYKLDVPNEQLSKMPFIEKTIYTDKNIKNILELSCYIENNIKIEYDVITNKDDIIATINKSEQFSQTLKENFIDLSEDMTFWLDLANNNQLPFFIYNFLQDFTIEIEYTQLIKLSEIINEIVYAYTNNTNTNTIGTLCKEMCPVYSLNNKRYFEEDLSSPKLIFVFGKNYFIPPPKNIPYKKANYF

SEQ ID NO: 10949 - DNA, 432 bp, Unknown
  Obtained from environmental sample
  misc_feature (1)..(432): n is a, c, g, or t
ttgcaagtaacatttttcacttttgtgttgattggtatctttatctactggaatcttaaacttaaagaggagataaaaagtaaagagttagctcaaaaacaactaaaattaagtgaagagaaatttcgaacactttttgatatagcacctgtgcttttaaactcttttgataaaaatggtcaaatagttctatggaacaaggagtgtcaaagagtttttggctggagtaaaaaagagcttattgtatctaagaagcctatagcattgttttatcctgatccaaaatcacaacaaaaacttatagattcattatcaaaaccagaccactctagctacaaattgtggtatccaaaaactaaaaatggtgaaactcttactactatgtgggcaaatataaccttaccgaaaggtgatataatcccaataggttaa

SEQ ID NO: 10950 - protein, 143 aa, Unknown
  Obtained from environmental sample
  DOMAIN (40)...(103): PAS domain
  misc_feature (1)..(143): Xaa is any amino acid
MQVTFFTFVLIGIFIYWNLKLKEEIKSKELAQKQLKLSEEKFRTLFDIAPVLLNSFDKNGQIVLWNKECQRVFGWSKKELIVSKKPIALFYPDPKSQQKLIDSLSKPDHSSYKLWYPKTKNGETLTTMWANITLPKGDIIPIG

SEQ ID NO: 10951 - DNA, 336 bp, Unknown
  Obtained from environmental sample
  misc_feature (1)..(336): n is a, c, g, or t
gtgcccatcaaggagtggctggcagaaaataatatctccgtcaatatcttcaattgtagagaacaaccagtatatggccatggctgtactcgctgcagcagcaacaacatatcccagagcaagatactcatcaagaccacgataagcagctatggctgtcaatccaccactaaaggcaacaaaccctccaaggagggtaacaagggttttctgcttgtcaaaatacatgagaaaaataattacatgaagaaaggtaaaatgaaaatatgccgcaacaataagctcccgaaacaagagggggctgaatttctgcagatgaaagaacgtgagcaatga

SEQ ID NO: 10952 - protein, 111 aa, Unknown
  Obtained from environmental sample
  misc_feature (1)..(111): Xaa is any amino acid
MPIKEWLAENNISVNIFNCREQPVYGHGCTRCSSNNISQSKILIKTTISSYGCQSTTKGNKPSKEGNKGFLLVKIHEKNNYMKKGKMKICRNNKLPKQEGAEFLQMKEREQ

SEQ ID NO: 10953 - DNA, 606 bp, Unknown
  Obtained from environmental sample
  misc_feature (1)..(606): n is a, c, g, or t
atgtttgtatcacaaacagatacagaggtgattgtacatctttttgaatactattttaacaaaacaaatgatgcaaaaaaatcttttcttgatactattgctagacttgaaggtgcatactcactccttcttattacaaaatcaccaccaaatacaatattttttatgaagcatggctcccctttagctattgcacgtgggaataataaagatgaaatattatttgcctcttctgatgctccacttattggattatcttctgatgtggcgtatcttgaggatggtgtaagtggatatgcagttgatggaaatattgtatttaatcaagaagtgaagtgcaccacacttcccacaagtaaacaatttgctcaaaaagatggttttagattttttatggaaaaagatatatatgagccacgtgatgtagttccggatagtacgcttggacggataaaagatgatggaatttattttgaagagttcacagaagatatttgcaaaggtatcagtgagattaaactctgtgcttggggtacttcctatcacgcggggttaaacacctctcttacctttttgaagagaatatccaaaaaggtgaagatgtag

SEQ ID NO: 10954 - protein, 201 aa, Unknown
  Obtained from environmental sample
  misc_feature (1)..(201): Xaa is any amino acid
MFVSQTDTEVIVHLFEYYFNKTNDAKKSFLDTIARLEGAYSLLLITKSPPNTIFFMKHGSPLAIARGNNKDEILFASSDAPLIGLSSDVAYLEDGVSGYAVDGNIVFNQEVKCTTLPTSKQFAQKDGFRFFMEKDIYEPRDVVPDSTLGRIKDDGIYFEEFTEDICKGISEIKLCAWGTSYHAGLNTSLTFLKRISKKVKM

SEQ ID NO: 10955 - DNA, 378 bp, Unknown
  Obtained from environmental sample
  misc_feature (1)..(378): n is a, c, g, or t
atgttcgataaattctacgccgttgcaggcaacactgactactctctagaccttccggaaaacctgtgcagtgaaattgaaggaataaaattttatctcgtacataacttaagtgctcctcacaggataatttcctctaaccattccaagatctgcaaatgcaccccgacccttgtagtttttggtcatacacacacaccgcttatcgaaaagaaagaaaatacaatatttttaaacccgggatctcttggaaaaaaaggacttaccggatacagatcctatgcaattattgaaattgacggctcacacattaaaaagatcgagataattgatgtcaagaaccagtcaataataaaaacatatgaaaatgaaaactaa

SEQ ID NO: 10956 - protein, 125 aa, Unknown
  Obtained from environmental sample
  misc_feature (1)..(125): Xaa is any amino acid
MFDKFYAVAGNTDYSLDLPENLCSEIEGIKFYLVHNLSAPHRIISSNHSKICKCTPTLVVFGHTHTPLIEKKENTIFLNPGSLGKKGLTGYRSYAIIEIDGSHIKKIEIIDVKNQSIIKTYENEN

SEQ ID NO: 10957 - DNA, 741 bp, Unknown
  Obtained from environmental sample
  misc_feature (1)..(741): n is a, c, g, or t
atgaaaatcttatatattcttgtatttgtattttcgttttttttagaagcacgggattttaaagttgcgtcgtataatgttgaaaatctttttgatttaaaatatgatggaacagagtataaagagtacaaacctaatacaaaaacttgggataaaaactcttttactaaaaaaatagaaaatattgcacaagttatcaatgatctgaatgcagatattatagctttacaagagatagaatctaaagaggcacttaacactctagtaaaaaaagctccccaatataaatatcacacctttcttaaaaaagaaacctcttctgtaggtgttgcacttttaagcatctatcctataaaaaactcaacaaaaattgatgtagattccaatgacaaatattctcgatatattttaaaagctacagttttaattgaagacaaaaagttaataatatttgtcaatcattggcgttcaaaaagagcagcagaaagcaaaagaattatctacgcaatgggattaaaaaaagagattgatagtttggataaaaatgaagattatattattttaggtgacctaaattctaattataatgaatttcaaactttcaaatatgataaaaatttaaatgatagctttggaataacaggtataaatcaaattttaaacactacagatagagaaaactttatccacatagaccatatgcttaacttcaataaaaaggtacattataacctatggtag

SEQ ID NO: 10958 - protein, 246 aa, Unknown
  Obtained from environmental sample
  DOMAIN (20)...(245): Endonuclease/Exonuclease/phosphatase family
  misc_feature (1)..(246): Xaa is any amino acid
MKILYILVFVFSFFLEARDFKVASYNVENLFDLKYDGTEYKEYKPNTKTWDKNSFTKKIENIAQVINDLNADIIALQEIESKEALNTLVKKAPQYKYHTFLKKETSSVGVALLSIYPIKNSTKIDVDSNDKYSRYILKATVLIEDKKLIIFVNHWRSKRAAESKRIIYAMGLKKEIDSLDKNEDYIILGDLNSNYNEFQTFKYDKNLNDSFGITGINQILNTTDRENFIHIDHMLNFNKKVHYNLW

SEQ ID NO: 10959 - DNA, 846 bp, Unknown
  Obtained from environmental sample
  misc_feature (1)..(846): n is a, c, g, or t
ttgggtcttctccctttgcttcccccagaaagcaagcaatcccgcgggactataaggctttctggaaaaggttctttcctaaaaagggaggttacccatacgttaaaagggaaaaaattttgggggggggggcgtaggcaatttttgggggggtccattcccaaggaagatggaagtggttcactttttgtgttaagggaggtgatttcttttctttggcaaaagatgcgcccactgtttctgcaaaacatattattttctggggggtacacttcatggctgaaactgctgaaatcgtcacaaaagaagatcagaaagttttacattcttgatccaacagccggatgtttccttgctgactgtgccaatattcaacaaatcgaagaggtttgggaaaaattgacatccatgactgatgacaaaatcattccgattacctatgtgaattctgctgccgacctgaaagcattcacaggaaaacatgaaggaattgtttgtacttcttccaatgcagaaaaagccttgacaaaagcccgtgagatcggcgataaaatattttttttcccggaccagcaccttggtagaaatactggtgtaaaaatgggaattaaccttgataaaattaaactatggaaaaaaaacagtactggtttgactgtttctgaaatacaaaatgcagaaattattctttgggacggatattgcgatgttcatcaggaattcagttccaattacatcgactacttaagagaaacttacgcaggaatcaaaatcgtcgctcatccggaatgcagtttccatcttgccaaaaagcagactatacaggtagtacaaaagagatcatag

SEQ ID NO: 10960 - protein, 281 aa, Unknown
  Obtained from environmental sample
  DOMAIN (72)...(281): Quinolinate synthetase A protein
  misc_feature (1)..(281): Xaa is any amino acid
MGLLPLLPPESKQSRGTIRLSGKGSFLKREVTHTLKGKKFWGGGRRQFLGGSIPKEDGSGSLFVLREVISFLWQKMRPLFLQNILFSGGYTSWLKLLKSSQKKIRKFYILDPTAGCFLADCANIQQIEEVWEKLTSMTDDKIIPITYVNSAADLKAFTGKHEGIVCTSSNAEKALTKAREIGDKIFFFPDQHLGRNTGVKMGINLDKIKLWKKNSTGLTVSEIQNAEIILWDGYCDVHQEFSSNYIDYLRETYAGIKIVAHPECSFHLAKKQTIQVVQKRS

SEQ ID NO: 10961 - DNA, 606 bp, Unknown
  Obtained from environmental sample
  misc_feature (1)..(606): n is a, c, g, or t
atgacattaaaccaacttccaaagaatataacattatatctttatggtagtggatatatgggtgaaacttattttcaattaatacaaatattaagagatgatattcaagttaagtttatcgatgataatgataacaatgaggatgctattaattttcatacatttcatgatttagaaaaaaacaacttttttattgttaactgtataatcactgcaaatgtaaaagaatctattaatatcaaattaatcaataatgggtataaggactatttaattgaaataaagggaattgatggttttttaaaaagtgaaacattcccttttaactacatgatgttagaaaaattttatatcaacaataaatctattataaataaaaatattgattcacttgattctaatcaagacaaattactatatgaatcattacttaagtacagatatctagatttaaaaaaacaagaactattaaaaaatggtgaattttttaatagttttggtaattataatgaagagttacaatattgtgaatatttaaatgatacacatatccatacaattattgagggcggtatatttgatggtaagaggtattataaagattaa

SEQ ID NO: 10962 - protein, 201 aa, Unknown
  Obtained from environmental sample
  misc_feature (1)..(201): Xaa is any amino acid
MTLNQLPKNITLYLYGSGYMGETYFQLIQILRDDIQVKFIDDNDNNEDAINFHTFHDLEKNNFFIVNCIITANVKESINIKLINNGYKDYLIEIKGIDGFLKSETFPFNYMMLEKFYINNKSIINKNIDSLDSNQDKLLYESLLKYRYLDLKKQELLKNGEFFNSFGNYNEELQYCEYLNDTHIHTIIEGGIFDGKRYYKD

SEQ ID NO: 10963 - DNA, 747 bp, Unknown
  Obtained from environmental sample
  misc_feature (1)..(747): n is a, c, g, or t
ttgcctccaccgacatatgtagcaaaagagtataaaattgatgatataaatgagtatctatatcaggcatacagttcagaagaagagaaacatttagcacaactgaaaaaacaaaaaatagcactgctagagaaaaaaatagatacattaaaaagacggttatattcattagagaatgaagaaaacctgcaaaacagcatgttggaaaatcaaaaaattggcaatattatcttggcaaacatgcataacataaaaccatacatgattgaagtgcttttggatgattttgatggttccgagatattgattaaatttgataaaagcatgacttcagcatctcagataggtaaccactattttaaaaaagcaaaaaaagagaaacaaaaaattaccaaccttcatatagagagagaaaatttagagcagaagatagagtatcttaaacactttgtacatactgtccaagatgcagagagtatctctacaatagagatgctctttccaaataaaaagcagctaanaaagactaaaaaagaggatgactcttgtgaaattttttggatagagggttataaggttactcttggtaaaaatgagagaggaaatattttactccttcaaaaagcaaaagcgagagatatttggttgcatctaaaagatcgtccatcaactcacgttattatctcaacagacaaacaaaatctgcccccaagtgttatctactctgcggcaaagttggtgggtgaa

SEQ ID NO: 10964 - protein, 249 aa, Unknown
  Obtained from environmental sample
  DOMAIN (185)...(249): Domain of unknown function (DUF814)
  misc_feature (1)..(249): Xaa is any amino acid
MPPPTYVAKEYKIDDINEYLYQAYSSEEEKHLAQLKKQKIALLEKKIDTLKRRLYSLENEENLQNSMLENQKIGNIILANMHNIKPYMIEVLLDDFDGSEILIKFDKSMTSASQIGNHYFKKAKKEKQKITNLHIERENLEQKIEYLKHFVHTVQDAESISTIEMLFPNKKQLXKTKKEDDSCEIFWIEGYKVTLGKNERGNILLLQKAKARDIWLHLKDRPSTHVIISTDKQNLPPSVIYSAAKLVGE

SEQ ID NO: 10965 - DNA, 783 bp, Unknown
  Obtained from environmental sample
  misc_feature (1)..(783): n is a, c, g, or t
atgaaaaaagtatttgtatatggtgattttaacatcttgcatccaggtcacttaagacttttaaagtttgccaaagggagtggggattatttaatagtaggtctaaacagtgatgaaatcagtcataaaggcgtaaaccaagatgttaggctagagtcaattgaagcaacaagttatgtagatgaagcatttatattagagagtacaccattagagtatattaaagacttcaaacctgatattgttgtaaaaggaaaagaacacgagagtagagaaaatattgagttagatattttaagttcttatggcggtaagctactttttagttcaggtgagattgctttttcatcaatggatttacttcaaaaagagtttttatcgtttaactcaaagcctcaacattcacaagaatatatatctagacataagttagatttctcaaacttaaaagaaataattgaaagtttttcaaaactaaatgttttagttgttggtgatactattgtagatgaatatatcacttgtgaacctttaggaatgtcacaagaagatccaacaatagttgtaagtccacttgcctacaataagtttataggtggagctgcaatagtagcatctcatgcaaaaacattaggtgcaaatgtgaaatttgtttcggttgtaggtgatgataaaaataaagactttgttaaatctgggcttgagaatctagatattgatacttctttattttgtgattcctctagacctaccacttttaaaacaagggtttcgtgccaataa

SEQ ID NO: 10966 - protein, 260 aa, Unknown
  Obtained from environmental sample
  DOMAIN (5)...(123): Cytidylyltransferase
  misc_feature (1)..(260): Xaa is any amino acid
MKKVFVYGDFNILHPGHLRLLKFAKGSGDYLIVGLNSDEISHKGVNQDVRLESIEATSYVDEAFILESTPLEYIKDFKPDIVVKGKEHESRENIELDILSSYGGKLLFSSGEIAFSSMDLLQKEFLSFNSKPQHSQEYISRHKLDFSNLKEIIESFSKLNVLVVGDTIVDEYITCEPLGMSQEDPTIVVSPLAYNKFIGGAAIVASHAKTLGANVKFVSVVGDDKNKDFVKSGLENLDIDTSLFCDSSRPTTFKTRVSCQ

SEQ ID NO: 10967 - DNA, 783 bp, Unknown
  Obtained from environmental sample
  misc_feature (1)..(783): n is a, c, g, or t
atgcccgctggattgattttcctttacggaatatttcctgacccacaaggcggaaaatttcccatagagaattcttcccctataattatcttttatgctcttgttcttgaaattagtaattcggagaataatgaagacttaaaaaaaattaatagacttgctgttgataatttgatttttaataagaatgaacatgctcttgatattggaggtggttgggagccatatagaattccatggattacagctcgtattttgataagcttcaaaaattctcagatagaaaatagtaaatacgaagcagttaataaatgtataaaagaaggattggaatcacttgtttttagaatatataaaggtaaattttggagaagtggggtaggtgattgggtgacaaattgggaatccacagggttatgccttgaagccttatttgaatggaattatattaagaaatatcctgaagaaatcgctaaggttctaaaatatactatggataatcaagatgattggttagagttaaatcctaattttacgagtgatgaaaaagctaacaaaactcttgctacaattattttaataacgacattattaagaatttcgcacagcgattttgatttttctatttgttctattagtttagaaaagtatttaaaatatctaagtctttgcatcgaagaaattgaggggaatggctcacctgttattagacaattttgcacaattcctcaaataatttactatatattggagttaatttatgaattgaaaaataaangatga

SEQ ID NO: 10968 - protein, 260 aa, Unknown
  Obtained from environmental sample
  misc_feature (1)..(260): Xaa is any amino acid
MPAGLIFLYGIFPDPQGGKFPIENSSPIIIFYALVLEISNSENNEDLKKINRLAVDNLIFNKNEHALDIGGGWEPYRIPWITARILISFKNSQIENSKYEAVNKCIKEGLESLVFRIYKGKFWRSGVGDWVTNWESTGLCLEALFEWNYIKKYPEEIAKVLKYTMDNQDDWLELNPNFTSDEKANKTLATIILITTLLRISHSDFDFSICSISLEKYLKYLSLCIEEIEGNGSPVIRQFCTIPQIIYYILELIYELKNKX

SEQ ID NO: 10969 - DNA, 780 bp, Unknown
  Obtained from environmental sample
  misc_feature (1)..(780): n is a, c, g, or t
atgcgtggtcgtgttggacgaagcaacaaaaaagcattctgctattttattactccagaatactctgcaatgaccactgatgccagaaagcgtatttccgctttagaacaatttactgaattgggtagcggatttaacattgccatgaaagatttagaaattagaggcgctggagatattttaggtggagaacaaagtgggtttattaatgatataggttttgatacgtatcaaaaaatactaaatgaagccattgaggaattaaaggaaactgaattttcagatttatataaagacgacctcaagcctaaagcatatgtaaaggatattactattgatactgattttgaattattatttccagacgattatatcaataatattaccgagcgtttaaacctttataccaaactcaacgacattaaaacagaagaagaactcgctaaatttgaaaccgaaattatcgacagatttggcgaattacctattcaagtttcagacttattagatagtgtacgcttaaaatggattgccacaaaaatgggaatagaaaaactcattatgaaacaaggtaaaatgattggttattttgtacaagaccagcaaagtggtttttatcaaagtgatgcatttacaaaagtgttacagtttgtacagttaaatgctcataaatgtaaaatgaaagagaaacaaactagaaaaggtttacgtttgcttcttaccttcggaaatataacatctacccaacaagcactggcagcattatccgatattaaatga

SEQ ID NO: 10970 - protein, 259 aa, Unknown
  Obtained from environmental sample
  DOMAIN (113)...(227): TRCF domain
  misc_feature (1)..(259): Xaa is any amino acid
MRGRVGRSNKKAFCYFITPEYSAMTTDARKRISALEQFTELGSGFNIAMKDLEIRGAGDILGGEQSGFINDIGFDTYQKILNEAIEELKETEFSDLYKDDLKPKAYVKDITIDTDFELLFPDDYINNITERLNLYTKLNDIKTEEELAKFETEIIDRFGELPIQVSDLLDSVRLKWIATKMGIEKLIMKQGKMIGYFVQDQQSGFYQSDAFTKVLQFVQLNAHKCKMKEKQTRKGLRLLLTFGNITSTQQALAALSDIK

SEQ ID NO: 10971 - DNA, 429 bp, Unknown
  Obtained from environmental sample
  misc_feature (1)..(429): n is a, c, g, or t
atggatcagatcggctcgagaataataaaacctagtaaaatctcagaagaaaagagtgatatagcagtttattcaaaagatgatagctttttatttgtaggaaatatggtatttaatggaagactccttagttataaaaaaacttcgaatataaatggctggatagaagccttagaaaacttagcaaaaataaaagcaaaatatcttttaggtggacatggaaaagactttgataaagattcttacaaagcatctttagaatatcttaaaattttaagagatgatgtaaaaaaagcatatgaagaaggaatcgatatttttgaagtaaaaaatcatgtcaaaactaaaaagtttgattatcttaagcattttgaacagttaaatagtgcaaatatatccatatattatactcaacttgagtgggaataa

SEQ ID NO: 10972 - protein, 142 aa, Unknown
  Obtained from environmental sample
  misc_feature (1)..(142): Xaa is any amino acid
MDQIGSRIIKPSKISEEKSDIAVYSKDDSFLFVGNMVFNGRLLSYKKTSNINGWIEALENLAKIKAKYLLGGHGKDFDKDSYKASLEYLKILRDDVKKAYEEGIDIFEVKNHVKTKKFDYLKHFEQLNSANISIYYTQLEWE

SEQ ID NO: 10973 - DNA, 450 bp, Unknown
  Obtained from environmental sample
  misc_feature (1)..(450): n is a, c, g, or t
gtggtgatactggcaattgctatgaatgtaattagttattatcgctcacttgatctaaataaggatagactaaatatagacactttttctctttttgatgggaataaatatgaagtctcaaaagataagcctatactgatttatttttgggctacatggtgtcctgtttgtaagtttcaatcacctaatatacaaaaattatcaaaagagtatgaagtaataactattgctgttcaatctggaaataaaaaagatatacaaaattatcttgatgaacacagtctaacatttaaagtagtaaacgatgaagatggtttttattttcaaaagtttaatatagaagtttttcctactacacttatatatgataaaaacaaaaatttaaaatttagtgaagtagggtatacaactactgcaggactttacacaaggatgttattgagcaaataa

SEQ ID NO: 10974 - protein, 149 aa, Unknown
  Obtained from environmental sample
  DOMAIN (27)...(148): Thioredoxin
  misc_feature (1)..(149): Xaa is any amino acid
MVILAIAMNVISYYRSLDLNKDRLNIDTFSLFDGNKYEVSKDKPILIYFWATWCPVCKFQSPNIQKLSKEYEVITIAVQSGNKKDIQNYLDEHSLTFKVVNDEDGFYFQKFNIEVFPTTLIYDKNKNLKFSEVGYTTTAGLYTRMLLSK

SEQ ID NO: 10975 - DNA, 681 bp, Unknown; identical to SEQ ID NO: 10429
  Obtained from environmental sample
  misc_feature (1)..(681): n is a, c, g, or t

SEQ ID NO: 10976 - protein, 226 aa, Unknown; identical to SEQ ID NO: 10430
  Obtained from environmental sample
  misc_feature (1)..(226): Xaa is any amino acid

SEQ ID NO: 10977 - DNA, 657 bp, Unknown
  Obtained from environmental sample
  misc_feature (1)..(657): n is a, c, g, or t
atgaaaaagcagatattggttgtagataatgataatgatatattagaacttctaaaatataatcttaatgttattggttatgatgtacttggactgctaagcacaaaatatgtaaagcaagttcttgaacaagaaaacatagaccttattattatggaaaaaaacttacctgatatcgaaggaggatactacgttgaaatgttacgtagtaaaggcatagagacacctgttatactactttcagaaaatggtacaactgaagatgtgaaagatggactcattaaaggtgctgatgactatatggctaaaccttttgatatagatgagttgattttacgcgcaaaaattattttgaaacgtactaacaaagagtttaaagtgttgaaacataatgttgtttataaagatatgcaaattgatctaaatatgaatcaggtttttatagaagatgcaagcatatcacttacaaatttagaaacaacacttctgaaagtttttgtatcaaacattggtaaagttttagatagagaatttttactaatgaatgtatggaaagatacagaaaatactcgcactaaaacagttaatgtagctataaaaagattaaaagagaagatagatcccttaaagaaacaaagatacataaaaaccgtttga

SEQ ID NO: 10978 - protein, 218 aa, Unknown
  Obtained from environmental sample
  DOMAIN (150)...(214): Transcriptional regulatory protein, C terminal
  misc_feature (1)..(218): Xaa is any amino acid
MKKQILVVDNDNDILELLKYNLNVIGYDVLGLLSTKYVKQVLEQENIDLIIMEKNLPDIEGGYYVEMLRSKGIETPVILLSENGTTEDVKDGLIKGADDYMAKPFDIDELILRAKIILKRTNKEFKVLKHNVVYKDMQIDLNMNQVFIEDASISLTNLETTLLKVFVSNIGKVLDREFLLMNVWKDTENTRTKTVNVAIKRLKEKIDPLKKQRYIKTV

SEQ ID NO: 10979 - DNA, 864 bp, Unknown
  Obtained from environmental sample
  misc_feature (1)..(864): n is a, c, g, or t
ttgagatattttcataagggtaatgaagcacttgcccacaataaagagcttctctataaagatggtgtaactaaactatttaaccgtagatattttgttctaaaaacaaatgagtttttaagtcctgaaaatagaaataacaacggctcactgattatgatagcacttcaagatgcaggtaaaataaatcaggcattaggtcatcaaaaaactgatgatctctttagaaatctggcaaaactgtttattgactctacagaaaaaataaaagattcgatcagcgcacgtctaaatggtacagagttcgccgttttacttccgcaaagtgatcttgaaaattcaaaagtaattgcggaacatgtagccaaaggagcatataaactatttgaagatgctgaattaaacccaacagagctaggtgtaaaaataggtctgagcaactactctcaaaatcaaaaactctctgatctgtttagctctgctgattatgctctgactcaggcaaaattgcttgaatatggaaaatactacctctataaaaacgaaagtgaaaaagagtcccttggaaaagaggcttggagagagattataaacagtgcactagaagttgacagatttaaaattctgctacgttctgttgtagatatagagagtaaaaaaatacctcatgacacgacaagtttttctatcaccactcaagatgataaaacattctactatggtgcatttatcgcacctgtcataggcttaggaatgcttacaaatgtatatctctatgttatcaataagattccttactaccgagaagctcaaaacctcaaaggaaaaaccccactccctacagaatctctcaaaattttataa

SEQ ID NO: 10980 - protein, 287 aa, Unknown
  Obtained from environmental sample
  DOMAIN (14)...(175): GGDEF domain
  misc_feature (1)..(287): Xaa is any amino acid
MRYFHKGNEALAHNKELLYKDGVTKLFNRRYFVLKTNEFLSPENRNNNGSLIMIALQDAGKINQALGHQKTDDLFRNLAKLFIDSTEKIKDSISARLNGTEFAVLLPQSDLENSKVIAEHVAKGAYKLFEDAELNPTELGVKIGLSNYSQNQKLSDLFSSADYALTQAKLLEYGKYYLYKNESEKESLGKEAWREIINSALEVDRFKILLRSVVDIESKKIPHDTTSFSITTQDDKTFYYGAFIAPVIGLGMLTNVYLYVINKIPYYREAQNLKGKTPLPTESLKIL

SEQ ID NO: 10981 - DNA, 729 bp, Unknown
  Obtained from environmental sample
  misc_feature (1)..(729): n is a, c, g, or t
atggaatatatatatatttgcaagatggtttcacaaaaattaatagataaaaagatgactcaattcacgcaagaagattttaagatatttgaagagatagaagagattcgagaaaatattaaaaaacaaaatcatgaaattaaatttttagattttggtgcaggtaatccagaagatacaagagatgataaaatgatgtctcaaggtgtacctactatcaaatacacaagtgagttatgtcaaatagggcttaaaaataactgggcacaacttatctactctttagtaaaagagaataagccaaatactattttagaactaggaacttgttgtggtttttcatctatctatatgtcaaaagcaagtaattcttctacaatctatacaatagagggagcttgtgaagtagctaaaatcgcaactcaaaatattcaaaaagcaaactgcgataatataatacaaaaaattggaaaatttaatgatattttaaaaccattattacaagagattaagaacgtagattttgcatttatagatggtcaccacgataaagatgcaacaattaaatattttgaagaaataaaaccatttttaaccaaaaatgctatcgttatttttgatgatattagctggtccgaggggatgaaagaaagttggcagataattactcaagacaaaggtattaaaaaatatgaaaatttagaaaaattaggaatttgctacttatga

SEQ ID NO: 10982 - protein, 242 aa, Unknown
  Obtained from environmental sample
  misc_feature (1)..(242): Xaa is any amino acid
MEYIYICKMVSQKLIDKKMTQFTQEDFKIFEEIEEIRENIKKQNHEIKFLDFGAGNPEDTRDDKMMSQGVPTIKYTSELCQIGLKNNWAQLIYSLVKENKPNTILELGTCCGFSSIYMSKASNSSTIYTIEGACEVAKIATQNIQKANCDNIIQKIGKFNDILKPLLQEIKNVDFAFIDGHHDKDATIKYFEEIKPFLTKNAIVIFDDISWSEGMKESWQIITQDKGIKKYENLEKLGICYL

SEQ ID NO: 10983 - DNA, 402 bp, Unknown
  Obtained from environmental sample
  misc_feature (1)..(402): n is a, c, g, or t
atggcaaaagaaaaacagtttaatagtatgaattcagatgaatatatgacatttattttaggtgagatgaagtatgccgtagagttacctaaaattagagaaattttaacttatccagagttaataacaattttaccaaatacaaaagattgggtaaaaggacttattaatttaagaggtgaagttgttccaattttagatattagaataaaatttaatacaggtaagattgaatataatgaaaataccgcagtaattgcagtaataacaaatgataatagaatgttaggattagttgtagataaagtagatgatgtacaaaaattaagactcagcttctttatatcccgtttcggacaggggttctggtatccctgccaaatatttaaaaggttttgttag

SEQ ID NO: 10984 - protein, 133 aa, Unknown
  Obtained from environmental sample
  DOMAIN (14)...(133): CheW-like domain
  misc_feature (1)..(133): Xaa is any amino acid
MAKEKQFNSMNSDEYMTFILGEMKYAVELPKIREILTYPELITILPNTKDWVKGLINLRGEVVPILDIRIKFNTGKIEYNENTAVIAVITNDNRMLGLVVDKVDDVQKLRLSFFISRFGQGFWYPCQIFKRFC

SEQ ID NO: 10985 - DNA, 309 bp, Unknown
  Obtained from environmental sample
  misc_feature (1)..(309): n is a, c, g, or t
atgggatatattcttaatatcaaaaacatggtttgtaaccgctgtattaaagtggtcgatgacgaaatatcaaaacttggttttgaaatcaaatcgattgaattaggcaaagtggtgctttccagaatacccaatgatactgaaaaagaaaaaatagaagcaagtttgcttaacaatggctttgaactaatcgatgataaaaagagcaagacaattgcagaaatcaaaaccattattattggacatgttcattacgataaagaaaaaaacgacaccttaattttttcgattttttaccgaaaaagatag

SEQ ID NO: 10986 - protein, 102 aa, Unknown
  Obtained from environmental sample
  misc_feature (1)..(102): Xaa is any amino acid
MGYILNIKNMVCNRCIKVVDDEISKLGFEIKSIELGKVVLSRIPNDTEKEKIEASLLNNGFELIDDKKSKTIAEIKTIIIGHVHYDKEKNDTLIFSIFYRKR

SEQ ID NO: 10987 - DNA, 315 bp, Unknown
  Obtained from environmental sample
  misc_feature (1)..(315): n is a, c, g, or t
ttgctattgtgggcatggagtcttagatggttcaatttttataaaacatatgctgatggagataaggctatttttgaagtaagtgataatgggggaggagtaaaagaagagatagtagataaaatttttgacccttattttactacgaaaaacaaaaaaaatggaactggacttggtctgtatatgagtagaattattatccaaaatcactgcaagggaaaactaaagtgtctaaaccttagtgatggagcagtttttaggattacaatcgatccaaatcagcttataagtgaggcttcaggttttcctatataa

SEQ ID NO: 10988 - protein, 104 aa, Unknown
  Obtained from environmental sample
  DOMAIN (6)...(93): Histidine kinase-, DNA gyrase B-, and HSP90-like ATPase
  misc_feature (1)..(104): Xaa is any amino acid
MLLWAWSLRWFNFYKTYADGDKAIFEVSDNGGGVKEEIVDKIFDPYFTTKNKKNGTGLGLYMSRIIIQNHCKGKLKCLNLSDGAVFRITIDPNQLISEASGFPI

SEQ ID NO: 10989 - DNA, 444 bp, Unknown
  Obtained from environmental sample
  misc_feature (1)..(444): n is a, c, g, or t
ttggaaggttatcttatttcatttttaaaagaaaaaataactctttatagtatggaaccatcgagaataacttttgaaatattagaaaatattactatttttaaaaactctaaaaaaataacacagcaactaaatgaactcagaggaatgggctttaaaatagcaatagatgattttggtatagaaaattcaaattttggtaggcttttggagataaatatagattttatcaaattagatggtatttttataaaaaacctaaaacacaataaaagaaatagaactataacaaaagcaattgtaaatcttgcaaaaactctaaaaatagagactgttgcagagttcgttgaagatgaagaagtttatgaaatagttaaagagtgtgggattgattatgctcaaggttattatataggaaaacctgaagcctcacttataagctga

SEQ ID NO: 10990 - protein, 147 aa, Unknown
  Obtained from environmental sample
  DOMAIN (1)...(141): EAL domain
  misc_feature (1)..(147): Xaa is any amino acid
MEGYLISFLKEKITLYSMEPSRITFEILENITIFKNSKKITQQLNELRGMGFKIAIDDFGIENSNFGRLLEINIDFIKLDGIFIKNLKHNKRNRTITKAIVNLAKTLKIETVAEFVEDEEVYEIVKECGIDYAQGYYIGKPEASLIS

SEQ ID NO: 10991 - DNA, 708 bp, Unknown
  Obtained from environmental sample
  misc_feature (1)..(708): n is a, c, g, or t
atgaatactaaacaattaagtactcttatctctagtacaaaaaaattagatgtactctatgtagaagatgataaaagtgccagagagacaacattaactttttttaaatctatatttttatctatagatgttgctgtagatggagatgaagcttggcaaaaatttaaaaataatagatacaatattatcataacagatataaacttacctcaaaaaagtggacttgaacttatagaacatataagagaaatcagttcatctattcctatctttgtactttcggcatatgataattcagactattttttacaaagcatcaaacttggggtagatggctaccttttaaaacctatagaatcagactctttcttttttactctttcaaaaataataagaaaaatagaactagagaagtctgtactagagtatcaaaatgagctagaaaataaagtagctctaaaaactaaaaaacttcaacatagatgcttccatgagttctatacagatttaccaaactctataatgcttcatgaagatttactaaaacataaatctagccatatgctacttttagatatgtcacatttttctactataaacaaggaatatggtaaaacatttgcaaatcttgttataaaaaagactgctttaattttagaaaagcatatacataaaaaagcaaaactctttaagggtggagtcagatag

SEQ ID NO: 10992 - protein, 235 aa, Unknown
  Obtained from environmental sample
  DOMAIN (16)...(135): Response regulator receiver domain
  misc_feature (1)..(235): Xaa is any amino acid
MNTKQLSTLISSTKKLDVLYVEDDKSARETTLTFFKSIFLSIDVAVDGDEAWQKFKNNRYNIIITDINLPQKSGLELIEHIREISSSIPIFVLSAYDNSDYFLQSIKLGVDGYLLKPIESDSFFFTLSKIIRKIELEKSVLEYQNELENKVALKTKKLQHRCFHEFYTDLPNSIMLHEDLLKHKSSHMLLLDMSHFSTINKEYGKTFANLVIKKTALILEKHIHKKAKLFKGGVR

SEQ ID NO: 10993 - DNA, 714 bp, Unknown
  Obtained from environmental sample
  misc_feature (1)..(714): n is a, c, g, or t
atgggatatggctcggttttttgtgtttgcctgcttggcgattttatttcatcgctctcaaattttattgatgaatacaagccagatgaggttattctggaagcatcgggaatttcagaccccataagtattgcacaggttttacattctcccaagttgaaaaataaaatttacctcgattatatttggagtattgttgatgtgccaaattttgaaaaaattgccggttttcacaccagggttgtccatcaacttcgaattgcagataccattattttgaataaaattgatttggctccgcaaaatgttgaaacaataagtaacaaggtggctaaaataaatccgatggctaaaattgttgaagcaacttattgtgaaaccgattttgaaaagagaaaagtaccatttaaaatattagctgaagggaaaccaggtattcgcccacaaatagaatcgttgataattaaaactacaaaaacaatttctttcgagtaccttgaactttttataaaagaaataaaaaacgactttattcgtatgaaaggttatgtaaatatcgaaggacacaaaaaagtgatgctgcagggtagttatgaaaattatcgttttttcgaggtcgacaattttatatccccaactgaaattgttggaattggtaatttaacggatgctgaaagatatgtgaaactgtatgaaagtttttgcttaaaatag

SEQ ID NO: 10994 - protein, 237 aa, Unknown
  Obtained from environmental sample
  DOMAIN (1)...(121): CobW/HypB/UreG, nucleotide-binding domain
  misc_feature (1)..(237): Xaa is any amino acid
MGYGSVFCVCLLGDFISSLSNFIDEYKPDEVILEASGISDPISIAQVLHSPKLKNKIYLDYIWSIVDVPNFEKIAGFHTRVVHQLRIADTIILNKIDLAPQNVETISNKVAKINPMAKIVEATYCETDFEKRKVPFKILAEGKPGIRPQIESLIIKTTKTISFEYLELFIKEIKNDFIRMKGYVNIEGHKKVMLQGSYENYRFFEVDNFISPTEIVGIGNLTDAERYVKLYESFCLK

SEQ ID NO: 10995 - DNA, 627 bp, Unknown
  Obtained from environmental sample
  misc_feature (1)..(627): n is a, c, g, or t
atggatgtttccaaagaggaagagactcaggctttaatcggattggctaactcctactataatctagcgatatataatagatcctatcctgaatataaaaaacttgtgaaagctgatcaggatcaagagattctccaatcatcattaaatggaatggtttggtctgcttcgcaaagtgataaatttgatttaattagtgaccttgggttacttattgaaaattctaataagagtaaatttaagatctctttatatcagaagaagatagaatattccaataataagagcgattgggaacaaattgagttagatatttctgctctctttaggctgaacccatccagtgatttaaaaaagaaaatgaatcttctccaagctgaaattgctgaagatcaaggtgatttagaaaaggctgataaaatttatcaaaacctggagcttaatgaaccagatgctgatatgttttatagctgggcaatgctaanagtgagattagatgataaatctggtgctgttgcaaagcttagaaaggcatcgatgattagtagagatgaaaagatttggactgatatgctgagtctggaagttgaaacaacccatgagtatttcatgaatgattataaataa

SEQ ID NO: 10996 - protein, 208 aa, Unknown
  Obtained from environmental sample
  misc_feature (1)..(208): Xaa is any amino acid
MDVSKEEETQALIGLANSYYNLAIYNRSYPEYKKLVKADQDQEILQSSLNGMVWSASQSDKFDLISDLGLLIENSNKSKFKISLYQKKIEYSNNKSDWEQIELDISALFRLNPSSDLKKKMNLLQAEIAEDQGDLEKADKIYQNLELNEPDADMFYSWAMLXVRLDDKSGAVAKLRKASMISRDEKIWTDMLSLEVETTHEYFMNDYK

SEQ ID NO: 10997 - DNA, 402 bp, Unknown
  Obtained from environmental sample
  misc_feature (1)..(402): n is a, c, g, or t
atgagtaacctagatgaaacacattggttttgtttaaatgatagtatgtggagtgaagttgatgctgtaaaagttgtcgcttatagagtattaaaaactttaaaaaatcaagatttattagatatgatgtatcttgaagatgatattaaagcttgggcagaagaaggattatttgaagaagagaataaagttatccataaagatagtaatggtgttactttaagtgcaggtgacacagtaagtattattaaagatcttgatgtaaaaggaacaggctttactgctaagagaggaactgctgtacgcaacatttctttacctcatgatgacgcagaacatattgagggaagagtaaatggtgttaaaattatgatattaacgaaataccttaaaaaagtataa

SEQ ID NO: 10998 - protein, 133 aa, Unknown
  Obtained from environmental sample
  DOMAIN (65)...(120): PhnA protein
  misc_feature (1)..(133): Xaa is any amino acid
MSNLDETHWFCLNDSMWSEVDAVKVVAYRVLKTLKNQDLLDMMYLEDDIKAWAEEGLFEEENKVIHKDSNGVTLSAGDTVSIIKDLDVKGTGFTAKRGTAVRNISLPHDDAEHIEGRVNGVKIMILTKYLKKV

SEQ ID NO: 10999 - DNA, 633 bp, Unknown
  Obtained from environmental sample
  misc_feature (1)..(633): n is a, c, g, or t
ttgggagagattttttgggtgaataaatggataaattttactgtaaagtggggtttcccccttttttttaaaaatgggaaaaacccaaattggtttcaaagtttgcccccaacacaagggggaggatgtttaaagtttttcataccccagaacattccagcttttccacctaaagcacacgaaatggaatttgatcttgaagcattcgttttctttaaaaaacatctttatttatttactaaaaatcgcactgtccctttcaacggcattacaaccttatataaaattggtgatcatgcagcaaactttgacgcaaaaaaaattagtaaattcaaaacctgtactattgcagaaaaattatgttggataacgtcagcggcattaagtcccagcagaaaaaaactcgcactgttagactcgcagcgtatttggctatttgaaaattggcgcggtgatgactttttctctggtgataagtaccgtattgatctgggtattgtgacgcaaaaagaagcaattaccttcttagatgagaatgttattatttttactgacgaagatttccacggtattggaggcaatgcgtattcaattgatcttaacgatgttgagaagcataaaccacccaactaa

SEQ ID NO: 11000 - protein, 210 aa, Unknown
  Obtained from environmental sample
  misc_feature (1)..(210): Xaa is any amino acid
MGEIFWVNKWINFTVKWGFPLFFKNGKNPNWFQSLPPTQGGGCLKFFIPQNIPAFPPKAHEMEFDLEAFVFFKKHLYLFTKNRTVPFNGITTLYKIGDHAANFDAKKISKFKTCTIAEKLCWITSAALSPSRKKLALLDSQRIWLFENWRGDDFFSGDKYRIDLGIVTQKEAITFLDENVIIFTDEDFHGIGGNAYSIDLNDVEKHKPPN

SEQ ID NO: 11001 - DNA, 789 bp, Unknown
  Obtained from environmental sample
  misc_feature (1)..(789): n is a, c, g, or t
ttgcctcgtgacttagattactacatagacgacatctcatacaacatatatcaagcgtttgagaaaatgagacttttatggcttagttcactctcatgtaacggcaatgtccactcatttttgaactacccatatttagagcagtttttaaaagattttgaatttatctaccaccctacaatcgatacaaactactctttgagggatatcgtctcaaaagatatagagtgtgatattttacttctcgatggaacactagaagatggttataaaaaagctgatatcgacatagcagatacaataaaaaaatatgccacaaaagtaaaaaaaattgttacagtaggaacttgtgcatcatttggcggtatctttgcagactcccatgaagatagatacggatttcatttcagtcatgaaacctctcatgagaggttcaaagagtttaaagataaaacgatcaccatttcaggttgcccggtacatcctgatattttggtaaatacactctatgcaattaaaaaagagtatctcatcaagctagatgaatatctcagaccacaagagttttatgcttaccccattcacaacggttgtacaagaaatgagtattttgagtataaagtagataaccctgagtttggaaaatttagaggggtgtatgttctaccaccatggtttgtcaagcctccttttactcaagggaagctgcaaaaaaaaatactcgggaatgaggacaacaccccagaaagccaggaggcggaacatccctgggttggggcgcagcactga

SEQ ID NO: 11002 - protein, 262 aa, Unknown
  Obtained from environmental sample
  DOMAIN (53)...(173): NADH ubiquinone oxidoreductase, 20 Kd subunit
  misc_feature (1)..(262): Xaa is any amino acid
MPRDLDYYIDDISYNIYQAFEKMRLLWLSSLSCNGNVHSFLNYPYLEQFLKDFEFIYHPTIDTNYSLRDIVSKDIECDILLLDGTLEDGYKKADIDIADTIKKYATKVKKIVTVGTCASFGGIFADSHEDRYGFHFSHETSHERFKEFKDKTITISGCPVHPDILVNTLYAIKKEYLIKLDEYLRPQEFYAYPIHNGCTRNEYFEYKVDNPEFGKFRGVYVLPPWFVKPPFTQGKLQKKILGNEDNTPESQEAEHPWVGAQH

SEQ ID NO: 11003 - DNA, 333 bp, Unknown
  Obtained from environmental sample
  misc_feature (1)..(333): n is a, c, g, or t
ttggataggcctattattttaaaaaaagattcttttttagttttaggtccatttcaaggaaaagtggcctgtgaaaaaattccttttaccaggggcgtttgtggtgattcttattcattaaaaaaaattataaatgtagataatgtgaatctttatgaaaaccatattgcttgtgaaactgatacttgtagcgaattagtaatacctttaataaataaatcaagagttttcggagtattagatattgattcaaaatcttttagtagatttaaagataatgaaataaaaatacttgaagaacttgtaggaattgttgccaaaaaattattttaa

SEQ ID NO: 11004 - protein, 110 aa, Unknown
  Obtained from environmental sample
  misc_feature (1)..(110): Xaa is any amino acid
MDRPIILKKDSFLVLGPFQGKVACEKIPFTRGVCGDSYSLKKIINVDNVNLYENHIACETDTCSELVIPLINKSRVFGVLDIDSKSFSRFKDNEIKILEELVGIVAKKLF

SEQ ID NO: 11005 - DNA, 612 bp, Unknown
  Obtained from environmental sample
  misc_feature (1)..(612): n is a, c, g, or t
atgtgggtttgcggaaacgctggagctggcataataaaagttattaataattctgaagaggataagtctaaacatctaaaatttagaactattattttgccaacagaaagtattgaatcaaccgatgaaaatgaaaaaaagaaagaaatagtaaaacttgaaactatataccaaatgggagtagattcaaaagtagattataatcctattgaaaagtatttaagatgtaacgaacttatagatatgaatttctcaattgaagagatttctaaaatgctctcaataaacatttcagctgtatataagatgaaagagatttttagtttaatgaataaatatcttactaggtataattataatgggatttatgtcgggttagagaaaaaggaaggacattttgtagatttaagaaattacttagtatcatacgaaagaggtgtcgggcgagaatatgctaaatggaattataatggaaacgacttaaataatatgcaggatatttattttgactatgcaaggttaagataccctgttcaaaattgtaggcttatttctaacccagcaaagtctcaaagctttttttgccatgaagatatatggaaaaaaatttga

SEQ ID NO: 11006 - protein, 203 aa, Unknown
  Obtained from environmental sample
  misc_feature (1)..(203): Xaa is any amino acid
MWVCGNAGAGIIKVINNSEEDKSKHLKFRTIILPTESIESTDENEKKKEIVKLETIYQMGVDSKVDYNPIEKYLRCNELIDMNFSIEEISKMLSINISAVYKMKEIFSLMNKYLTRYNYNGIYVGLEKKEGHFVDLRNYLVSYERGVGREYAKWNYNGNDLNNMQDIYFDYARLRYPVQNCRLISNPAKSQSFFCHEDIWKKI

SEQ ID NO: 11007 - DNA, 696 bp, Unknown
  Obtained from environmental sample
  misc_feature (1)..(696): n is a, c, g, or t
atgagcaaacaatacgaacatatttttttcgatttagacagaacccttgggcattttgatgaaaactctaaaaatgtactgaatgaaatctttgtaaaatttgagttagctcgttatatcaataatgttgatgagtttattaagtcctacgaaatcattaatgataatctttggcgacaatacagtaaaagtagaatagataaagaaaaacttcgctcagaaaggttttaccaaaccctacttaaatatggtgcagatgaaaatgatattgccatacaaataggcgattattacattaaccattctccacaacaaactgctttattgccacacactattgaaaccttagattatttaaaagacaaatatgtgttgcatattattactaacggttttgaggaggttcagctaataaaactcagtaaatctggtataatggattactttaatcagcttattttttctgagaaagtgggcgttaaaaagccacatcctttaatttttaaaagagccataaaaaatgccaatgcccatattagcaattccattatgataggggatgattattatgccgatatttatggagctacaagagcaggtatggacagtatttacttcaactttaacaatcgtccgcaccaacacaaggttaataatgaaataaattgtttaagcgagttgacagggttgctttaa

SEQ ID NO: 11008 - protein, 231 aa, Unknown
  Obtained from environmental sample
  DOMAIN (5)...(209): haloacid dehalogenase-like hydrolase
  misc_feature (1)..(231): Xaa is any amino acid
MSKQYEHIFFDLDRTLGHFDENSKNVLNEIFVKFELARYINNVDEFIKSYEIINDNLWRQYSKSRIDKEKLRSERFYQTLLKYGADENDIAIQIGDYYINHSPQQTALLPHTIETLDYLKDKYVLHIITNGFEEVQLIKLSKSGIMDYFNQLIFSEKVGVKKPHPLIFKRAIKNANAHISNSIMIGDDYYADIYGATRAGMDSIYFNFNNRPHQHKVNNEINCLSELTGLL

SEQ ID NO: 11009 - DNA, 654 bp, Unknown
  Obtained from environmental sample
  misc_feature (1)..(654): n is a, c, g, or t
atggggagcttgtcaaacaactatataacaagcaacataaatgcactgaaaagatttagcaagtacttggagcaaacaggcaaagcaagcatagaaataaacttggaactgcaagtggataaaaacaataccaaaaccatactcacaaaagaagaagccgaagcactatacaaagcatgtacaaatgattatttagggataagggacagggcaatgctagggatattttacggttgcggattaaggagaagcgaaggggtcgccttggacttagcagatatactccttaaagaaaaaagggtacacgtaagaaaaggcaaaaactacagggaacgttatgttccgatgacagaaagagtaaaagaggacttggagaattatatttatgtatcgagggaaaagatcttaagctttaaaaatattaaacaagaagcattgtttttaggaatgggcgtaaagcgtttaggcggagtaggtttaattaacaggttacataaattagtccatggagcagcgatacaaaaagaaatcgggcttcattcattgcgccattccatagcaacacaccttttgcaatcagggatggaactagaagaagtaagccagtttttgggacatagcagtttagaaagtacgcagattttacccacctag

SEQ ID NO: 11010 - protein, 217 aa, Unknown
  Obtained from environmental sample
  DOMAIN (48)...(213): Phage integrase family
  misc_feature (1)..(217): Xaa is any amino acid
MGSLSNNYITSNINALKRFSKYLEQTGKASIEINLELQVDKNNTKTILTKEEAEALYKACTNDYLGIRDRAMLGIFYGCGLRRSEGVALDLADILLKEKRVHVRKGKNYRERYVPMTERVKEDLENYIYVSREKILSFKNIKQEALFLGMGVKRLGGVGLINRLHKLVHGAAIQKEIGLHSLRHSIATHLLQSGMELEEVSQFLGHSSLESTQILPT

SEQ ID NO: 11011 - DNA, 639 bp, Unknown
  Obtained from environmental sample
  misc_feature (1)..(639): n is a, c, g, or t
ttgaaggcaaagtataatgtaggattgaatgatgttgataaatcaaaaccatttgtagaaatagagaatttagaacgagatattaatcaattagtttataaagttactcgtagtgatttaataaacgcaggattaactttaataagaaatgaaaaagatattttaccaataaagaaaataaaacgaaagaaatttgcttcgatagcttttaataccaatgatattacagaatttcaaacaaaactttctaagtatgcagaagtagatcattttatttttaatgaacaaagaagagattcattatttgatattttgaaagaatatgatcttgtgtttgctagtgtacataatacatcgtattacactccttcaaattataaagtcaagtcagatcatttatatcaaattgcagaattatcgaatgaaacgaaagtgatttttagtgtttttgcaaatccttatagcttacgaaagtttgaatttattgatagtattgatgcagttttaatagcttattcggataatgtagatactcaaaatgcagcagctcaagctgtctttggtggattggaattgtcgggtaaattgcctgtgggtattaatagtaattatcctgtaggaacgggaatccacctttaa

SEQ ID NO: 11012 - protein, 212 aa, Unknown
  Obtained from environmental sample
  misc_feature (1)..(212): Xaa is any amino acid
MKAKYNVGLNDVDKSKPFVEIENLERDINQLVYKVTRSDLINAGLTLIRNEKDILPIKKIKRKKFASIAFNTNDITEFQTKLSKYAEVDHFIFNEQRRDSLFDILKEYDLVFASVHNTSYYTPSNYKVKSDHLYQIAELSNETKVIFSVFANPYSLRKFEFIDSIDAVLIAYSDNVDTQNAAAQAVFGGLELSGKLPVGINSNYPVGTGIHL

SEQ ID NO: 11013 - DNA, 864 bp, Unknown
  Obtained from environmental sample
  misc_feature (1)..(864): n is a, c, g, or t
ttggatcaatttgtatctggtcaacaattagctgacgatttaaaagttagtagaacagcaatttggaaagcaatttcagaattaagaaaagaaggtgctttgataaatgctgtaactaataagggttactatttagttagagaatcacaaaaattatcactctttagtttaaaaaaagaattaaaggattttgaagtacattatttagaggaagtagattctaccaattcttattgtaagaaacttcctacaagtgatgtttttaaaaaaacagttgttgttgcatctaagcaaacaggtggaagaggaagacgaggtagaacctttgtctctcccattggcggtatctattttagtttattaattgattctcataataacaatgatgataatttattgattacaagtattgcatctgtttccgtagctcgagccattaaaagagtatgcggtgttgattgtaaaattaaatgggtaaatgatatctttatcaaggatagaaaagtctgtggtatattaacagaaggtgttattgatatggaagtcgggaagattaaatcaatggtagttggtattggtataaacttttcaactcctatggatcaatttccaattgaacttacagatattgtaactagtatatacagtgatgaagaagctattccaaataatgtaagtagaacaatgcttgtaaaagaagtagtaactgagatatatagtatttgggataatctaccaaataaagattttttaaatgactatagaacaaaatcaaatgtaataggtaaaagtgttactatatacaatagagataattcacagcaaaatggagtaacaatcggtattatgatagtgcccatttga

SEQ ID NO: 11014 - protein, 287 aa, Unknown
  Obtained from environmental sample
  DOMAIN (68)...(202): Biotin/lipoate A/B protein ligase family
  misc_feature (1)..(287): Xaa is any amino acid
MDQFVSGQQLADDLKVSRTAIWKAISELRKEGALINAVTNKGYYLVRESQKLSLFSLKKELKDFEVHYLEEVDSTNSYCKKLPTSDVFKKTVVVASKQTGGRGRRGRTFVSPIGGIYFSLLIDSHNNNDDNLLITSIASVSVARAIKRVCGVDCKIKWVNDIFIKDRKVCGILTEGVIDMEVGKIKSMVVGIGINFSTPMDQFPIELTDIVTSIYSDEEAIPNNVSRTMLVKEVVTEIYSIWDNLPNKDFLNDYRTKSNVIGKSVTIYNRDNSQQNGVTIGIMIVPI

SEQ ID NO: 11015 - DNA, 651 bp, Unknown
  Obtained from environmental sample
  misc_feature (1)..(651): n is a, c, g, or t
ttgagggaaaatcaaatgataaatccaaaaattgtagattatatatttagttctgcatcaatacaaaggtggaatgactatcctcgaatgatagatttagttgaattagataaacaagcacataaatttattatcgctttttttatagcaaaacttgaagataatataaattttacacacttaatagaagcaggtatttttgagtttttaagacgagtagttgtaacagatatacgcccagatgtatttagaaaagctttacaaaaaaaaggtaatgagataaatcattgggttattgggaaactagaagagagtcttcaagatatagataaaggactttttttacaaaagtttaaagaatacttagctgatgataatatgtataaaaaagagagatttgttcttaaagccgcttcatatcttgccacaaaatgggaatttggtatcgtatatcaaaccagtcaatttctcaatgatattgaagaggtaaaaaaagaggttgatgctgagatagaagattattatgaacttataggggttcgtaaaattgcattaaatcagaaattagcaaaaatagtagatttaagtggtagacttcgatttcaaaaaagatgggcacaaacaccaagaattccagaaacttcagtataa

SEQ ID NO: 11016 - protein, 216 aa, Unknown
  Obtained from environmental sample
  misc_feature (1)..(216): Xaa is any amino acid
MRENQMINPKIVDYIFSSASIQRWNDYPRMIDLVELDKQAHKFIIAFFIAKLEDNINFTHLIEAGIFEFLRRVVVTDIRPDVFRKALQKKGNEINHWVIGKLEESLQDIDKGLFLQKFKEYLADDNMYKKERFVLKAASYLATKWEFGIVYQTSQFLNDIEEVKKEVDAEIEDYYELIGVRKIALNQKLAKIVDLSGRLRFQKRWAQTPRIPETSV

SEQ ID NO: 11017 - DNA, 405 bp, Unknown
  Obtained from environmental sample
  misc_feature (1)..(405): n is a, c, g, or t
gtgagtcaaattgaagataaaattatgccttatgttcctatgaatttaaaaaaagaattttcatatattttaggtcttgataaaaacaatatcaaagatgaatttgaaaataaaattattcaaaatgagacaatcacaacagttgcagatatgtctcaatataatcttgataaatataatcctatagatggaaaagcattaaaacaatgtgataaactttctgcatttatagaagctagcttatctatatcacatgggattaaatcaaaagagttaatcagtggtaaaaaacagattatggcatctttacaagaggtacaaggtgtagatttcaaagcaattgcaacttgtattgatgaagagttttgtacaactggaaaaacccaaacaacaatggagttataa

SEQ ID NO: 11018 - protein, 134 aa, Unknown
  Obtained from environmental sample
  misc_feature (1)..(134): Xaa is any amino acid
MSQIEDKIMPYVPMNLKKEFSYILGLDKNNIKDEFENKIIQNETITTVADMSQYNLDKYNPIDGKALKQCDKLSAFIEASLSISHGIKSKELISGKKQIMASLQEVQGVDFKAIATCIDEEFCTTGKTQTTMEL

SEQ ID NO: 11019 - DNA, 744 bp, Unknown
  Obtained from environmental sample
  misc_feature (1)..(744): n is a, c, g, or t
ttgatattgaggacggaaaagtgcagaatcttcagttatttgaaaagcatagaaaatctaaacttatttaagatggaagaaaagtaccccaacaaaattttaaatgttaagcatctagtagaaaaatacgatgagcctgcatttgcatgtaatagcttcttttattcggagcaggaaatcaaaccaagcatggcagttcttttaccttgcacagatgctggttgtatgtcgtatacaagaggaataaaacgattttgtgagaaacatgatattgtttgtaatgattatattgtgaagtctgcagatgagttaagtcagactatcgaaaggttaaataatgatgattcggttcatggtattatgataatgtatccttctggatatggagtaaaggatactacatttatgaatatgattaatccgatgaaagatgttgagggtttacataactcatatcttggatatttagttcaatttgaaaagtttcgcgatcctgaaaatttgaggaaacttgttattccaccaacttctaaaggcgtattgagcatcttgaagagatatgctcttgattatgacaacttttataaagaaagaggcttttatcctgagaatgttgagactaatccatttaatttagaaggaaaaagagttacagtaattaacgactctttggctgttgggcgatcaatggctttaatgcttttgaatgaaaatgcatacgttcaggtatgtcatgaatataca

SEQ ID NO: 11020 - protein, 248 aa, Unknown
  Obtained from environmental sample
  DOMAIN (32)...(146): Tetrahydrofolate dehydrogenase/cyclohydrolase, catalytic domain
  misc_feature (1)..(248): Xaa is any amino acid
MILRTEKCRIFSYLKSIENLNLFKMEEKYPNKILNVKHLVEKYDEPAFACNSFFYSEQEIKPSMAVLLPCTDAGCMSYTRGIKRFCEKHDIVCNDYIVKSADELSQTIERLNNDDSVHGIMIMYPSGYGVKDTTFMNMINPMKDVEGLHNSYLGYLVQFEKFRDPENLRKLVIPPTSKGVLSILKRYALDYDNFYKERGFYPENVETNPFNLEGKRVTVINDSLAVGRSMALMLLNENAYVQVCHEYT

SEQ ID NO: 11021 - DNA, 543 bp, Unknown
  Obtained from environmental sample
  misc_feature (1)..(543): n is a, c, g, or t
ttgtancttgcaacttccggtggtggatttgagcagtgttataatgcacaggcttcagtagaacatgagagtcgtcttattacacacaaccacgtcgcacagaatgcaaatgacaaacaagaaattatacagacgcttaaatggttcaaagaatacccaagacttaaaccagcttcacttttagcagatgctggctactttagtgaacacaacattcaccaatgtgaaaatagtaagattacaccctatatctcttttggcaaagatcaacacaaccaaccccttgaagaacgtttcaaaaaagaagaaccactttctaaaaatcccacatatattgaaaaaatgaagcatcgattacaaacgaaagaaggcaagcagatttatgcccagcgtaaaagtactgttgaacctgtatttggcgttataaaacatgtaataggatttagacagtttatgcttagaggctttgaaaaagcaagaggtgaatggaatttaatctgtattgcatataatcttaagagactacatacgatgagaggataa

SEQ ID NO: 11022 - protein, 180 aa, Unknown
  Obtained from environmental sample
  DOMAIN (2)...(172): Transposase DDE domain
  misc_feature (1)..(180): Xaa is any amino acid
MXLATSGGGFEQCYNAQASVEHESRLITHNHVAQNANDKQEIIQTLKWFKEYPRLKPASLLADAGYFSEHNIHQCENSKITPYISFGKDQHNQPLEERFKKEEPLSKNPTYIEKMKHRLQTKEGKQIYAQRKSTVEPVFGVIKHVIGFRQFMLRGFEKARGEWNLICIAYNLKRLHTMRG

SEQ ID NO: 11023 - DNA, 897 bp, Unknown
  Obtained from environmental sample
  misc_feature (1)..(897): n is a, c, g, or t
ttggctgaagaacaggtaaataaatcatacccttcggtattagatgaaatccctgacaaagctgaaaggatttctcctgaaattaaagtagaaaaagtagaaaatacgtcacacaaaaatgatgtgagtgtctttgaaatgccatctattttttccatgcctagtgctaagtcccttaagttttttgatgttgagctttcagatgagcctgaagcagaaggtagagttgttgttgatctagataatgaagaccctatagcggcagctgaaaaaatgaaaaatatttacgaatctttaaaaacaaaagccgcgatttgtcaatacattacaaaaactgattttagtaacatcaattttgcggatttattaaactctcctgatttagagatttcacatgataatgaagaagtgattaaaggcgcaataaaaaaattaatctttaattctaattttacagacaaagaggattttactaaaaaattatataaacttcgtgaaattgaagacttgatccaagaatcaatgttagtgaaagactttgacaaaaaaatattagcccttcgaaaaaatcttgagcacctaatgatagaatacgaaactactgttgggaaaaaggtttataaagagataactcgaattaaggcttctactcaaaaacttatagacacaagtagcgagataaatactctaaaagaggctaaacaagaatttgagtctcagaacttcaacttaagacaaacatcctctgaactagagagcaaatgtctactgctagaagaaactaatctcgaaataaaacaagagcttcttggggtaataatttctttgagaaagttaggtctattgatgagtccgatgactttgaaacgattcctgtggaaattaaggattccctcc

SEQ ID NO: 11024 - protein, 299 aa, Unknown
  Obtained from environmental sample
  misc_feature (1)..(299): Xaa is any amino acid
MAEEQVNKSYPSVLDEIPDKAERISPEIKVEKVENTSHKNDVSVFEMPSIFSMPSAKSLKFFDVELSDEPEAEGRVVVDLDNEDPIAAAEKMKNIYESLKTKAAICQYITKTDFSNINFADLLNSPDLEISHDNEEVIKGAIKKLIFNSNFTDKEDFTKKLYKLREIEDLIQESMLVKDFDKKILALRKNLEHLMIEYETTVGKKVYKEITRIKASTQKLIDTSSEINTLKEAKQEFESQNFNLRQTSSELESKCLLLEETNLEIKQELLGVIISLRKLGLLMSPMTLKRFLWKLRIPS

SEQ ID NO: 11025 - DNA, 771 bp, Unknown
  Obtained from environmental sample
  misc_feature (1)..(771): n is a, c, g, or t
ttgaaagaagatttatcctttgaggaaaatagagctaatgagttagaatcaaaggtcaattctttagaaatttctctatttagtcttgaggaaaagaatgtaactcttaatgatacggttgtttcattagaatcgaagtttaaagaacaaacctttgttgcctcatcaaacattaatgatcataacaatccagagccaaaaaacaaagaagagttagaaacagaatatgaagacgaagacgaagatgaagatgaagatgaagacgatattgaaagtagcgggtcaaataagctaaaaatcattggttttgtctttggtggatttgtactgtttatacttttatttataggggtaggctactcacttcttgatgaggaagataaggaaccagtaagtaaggtttcttatccaacttctaaagaaatagaggttaacactcaagagataagagatggtgttgcatctcagccttcaccaaagataattgttgcttctctgagtaaagaaaatgagcttcctagtctagaggtttcagttccttccgtgacgaagaagactttgtatgattttgaaaaaaatatttctgagaaagagctgtcaagccaaaaatttgatatttatttgtctgattttaaaaaggttagaataaacgagaaggattttgtcaagggtgatgtaataaatggttataaatttattaaagcaaccagtataggaaagattctttttattaatagcaatggtgaacctgtgtgggtggatatgaaatga

SEQ ID NO: 11026 - protein, 256 aa, Unknown
  Obtained from environmental sample
  misc_feature (1)..(256): Xaa is any amino acid
MKEDLSFEENRANELESKVNSLEISLFSLEEKNVTLNDTVVSLESKFKEQTFVASSNINDHNNPEPKNKEELETEYEDEDEDEDEDEDDIESSGSNKLKIIGFVFGGFVLFILLFIGVGYSLLDEEDKEPVSKVSYPTSKEIEVNTQEIRDGVASQPSPKIIVASLSKENELPSLEVSVPSVTKKTLYDFEKNISEKELSSQKFDIYLSDFKKVRINEKDFVKGDVINGYKFIKATSIGKILFINSNGEPVWVDMK

SEQ ID NO: 11027 - DNA, 453 bp, Unknown
  Obtained from environmental sample
  misc_feature (1)..(453): n is a, c, g, or t
atggatgagcatgtatataaaagtcataataaaacattactactttatcattttgtctttcctgcaaaatatcggagaaaaatatttgatgataaaatagataataaactaagagatgtatgtattgaaatatctgaaagatatgagataaattttgtagagattggaaatgatttagatcatatacatatattagttcaaagcatacctacaattacagttgcaaggatagtgactataatcaagagcataacagccaaagagatatttaaacagtttccacaactgaaaaaagatatgtggggttcaagtctctggacaagtggatattatgcgaatactgttggcatgtatgcgagcaaagatacaatagtaaaatatataaagaaccaaggtaataatgaaaaagattatgtaaaaatacatcaaggtcagttaaagcttgacttatag

SEQ ID NO: 11028 - protein, 150 aa, Unknown
  Obtained from environmental sample
  DOMAIN (19)...(124): Transposase IS200 like
  misc_feature (1)..(150): Xaa is any amino acid
MDEHVYKSHNKTLLLYHFVFPAKYRRKIFDDKIDNKLRDVCIEISERYEINFVEIGNDLDHIHILVQSIPTITVARIVTIIKSITAKEIFKQFPQLKKDMWGSSLWTSGYYANTVGMYASKDTIVKYIKNQGNNEKDYVKIHQGQLKLDL

SEQ ID NO: 11029 - DNA, 318 bp, Unknown
  Obtained from environmental sample
  misc_feature (1)..(318): n is a, c, g, or t
atgcaaagactcaatgaatcttttggaataggtataattgaacttaaatcaaatccttatgagagtaaaatattatttcaatcaaaatttaaagagttggattttaaaaccatagataaattatgtaaagttaatgaaaaatatgaaaactttatagagttaatagaaagaatgttaacaatagatgatagaaattaccaatctgttgaaaatgagttaaataatttttgtgataaatattttgaaaatgattctgagactaaagagtattgtaaaaaacatttcataccatttgatgaagatgagggacaagaataa

SEQ ID NO: 11030 - protein, 105 aa, Unknown
  Obtained from environmental sample
  misc_feature (1)..(105): Xaa is any amino acid
MQRLNESFGIGIIELKSNPYESKILFQSKFKELDFKTIDKLCKVNEKYENFIELIERMLTIDDRNYQSVENELNNFCDKYFENDSETKEYCKKHFIPFDEDEGQE

SEQ ID NO: 11031 - DNA, 627 bp, Unknown
  Obtained from environmental sample
  misc_feature (1)..(627): n is a, c, g, or t
ttgttggttgctatttctataagtgctaatgcagagaaaccaaaagattctgtgtatttagaggggacaaaagatagtgcattgatattgcttcatggaaaagggaaatatccaacttggaaagttgttgaccctttacgaaaaaatattaataacatcttgggttttcatactttatcacttcaaatgccaactgctggtgataactttaaagactatgaagaacattttcctaaagtatacagtgtaattcaagatgctataacatttttaaaagaaaaaaatataaaaaatatctatctttttggacatagtatgggaagtagaatggctagtgcttttatagcagaaaatggaaactcttcaattaaaggcttgatactagcaggttgtagaaataatggcggtggattactgtcttgttcaaataatattgagatgatagatttacccatattagatgtttggggtgcaaaaaataaaaaagatagaaaagcagcatctcaaagagaaaatttcatatctgatacttatactcaagtgaaagtaaatggatcaaatcatgtatttaaaggctatgattcagagttaagtgatattgttatgaaatggatagaaaaaaactaa

SEQ ID NO: 11032 - protein, 208 aa, Unknown
  Obtained from environmental sample
  misc_feature (1)..(208): Xaa is any amino acid
MLVAISISANAEKPKDSVYLEGTKDSALILLHGKGKYPTWKVVDPLRKNINNILGFHTLSLQMPTAGDNFKDYEEHFPKVYSVIQDAITFLKEKNIKNIYLFGHSMGSRMASAFIAENGNSSIKGLILAGCRNNGGGLLSCSNNIEMIDLPILDVWGAKNKKDRKAASQRENFISDTYTQVKVNGSNHVFKGYDSELSDIVMKWIEKN

SEQ ID NO: 11033 - DNA, 891 bp, Unknown
  Obtained from environmental sample
  misc_feature (1)..(891): n is a, c, g, or t
gtgctatttattgtacggttattctacctacagattatcgacagcagttataaattgagtgccgacaatattgttctccgtaaagtacgggaatatccaccacggggattaatatttgacagaaatggtgagctgatggtatttaatgaagcagcatatgacctaatgattattccgcggcaaatgaagaaaatcgatactgcccttatatgtgagattacgggaatagataaagaatcatttattaagaagatcaaaaaagcaaagcattactcatattataaaccatcaacttttcttaaacagatttccaaaaaggatataggtaaaattcaagaaaaattatatcagatacccggattatatattcaaaccaggactttacgccaatatccacttcccattgctggtcatttacttggcagtattggcgaagttagcaggagggatttggaaaaagataagttttacagatccggggattatattggcaagtcggggatagaaaactattacgaaaaatatcttagaggaaaaagcgggttgagtattgttgaagttgatgtacataatcgcataaagggaaaatatagtaatggcagtttcgataccattgcagaagccggcaaggacattttcctaggtattgatgctcagttgcaactttatggtgaaatactcatgcagaataaaaaaggcagtgtagtagctattgacccaaaaaccggagaaatattagcacttataagcagtcctggatataatccaaacctattggttggcagagaaagatccgaaaattattccaggttactgcacgactctttgggtcctctgatgaacagggcaacaatgggaacttatcctccgggctctacttttaaatggtaa

SEQ ID NO: 11034 - protein, 296 aa, Unknown
  Obtained from environmental sample
  DOMAIN (30)...(197): Penicillin-binding Protein dimerisation domain
  misc_feature (1)..(296): Xaa is any amino acid
MLFIVRLFYLQIIDSSYKLSADNIVLRKVREYPPRGLIFDRNGELMVFNEAAYDLMIIPRQMKKIDTALICEITGIDKESFIKKIKKAKHYSYYKPSTFLKQISKKDIGKIQEKLYQIPGLYIQTRTLRQYPLPIAGHLLGSIGEVSRRDLEKDKFYRSGDYIGKSGIENYYEKYLRGKSGLSIVEVDVHNRIKGKYSNGSFDTIAEAGKDIFLGIDAQLQLYGEILMQNKKGSVVAIDPKTGEILALISSPGYNPNLLVGRERSENYSRLLHDSLGPLMNRATMGTYPPGSTFKW

SEQ ID NO: 11035 - DNA, 744 bp, Unknown
  Obtained from environmental sample
  misc_feature (1)..(744): n is a, c, g, or t
ttgggggtggtattggaaaatttcgaggagaggattgagtttaaagatgttgattacttctttaaagatagtaaatatccttccttagataaattctctttagaaattaaacagggtgaaaaagtaggtattattggacaaacaggtgctgggaaaagtacacttttgaaacttcttacagggctttattctcctagttcagggtctatatattttgatggacacgatacctctacaatgcatcctgttgagatacgacaaaatattggggtgatgccacaggaaccatttttattcaatggctctttaaaagaaaatattgaactctcacgaacaataagtaaagaaaagatgatggagcttatccgtatcactggactagaagaacttgtaaaaaaatctggaaaaggggatggtctacaagtgggtgagagaggtagtaatctttcaacaggtcaaagacagcttgtagcaatggcacgagccattgtaaatgatcctcctatgttgatttttgatgagccaacttctggtcttgatgtagggctagaaaaaacgctcataaatcaactcaaaggtgtcatagcatctcataaaacagtaattattatcactcatagattttcagctcttgatcttgtagatagagttattgttttaaataatggaaaaattgtagcagatggaccaaagcaaaaagttttagctgctcttagtggacaaaatacaaaggctacttcatga

SEQ ID NO: 11036 - protein, 247 aa, Unknown
  Obtained from environmental sample
  DOMAIN (39)...(223): ABC transporter
  misc_feature (1)..(247): Xaa is any amino acid
MGVVLENFEERIEFKDVDYFFKDSKYPSLDKFSLEIKQGEKVGIIGQTGAGKSTLLKLLTGLYSPSSGSIYFDGHDTSTMHPVEIRQNIGVMPQEPFLFNGSLKENIELSRTISKEKMMELIRITGLEELVKKSGKGDGLQVGERGSNLSTGQRQLVAMARAIVNDPPMLIFDEPTSGLDVGLEKTLINQLKGVIASHKTVIIITHRFSALDLVDRVIVLNNGKIVADGPKQKVLAALSGQNTKATS

SEQ ID NO: 11037 - DNA, 945 bp, Unknown
  Obtained from environmental sample
  misc_feature (1)..(945): n is a, c, g, or t
atggacagaatcggctcgaggcccctatcccactacaattcgtttgatgaccttcgttataactttagatcagtttgtacagatttaataagcggaagagagattgttctaaaagaaggatctttgggacttgcaatgagagcaagttcaagcgtgatgtttttgctaactcccgttgaattggatacacttaagttggtggatggtggattggtagcaaacatcccggtgaacgtagcaaaaaaactaaattgtgattttattgttgcttccaatgttacgagcccattgttttccaaactggagttggatatcccatggaaagttgctgaccagataattagtattccaatgatgcagttaaataaaattcagttggatgacgctgatttagtcgttaatccggtggttgatgaaattaaaaatacagacttccagaaagttgatacacttattgacgaagggtataaagttgctttagaaaaaataaaagcattggaagaaaaatacacagaaaggtattacaaaaatatatctgtggatcatgttgaatattcaaatgtagtcttttctagcaattctgaaatagcaaaaaaccattttataaagctgcatgcaaaaagagtaattactaaaaaagacttactctatatgttgggtgaattaaatcgtaaaggtggctttagtaaattatcagtagagatatccatagcggagaatgccaacatatttataaatgctattgaaaattctctggttaaaagaattgaaattgaagattgcacatttttaccggatagtgtgttgcatgaaattacacgtcctttattaaaacaaacctttaacagcagggaaatcggtgaaatttgggtggccattattcacgaatacagacatggcgaaatatctcttgcagaaattcagggaatgcttttgatgaaaaaa

SEQ ID NO: 11038 - protein, 315 aa, Unknown
  Obtained from environmental sample
  misc_feature (1)..(315): Xaa is any amino acid
MDRIGSRPLSHYNSFDDLRYNFRSVCTDLISGREIVLKEGSLGLAMRASSSVMFLLTPVELDTLKLVDGGLVANIPVNVAKKLNCDFIVASNVTSPLFSKLELDIPWKVADQIISIPMMQLNKIQLDDADLVVNPVVDEIKNTDFQKVDTLIDEGYKVALEKIKALEEKYTERYYKNISVDHVEYSNVVFSSNSEIAKNHFIKLHAKRVITKKDLLYMLGELNRKGGFSKLSVEISIAENANIFINAIENSLVKRIEIEDCTFLPDSVLHEITRPLLKQTFNSREIGEIWVAIIHEYRHGEISLAEIQGMLLMKK

SEQ ID NO: 11039 - DNA, 879 bp, Unknown
  Obtained from environmental sample
  misc_feature (1)..(879): n is a, c, g, or t
ttggagggtggattagaaaggggttatgctaaatcaattgaagctattattgaacaactagtagctcctacaacttcgattgataataaaaaagcagttatcatccctaatgtaaaccttactccaattgaagtagaaaagataaaagaacaagtagacttatttggttatgaaacactagcattacctgatattagtcaatctcttgatggtcatcttggacttaaacaaggtgcaatgagtagtggtggaataagtattgaagagatagaaaaactcgctagttcacaagttgttataacaattggaaactctgtagaaaaagctggaaatttacttaatggtaaaaatgaaaatatgatacatcttcactttgatacgataagtggtttactaaaagctgataaattttataaaggtttaatggatattaaaaaaatatctaaaccaaatccatcagtggtacgatggagaaaaagattacaagatgctcttctagatacacattttgcattaggtggggcaaaagttgttattgctgctgaaccagatcaaatccttagtattgcttcaacaataaaagaagcaggagcaaatatcacagctgtagtgtctcctaccaaaagtgtaagtttagaaacactcaatgacataaatgtaataattggtgattttgatgatgtagaaaatgaactaaaaaatgctgatattcttatctcaaactttcatggagaaagaatctgtaataatcttaaaaaagcacttatggtaagaggttttccaaactatgaattagtaggaaacaaccttaaaaatgatactttgtatgagggaagttgctatatgctttttgagatagcaaactcgagccgattctga

SEQ ID NO: 11040 - protein, 292 aa, Unknown
  Obtained from environmental sample
  DOMAIN (1)...(292): Nitrogenase component 1 type Oxidoreductase
  misc_feature (1)..(292): Xaa is any amino acid
MEGGLERGYAKSIEAIIEQLVAPTTSIDNKKAVIIPNVNLTPIEVEKIKEQVDLFGYETLALPDISQSLDGHLGLKQGAMSSGGISIEEIEKLASSQVVITIGNSVEKAGNLLNGKNENMIHLHFDTISGLLKADKFYKGLMDIKKISKPNPSVVRWRKRLQDALLDTHFALGGAKVVIAAEPDQILSIASTIKEAGANITAVVSPTKSVSLETLNDINVIIGDFDDVENELKNADILISNFHGERICNNLKKALMVRGFPNYELVGNNLKNDTLYEGSCYMLFEIANSSRF

SEQ ID NO: 11041 - DNA, 870 bp, Unknown
  Obtained from environmental sample
  misc_feature (1)..(870): n is a, c, g, or t
atggccgacttangtatttattacctatcattagaaaaagataatgtaaaaggtgaacataaaatattctctaatttaaatgaagttattatggcaatggagcttaaaaaagttgatattcatgcaaaaatcagaacaatgattgatggacaagtaatagcaactacaccaggaagaatgattattcatgatattttaccttcatttgtaccagtagcttattggaataaaattttaaagaaaaaagatattggtattttagttgattatatttataaacatggtggatataaagttactccaagattcttagataacttgaaaaacttagggtttaaatatgctacaagtgctggtatatcaatctctattgatgatattagaattcctgattcaaaagagggacatgttgtaacagctaaaaaagaagttattgatgtacaaaaacaatttaatcaaggtttattaacagaacaagaaagatacaataaaattattgatatctggacagttttaaataataaacttggtgctgagatgatggaacttgttcaaacagataaaaatggattcaactctatttacatgatggcagattctggggctagaggtagttcagctcagattagacagcttgcaggtatgaggggtcttatggctaagccagatggttctattattgaaacaccaattatctctaacttccgtgaaggtctaaatgttttagagtactttatttctactcacggtgcgagaaaagggttagcggatacagcgttaaaaacagcgaatgctgggtacttaacaagaaagctaatagatgtatctcaaaatgtaaaaaatgaccttgaagatttgtggaacacatga

SEQ ID NO: 11042 - protein, 289 aa, Unknown
  Obtained from environmental sample
  DOMAIN (4)...(127): RNA polymerase Rpb1, domain 3
  misc_feature (1)..(289): Xaa is any amino acid
MADLXIYYLSLEKDNVKGEHKIFSNLNEVIMAMELKKVDIHAKIRTMIDGQVIATTPGRMIIHDILPSFVPVAYWNKILKKKDIGILVDYIYKHGGYKVTPRFLDNLKNLGFKYATSAGISISIDDIRIPDSKEGHVVTAKKEVIDVQKQFNQGLLTEQERYNKIIDIWTVLNNKLGAEMMELVQTDKNGFNSIYMMADSGARGSSAQIRQLAGMRGLMAKPDGSIIETPIISNFREGLNVLEYFISTHGARKGLADTALKTANAGYLTRKLIDVSQNVKNDLEDLWNT

SEQ ID NO: 11043 - DNA, 507 bp, Unknown
  Obtained from environmental sample
  misc_feature (1)..(507): n is a, c, g, or t
atggtgcaatttgttacactccctattaataaaattagaactttcgttaaaaatgaaagtgcaatttataatgaatcaattcctaaaaatgattttaataaatcgctcgcagaagcaggaggaacagacgggaaagtgaaaattattcatgaagtttctaaaggagaatattttcataaaatagctataaattatagttgtacaattgatgatataaaaatttggaatagattacctacaaatgatcttaatgttggacagaagcttataatatggttaaatccgcaaatggcacgaattattgaagaagaaaaaactcgtccaaaacaacaaagagactcaacagatcgttttatttattatactgtacaaaatggcgatacagtgtggagtatagcagagaaatttaattgtagatcaatttcggagttgaaagaggagaataatattaataaggaaaaggatctaaaaccaggtaaaaaattaaagatttatttaaataagtaa

SEQ ID NO: 11044 - protein, 168 aa, Unknown
  Obtained from environmental sample
  DOMAIN (50)...(92): LysM domain
  misc_feature (1)..(168): Xaa is any amino acid
MVQFVTLPINKIRTFVKNESAIYNESIPKNDFNKSLAEAGGTDGKVKIIHEVSKGEYFHKIAINYSCTIDDIKIWNRLPTNDLNVGQKLIIWLNPQMARIIEEEKTRPKQQRDSTDRFIYYTVQNGDTVWSIAEKFNCRSISELKEENNINKEKDLKPGKKLKIYLNK

SEQ ID NO: 11045 - DNA, 762 bp, Unknown
  Obtained from environmental sample
  misc_feature (1)..(762): n is a, c, g, or t
atgaataagcactccatttctggtgatgctgctcaatcgagattatacgatttaatttggaaaagaaccgttgcttctcaaatgagtgatgctaaacttgagaaaacaaccattactataggtataaatacttcaaaagaaaaatttgtagctaaaggagaggtgttattgttcgaaggatttttaaaagtttatttagagtctagtgatgatgaccaccaagaagacgaaaaagaaggtattttaccacaagttaagaaaggagagaatttaaacttaaatgagcttactgctacagaaaaatacaataaccacccaccaagatataccgaagctagtttagttaaaaaattagaggagttagggataggaagaccatctacttatgcacctactatttctaccatacaaaaaagaggctatattgttagggaagatagagacggaaatcagagaaactatgtgttgctgacattaaaatcagggaaaatttctgaaaaacaactaaaagaaaactttggttttgagaagaaaaaaatgtttccaacagatataggtattgtggttacagatttcttagttgaaaacttcggaaaagtgttagactataattttactgcaagagttgaagaacagtttgatgaaattgcagaaggattgaaggtatggagcaagatgattgctgaattttataaaccttttcacaatcaaattaccgatactcttgaaaatgcagaaagaagcagtggtgaatggtattag

SEQ ID NO: 11046 - protein, 253 aa, Unknown
  Obtained from environmental sample
  DOMAIN (1)...(216): DNA topoisomerase
  misc_feature (1)..(253): Xaa is any amino acid
MNKHSISGDAAQSRLYDLIWKRTVASQMSDAKLEKTTITIGINTSKEKFVAKGEVLLFEGFLKVYLESSDDDHQEDEKEGILPQVKKGENLNLNELTATEKYNNHPPRYTEASLVKKLEELGIGRPSTYAPTISTIQKRGYIVREDRDGNQRNYVLLTLKSGKISEKQLKENFGFEKKKMFPTDIGIVVTDFLVENFGKVLDYNFTARVEEQFDEIAEGLKVWSKMIAEFYKPFHNQITDTLENAERSSGEWY

SEQ ID NO: 11047 - DNA, 789 bp, Unknown
  Obtained from environmental sample
  misc_feature (1)..(789): n is a, c, g, or t
atgccggaagccgcgttctcgatgagtttgccaagcaaggtatttgctcagcagataaaatacgcattggttgatcataaggacatatttttaggttatgaagaatttttaccgaccttcaacactcgatcaattgagacgatgatttggaatatccaaggattgtctgactattttatctatatgaacgatgatttcttttttaatcaaccagtgacgatagatgactttttagacagtgagaagctaatcattcatggtgagtggcgtaaaagtgctgctttgaatgccaagcttaattttcgaaaatcacgctttagattgtttggcacatcgatacagccaaggcatactatcgcgcaaatgttaagtgctaaaatactgggcatgaatcagttttttgaaattcatcattaccctcatattgtcgataaaaacatcttaaagtcccatttgttgaatcatccgcaattattgaccgagcagataaaatacaaattcagagatgtcgcccaagttaaccctataacaatgatgaatcatcttaaaattcaaaaaagcgaagcacacttaaagcctaatacctctatcaactatctaaaaaatgagaatagcgtagaggactttatcattgctttagaagataaaactatcaaatatggttgtattcaaagtttggatcttttgaaaccagatttgtataaaaaaatcagtcaagctatgaggcacaagttcttagattatctgcctaattccgtgttagaaaacacaaataatgagcctaaatga

SEQ ID NO: 11048 - protein, 262 aa, Unknown
  Obtained from environmental sample
  SIGNAL (1)...(16)
  misc_feature (1)..(262): Xaa is any amino acid
MPEAAFSMSLPSKVFAQQIKYALVDHKDIFLGYEEFLPTFNTRSIETMIWNIQGLSDYFIYMNDDFFFNQPVTIDDFLDSEKLIIHGEWRKSAALNAKLNFRKSRFRLFGTSIQPRHTIAQMLSAKILGMNQFFEIHHYPHIVDKNILKSHLLNHPQLLTEQIKYKFRDVAQVNPITMMNHLKIQKSEAHLKPNTSINYLKNENSVEDFIIALEDKTIKYGCIQSLDLLKPDLYKKISQAMRHKFLDYLPNSVLENTNNEPK

SEQ ID NO: 11049 - DNA, 552 bp, Unknown
  Obtained from environmental sample
  misc_feature (1)..(552): n is a, c, g, or t
atgcgcgtggcttattttaatgagcttgatacttatgcgcaaacctttggacttgagaccaaacaaatcatcgaagggattggcttagaccctcgtattggcaatcattataataacccttcttttggctatggcggctactgtctgcccaaagatactaagcagttattagcaaattacgatgaagtaccaagcaacctaataaaagccattgtcgattctaataggacccgcaaagactttattgcagataaaatcatcgaaagacagccaaaaatcgtgggaatacatcgcctagtgatgaaaagtgggtcagataactttagagcatctgccatacaaggcatcatgaaacgtatcaaggcaaaaggtatcgaggttgttgtctacgaacctgtgctaaaagaagatgatttctttaattcgcgtgtaattcaagacttggacaccttcaaatcaatgagtgatgtcattgtcgcaaaccgcctatctgatgagataaaagatgtggcggataaagtatttactcgagatctatttgggagcgattaa

SEQ ID NO: 11050 - protein, 183 aa, Unknown
  Obtained from environmental sample
  DOMAIN (95)...(182): UDP-glucose/GDP-mannose dehydrogenase family, UDP binding domain
  misc_feature (1)..(183): Xaa is any amino acid
MRVAYFNELDTYAQTFGLETKQIIEGIGLDPRIGNHYNNPSFGYGGYCLPKDTKQLLANYDEVPSNLIKAIVDSNRTRKDFIADKIIERQPKIVGIHRLVMKSGSDNFRASAIQGIMKRIKAKGIEVVVYEPVLKEDDFFNSRVIQDLDTFKSMSDVIVANRLSDEIKDVADKVFTRDLFGSD

SEQ ID NO: 11051 - DNA, 810 bp, Unknown
  Obtained from environmental sample
  misc_feature (1)..(810): n is a, c, g, or t
atgccaaaggaggcatttaaagacctttgggacacaatacaaagtggaaaaagttggtctggtgaagttaaaaatagaaaaaaagatgggagttcttattgggtatttgcctatattgaaccaatctttgatgataaacatatcattattggctacagtgcaattagacaagagatcacagataaaaaagatgctcagtttaaaatggaacaaattgatgctattataaaatttgcaaatagtggtgtaggtacaattgattttgaaggaaattttttaagtgtaaatggatattacactaagctttttggttattctacagaagagatgataggaaaaaattgtattgaaatgtcaagttctgattctaaaatagtcgcagaagaagcattaaaaactgcgatagaaactggaacagtaagtcaagttgaaaaagcttgtgatgataaatatggaaacaaagttcatgttgaattttcacttaatcttctccccgataaaaaaacttttgttgttgtaattaactctttagaggataagaaaaaactagaagcattgaataaatcactcaatgaaaagattaagcaagaggtagagaaaagtactaaacagttggaaatgatccaaaaagagcaattagaaagtgcaaaacttagctctattggagcattagctgctggtattacacatgagataaatacgccgcttacctatattaggggtaactttgaattaatggattatgatattgatgatttagaacccagtgattttaaaacaagaatgaaaatgattccattaaaaaattga

SEQ ID NO: 11052 - protein, 269 aa, Unknown
  Obtained from environmental sample
  DOMAIN (70)...(132): PAS domain
  misc_feature (1)..(269): Xaa is any amino acid
MPKEAFKDLWDTIQSGKSWSGEVKNRKKDGSSYWVFAYIEPIFDDKHIIIGYSAIRQEITDKKDAQFKMEQIDAIIKFANSGVGTIDFEGNFLSVNGYYTKLFGYSTEEMIGKNCIEMSSSDSKIVAEEALKTAIETGTVSQVEKACDDKYGNKVHVEFSLNLLPDKKTFVVVINSLEDKKKLEALNKSLNEKIKQEVEKSTKQLEMIQKEQLESAKLSSIGALAAGITHEINTPLTYIRGNFELMDYDIDDLEPSDFKTRMKMIPLKN

SEQ ID NO: 11053 - DNA, 720 bp, Unknown
  Obtained from environmental sample
  misc_feature (1)..(720): n is a, c, g, or t
ttggaaatgatccaaaaagagcaattagaaagtgcaaaacttagctctattggagcattagctgctggtattacacatgagataaatacgccgcttacttatattaagggtaactttgaattaatgaattatgatattgatgatttagaaccaagtgatattaaaacaagaatgaaaaatgattcgattaaaataattgagggtatagatagaattgctaatatcattgaatctatgaaagaggtatcacaagttgcaagtgagaaaaaagacttagttaatatatacagcacacttgtgactgctttaattgtgagtcataattctattaatcaaattacaaatgtttatttaaatggtgagaaatttgatattaatacagataaaaataaatttatttttaattcaaaagtacaaaaacaaagaattgaacaagtttggatagtgataattaaaaatgccttagatcaactcatctatattgatgattttgataatagaaaattatcaattgatattaacaatatagagaaccatgtagttgtacagtttaaagataatggtggtggaattaagaaagatattttagaaaatatattcgaaccttttgtaagttttaaagaacatggtggaattggggttggtttaaacattgcaaaaaaaattatagaagatcaagatggagagatttcagcatacaatgactcagccgaattctga

SEQ ID NO: 11054 - protein, 239 aa, Unknown
  Obtained from environmental sample
  DOMAIN (16)...(88): His Kinase A (phosphoacceptor) domain
  misc_feature (1)..(239): Xaa is any amino acid
MEMIQKEQLESAKLSSIGALAAGITHEINTPLTYIKGNFELMNYDIDDLEPSDIKTRMKNDSIKIIEGIDRIANIIESMKEVSQVASEKKDLVNIYSTLVTALIVSHNSINQITNVYLNGEKFDINTDKNKFIFNSKVQKQRIEQVWIVIIKNALDQLIYIDDFDNRKLSIDINNIENHVVVQFKDNGGGIKKDILENIFEPFVSFKEHGGIGVGLNIAKKIIEDQDGEISAYNDSAEF

SEQ ID NO: 11055 - DNA, 531 bp, Unknown
  Obtained from environmental sample
  misc_feature (1)..(531): n is a, c, g, or t
ttggcaatcataagggattggcctctgtttatagaaattgaacaggtgccggaggctattgaactcagtgagattgttgatccagatgctaaacgcttatttggaggcagctatctttatggaaatagccttggcggtaaaattacggtttatccttttgacatagcaaaaatgggtaaaggttttctggatcctacccgtaaaaagatgttgtataatatattgaagtggttatccggtgataccattccattgtttatggaaggtgaacgcgaagttttgccgcttcgctgtgattttccagaatactcagtcgtgtcattattcaatttgtctcacgatgatctgcttaatatttcagctgaaatgaatataggaaataaagagattgaaaacgcgcagtacttggctcttaacggagaatggcagactttcaataacttagaatgtgatggtagtaagctaaagttgaaaatcgataagctgacttttgataaaccgctattcgtgacaattaatttcaaggggtaa

SEQ ID NO: 11056 - protein, 176 aa, Unknown
  Obtained from environmental sample
  misc_feature (1)..(176): Xaa is any amino acid
MAIIRDWPLFIEIEQVPEAIELSEIVDPDAKRLFGGSYLYGNSLGGKITVYPFDIAKMGKGFLDPTRKKMLYNILKWLSGDTIPLFMEGEREVLPLRCDFPEYSVVSLFNLSHDDLLNISAEMNIGNKEIENAQYLALNGEWQTFNNLECDGSKLKLKIDKLTFDKPLFVTINFKG

SEQ ID NO: 11057 - DNA, 486 bp, Unknown
  Obtained from environmental sample
  misc_feature (1)..(486): n is a, c, g, or t
ttgatggctcagggatatatgatgcaatatccacgatttggaaaaattccttatcttatcaattcaccagaactaggaagaggatataaacttatatcattacttattgcacaagattatgggcaaatagaagaggtgtatggaaaagctcaaattagtagaattaatacttctacatcttataaagtaatttttccacaaacaaatagtgagacagcagaaacaactagcaaatttataggtgagtttactcgagaaactgtaagtgaaagcaaatcaaacggagataaaggaaatactaataaatctttatcaacacaattaagcggtcaagctttaatatctaaacaagatattttaaatatgaatgaggggcaaatttatatattagcaaaaaactattataaaaatccaatcaaagcaaaaccatatttatattatgaagataaaaaacttaaaaacctagtaccacaagaagaggaataa

SEQ ID NO: 11058 - protein, 161 aa, Unknown
  Obtained from environmental sample
  misc_feature (1)..(161): Xaa is any amino acid
MMAQGYMMQYPRFGKIPYLINSPELGRGYKLISLLIAQDYGQIEEVYGKAQISRINTSTSYKVIFPQTNSETAETTSKFIGEFTRETVSESKSNGDKGNTNKSLSTQLSGQALISKQDILNMNEGQIYILAKNYYKNPIKAKPYLYYEDKKLKNLVPQEEE

SEQ ID NO: 11059 - DNA, 543 bp, Unknown
  Obtained from environmental sample
  misc_feature (1)..(543): n is a, c, g, or t
atgtgtgatgagtgtaatggaaaaagatataatagagaaacattagaagtaaggtataaaggaaaatctattagtgatgtgttgaatatgagtattgaacaagcagtagttttctttgaaaatcatcctaatattttacagaaaataaaaactcttaatgacgttggtttggggtatattaatttaggacaaccatcaacaacactttcgggtggagaagcacaacgagtgaaattagctgccgaattagctaaacgacaaacaggtaaaacattgtatattttagatgaaccatcaacaggtttgcattttgaagatattaaagtattgttggacgttttaaataaattagttgatattggtaatacggtgctggtggtagaacataatttagatattattaaagtagcagattatattgtagatgttggtccggaaggcggacaagaaggaggaaagattgttgccgaaggaacaccagaacaattggctaaaaacaaaaaaagttatacggctagttttttaaaagaagagttgaaatag

SEQ ID NO: 11060 - protein, 180 aa, Unknown
  Obtained from environmental sample
  DOMAIN (7)...(144): ABC transporter
  misc_feature (1)..(180): Xaa is any amino acid
MCDECNGKRYNRETLEVRYKGKSISDVLNMSIEQAVVFFENHPNILQKIKTLNDVGLGYINLGQPSTTLSGGEAQRVKLAAELAKRQTGKTLYILDEPSTGLHFEDIKVLLDVLNKLVDIGNTVLVVEHNLDIIKVADYIVDVGPEGGQEGGKIVAEGTPEQLAKNKKSYTASFLKEELK

SEQ ID NO: 11061 - DNA, 744 bp, Unknown
  Obtained from environmental sample
  misc_feature (1)..(744): n is a, c, g, or t
gtggatatgactggattttgtgcatctatttaccaaagaggtattgattttatacaagttcctacaactctattatcacaagttgatgcaagtgttggaggaaaaactggtgtaaataataagtttggtaaaaacttaattggagctcttcatcaaccaagagctgtgtatattgacccatactttttaagtactttacctaaaagagagtttggtgcaggaatcgctgaaatagttaaaatggcagtaacctttaacaaagagtttttcgaatggattgagagtcatgatttgtatgaccaagagaacataaaaattgccataaaaaaatctgttgaaacaaaggcttgggttgtatctaaagatgaaaaagaaaatggaataagagctgctttaaattatggacatacctttggacatgttgtagaaaatgagacaaaatattcaaaatatcttcatggtgaagctgtaggtattggtatggttatggccaatgaagtttctaaaaaaatcggacttatgagtagtgaagatgctttaagggtaaaaaatgttttagagaaatataatattccaacatcatacaaaataaatgatgtagaagatttttatgaacacttctttttggataagaaaagccttgatgataaaataaaatttatcttacctgttggtcttggtgattgtaagattactgatgaagtatctaaaactgatgttattgacgttttaaaaggattttaa

SEQ ID NO: 11062 - protein, 247 aa, Unknown
  Obtained from environmental sample
  DOMAIN (2)...(245): 3-dehydroquinate synthase
  misc_feature (1)..(247): Xaa is any amino acid
MDMTGFCASIYQRGIDFIQVPTTLLSQVDASVGGKTGVNNKFGKNLIGALHQPRAVYIDPYFLSTLPKREFGAGIAEIVKMAVTFNKEFFEWIESHDLYDQENIKIAIKKSVETKAWVVSKDEKENGIRAALNYGHTFGHVVENETKYSKYLHGEAVGIGMVMANEVSKKIGLMSSEDALRVKNVLEKYNIPTSYKINDVEDFYEHFFLDKKSLDDKIKFILPVGLGDCKITDEVSKTDVIDVLKGF

SEQ ID NO: 11063 - DNA, 918 bp, Unknown
  Obtained from environmental sample
  misc_feature (1)..(918): n is a, c, g, or t
ttggttaaaccgttagtttcaatttatgaaaaaacaacccatgaattaactacccaaattgagctacaacatttttcggtagttggtgttagttattggaattatttatttaacgataaaattacactagataacatcctttttagtcagcccaaagtaacttactaccataatgatacatcaaaatctcataaagatgaatttacaaaagacttaaaacaaataatacaaattgaatccctgcaaatacaggatgccgatgtaaaggtttatgatgtttccaatgattcattattattaaaaacagaaaaactaaatttaaaaattaatgctattgaaatcaatccatcaacagcaaaaaaactaatcacttataaaaatttcaaagcaacatccaattctaccttttgtagtttaaatgactacgaaaatcttgttattgaaaatttagatgtaaccgctgacttttctacccttaaaggaataacattaaaaactaaatactccaaagaggcattattgaagcaaataacagtagagcgcgatcattatgatttaaccatagattccattaaagtaaaaaatcaaaattttggttttgagcaagatacatccttctattttaaaagccagcgtgtcgatttttatcagcctaattttaaaatatatagaaataagttagtagccgaatatttaagttttaaaccgctgtatagtaaaatgctaagggatttaaacttttctatggctttaaactctgttttcttaaacaatgctgctgttgtttataccgaaaaagtaaaaacagaaacaaaaggaggtaaaatttttatttccaaactaaatggcgaaatcaaaaatttgagcaatacttataagtctgatgacacacctacatcgattaaggtaaaggcattt

SEQ ID NO: 11064 - protein, 306 aa, Unknown
  Obtained from environmental sample
  misc_feature (1)..(306): Xaa is any amino acid
MVKPLVSIYEKTTHELTTQIELQHFSVVGVSYWNYLFNDKITLDNILFSQPKVTYYHNDTSKSHKDEFTKDLKQIIQIESLQIQDADVKVYDVSNDSLLLKTEKLNLKINAIEINPSTAKKLITYKNFKATSNSTFCSLNDYENLVIENLDVTADFSTLKGITLKTKYSKEALLKQITVERDHYDLTIDSIKVKNQNFGFEQDTSFYFKSQRVDFYQPNFKIYRNKLVAEYLSFKPLYSKMLRDLNFSMALNSVFLNNAAVVYTEKVKTETKGGKIFISKLNGEIKNLSNTYKSDDTPTSIKVKAF

SEQ ID NO: 11065 - DNA, 708 bp, Unknown
  Obtained from environmental sample
  misc_feature (1)..(708): n is a, c, g, or t
gtgcggagtatggagaaaggagttcgtaactcacttctattggcgccaatgcctaccgcttctacttctcaaatcttgggcaacaacgaatgttttgagccatacactagtaacatctacacccgtagagtactttctggtgagttcatcgttgtgaataagcacctgcttattgacctagttgatctaggactttggagcgaagatttgaagaacgatattattcgcgcaaacggttctatccaaggtattgatgtcattcctgataacctgaaggagatttacaaaaccgtgtgggagatgagtatgaaagacatcatcgacatgagtgcggatagaggttggtttattgatcagtctcaatctctcaacttgtttatggaaaatgccaacattggtaaactcacttctatgcatttttacgcatgggaaaaaggtttgaaaaccggtatgtactacttgcgcactaaagcggcaagtgatgccattaagtttacggtgcaaaagcaaagtaaagctgaggttactccagtaactgagggcaagcaaactgaaaaaattcaggaaaaggaaagtgtgcaaaaggcaaataaccttggtgaaaagcgggtagctgaaatggctgagcgcgtaaataacttttctgacgaagaagtgatagcatgttctatcgacaatcctgatgattgcgaagcttgcggatcataa

SEQ ID NO: 11066 - protein, 235 aa, Unknown
  Obtained from environmental sample
  DOMAIN (1)...(158): Ribonucleotide reductase, barrel domain
  misc_feature (1)..(235): Xaa is any amino acid
MRSMEKGVRNSLLLAPMPTASTSQILGNNECFEPYTSNIYTRRVLSGEFIVVNKHLLIDLVDLGLWSEDLKNDIIRANGSIQGIDVIPDNLKEIYKTVWEMSMKDIIDMSADRGWFIDQSQSLNLFMENANIGKLTSMHFYAWEKGLKTGMYYLRTKAASDAIKFTVQKQSKAEVTPVTEGKQTEKIQEKESVQKANNLGEKRVAEMAERVNNFSDEEVIACSIDNPDDCEACGS

SEQ ID NO: 11067 - DNA, 759 bp, Unknown
  Obtained from environmental sample
  misc_feature (1)..(759): n is a, c, g, or t
ttgcattttagtccacttgatattcttaatataaatttaaaagcagagaatatcggcataattaacgatgtttttaagcatatctgtttgaatttcagatatttaatcttggatcggaacaacaaagctttcgctatagccagccctactaagggtgaagggaaaagtgcaatttcactcaatatggctcaagctctggccaatgatcatcaaaaagttattcttatagatactgattttcatattcccagaatttcaagaacaattaataacaatgagcaagccggtttatcggaaatactttcgggacagatcgaaattgatgattgcattcaaaaaattgaaccaaataattttgattttattccttccggtaagaggccgcccaatattcctcgaatgattaacagtaaggcatttaaagatttcatcagagagatgaaatctagatatgatattgtgctgtttgatactcccgccactcttttggttacggagacatcttacttatacagtcatctggatggagttatcctaactgtaaaaatcctaaagactaattattctgatgtaagaaaaatgataagaaggatgataaccactaatacagagattttgggtgcaattgtaaatggaagtagaaacagtatttttgataaagaatttggtgaatatggcagctactactataaaaataaatacagttattatactgataaaaaaccaagtcttgtttcgcgaataacttcccaaatttaa

SEQ ID NO: 11068 - protein, 252 aa, Unknown
  Obtained from environmental sample
  DOMAIN (44)...(242): CobQ/CobB/MinD/ParA nucleotide binding domain
  misc_feature (1)..(252): Xaa is any amino acid
MHFSPLDILNINLKAENIGIINDVFKHICLNFRYLILDRNNKAFAIASPTKGEGKSAISLNMAQALANDHQKVILIDTDFHIPRISRTINNNEQAGLSEILSGQIEIDDCIQKIEPNNFDFIPSGKRPPNIPRMINSKAFKDFIREMKSRYDIVLFDTPATLLVTETSYLYSHLDGVILTVKILKTNYSDVRKMIRRMITTNTEILGAIVNGSRNSIFDKEFGEYGSYYYKNKYSYYTDKKPSLVSRITSQI

SEQ ID NO: 11069 - DNA, 759 bp, Unknown
  Obtained from environmental sample
  misc_feature (1)..(759): n is a, c, g, or t
ttggtgggctttcctggaactaatcaatttatttcaatcatcctggataacgatctaatcacagtacccattatccccttgtttacacgagcaacaccaaggttcgagtatcctggttcattgtatgaaatttatcttactggtggggttccatttttgcttagatcatcacagattattctccaggaaaaaatcgattttttcttcactcaaaaaagaccatcctggattaagtttattgactatctaggtggagttgaggttaccctaccaagtaagtttgctgatgaatataaactacccaagggtaagtataacctcactggccccctttcctggcagtatattagctatatcagtaaaaggaatagagaaaataacaactgggtaacaggatcaggctatcgtataaagtatcaaaaagatttcatgctcgcgatgtataataaattcaaacagcaaaattttatgctccaaggtgatattttgagaaagattatagctgaatctgagaccaatatgaagaatcaggatttcttaaaaattgctaatgcagctagaaaaatgaaaaacatcaaactagagttttttactttacctggaattattcaggagtatgataagcaactattttgggtaacagatctggatgaatatcagctaaaacagagtaaaataattactgatcaaattaaaggaattgatagattaagaattgataaaggtggttttggtggaaaagtcaaagaactggattaa

SEQ ID NO: 11070 - protein, 252 aa, Unknown
  Obtained from environmental sample
  misc_feature (1)..(252): Xaa is any amino acid
MVGFPGTNQFISIILDNDLITVPIIPLFTRATPRFEYPGSLYEIYLTGGVPFLLRSSQIILQEKIDFFFTQKRPSWIKFIDYLGGVEVTLPSKFADEYKLPKGKYNLTGPLSWQYISYISKRNRENNNWVTGSGYRIKYQKDFMLAMYNKFKQQNFMLQGDILRKIIAESETNMKNQDFLKIANAARKMKNIKLEFFTLPGIIQEYDKQLFWVTDLDEYQLKQSKIITDQIKGIDRLRIDKGGFGGKVKELD

SEQ ID NO: 11071 - DNA, 636 bp, Unknown
  Obtained from environmental sample
  misc_feature (1)..(636): n is a, c, g, or t
atgaaaaaaaagctctctcttacaaaacaaaagataaaaaatagtgccataatcctttttaacgaaggggacacgctcagtataacaacaaatcatattgcagcaaaagccggtatctcttctggaaatttgtattatcactataaaaataaagaggatattttagttgatatatatctagatatgtccgaaaagtttgaaagttttgagagctttgatactattttaactagtgaaaatccactaaaaagtttatatgagatgtatgatgtttacggggaacttttttgggagtttagatttcttatgagagattctgttgtacttatgagacttaatcctaaacttaaagagatgtttttagaaagacaaacgaaaagaatttttcaaattgaatctcttataaattattttgtctctaaagagatattcactgatatcccaaaacaagagatttctctaagagcaaagcttaattggttcatctctgcatattggcaaacctttgtttctactgatgatgagcttacaaaagagtctataaaagagataaaagatatagtatttacaatcaatatttatccttttttaacagacaaagggaaacttctagcaaaagaattcaaaaaagaataa

SEQ ID NO: 11072 - protein, 211 aa, Unknown
  Obtained from environmental sample
  DOMAIN (12)...(58): Bacterial regulatory proteins, tetR family
  misc_feature (1)..(211): Xaa is any amino acid
MKKKLSLTKQKIKNSAIILFNEGDTLSITTNHIAAKAGISSGNLYYHYKNKEDILVDIYLDMSEKFESFESFDTILTSENPLKSLYEMYDVYGELFWEFRFLMRDSVVLMRLNPKLKEMFLERQTKRIFQIESLINYFVSKEIFTDIPKQEISLRAKLNWFISAYWQTFVSTDDELTKESIKEIKDIVFTINIYPFLTDKGKLLAKEFKKE

SEQ ID NO: 11073 - DNA, 912 bp, Unknown
  Obtained from environmental sample
  misc_feature (1)..(912): n is a, c, g, or t
atggtcagaatcggctcgagactatttagtaaacatttacaagtattaaaacaagttgaagaggatattaatagcaatattatgaatattgaacaacttggagaatttgttagaaaaaattttatcaaaagaaaaaataaaatacttgaagggcttatagggacacaaaaaactataaaagagatttatattttagacagagaaggcttagtaaaagattttcaaacgagagtaaaatctaatctttttattggatatgatttttcaaatacaaaatattatatggagataaataatggtaagttgaaatattggtcagatgtatatctatcaaatacaacaaatacaccagtgatatcttatagtgtaaaaatagatgatgataatattattgtttttgttcttgatcttgccatgctaaacacatttgcacagaagtttcagagtggagatggttcaactatggttagaattatggataacaatggtgtctttttagcaaatcccgataagccagagtttgtatttcagcaaaaaaatatcttaaatcttggattgtataaaaattttatttcaaagggatataaataccgacaaataacatttcaaaatgcagctaaaaattctttgaacaatattggagtatatggcgtaacanaaaaacttcaatggtatgtagtagtaaaagagagatatgagtatatatttcanacatattttaatattatgtattttcttggcttatttattgttgtgatgatagttttatctatgattgttgcagtaagacttgctaagtcaattttaaaacctttagatgaggtaagtttacagatgggaaatattgctcaagagaggatatccgaggtattgataaaaataattataagagttaaaaaaacttattattag

SEQ ID NO: 11074 - protein, 303 aa, Unknown
  Obtained from environmental sample
  misc_feature (1)..(303): Xaa is any amino acid
MVRIGSRLFSKHLQVLKQVEEDINSNIMNIEQLGEFVRKNFIKRKNKILEGLIGTQKTIKEIYILDREGLVKDFQTRVKSNLFIGYDFSNTKYYMEINNGKLKYWSDVYLSNTTNTPVISYSVKIDDDNIIVFVLDLAMLNTFAQKFQSGDGSTMVRIMDNNGVFLANPDKPEFVFQQKNILNLGLYKNFISKGYKYRQITFQNAAKNSLNNIGVYGVTXKLQWYVVVKERYEYIFXTYFNIMYFLGLFIVVMIVLSMIVAVRLAKSILKPLDEVSLQMGNIAQERISEVLIKIIIRVKKTYY

SEQ ID NO: 11075 - DNA, 375 bp, Unknown
  Obtained from environmental sample
  misc_feature (1)..(375): n is a, c, g, or t
atgaaaattataggcgtagatccaggtacaaatttgttaggatattcaatattaaatatttcaaactctaaacctgaaattattgtttctggtaaattaaatttattaaaggttactgacccatacgaaaaacttgaaaaaatttactctaaaatttcttcgttggttaaagaatattctcctgaagagttagctattgaagctcctttttttggtaaaaatgcacaatcaatgctaaaattaggacgagctcaaggtgtcgcgattgctgctgctatgggacttggtgttaaagtttttgaatattctcctagaaaaataaaacaatctgttacaggcaatggaaatgcttcaaagagcaggttgcacagatag

SEQ ID NO: 11076 - protein, 124 aa, Unknown
  Obtained from environmental sample
  DOMAIN (3)...(123): Crossover junction endodeoxyribonuclease RuvC
  misc_feature (1)..(124): Xaa is any amino acid
MKIIGVDPGTNLLGYSILNISNSKPEIIVSGKLNLLKVTDPYEKLEKIYSKISSLVKEYSPEELAIEAPFFGKNAQSMLKLGRAQGVAIAAAMGLGVKVFEYSPRKIKQSVTGNGNASKSRLHR

SEQ ID NO: 11077 - DNA, 567 bp, Unknown
  Obtained from environmental sample
  misc_feature (1)..(567): n is a, c, g, or t
atgtttgagtcagatgattattgggaagaagagtttataggatacgatgataaaaacttggactctatctactttgataactgtacctttataaaatgtaactttctaaaaagtaagattagtagttgtaaatttacagagtgtacttttatagattgtgatttatctctaagtactttgaaaaactctatctttaatgatgttacatttgaaaactcaaaacttttagggataagttggagtagttgtgatgagccttttgatgtgacatttgattcatctaatatctcacaaaactcttttcatcgtttagatttaagacagatgaagtttattaactgccagataaaagatacaggttttgaagagtgcaatcttgaacgggcactttttgataactgcaatttagaacaaacagtttttatcaaaaacaatctcaaaaaagcaaattttgaaacctctaaaaactatctcatagaccctaatcaaaatgatatacaaaaagctcaattttcacttcctgaagcgttaagtttcttaagtttacttccaattcaattaaaataa

SEQ ID NO: 11078 - protein, 188 aa, Unknown
  Obtained from environmental sample
  misc_feature (1)..(188): Xaa is any amino acid
MFESDDYWEEEFIGYDDKNLDSIYFDNCTFIKCNFLKSKISSCKFTECTFIDCDLSLSTLKNSIFNDVTFENSKLLGISWSSCDEPFDVTFDSSNISQNSFHRLDLRQMKFINCQIKDTGFEECNLERALFDNCNLEQTVFIKNNLKKANFETSKNYLIDPNQNDIQKAQFSLPEALSFLSLLPIQLK

SEQ ID NO: 11079 - DNA, 738 bp, Unknown
  Obtained from environmental sample
  misc_feature (1)..(738): n is a, c, g, or t
gtggatgttcttactccaaaatacgatatcatcgctagatttcaaggcggacctaatgctggtcacactttagagtttgaaggtatcaaacatgtacttcacaccattccttcaggcatctttcacaaaggagtgaagaatgttgtaggaaatggagttgtgatagatccagtagttctaaaagtagaaattgacaaattaacaccaatgggtgttgatgtaaaagagcaactacttatttctagaaaagcacatcttatacttccttcccataaattactagacaaagcctcagagacttcaaaaggtaaagcaaaaattggttccacgcttaaaggtattggcccaacttatatggacaaaactggtagaaatggtcttagagttggagatgtatttgcttcaaacttcaagcaactctatgatgctttagtagaaaagcacaaaaacttattaaagaactttgacatagaatttgatatagaatcactagaaaaagatttcttcgaaggaattgaaacactaaaatcactaacgccaatagacagcgagcattacttaaatgatgcatggaaagctggtaaaaaaatattagcagaaggagcacagggaacattacttgatgttgactttggaacttatccatttgtgacttcatccaatacaattactgctggaacttgcactggattagggattgctcctaaaaagattaaaaacgttattggtattttttaa

SEQ ID NO: 11080 - protein, 245 aa, Unknown
  Obtained from environmental sample
  DOMAIN (2)...(245): Adenylosuccinate synthetase
  misc_feature (1)..(245): Xaa is any amino acid
MDVLTPKYDIIARFQGGPNAGHTLEFEGIKHVLHTIPSGIFHKGVKNVVGNGVVIDPVVLKVEIDKLTPMGVDVKEQLLISRKAHLILPSHKLLDKASETSKGKAKIGSTLKGIGPTYMDKTGRNGLRVGDVFASNFKQLYDALVEKHKNLLKNFDIEFDIESLEKDFFEGIETLKSLTPIDSEHYLNDAWKAGKKILAEGAQGTLLDVDFGTYPFVTSSNTITAGTCTGLGIAPKKIKNVIGIF

SEQ ID NO: 11081 - DNA, 858 bp, Unknown
  Obtained from environmental sample
  misc_feature (1)..(858): n is a, c, g, or t
atggaaagtatggtctatgatgataggaaaatgcacatggtaatggagtcactgcactacgattttaatacaaaaattggatcatataactccctggctaccattacaagcttggaagacaaaaacacattaacgagtaagcaagggctttacaacagcacaacccaaaagatgcatttcaaagatagtgtaaggctaaaaaatgaaaattacaccatggagtcagacacattgacgtatggaatggaatccaaaattgcaactttccatggtccaaccaacattatatctaaggataacaccatttattgcgaagctggagtatataatacagaaacggaaattagttcactatggaacaatgccaatattataaccaaagaacaaactctgggaggtgatagtatctattatgatagagaatccggaattggagaggttttctgcaatgtacttatgattgatacagtaaacaaggtcactctaattggtgattatggttttcacgatgaactgaatgactctactgccatcattggtaatgctgaaatgatgcaaaaaaacgaaacagacacattatttctttccgctaaatatctgacaattaaatcagattcactaaatgaaaataaaaaaatcaaagcttatagaaacgtaaaaatctataaatcagattttcaaggtgtatgtgattcacttgcttataatgatatcgattctatgatgaagttctttatagagcctatcttatggtctggtaagaatcaaataacagggaagtttattgaagcaaaaactggcaaagaagaaatagaatacctcaacgtaattaaagatgcttatatcattcgcaaatga

SEQ ID NO: 11082 - protein, 285 aa, Unknown
  Obtained from environmental sample
  misc_feature (1)..(285): Xaa is any amino acid
MESMVYDDRKMHMVMESLHYDFNTKIGSYNSLATITSLEDKNTLTSKQGLYNSTTQKMHFKDSVRLKNENYTMESDTLTYGMESKIATFHGPTNIISKDNTIYCEAGVYNTETEISSLWNNANIITKEQTLGGDSIYYDRESGIGEVFCNVLMIDTVNKVTLIGDYGFHDELNDSTAIIGNAEMMQKNETDTLFLSAKYLTIKSDSLNENKKIKAYRNVKIYKSDFQGVCDSLAYNDIDSMMKFFIEPILWSGKNQITGKFIEAKTGKEEIEYLNVIKDAYIIRK

SEQ ID NO: 11083 - DNA, 639 bp, Unknown
  Obtained from environmental sample
  misc_feature (1)..(639): n is a, c, g, or t
atgattaaaagggcagatttcacaaaacaaattagaaataatgaattgaatattagctatactccacttagcgaaaaagatagtcttggaaatgcacttgttgctcttcataataattttcttgagataaaaaataaagaagacattcgcaaagcaaaagcgaagcaaacaaactggattaaccatggaataggaaaatttagcgacctgttaagactaaataatgatgatatgcagcttttggctgataatattataaccaacatggtgaaatacgtaaatgcacatcagggtggtttatatttatttaacgaagaagataaagataatatttttcttgaattaatagcagcttatgcatacgatcgaaaaaaatttctggatataaaaattgaaattggtgttggacttattggtacttgtgcaattgaaaaaaagacaatttacttaactgaaattcctcaggattatgtcaaaatttcctcaggatttggacaaactaatccaaacagtgttttgatagttccccttactatggaaaacaaagtgtacggaattattgaacttacatcattgaataaatttgaaaattatgaaatagaattgtcgaaaaaatgggcgaactcgagccgatcctga

SEQ ID NO: 11084 - protein, 212 aa, Unknown
  Obtained from environmental sample
  misc_feature (1)..(212): Xaa is any amino acid
MIKRADFTKQIRNNELNISYTPLSEKDSLGNALVALHNNFLEIKNKEDIRKAKAKQTNWINHGIGKFSDLLRLNNDDMQLLADNIITNMVKYVNAHQGGLYLFNEEDKDNIFLELIAAYAYDRKKFLDIKIEIGVGLIGTCAIEKKTIYLTEIPQDYVKISSGFGQTNPNSVLIVPLTMENKVYGIIELTSLNKFENYEIELSKKWANSSRS

SEQ ID NO: 11085 - DNA, 753 bp, Unknown
  Obtained from environmental sample
  misc_feature (1)..(753): n is a, c, g, or t
atgccaaaaacattaaaaaactttatattttcaataaatattattcttctgtcgtctctgtttctactgatatttatctttacaacatatcttcatacaactttagctcaaaaaaatgctattaaacatgcaaatgcagtatctaatcaagtattctcatctatgtatcaggttatgaaaaaagggtgggataaagaggaacttaatgagtttatgaactcactgaaagagaactttaacgatactgattacaatataaatatttatcgttccgatcgggtaaaagagctctttggtgaagttagtgaaaaccctaaagatgatcttgtgaaaactgttttaaagagcggtcaaaaagtgacaatcagccaaatgcaaacgattagaaatttactgcctctaaacgctaaacaagagtgtttaagctgccatgtgaatgctaatgtaggagatacgttaggtgttattgatgtagagcaaaatttagttgacataattaaagagacatttttagactatgtatatttctttttaatagtgcttcctatttttgctttagttgcatttatcgcttcgagatatacaacttcaaagattacagagtcactgaaactgtttaataaaaaggttcaaaatatncattcgcttgaggactttagagagtttgattcaaaagagatagatctgaagtttgatgagataaatgagaatattacaaatgtggatcttttggctcataagcaaaagatatag

SEQ ID NO: 11086 - protein, 250 aa, Unknown
  Obtained from environmental sample
  misc_feature (1)..(250): Xaa is any amino acid
MPKTLKNFIFSINIILLSSLFLLIFIFTTYLHTTLAQKNAIKHANAVSNQVFSSMYQVMKKGWDKEELNEFMNSLKENFNDTDYNINIYRSDRVKELFGEVSENPKDDLVKTVLKSGQKVTISQMQTIRNLLPLNAKQECLSCHVNANVGDTLGVIDVEQNLVDIIKETFLDYVYFFLIVLPIFALVAFIASRYTTSKITESLKLFNKKVQNXHSLEDFREFDSKEIDLKFDEINENITNVDLLAHKQKI

SEQ ID NO: 11087 - DNA, 660 bp, Unknown
  Obtained from environmental sample
  misc_feature (1)..(660): n is a, c, g, or t
atgataccaatgattaattcttatgacgcatttgctttaacagaagataaatttcatacctcctttgtacttcgaaataacggtgttatgactgcagattataaactatgtcacagagatgatactgttgaattgaaaaaaattcttagaagatggggcaaaatgatatataaaccaactgatggttggggtggtgttggacttacaaagatagaaaatagggcaagtcttgatatgcttatgccatttttaaatcaaatggatttacgatatttttatgttgaaaaatttatagattatgataatacagactttagagtagatatagtagatgggcaatttgtaggttgttatggtagaaaagctagtggaacagattggagaaccaatattacaagtggtggaagtgtatttttaagagaaccaaatgatgagataattgatattgcaattaaagcatcaaatgcttgtggtactgatattgctggagtggatataatttatgatagaacaaaagaggaatatgtagttcttgaagtaaatggaatacctgcatttgcaacaccagaacaagaaaagttaggacttgattttaacgataaaaagatagatttaatagtagatttaatagacagaaaaacaaacaaaggggaaaaataa

SEQ ID NO: 11088 - protein, 219 aa, Unknown
  Obtained from environmental sample
  DOMAIN (16)...(211): D-ala D-ala ligase C-terminus
  misc_feature (1)..(219): Xaa is any amino acid
MIPMINSYDAFALTEDKFHTSFVLRNNGVMTADYKLCHRDDTVELKKILRRWGKMIYKPTDGWGGVGLTKIENRASLDMLMPFLNQMDLRYFYVEKFIDYDNTDFRVDIVDGQFVGCYGRKASGTDWRTNITSGGSVFLREPNDEIIDIAIKASNACGTDIAGVDIIYDRTKEEYVVLEVNGIPAFATPEQEKLGLDFNDKKIDLIVDLIDRKTNKGEK

SEQ ID NO: 11089 - DNA, 954 bp, Unknown
  Obtained from environmental sample
  misc_feature (1)..(954): n is a, c, g, or t
atgggaggaagtattttaagagtacccagaccagacatttcagaagaaaactttaatagtaaaagtattaaagctgtccatcttaataaaaaagtagagagtcactatgagatagatcgtttttttgaaggtattagatatatttaccctctgtttttagaggataaatttttgggttcagtagaactctctatcgacatggagtcattgatgcatcanagatataaggggcttgacgctgcatatagtatgatagtgaaagctgatgcaataaagcttgtcatggatgatttatatcttaaaaatcactatcatgagacttgtcttggcagtgactactatatgcatacaaatattcataactcaaaagtgattaataaaagtattgcaaaatcgatctatcctgaattaaaatccaatcttccaaaagatagagcatttgctattaacagagtaacatctctattagagagtgagatatatctgtttcttcctacagttgataaaagtggtgagaatatgggttatatggtctctaaaagaatagagggtactgttaatgagatctatatagagcagtgtttaaagttacttagtgtgttaatagtattttatatatttacgcttttatataaaaaaaatctaaaatcgattgcacttttagatcaatataaaaatgtagttgatcagactactctactatcaaaaacagatcttagtggtaaaattacctatgtaaacagtgcatttgagaaactatcaggttattcaaatgaggagctgcttggaaaagcacactctatagtaaggcatgatgatatgccaagtgaatcatttgagaatttatggaaaacaataaaagctggaaatgtgtggcatggaaaagtaaaaaacagaaaaaaagatggtggttcgtatacggtggatgcaactatcttctcagccgaattctga

SEQ ID NO: 11090 - protein, 317 aa, Unknown
  Obtained from environmental sample
  DOMAIN (222)...(284): PAS domain
  misc_feature (1)..(317): Xaa is any amino acid
MGGSILRVPRPDISEENFNSKSIKAVHLNKKVESHYEIDRFFEGIRYIYPLFLEDKFLGSVELSIDMESLMHXRYKGLDAAYSMIVKADAIKLVMDDLYLKNHYHETCLGSDYYMHTNIHNSKVINKSIAKSIYPELKSNLPKDRAFAINRVTSLLESEIYLFLPTVDKSGENMGYMVSKRIEGTVNEIYIEQCLKLLSVLIVFYIFTLLYKKNLKSIALLDQYKNVVDQTTLLSKTDLSGKITYVNSAFEKLSGYSNEELLGKAHSIVRHDDMPSESFENLWKTIKAGNVWHGKVKNRKKDGGSYTVDATIFSAEF

SEQ ID NO: 11091 - DNA, 876 bp, Unknown
  Obtained from environmental sample
  misc_feature (1)..(876): n is a, c, g, or t
ttgatgttttccatagaaaacagagataagatagatttgattattacagatatcttgatgcctaatatgaatggtatagagatgattgatgagataagagatatggattctgatatccctgttatctattcaaccgctcttagtgatagtgaatatttaaaaaaaactattgaacaatcagttaccggatacataataaaaccaatagatatagaacttcttctcaaggctattgaaaaagcttctttaaaaatagaaaatgataaactcaaaatatttcttcaagaaatcaatcaagatttagaaaaaaaagtagaggaaaaaactcaagaactccgttctcaaaacaaagaactttactatcagcttcatacggatagactaacttctcttaaaaacagaaagtcacttctaagagacttagacaaaacaagtacaccaatcctctcaataatagatatagactcttttaaaagtataaatgatttatacggggagcatataggtaacttagtcttagatgctgtctctaaaaaattgaaacattttgttaaaagtacagagtgtgaattgtatagaataggtgctgaccaatttgccttaatgaaagatgctccaattgatataagggattgtgaagagactttagagtcagttatgagagagataaactcagaacctttaaacatagttgattatgacattgttataagagtaaatgtaacaataggtgtttctcatgaaaaaagtaatactctcgaaagtgctgatatggcacttaaaaaagcgaagacagaaagattgccatattttatctataccgagaactgtagtctagattcagagtataagaatgatgtaaaatggactagataa

SEQ ID NO: 11092 - protein, 291 aa, Unknown
  Obtained from environmental sample
  DOMAIN (2)...(86): Response regulator receiver domain
  misc_feature (1)..(291): Xaa is any amino acid
MMFSIENRDKIDLIITDILMPNMNGIEMIDEIRDMDSDIPVIYSTALSDSEYLKKTIEQSVTGYIIKPIDIELLLKAIEKASLKIENDKLKIFLQEINQDLEKKVEEKTQELRSQNKELYYQLHTDRLTSLKNRKSLLRDLDKTSTPILSIIDIDSFKSINDLYGEHIGNLVLDAVSKKLKHFVKSTECELYRIGADQFALMKDAPIDIRDCEETLESVMREINSEPLNIVDYDIVIRVNVTIGVSHEKSNTLESADMALKKAKTERLPYFIYTENCSLDSEYKNDVKWTR

SEQ ID NO: 11093 - DNA, 486 bp, Unknown
  Obtained from environmental sample
  misc_feature (1)..(486): n is a, c, g, or t
atggaagctgacagtctggaaaatttttcgactattcagatacaagaacttgatgaacttatacagaaatgtggaaacaatcagagcaatttaattcctttgttagaaaaagtacagttacttttgggctatattcccgtgtgtgtgcaagcaagaatctcagaaaagacaggaattcctgcaaaccaaatatatggtgtagtaactttctattcatttttttccatggaagcaaaagccaagcataggattcaagtttgtctcggaaccgcttgttacgtaaagggtggaaaagagatagcagaaaagatttctcatgatttgggtgtaaactttggtgaaagtacaaaagacggacttttcactcttgaaaaagcccgatgttttggttcctgtggccttgctcccgtagtagttgtcgatggcaaaatatacggaaaggtaacgcttaatagtgtagatgagattttggctcaatacaaataa

SEQ ID NO: 11094 - protein, 161 aa, Unknown
  Obtained from environmental sample
  DOMAIN (8)...(161): Respiratory-chain NADH dehydrogenase 24 Kd subunit
  misc_feature (1)..(161): Xaa is any amino acid
MEADSLENFSTIQIQELDELIQKCGNNQSNLIPLLEKVQLLLGYIPVCVQARISEKTGIPANQIYGVVTFYSFFSMEAKAKHRIQVCLGTACYVKGGKEIAEKISHDLGVNFGESTKDGLFTLEKARCFGSCGLAPVVVVDGKIYGKVTLNSVDEILAQYK

SEQ ID NO: 11095 - DNA, 615 bp, Unknown
  Obtained from environmental sample
  misc_feature (1)..(615): n is a, c, g, or t
atgaccaataagaaaaaatataaattctcaagtgactggattcataaactagaaaacgagaggcactggcaatactaccatgcacaacaagcattcttagagaatagaatatctaaagaagaatctttacttgaagtaggcattggcacatcgtttacttccaattacttaaaaagcaaacattacaatattcgaacgatggatattgacgcaaataaaaaaccggataccgttgcaaatattgtaactgataccattcccgggccagttgatgcattgctggcatttgaggtttttgagcatatcccctatcaggaattcctcatcagcatagacaaaatgaagaagcatgaaattaaaaaagtatttttaagcattccgtacaacgagaaagtctggtttgatattgatctgcgaatacatgttctcggacgattttggtttcaaattgctacgcgacgaaacagactaacaaccgatcatcaccaatgggaaatcaaatataaaaaacattcactaagaaaaattaaaaaggatatagaggaaagaggatataagattgttgcagaccaacgaaaattctcacaacgctttttctatttaccacttcaataa

SEQ ID NO: 11096 - protein, 204 aa, Unknown
  Obtained from environmental sample
  misc_feature (1)..(204): Xaa is any amino acid
MTNKKKYKFSSDWIHKLENERHWQYYHAQQAFLENRISKEESLLEVGIGTSFTSNYLKSKHYNIRTMDIDANKKPDTVANIVTDTIPGPVDALLAFEVFEHIPYQEFLISIDKMKKHEIKKVFLSIPYNEKVWFDIDLRIHVLGRFWFQIATRRNRLTTDHHQWEIKYKKHSLRKIKKDIEERGYKIVADQRKFSQRFFYLPLQ

SEQ ID NO: 11097 - DNA, 357 bp, Unknown
  Obtained from environmental sample
  misc_feature (1)..(357): n is a, c, g, or t
atgaaacagaaaaaaagaattattacaattgtaaacaagtattgggaatgtgatcctgtgtgttgggtgcttacaaataaatacattaacgataatggacagtgtgcaatagatttagatgtcgccaatactcaggatctaattacatacccgtcttatggatcggtaaagcctgaaaaagctgaggatactttgccacgtatagtgtatgagactgattcaagaattattgaagtttggtgtatttcggatttattaagcaatagttcgtcgaaagagcagtccagttctgaagaaaaaatggatttattgccaattatatataactataactataaaaatataaacgcgaaatag

SEQ ID NO: 11098 - protein, 118 aa, Unknown
  Obtained from environmental sample
  misc_feature (1)..(118): Xaa is any amino acid
MKQKKRIITIVNKYWECDPVCWVLTNKYINDNGQCAIDLDVANTQDLITYPSYGSVKPEKAEDTLPRIVYETDSRIIEVWCISDLLSNSSSKEQSSSEEKMDLLPIIYNYNYKNINAK

SEQ ID NO: 11099 - DNA, 378 bp, Unknown
  Obtained from environmental sample
  misc_feature (1)..(378): n is a, c, g, or t
atgacagatcggccgagagatgatggttttcttttcatcaaaggtagaagtaaaagtatgattcttggttcatcaggacaaaacatatatccagaagaaattgaattgaaaattaacaacattcactatgtacaagaatctgtagttatagaacaagacggcaaacttattgcacttgtttaccctgactatgaaacagttgatgccaaaggaggcgtgaactcaataaatgacgaagctataatagaagcatcaagaaaagaactgaacaaatcactgcctccatacagtcaaattacaaaagtaaaaatttggccagaagagtttcaaaagactccttcaagaaaaatcaaaagatacctatatcaagaaaaataa

SEQ ID NO: 11100 - protein, 125 aa, Unknown
  Obtained from environmental sample
  misc_feature (1)..(125): Xaa is any amino acid
MTDRPRDDGFLFIKGRSKSMILGSSGQNIYPEEIELKINNIHYVQESVVIEQDGKLIALVYPDYETVDAKGGVNSINDEAIIEASRKELNKSLPPYSQITKVKIWPEEFQKTPSRKIKRYLYQEK

SEQ ID NO: 11101 - DNA, 582 bp, Unknown
  Obtained from environmental sample
  misc_feature (1)..(582): n is a, c, g, or t
atgaaaaaaaatagttattttctatctatttatgcacatattggaccaatagaatctttatataaaattattagacgacatgatcaagcaatggcattatggcaaataatcgataataaacttactttagttagatattgggaatttgaacgcttgagtggcattaaagggcatggtcattcctttccaaatgtagaaaatgcaaaaaaattcattaccgatcttttaaatgaagagggattaaattttgaagagattgatgaaattgttggaacacctggcttagaaacctcacatggatcagataaaaagacaaaatattcacttacaaatcatagtctgtgtcatctgtatacaggattattcacagattcatcactattttataatgagaagatactctgtttggcattagatgcaggaccagatcacgtgcttgatttagatgtatggaaaaaagataaatatttagctgcttatgttgataaaggtttaatgaaaataatttccagtggaatcaccagctattttatggggcttttttacctgaattttatggtttacaaaaaggaatattatggg

SEQ ID NO: 11102 - protein, 194 aa, Unknown
  Obtained from environmental sample
  misc_feature (1)..(194): Xaa is any amino acid
MKKNSYFLSIYAHIGPIESLYKIIRRHDQAMALWQIIDNKLTLVRYWEFERLSGIKGHGHSFPNVENAKKFITDLLNEEGLNFEEIDEIVGTPGLETSHGSDKKTKYSLTNHSLCHLYTGLFTDSSLFYNEKILCLALDAGPDHVLDLDVWKKDKYLAAYVDKGLMKIISSGITSYFMGLFYLNFMVYKKEYYG

SEQ ID NO: 11103 - DNA, 636 bp, Unknown
  Obtained from environmental sample
  misc_feature (1)..(636): n is a, c, g, or t
atggcgcaaaatatagaaaatctcataacttcaagagaggagtttttaagagatatcagccatgaacttagaactcctatctctaaaggactttttgctgttgagacacttgaggattcgcaagctaaacgtcttattgaaaaatcattctccgagcttgaacgtctgagttcagagcttttagagatagaaaaattacatgccatgaacactttgcagagtgaaagttttaaagctgaaacactcattttagaatcactatcaagacttattttagaagatgaatctaaaattgagattgatatcaaagataattttttaattgtgggtgatctgaattatctctctcttgcacttaaaaatttgattgataacgctattaaatatacaaatgagtttcctgtatatatagtcgctgataaagataaaatagtagtaaaaaaccaaggtgaaaaacttctccatgatatttcatactattttgaagcatttacgcaagaggcgaattctagaggtgctaaagggtatgggcttgggttaaatattgttaaaaagattatggatatacatcaattcactctctcttacgattatgtagagggttatcatctctttacatttaattttaaaatatag

SEQ ID NO: 11104 - protein, 211 aa, Unknown
  Obtained from environmental sample
  DOMAIN (110)...(210): Histidine kinase-, DNA gyrase B-, and HSP90-like ATPase
  misc_feature (1)..(211): Xaa is any amino acid
MAQNIENLITSREEFLRDISHELRTPISKGLFAVETLEDSQAKRLIEKSFSELERLSSELLEIEKLHAMNTLQSESFKAETLILESLSRLILEDESKIEIDIKDNFLIVGDLNYLSLALKNLIDNAIKYTNEFPVYIVADKDKIVVKNQGEKLLHDISYYFEAFTQEANSRGAKGYGLGLNIVKKIMDIHQFTLSYDYVEGYHLFTFNFKI

SEQ ID NO: 11105 - DNA, 885 bp, Unknown
  Obtained from environmental sample
  misc_feature (1)..(885): n is a, c, g, or t
atgttttgtttaataggttatattacatttatagtttactatacaaaaacaaagatagacattcctcttaaaaactttcttgactctaatttacgtgagtttgtaaatggaatactcgcatcatatacagattgtactaagatgaaatctatagaaaatattatgcttccaagtggacttaaaaacagactcttagagacttttggaatgcttcaaaagtggtcatgttataaaatacattttgatgaatttttaagaatgacagttgctgaaagtgataaaaatcagttagtgaataatctttttatggctatcgaaaaagacttttttgtaaagaggttggttctgcttgaaattaatcatagtttaaatcgttttgaaccaattatgctgagttctgataatcataatcaggagtaccctgaaagcatattatctgatccttcaacatgtttgtcgtttagaacaggaaatcgagtttttttagacgatccagagaaatcgccatgtagtacatgcccagtagcaaagaatgaaacggttttatgtaaacctatgatgtcaagtggaaaacagacaggtgtcataaaatttacactcgataatgaaaaaatagagaaaaatggagatattaacagttcttctgagtcaaagattagatttttagagagctatttaacttcatatattgatcttacttcacttacgataagtaatattaatctgtttaatgcatataaaaatcaggctttgactgatccacttacaaacatttacaatagacgctacattactgaatatctatatggattgttaaatatatcaaaaagtaaagagtctccccttagtgttttaatgaaagatatggataattttaacgattaa

SEQ ID NO: 11106 - protein, 294 aa, Unknown
  Obtained from environmental sample
  misc_feature (1)..(294): Xaa is any amino acid
MFCLIGYITFIVYYTKTKIDIPLKNFLDSNLREFVNGILASYTDCTKMKSIENIMLPSGLKNRLLETFGMLQKWSCYKIHFDEFLRMTVAESDKNQLVNNLFMAIEKDFFVKRLVLLEINHSLNRFEPIMLSSDNHNQEYPESILSDPSTCLSFRTGNRVFLDDPEKSPCSTCPVAKNETVLCKPMMSSGKQTGVIKFTLDNEKIEKNGDINSSSESKIRFLESYLTSYIDLTSLTISNINLFNAYKNQALTDPLTNIYNRRYITEYLYGLLNISKSKESPLSVLMKDMDNFND

SEQ ID NO: 11107 - DNA, 435 bp, Unknown
  Obtained from environmental sample
  misc_feature (1)..(435): n is a, c, g, or t
atgactattcatgaacaactgcttgaaaaatggcaacaatgccgtgaaaaacgataccctgtgctgtttattatcaccgcaccgctggacacattgtttccccctgatcttgttaaaaattttgctgatgcatccggggcaaaaacgattaattttaaaaaccgatatcaaaacaggcttgaagagtttttcacttggcagacggtgcgtgatgaaatctatggcgaagcaaaaaaaacgccggtcattattactgagcttgaaccgctttatgccaagtggccgcaggaagaacgactctcttttgtaaaaaacctgctcagaagtgagcctgctcagggtatcgtcattatcatcaactgccaggaagatttaagtgaattaaataaaattaaggaaaacagcagggggcttatctgggctccttccaaatag

SEQ ID NO: 11108 - protein, 144 aa, Unknown
  Obtained from environmental sample
  misc_feature (1)..(144): Xaa is any amino acid
MTIHEQLLEKWQQCREKRYPVLFIITAPLDTLFPPDLVKNFADASGAKTINFKNRYQNRLEEFFTWQTVRDEIYGEAKKTPVIITELEPLYAKWPQEERLSFVKNLLRSEPAQGIVIIINCQEDLSELNKIKENSRGLIWAPSK

SEQ ID NO: 11109 - DNA, 831 bp, Unknown
  Obtained from environmental sample
  misc_feature (1)..(831): n is a, c, g, or t
atgaacagaatcaaatgggaacatgacggaagcttttcatatagaagaagttgtagacatggtatttgtggaagttgtgcaattaaagtaaaccaaaaaccaactcttgcatgtaaagacaatgtatttgaacttgtagaggtatttggtgaagagttaacaatcgaaccacaagatatcaaaagagcctataaagatatggttatagataaagaaaacttctggcaaaaatatgatgcagtaaaaccttttgttgtaacagatatagatgagttcccaacacaagaaaatattgttactcaacaacaagctgaactaatagatgaagctgattattgtatcgcttgtggtaactgtttttatgcctgtcctgcagttgaagtaaatagtgaatatctaggaccaatggcacttacaaaagcatggcgatttaatgctgatgtaagagacaatgcgcaacatgaaaggctagacactcttcaaaaattagggagcggtatttgggattgtgtaaaatgtaacgaatgtgctgaagcgtgtccaaaagagttagacccaatagggaaaattacaaaactacacttacaaacattccaagaggaaaaatctcttgataatgtagcagtaagacatgctgttggatttaaatggtctattaaaaaacacggtattttagatgagggtgaacttgtaagatatagtgaaggtaatattggtgttatgaaacatatccctgaagcaatcgctatgtttgcaaaaggaaaaatagtaatgccttggaatatgccaaaatctaaaaatttagatgaaataaaaaacttgttgagatag

SEQ ID NO: 11110 - protein, 276 aa, Unknown
  Obtained from environmental sample
  misc_feature (1)..(276): Xaa is any amino acid
MNRIKWEHDGSFSYRRSCRHGICGSCAIKVNQKPTLACKDNVFELVEVFGEELTIEPQDIKRAYKDMVIDKENFWQKYDAVKPFVVTDIDEFPTQENIVTQQQAELIDEADYCIACGNCFYACPAVEVNSEYLGPMALTKAWRFNADVRDNAQHERLDTLQKLGSGIWDCVKCNECAEACPKELDPIGKITKLHLQTFQEEKSLDNVAVRHAVGFKWSIKKHGILDEGELVRYSEGNIGVMKHIPEAIAMFAKGKIVMPWNMPKSKNLDEIKNLLR

SEQ ID NO: 11111 - DNA, 765 bp, Unknown
  Obtained from environmental sample
  misc_feature (1)..(765): n is a, c, g, or t
atgaacaatacattagataaaaaggtggaaaattctcgaattaatttcgcctcaaccaaaaaccaattagaatatccagatttcttagatattcaaatcaaatcatttcaatcttattttcaattagatactactcctgaaaatagagcttcagaaggattgtttaaagttttcagtgaaaactttccaattacagatgctcgtaatcagtttgtattagaatttttggattactttattgatccaccaagatacgctattgaagaatgtattgaaagaggtttaacttacagtgtgcctttaaaagcaaaacttaaattgtattgtacagatcccgaacacgaggattttgaaactattgtacaggatgtatatttgggaactatcccttatatgactcctaaaggaacttttgtgattaacggtgctgaaagagttatcgtatcacagctacaccgttcaccaggtgttttctttggtcaaagtaaacacgctaacggtacaaaattatattcagcaagaattatcccttttagaggttcttggatagaatttgctactgacatcaataatgtaatgtatgcttacatcgatcgtaagaaaaaattaccagtaacaaccctttttagagctataggctttgaaacagataaagaaattttagaactttttgatttagcagatgaagttaaagtaagcaaatctggattgaaaaaagttatcggtagaaaattagctgctcgtgtacttaaaaccatgggttga

SEQ ID NO: 11112 - protein, 254 aa, Unknown
  Obtained from environmental sample
  misc_feature (1)..(254): Xaa is any amino acid
MNNTLDKKVENSRINFASTKNQLEYPDFLDIQIKSFQSYFQLDTTPENRASEGLFKVFSENFPITDARNQFVLEFLDYFIDPPRYAIEECIERGLTYSVPLKAKLKLYCTDPEHEDFETIVQDVYLGTIPYMTPKGTFVINGAERVIVSQLHRSPGVFFGQSKHANGTKLYSARIIPFRGSWIEFATDINNVMYAYIDRKKKLPVTTLFRAIGFETDKEILELFDLADEVKVSKSGLKKVIGRKLAARVLKTMG

SEQ ID NO: 11113 - DNA, 543 bp, Unknown
  Obtained from environmental sample
  misc_feature (1)..(543): n is a, c, g, or t
atgaatataaataaaaaatttaatatatctatcgtaggtatatctatagttacactttcaataggcttttttattttacatggatatgctaaacaagctgaaaaagagacctatttacagataaagaactctttaaaaatctctgcgattagtaaaattaatgagaagaaagtcgttggtttaacaaatgcaattggaatagcaaatgatactaaaattaaaaaagcacttagacttagtcaaagacaattagctattataagtctaaaaaatgtatccgactcttataaaaaaaatacaccattcaaaaatataaaaattcatattcataaaaaagacaatacatcttatgtaagaagttggaaattagattcgcatgatgatgacttaagttcatttagatcaagtgttgttaaagcaaataaaactgaacaagcaattacaacttttgaagttggtaaagctggcttaggtttgagagcagttgttccaaataatgataatggtacacatttaggctctttggaatcatacaaggtataa

SEQ ID NO: 11114 - protein, 180 aa, Unknown
  Obtained from environmental sample
  misc_feature (1)..(180): Xaa is any amino acid
MNINKKFNISIVGISIVTLSIGFFILHGYAKQAEKETYLQIKNSLKISAISKINEKKVVGLTNAIGIANDTKIKKALRLSQRQLAIISLKNVSDSYKKNTPFKNIKIHIHKKDNTSYVRSWKLDSHDDDLSSFRSSVVKANKTEQAITTFEVGKAGLGLRAVVPNNDNGTHLGSLESYKV

SEQ ID NO: 11115 - DNA, 465 bp, Unknown
  Obtained from environmental sample
  misc_feature (1)..(465): n is a, c, g, or t
ttgtattatggttttggaaaagatcaaacacaacacattgtttttgaaggactaacacctttagaacagaaaagtcctttttttgactatttaccttcttctttgatttggttagatgctttttattatgatcaagaaaaaaagttaataggattttataaaaaatttaattcaatagatgcaaaatatttgttatggctagacagcattgaattgcaacatcttggtttgactcttgacaattataataacggtctaagagctttaaatcataaaaatgaggtagtattaaaattcagatgttggaaagaggaacctttagacaattcaacttcttttataaatataaactcaaatatttcaaagctagagggatgcgagttattattaagaaaagattacttggatatgttaaaagttttagtttctaacttaaaatatacaattaaaaagattatcatttaa

SEQ ID NO: 11116 - protein, 154 aa, Unknown
  Obtained from environmental sample
  misc_feature (1)..(154): Xaa is any amino acid
MYYGFGKDQTQHIVFEGLTPLEQKSPFFDYLPSSLIWLDAFYYDQEKKLIGFYKKFNSIDAKYLLWLDSIELQHLGLTLDNYNNGLRALNHKNEVVLKFRCWKEEPLDNSTSFININSNISKLEGCELLLRKDYLDMLKVLVSNLKYTIKKIII

SEQ ID NO: 11117 - DNA, 321 bp, Unknown
  Obtained from environmental sample
  misc_feature (1)..(321): n is a, c, g, or t
atggattttgtaacatcaacattaataggtggaatgatttatgatgtatttaaaaaaggtgtattctcatcttatgaaatttctaaaaaagtactatctaattttactcaagatgaaaacttatataaaaaattagaaaagatattggatcatgagggaattaatgttaattcaacattggaagatattgttagaaaactagaatctaatcaacaaacaataactataattaacaacattcaaaatattcaaaatatacatggtcataataatacaattaaatattactatgaaaataagaaaaagaaaattttatattag

SEQ ID NO: 11118 - protein, 106 aa, Unknown
  Obtained from environmental sample
  misc_feature (1)..(106): Xaa is any amino acid
MDFVTSTLIGGMIYDVFKKGVFSSYEISKKVLSNFTQDENLYKKLEKILDHEGINVNSTLEDIVRKLESNQQTITIINNIQNIQNIHGHNNTIKYYYENKKKKILY

SEQ ID NO: 11119 - DNA, 834 bp, Unknown
  Obtained from environmental sample
  misc_feature (1)..(834): n is a, c, g, or t
gtgaatcataaaaatagagagattttaggtgatgaagaagagtatgcagaaggcgaatatcctttagaagatgaaaagattgaagaagaagttgatgataataatattaaagtagctattataggtagagttaatgttggtaaatcatcaattctaaatgccttaataggagaagaaagatcagtagtctctccaatagcaggaacaacaatagaccctgttgatgaatcatttgagtataaagataaaaatattacttttgttgatacagctggattaagaagaagaggaagtattgagggaattgaaaaatttgctttaatgagaacaaaagagatgcttcaaaaggcaaatcttgctttagttgttttagatgcttcttctgaacttgttgatttagatgagaaaattgctggattagttgatgagtatggattaggtacaattattgttttaaacaaatgggatgaaaatatggataccttccaaaagatacaagagacaattagaagtaaatttaagtttttatattatgctccaataatcgcagtatctgcaaagactggtagaagtatagataagctaaaagacaaactaattgaaattcataaaaactatggtcaaagaatttctacctctgaattaaatagaataattgaacatgctttaataagaactgcacttcctagtccaaatggggcatatttaaaaatatactataccacgcaatttgaaacaaaacctcccagaatgaggcnttttntnnatnaacccactttttttcccctccccccctcncacatttttactccaatttttaacaaaaaattttaa

SEQ ID NO: 11120 - protein, 277 aa, Unknown
  Obtained from environmental sample
  DOMAIN (33)...(211): Elongation factor Tu GTP binding domain
  misc_feature (1)..(277): Xaa is any amino acid
MNHKNREILGDEEEYAEGEYPLEDEKIEEEVDDNNIKVAIIGRVNVGKSSILNALIGEERSVVSPIAGTTIDPVDESFEYKDKNITFVDTAGLRRRGSIEGIEKFALMRTKEMLQKANLALVVLDASSELVDLDEKIAGLVDEYGLGTIIVLNKWDENMDTFQKIQETIRSKFKFLYYAPIIAVSAKTGRSIDKLKDKLIEIHKNYGQRISTSELNRIIEHALIRTALPSPNGAYLKIYYTTQFETKPPRMRXFXXXPTFFPLPPSHIFTPIFNKKF

SEQ ID NO: 11121 - DNA, 321 bp, Unknown
  Obtained from environmental sample
  misc_feature (1)..(321): n is a, c, g, or t
atgaataatattattttattatcaaatgtaaaacatgagggtgttattagtctgcctgtatttgatattgagtatttagatataaaaattgatttagaaaaatatgattcattaattttcacttcaaaaaatgctatttatgcccttgataaattaaatattccttgggaaaatttagattcatacgcaattgcagaaaaaacttcagatattttaaaaaagtataactcaaaagtagtttttaccggtactcactcacatggtaatgagtttgcttatgagttaattcctttattaaaaaataaaaaagtttttatgtaa

SEQ ID NO: 11122 - protein, 106 aa, Unknown
  Obtained from environmental sample
  misc_feature (1)..(106): Xaa is any amino acid
MNNIILLSNVKHEGVISLPVFDIEYLDIKIDLEKYDSLIFTSKNAIYALDKLNIPWENLDSYAIAEKTSDILKKYNSKVVFTGTHSHGNEFAYELIPLLKNKKVFM

SEQ ID NO: 11123 - DNA, 501 bp, Unknown
  Obtained from environmental sample
  misc_feature (1)..(501): n is a, c, g, or t
atgattacagtattacttttaactgtatttgtagaccttataatggctgtgggtgcaggtattacatttgctgcaatatctgctgtttataaaatatctaaacagacaaaaatacaaacaataaaatcttttaaagatagtccttttgatatagatatagataattatgatataagaatattaaaaattgatggagcatttttctttggaagtgctatgttactagagcaaagaattaaaaaagttttaagagcaaaacatattataattgattgtagaaatataccttttttagatatttctgcaattatcactattgaagagaccataaatttactaaatgagtatggaataaatgtttcacttgttgtaaaagagagagatagaagaagacttgttaaaattgaagatagtgaactattcaaaagtattaaaatttataaagatatagatttagcaataaatgaaatacaaaaagagaagttgcaaataaatgaataa

SEQ ID NO: 11124 - protein, 166 aa, Unknown
  Obtained from environmental sample
  DOMAIN (49)...(153): STAS domain
  misc_feature (1)..(166): Xaa is any amino acid
MITVLLLTVFVDLIMAVGAGITFAAISAVYKISKQTKIQTIKSFKDSPFDIDIDNYDIRILKIDGAFFFGSAMLLEQRIKKVLRAKHIIIDCRNIPFLDISAIITIEETINLLNEYGINVSLVVKERDRRRLVKIEDSELFKSIKIYKDIDLAINEIQKEKLQINE

SEQ ID NO: 11125 - DNA, 759 bp, Unknown
  Obtained from environmental sample
  misc_feature (1)..(759): n is a, c, g, or t
atgggcttccctggatatttcttaatagtccaagattttctgaatgcagcacgcgaaatggatgtcgctgttggtcctgggcgaggatccgctgcaggatcagttgttgcatattgtaaccgtataactgatattgatcctcttaaatacaatctactgtttgagagatttcttaatcccgatcgaatatcaatgcccgatattgatatagattttgatgatgatggcagagataaagttattaaatgggttgttaacaaatatggagaaaaacgagtagcacagattattacgtttggaacaatggccgcaaaaatggccatacgcgatgttgcccgtgtagaaaaactaccattaagtgaagccgaccgattatcgaaattagttcctgaaagaccaggtatttctttgaaagaagcatttaaagaagttccagaacttaaagcagcgaaaaattctgaaaatccactaatagtaaaaacattaaaatttgcagaaactctggaaggctcagtgcgacatacaggactgcatgcctgtggaattattattgggcgcgacgatttatttgaacatattccgatttgtacttcaaaagattctgaactttatgtaactcaatttgacggaagtcatgttgaatctggtggaatgctaaaaatggacttcctgggacttaaaacattgtcgaataaaaaagatgccggtgaaaatgtaaaagaatcccttgggtaccgaaatagaatattgccaatgtag

SEQ ID NO: 11126 - protein, 252 aa, Unknown
  Obtained from environmental sample
  misc_feature (1)..(252): Xaa is any amino acid
MGFPGYFLIVQDFLNAAREMDVAVGPGRGSAAGSVVAYCNRITDIDPLKYNLLFERFLNPDRISMPDIDIDFDDDGRDKVIKWVVNKYGEKRVAQIITFGTMAAKMAIRDVARVEKLPLSEADRLSKLVPERPGISLKEAFKEVPELKAAKNSENPLIVKTLKFAETLEGSVRHTGLHACGIIIGRDDLFEHIPICTSKDSELYVTQFDGSHVESGGMLKMDFLGLKTLSNKKDAGENVKESLGYRNRILPM

SEQ ID NO: 11127 - DNA, 351 bp, Unknown
  Obtained from environmental sample
  misc_feature (1)..(351): n is a, c, g, or t
atgaaagcattgaaaagattaaaattcgctggggcattaatgttctttcttggattgggattgattaaccaagtttctgcacagacaaccacttggcagtttgatggcggagatggtaaaggagcaattaaagttattgaaaaaagcgatggcatatcttcagtatatcttctattaacagacggaacatggggaaaggctattatcaatagcatagatgattacgaagatacttatatgagaattacatttaactctgaagtgtctgaaatctatgtttattggtacgatgataagttagtgcagatatgggcaaacggaaaagagaaagcctattggttaaaaaagtaa

SEQ ID NO: 11128 - protein, 116 aa, Unknown
  Obtained from environmental sample
  misc_feature (1)..(116): Xaa is any amino acid
MKALKRLKFAGALMFFLGLGLINQVSAQTTTWQFDGGDGKGAIKVIEKSDGISSVYLLLTDGTWGKAIINSIDDYEDTYMRITFNSEVSEIYVYWYDDKLVQIWANGKEKAYWLKK

SEQ ID NO: 11129 - DNA, 363 bp, Unknown
  Obtained from environmental sample
  misc_feature (1)..(363): n is a, c, g, or t
ttgttgccaatgagtgcaattggattaatggacaaagaattgaaatatcagggggagtattgttatatcacgaaaaaagaattaaaacacttaatctctttagttcaaacgcacgaaataaaagatggtgtaaatgatacaaatatcccatctttgaaaatttttaaatcatcacatctaactcaacattgtttaccaccagtgtatgagccatcattgatttttattctacaaggttcaaagcttgtaatagtaggtaataaaacacttgagtatgactcctcatcatatttaatttcatcttcttttatgcctgtatcagggagaaataactcaacgctaatgaagaagaaccctatatag

SEQ ID NO: 11130 - protein, 120 aa, Unknown
  Obtained from environmental sample
  DOMAIN (47)...(117): AraC-type transcriptional regulator N-terminus
  misc_feature (1)..(120): Xaa is any amino acid
MLPMSAIGLMDKELKYQGEYCYITKKELKHLISLVQTHEIKDGVNDTNIPSLKIFKSSHLTQHCLPPVYEPSLIFILQGSKLVIVGNKTLEYDSSSYLISSSFMPVSGRNNSTLMKKNPI

SEQ ID NO: 11131 - DNA, 708 bp, Unknown
  Obtained from environmental sample
  misc_feature (1)..(708): n is a, c, g, or t
gtggatagtatagaacttttcccggccagcgagggatttttcgcctaccaaaattcgcaaaaggaacaaggaatgcttttgttgttgaattcaggcatcttttatgagtttgtgaaggccgatgaattctttgtagaaagtcccaaaagaattacattaaaggatgttaagttgggagtaaattatgtaatgatcatctctacgaatgctggtctttggggctataatctaggggataccgttcagtttatttcgataaaaccctataaaattctggtttccggaagaataaaacatttcatttcggcttttggagagcatgtgataggcaaggaggttgaagaggcgatgaaacaagctatagaaggcacggatgccagaatcaacgaatttacggttgccccccaaatcaatcccgaaaaaaaagaacttccgtatcatgaatggctgattgaatttgaacatccaccctcggacattaaaaaattcatcagtatattggataccaccttacaaaaacaaaacagttattattttgatttaattgaaggaaaaattcttcaaaccctcaaaataaccgagataaaaaacgacggatttccggaatatatgaagtccattggaaaattagggggtcagaacaaagtccaacccctatcccatgaaagaaaagtgcccgatgctttaagaattggcttcagtaaataa

SEQ ID NO: 11132 - protein, 235 aa, Unknown
  Obtained from environmental sample
  misc_feature (1)..(235): Xaa is any amino acid
MDSIELFPASEGFFAYQNSQKEQGMLLLLNSGIFYEFVKADEFFVESPKRITLKDVKLGVNYVMIISTNAGLWGYNLGDTVQFISIKPYKILVSGRIKHFISAFGEHVIGKEVEEAMKQAIEGTDARINEFTVAPQINPEKKELPYHEWLIEFEHPPSDIKKFISILDTTLQKQNSYYFDLIEGKILQTLKITEIKNDGFPEYMKSIGKLGGQNKVQPLSHERKVPDALRIGFSK

SEQ ID NO: 11133 - DNA, 513 bp, Unknown
  Obtained from environmental sample
  misc_feature (1)..(513): n is a, c, g, or t
atgccttcaggcaatatatataaatatatgcttggtcattatgatatatatattcctagtgtaatgtttaaaagagattttatattagaaaaaaaaatattatttaatgttgaatatgatttaattgaagaattcgatttttttctcaagatattaaaagacacaaaagcattatatattaatgaatgtcttgcaaattggcgagttcatgaagaaagtaatacatggaaaaaatatcatttattttcaatagaaagagaacattttttaaataatcttaatttaacaagtgatgatgaaaaaaaatttaaatatgaaattcaacaaataaaaaatttaaatttatttcaagaaagtatttttaaatggagaaataacaacaattacacagcaagaaaaactattttgccaattatattttcacgtttaaagtatttttttgtatttttattaatgtttttcccatacaagtatataaaacatctaatttctttttataaaaaacttccataa

SEQ ID NO: 11134 - protein, 170 aa, Unknown
  Obtained from environmental sample
  misc_feature (1)..(170): Xaa is any amino acid
MPSGNIYKYMLGHYDIYIPSVMFKRDFILEKKILFNVEYDLIEEFDFFLKILKDTKALYINECLANWRVHEESNTWKKYHLFSIEREHFLNNLNLTSDDEKKFKYEIQQIKNLNLFQESIFKWRNNNNYTARKTILPIIFSRLKYFFVFLLMFFPYKYIKHLISFYKKLP

SEQ ID NO: 11135 - DNA, 885 bp, Unknown
  Obtained from environmental sample
  misc_feature (1)..(885): n is a, c, g, or t
atgtttacatcgtttcttatattatgctatagcgcattttggttaaccgaaattattattcctactcgtagcgacattattatattaattgcaagtaattatttagtggtgatttttgcagttgtaattcactttattagagagtcatacaaccgattaatagagaaaaaagaacttgaaaagcagcagataattaccgaaggtaaactaaacgaaatacatctgaaactacttcaaagtcagttgcatcctcattttttgtttaatatgcttaataatatttttgggctggttaagcaaaagccaaatattgcacgcgaagttattattaggttatcggatttattggaatatatgctttacaaatgtgattcgaaagaggtactgctctccaacgaagttgcatttatcgaaaattatattgcccttgagcaaattagaaataatgaaaactttgatgtaaaattcacacatactgaatgcttcggcgatataaaaatagctccgttgctactatttacattcattgaaaatgcctttaagcacggtaaaataaaaaatggcggtgttgaaatagatattaacctccaaataaaaacagatgtacttttatttgaagtgacaaacagtttttcgacaccatgtaacgacgtatacttgaatagtaaacatagtggaattggattaaaaaacattcacgaacgtcttaaaattctntatggaaatacccacacaatgactaccgaaaaagacgaacaacgattttatactacacttaaaaattccgtttacatgaccaaagagagaatatacaaatgtgtaataattgacgatgaacctatagcccatgaatgttggtgccagaacattttaaaaccagtttaa

SEQ ID NO: 11136 - protein, 294 aa, Unknown
  Obtained from environmental sample
  DOMAIN (74)...(157): Histidine kinase
  misc_feature (1)..(294): Xaa is any amino acid
MFTSFLILCYSAFWLTEIIIPTRSDIIILIASNYLVVIFAVVIHFIRESYNRLIEKKELEKQQIITEGKLNEIHLKLLQSQLHPHFLFNMLNNIFGLVKQKPNIAREVIIRLSDLLEYMLYKCDSKEVLLSNEVAFIENYIALEQIRNNENFDVKFTHTECFGDIKIAPLLLFTFIENAFKHGKIKNGGVEIDINLQIKTDVLLFEVTNSFSTPCNDVYLNSKHSGIGLKNIHERLKILYGNTHTMTTEKDEQRFYTTLKNSVYMTKERIYKCVIIDDEPIAHECWCQNILKPV

SEQ ID NO: 11137 - DNA, 480 bp, Unknown
  Obtained from environmental sample
  misc_feature (1)..(480): n is a, c, g, or t
ttgatttatagtgcaaagtcaatacttttttcaattccaaagagagttaaagtgtttgatagtagcaataacgagaaaattactttgataaaggctattacgttgattcatcctaagtttgacattatcttttctggagggacccacctttcactggaaggtaaatcttggatttatgactatttcaaactaagagttccagaaggttcatttgaaattcatcaccaacggagattaaaattagccatatttttaaacaatgaacaagtcgccgagatggtgaaaaatagagttgcagtatttggcggagatgaatataaaattcaagcgaattctgatattaatagagaattgctgattgggatatgtttagcatgggacttaaatgattttgataatgggaactctgtctcaattggtataggaaatattgggcctgtaaaaaagaaggctgagaaggattggataccgacaagataa

SEQ ID NO: 11138 - protein, 159 aa, Unknown
  Obtained from environmental sample
  misc_feature (1)..(159): Xaa is any amino acid
MIYSAKSILFSIPKRVKVFDSSNNEKITLIKAITLIHPKFDIIFSGGTHLSLEGKSWIYDYFKLRVPEGSFEIHHQRRLKLAIFLNNEQVAEMVKNRVAVFGGDEYKIQANSDINRELLIGICLAWDLNDFDNGNSVSIGIGNIGPVKKKAEKDWIPTR

SEQ ID NO: 11139 - DNA, 816 bp, Unknown
  Obtained from environmental sample
  misc_feature (1)..(816): n is a, c, g, or t
atggacatttacttccatatagtggcaaaaaaaaggttcatcctcgcttttaatacacagcgtaaaatggtgatgccgggacaaacgaacatggttgcgtgcgatataacgggtcgtattgttgattttcaaattcaagaaggaacgggtgaccttaaagctcatattgttcatctgaaacaaaaatgggatgaagatctcacagaacctcctatcatggtctttgatcgagaaggttatggggcacaatttttcagcaatcttattgacaataagattccctttgtgacttgggaaaagcatgtagatttaaaaaaactcaatgctttagaggatagcaaatttaacgaatcttttgagatgaataataaaaactattccatatttgagggagagaaaacgtttactctcaagcaagatgacaagacaacacagacattaactctccggagaatttatctttggaataagaccagcaaacgtcgaacctgtggacttgcatgggatgctggtagatctatgagtactattgaatgtgcacaagctatattgagccgctggggtgcatctgaaaacacatttaaacatctttatgacaggcatccctttcattatcatccaggttttactaccgtggagagtgaaaagcagcttatagtaaatcctgaagtcaagtcaattgacaaagaaattaaggtattacgcacaaagcttgataaactttataaaaagtgtgcaaaagccaaggatgcccttaacaaagatggctcaaaacccgagaaacagttaaaaagctcgtttgggaatcagaaataa

SEQ ID NO: 11140 - protein, 271 aa, Unknown
  Obtained from environmental sample
  misc_feature (1)..(271): Xaa is any amino acid
MDIYFHIVAKKRFILAFNTQRKMVMPGQTNMVACDITGRIVDFQIQEGTGDLKAHIVHLKQKWDEDLTEPPIMVFDREGYGAQFFSNLIDNKIPFVTWEKHVDLKKLNALEDSKFNESFEMNNKNYSIFEGEKTFTLKQDDKTTQTLTLRRIYLWNKTSKRRTCGLAWDAGRSMSTIECAQAILSRWGASENTFKHLYDRHPFHYHPGFTTVESEKQLIVNPEVKSIDKEIKVLRTKLDKLYKKCAKAKDALNKDGSKPEKQLKSSFGNQK

SEQ ID NO: 11141 - DNA, 345 bp, Unknown
  Obtained from environmental sample
  misc_feature (1)..(345): n is a, c, g, or t
atggttctaaaagttactataaaacttgattatgaaaagctatttgatttagatagtcctgaatatgctaaattatttaatgaatttttagaaagcattaaagatgaaattattaaaaagaaaaaaattttaggacaggatattacaggtgctattttaaatttaattttaaaaaaatcaagttttgaatttgtcaaacaaagaactttcgttaaatttacaaaagaaagaaaagcaaaaatgagaacattagttccaaatgtttgtatactgacagttaagaatcccgaaaaaaacattattaaagattcaattaccacgataattaaaaaaaacatacgatga

SEQ ID NO: 11142 - protein, 114 aa, Unknown
  Obtained from environmental sample
  misc_feature (1)..(114): Xaa is any amino acid
MVLKVTIKLDYEKLFDLDSPEYAKLFNEFLESIKDEIIKKKKILGQDITGAILNLILKKSSFEFVKQRTFVKFTKERKAKMRTLVPNVCILTVKNPEKNIIKDSITTIIKKNIR

SEQ ID NO: 11143 - DNA, 744 bp, Unknown
  Obtained from environmental sample
  misc_feature (1)..(744): n is a, c, g, or t
ttggaagaaaataaaaaagtaactaaaagtggtgagtttcaaactgatccacttttaattgctacgaaatttattttggatttttattatggagatatatccttagaaactattgcaagttttacccctaaaaacgaaaatggctttgatgaatcgtgtgttatagaggtagtttcaaatttagggctaaatgcacttaaaagagagatagacgggtttgaaatacctgattatttcctcccttgtatcatttttgataagtttaaccatccaatggtatatttaaaaagaaatggaaatacagtttatctatttgacccatttgaaaaaactgaaaaaactattgaaaaagcagtacttaaagaatatacaagtgctatagtggtatttagagaatcacaaaaaaaagaccatatagataaagataaaaaaaagtcgtggttttttgaacctgtaaagtctttttggcgatcttatattgaaataggaattttaactttttttattaatatatttgcgctggcagtccctttatttactatgagtgtttatgatagggtagtaccaaatagtgcttttgagactttatttgttttgagtattggtgtggttattatcctcttatttgatttggcatttaaaagtgtgcgaaactatattatagaaaaaacagggaaaaagcttggacttcatcttgaagaggagcttatgaaaagaagttttacttatacaagttcaatatga

SEQ ID NO: 11144 - protein, 247 aa, Unknown
  Obtained from environmental sample
  DOMAIN (14)...(136): Peptidase C39 family
  misc_feature (1)..(247): Xaa is any amino acid
MEENKKVTKSGEFQTDPLLIATKFILDFYYGDISLETIASFTPKNENGFDESCVIEVVSNLGLNALKREIDGFEIPDYFLPCIIFDKFNHPMVYLKRNGNTVYLFDPFEKTEKTIEKAVLKEYTSAIVVFRESQKKDHIDKDKKKSWFFEPVKSFWRSYIEIGILTFFINIFALAVPLFTMSVYDRVVPNSAFETLFVLSIGVVIILLFDLAFKSVRNYIIEKTGKKLGLHLEEELMKRSFTYTSSI

SEQ ID NO: 11145 - DNA, 738 bp, Unknown
  Obtained from environmental sample
  misc_feature (1)..(738): n is a, c, g, or t
atgtatgcaagatttttgcctcaacttaaaaaacttggttgtaaattagcagttgaatgtagagatgaattaaaaacactttttgagtcaatagagtgtttagatatagttgtaggaagggaagagaataaaactccaccttttgattttcatctacctattatgagtttaccgtatattttagatgtgaaaagttttgatgattttcctacaagaccatattttaaagtccaaaaagatgaacagtttaatctaaaagatgacaaaatcaaaataggactttgttggtcagcatctgcaacaggtgagagttatgatggaaaagtatttgatttaatcaattttgccccacttattaaaaactctaaaatacaaatatattcactacaagttggacatgggagtgaacaaatcaaagaaaatggctatgaaaatgatataatagatttaactcataagttaacagatttttcaaaaactgcatcattgatgaaagaactcgatttggtaataagttctgatacaagtgttgcacatctagctggagctattggagtaaaaacatatacacttcttcaaaaatatccagactggagatggttaaacaaaggagaagaatcctacttatatccatctatgaaactctttagacaaaaacaaaatagaaattggaaatctgtttttcaatcactatttgctaaaatgaataaagaatataaactaaaattaaaaatataa

SEQ ID NO: 11146 - protein, 245 aa, Unknown
  Obtained from environmental sample
  misc_feature (1)..(245): Xaa is any amino acid
MYARFLPQLKKLGCKLAVECRDELKTLFESIECLDIVVGREENKTPPFDFHLPIMSLPYILDVKSFDDFPTRPYFKVQKDEQFNLKDDKIKIGLCWSASATGESYDGKVFDLINFAPLIKNSKIQIYSLQVGHGSEQIKENGYENDIIDLTHKLTDFSKTASLMKELDLVISSDTSVAHLAGAIGVKTYTLLQKYPDWRWLNKGEESYLYPSMKLFRQKQNRNWKSVFQSLFAKMNKEYKLKLKI

SEQ ID NO: 11147 - DNA, 771 bp, Unknown
  Obtained from environmental sample
  misc_feature (1)..(771): n is a, c, g, or t
gtgatgaatagcaaaagtgcctgtccactagactgttttgatagttgcgttatagagtacagagagggtgtaataaaagcagataaaagtgatacatatactgcaggttacttgtgcccttttatgaatcattatgaaaaatatgagagaattgaaaagccaagctataacggtattgaaatcagcatggatgaagctttagaaatattggcaaatatcttaagaaaaacagatccgttgaaaactctctactttaaaggtaatgcgaacatgggagttatgcaaaatgtgacttcacatctatttgcttcattaggaactgtaaaagcagacggttcaatctgctctggtgcaggagatgccggtattgaagagggacgaggtgtaaatcttccactaacacttgagcagatagcaaatagtgaggtagttgtattatggggaagaaatccgcatacaagtaattcacatcttcttcccattattaaaggtaaaaagcttatagtgattgatcctataaaaatagatgctgttaagagtgctgatttgcatattcaactaaagcctcatggagatctatttttagctcttttaattgctagatttgtaattattgagggagcagaagataaagagtttttggataaatattgtgaagatcatgaagatttttatgagcttacacaatcacttagaattaaaaaaactgtagaagagataggtataacactgggggcaattggtgaatttatgtcacacgtaaaaaaataa

SEQ ID NO: 11148 - protein, 256 aa, Unknown
  Obtained from environmental sample
  misc_feature (1)..(256): Xaa is any amino acid
MMNSKSACPLDCFDSCVIEYREGVIKADKSDTYTAGYLCPFMNHYEKYERIEKPSYNGIEISMDEALEILANILRKTDPLKTLYFKGNANMGVMQNVTSHLFASLGTVKADGSICSGAGDAGIEEGRGVNLPLTLEQIANSEVVVLWGRNPHTSNSHLLPIIKGKKLIVIDPIKIDAVKSADLHIQLKPHGDLFLALLIARFVIIEGAEDKEFLDKYCEDHEDFYELTQSLRIKKTVEEIGITLGAIGEFMSHVKK

SEQ ID NO: 11149 - DNA, 876 bp, Unknown
  Obtained from environmental sample
  misc_feature (1)..(876): n is a, c, g, or t
atggaagttatgcaaaatgtgacttcacatctatttgctccattaggaactgtaaaagcagacggttcaatctgctctggtgcaggagaggccggtattgaagagggacgaggtgtaaatcttccactaacacttgagcagatagcaaatagtgaggtagttgtattatggggaagaaatccgcatacaagtaattcacatcttcttcccattattaaaggtaaaaagcttatagtgattgatcctataaaaatagatgctgttaagagtgctgatttgcatattcaactaaagcctcatggagatctatttttagctcttttaattgctagatttgtaattattgagggagcagaagataaagagtttttggataaatattgtgaagatcatgaagatttttatgagcttacacaatcacttagaattaaaaaaactgtagaagagataggtataacactggggcaaattggtgaatttatgtcacacgtaaaaaataaaaaaacagtttttttggtaggaacaggagtacagcgttatcgaaatggttcagagataatacgttccattgattctcttgcggctgttttaggattatttggaaaaagcggctgtggtgtaggttttttatctgattcaacttatggtgttgagatgccctttaagaagtttaaaaaaagctcacctaaagcaacaatagatttttcaaagtatgagactgtctttattcaaggttcaaaccctctttcacaacttccaaattctaaaaagttagaaaaagagattaaaaagtgtgagaatgttgtctattttgctctttttgaaaatgagagttcaaaagtagcaaatctgatcattcctgcaaaaactttttag

SEQ ID NO: 11150 - protein, 291 aa, Unknown
  Obtained from environmental sample
  DOMAIN (3)...(291): Molybdopterin oxidoreductase
  misc_feature (1)..(291): Xaa is any amino acid
MEVMQNVTSHLFAPLGTVKADGSICSGAGEAGIEEGRGVNLPLTLEQIANSEVVVLWGRNPHTSNSHLLPIIKGKKLIVIDPIKIDAVKSADLHIQLKPHGDLFLALLIARFVIIEGAEDKEFLDKYCEDHEDFYELTQSLRIKKTVEEIGITLGQIGEFMSHVKNKKTVFLVGTGVQRYRNGSEIIRSIDSLAAVLGLFGKSGCGVGFLSDSTYGVEMPFKKFKKSSPKATIDFSKYETVFIQGSNPLSQLPNSKKLEKEIKKCENVVYFALFENESSKVANLIIPAKTF

SEQ ID NO: 11151 - DNA, 813 bp, Unknown
  Obtained from environmental sample
  misc_feature (1)..(813): n is a, c, g, or t
atgccatcttggtttatgaatagctttcttgatttttctgaagatattgaaagtttagcaaaagagaacaaaagacttatactctttgtagaacaagatagttgcccctactgtcatgcttttgtaacaaaaaacttaagccatacaaaaacaaaagaaaaggtacaaaaacattttggtgtcattgatttaaatatgtttggtgacagagaggttatagatactgatggtgaagagtttacagaaaaagagtttgcaaaaaagcataatatacagttcactccaactattatcttctttgatgaaaacaaaaaacagatactaagattaaatggatacattgatataccacagtttaatcttgccttagattatataaaagataaaaatgagactagtttaacgtatcaagagtatatacttaaaaataaaaaacaaaataatgctttaataagtgaaccaggactttttaaagacttaaaaaattttatgagaaccaaaaattctaaaaaaatagcaatattttttgaatcatccaattgtgataattgtgaaatactccataacaaacttttaaaagataaaacgacaagagaactactcaaaaaaatagatttggtgcaagttgatataaactcaaaagaagctattgttagtcctgataggatggtttacaatataaaagattggataactatactaaatatcacccatactcctactatcatattttttgatgagaaagcaaatgagataatgagaatagaagccatgtttaaaaactttcattttcaagtattgttgactatgtag

SEQ ID NO: 11152 - protein, 270 aa, Unknown
  Obtained from environmental sample
  misc_feature (1)..(270): Xaa is any amino acid
MPSWFMNSFLDFSEDIESLAKENKRLILFVEQDSCPYCHAFVTKNLSHTKTKEKVQKHFGVIDLNMFGDREVIDTDGEEFTEKEFAKKHNIQFTPTIIFFDENKKQILRLNGYIDIPQFNLALDYIKDKNETSLTYQEYILKNKKQNNALISEPGLFKDLKNFMRTKNSKKIAIFFESSNCDNCEILHNKLLKDKTTRELLKKIDLVQVDINSKEAIVSPDRMVYNIKDWITILNITHTPTIIFFDEKANEIMRIEAMFKNFHFQVLLTM

SEQ ID NO: 11153 - DNA, 531 bp, Unknown
  Obtained from environmental sample
  misc_feature (1)..(531): n is a, c, g, or t
atgatcatgagcaaatacaataatattttcgatcctaagccagctgatgaacaatcaattagctcaataaaaaagccgagcatcctgccagatgctcagctttcagagactacttcagataacattgacgatccatcactaggtattttatcacgaaatgtaccaaaagttagctcaaaggaagcaaaagatattatcaataacatggctgtcttatcagaattagattatcagctattacgagttgatactgctaaatttttaaatataacattgaacgccttcgacaagctagttaaaagtgccagaaacgaattgggcaagaaaaacactcagagtttagtagttaatattggtccgtataaagaaccagtgaacggtgttttagtagctgatcaaatatttacgacactaagccatcatatcgtctgtactatttcagttaaagtagctgtcgtactatggatatttatgacatgggttataccagcaagtcacattttgcctatcgcttggattaatgcaccctga

SEQ ID NO: 11154 - protein, 176 aa, Unknown
  Obtained from environmental sample
  misc_feature (1)..(176): Xaa is any amino acid
MIMSKYNNIFDPKPADEQSISSIKKPSILPDAQLSETTSDNIDDPSLGILSRNVPKVSSKEAKDIINNMAVLSELDYQLLRVDTAKFLNITLNAFDKLVKSARNELGKKNTQSLVVNIGPYKEPVNGVLVADQIFTTLSHHIVCTISVKVAVVLWIFMTWVIPASHILPIAWINAP

SEQ ID NO: 11155 - DNA, 600 bp, Unknown
  Obtained from environmental sample
  misc_feature (1)..(600): n is a, c, g, or t
atgccaaaaacattaaaaaactttatattttcaataaatattattcttctgtcgtctctgtttctactgatatttatctttacaacatatcttcatacaactttagctcaaaaaaatgctattaaacatgcaaatgcagtatctaatcaagtattctcatctatgtatcaggttatgaaaaaagggtgggataaagaggaacttaatgagtttatgaactcactgaaagagaactttaacgatactgattacaatataaatatttatcgttccgatcgggtaaaagagctctttggtgaagttagtgaaaaccctaaagatgatcttgtgaaaactgttttaaagagcggtcaaaaagtgacaatcagccaaatgcaaacgattagaaatttactgcctctaaacgctaaacaagagtgtttaagctgccatgtgaatgctaatgtaggagatacgttaggtgttattgatgtagagcaaaatttagttgacataataaagagacattttagactatgtatatttctttttaatagggcttcccatttttggcttagttgcctttatcccctccagatatacaccttcaagaataacgag

SEQ ID NO: 11156 - protein, 200 aa, Unknown
  Obtained from environmental sample
  misc_feature (1)..(200): Xaa is any amino acid
MPKTLKNFIFSINIILLSSLFLLIFIFTTYLHTTLAQKNAIKHANAVSNQVFSSMYQVMKKGWDKEELNEFMNSLKENFNDTDYNINIYRSDRVKELFGEVSENPKDDLVKTVLKSGQKVTISQMQTIRNLLPLNAKQECLSCHVNANVGDTLGVIDVEQNLVDIIKRHFRLCIFLFNRASHFWLSCLYPLQIYTFKNNE

SEQ ID NO: 11157 - DNA, 489 bp, Unknown
  Obtained from environmental sample
  misc_feature (1)..(489): n is a, c, g, or t
ttgttattaaggaggttggtaatgaaaaagtattttcctataattttgatagtgatcgttggattaactattatgcagagaaaaagaaaagagacaaatttcaataaaatcgattacgaccaaatagaaaataatatagatgaaagccaaaatgaaaatattgaattcattgatgaatcaggtggctatggtctactctatcccggtaattgggaattaagtgattctgcctataaagaagaaatgatcagggcagatatttttaaaggtaatgatatcggtttccaaatcaggctatacaataatgaaaatatgagcttcaagaagtttgtaaaaagctacctagaacaatttgaaaatgatatggaaaaacgttggggtggggatttaaatttagagaagcggagttttgttgaaggcagaaaaaatgtttactatagagttatctatcaacaaccaaaagataatggagagatgggaaatatatga

SEQ ID NO: 11158 - protein, 162 aa, Unknown
  Obtained from environmental sample
  misc_feature (1)..(162): Xaa is any amino acid
MLLRRLVMKKYFPIILIVIVGLTIMQRKRKETNFNKIDYDQIENNIDESQNENIEFIDESGGYGLLYPGNWELSDSAYKEEMIRADIFKGNDIGFQIRLYNNENMSFKKFVKSYLEQFENDMEKRWGGDLNLEKRSFVEGRKNVYYRVIYQQPKDNGEMGNI

SEQ ID NO: 11159 - DNA, 660 bp, Unknown
  Obtained from environmental sample
  misc_feature (1)..(660): n is a, c, g, or t
ttggtgggggggaaccccttattgactgaagagcattacttacttttagattttttaatgaaaaacaagcgaacaaacctttgtctgcgatataatacgaatttttctattctagaatataaaggaaaaaacatactcgattattggaaacagttcgacaatgtagaaatactagcgagcattgatgctcatgaaaagctaggagaatacattaggaaaggttttaattgggatcaatttgtgaagaatagagatgcaattcgagaattaccacatattaaattcaagatagcacccacaatctcggtgctttcaattgctaatcttccagatttatacaagacctgtttagaacttgatattattgaaaaagaaggtatttacatcaatatacttgaacgacctcatttttataatactaaagctattcctgcgtcaattaaggctgagatttcaaaatcatttgatcaattttatatttgggcaattcgcaataaggttcctaaatctgtattaagtcggtttgaagaatgtatcgattatatgggagctgatgatctaagcaagcattggaagaaatttattcaggaaacggctcttttcgataagttacgcaatgagcattctccattccttaaggatctattcgaaacgaattaa

SEQ ID NO: 11160 - protein, 219 aa, Unknown
  Obtained from environmental sample
  misc_feature (1)..(219): Xaa is any amino acid
MVGGNPLLTEEHYLLLDFLMKNKRTNLCLRYNTNFSILEYKGKNILDYWKQFDNVEILASIDAHEKLGEYIRKGFNWDQFVKNRDAIRELPHIKFKIAPTISVLSIANLPDLYKTCLELDIIEKEGIYINILERPHFYNTKAIPASIKAEISKSFDQFYIWAIRNKVPKSVLSRFEECIDYMGADDLSKHWKKFIQETALFDKLRNEHSPFLKDLFETN

SEQ ID NO: 11161 - DNA, 873 bp, Unknown
  Obtained from environmental sample
  misc_feature (1)..(873): n is a, c, g, or t
atgttaaatcttgatagtgaagcgcaaggtgaaatttgtataggatgtgctggtggaattgatatatttgggataaataacaaaggtgaatatctaaaaaacaaagaccataaaaagctttatgagataacaattgataatcttgatggtggacatagtggagttgatatagacaaaaatatcccaaatgctttgaaacttatgacaaaaactattaaagagtgtgatgctgatttacttgatattagtggaggtgaacggataaactctatccctaaatcagcatcagctattatcgtatctcataaacaaccacagcctacacatcctaatatgaaaataatagaagtggatacaaatacgcaacattataaaaaattagatgagggtataattaactttttgtatacattttcaaatggtgttagaggatacgataaagagttaggggtagtactgagttctattaatttagcaatcatagaaaactcaattgagggattaaaaattagtttaagtggtagaagtatggataatgatgagttaaaaattgtagctgctgaaacaattgaagcgttaaaaatatttgggtttgaagtgactacaaatggaaaatacccagcttggaagccaactcatagtgactttacagctgaagttttaaaagtttataaagaggttattccagaagctacacttaatgcaattcatgcaggattagagtgtgctatatttaaagcaaaatatccaaatattgatgtatgtcctgttggacctaatatctactttccacactcacaccgagaagagtgtgaaattagttcagtgataaaaataaatgatgttgtacaaaaggtaggtaaaaacttttaa

SEQ ID NO: 11162 - protein, 290 aa, Unknown
  Obtained from environmental sample
  misc_feature (1)..(290): Xaa is any amino acid
MLNLDSEAQGEICIGCAGGIDIFGINNKGEYLKNKDHKKLYEITIDNLDGGHSGVDIDKNIPNALKLMTKTIKECDADLLDISGGERINSIPKSASAIIVSHKQPQPTHPNMKIIEVDTNTQHYKKLDEGIINFLYTFSNGVRGYDKELGVVLSSINLAIIENSIEGLKISLSGRSMDNDELKIVAAETIEALKIFGFEVTTNGKYPAWKPTHSDFTAEVLKVYKEVIPEATLNAIHAGLECAIFKAKYPNIDVCPVGPNIYFPHSHREECEISSVIKINDVVQKVGKNF

SEQ ID NO: 11163 - DNA, 861 bp, Unknown
  Obtained from environmental sample
  misc_feature (1)..(861): n is a, c, g, or t
gtgttagactataattttactgcaagagttgaagaacagtttgatgaaattgcagaaggattgaaggaatggagcaagatgattgctgaattttataaaccttttcacaatcaaattaccgatactcttgaaaatgcagaaagagcaagtggtgaaaggttattaggtactgatccaaaaacaaaaaaaccagttattgctcgtattggtagattcggaccaatgattcagataggaagtgctgatgatgaagaaaaacctcagtttgctagcttactttcagatcaaaatatttctaatataactttagaacaagcactaacattgtttcaatttccaaaaaccttaggaaattatgaaggtaaagaagtcgttgtatcacaaggtaaatttggtccttatgtaaaatttgatgaaaaatttatttctttacccaaaggagaagaaattactgctgtaaatcttgatagagctattgaattaattaaggaaaaacaacaagcagatgctccaattgctgaatatcaaggcaagcctgttcagaagggagtaggaaggtttggtccatttattaaatggaacaacatgtttatcaatgtaaacaagaagtataattttgataacctatctcagagtgatattaaagaattaattgaagacaagcttcaaaaagaaaaagataaatttattcataattgggaagacaaaggtatttcagttcagaaagcacgttggggaagatttaatattgttaaaggaaaaacaaaaattgaattatcaaaggatacagatgtaaaaaaaatgacgttggaaaaagttgaaaaaataattgaaaaaacaaaacccggaaaaaaggcctaa

SEQ ID NO: 11164 - protein, 286 aa, Unknown
  Obtained from environmental sample
  misc_feature (1)..(286): Xaa is any amino acid
MLDYNFTARVEEQFDEIAEGLKEWSKMIAEFYKPFHNQITDTLENAERASGERLLGTDPKTKKPVIARIGRFGPMIQIGSADDEEKPQFASLLSDQNISNITLEQALTLFQFPKTLGNYEGKEVVVSQGKFGPYVKFDEKFISLPKGEEITAVNLDRAIELIKEKQQADAPIAEYQGKPVQKGVGRFGPFIKWNNMFINVNKKYNFDNLSQSDIKELIEDKLQKEKDKFIHNWEDKGISVQKARWGRFNIVKGKTKIELSKDTDVKKMTLEKVEKIIEKTKPGKKA

SEQ ID NO: 11165 - DNA, 516 bp, Unknown
  Obtained from environmental sample
  misc_feature (1)..(516): n is a, c, g, or t
ttgatggtagagcaggttttgaatgacttttcaggcgcatataagtttaagtatgttgctttgaggtattttaatgcagcaggaattaatccagaacgaagtataaatatagaatctatttcaggaacacatcttattccaaatgtgattaaatctgcaaaaaatcctaggaaagttttgaaggtttttgggaataattataagactaaagatggtacgtgtgttagggactatatccatgtagttgacttgtgttcagcacatttgttagcacttaaatatttggcaaaaaacaataaaagtgatatttttaatcttggtagtggtaaagggttcacggttaaagaagttattgataccgttgagaaagttactggaaaaaaggtaaagacaaaggttataggaagaagaggtggggatcttcctgaactaatagcaaatagtaataaagctagaaaaattttgggttggaagcctaagtatacattgaaagggattatcgaaacatctatatag

SEQ ID NO: 11166 - protein, 171 aa, Unknown
  Obtained from environmental sample
  DOMAIN (1)...(171): NAD dependent epimerase/dehydratase family
  misc_feature (1)..(171): Xaa is any amino acid
MMVEQVLNDFSGAYKFKYVALRYFNAAGINPERSINIESISGTHLIPNVIKSAKNPRKVLKVFGNNYKTKDGTCVRDYIHVVDLCSAHLLALKYLAKNNKSDIFNLGSGKGFTVKEVIDTVEKVTGKKVKTKVIGRRGGDLPELIANSNKARKILGWKPKYTLKGIIETSI

SEQ ID NO: 11167 - DNA, 807 bp, Unknown
  Obtained from environmental sample
  misc_feature (1)..(807): n is a, c, g, or t
gtgggaattgactcaatgaatttatcccgtgagtattttgatttgaatagtatcaagttggataagcctttcgctaaattcacaattgatgatcattcggataacttcagcagactaataaaatacgattcaacggctgcttcggagaatagttattccaatctttttataatagctggtaagtatatctccgcgtttattaatcaaattaaagtgacgaacttttcggttgacaacctcaacatggctgatataggtgttgattttacggataagagcttactaaagacatttaaatacaaactctttcatggaacactaacttctaacaacttaaaatctaacaatgacagtattcacgttgtgtttaatgctgatgtacaaaacaaagggagactaaattcaatggggattttcaactcgattgatccagataatatttatggaaatattaaactcgaggatattgaagctactgatttctctccttactcttatgagtatttcggtttaccaatacttcaaggtaaaggttttttaaattcacatgtcaatatcaccaataagcaacttgacaacaataatagggttcggtttttcaaccttgagtttggaaagaaagttagaaatcctgaaatgcttcacttacctgttaaatcagctgctcaagcgcttaaaaataaagaaggagaaacacttttacaatttaatattacgggagaattatcgaatccgaactataatgttttagatgtggctggacaggtactaaaagaacttgttcaaaaagcggcgaggtatcattga

SEQ ID NO: 11168 - protein, 268 aa, Unknown
  Obtained from environmental sample
  DOMAIN (71)...(225): Domain of Unknown Function (DUF748)
  misc_feature (1)..(268): Xaa is any amino acid
MGIDSMNLSREYFDLNSIKLDKPFAKFTIDDHSDNFSRLIKYDSTAASENSYSNLFIIAGKYISAFINQIKVTNFSVDNLNMADIGVDFTDKSLLKTFKYKLFHGTLTSNNLKSNNDSIHVVFNADVQNKGRLNSMGIFNSIDPDNIYGNIKLEDIEATDFSPYSYEYFGLPILQGKGFLNSHVNITNKQLDNNNRVRFFNLEFGKKVRNPEMLHLPVKSAAQALKNKEGETLLQFNITGELSNPNYNVLDVAGQVLKELVQKAARYH

SEQ ID NO: 11169 - DNA, 909 bp, Unknown
  Obtained from environmental sample
  misc_feature (1)..(909): n is a, c, g, or t
ttgattcatttagatgaaaagcagcctttagttgcatatgagattttaagaagattaaaccaaaacaaacctaatcatcaatatttaatcaatatgctaagagcttattatgaagctcataaagatgatgcaaataaaaaagagaaatttgaacatattattgcagagtataaaaagcttgaagaaaaattagaaaattataaattagaaaattataaaaaggaactttatgattatcaggttttattggcactttatacagatatagatgattttaagtcgttttctgagctatggaatgagttgccaaaagtgtactattatgatctttatattgcacagattagatgtaagtttttacaaaaaaacaaacaattcaccgaagcattaagttatatagaagagttaaaacaacaccataaaggctttaacgaagatgatacaaaagaattagacgaacttgaagagaatataaaaaaagaaataactattgaagtaaaagacaataaatcatctcacgtagttttagaaaaatcaaaaatattagataaatatgaggcaaaaaactattggcttcaactaaaagatatggatgatgaaagtcatgctcatatatttgccagtcaagttaatgttgaagaatatataanagatataatgtttaacattgctgaagaattgttagaaagaaaagtaaacttacatagagtaagcgaaaacaataagctagaattagaagatatcatanatgattgggtgacttctttattaactcataggaagaactttttaggatggaaaattttagaccaaaaagaggtggagttcaggaaaccaagaaggagttgggaaaaagacttggttgtcaaaaactccaaaatagaaattaatttcaatttgaggctttaa

SEQ ID NO: 11170 - protein, 302 aa, Unknown
  Obtained from environmental sample
  misc_feature (1)..(302): Xaa is any amino acid
MIHLDEKQPLVAYEILRRLNQNKPNHQYLINMLRAYYEAHKDDANKKEKFEHIIAEYKKLEEKLENYKLENYKKELYDYQVLLALYTDIDDFKSFSELWNELPKVYYYDLYIAQIRCKFLQKNKQFTEALSYIEELKQHHKGFNEDDTKELDELEENIKKEITIEVKDNKSSHVVLEKSKILDKYEAKNYWLQLKDMDDESHAHIFASQVNVEEYIXDIMFNIAEELLERKVNLHRVSENNKLELEDIIXDWVTSLLTHRKNFLGWKILDQKEVEFRKPRRSWEKDLVVKNSKIEINFNLRL

SEQ ID NO: 11171 - DNA, 612 bp, Unknown
  Obtained from environmental sample
  misc_feature (1)..(612): n is a, c, g, or t
atggatgatgaaagtcatgctcatatatttgccagtcaagttaatgttgaagaatatataaaagatataatgtttaacattgctgaagaattgttagaaagaaaagtaaacttacatagagtaagcgaaaacaataagctagaattagaagatatcataaatgattgggtgacttctttattaactcataggaagaactttttaggatggaaaattttagaccaaaaaagaggtggagtttcaggaagcaaagaaggagttggagaaaaagacttggttgtcaaaaactcaaaaaatagaaatttatttctatttgaagcttttaaaaacaaaatagaagatcacttaaataaacttgatggctataatgccactggatgtaaactgatcttcgtatttgtttacactaaagaaaaaaactttactaattgttcaaatggctataaagaaaaaatatcaaaattgaagtatacaggttttgatgatatgattttaccagtaactgtagaaaaagttgattgtcaaagtagtacaattcatttatataaagagataagacaaaaaaacaaagaagatacaacaatcttgcattatttgttagattttaattga

SEQ ID NO: 11172 - protein, 203 aa, Unknown
  Obtained from environmental sample
  misc_feature (1)..(203): Xaa is any amino acid
MDDESHAHIFASQVNVEEYIKDIMFNIAEELLERKVNLHRVSENNKLELEDIINDWVTSLLTHRKNFLGWKILDQKRGGVSGSKEGVGEKDLVVKNSKNRNLFLFEAFKNKIEDHLNKLDGYNATGCKLIFVFVYTKEKNFTNCSNGYKEKISKLKYTGFDDMILPVTVEKVDCQSSTIHLYKEIRQKNKEDTTILHYLLDFN

SEQ ID NO: 11173 - DNA, 441 bp, Unknown
  Obtained from environmental sample
  misc_feature (1)..(441): n is a, c, g, or t
atgaaacaagtagaagaaaacgatacagttattgtcagctatattggtaccctggataatgagactgtttttgaaaccgttaaagagtctaagcctaaagaaattgaccttagtgacgagaaaacagcccgttcttttaaaaggaatctggttggaatgcagattggggaaatgcgtacagtaaagttgacccctgaagagggtgaatatggaattcgccgcgctgaccttcttcaccagataccaaaaaccacttttacagataagatcgaacccaaagttggccttgttctttccatgaacatggaacgtgacggtgtaactcaccaggtaccagccacgatagttgaagtctctagtgaacttgttactctagactacaaccatccacttgctggccatccactgaaatatgagatcaaaattctagctattaagtag

SEQ ID NO: 11174 - protein, 146 aa, Unknown
  Obtained from environmental sample
  DOMAIN (2)...(143): FKBP-type peptidyl-prolyl cis-trans isomerase
  misc_feature (1)..(146): Xaa is any amino acid
MKQVEENDTVIVSYIGTLDNETVFETVKESKPKEIDLSDEKTARSFKRNLVGMQIGEMRTVKLTPEEGEYGIRRADLLHQIPKTTFTDKIEPKVGLVLSMNMERDGVTHQVPATIVEVSSELVTLDYNHPLAGHPLKYEIKILAIK

SEQ ID NO: 11175 - DNA, 402 bp, Unknown
  Obtained from environmental sample
  misc_feature (1)..(402): n is a, c, g, or t
atgaaaaagactataatccaacttgctttatttgtagtgatagttgctttaggatacatggtttacgatagtatcatgaagcctgtaagatttaacaaggaaaaacaacaaagggaaaaggttgttattgaaagactaaaggatataagaagttcacagtttatatataaacaattgaacggctcatatgctactaattttgatacattgatttcattcttaaaggttgctgaaattcctattgtgaaaattattccagatccaagcgatactacttatactctgacaattaatgacactggtggatatattaaggtagctgaatccttatttggacctcatgggaatttcagtcactcaccaatgagaacagaccctttttcaaagggttattttgtttga

SEQ ID NO: 11176 - protein, 133 aa, Unknown
  Obtained from environmental sample
  misc_feature (1)..(133): Xaa is any amino acid
MKKTIIQLALFVVIVALGYMVYDSIMKPVRFNKEKQQREKVVIERLKDIRSSQFIYKQLNGSYATNFDTLISFLKVAEIPIVKIIPDPSDTTYTLTINDTGGYIKVAESLFGPHGNFSHSPMRTDPFSKGYFV

SEQ ID NO: 11177 - DNA, 900 bp, Unknown
  Obtained from environmental sample
  misc_feature (1)..(900): n is a, c, g, or t
atgttgaaagttttaatgctcggctgggaatttcctccgattaaatcgggcgggctcggcgtcgcgtcgaaagcgctcgcggaggcggtcgcgcggcaaaatgtcgagctgactttcgtgctcccctctttcgtcgggaaaaaaattgacgagaaattgcctttcaacatcgcgtttaatttaaaaaaaatcaatttcgaagtcctccaaaaaataaaaacgacaatctattcgccctacatttcggaaaatgaatacgaaaatttcgtccaaaaatgggactcggacgagccgggcgacgattcgaaaaaagaaatttacggaaaaaatttattcgcggagatcgaaagatacgccatcgaggtcgaaaatctcgagctcgcgaaaaaatttgatgtaatccacacgcacgactggatcacctgtcccgccgcgattcggcttaaaaatagacttaaaattccgctcgtcgtgcatgttcacgcgacggagttcgaccggaccggcagaaatttcaatccagaagttttcaaaatcgaanaagaatcgtggaccgcggcggacaaattgatcgctgtttcgaattacacgaagaacatcgtcgtcgaacattacggcatcgatcccgcgaaaatcgaggtcgtgcacaacggaaaagacgatttcctcccgacagtgaatcgaaaatacatgtgccgcagtgacaaaaagacagttttatttttggngacaactcccgattccaaaaaggttccggaactggttccattaaaggtcccggaaaaaagtttttgccaaaaaacggaaaaaaatgttccaatttttctcgcccccccgggaacggggccgaaccttgatgccccaaaaatttattccaacgcagaaattgtgggccaaaaa

SEQ ID NO: 11178 - protein, 300 aa, Unknown
  Obtained from environmental sample
  misc_feature (1)..(300): Xaa is any amino acid
MLKVLMLGWEFPPIKSGGLGVASKALAEAVARQNVELTFVLPSFVGKKIDEKLPFNIAFNLKKINFEVLQKIKTTIYSPYISENEYENFVQKWDSDEPGDDSKKEIYGKNLFAEIERYAIEVENLELAKKFDVIHTHDWITCPAAIRLKNRLKIPLVVHVHATEFDRTGRNFNPEVFKIEXESWTAADKLIAVSNYTKNIVVEHYGIDPAKIEVVHNGKDDFLPTVNRKYMCRSDKKTVLFLXTTPDSKKVPELVPLKVPEKSFCQKTEKNVPIFLAPPGTGPNLDAPKIYSNAEIVGQK

SEQ ID NO: 11179 - DNA, 747 bp, Unknown
  Obtained from environmental sample
  misc_feature (1)..(747): n is a, c, g, or t
atgatcgcaaaaagattacaatatattacagcacctatggaacttgaagagattttagatattgcaaaaatggaatctttgcaactcaaacaaccaacatttacccctcaaagaacttttatctcccctcatcatagctctacaaaagcttcaatcgtaggtggaacacaaataggggaggtggctttatcaaatcatggggtactattttttgatgaattaccacattatgataaaaatgttttagaagctatgagagaacctttagaagattatgagatatcaatttcaagagtaaatagtaaggtaaaatatcctacaaaatttcttttcgtagcagcacaaaacccatgcccttgtggtaacttactctctcaaacaaaactatgccgatgcaatgatgttgagatacaaagatataaaaataaaatatcggatccttttttagatagaattgatctttatgtggttatgaatgaggtaacaaaagaggataaatctgatgtgacatcagaacaattacacttacaagtattagaagtctttaagcgtcaaaaacttcgtggacaaaaagaacttaatggaaaacttaatgatgaggatataaaaaaatattgtaccatttcaatagaagcacaaaatattttggacctgtctattgaaaaatttgctttatcctttcgctctattaataaagtattaaaagtatcaagaacaatcgctgatttagaaatagttattacatag

SEQ ID NO: 11180 - protein, 248 aa, Unknown
  Obtained from environmental sample
  misc_feature (1)..(248): Xaa is any amino acid
MIAKRLQYITAPMELEEILDIAKMESLQLKQPTFTPQRTFISPHHSSTKASIVGGTQIGEVALSNHGVLFFDELPHYDKNVLEAMREPLEDYEISISRVNSKVKYPTKFLFVAAQNPCPCGNLLSQTKLCRCNDVEIQRYKNKISDPFLDRIDLYVVMNEVTKEDKSDVTSEQLHLQVLEVFKRQKLRGQKELNGKLNDEDIKKYCTISIEAQNILDLSIEKFALSFRSINKVLKVSRTIADLEIVIT

SEQ ID NO: 11181 - DNA, 435 bp, Unknown
  Obtained from environmental sample
  misc_feature (1)..(435): n is a, c, g, or t
ttggggtacttactctctcaacaaaaactatgccgatgcaatgatgttgagatacaaagatataaaaataaaatatcggatccttttttagatagaattgatctttatgtggttatgaatgaggtaacaaaagaggataaatctgatgtgacatcagaacaattacacttacaagtattagaagtctttaagcgtcaaaaacttcgtggacaaaaagaacttaatggaaaacttaatgatgaggatataaaaaaatattgtaccatttcaatagaagcacaaaatattttggacctgtctattgaaaaatttgctttatcctttcgctctattaataaagtattaaaagtatcaagaacaatcgctgatttagataatagttatacaatagaaaaacagcatattatagaagctttgagttatagaaagagatag

SEQ ID NO: 11182 - protein, 144 aa, Unknown
  Obtained from environmental sample
  misc_feature (1)..(144): Xaa is any amino acid
MGYLLSQQKLCRCNDVEIQRYKNKISDPFLDRIDLYVVMNEVTKEDKSDVTSEQLHLQVLEVFKRQKLRGQKELNGKLNDEDIKKYCTISIEAQNILDLSIEKFALSFRSINKVLKVSRTIADLDNSYTIEKQHIIEALSYRKR

SEQ ID NO: 11183 - DNA, 768 bp, Unknown
  Obtained from environmental sample
  misc_feature (1)..(768): n is a, c, g, or t
atgcacgctaatgtagcttatgtttttatggaaatgggtaagtatgaagatgcgtttaatagtttacaaaaggcgttaactatttcagaacaagaaaaagatgaatcgttagaaattcttactttgagctacttggcaaacttgtattcatacatgaaccagtttactaaagccattgagacttatagaaaaacattaaattattacataaaacaagaaaacactcgaaatgttcagatgtgtttaaataacataggaacaatattttttcaatctaataatttagatagtgctcaactatatttccatcaatcattagctgttggtaaaaaaattggggataataaaaatattgctaatggattactcaatttaggaagtatatcttacaaaaaaaaggaatttaccgaagctgaaacatattataaagaagctttaacatataatattgctagaggcgatgattcacaattatttaaaaattacatcaacctaagtaatgtttattttaaccttaataagtttgatatttcctatcaatatgcaatgaaagcaaaagaaattgcagatagaacagataatataaaatctaaaagtagcgtacattcaactttagctagctattataaatcaaaaaaagattataaaaaagctttagaaaattatgaaatacatgttcagctggaaaactctattttaagggttgaaccaacccaacagattaatgaatttagcggcaaaatatggaaaatgaaagaaaggaattag

SEQ ID NO: 11184 - protein, 255 aa, Unknown
  Obtained from environmental sample
  misc_feature (1)..(255): Xaa is any amino acid
MHANVAYVFMEMGKYEDAFNSLQKALTISEQEKDESLEILTLSYLANLYSYMNQFTKAIETYRKTLNYYIKQENTRNVQMCLNNIGTIFFQSNNLDSAQLYFHQSLAVGKKIGDNKNIANGLLNLGSISYKKKEFTEAETYYKEALTYNIARGDDSQLFKNYINLSNVYFNLNKFDISYQYAMKAKEIADRTDNIKSKSSVHSTLASYYKSKKDYKKALENYEIHVQLENSILRVEPTQQINEFSGKIWKMKERN

SEQ ID NO: 11185 - DNA, 801 bp, Unknown
  Obtained from environmental sample
  misc_feature (1)..(801): n is a, c, g, or t
ttgaaatttcctccagttgaggctatagatgatgatgagctgatagatctttttgtgaaagaggcatggaatgcatcacgacttaaagctggtttttttgcaaaagcatggatacctgaggtcagaactaaaaggtattatgttttagattatgcagaagggacaactttaaaagagtacatatctaaaaaaccgcttcatatagatgatgctattaatttggcaaaattcttactgaaaatgagtcaatttttaattaaacttgaccttgtccatggagacattaaacctgaaaatatcatagtaaacaagcgtgatgagaagctgatatttaagatgatagattacggctcaatcgtagaggtcttttccataaacaacaaagcaggaactccgtcatatttggcacctgagagatttgagggtgcatccataacagagcagagtgagatattttctatcggtgtgactctatacgaatcattaacactaaagtatccttatggtgagatagagccttttcaaaacccatctttttcaaatgcaacaaggcctaaaaaacataataacaatattccctcatggttggagagtgttatcttaagagcgctttcttcaaaaactgatgataggtatgaggtatattctcaaatgagttttgagttagatcacagtgataaagtaagagcatatttttctaaagagacacctcttatagatcgtgatccattgaagttttacaagtatggattttttgtaatgttagttataaactttttaataatattatctaccacttag

SEQ ID NO: 11186 - protein, 266 aa, Unknown
  Obtained from environmental sample
  DOMAIN (6)...(218): Protein kinase domain
  misc_feature (1)..(266): Xaa is any amino acid
MKFPPVEAIDDDELIDLFVKEAWNASRLKAGFFAKAWIPEVRTKRYYVLDYAEGTTLKEYISKKPLHIDDAINLAKFLLKMSQFLIKLDLVHGDIKPENIIVNKRDEKLIFKMIDYGSIVEVFSINNKAGTPSYLAPERFEGASITEQSEIFSIGVTLYESLTLKYPYGEIEPFQNPSFSNATRPKKHNNNIPSWLESVILRALSSKTDDRYEVYSQMSFELDHSDKVRAYFSKETPLIDRDPLKFYKYGFFVMLVINFLIILSTT

SEQ ID NO: 11187 - DNA, 393 bp, Unknown
  Obtained from environmental sample
  misc_feature (1)..(393): n is a, c, g, or t
ttgagtagtttaaaaaacatattgatcaatgccgatgactattgtttatctgatgcgataaataaggctgttgtaaaattggctaagcatggtttaataaacagtgtttcggttcttattaataatccatcagtaaattatcaatacgagataggcaaattaaataatgttaaaattggtcttcacttaaatcttagcgaaggcaagccattgtgtaaacaaaaacttgtttcaagtttggtaaatagtaaaggtgaattttattctctaccttttttctggttaagatatatgtttggattaataaaaaaggaacatatttcgctcgaaatagatgcacagtatgcaaaattagcttctgtaaatatcactcgatcatgtagattctcataa

SEQ ID NO: 11188 - protein, 130 aa, Unknown
  Obtained from environmental sample
  misc_feature (1)..(130): Xaa is any amino acid
MSSLKNILINADDYCLSDAINKAVVKLAKHGLINSVSVLINNPSVNYQYEIGKLNNVKIGLHLNLSEGKPLCKQKLVSSLVNSKGEFYSLPFFWLRYMFGLIKKEHISLEIDAQYAKLASVNITRSCRFS

SEQ ID NO: 11189 - DNA, 372 bp, Unknown
  Obtained from environmental sample
  misc_feature (1)..(372): n is a, c, g, or t
gtgtttccaaatttcttgtttgcaaccaaatatagttttcagggggtattggatatggataatatggatattgtaataaattatgatgttcntcatgaggctgaagattatgttcatagagtgggaagaacagcacgtgccgaatcgacaggtgtagctcttacatttataacaaaaaatgaccaaaatgatttttataagattgaggagttgattgaaaatgcgatttataaaattccacttcctttacattttgaaaaagcaccagtatataatccaaatactaacagtaaacaaaataaacgaataaaaaatacaaaaacagtaaaaagaaaacccaaaaagtcagtaaaagataattacaaaaagtaa

SEQ ID NO: 11190 - protein, 123 aa, Unknown
  Obtained from environmental sample
  misc_feature (1)..(123): Xaa is any amino acid
MFPNFLFATKYSFQGVLDMDNMDIVINYDVXHEAEDYVHRVGRTARAESTGVALTFITKNDQNDFYKIEELIENAIYKIPLPLHFEKAPVYNPNTNSKQNKRIKNTKTVKRKPKKSVKDNYKK

SEQ ID NO: 11191 - DNA, 414 bp, Unknown
  Obtained from environmental sample
  misc_feature (1)..(414): n is a, c, g, or t
atgtcattcaaaaaattacttccaccaataaaaaatgccttacaacatttaaagattgacacgcccacttcttttcaaaaactattaattccaaaaattaaaagtggtgtagatgttattgctattgctaaagaaggagctggaaaaacaactactttaatcattaataccattcagaaattaaatggagcagcttatgaagatgttccaagagctttaatttttgtacaaaacaaagaggctgctttgactcttgaagaaaagtttaaccaatttaccaaatataccgatttaagaattttttgtgcttatgaagaaagcactttacaatttcaaaaagatactatttatactggggttgatattgttattggtactccaaaacgattaacaagattattccaaaatgaataa

SEQ ID NO: 11192 - protein, 137 aa, Unknown
  Obtained from environmental sample
  DOMAIN (22)...(137): DEAD/DEAH box helicase
  misc_feature (1)..(137): Xaa is any amino acid
MSFKKLLPPIKNALQHLKIDTPTSFQKLLIPKIKSGVDVIAIAKEGAGKTTTLIINTIQKLNGAAYEDVPRALIFVQNKEAALTLEEKFNQFTKYTDLRIFCAYEESTLQFQKDTIYTGVDIVIGTPKRLTRLFQNE

SEQ ID NO: 11193 - DNA, 633 bp, Unknown
  Obtained from environmental sample
  misc_feature (1)..(633): n is a, c, g, or t
gtgaattataacgataagaaaatgaatatctcggatgttgagtttattgaatccttatcaaaaactaccactaaatccattatttctaaaagtggatatgatattttgccttatacctcagatttttttcctgaagacgttgaaaaaatagctttttatgcagagatatataatgcagataaaatgttaggagcagacgaaagttatttggtaacttattccatagagtcttacgaaacaaatactgtggttggaaatcttaaaggatttgtaagagaatcagctaaacctgtaaacattatattaaaatctttcaatattgttaacttggcctcgggtaattataatttggtaattgaagctagagataaatccaatgaattaatgttgcagaaaaaagtattctttcagagaagtaatcctgcactagtgccagatatcgctaatgttgattttgaaagtacttttgttatagatatggatgctgaacaacttacagaatatataagaagtatagagccaatttctacagcaatagagttaaattatgctaggaaccagttaaaggggaaagacaaagagttaatgcaaaaatatttttataatttttggttactctcgagccaattctga

SEQ ID NO: 11194 - protein, 210 aa, Unknown
  Obtained from environmental sample
  misc_feature (1)..(210): Xaa is any amino acid
MNYNDKKMNISDVEFIESLSKTTTKSIISKSGYDILPYTSDFFPEDVEKIAFYAEIYNADKMLGADESYLVTYSIESYETNTVVGNLKGFVRESAKPVNIILKSFNIVNLASGNYNLVIEARDKSNELMLQKKVFFQRSNPALVPDIANVDFESTFVIDMDAEQLTEYIRSIEPISTAIELNYARNQLKGKDKELMQKYFYNFWLLSSQF

SEQ ID NO: 11195 - DNA, 528 bp, Unknown
  Obtained from environmental sample
  misc_feature (1)..(528): n is a, c, g, or t
atgagaagaagattttcagaaaaatatggatatacaaaacctagagaagttttacaaattgataatgtagatgaacgtttaaaaaatagaatttggaatgctattaataatataatcttagaaaaaattgaattacaaagtggaaattttggtaatccgtttgatacaattcagtatcaaaaagattatgatatttttattaaactatatgatgaagtttttgctgaaaaaagaaaaccctatttagaatttaaaaagctgtctcaaaacttacacaataaatatgaatcttttatttggtatgaaatatataattttttagaagatatatgttttgctcattatagtgatgaaataatacaaacatttaaattaactatcaataaagttctagaagaagagctatcaggctatagattaattgaaaactatattgttcaaataattgacgaaatagaaattaaagaaattgaagaaatttttaatagtaaatatacaccagtaaaaaggcatttatctaaggcatag

SEQ ID NO: 11196 - protein, 175 aa, Unknown
  Obtained from environmental sample
  misc_feature (1)..(175): Xaa is any amino acid
MRRRFSEKYGYTKPREVLQIDNVDERLKNRIWNAINNIILEKIELQSGNFGNPFDTIQYQKDYDIFIKLYDEVFAEKRKPYLEFKKLSQNLHNKYESFIWYEIYNFLEDICFAHYSDEIIQTFKLTINKVLEEELSGYRLIENYIVQIIDEIEIKEIEEIFNSKYTPVKRHLSKA

SEQ ID NO: 11197 - DNA, 717 bp, Unknown
  Obtained from environmental sample
  misc_feature (1)..(717): n is a, c, g, or t
atgaagaatagtttatatataactctcctaagtttgatttttttaacgtgtaatcatttgaacttttatggagatggtcgatataaagaaggtggttttttgggtatccttaaagattacaatagtattgactttgagccttttcaattaaatcaatctaaaaccttaaaatatgaattcaaaaattttaaatcattatctcctcaaaaaggtcatgttgggttaatacttgaaattatctcaccaaaaacaattgattattcaaaggtaaatgcttctataaatatatctattacggatttatctgatgacactttactttatgtaaatggaccgataaattcaacaataaatagtttactaaatggcattattccgtctgcggatacttgtttttggtattggcaaaaaggttatcaggcaaactgggaatatataaaaggagatactgctgcgatataccaagtatttaatccagtacaaaaaaaatgtgtttttataacaggttttatactaaattctaagaaaaaacattttcttaatattgagatggataatattaataagggttatgagaatttaatttgtaacttacaaatttgttccacatggaaaaaagaaatattttgccaaggaggaccacccataaaaaagcacgccaaatttttggtggggggggctgaaaaaaaaataaaaaaaatccccgtggttttttaa

SEQ ID NO: 11198 - protein, 238 aa, Unknown
  Obtained from environmental sample
  misc_feature (1)..(238): Xaa is any amino acid
MKNSLYITLLSLIFLTCNHLNFYGDGRYKEGGFLGILKDYNSIDFEPFQLNQSKTLKYEFKNFKSLSPQKGHVGLILEIISPKTIDYSKVNASINISITDLSDDTLLYVNGPINSTINSLLNGIIPSADTCFWYWQKGYQANWEYIKGDTAAIYQVFNPVQKKCVFITGFILNSKKKHFLNIEMDNINKGYENLICNLQICSTWKKEIFCQGGPPIKKHAKFLVGGAEKKIKKIPVVF

SEQ ID NO: 11199 - DNA, 714 bp, Unknown
  Obtained from environmental sample
  misc_feature (1)..(714): n is a, c, g, or t
atgctacaggaaaagaaacaagtacaaatgaacttgaatatattgccaaagagctcaaaaaatttattgaaagtctttaaaatgagcaaaaatattttttatacaaagtttagtgaacttgaaaataggttagacccacagttctataaaactgaatatgaagatatactgaataaaataaaaaaagtgaatttcaaaaagctttcacaatgtgtacttttttcttcagaagtttggaatcaaaaagatttttttaatcaaacttttccatatatagaaattagtgagatagatttaatttctgggaaaattcataatgttaaacaaattaatattttagaagctccaagtagagcaaaaatgatagtacgaaatcaagatattttaatttcaaccacaagaccaaacagaggtgcaatttcattaattgattcggataatattcttatcgcttcaactggttttgctgtcattagaaattgttctgagcaaatatctaaaaaatatctttttatcgttcttaaaatggattttattttaaaacaatttgaacaaagaagtagcggaggaaattatccagctattacattagaagaattatcgaatataattattcctattccatcaagagatgttcaaaatccaattattttaaagatgggaacaagcctacaaacaaaaagacaaaaagaaaaagaggctcaaaataattag

SEQ ID NO: 11200 - protein, 237 aa, Unknown
  Obtained from environmental sample
  DOMAIN (63)...(226): Type I restriction modification DNA specificity domain
  misc_feature (1)..(237): Xaa is any amino acid
MLQEKKQVQMNLNILPKSSKNLLKVFKMSKNIFYTKFSELENRLDPQFYKTEYEDILNKIKKVNFKKLSQCVLFSSEVWNQKDFFNQTFPYIEISEIDLISGKIHNVKQINILEAPSRAKMIVRNQDILISTTRPNRGAISLIDSDNILIASTGFAVIRNCSEQISKKYLFIVLKMDFILKQFEQRSSGGNYPAITLEELSNIIIPIPSRDVQNPIILKMGTSLQTKRQKEKEAQNN

SEQ ID NO: 11201 - DNA, 606 bp, Unknown
  Obtained from environmental sample
  misc_feature (1)..(606): n is a, c, g, or t
atgattaaacttcaaggactactcggacaaactttcggtggatatattacgataagaggaacttcaaaattttctgatatagtgaatcattctgaggcaaaagcgtatcaaagagagaccatacaaaaacatcttcaagagattagtgattattatgaagagcgagaaaatctattttttccagaagttattttatctcttgagttgaaatatgattttgatactcctgatgcaaaaagtggtgtaaatcctatccaagatatagttggtggaaaatggtttaaatcaaatgtagatgcagtaaatattcaaccgttagctaaaagacatgaaaatgatttgttaaaagttgtaaatattcatttaaattctaatgataaagtgtttggaaggatagatggaaatcacagattaaccgctacaaataccggaaatatttataatgcagagatacctttttgtgtagtgttgtttgatagtgaaaatatacaaaaacaagaaaaaatgcttttttttaatataaattcaaaggcaattcctcttactacagaagaatctttaaagtcaatttttgaagatgaaataaatttttcaaatgaactttaa

SEQ ID NO: 11202 - protein, 201 aa, Unknown
  Obtained from environmental sample
  misc_feature (1)..(201): Xaa is any amino acid
MIKLQGLLGQTFGGYITIRGTSKFSDIVNHSEAKAYQRETIQKHLQEISDYYEERENLFFPEVILSLELKYDFDTPDAKSGVNPIQDIVGGKWFKSNVDAVNIQPLAKRHENDLLKVVNIHLNSNDKVFGRIDGNHRLTATNTGNIYNAEIPFCVVLFDSENIQKQEKMLFFNINSKAIPLTTEESLKSIFEDEINFSNEL

SEQ ID NO: 11203 - DNA, 690 bp, Unknown
  Obtained from environmental sample
  misc_feature (1)..(690): n is a, c, g, or t
atggttaatgtagaaaatgtactgaaagacgcagatgctatgaagttagaagcactagataaagtaaaagacattaaaaataaccctaaacttccagatgaagcaaaagactttgaagtagacaccgcttttctagagccaaaagttaaagagtggagtgattggggctttgactttttgagtgagagtgtaaagagtttagaaaaagagcctgaggtgatgcacaaacttcgtcaccttggtttagcaaagcgaaccattaaacgctcttggttaggttttaacacagaagaaacaagtgttaaagcttctgagtgggcactcgatgatgaagagaatatctacctgcctaaaggtttagtagttcctcgttttgaagaggcaaaactaatctctttgagaattatagatatcgataaacttatagatgccaaagtggaaattattaaaggttcagattctgattttgataatcttctttgttatgaaaatgaagagttgcctctattttacttcaaagatgatttacaggcttggctctgtgaccaagagtgttacgatatctgtaatactttggtctgtgatgatatttcaaatgctggagataaggctagtgaactacttgaaaaagcatctgtaattttctatctggaagaaaacggtgtagttgaaaagttggaaattcaatga

SEQ ID NO: 11204 - protein, 229 aa, Unknown
  Obtained from environmental sample
  misc_feature (1)..(229): Xaa is any amino acid
MVNVENVLKDADAMKLEALDKVKDIKNNPKLPDEAKDFEVDTAFLEPKVKEWSDWGFDFLSESVKSLEKEPEVMHKLRHLGLAKRTIKRSWLGFNTEETSVKASEWALDDEENIYLPKGLVVPRFEEAKLISLRIIDIDKLIDAKVEIIKGSDSDFDNLLCYENEELPLFYFKDDLQAWLCDQECYDICNTLVCDDISNAGDKASELLEKASVIFYLEENGVVEKLEIQ

SEQ ID NO: 11205 - DNA, 501 bp, Unknown
  Obtained from environmental sample
  misc_feature (1)..(501): n is a, c, g, or t
gtgatatttggacagattgaagagattgtagcaagtggtgataatattatgcaaggctactttaaggatgatgaagaaacgcagtccgttttaagaaatggaagtttgtatactggagatttgggaagagtagatgaggatggctttatttttctggaaagcagaaaaaaagagattataaaagtaggagggaagcgtgtaagtcctaaggaaattgaagaagtcattttatcagttgccgaagttatcgattgtatagtagagagtgtttatgatgatctattgggagaagctataaaggcgagtattgtattaaacaagtcaagtaatcaaaaaaagataaaagaagagattataaaattatgccataataaactgctaacatataaaatacccaagttttggagtattgaaaagaatttaaacctcagtttaacgggtaagaaaataaagaaccagtctaaaggtcaaacttatacgataaaatatgaaattccataa

SEQ ID NO: 11206 - protein, 166 aa, Unknown
  Obtained from environmental sample
  misc_feature (1)..(166): Xaa is any amino acid
MIFGQIEEIVASGDNIMQGYFKDDEETQSVLRNGSLYTGDLGRVDEDGFIFLESRKKEIIKVGGKRVSPKEIEEVILSVAEVIDCIVESVYDDLLGEAIKASIVLNKSSNQKKIKEEIIKLCHNKLLTYKIPKFWSIEKNLNLSLTGKKIKNQSKGQTYTIKYEIP

SEQ ID NO: 11207 - DNA, 804 bp, Unknown
  Obtained from environmental sample
  misc_feature (1)..(804): n is a, c, g, or t
atggatctggcagaagaagtaccgagtgggaaaagtacccaagaattgatcgccatatccaaagaattggacatcgcaattttggctggcttgatagaaaaattcaaaggaaagatatacaattgttatatatgtgtaacgggggaaggggtaattgccaagtatcggaaattgcatccatttatcaacaagttcatgagtccaggaaatgagtactgtgtatttgagttgctgggctggaaatgtggaatcttaatttgttatgataataacatcattgaaaacgtaagggctacaagtctcatgggggccgaaattatttttgcgccccacgttaccggctgtactccttcagcaatgccccatagaggttatgtggcggataaatactggcagaaccgggaaaaagaccctgtttcccttagaatggaatttgatggtccaaagggtaggggttggttaatgcactggttgccgacaagagcttatgacaatggtgtctactatgccttcacaaacccgattggttatgacggtgaacatttgaaaaatggcaattcgatgataattgacccgtttggagaaattttgtccgagataaaatcattcgatgatgaaatcaccattgcaaaagtaatcaaagaaaaaatcaaactttctggaggttggaggtacaagaatgctcgacgccccgaactttacaaggatataattgggtggagaccacaaatccgagacaaaaccggtgtgggtggaagggaaccccgggaaatggataatattctccaatatgtaatgagataa

SEQ ID NO: 11208 - protein, 267 aa, Unknown
  Obtained from environmental sample
  DOMAIN (2)...(112): Carbon-nitrogen hydrolase
  misc_feature (1)..(267): Xaa is any amino acid
MDLAEEVPSGKSTQELIAISKELDIAILAGLIEKFKGKIYNCYICVTGEGVIAKYRKLHPFINKFMSPGNEYCVFELLGWKCGILICYDNNIIENVRATSLMGAEIIFAPHVTGCTPSAMPHRGYVADKYWQNREKDPVSLRMEFDGPKGRGWLMHWLPTRAYDNGVYYAFTNPIGYDGEHLKNGNSMIIDPFGEILSEIKSFDDEITIAKVIKEKIKLSGGWRYKNARRPELYKDIIGWRPQIRDKTGVGGREPREMDNILQYVMR

SEQ ID NO: 11209 - DNA, 564 bp, Unknown
  Obtained from environmental sample
  misc_feature (1)..(564): n is a, c, g, or t
atgaaacaaattatactccttttttcaatactatttatagttggaaaatcgtattcaactccaataattcccgttaaccatactgataaagacaacacatccaaaataaaaattgttcttatcaatcccgatgtattttatttaaagtctatagtttacatgacaaagaaaggtataatcaatgctgggaatattgaatatctcgctgttttttataccaaaagtgaaataaaatatagtgaagccaaaaattttgtcgatgagaacgatattaagtttataaaattcaaggaagtatatggcaacctagatatcaacaatatttatacaaggaatgaatgcacagataattttcatgatgttttcaaaaattctgatggcattatattttttggcggatgggatattccgccggtttattacggacaaaagacaaaactaacagtcggaataaaaacaccaaacagacatttgtttgaattgagttttctttttcatttattgggagggaatcaaaatggtggttttaataattttttagaagaaaacccaattaccccgtga

SEQ ID NO: 11210 - protein, 187 aa, Unknown
  Obtained from environmental sample
  SIGNAL (1)...(19)
  misc_feature (1)..(187): Xaa is any amino acid
MKQIILLFSILFIVGKSYSTPIIPVNHTDKDNTSKIKIVLINPDVFYLKSIVYMTKKGIINAGNIEYLAVFYTKSEIKYSEAKNFVDENDIKFIKFKEVYGNLDINNIYTRNECTDNFHDVFKNSDGIIFFGGWDIPPVYYGQKTKLTVGIKTPNRHLFELSFLFHLLGGNQNGGFNNFLEENPITP

SEQ ID NO: 11211 - DNA, 612 bp, Unknown
  Obtained from environmental sample
  misc_feature (1)..(612): n is a, c, g, or t
atggaaccgctatctcgaaaagagagagaaaaaaaacgtaaacgtgaggaaattttagctgccgctttatctgtattcgcgcaaaaaggatatcacggtgcaaccatggctgagattagccagatttcagagtatccactgggtaccatatacaaatttttccaggggaaagagcggatctaccatgagatggttatggaaacaggtgttgcctttggagatatcttgcttgatatcattaagaataatgaaggttctccaaaagatcagattagaaagtgtttcaatgaatacctaaagtatggaattgaaaggagagagtattttttaatttacaactcccagagaagctcaatagatgcagtccttgttcctaatatcaataaaagtataaacaaacttcataacaaaatgaatgaacttttagcagatatttttgaagaggggatcaagcaaggagagtttaaagatcatcctccccttgaaatggcaaatatttttagcagtgtggttttttcaacaatatggatgattatgggcgatcctgagaactatggacagaagaggcttgatactattttttctatatttatggaaggggtttatgcatag

SEQ ID NO: 11212 - protein, 203 aa, Unknown
  Obtained from environmental sample
  DOMAIN (18)...(64): Bacterial regulatory proteins, tetR family
  misc_feature (1)..(203): Xaa is any amino acid
MEPLSRKEREKKRKREEILAAALSVFAQKGYHGATMAEISQISEYPLGTIYKFFQGKERIYHEMVMETGVAFGDILLDIIKNNEGSPKDQIRKCFNEYLKYGIERREYFLIYNSQRSSIDAVLVPNINKSINKLHNKMNELLADIFEEGIKQGEFKDHPPLEMANIFSSVVFSTIWMIMGDPENYGQKRLDTIFSIFMEGVYA

SEQ ID NO: 11213 - DNA, 534 bp, Unknown
  Obtained from environmental sample
  misc_feature (1)..(534): n is a, c, g, or t
atgaaatataaaataacctatcaaaaagatggtaagattgagatacttaaaagtgacaatttagaaaacctaccaaacaatattataaaaatacaaaaaagtagagtattgccaacctttcaattaatacaaaacaataaaaagaatatactcagtatgtttgaacagttaaatattatgttaaatgcaaatataactttaaatgaagcaatagatttgtctttaaacaatgagcaagagaaaataacaaaagagatacttctgaaaatgaaaagtgcaataacaagtggtcaaccaatagataaagcgcttcaagaatataaaaatatcttaggtgaggtaaccatactctttttaaaacttggaattgaaaatggaaatgtaaagcaatctttaaactcattgacacaactacttcaagaagatatgaaaataaaaacaaaatttaatgatgctttacgataccctaagttattaataggattccttatagtttcactttgtatgatttttatatatgtgtaccaaacttga

SEQ ID NO: 11214 - protein, 177 aa, Unknown
  Obtained from environmental sample
  DOMAIN (51)...(176): Bacterial type II secretion system protein F domain
  misc_feature (1)..(177): Xaa is any amino acid
MKYKITYQKDGKIEILKSDNLENLPNNIIKIQKSRVLPTFQLIQNNKKNILSMFEQLNIMLNANITLNEAIDLSLNNEQEKITKEILLKMKSAITSGQPIDKALQEYKNILGEVTILFLKLGIENGNVKQSLNSLTQLLQEDMKIKTKFNDALRYPKLLIGFLIVSLCMIFIYVYQT

SEQ ID NO: 11215 - DNA, 639 bp, Unknown
  Obtained from environmental sample
  misc_feature (1)..(639): n is a, c, g, or t
atggtcaggattcggctgagacagaaactattgattattaaagaacctaatatagtacaacaacaattaagtgtaaaaagtttatcagataaaattgtagtaaaaaacaataaagagattatggattatattgaaacgcaaatagctaaacacgatattttcgtacaagctatgacaacttcgaatcatactatttctttaaatataaatagttcatttgatccacttatagagtttttatatattttagaacaacacttaattatagaagagttctctttagataaggtagagcctaatagtaaaatgataaaaagtagagttgtatttttaagtgaatattttgtaaatccaactcaaaaagaaaaaatagtaaaaaatataaaaaatcctttttttcaagaaactaaaactattgtattaaaagaggaaaatacaataataaataagtcgcaatcaactatgctacaagttgatgctatagttacaaatgaagttttaattcaaggagactggtataaaaaaggggatgtttttcagaaaataaagattgttcaaattgagccaacggttgtaaaagttttacatcaagagacaaatacgatagaaatcataaggttagatattgatgaaaaatag

SEQ ID NO: 11216 - protein, 212 aa, Unknown
  Obtained from environmental sample
  misc_feature (1)..(212): Xaa is any amino acid
MVRIRLRQKLLIIKEPNIVQQQLSVKSLSDKIVVKNNKEIMDYIETQIAKHDIFVQAMTTSNHTISLNINSSFDPLIEFLYILEQHLIIEEFSLDKVEPNSKMIKSRVVFLSEYFVNPTQKEKIVKNIKNPFFQETKTIVLKEENTIINKSQSTMLQVDAIVTNEVLIQGDWYKKGDVFQKIKIVQIEPTVVKVLHQETNTIEIIRLDIDEK

SEQ ID NO: 11217 - DNA, 630 bp, Unknown
  Obtained from environmental sample
  misc_feature (1)..(630): n is a, c, g, or t
atggataaacgtacgattggaatgtggctttacacaaatagcggtggagcaaaaataggtaaaaaaatcattaaaaagttgaaagacagagatattgaaactattgataatatcaatcttagagatgcgattgcatacaacaaagatatcatctgtaatgatattaaacttaatgagttagacctatttttctcatataatgcgggtgagcagacactttatcaaatgtttctctatcgtgcgttaaaccgtgctatacctatgatcaacaattacgaagccttctctttaacagaagataaatttcaaacctcttatctactaagacaacatggcataaatactgccgaatatgaactttgtcacagagataacagtgctcatcttaaaaaaattatcaaacagtgggataagatggtatataaaccaactgatggttggggtggagtcggacttacaaaaatagagaacgaagcaagtttagatatgttaatgccctttttaaatcagatggatctgcgttttttctatgtagagaagtttatcaaatacgataacacagacttccgtgtagatattgtagatggtcaatttgtaagttgttatgggaagaaaagcaagtggatctga

SEQ ID NO: 11218 - protein, 209 aa, Unknown
  Obtained from environmental sample
  misc_feature (1)..(209): Xaa is any amino acid
MDKRTIGMWLYTNSGGAKIGKKIIKKLKDRDIETIDNINLRDAIAYNKDIICNDIKLNELDLFFSYNAGEQTLYQMFLYRALNRAIPMINNYEAFSLTEDKFQTSYLLRQHGINTAEYELCHRDNSAHLKKIIKQWDKMVYKPTDGWGGVGLTKIENEASLDMLMPFLNQMDLRFFYVEKFIKYDNTDFRVDIVDGQFVSCYGKKSKWI

SEQ ID NO: 11219 - DNA, 471 bp, Unknown
  Obtained from environmental sample
  misc_feature (1)..(471): n is a, c, g, or t
gtgggggcatattttggtaaaagaaaaaattctatggggggggagagggtattttttcatcagttggccagtaatattaaatttttgatgttaacccagaaccttggagagtggccagtagcaaaatggaactatcaagttaagtttccactaaagagcataaattttatgaaagtgtctgaaaaagatgcaatagatgctcctgttagcggtgatgaagcaactccagccataaaactatttaaaactgagataaaagagattctaatctccgtagatggtataggcaataaaaaagcaaaaagaattttagaaaactataataaaactgaactagtagagatattagatcaagagccttcactacttctgaatattaaaggcgtaacaggaaaaatagtagaaaaactatcaaaagtgtgggatgattttattaacaactacaacaacaaagaaggtaaagactcttaa

SEQ ID NO: 11220 - protein, 156 aa, Unknown
  Obtained from environmental sample
  misc_feature (1)..(156): Xaa is any amino acid
MGAYFGKRKNSMGGERVFFHQLASNIKFLMLTQNLGEWPVAKWNYQVKFPLKSINFMKVSEKDAIDAPVSGDEATPAIKLFKTEIKEILISVDGIGNKKAKRILENYNKTELVEILDQEPSLLLNIKGVTGKIVEKLSKVWDDFINNYNNKEGKDS

SEQ ID NO: 11221 - DNA, 711 bp, Unknown
  Obtained from environmental sample
  misc_feature (1)..(711): n is a, c, g, or t
gtgactgagaaagcacaaattccatcgttgtctttaccactaaaagttggtattgcatttgttccagaaagtgaagattatgatgaattttcttcattgacagaaagttataaaatgaagttactaaatgaggtatcagaacaatttaaacaatataagtatgtagagaatattgaagttattccttctgattacctacgtgcaaaaggaggatttaccaatcttgatcagattaaaacaatgtatgacattgatataatggtattggtttcatataaccaacatcaatttaccgatgaaggaattgcctctttagcttattggacaattattggtgcttatataatccctggtgaaaaaaatgatacacatactatggttgatactgttgtttatgatattaaaagtcgtaaattactttttagagctcctggagttagtcacattaaaggtgtatcaacaccagttaatctttctgaagagttaagaaaagacagtttgaaagggtttgatttagcaagtaaagaattagtgaaaaatttagatacacagctacagctttttaatgaaaaagttaaaagattaccaaaagagtaccatatcagtcataagaaaggttacacaggtggtggtagcattgatggaatattattggtatttatggcttttgcaggtggatatggattatggagtagaagacgtcaagattga

SEQ ID NO: 11222 - protein, 236 aa, Unknown
  Obtained from environmental sample
  misc_feature (1)..(236): Xaa is any amino acid
MTEKAQIPSLSLPLKVGIAFVPESEDYDEFSSLTESYKMKLLNEVSEQFKQYKYVENIEVIPSDYLRAKGGFTNLDQIKTMYDIDIMVLVSYNQHQFTDEGIASLAYWTIIGAYIIPGEKNDTHTMVDTVVYDIKSRKLLFRAPGVSHIKGVSTPVNLSEELRKDSLKGFDLASKELVKNLDTQLQLFNEKVKRLPKEYHISHKKGYTGGGSIDGILLVFMAFAGGYGLWSRRRQD

SEQ ID NO: 11223 - DNA, 711 bp, Unknown
  Obtained from environmental sample
  misc_feature (1)..(711): n is a, c, g, or t
atgaaaaatgagattacaccaaatataaaagatctttttttgaatctaaaagagcagatacttagtaaaaattttgttgaaataaaaaatggttttatgttagttgaggaaaaaataacaaatgtagctgaccaaatagcaggggcaaaaaatattaaaagtgatatctcaaatactttagaacaattaagaagtttcaatgttgctaaaacaccacagcaacaacagcttgtattacaaaatatatttaataacacacaagctatccagacaaaagtagatacacttccacaagcattatttgagaataatttaagtaaaacaacgaattttatgaatgatttgaaaataactgcttcaattatagaggagtatacaaaaaactcaaatgaaccaatttcaaaagagttaaaaactataattgataaaattaatacccaaatagacttttatcaactgttgtcttattcaacaaattcaacccatacttatctttcatttttacaagacgagatagaggactcagatataaggtttaataaaaataatgacaagagtttttcgtgtcaaatcaatttaagtttgaaaaaatatggggatttaaaaattttaatgatacttgataataaaagtaatattaatattaatataggactagaacaagaggagttaaatccttggacaagaaaattacactcgagccgatcctga

SEQ ID NO: 11224 - protein, 236 aa, Unknown
  Obtained from environmental sample
  misc_feature (1)..(236): Xaa is any amino acid
MKNEITPNIKDLFLNLKEQILSKNFVEIKNGFMLVEEKITNVADQIAGAKNIKSDISNTLEQLRSFNVAKTPQQQQLVLQNIFNNTQAIQTKVDTLPQALFENNLSKTTNFMNDLKITASIIEEYTKNSNEPISKELKTIIDKINTQIDFYQLLSYSTNSTHTYLSFLQDEIEDSDIRFNKNNDKSFSCQINLSLKKYGDLKILMILDNKSNININIGLEQEELNPWTRKLHSSRS

SEQ ID NO: 11225 - DNA, 600 bp, Unknown
  Obtained from environmental sample
  misc_feature (1)..(600): n is a, c, g, or t
atgtatttcaaaaaattagcgttaagccattggcagcaatttgaaaaaattgacattgatgtacatgatagattaacgattgttaccggggctaatggatgtgggaaaacaactttaatgaatttatttgcaaggcattgtggttggcagcatcattctttatctactccaaaaaaagataaaggaactggggtgataaagtatttttctagattattcaatggtcaaaatgaaatttctaaaaatagcattggtgaaattttctattcgaatgacactaatagtgacctgttggttggagaaacaaaagctgctcagtatcaaattcaaataaatgggcaacagccggtaaagagcttctatatcccttcacatagatcaatatttagataccaaccccttggaaatatcccaacagctaaaaaaaataaacaaaacgcatttactgaagtagacaatgtaaataagcaaagatatacgggcggacataacccccagtccgctagtttattgatgaaatctacacttattgggttggctataaacggttatggtgtgtcaagcaataaaaaaaaaataattatgcaaaatggacgttga

SEQ ID NO: 11226 - protein, 199 aa, Unknown
  Obtained from environmental sample
  misc_feature (1)..(199): Xaa is any amino acid
MYFKKLALSHWQQFEKIDIDVHDRLTIVTGANGCGKTTLMNLFARHCGWQHHSLSTPKKDKGTGVIKYFSRLFNGQNEISKNSIGEIFYSNDTNSDLLVGETKAAQYQIQINGQQPVKSFYIPSHRSIFRYQPLGNIPTAKKNKQNAFTEVDNVNKQRYTGGHNPQSASLLMKSTLIGLAINGYGVSSNKKKIIMQNGR

SEQ ID NO: 11227 - DNA, 486 bp, Unknown
  Obtained from environmental sample
  misc_feature (1)..(486): n is a, c, g, or t
ttgaaaattgaaaaactaataataaacattaaaacactagatatgaaaatgagcatccaacttactccgttaaaacaagcaataatagcttcaatcatcgccattttattattgtttgctactaacaaacttagagcacagtcggtaactactaaagttacttttgaggcagctccagaatatgtagtaaaacaatttacggcaaagcatattcagaataagttttactttaagtttttaatacaagaaaacagagaagatgttgcttatgtattagaatcatctactgatggggttaattttagtgaggtaactaataaagagggtgttaaatctcctaacaatcagccattattatactgttacattgttgatgctgaagctataggcgatagaatttttagagttaaaatgatatcaaacgaagagcttaccttatcctctttaataaacttttcttcacaaacccccgaactttggtattaa

SEQ ID NO: 11228 - protein, 161 aa, Unknown
  Obtained from environmental sample
  misc_feature (1)..(161): Xaa is any amino acid
MKIEKLIINIKTLDMKMSIQLTPLKQAIIASIIAILLLFATNKLRAQSVTTKVTFEAAPEYVVKQFTAKHIQNKFYFKFLIQENREDVAYVLESSTDGVNFSEVTNKEGVKSPNNQPLLYCYIVDAEAIGDRIFRVKMISNEELTLSSLINFSSQTPELWY

SEQ ID NO: 11229 - DNA, 579 bp, Unknown
  Obtained from environmental sample
  misc_feature (1)..(579): n is a, c, g, or t
atgattgcttttggttttatttttgttacattttttattattatttctattggtattcggattactcaaaaatggattaaaacagaaaaagaagttgaaaatctgaaacgttcaaaacttcatagcgaatataatgctcttcaagaccaattgaatccacactttttatttaataatcttagtgtattaaaatcgatgataatttacgatgctgattctgcggttgatttcacccaaaatttcactgatgtttatcgctatgtacttcaatgcaaaggaaaaacaacagtaacattaagcaacgaacttgaatttatacaatcatatttaagtcttcataaagaacgctttggtgaaggcttaaatattaaaatttcagctcaaaaagaattactgaaaaaactaattccgccactttccttacaacttttggttgaaaatgcaattaagcataatgtcgcaactaaatcggaacctttaacaattgaagttattgctaatgaagataaaatttgggttgaaaacaatttacaaccaaaagaaacgtcattttcaacaaaaacaggcttcaaaacctaa

SEQ ID NO: 11230 - protein, 192 aa, Unknown
  Obtained from environmental sample
  DOMAIN (43)...(126): Histidine kinase
  misc_feature (1)..(192): Xaa is any amino acid
MIAFGFIFVTFFIIISIGIRITQKWIKTEKEVENLKRSKLHSEYNALQDQLNPHFLFNNLSVLKSMIIYDADSAVDFTQNFTDVYRYVLQCKGKTTVTLSNELEFIQSYLSLHKERFGEGLNIKISAQKELLKKLIPPLSLQLLVENAIKHNVATKSEPLTIEVIANEDKIWVENNLQPKETSFSTKTGFKT

SEQ ID NO: 11231 - DNA, 693 bp, Unknown
  Obtained from environmental sample
  misc_feature (1)..(693): n is a, c, g, or t
atggagagggacaacctaaaatctgagagttgtgattgttttgctacctttgtaaatagacttggtgatgtaaaatatgaaaagctagataaaaaacttcaaagtagtaaagaaaatacatatctatttaaagagataccggagttagatctcttaactgttcaggatgttatagaaggtgtagaagctaaagctattttacttggagaaaaagatcatacaagagttataagagggataaaagtagcggcacttactcttgataattttttagattatatagaagaagatgacctaataattgttccggctgatagatcagatattatacttggactatttggtgcactatattctaaaaactttccaaatataagtgcaatagtatttccatttagtatgagagcacatccaaatataaaaaaacttgttgaaggattggatagctttaatatccctgtcttatctgttccaactgatacttatcaaacagcaaaattactctcgaaagtaaatgctagactacgagttacaagtgagagaaagatatcgttagcacttggactttttcactcaaatgtggatatagaactgatagagaaaaaaatatcaactgctaaaacaaatgttgtaactccgatgatgtttgagtataaactttttgaacttgcaagactaaataaaaacgaatag

SEQ ID NO: 11232 - protein, 230 aa, Unknown
  Obtained from environmental sample
  DOMAIN (56)...(171): DRTGG domain
  misc_feature (1)..(230): Xaa is any amino acid
MERDNLKSESCDCFATFVNRLGDVKYEKLDKKLQSSKENTYLFKEIPELDLLTVQDVIEGVEAKAILLGEKDHTRVIRGIKVAALTLDNFLDYIEEDDLIIVPADRSDIILGLFGALYSKNFPNISAIVFPFSMRAHPNIKKLVEGLDSFNIPVLSVPTDTYQTAKLLSKVNARLRVTSERKISLALGLFHSNVDIELIEKKISTAKTNVVTPMMFEYKLFELARLNKNE

SEQ ID NO: 11233 - DNA, 828 bp, Unknown
  Obtained from environmental sample
  misc_feature (1)..(828): n is a, c, g, or t
gtgaaaaaaatgttaggaactgcaaaaaaagctcttagcggtgaagagcttgctaaaaagctgctcatgatgagagtagacctactctttaacggtggtgtcggaacttatgttaaaagtgtagatgagagtaatctagaccttggcgataaacaaaatgaagctgtcagactagatgcacatgaacttaatgccagagtggtaagtgagggtggaaacttaggttttacacaaagagccagaattgagtatgcacaagcaggtgggaaaataaatattgatggaattgataatgcagcaggtgttgacacatctgaccatgaagtaaatttaaaaatcttactaaatattatccgatcaaaaggtcttttatgcaaagaagatgcagataaaactcttcaaggattaacagatcaggtggtaaacttagttctatggagtaactaccatcaagctcttgccatatctaaagacagctacttaagtacgaagtatcaaaatgattttataacaacaattgaggtacttgaaaatagtgagttaggttttaatagaagagatttctatattcctaaaaatgagaatataaatgaaattttggcacctgatggctcaatagtacgccctgttttatgttcacttctatcatactcaaaaatatttattaaaactttactattaaagtcctctcttatagatgaaacatttgcaacacagtttttatataaatattttccaaaatcatttgtcagtgcttatgagcatgatataataaatcatccccttcatcgtgaaataatagccacggtatttgcgatatgttcgtaa

SEQ ID NO: 11234 - protein, 275 aa, Unknown
  Obtained from environmental sample
  misc_feature (1)..(275): Xaa is any amino acid
MKKMLGTAKKALSGEELAKKLLMMRVDLLFNGGVGTYVKSVDESNLDLGDKQNEAVRLDAHELNARVVSEGGNLGFTQRARIEYAQAGGKINIDGIDNAAGVDTSDHEVNLKILLNIIRSKGLLCKEDADKTLQGLTDQVVNLVLWSNYHQALAISKDSYLSTKYQNDFITTIEVLENSELGFNRRDFYIPKNENINEILAPDGSIVRPVLCSLLSYSKIFIKTLLLKSSLIDETFATQFLYKYFPKSFVSAYEHDIINHPLHREIIATVFAICS

SEQ ID NO: 11235 - DNA, 606 bp, Unknown
  Obtained from environmental sample
  misc_feature (1)..(606): n is a, c, g, or t
ttgaagttagatcgtaaaaaaaagattagcaaaaaagcacttgcatctttaggtcaacctgttttgatgagtagttacaaaaagaaatttgatatatatgatattacaacatctcaaattttactgacagaagaggattttgactctagaaaaagaacagctatctttcaagagatcatgaacacactgctttcaaattcaatcattcctatcgttaacgagaatgatatttcaacaacatctgagcaagtttttggagacaatgaccaactctcagcccatgtttctcattttacaggtgcagatctgttggtaattcttagtgatatagatggatattatgataaaaatcctaatgagaataaagatgcaaaaatattaaaagaggtaaatgaaatacctcaagaacttttaaatgcagatcacacaccaactaatgcatttgcaacaggaggaattgttacaaagctaatggctgcaaaatttcttctagatcgaaataaaaagatgtttttatgtaatggatatgacctaagcagtgctgaagagtatcttttacatcaaaatcatacactaggtacaatttttcaaaaaaaagttaaataa

SEQ ID NO: 11236 - protein, 201 aa, Unknown
  Obtained from environmental sample
  DOMAIN (1)...(174): Amino acid kinase family
  misc_feature (1)..(201): Xaa is any amino acid
MKLDRKKKISKKALASLGQPVLMSSYKKKFDIYDITTSQILLTEEDFDSRKRTAIFQEIMNTLLSNSIIPIVNENDISTTSEQVFGDNDQLSAHVSHFTGADLLVILSDIDGYYDKNPNENKDAKILKEVNEIPQELLNADHTPTNAFATGGIVTKLMAAKFLLDRNKKMFLCNGYDLSSAEEYLLHQNHTLGTIFQKKVK

SEQ ID NO: 11237 - DNA, 543 bp, Unknown
  Obtained from environmental sample
  misc_feature (1)..(543): n is a, c, g, or t
gtgattcgtcattattgttatacaagtgttgaagatgaatttgcagaaaaaagaatagattcagatgtgttttttggaaatttgataaaagatttgttagataaagtaccatcactacaaaagattaagacaaattttgtatcagatttaggagaattgaactttttactttttcatgtaaaagaaccactggttatagtaatagatggattagaccacattgatagactattaaaaaattctaaacaattatctattgaaaaaactagaattatcgactttatttctaagataaagttacctagtaatgtttctataattttaggtagtcaacctataattgaattaaaagaacttactgataaacactcatataaaagatataatattcttaaatggacaggagaagaaacattatcattaatgagtaaatattcattaaaagatagaataattgatcacataatgctttctcaacatattcttaataaaagtgaaggaaactctctttatacaacttatattttaaaaaaactaatttga

SEQ ID NO: 11238 - protein, 180 aa, Unknown
  Obtained from environmental sample
  misc_feature (1)..(180): Xaa is any amino acid
MIRHYCYTSVEDEFAEKRIDSDVFFGNLIKDLLDKVPSLQKIKTNFVSDLGELNFLLFHVKEPLVIVIDGLDHIDRLLKNSKQLSIEKTRIIDFISKIKLPSNVSIILGSQPIIELKELTDKHSYKRYNILKWTGEETLSLMSKYSLKDRIIDHIMLSQHILNKSEGNSLYTTYILKKLI

SEQ ID NO: 11239 - DNA, 336 bp, Unknown
  Obtained from environmental sample
  misc_feature (1)..(336): n is a, c, g, or t
ttggagattatatttttccatagacatataaatattgataaactatatgatgaggttaaacaaaaatttgactcaatatctttagctactatttataaaaatataaatgctatgactaaaaatatgttattacaagagattaagctaccaaacgagaaaagtgtatatgagatgataaaagaggagcattcacatcttttatgtaataaatgcggagaagttatcgatatacaagttgagactaaagatattactaaagatatagaaaaaaaatatgattttactatatctcaaagtgatgttgtactttccggtacttgtaaaaaatgtcactaa

SEQ ID NO: 11240 - protein, 111 aa, Unknown
  Obtained from environmental sample
  DOMAIN (8)...(104): Ferric uptake regulator family
  misc_feature (1)..(111): Xaa is any amino acid
MEIIFFHRHINIDKLYDEVKQKFDSISLATIYKNINAMTKNMLLQEIKLPNEKSVYEMIKEEHSHLLCNKCGEVIDIQVETKDITKDIEKKYDFTISQSDVVLSGTCKKCH

SEQ ID NO: 11241 - DNA, 816 bp, Unknown
  Obtained from environmental sample
  misc_feature (1)..(816): n is a, c, g, or t
atgatccaacaaatcgccaaggcgcgtaacgacatcaagttcgggcaccaacaaaccgaaatgcaaaagctgtacctgcaagcgattatcaaaaacctcaacagcggggtcatcactttcgacatgaacctgcgcctgaaaaccattaacgacgccaccaacagcattctcaacaccgatcttttccgccagctcggcaagccgttggacgaagtcctcaaacaacccgatacccaacgtctcaaaccgtttttcgacgcgatttttccattattcaaaagcgaatccaaaccttggagcgaacaattcaccttcgactgcaaagaagggcaaaaaatattattggtacacggttcgacattgcccagtctggatcaaaaggtcggcggctttgttatcgttatcgaagacatcacccaactggttcaggcgcaactgcatgccgcctggagcgatgtcgcacaacgcctggcccatgaaatcaaaaacccgctgacaccaatccagctctcggccgaacgtttaaactacaagctctccaacaagctcgagccatcggatcaaaaattgttaaatcgcatgaccgacaccattatcgaacaggtgaccaccatgcaaaacctggtacaggcctttactgaatacgccgacaccccggaaatcgaactgcatcaagtcaacctcaacacgctggtcaaagacgtcgtcagcatgtaccagaccccgaaagtcacctggaaagtcaattacgatattgactcggattgtccgatcatcacggccgatgcgtctaaactgcgacagcctattgcataa

SEQ ID NO: 11242 - protein, 271 aa, Unknown
  Obtained from environmental sample
  DOMAIN (149)...(221): His Kinase A (phosphoacceptor) domain
  misc_feature (1)..(271): Xaa is any amino acid
MIQQIAKARNDIKFGHQQTEMQKLYLQAIIKNLNSGVITFDMNLRLKTINDATNSILNTDLFRQLGKPLDEVLKQPDTQRLKPFFDAIFPLFKSESKPWSEQFTFDCKEGQKILLVHGSTLPSLDQKVGGFVIVIEDITQLVQAQLHAAWSDVAQRLAHEIKNPLTPIQLSAERLNYKLSNKLEPSDQKLLNRMTDTIIEQVTTMQNLVQAFTEYADTPEIELHQVNLNTLVKDVVSMYQTPKVTWKVNYDIDSDCPIITADASKLRQPIA

SEQ ID NO: 11243 - DNA, 939 bp, Unknown
  Obtained from environmental sample
  misc_feature (1)..(939): n is a, c, g, or t
atgtttacattaaataaatttcataacaaagaaagattattgaatagtaaaaagagaataatatttcctttaaaagatgaaataaataaaaaaatagagttaaaacaaccctttgctgtatataaacaatatacaaataatgtaaatgtagttacttttttaccaattgataatgtacgagaagagaaagctgtagcttatttggtatcttatgataaagatccatatatttatgatatatatagaagttattctattataaatatagtattatttgtaggtttggcaacactattttactttatctatagaaatttaaattataaaaaagagctagaggaagaggtctctataaaaacgaaagatctacaaaaagttagtaaaaacctaaaagatttaaatgaaaatttagaacaaaaaatagtttttgaagttgaaaaaagtaaagctatggagagcaaactattccagtctgaaaaaatggcctctatgggagaaatgataggaaatatagcacatcaatggagacaaccactttctgtaatatctacaggtgtaacaggtatgaagatgcaaaaagagtatgatttattaactgatgatatttttaatgatacttgtgatgtgattaataaaaatgcacagtatctctctacaacaatagatgattttagaaactatattaaaggggatagagagaaaaaagtttttaatctcaaaaaagatattaatagttttatccatcttgtagagggttcaattcataaatataatataaatatagttttggatttagatgaatctatagagattaatggatatgaaaatggacttacccagtgttttatcaatattttcaataatgctaaagatgttttagtagagatagaaaataattctgaacgaaatttgtttatttctccaaattttgaaaaatga

SEQ ID NO: 11244 - protein, 312 aa, Unknown
  Obtained from environmental sample
  DOMAIN (163)...(233): His Kinase A (phosphoacceptor) domain
  misc_feature (1)..(312): Xaa is any amino acid
MFTLNKFHNKERLLNSKKRIIFPLKDEINKKIELKQPFAVYKQYTNNVNVVTFLPIDNVREEKAVAYLVSYDKDPYIYDIYRSYSIINIVLFVGLATLFYFIYRNLNYKKELEEEVSIKTKDLQKVSKNLKDLNENLEQKIVFEVEKSKAMESKLFQSEKMASMGEMIGNIAHQWRQPLSVISTGVTGMKMQKEYDLLTDDIFNDTCDVINKNAQYLSTTIDDFRNYIKGDREKKVFNLKKDINSFIHLVEGSIHKYNINIVLDLDESIEINGYENGLTQCFINIFNNAKDVLVEIENNSERNLFISPNFEK

SEQ ID NO: 11245 - DNA, 351 bp, Unknown
  Obtained from environmental sample
  misc_feature (1)..(351): n is a, c, g, or t
ttgaaaaattcattttcaagttcaatcacaagatttcaacacgctttaaacaagcagtttataaatattagtaatgcaaacaatatgttttctcaaaaaaacaaaaaccaattaaatacttttaagttaaaattgcaaaatacatcacaaacatttttaaacaagcaaacatataaattaaaattattagaaaaaaccagtataaatattgacccaataaatattatgaaaagaggttatacaataacccgaaaaaacgggaaacttatacgtagcttttccgaactacaagaaaatgatgtaattgaaacaattttaaaagatggtagtgttaaaagtaaagttcaataa

SEQ ID NO: 11246 - protein, 116 aa, Unknown
  Obtained from environmental sample
  misc_feature (1)..(116): Xaa is any amino acid
MKNSFSSSITRFQHALNKQFINISNANNMFSQKNKNQLNTFKLKLQNTSQTFLNKQTYKLKLLEKTSINIDPINIMKRGYTITRKNGKLIRSFSELQENDVIETILKDGSVKSKVQ

SEQ ID NO: 11247 - DNA, 438 bp, Unknown
  Obtained from environmental sample
  misc_feature (1)..(438): n is a, c, g, or t
atgaaaggaagaaatattaaagaaattcttaaaattattatagataaattagaaaataaaaaaatcatctggcggatagaaggaagtgcgaatctcataatacaaggagttgaaacttcagttagcgacctagatataacaacaaatgacgagggaatagagatctttaaagaaactctaaaggatttcattgaaaaagatttttttaatgaaaagataaatgggaaatcattgatttgtgatataaatggatttgaagtagaggttaattcttatggggacaaagaaaaagatttttttagtgaaattagaacaattgaatggaataccttagaagttcccattctgcctttaaaatatgctttggaattttataaattaattaacagggatgaaaaagttaaattaatccaaagttatctagctgtccactcctaa

SEQ ID NO: 11248 - protein, 145 aa, Unknown
  Obtained from environmental sample
  misc_feature (1)..(145): Xaa is any amino acid
MKGRNIKEILKIIIDKLENKKIIWRIEGSANLIIQGVETSVSDLDITTNDEGIEIFKETLKDFIEKDFFNEKINGKSLICDINGFEVEVNSYGDKEKDFFSEIRTIEWNTLEVPILPLKYALEFYKLINRDEKVKLIQSYLAVHS

SEQ ID NO: 11249 - DNA, 303 bp, Unknown
  Obtained from environmental sample
  misc_feature (1)..(303): n is a, c, g, or t
atggaaagccatttaaagagaaaattatacattttcccaaatctaccaccctatttaaaagctggggatgaaatgttagccaaacgtgaacacatctcattagttattgataattatggtggaatggacggtataactacccttgaagatattatagaatcattattaggttttgagattattgacgaaaaagacaaggttgataatatgcaaaaatacgcgttagacagatggaaaagcaaacaaaaaaaatacgatttgctaaaggatgcgaggaaaaaagatgaaaacaagaattcataa

SEQ ID NO: 11250 - protein, 100 aa, Unknown
  Obtained from environmental sample
  misc_feature (1)..(100): Xaa is any amino acid
MESHLKRKLYIFPNLPPYLKAGDEMLAKREHISLVIDNYGGMDGITTLEDIIESLLGFEIIDEKDKVDNMQKYALDRWKSKQKKYDLLKDARKKDENKNS

SEQ ID NO: 11251 - DNA, 873 bp, Unknown
  Obtained from environmental sample
  misc_feature (1)..(873): n is a, c, g, or t
atggcacatattatgagtatgaaagttatagcagaaggtgtagaaataaaagaggagtatctcacttgtaaagatattggtgtggatttagtacaaggatatcttatccaaaaacctaaaacagatatcacaaaaattaaagggaaatatcaccacataaatgaactttataaaaatgaccaaagaagttacacaacaaatattgttgataaaagtaaaatagaatttattgaacctcttaaacttgacactactttaaatgacctctttgaatattttaaaaatcatccaactaatacttttgtacctatagttgataaaattggtcaactctacggtgtgatttatgaaaaagatattaaagaactctcctactctcaatttggcgtatcgttggcaaaaaatgataaaactaataataaattaaaaaagtttatcaaagatactatctcttctgaaatcacatggggagtggataaaattttagagatatataatatggataaaaatagttcttatggtatttttataacaaaaaatagtcaatactatggctttatcgatgtgaataatcttctttctatctcttatcatagaaatatagagatagctaaagatcaaaatcctctcactaaacttccaggtaatagacaaattgaactttttattactgatgctttacaatgtgttgtcgataaaacatatcacatagtatattttgattttaatgatttcaaaccctttaatgatatctatggtttcagaccaggcgatagagcgataattctttttactgatatatttaaaaaagagttaactaaagatcactttatagctcatattggtggtgatgactttttcatcggattttaa

SEQ ID NO: 11252 - protein, 290 aa, Unknown
  Obtained from environmental sample
  misc_feature (1)..(290): Xaa is any amino acid
MAHIMSMKVIAEGVEIKEEYLTCKDIGVDLVQGYLIQKPKTDITKIKGKYHHINELYKNDQRSYTTNIVDKSKIEFIEPLKLDTTLNDLFEYFKNHPTNTFVPIVDKIGQLYGVIYEKDIKELSYSQFGVSLAKNDKTNNKLKKFIKDTISSEITWGVDKILEIYNMDKNSSYGIFITKNSQYYGFIDVNNLLSISYHRNIEIAKDQNPLTKLPGNRQIELFITDALQCVVDKTYHIVYFDFNDFKPFNDIYGFRPGDRAIILFTDIFKKELTKDHFIAHIGGDDFFIGF

SEQ ID NO: 11253 - DNA, 513 bp, Unknown
  Obtained from environmental sample
  misc_feature (1)..(513): n is a, c, g, or t
atgaaaaatatattctttttttctatactcctttttttatcttttacaggaaaggctaattctaacgaactggatcaatcaccatggcacattgttgctaccgatcaggcaaattataacggtattgccctttcaaatggaagaatcggcatcataccttctaaatctccttttaaaactgaatcaataattttaaacaacgtttatgaaaaaagttcgaaattcagagtaagcagattgctgaaaggaatcaactttgctaacttaggaatagtaattgatggtgatacggttgatgcatcgaacatttctaattggaaacaagtgctgaatttaaaagaagcttttctgaccacttcgttccaatttaaagggaaagctgaaattgaatattcgatttttgcattaagaggcatgccctatgccggtttgattgatgttaccattaaagcacttgacaaaaatataaagatttcagtatctggggaaatatcgtggcccttcctcgtataa

SEQ ID NO: 11254 - protein, 170 aa, Unknown
  Obtained from environmental sample
  SIGNAL (1)...(19)
  misc_feature (1)..(170): Xaa is any amino acid
MKNIFFFSILLFLSFTGKANSNELDQSPWHIVATDQANYNGIALSNGRIGIIPSKSPFKTESIILNNVYEKSSKFRVSRLLKGINFANLGIVIDGDTVDASNISNWKQVLNLKEAFLTTSFQFKGKAEIEYSIFALRGMPYAGLIDVTIKALDKNIKISVSGEISWPFLV

SEQ ID NO: 11255 - DNA, 828 bp, Unknown
  Obtained from environmental sample
  misc_feature (1)..(828): n is a, c, g, or t
atgattgatatagtaaatgaatttatttcaaatattgcttatacttataatcaacctacaatgtcaaatatatctagaaattttagaaaagaaacagatgtagattatcatatttatttatttattattaacatgatgaaaactaaaaataaaagtttaaatttttttaataatttcaaaataatttcaaataatccctatagggaatatattattaataaagagtatgaaaatataaatatgattgataatcttgatgaggatggatttaccgatttactctcaaatatagataatttaattgaatgtaaaaaaaataaaaataaacttgcaaaaaagttatctaatgatatttcatcatttttacctaatgaagtattaattgaacatattgaagatacatatgataatccagagaatagatttataaaattttttcttttaaaatgtattcatattttagaattatttcaagttaaatttaaaaatcaaaaaaaacaaatattaaatctaaatttaattaatgaaaatgaattttatattaaaaaattaaataatttattaactttttcatatttaaaatatgtcaatgatattaatattattccaatgcagtcaactattttgacaagaaaagatggatatagaaatttatttagcttttatcttggtttaaagtcaatgccaactaatatacttaatgatactaatttagaagaattaattgaaaataagtcagtagatgtgatttatgaaattttttgttttttttctatagaaaatattttgtcaaatatataccaagtggattccaagccatttaaataa

SEQ ID NO: 11256 - protein, 275 aa, Unknown
  Obtained from environmental sample
  misc_feature (1)..(275): Xaa is any amino acid
MIDIVNEFISNIAYTYNQPTMSNISRNFRKETDVDYHIYLFIINMMKTKNKSLNFFNNFKIISNNPYREYIINKEYENINMIDNLDEDGFTDLLSNIDNLIECKKNKNKLAKKLSNDISSFLPNEVLIEHIEDTYDNPENRFIKFFLLKCIHILELFQVKFKNQKKQILNLNLINENEFYIKKLNNLLTFSYLKYVNDINIIPMQSTILTRKDGYRNLFSFYLGLKSMPTNILNDTNLEELIENKSVDVIYEIFCFFSIENILSNIYQVDSKPFK

SEQ ID NO: 11257 - DNA, 522 bp, Unknown
  Obtained from environmental sample
  misc_feature (1)..(522): n is a, c, g, or t
atgaaagagggtaatttgagcacaagtgttatttcaataaaggaccttaagaaagtattcggaactttaacggcagtagatgctatcaattttgatgtgaatcagggcgagattttcgcactccttggaccaaatggatcaggcaaaaccaccacaattagaatgctcatggggttgctaaaacccaccagtgggactgcaaaaatttgtggctacgattgcttcgcagatagtgtcgaagtcaaaagtcacgtcggttatcttcctgatgaaccaattttctacgattaccttagagggattgagataatcaggttcgttggacaaatgcacggagttcctgttgagacaattaacaaaaaagcgtttgctattgcagatggggttgatcttacagatgctcgtggggattatgctgaaaacctcccaaggggaatgaaaaaaaagcctcccactaatttgtgcaatgtggcaagaaccaaaacctgcttaattcttgaaaagacccacaaagggacttga

SEQ ID NO: 11258 - protein, 173 aa, Unknown
  Obtained from environmental sample
  DOMAIN (36)...(172): ABC transporter
  misc_feature (1)..(173): Xaa is any amino acid
MKEGNLSTSVISIKDLKKVFGTLTAVDAINFDVNQGEIFALLGPNGSGKTTTIRMLMGLLKPTSGTAKICGYDCFADSVEVKSHVGYLPDEPIFYDYLRGIEIIRFVGQMHGVPVETINKKAFAIADGVDLTDARGDYAENLPRGMKKKPPTNLCNVARTKTCLILEKTHKGT

SEQ ID NO: 11259 - DNA, 345 bp, Unknown
  Obtained from environmental sample
  misc_feature (1)..(345): n is a, c, g, or t
ttgttctttaaagttactataaaacttgattatgaaaagctatttgatttagatagtccggattatgctaaattatttaatgaatttttagaaagcattaaagatgaaattattaaaaagaaaaaaattttgggacaggatattacaggtgctattttaaatttaattttaaaaaaatcaagttttgaatttgtcaaacaaagaactttcgttaaatttacaaaagaaagaaaagcaaaaatgagaacattagttccaaatgtttgtatactgacagttaagaatcccgaaaaaaacattattaaagattcaattaccacgataattaaaaaaaacatacgatga

SEQ ID NO: 11260 - protein, 114 aa, Unknown
  Obtained from environmental sample
  misc_feature (1)..(114): Xaa is any amino acid
MFFKVTIKLDYEKLFDLDSPDYAKLFNEFLESIKDEIIKKKKILGQDITGAILNLILKKSSFEFVKQRTFVKFTKERKAKMRTLVPNVCILTVKNPEKNIIKDSITTIIKKNIR

SEQ ID NO: 11261 - DNA, 459 bp, Unknown
  Obtained from environmental sample
  misc_feature (1)..(459): n is a, c, g, or t
atgactaagctcgataagaacatgaaaatcgtcattattgcaggcggtatgtcagatgaaagaagcgtaagcctggaaacaggaaagatgatgtacgaggctgttattaagggtggctataaaaacactcaatttatagatgttgattttaatcttgatatcgttttaagagaatttgaacctgatgtggtaataaacggactgcatggtaaatatggagaggatggaactgttcagggtcttcttgaaatgcttcagatcccttataccaattcgggcgttagtgccagtgctttcggtatggacaagtttgttgcaagagctgttatgaaagagctggggattaaaatagcagaaggaacttgtctgaccattaactctttggtaaagcctccttttgattttccgcttgttcttaaagatcctcttaatggttccagcagaggaatctatgaataa

SEQ ID NO: 11262 - protein, 152 aa, Unknown
  Obtained from environmental sample
  DOMAIN (8)...(101): D-ala D-ala ligase N-terminus
  misc_feature (1)..(152): Xaa is any amino acid
MTKLDKNMKIVIIAGGMSDERSVSLETGKMMYEAVIKGGYKNTQFIDVDFNLDIVLREFEPDVVINGLHGKYGEDGTVQGLLEMLQIPYTNSGVSASAFGMDKFVARAVMKELGIKIAEGTCLTINSLVKPPFDFPLVLKDPLNGSSRGIYE

SEQ ID NO: 11263 - DNA, 744 bp, Unknown
  Obtained from environmental sample
  misc_feature (1)..(744): n is a, c, g, or t
ttggctgagcgttatgcagttagggaggagaatatggatagagataaagttacgacgaagtacattcttcttattacaggtattgatagtacgcgtagattaaaaatggctattgcttttgcaatggttttaagaacaaaaggaattatgtctctcttaactcttgcaggtgatgctgtttcggcgaaaaagaagatggaggagtttggatacgaagttgtttcatgtgaaagtaaaaaaaagaagagaggtctgatggatattcttcttggatccttcaaatacaaatctttcgtgaaaaaggccgaaaagattctttcacttaaaacagttaaaggtgtcattactatgggtggagcttgtggaatcccgtttattgaggctgccaaacagaaaggaataaaaacatttctgcatgaatcgaatgctatactttcaccctccaatgtgaaaatagttaatactgtagataaaatatttttatcatttaaagagcttggaagtggattggatcctaaaaaagtcgaggttacaggaactccaatagaaaaaagacttctaaacgctgaaccaaggaaaattccaactgacaaaaaaataatggttgttttcaagtgtgataagaattcaaatacgatgaatgatctcattagagctctttttaaaaagtatcccggaaatggagaagggaattctttgtgccttcaggaaaaccggagaataaagaacgtggccaagtattaa

SEQ ID NO: 11264 - protein, 247 aa, Unknown
  Obtained from environmental sample
  DOMAIN (23)...(161): Glycosyltransferase family 28 N-terminal domain
  misc_feature (1)..(247): Xaa is any amino acid
MAERYAVREENMDRDKVTTKYILLITGIDSTRRLKMAIAFAMVLRTKGIMSLLTLAGDAVSAKKKMEEFGYEVVSCESKKKKRGLMDILLGSFKYKSFVKKAEKILSLKTVKGVITMGGACGIPFIEAAKQKGIKTFLHESNAILSPSNVKIVNTVDKIFLSFKELGSGLDPKKVEVTGTPIEKRLLNAEPRKIPTDKKIMVVFKCDKNSNTMNDLIRALFKKYPGNGEGNSLCLQENRRIKNVAKY

SEQ ID NO: 11265 - DNA, 849 bp, Unknown
  Obtained from environmental sample
  misc_feature (1)..(849): n is a, c, g, or t
ttggttggcggggtgcggtttacagctttaattgcggaaagacttaccagtgatgatttggtgaacccaagccactatgataaactattaactcaaatggagtctgatggaattgtagagcctaatattgaaataatattaagtcaaattagagcattaaaacaagttgcaggaaaaggaacagtaaagggatttacagagaaagatttaatcgaaattgacgaactcatttgtaaaacaatttcagaagtagttgacaagcttttgccaaatcttgaaacgccatatcacggtttagccgcatgggcaaaagcattagacagagacaagcctattcatattttcacaacaaactatgacctgttaacagaacaagcattggaagaagaaggctgcttatattttgatgggtttatcggtgcaagaaaagccttctttgatttaggtgcagttgaggatgaaaaaatacttcatccgagatgggcaagactttggaagattcacggttcaataaattggagattagatactaataaaaatatcattagaacttatgagaaagatgaaaagcaaagctatttaatttatccttcgcatttgaaatatgaccaaagcagaaaaatgccttaccttgcaatgcttgacaggcttaaagattttataatgtctccttcttctgctttgtttattgtaggttattcttttagtgatgaccacatcaacgacataattttacaaagtcttcgtagcaatccaactgcaattatttattcatttattttccgggagttagaacagcccaaatatgaaaaagccatttcttgggccaagttaacaaacaatctttag

SEQ ID NO: 11266 - protein, 282 aa, Unknown
  Obtained from environmental sample
  misc_feature (1)..(282): Xaa is any amino acid
MVGGVRFTALIAERLTSDDLVNPSHYDKLLTQMESDGIVEPNIEIILSQIRALKQVAGKGTVKGFTEKDLIEIDELICKTISEVVDKLLPNLETPYHGLAAWAKALDRDKPIHIFTTNYDLLTEQALEEEGCLYFDGFIGARKAFFDLGAVEDEKILHPRWARLWKIHGSINWRLDTNKNIIRTYEKDEKQSYLIYPSHLKYDQSRKMPYLAMLDRLKDFIMSPSSALFIVGYSFSDDHINDIILQSLRSNPTAIIYSFIFRELEQPKYEKAISWAKLTNNL

SEQ ID NO: 11267 - DNA, 636 bp, Unknown
  Obtained from environmental sample
  misc_feature (1)..(636): n is a, c, g, or t
atgaacaaggaagaagaaaaatactatcttgaacgattcttcaaattcttcgaatcagaagaatctcctttattttgtcgagagagacctgacttttcagtaaaattcgacaaccaatctattggcatagaagtaacagaatttcatactttcgacggatccagcgcccaaaatggaaaaaggaaagaacaaagaagaaaaaattttataaaaatattaaaaaacaaattagacgatttaaaaattaaatcaaagatatccattacatttaacgataatgcacaggaattcaaaacagaagaaaatattacctcaaccataagactgatagaaaatgtaatatcaggagaattaactacatttaatgggaacatatcacgcgaaattattgacgaaaattttattaaaaatattcacattatcccccatcatgaattggatattaatcacattcaaggttacgatatagaaccagatctaaaaatagaaagactggctgatacaatcagaaagaaatcagaaaaattccacgacccaaaatacgagaaatttgacattaattctctgcttatagtctttaactacatagatccctcttcaaatcaaaatttagacatagaatttagaaaaaaataa

SEQ ID NO: 11268 - protein, 211 aa, Unknown
  Obtained from environmental sample
  misc_feature (1)..(211): Xaa is any amino acid
MNKEEEKYYLERFFKFFESEESPLFCRERPDFSVKFDNQSIGIEVTEFHTFDGSSAQNGKRKEQRRKNFIKILKNKLDDLKIKSKISITFNDNAQEFKTEENITSTIRLIENVISGELTTFNGNISREIIDENFIKNIHIIPHHELDINHIQGYDIEPDLKIERLADTIRKKSEKFHDPKYEKFDINSLLIVFNYIDPSSNQNLDIEFRKK

SEQ ID NO: 11269 - DNA, 423 bp, Unknown
  Obtained from environmental sample
  misc_feature (1)..(423): n is a, c, g, or t
atgaatgaaaagtttgggagaaagtatgttgcacaagatggactctatgaactttttggacgatttgaagtagaaagctatttagagtataatgggtataattttccacataactttgatccattaagttatttatatattataaaaaccatcaatatttttgatgcagcaagaggcagtgataagcttgaagatgtacttggaagaataaagtctaaacttcatttgatttcattcagtggtgatatgttatttttccctagtgaaatggaagagataaagattgtgatggataaagttggaaatggtgataagtgtacttatgatatgattgaaagtgattatggccatgatgcatttttagtggaagtggaaaaattcgaagataaaataatacaaatgctggaggggaaatatgagtga

SEQ ID NO: 11270 - protein, 140 aa, Unknown
  Obtained from environmental sample
  misc_feature (1)..(140): Xaa is any amino acid
MNEKFGRKYVAQDGLYELFGRFEVESYLEYNGYNFPHNFDPLSYLYIIKTINIFDAARGSDKLEDVLGRIKSKLHLISFSGDMLFFPSEMEEIKIVMDKVGNGDKCTYDMIESDYGHDAFLVEVEKFEDKIIQMLEGKYE

SEQ ID NO: 11271 - DNA, 594 bp, Unknown
  Obtained from environmental sample
  misc_feature (1)..(594): n is a, c, g, or t
ttggtaattatcttaccatcagttgggatatattggtttttcctgtgtaggacggaaacgccgcccattgaagagttatcaagtcaatatgatcttcttattttagatatagatacaccgaagagaagtggattagaagtgctaaaagagtcggttgatcttttccctgatctgcctgtacttatgattagtgcaactatagagattaatactatcgtaaaagcgtacaacatcggttgtagtgattatattaaaaagccttttgatgttttagagcttgagatgaagataaaacatcttctcaaacatgataatccgatagtagagtttgaaaatggattggtttataatttgattacagaatctatctctttggataataaagagattgagttgacacaaaaggagaggaaactattttcatatttagttaaaaatcgagggcttaatatatctcaagagagtctaagtttttatatttggaatgaggatatagaaaagtctaatataagacagttagtgtcaagagttagaaaaaaacttcctgatgatatgattgtaaatagttttggaaatggttattgcttgaaatag

SEQ ID NO: 11272 - protein, 197 aa, Unknown
  Obtained from environmental sample
  DOMAIN (1)...(105): Response regulator receiver domain
  misc_feature (1)..(197): Xaa is any amino acid
MVIILPSVGIYWFFLCRTETPPIEELSSQYDLLILDIDTPKRSGLEVLKESVDLFPDLPVLMISATIEINTIVKAYNIGCSDYIKKPFDVLELEMKIKHLLKHDNPIVEFENGLVYNLITESISLDNKEIELTQKERKLFSYLVKNRGLNISQESLSFYIWNEDIEKSNIRQLVSRVRKKLPDDMIVNSFGNGYCLK

SEQ ID NO: 11273 - DNA, 633 bp, Unknown
  Obtained from environmental sample
  misc_feature (1)..(633): n is a, c, g, or t
atgatcatagttcgtgattgtgagagcattttatgtgatgtgcatgcaagtggtgatgaagcgatgatatatgctcaaaaagttctaaactcgatagtaattgtaagtgaaaatagagagattggcattttaaaagcaaaagagcttggagcaaagatagttttcttagatgatgcgtatagacatcatcaaataaaaaagttagatattttaatcgatgtgagtagttcaaacagtttttgccttccatcaggtccatatcgtgagaagttatggagtaataaagaggcagtggttcttcatgaagcagaagatttttttagagagactacactgataaatgagagtgatagcatggtcttagtgactgctatatcacaacctcaaagattagataaatttttaccgcaaaatgtaatagaaaaatattactttagtgatcattacttttttactaaagatgaactttcacagattatgaaaagtagtggtgctaagagcatattgtgtacatataaagattatgtaaagataaaagattttggttttgatatctcacttttagatttaaagttgagtgtagatagtagtctgtttgaaaatatagatagatatatacaaaagtgtaattaa

SEQ ID NO: 11274 - protein, 210 aa, Unknown
  Obtained from environmental sample
  DOMAIN (1)...(209): Tetraacyldisaccharide-1-P 4'-kinase
  misc_feature (1)..(210): Xaa is any amino acid
MIIVRDCESILCDVHASGDEAMIYAQKVLNSIVIVSENREIGILKAKELGAKIVFLDDAYRHHQIKKLDILIDVSSSNSFCLPSGPYREKLWSNKEAVVLHEAEDFFRETTLINESDSMVLVTAISQPQRLDKFLPQNVIEKYYFSDHYFFTKDELSQIMKSSGAKSILCTYKDYVKIKDFGFDISLLDLKLSVDSSLFENIDRYIQKCN

SEQ ID NO: 11275 - DNA, 690 bp, Unknown
  Obtained from environmental sample
  misc_feature (1)..(690): n is a, c, g, or t
atggatataattgttcataagattagacctcttttaagaaaaaacagagagtggcatggtgttttaaattataaaacaaaaaatagaaaagatatatatctgcagagctcttttgtacctattttagacatagataataaaattttggaatatatctgtttttatgtagatttaacagagagtattaatttaaataaagagattttaacaactcaaaaagaggttatttccaccatgggtgccataggtgagacaagatccaaagagaccggcgatcatgtaagaagagttgctgaatattcaaaatttttagctttaaaggcaggattatctattgaagatgcggaagagctaaagatggcttctcctatgcatgatataggaaaagttggaattgttgatgctattttgaataaaccagcaaaacttacagaagaagaatttgagattatgaaaactcactctgaactaggtcatgagatgcttaagaactcanatcaaaaattacttaaaacggcttccatcgtagcactgcaacaccatgagaaatggaaatggaaaggttacccaaatggattaagtggtaatgatattcatatttttggacgaattactggtatagctgaaggttttgatgcattaggacatgatcgcatatataaaaaacttgggccgttaaaaaaattttag

SEQ ID NO: 11276 - protein, 229 aa, Unknown
  Obtained from environmental sample
  DOMAIN (90)...(214): HD domain
  misc_feature (1)..(229): Xaa is any amino acid
MDIIVHKIRPLLRKNREWHGVLNYKTKNRKDIYLQSSFVPILDIDNKILEYICFYVDLTESINLNKEILTTQKEVISTMGAIGETRSKETGDHVRRVAEYSKFLALKAGLSIEDAEELKMASPMHDIGKVGIVDAILNKPAKLTEEEFEIMKTHSELGHEMLKNSXQKLLKTASIVALQHHEKWKWKGYPNGLSGNDIHIFGRITGIAEGFDALGHDRIYKKLGPLKKF

SEQ ID NO: 11277 - DNA, 354 bp, Unknown
  Obtained from environmental sample
  misc_feature (1)..(354): n is a, c, g, or t
ttgagcattagaaaaaaatttgacaatgtcatggcagttctttctattcttgggatagcaggactgtttttgaataatttgtttaatccgaaagggtctcccgttgaggtacagacaagaactgtcaaggcatactctgtgaatgtcatcaaaacaaagtatgattttttaacgcctaaagagggtgtgggttcaaacagttcaagtaaaaagatacaaaagatagcttatcacaatagccaagatgaatataaaagattttccaaacggtttattcattacaccgattgggaaaaacaaccgtatgcaatggtccgcccccttctacaaaaaagaaatttttatttttgttaa

SEQ ID NO: 11278 - protein, 117 aa, Unknown
  Obtained from environmental sample
  misc_feature (1)..(117): Xaa is any amino acid
MSIRKKFDNVMAVLSILGIAGLFLNNLFNPKGSPVEVQTRTVKAYSVNVIKTKYDFLTPKEGVGSNSSSKKIQKIAYHNSQDEYKRFSKRFIHYTDWEKQPYAMVRPLLQKRNFYFC

SEQ ID NO: 11279 - DNA, 774 bp, Unknown
  Obtained from environmental sample
  misc_feature (1)..(774): n is a, c, g, or t
ttgtcattaaaagttgcatatgaacttcttgaaaacagaactattgaatcacggattccaattctactggaattaagagggaagagtcctagaaatttaagtgttgatgaacttttatcaacctgggcattaaattttaggttagatcccacagcaataatgaaattgcataaagcaggtaaattgctaattatatttgaaggctttgatgagatggatatgattgcggataaagaaatgaggcttaatcattttcaaagattatgggaatttgcattaccaaattcaaaattaataataacaggtagacccaacttctttttggatgatgaggagttgaagtcaaatttaggaattgataaaccttatgaatcatctcattattgtgaggctatttatttaagtaagtttacgaaaaatcaaattgacaaggctcttcgaaatgtagaatcagaaaccaaaaaacaaattatagaaatacttgaaaaatctacagattcaaatttttatgacttaatctctaggccaactattttgtttttagttgctactatatggaaaaataggaaactttctgaaataaagaacagaatcaactcggcagtagtcatttcggagttcattaaatttagctattctagacaaaatgacaaaagaattgtattccctttaacagaaaaggaaagagaattctttatgctaggtattgcagtaggtatggtctattcatcattctatacaaatccaaatagcaaagaaaatttgcatgaattt

SEQ ID NO: 11280 - protein, 258 aa, Unknown
  Obtained from environmental sample
  misc_feature (1)..(258): Xaa is any amino acid
MSLKVAYELLENRTIESRIPILLELRGKSPRNLSVDELLSTWALNFRLDPTAIMKLHKAGKLLIIFEGFDEMDMIADKEMRLNHFQRLWEFALPNSKLIITGRPNFFLDDEELKSNLGIDKPYESSHYCEAIYLSKFTKNQIDKALRNVESETKKQIIEILEKSTDSNFYDLISRPTILFLVATIWKNRKLSEIKNRINSAVVISEFIKFSYSRQNDKRIVFPLTEKEREFFMLGIAVGMVYSSFYTNPNSKENLHEF

SEQ ID NO: 11281 - DNA, 513 bp, Unknown
  Obtained from environmental sample
  misc_feature (1)..(513): n is a, c, g, or t
atgaatctccctaataatttaaaattcagtgtcatgcaaaaaaaaattccaagtattatccaaaaagccatccagactatcgatggtttcgaaaaggtgtataatgtattataccaaaaaactattctacaaggtagaagtaaaagcacttttgagaactatatacgtagaattactcgaataagtttgcattttgacagacttcctgaagatatttcagatgatgaaattaatgagtatttggttgcgttggctttatcctcaaagtcaccctcacgaagtagttttaaacatatggtttatggtcttcgctattatttccgacatacggaattaaatcagcgagcaattaatctgccttcgttgaagaaagaaacaaaactcccggttattttaaacagtagtgagctaaaagaacttttcaaaacccctacattgctcaagcatcgcataattttatcattgacctattcaaccagtttattgccgtggttgattcttggcacactatga

SEQ ID NO: 11282 - protein, 170 aa, Unknown
  Obtained from environmental sample
  misc_feature (1)..(170): Xaa is any amino acid
MNLPNNLKFSVMQKKIPSIIQKAIQTIDGFEKVYNVLYQKTILQGRSKSTFENYIRRITRISLHFDRLPEDISDDEINEYLVALALSSKSPSRSSFKHMVYGLRYYFRHTELNQRAINLPSLKKETKLPVILNSSELKELFKTPTLLKHRIILSLTYSTSLLPWLILGTL

SEQ ID NO: 11283 - DNA, 573 bp, Unknown
  Obtained from environmental sample
  misc_feature (1)..(573): n is a, c, g, or t
ttggtgaattatattatatacaagcgtatgtcaacagtattaaaaatatccgaagaggatgaaaaaaacacttcttgtgaagcacttgataaaaagctcatgacaaattcaatacagcttttacaaaaagctctccttttaactccaaaaaactttgacgcaaaaagattactttcaaaaatatatttcagaagtggacaaaataaattaagtatttatatattaaaacatattgctcaaaatgaacaaaacaatccccttactctatcaacattagcatatagatctctatccgattttgaacttgagaaagcaaaaataattttaaaagatctctcttcagatgacacagatattgatgattataataatagcactttttttgcaatttttattttggaagagaattgggataaagtaattgaatattttaaaaagttatctagtgagtataacacattttatagatatattgattatgtaagtgcaaaaaattttaagtttaacacaatttcatatgctgaattagataccttactatcctcagttatattaagtgatgtggcatattaa

SEQ ID NO: 11284 - protein, 190 aa, Unknown
  Obtained from environmental sample
  misc_feature (1)..(190): Xaa is any amino acid
MVNYIIYKRMSTVLKISEEDEKNTSCEALDKKLMTNSIQLLQKALLLTPKNFDAKRLLSKIYFRSGQNKLSIYILKHIAQNEQNNPLTLSTLAYRSLSDFELEKAKIILKDLSSDDTDIDDYNNSTFFAIFILEENWDKVIEYFKKLSSEYNTFYRYIDYVSAKNFKFNTISYAELDTLLSSVILSDVAY

SEQ ID NO: 11285 - DNA, 324 bp, Unknown
  Obtained from environmental sample
  misc_feature (1)..(324): n is a, c, g, or t
atgactcgtgttgaggtatggtaccttttacattttgattatattccaaccccttttttaagagatgaaataaataaaaaattggtgaagaaactaaaagaaaaagaaccatataaattttcacaactaaataaaaataatattaaacaagaaaattataccaaacatatttttgatgaacttttggaattacaagaaaatgcaattaaaaatgctagaaaactacttgaaagttatagtgctgaacataatccagaaagtgctaacccatcaactactgttcatcaacttattgagattttaaacagtttaaataaaagttaa

SEQ ID NO: 11286 - protein, 107 aa, Unknown
  Obtained from environmental sample
  misc_feature (1)..(107): Xaa is any amino acid
MTRVEVWYLLHFDYIPTPFLRDEINKKLVKKLKEKEPYKFSQLNKNNIKQENYTKHIFDELLELQENAIKNARKLLESYSAEHNPESANPSTTVHQLIEILNSLNKS

SEQ ID NO: 11287 - DNA, 486 bp, Unknown
  Obtained from environmental sample
  misc_feature (1)..(486): n is a, c, g, or t
atgaattttgatgatattaaagaggatttagttaattttgaagtttataagaaaaaattattatttattaatgaaatcaaagattatagtttattttatttaagtgtttataatggaaagattttacgatttaataataagaaaataagtgtaaaaaaattaaaagacgaatttataaatagttcaaaatacatagatttaagtcattatgtaaaaaatgaactttatagtgaatatatagaaaaaaatttatataaaaaaagttttcaggtcattacatatcttataccaaaagataaaagaactaaaagtgattttaataaaatgaatgatttagtattcgaatttgataaatcttgttttgagattataaatacaccaattagtaaattatttgagcatataaatacacactatatggcatatattggaatttatactttgtatctattggtctataccgcttatttatatttaggtttatag

SEQ ID NO: 11288 - protein, 161 aa, Unknown
  Obtained from environmental sample
  misc_feature (1)..(161): Xaa is any amino acid
MNFDDIKEDLVNFEVYKKKLLFINEIKDYSLFYLSVYNGKILRFNNKKISVKKLKDEFINSSKYIDLSHYVKNELYSEYIEKNLYKKSFQVITYLIPKDKRTKSDFNKMNDLVFEFDKSCFEIINTPISKLFEHINTHYMAYIGIYTLYLLVYTAYLYLGL

SEQ ID NO: 11289 - DNA, 855 bp, Unknown
  Obtained from environmental sample
  misc_feature (1)..(855): n is a, c, g, or t
atgaatatattagaacaaatttatgaaataaattttaataaagttaactttcttgagagaaaaatttcaatacaaaatccaaatactattttagtaggaagtccaaaaagtggtaaaacataccttatatacgattatttagcacgatttgaaaatgaacaatatatttatattgattttgatgattataaaaataattttaatgagatatcagaaaacttagaggcatttattaaaaaaaataatatattagttttagttctcgaaaattataaatttaatcttaatttaccaaaagttacaagtacgattattacaacgaaagaaaaaaatattattgcaggttttgataaaatatttgtaaaaccacttgattttgaagagtttttactttttgatacaaaacatcaaaatactttaaatagttttaacagttttttaaagtttggaaatactccagaggtattagaatacagtgaacaaaaaaaatctcaacggaattttgagatttgtaagctttattgtgaagataaaacacaattagatatattacttattatcattaaattctcctctgaaacgagatccttatttcagctttttagtgctttaaaaaaagagaaaaaaatatcaaaagataagttttataaaacttgtgaggaatttgaacaaaacaagttactatatttttgttctaaatatgaacaaccaaaagcggtaaaaaaaatatttgtttttaatcatgctcttattgatatagtttcttacaaaaagaattttaataatctttttaaaaatatggtatttttagaaatagaaaaaagatatataaatattttttatcttgataataat

SEQ ID NO: 11290 - protein, 285 aa, Unknown
  Obtained from environmental sample
  misc_feature (1)..(285): Xaa is any amino acid
MNILEQIYEINFNKVNFLERKISIQNPNTILVGSPKSGKTYLIYDYLARFENEQYIYIDFDDYKNNFNEISENLEAFIKKNNILVLVLENYKFNLNLPKVTSTIITTKEKNIIAGFDKIFVKPLDFEEFLLFDTKHQNTLNSFNSFLKFGNTPEVLEYSEQKKSQRNFEICKLYCEDKTQLDILLIIIKFSSETRSLFQLFSALKKEKKISKDKFYKTCEEFEQNKLLYFCSKYEQPKAVKKIFVFNHALIDIVSYKKNFNNLFKNMVFLEIEKRYINIFYLDNN

SEQ ID NO: 11291 - DNA, 585 bp, Unknown
  Obtained from environmental sample
  misc_feature (1)..(585): n is a, c, g, or t
atgagagaaaattatcatacgaatttatgtggtattgatgaagcaggaaggggaccatttgctggacctttagttgtggctggtgtgatattaaaaaaagagttacaggagcttgatgattccaaaaaactaactgaaaaaaaaagggaaaaactttttgatataattaaagagaatagtatccatcatatcgtttttacaagtgcaaaagagatagatgaactaggtttaagtatctgtttgcaaaactccataaaagagattatgaaaaatcttgatgcgcaacaatatttaatggatggaaatacagcttttggaatagctaatctacaatatctcataaaagcagatgctcaaataaaagaggtaagtgcagcttcaatattagcaaaagtaagtcgtgatagatatatgtgtgaaatatcctcttcttatcctcaatactcttttgagaaacacaaagggtatggtacaaaagctcatattgaagctatagtaacttatgggtatagtgatattcatagaagaagtttcaagataaaacaacttgaaaatatcaccatcaaggagcctactttattttaa

SEQ ID NO: 11292 - protein, 194 aa, Unknown
  Obtained from environmental sample
  DOMAIN (10)...(181): Ribonuclease HII
  misc_feature (1)..(194): Xaa is any amino acid
MRENYHTNLCGIDEAGRGPFAGPLVVAGVILKKELQELDDSKKLTEKKREKLFDIIKENSIHHIVFTSAKEIDELGLSICLQNSIKEIMKNLDAQQYLMDGNTAFGIANLQYLIKADAQIKEVSAASILAKVSRDRYMCEISSSYPQYSFEKHKGYGTKAHIEAIVTYGYSDIHRRSFKIKQLENITIKEPTLF

SEQ ID NO: 11293 - DNA, 480 bp, Unknown
  Obtained from environmental sample
  misc_feature (1)..(480): n is a, c, g, or t
atggattggctttacattttattgagcaaattaggggttgataataaagaggttccaattgttgtgttaagtgcacataaagatgaagaatttttgctaaaagcaatccctttagggctcacctcttatgaagttaagcctattaattttactgattttaaaagtttacttaataaatgtgctcaagctattaacagtaaaaatttattacttataaaagatgatattttttatgattatgacacaaagtctatttataaaaatcaagaggagatacttttgagtaaaaaagaatctctatttgttgagttactcataaaaaataaaaatagtattacaagtaaagatgatatcaataattttatttgggaaaatgaaattatgagtgaatcggcattgaaaaactttttgttaagagtaagaaaaaaagttggaaaagattttttttatacaattcagaatataggatatagattataa

SEQ ID NO: 11294 - protein, 159 aa, Unknown
  Obtained from environmental sample
  DOMAIN (89)...(159): Transcriptional regulatory protein, C terminal
  misc_feature (1)..(159): Xaa is any amino acid
MDWLYILLSKLGVDNKEVPIVVLSAHKDEEFLLKAIPLGLTSYEVKPINFTDFKSLLNKCAQAINSKNLLLIKDDIFYDYDTKSIYKNQEEILLSKKESLFVELLIKNKNSITSKDDINNFIWENEIMSESALKNFLLRVRKKVGKDFFYTIQNIGYRL

SEQ ID NO: 11295 - DNA, 843 bp, Unknown
  Obtained from environmental sample
  misc_feature (1)..(843): n is a, c, g, or t
ttgattaatgatattttagatagttcaaaaatagagataggaaagcttaatattgtaaaaaataacttcaatatggatcaagtattaaacaatgttaaagcagttgcaacatctaatattgaagctaaagatatagattttgagattcattatgacaaaattttaccaaaatactttaatggagatagtttacgattagagcaagttttaataaaccttgtgagtaatgctacaaaatttacacaaagaggctcagtacaattatctatagaaaatataaactacaataggtatagatttagtgtaagtgatacaggtattggagtaacacaagaacaaatagaaaatatttttgagccatttactcaagcagatgacacaattacaagagaatatggtggtactggacttggtctatctatatcaaaacaacttgtagagttaatgggtggaatacttagaattgaaagtaaggtaaaagagggtacacaaatatattttgatattgagttaagagaaataaaacaagaggattacattaacgagaaagggttagaaaaaacaaagaaaaaaatagagtttaatttgtataataagagagagacaatagtttttgaaaaagagaaagagttacttgaacaattagaagaggcagtattgagaaaaagaccaaatgtggtatatcctattattgatgaattagataaatataatttacaaatactaagtagtgtagattttaagaatataaaaacatatattaagagatatatgtttcatgaagcaagcgagatactaaataaatatgaaaaaataaaaaatccccccacaatattaaatgtt

SEQ ID NO: 11296 - protein, 281 aa, Unknown
  Obtained from environmental sample
  DOMAIN (61)...(172): Histidine kinase-, DNA gyrase B-, and HSP90-like ATPase
  misc_feature (1)..(281): Xaa is any amino acid
MINDILDSSKIEIGKLNIVKNNFNMDQVLNNVKAVATSNIEAKDIDFEIHYDKILPKYFNGDSLRLEQVLINLVSNATKFTQRGSVQLSIENINYNRYRFSVSDTGIGVTQEQIENIFEPFTQADDTITREYGGTGLGLSISKQLVELMGGILRIESKVKEGTQIYFDIELREIKQEDYINEKGLEKTKKKIEFNLYNKRETIVFEKEKELLEQLEEAVLRKRPNVVYPIIDELDKYNLQILSSVDFKNIKTYIKRYMFHEASEILNKYEKIKNPPTILNV

SEQ ID NO: 11297 - DNA, 438 bp, Unknown
  Obtained from environmental sample
  misc_feature (1)..(438): n is a, c, g, or t
atgtataacatacttgaaaaaatacctcttgaaactatcatttttccaatgagcattgttgtaggaactatgtcaggtaaagttgagataaaaagagatatttatgcacttgaaaaaaaagttaaattattagagttaaaagaaaataataacttagattctatttttaataaaattgatacaaaataccattatttactaggatcagaaaaattacaaaaacattttaaaattgaaaaaacaaaagaccattctgacaggtataatttaaaaaaattctgggcaaatactacaaataaaagatcattaatatggggtggaataatactccccttttctttaaatgcaggaataggaatcatgttaggttataaaataggatataaaattgctcaaaaaatagaaataaataattatgtaaaaaaaattaaaccttga

SEQ ID NO: 11298 - protein, 145 aa, Unknown
  Obtained from environmental sample
  misc_feature (1)..(145): Xaa is any amino acid
MYNILEKIPLETIIFPMSIVVGTMSGKVEIKRDIYALEKKVKLLELKENNNLDSIFNKIDTKYHYLLGSEKLQKHFKIEKTKDHSDRYNLKKFWANTTNKRSLIWGGIILPFSLNAGIGIMLGYKIGYKIAQKIEINNYVKKIKP

SEQ ID NO: 11299 - DNA, 714 bp, Unknown
  Obtained from environmental sample
  misc_feature (1)..(714): n is a, c, g, or t
atggacgtctcagaagctattagaaagcgtagaagtattaagagatatcttgatgttccaatagaatgggagaagattggaagcatattagattcaggaagattagctccttcagcagggaatttacaaccctggaaatttttagttgtaactaatcctgaaggaagaaaaaaaattgctgaatcttgttttcaacaatattggatgcaatctgctccagttcatattattatttgtgctgaattaaataaaatgaatcgtttttatggggttcgtggtgaaagattgtattcagtgcaaagttgtgctgtagctgctgaaaatatgttacttgaagcagtaaatcaaggtttggcaggatcatttatttcagcttttgatgaagagatgattaaaaggcattttaaaatgccagattttacaaggcctcaagttgtattaacaattggttttgctggggaagaagtgccttctcctcctaaatatactttaaatgatgttgttcatgttgaatcttatggtgctaaaataggggatgttatgggttattttggttatggttctgggagaacaatcaaaaatgtggtatcaaaaggcaaggaaatgttcgataaatttgctcaaaaaggagaaaaagcaattaaaggaaaaataagtagtatgaaaatcaataaagagaagatttctaatgaagattttttttatagatcttaa

SEQ ID NO: 11300 - protein, 237 aa, Unknown
  Obtained from environmental sample
  DOMAIN (7)...(151): Nitroreductase family
  misc_feature (1)..(237): Xaa is any amino acid
MDVSEAIRKRRSIKRYLDVPIEWEKIGSILDSGRLAPSAGNLQPWKFLVVTNPEGRKKIAESCFQQYWMQSAPVHIIICAELNKMNRFYGVRGERLYSVQSCAVAAENMLLEAVNQGLAGSFISAFDEEMIKRHFKMPDFTRPQVVLTIGFAGEEVPSPPKYTLNDVVHVESYGAKIGDVMGYFGYGSGRTIKNVVSKGKEMFDKFAQKGEKAIKGKISSMKINKEKISNEDFFYRS

SEQ ID NO: 11301 - DNA, 726 bp, Unknown
  Obtained from environmental sample
  misc_feature (1)..(726): n is a, c, g, or t
atggatgagataagaaatcttttttctcaaacaaaagagtcacaaatacgcggttatacaacttcaagatttagctttaatgttaaaggtggtagatgtgagaagtgtcaaggtgagggtgagataaagatagagatgcactttcttccagacatcatggttaagtgtgatacttgtcttggtacaaggtacaaccagcagactttagaagttttttacaaaggtaaaactatctctgatgttcttaatatgagcgttgatgaagcatttgagttttttaaaccaatcccaaaaatacaccaaaagatgaaaacccttgttgatgtaggtcttggttatatctctctaggtcaaaatgctgtaaccttgtcaggtggtgaagcacaaagaattaagctgagtaaagagttaagtcgtaaagacacaggaaaaactctttatatattagatgaaccgacaacaggacttcactttgcagatgttgatagacttacaaaagttcttcatcactttgtagaacttggaaatagtgttttaattatcgagcataacctagacatgattaaaaatgctgactgggttatagatatgggtccagaaggtggttcaggcggtggtcttattatcgctgagggttcacctgaagacttagcccagaaccatgaaaaaactggtagttatacgggagaatatctaaaaacagagttagctttgcataaaagttaa

SEQ ID NO: 11302 - protein, 241 aa, Unknown
  Obtained from environmental sample
  DOMAIN (59)...(198): ABC transporter
  misc_feature (1)..(241): Xaa is any amino acid
MDEIRNLFSQTKESQIRGYTTSRFSFNVKGGRCEKCQGEGEIKIEMHFLPDIMVKCDTCLGTRYNQQTLEVFYKGKTISDVLNMSVDEAFEFFKPIPKIHQKMKTLVDVGLGYISLGQNAVTLSGGEAQRIKLSKELSRKDTGKTLYILDEPTTGLHFADVDRLTKVLHHFVELGNSVLIIEHNLDMIKNADWVIDMGPEGGSGGGLIIAEGSPEDLAQNHEKTGSYTGEYLKTELALHKS

SEQ ID NO: 11303 - DNA, 933 bp, Unknown
  Obtained from environmental sample
  misc_feature (1)..(933): n is a, c, g, or t
atggntgttttacgtaaaggtgctacaggtaaaaatcttgagccagaaaacacgcttaagaaaggccaaacgcgtttagagaaaattatttctttaggcacagaaggcggtatgaacaactttgatgacttgtttactgaagaagaaatcagcaacttggcaacatttattcaaatggagccgccagtaccaccagaaatgtctttagagcaaatgcgttcttatacgaaagaatatgtggcgccaaaagactatccaactaagcctatgcacggtttaaactggaaaaacttctttgttgttatcgaacgtgacgcgggtactgcggcaattattgatggcgatacgaaaaaaatcatcacacatatcgatacgggttatgcggtacatgtaattaaaggtactgaacatcataaagttgaccatgcgaaagatgttggtcgtttttggtacaccattggccgtgatggtaaagttaacaaaatcgatttatggcaaacacctgacaaaatgttagttgctgaaactaaaatggcatacgacgcacgtgatattgcggtatcaggtgacggtaaatacgtcattgctggtggttactggcctgcacatttcgttatcatggatgcagaaacattaaacccacttaaagttgtttcaactcgtggttacaacacgaaaggtgagtttattaacgaagccgcgtgtagcgggcaatttatacggcaccccaatacgtccttcttttcatccgttgctggtaaaagaaaccgggcccaaaattgttaccaggttgtattattaaccgaccttaagattaactttaaccgattcaaccaacgcatttgccttccggctggaatttcattacaaagaatgggtttccttgtgacccctacaagggtcgggttgattttcccaaaatttggggggtaa

SEQ ID NO: 11304 - protein, 310 aa, Unknown
  Obtained from environmental sample
  DOMAIN (92)...(307): Cytochrome D1 heme domain
  misc_feature (1)..(310): Xaa is any amino acid
MXVLRKGATGKNLEPENTLKKGQTRLEKIISLGTEGGMNNFDDLFTEEEISNLATFIQMEPPVPPEMSLEQMRSYTKEYVAPKDYPTKPMHGLNWKNFFVVIERDAGTAAIIDGDTKKIITHIDTGYAVHVIKGTEHHKVDHAKDVGRFWYTIGRDGKVNKIDLWQTPDKMLVAETKMAYDARDIAVSGDGKYVIAGGYWPAHFVIMDAETLNPLKVVSTRGYNTKGEFINEAACSGQFIRHPNTSFFSSVAGKRNRAQNCYQVVLLTDLKINFNRFNQRICLPAGISLQRMGFLVTPTRVGLIFPKFGG

SEQ ID NO: 11305 - DNA, 690 bp, Unknown
  Obtained from environmental sample
  misc_feature (1)..(690): n is a, c, g, or t
ttgctaagttcttgcaaaacagttgggcaaatattaaaaaaaggtgattatgtagtgtttgaatcaactgtatacccaggttgtacagaagaagattgcgtacctatattggaaaaagaatctggactgaaatttaaaacggattttaaagtgggtttttcacctgaaaggataaatcctggtgataaagtaaatacgcttacaagcatcaaaaaaattacttccggctgtgatgctgaatcaagtgaggaaattgccaaagtttatgaaatgattattaaggctggtgttcaccgtgccagctcaataaaagtagccgaagcagcaaaaataattgaaaacacccaaagagatgtaaacattgctctaatgaatgaactttcaatcatatttaacaaactgaatattaacacatttgaagtgctagaggctgccggcactaaatggaatttccttaaatttttcccgggtttagttggtgggcattgtattggtgtagatccttattatctggtacataaagcaaaagaaataggttatcatccccaaattataaattcaggaagatttgttaacgattctatgggcggatatattgccaaacaaattgttaaaatgcttttggctgaagataaacacctgaaagagtcaaaagtactggtaatgggaatcacttttaaaaaaatgtaa

SEQ ID NO: 11306 - protein, 229 aa, Unknown
  Obtained from environmental sample
  DOMAIN (1)...(94): UDP-glucose/GDP-mannose dehydrogenase family, NAD binding domain
  misc_feature (1)..(229): Xaa is any amino acid
MLSSCKTVGQILKKGDYVVFESTVYPGCTEEDCVPILEKESGLKFKTDFKVGFSPERINPGDKVNTLTSIKKITSGCDAESSEEIAKVYEMIIKAGVHRASSIKVAEAAKIIENTQRDVNIALMNELSIIFNKLNINTFEVLEAAGTKWNFLKFFPGLVGGHCIGVDPYYLVHKAKEIGYHPQIINSGRFVNDSMGGYIAKQIVKMLLAEDKHLKESKVLVMGITFKKM

SEQ ID NO: 11307 - DNA, 723 bp, Unknown
  Obtained from environmental sample
  misc_feature (1)..(723): n is a, c, g, or t
ttggctcggggatggatcaactcagacttaggaaatgacttaggaaatttactaaacagaatccaagggatgagtggaaaatattttgattttaaagttactagtaaagatgtggcaaaatatcatcaaaaagagttagatgatgttcatacaatcttagaaaatgcagaaccacttatctataatatgcaaatcaatagatatcttgaagagatttggaaagtactaactatagctaacaaagcaataggagactatgaaccttggactatgatgaaagatggacgagaagaggaagctatggctttagtagcccttattacaaatatcatggcaaaagtttcactactacttgatagtgttatgccagaaaaaatttctaaaatcgcatcttcattaggtatcgaaatctcaacagaaaactataataaacttctaaaaaataaagagttaatagctgatacaactatcactaaaattgatgccctattcccaagaattgaagaggaattaatagcaacagcagatgtacaaaaaacagaatctgtagttgaaaaacctcgaaaagaagctgcaaagcaagagggaaaaacagaaaaaccagacaatcttatcactattgatcagttttttgaaacaacattaaaaataggtacaattgtagaggcccaagaggttccaaagtccaaaaaacttttaaaacttcaagttgatgtggggtga

SEQ ID NO: 11308 - protein, 240 aa, Unknown
  Obtained from environmental sample
  misc_feature (1)..(240): Xaa is any amino acid
MARGWINSDLGNDLGNLLNRIQGMSGKYFDFKVTSKDVAKYHQKELDDVHTILENAEPLIYNMQINRYLEEIWKVLTIANKAIGDYEPWTMMKDGREEEAMALVALITNIMAKVSLLLDSVMPEKISKIASSLGIEISTENYNKLLKNKELIADTTITKIDALFPRIEEELIATADVQKTESVVEKPRKEAAKQEGKTEKPDNLITIDQFFETTLKIGTIVEAQEVPKSKKLLKLQVDVG

SEQ ID NO: 11309 - DNA, 492 bp, Unknown
  Obtained from environmental sample
  misc_feature (1)..(492): n is a, c, g, or t
atgaataaaatttttaaaatattacttcttattactataatctcaactattttatttttctatttattgtatcaagatcaacaattcaaaaacaatccattatctcaagagattctttctaaattagaaaataaaaacaatgtaataagacaaactataaaacaaaaatataatataaactataatatcccaattatcatatctgataaactaccaaataatctttatggattagcgagttatcaacaaggtattataaaaattcaacttaataaaaaaagatttcaagaaaatgaaaactacatgatagaatatgttttacctcacgaatatgctcatacacttatgttttattttggtaaatttgacaaagaaaatggtggtcatacaaaactatggcaacaaatttgttttgatattggtgggatgaaatgtgatagatttgtaaatcacaatgatattttaatagaaaaaattggagatatatactaa

SEQ ID NO: 11310 - protein, 163 aa, Unknown
  Obtained from environmental sample
  misc_feature (1)..(163): Xaa is any amino acid
MNKIFKILLLITIISTILFFYLLYQDQQFKNNPLSQEILSKLENKNNVIRQTIKQKYNINYNIPIIISDKLPNNLYGLASYQQGIIKIQLNKKRFQENENYMIEYVLPHEYAHTLMFYFGKFDKENGGHTKLWQQICFDIGGMKCDRFVNHNDILIEKIGDIY

SEQ ID NO: 11311 - DNA, 864 bp, Unknown
  Obtained from environmental sample
  misc_feature (1)..(864): n is a, c, g, or t
ttggctcggtcgggaattgaaagtattatgttagtggacaaaagttataaggaaaggtttattaatcctttaactggattatttattgatgattattatgtagttaatgaaaatgcatcacaacaattaatgaatgatattaaagataaaggtatagaaaagtttatttacaataaggaatactttatatttaacaaatactttatagttactgatcaaattagaaatataaaaaataaacctatgggatattttatattttttagtaaagtagaagatattgatatgtccaaagttcatcagtttaaaactacatattttcagctattaagtatatttggaattgttactacattattattattgctttatataaatagaaagtttgtaaaagctttaaatcaagaagtacaacaaaaaactagaaaaattagtaaacaaaaagagtacttaaagtcactacttcaaatatatgacaaaaatgttattttttcaaaaacagatccaaaaggttttattactcatgtaagtgaagctttttgtaaaataagtggatatacaaaagaagaacttatagggcaaaatcataatattattagacatccagatatgccaaaagagacatttagatatttatgggaagagttaaaaaaaggaaataaagtaaatatagaggttaaaaaccttaaaaaagatggtggttattattgggttgaagcagagatagaaccagaatatgataaaaaaggtgtattagtaggctacaatgcagtaagggaaaatattacagcgaataaagatattgaggctattcaaaaagagataatttttactatgggatctattggagagagtcgaaagtaa

SEQ ID NO: 11312 - protein, 287 aa, Unknown
  Obtained from environmental sample
  DOMAIN (223)...(265): PAC motif
  misc_feature (1)..(287): Xaa is any amino acid
MARSGIESIMLVDKSYKERFINPLTGLFIDDYYVVNENASQQLMNDIKDKGIEKFIYNKEYFIFNKYFIVTDQIRNIKNKPMGYFIFFSKVEDIDMSKVHQFKTTYFQLLSIFGIVTTLLLLLYINRKFVKALNQEVQQKTRKISKQKEYLKSLLQIYDKNVIFSKTDPKGFITHVSEAFCKISGYTKEELIGQNHNIIRHPDMPKETFRYLWEELKKGNKVNIEVKNLKKDGGYYWVEAEIEPEYDKKGVLVGYNAVRENITANKDIEAIQKEIIFTMGSIGESRK

SEQ ID NO: 11313 - DNA, 351 bp, Unknown
  Obtained from environmental sample
  misc_feature (1)..(351): n is a, c, g, or t
atgttaaataaaatatctaaggtaatgggattaatagttttggcggtcgttcttgcggggtgggaaaatagtgatttttcacatacttatttaatgcgtggtcaagtcgtttccgcatctgaaagtgaagccattgtttgtgttggcttgaatgatggtgcaaaaacggggcaaattttacatacctatcggtttgtcatgaatgatgacaatgacgaaggagctgagttctataagcagcaagaaataggacaagtgagaatagataaaattattgatgaacattttgcgaaagttacagttttaaaaggagctattaaaaaacacgatatggtgcaattaaataaataa

SEQ ID NO: 11314 - protein, 116 aa, Unknown
  Obtained from environmental sample
  misc_feature (1)..(116): Xaa is any amino acid
MLNKISKVMGLIVLAVVLAGWENSDFSHTYLMRGQVVSASESEAIVCVGLNDGAKTGQILHTYRFVMNDDNDEGAEFYKQQEIGQVRIDKIIDEHFAKVTVLKGAIKKHDMVQLNK

SEQ ID NO: 11315 - DNA, 501 bp, Unknown
  Obtained from environmental sample
  misc_feature (1)..(501): n is a, c, g, or t
gtggctaagaaaattgtcagcatccaatttcatattcttgagcaggtcggggaaaagttagatggcgccattaatcttgaaaaagctttaaaatatgatgaaacagatgaagtcatatttgtcaataggggcatacttacccttgagcatatccgtcgagagtttattctggaagctttgcgagtgaggatggaaactaaagaaattcaggtgagactcaccataatatccaactcaggaggtctgaaaattcatgagttctgggttggtttttttgactttccgagcatagacaacacccgattatcaaacaatcaaagatgtgccatagtattgaaacagtttgacgaaaaggagaattttgcagaagttaccttgttatattttccaggagattatgccagtcttaaagataagccttatatcgaagatatgatcagaaagcttagattagaaaagccggggcaacctatgaactccgtggaaaagtcttttaattaa

SEQ ID NO: 11316 - protein, 166 aa, Unknown
  Obtained from environmental sample
  misc_feature (1)..(166): Xaa is any amino acid
MAKKIVSIQFHILEQVGEKLDGAINLEKALKYDETDEVIFVNRGILTLEHIRREFILEALRVRMETKEIQVRLTIISNSGGLKIHEFWVGFFDFPSIDNTRLSNNQRCAIVLKQFDEKENFAEVTLLYFPGDYASLKDKPYIEDMIRKLRLEKPGQPMNSVEKSFN

SEQ ID NO: 11317 - DNA, 909 bp, Unknown
  Obtained from environmental sample
  misc_feature (1)..(909): n is a, c, g, or t
ttgaaaataacaattgatatagccatagcagtagatcaattaggacaagaaaaaggtgcgattgcagtctatcttgaaccatggcatatagatatcaatgacttccttgatctaaaaaagaactctggtgaagagcgtagacgtgcacatgatctttttcccgctctatggctgaatgatctatttatgaagcgtgcagctgctgatgaaatgtggtcactttttgacccatatgaagttagtgaactttccactctaacaggtgaagattttgaaaaaagatatattgaatttgaaaatgataagagtgtattaaaagagactataaaagcaaaagatctctggaaaaaaattctaaaaagctattttgaaacaggtagtccatttttatgttttaaagatagtgctaacaaagctaacccgaatgatcactttggaacaattagaagctctaatctttgtacagaaatatttcaaaacacagaccctgatcactacaaaataagaattaaatttgatgatgatagtgttatactttttgaagaagatgatcaagtaaaagtagatagtggcataacaaaaaaagctaacaaagtaactgcattagacagcatagacggtaaacgtatcttcatagttgaaaaagagaagataaatggttctactgctgtttgtaatttggcatctgtaaatctatcacgtattaacacaaaagaggatatagatagaatagttcctattgctattcgtgcgttagataatgttattgatctaaacttttatccgttagaaaaagtaaaacgaactaacttacgcagtcgtgctatcggtcttggtgttatgggtgaagctcaaatgttagcagagcatcaaataaactggggaagccaagctcacttgacaagatag

SEQ ID NO: 11318 - protein, 302 aa, Unknown
  Obtained from environmental sample
  DOMAIN (3)...(302): Ribonucleotide reductase, barrel domain
  misc_feature (1)..(302): Xaa is any amino acid
MKITIDIAIAVDQLGQEKGAIAVYLEPWHIDINDFLDLKKNSGEERRRAHDLFPALWLNDLFMKRAAADEMWSLFDPYEVSELSTLTGEDFEKRYIEFENDKSVLKETIKAKDLWKKILKSYFETGSPFLCFKDSANKANPNDHFGTIRSSNLCTEIFQNTDPDHYKIRIKFDDDSVILFEEDDQVKVDSGITKKANKVTALDSIDGKRIFIVEKEKINGSTAVCNLASVNLSRINTKEDIDRIVPIAIRALDNVIDLNFYPLEKVKRTNLRSRAIGLGVMGEAQMLAEHQINWGSQAHLTR

SEQ ID NO: 11319 - DNA, 462 bp, Unknown
  Obtained from environmental sample
  misc_feature (1)..(462): n is a, c, g, or t
atgatttgtggggttagagtaatgaacgaaaatttagcatacataatcgaatgggccatatggtctaatttggatagaattacagaattggagcttgttctacttaaaggacatcagcacatcgaaataataattgatactgttttatccgaaaacgggattaagaattgcgaagatttatccttttacaaaaagacaaaggagctgaaaatcattggaagcaaatctaatggtaacagcaagattattacagacaagttgtttgaattgaataaaatcaggaataaattagctcacgaactcgaatttgaaataaagaatggagaattagaagattgggcacaaagtgtactgtcaatatttaaaggccaaaaattcacaaaacatacttataggacaaagattgttcatgcattctcaagtatcgcaaaagctataacagaaatacgaatttgtctctaa

SEQ ID NO: 11320 - protein, 153 aa, Unknown
  Obtained from environmental sample
  misc_feature (1)..(153): Xaa is any amino acid
MICGVRVMNENLAYIIEWAIWSNLDRITELELVLLKGHQHIEIIIDTVLSENGIKNCEDLSFYKKTKELKIIGSKSNGNSKIITDKLFELNKIRNKLAHELEFEIKNGELEDWAQSVLSIFKGQKFTKHTYRTKIVHAFSSIAKAITEIRICL

SEQ ID NO: 11321 - DNA, 498 bp, Unknown
  Obtained from environmental sample
  misc_feature (1)..(498): n is a, c, g, or t
atggctaaaattaaatttaaaggaaacgaaataaatacgagtggaacacttccaaatgttggttcgcatgcaaaagattttcggttagtagcaactgacttaagtaccaaaacattaagtgactttaaaggaagtaaattaatattaaatatttttccaagtattgatacaggtatttgtgccgaatcagtaagaaactttaataaaaaagcagcagacttagacaacacaaaagtattgtgtatttctagagatttaccttttgctcaaaaaagattttgtggtgcagagggaattgaaaatgtagaaatgttatctgactttaaaacaggtcaatttagtaaagattatggtttagaaatgttagaaggacctttagccggattaagttcaagatgtattgttgttttggatgaaacaggagaggtagtttatacagaacaagtggaagagattgttacagaacctgattatgagaaagctttagcaagtatttaa

SEQ ID NO: 11322 - protein, 165 aa, Unknown
  Obtained from environmental sample
  DOMAIN (20)...(162): AhpC/TSA family
  misc_feature (1)..(165): Xaa is any amino acid
MAKIKFKGNEINTSGTLPNVGSHAKDFRLVATDLSTKTLSDFKGSKLILNIFPSIDTGICAESVRNFNKKAADLDNTKVLCISRDLPFAQKRFCGAEGIENVEMLSDFKTGQFSKDYGLEMLEGPLAGLSSRCIVVLDETGEVVYTEQVEEIVTEPDYEKALASI

SEQ ID NO: 11323 - DNA, 384 bp, Unknown
  Obtained from environmental sample
  misc_feature (1)..(384): n is a, c, g, or t
atgtacaaaccaattaaatttaaaattatgacagaaattataggtgtatcaattccaatttttataacactaggtgtttttgcaatgatagtattgcttagaagaatggaaaatcaggaaagattaaaaatgatagaaaaaggtatggatttaaacttgcctaaaaaagaaaataacagtggttctgcattaaagtttgcattaatagcagtaggtgttggtgtaggcttgttagcagggaatttgttggatgtttatacaccattaaaagatgaggtatgttatttttcaatgatctttttatttggaggtttaggcttgtttattgccaataaaatggacgagaaaaaacgtaaaaacaataataacggagatattagttaa

SEQ ID NO: 11324 - protein, 127 aa, Unknown
  Obtained from environmental sample
  misc_feature (1)..(127): Xaa is any amino acid
MYKPIKFKIMTEIIGVSIPIFITLGVFAMIVLLRRMENQERLKMIEKGMDLNLPKKENNSGSALKFALIAVGVGVGLLAGNLLDVYTPLKDEVCYFSMIFLFGGLGLFIANKMDEKKRKNNNNGDIS

SEQ ID NO: 11325 - DNA, 834 bp, Unknown
  Obtained from environmental sample
  misc_feature (1)..(834): n is a, c, g, or t
atgctatcaacactcttaaagatcagtaaccttatattgaaatcactattagttagattaactcttggtctttatgatcaagatataagcaaagatgagagagtaattctagatgaactactcagtgaatctatcgtagtctatgaagactcaaaatatactataccatcaaaatatagagcaggaatcatttcactctctcaaaactctaatgcatatcttcagattttagcagctactaatgtaaaagatctttttatagctcaagaagatctttttggggctaaagatggtgatttagttatagtccagcgtcttttgggacgaaagggaactccatctgctaaagttattaaaatagtaggtcatgcacaaacttactcaattgctttggtaaaagtagttgatgggaaaaaagctctggttaatctgcacacttctcatccatcaggtgtagagataactacacaagagctaaacagttatgaagaaggcactctatttaaaatagataatattcaaaatattatcttagatactcttggaaatatctctgatccaaaagttgatgagaagatagttttagcaaaatacaacaaacacgatgaatttgatcaagatattttagatcttgcatcaacatttggtgaagttgatgcaacaaaatatcctaaaagaaaagatctaagagattatccattttgtacgatcgatcctgtaactgctaaagattttgatgatgctatatactatgatgagaaaaactccacactctatgtagccatagcggatgttagtgagtatgtaaaacccatttggaccgatcgatgctga

SEQ ID NO: 11326 - protein, 277 aa, Unknown
  Obtained from environmental sample
  misc_feature (1)..(277): Xaa is any amino acid
MLSTLLKISNLILKSLLVRLTLGLYDQDISKDERVILDELLSESIVVYEDSKYTIPSKYRAGIISLSQNSNAYLQILAATNVKDLFIAQEDLFGAKDGDLVIVQRLLGRKGTPSAKVIKIVGHAQTYSIALVKVVDGKKALVNLHTSHPSGVEITTQELNSYEEGTLFKIDNIQNIILDTLGNISDPKVDEKIVLAKYNKHDEFDQDILDLASTFGEVDATKYPKRKDLRDYPFCTIDPVTAKDFDDAIYYDEKNSTLYVAIADVSEYVKPIWTDRC

SEQ ID NO: 11327 - DNA, 408 bp, Unknown
  Obtained from environmental sample
  misc_feature (1)..(408): n is a, c, g, or t
atgcagcagcttaaaaacacttcctttattttttgtggcagcaatcaaaaaatgatgcacgaaatatttaattctgccaaacgaccattttttgcaagttgtaccaatatgagtatggaggctatatcagaaactgaatataaaaaattcatcaaaaaacattttaataatgcaggtagaacaattagtgatgaatgtttaaattttatttgcgattggactcaattgcataccttttacactcaatatttttgttacaccttatttgctctgaataaaaataatagtggaatagaagaagcaaaaattgctgcacaaacaatattaaaactgagtgaacctactttttttcaatacaaaaacttattaaccgaatcgcagtggaagtttttaatgtgctgtaggtaa

SEQ ID NO: 11328 - protein, 135 aa, Unknown
  Obtained from environmental sample
  misc_feature (1)..(135): Xaa is any amino acid
MQQLKNTSFIFCGSNQKMMHEIFNSAKRPFFASCTNMSMEAISETEYKKFIKKHFNNAGRTISDECLNFICDWTQLHTFYTQYFCYTLFALNKNNSGIEEAKIAAQTILKLSEPTFFQYKNLLTESQWKFLMCCR

SEQ ID NO: 11329 - DNA, 549 bp, Unknown
  Obtained from environmental sample
  misc_feature (1)..(549): n is a, c, g, or t
ttgcaggcggcggggaaaaaagttcatatacttgaaatggaggaggatgggaaactgacaaaaacaggttcaataaaaacagatgaatgctggaacataagggttgagaacggatatcttttcaccggagaggacggtaaagtgaagatttataacatcaaaacagattcgacacctcagttggtaaaagaagtatcactttctggtaatgttaaagatcttgaagttaaaggaaactccctttttatctatcaggaggccggatggtggttctggaagaaaaatgaagttcagaaaattgatatcacggatgtttacaatccagttgagttgaataaaatcagttttgaatgcagggatgttgaattcacaaaggacagaggcactgtttatatgggctgcaagaatggacaaagggaaattgttgaagacggtgacagtttttcacttgaaatgataagtggaaaaaagaattatttcagagatagttatttttataaaggaatcggatatactgttcatagcggaagcatttacctgagcagataa

SEQ ID NO: 11330 - protein, 182 aa, Unknown
  Obtained from environmental sample
  misc_feature (1)..(182): Xaa is any amino acid
MQAAGKKVHILEMEEDGKLTKTGSIKTDECWNIRVENGYLFTGEDGKVKIYNIKTDSTPQLVKEVSLSGNVKDLEVKGNSLFIYQEAGWWFWKKNEVQKIDITDVYNPVELNKISFECRDVEFTKDRGTVYMGCKNGQREIVEDGDSFSLEMISGKKNYFRDSYFYKGIGYTVHSGSIYLSR

SEQ ID NO: 11331 - DNA, 834 bp, Unknown
  Obtained from environmental sample
  misc_feature (1)..(834): n is a, c, g, or t
atggtagattggctcgagagcggtggagttatattaaatcctattattgatcctatgaaaaaatctcaaaaaatagaacttttaaaagtattagaaaaaaaagatattcttgaatcttataaaatactacttcaagctcacaaaaaaggtttaggacttatatcttctgctcaaagatttgctcttagtcatgaagaagctttagagtttgctagaaatatggaagggtgttttatagatgaaaagtcacttgttatctaccctattgcaacaaaagagattattaaagatattattaaaaacatctatacaaaaaacaaatatgctttactttcaaatagttctataggattaagactagtttgggcaagtgaaaattttatagaacttgcattaaaagaactttgtgaggacaatatacttacaaaagatggtaatttatacaaaaatagtgatattaaagaggatatccaagataaactagaggtgataatacttcaaagactaaaagaggaagggattgtccctacagctccttataatatatatgatgaactcgatattgacagaagacttggagatactattttcaaagcactaacaaagaaaaaacttgtaacaagaatacagcataacttatttatagaagctcatatacttactaatctaatcactgctatgaaaaatattattaagcaagagggatacatagatattaaaaattttaaacaaaaatataccataagtagaaaatatatgatcgcttatttagattatttagataaaacaactaatatagaaaacaaagagggaaagagatatctcatctcttaa

SEQ ID NO: 11332 - protein, 277 aa, Unknown
  Obtained from environmental sample
  misc_feature (1)..(277): Xaa is any amino acid
MVDWLESGGVILNPIIDPMKKSQKIELLKVLEKKDILESYKILLQAHKKGLGLISSAQRFALSHEEALEFARNMEGCFIDEKSLVIYPIATKEIIKDIIKNIYTKNKYALLSNSSIGLRLVWASENFIELALKELCEDNILTKDGNLYKNSDIKEDIQDKLEVIILQRLKEEGIVPTAPYNIYDELDIDRRLGDTIFKALTKKKLVTRIQHNLFIEAHILTNLITAMKNIIKQEGYIDIKNFKQKYTISRKYMIAYLDYLDKTTNIENKEGKRYLIS

SEQ ID NO: 11333 - DNA, 654 bp, Unknown
  Obtained from environmental sample
  misc_feature (1)..(654): n is a, c, g, or t
atgatccgggttgtgatgccgctttactgtcacaaggcccagtcaattacattgcaggatgtacgtaatgttttcctgagtcgtgctaaagcaaaattggctgaaatggaattgggtgctgttgtacttgactctgtagctgcaccgaatttgccgccatacactgtggttgaacaacagccattacctggaaatcttgtaaaaaaaggacgagcaattttcctcacagtttccaggggcaaagaatatgttgaaatgccaaatctcatgggaaaagcactaaccgaagtaaaattaattctcgatcaattaaatctcgacataaaaactacagaatataaatacgattttgataaacctcagggagtaatttgtgggcaatccatcaatcccggtattgctgtggcgaaacattcatcactcagcatctggattagtaatggaccaccagtaaaaatttacaaaatacctgatctttttggagtaagtttgggtgtggccagaaaaagaattcgtgaagccggtctgaaagtcggtagtatcaattacatcagaaatgaagaattgacacctctcactatcataggacaatctcctgcaaaaggaactgaagttttcgaagttattgaaattgatctggaagtgaccaactag

SEQ ID NO: 11334 - protein, 217 aa, Unknown
  Obtained from environmental sample
  DOMAIN (152)...(217): PASTA domain
  misc_feature (1)..(217): Xaa is any amino acid
MIRVVMPLYCHKAQSITLQDVRNVFLSRAKAKLAEMELGAVVLDSVAAPNLPPYTVVEQQPLPGNLVKKGRAIFLTVSRGKEYVEMPNLMGKALTEVKLILDQLNLDIKTTEYKYDFDKPQGVICGQSINPGIAVAKHSSLSIWISNGPPVKIYKIPDLFGVSLGVARKRIREAGLKVGSINYIRNEELTPLTIIGQSPAKGTEVFEVIEIDLEVTN

SEQ ID NO: 11335 - DNA, 555 bp, Unknown
  Obtained from environmental sample
  misc_feature (1)..(555): n is a, c, g, or t
gtgatattatgtttacttgatttgacaactgaaaaaagattaaaaatatttttaccagcatgggctcctgattgtatcgagtataataacttagatatcacgagaggaaaactcaacaacctaaaagctactgacttaagagagtataacttaatagcaactaccgatggacattttgcatttagtgagtttggtttgaatcgagatgcggtattttcaagttttaaaatacttgaactacttcaaaaatctggaaaaacactctctaatataattgcacatatcccatattttgcttataaaggtgaaaatgtagcatgccctagtgaatttaaagggaagatgatgagaaagtttctagaggatgggaaaaataaaaaaactagctctgtagatggtgtgaaaatttggataagtgatgatgaatggattctaatggttccagatgaatacaatgattatttaaatatctatatccaagcagatgatgagaaaaatgctagtaaaatattctggaaataccaagaaaaaattgagaactggattagtgaataa

SEQ ID NO: 11336 - protein, 184 aa, Unknown
  Obtained from environmental sample
  misc_feature (1)..(184): Xaa is any amino acid
MILCLLDLTTEKRLKIFLPAWAPDCIEYNNLDITRGKLNNLKATDLREYNLIATTDGHFAFSEFGLNRDAVFSSFKILELLQKSGKTLSNIIAHIPYFAYKGENVACPSEFKGKMMRKFLEDGKNKKTSSVDGVKIWISDDEWILMVPDEYNDYLNIYIQADDEKNASKIFWKYQEKIENWISE

SEQ ID NO: 11337 - DNA, 393 bp, Unknown
  Obtained from environmental sample
  misc_feature (1)..(393): n is a, c, g, or t
ttgattgctgatgaaaaaagttttaaaaaagctatattattcgaaaataacttttttatagcctattgtccttatgcatctcgatatccttttgagataactattgttgctaaaaaaaacctcacctcattaattgattttactgatgtggatatctattcattaagtgaagttatcagtttttgttttttaaaacttaagtctgctttgggaaaaccagattttaatatgcttattaaaaatggagatatacaatcttctacaaactcaaatcgttttcatatagaaattttacctcgactttataagacggctggatttgagttagatacagatataatggtgaatacttttttaccagaaacagcagcagaaattttaaaagagagttaa

SEQ ID NO: 11338 - protein, 130 aa, Unknown
  Obtained from environmental sample
  misc_feature (1)..(130): Xaa is any amino acid
MIADEKSFKKAILFENNFFIAYCPYASRYPFEITIVAKKNLTSLIDFTDVDIYSLSEVISFCFLKLKSALGKPDFNMLIKNGDIQSSTNSNRFHIEILPRLYKTAGFELDTDIMVNTFLPETAAEILKES

SEQ ID NO: 11339 - DNA, 597 bp, Unknown
  Obtained from environmental sample
  misc_feature (1)..(597): n is a, c, g, or t
atgttaaaaagtataagtttatttatcctaattactatagtgacaggttgtagtgtaaaacaaccctatattacagaatacaacatgaagataaaagagtttccaaaaaatgaaatatcaaaaaaatgtaataataaaacattaaaagtactccaagcttttagtgataatactcttatgagtaccaatatgaattatattttaggcaaatataaacaatactcttttaccaagtcacagtggagtattccagttaatcaaatggtcaccataaatctcactaatatgttaagtcaattagatgtttttaaaagtgtacaaaactacaaatccatcacaaaagatgactacataattcaaagtaacataatagattttaaacaatattttagtgaagattcaaaatcatcatatgtaaaagttataatcaatatctcactaatagactataactcaaataccgtcatccattcaaaaactttttcatctgttataaatagtgcaacacaagatgcatatggtggagttaaagctttcaataaagcatttacaaaagtactagaagaaattgataaatggattgtttccatttgttaa

SEQ ID NO: 11340 - protein, 198 aa, Unknown
  Obtained from environmental sample
  SIGNAL (1)...(19)
  misc_feature (1)..(198): Xaa is any amino acid
MLKSISLFILITIVTGCSVKQPYITEYNMKIKEFPKNEISKKCNNKTLKVLQAFSDNTLMSTNMNYILGKYKQYSFTKSQWSIPVNQMVTINLTNMLSQLDVFKSVQNYKSITKDDYIIQSNIIDFKQYFSEDSKSSYVKVIINISLIDYNSNTVIHSKTFSSVINSATQDAYGGVKAFNKAFTKVLEEIDKWIVSIC

SEQ ID NO: 11341 - DNA, 798 bp, Unknown
  Obtained from environmental sample
  misc_feature (1)..(798): n is a, c, g, or t
atgaaacaaatcgataccttgatacttcaatctatacataaatactcaaatattattatgttttcccttgatacaaattatagatatatatcattttcacaaaaatataatgcggttattaaaaataaattagatatagatataaaaataggtgattgcatgttagattctattgaagatacttttgataagaatcgagcaaaatgtcattttgataaagtattacaaggtgatagttttacactcagtgaagagtttattgataaaaaaactatatctactcattgggaaaattattatactcctatatatgaaaatgaaaatatcataggtataaatataataatatttgatgtgacacatcatgtaaggatttcaagaaaatttgatgaagtcaaactatttgaagaaatagtaaatttaattgatgtaggcatcgctatagttgaccctcatcaacaagatatcccaataatatatattaataacagcttttctaaaattactggctatcaaaaagatgaagttataggtaaaaatgggagttttttacatcaaaatgatttagaacaagatgaaataaaactattagaagatgcaatatcaaataaaagtaaatgtgaagtcgttctaaggttttataaaaaagataatacattgttttttgcacttttaaatataacaccaattttggatataaatggagaagtaatttatgtggtaggggttttaattgatatcacaaatactattgagataaaaaaccttgaagtatcaaaagattatcagcaggattaa

SEQ ID NO: 11342 - protein, 265 aa, Unknown
  Obtained from environmental sample
  DOMAIN (133)...(198): PAS domain
  misc_feature (1)..(265): Xaa is any amino acid
MKQIDTLILQSIHKYSNIIMFSLDTNYRYISFSQKYNAVIKNKLDIDIKIGDCMLDSIEDTFDKNRAKCHFDKVLQGDSFTLSEEFIDKKTISTHWENYYTPIYENENIIGINIIIFDVTHHVRISRKFDEVKLFEEIVNLIDVGIAIVDPHQQDIPIIYINNSFSKITGYQKDEVIGKNGSFLHQNDLEQDEIKLLEDAISNKSKCEVVLRFYKKDNTLFFALLNITPILDINGEVIYVVGVLIDITNTIEIKNLEVSKDYQQD

SEQ ID NO: 11343 - DNA, 606 bp, Unknown
  Obtained from environmental sample
  misc_feature (1)..(606): n is a, c, g, or t
gtggtnnnnnntggtggtgggattcaaagatttttcacagtttctccaaaaaaagtaagagatcaaacaattttattttttggaagaatagaaccaagaaaacaagttcatgttttaatagaagctttttcaaaaatttcagaaaaatatcctaaagcaaaattgcttcttttgggcccaatagaaaatactatggattatgaaaatcagctaaaacaattaattaaattaaaccatttggaagaaagagttttatttttaggcccaatttacgatatgggaaaaaaaattgatattttgaactcttcccaactttatgttcttccaagcacatgggaaggattcccccaaactttaattgaaatgatgagtttgggcaaatgtataatcgcctctaattgtaatggaaataaagaagtaataaaagattacaagacaggatttttgtttaatattggagattcaaatgaacttgcagaaaaaataagtttttgtttatcaaacgatacctccagaatagaagataatgcaaaacaattatctgaaaattttaaatgggaaaaaatagttgatgatgttgaagaaatttataaacaactaatctaa

SEQ ID NO: 11344 - protein, 201 aa, Unknown
  Obtained from environmental sample
  DOMAIN (8)...(180): Glycosyl transferases group 1
  misc_feature (1)..(201): Xaa is any amino acid
MVXXGGGIQRFFTVSPKKVRDQTILFFGRIEPRKQVHVLIEAFSKISEKYPKAKLLLLGPIENTMDYENQLKQLIKLNHLEERVLFLGPIYDMGKKIDILNSSQLYVLPSTWEGFPQTLIEMMSLGKCIIASNCNGNKEVIKDYKTGFLFNIGDSNELAEKISFCLSNDTSRIEDNAKQLSENFKWEKIVDDVEEIYKQLI

SEQ ID NO: 11345 - DNA, 669 bp, Unknown
  Obtained from environmental sample
  misc_feature (1)..(669): n is a, c, g, or t
atgcttgaagtattaggaaaagatgatacggatgtagtacttattataagagaacaatgggattatttgagatcattctataaaaatatgataagaacaagtagtttccctcattcttatcaatatttttgtgaatatgttcttgatcatcacaatagttttttaatgccctatttaagatatgataaacttatagaaggtttaaataagattactccaaatttaaaagttataacgctttcagaattttcaaaaaagcaatcttggattcataaagaattaaatattaaaactggcataagtaaacattctaacaaagctttacctgattcttggatggaatggaaaaggagagagtcatttacaaaaaatatttataagcaagatgcctattataatagagttttttggccaacatataggaaaaaaattctcgatcaacctgatttgtttaaatcgttgaaaaatgaaatggataaaaaatataattatgaaacatggatcaaatataggctattccaagtaaaaaacttcttctttaaatataaaatagattatagtgttagtgatgaagtatataaaaatttagatgtaatatttaaaaaaagtaatttgaaaataaaaagagaattccatatcaatattatggaatcaaagaataataaataa

SEQ ID NO: 11346 - protein, 222 aa, Unknown
  Obtained from environmental sample
  misc_feature (1)..(222): Xaa is any amino acid
MLEVLGKDDTDVVLIIREQWDYLRSFYKNMIRTSSFPHSYQYFCEYVLDHHNSFLMPYLRYDKLIEGLNKITPNLKVITLSEFSKKQSWIHKELNIKTGISKHSNKALPDSWMEWKRRESFTKNIYKQDAYYNRVFWPTYRKKILDQPDLFKSLKNEMDKKYNYETWIKYRLFQVKNFFFKYKIDYSVSDEVYKNLDVIFKKSNLKIKREFHINIMESKNNK

SEQ ID NO: 11347 - DNA, 744 bp, Unknown
  Obtained from environmental sample
  misc_feature (1)..(744): n is a, c, g, or t
atggtgagtgtatttatcaagaaacccgtgcaaaagcggagtttatggcaaaaaatctggaaaaagcaaatacctgaaaacctgatcatagaaattaataacttgctggcaggcagacctatcttagaagcatcgccggcagacataaaaatgatttctcaaagatatgatgctgtgacactggcaaaaacccaacgtcggctgctgggttattattacctgtatttacaggaatgcctggaagacaaaaaactcactgagcaggagatagcagagcttgccaagctgaagctgcttttaggcttatcagacagactgatcaaagaaacgcattctgcggtagttacaagattatacagcaaagaagtaggacaaagcttaaatgacggcaccatcgacagtgaagaacaggattttctggatagactaagtgaaaatctgctgctttccaaagagcgaaccgatgagatactggctaaacaggcaaataaaaagatcggtgaaaagttagatgagatcatggaagatggtaggatcacaccggaagaagaaactgattttcaggcattagtccaaaatctgggtttaaagtcagaccttgcttttcaaactcaggagatttacgaaaaatacaaaatctactggcaattggaaaacgaggttctgcctgtaatagccaccgatattcagttacgagactcagaactcgcctgtttcactgcaccctgccaatggtatgaatca

SEQ ID NO: 11348 - protein, 248 aa, Unknown
  Obtained from environmental sample
  misc_feature (1)..(248): Xaa is any amino acid
MVSVFIKKPVQKRSLWQKIWKKQIPENLIIEINNLLAGRPILEASPADIKMISQRYDAVTLAKTQRRLLGYYYLYLQECLEDKKLTEQEIAELAKLKLLLGLSDRLIKETHSAVVTRLYSKEVGQSLNDGTIDSEEQDFLDRLSENLLLSKERTDEILAKQANKKIGEKLDEIMEDGRITPEEETDFQALVQNLGLKSDLAFQTQEIYEKYKIYWQLENEVLPVIATDIQLRDSELACFTAPCQWYES

SEQ ID NO: 11349 - DNA, 456 bp, Unknown
  Obtained from environmental sample
  misc_feature (1)..(456): n is a, c, g, or t
atggctgtcattaaaagaaaaaatgatagagctattatgatttttaatcctccatcaaacttacaatggggttttggttacaatatagttgtaaatagtattgatttatataatggattaaaagagattaaaaaaatatcagatattcaaaagttaaactctatagagaattattctaactattatatagatgctaatactattaatctttttgatataaaaaatcaaaataatattataaaaaatctaactggggtatatcaaaaaggttatttgtattttaaaaaaggaactaaagaggaaaaaataaaactctacttttacaaagagttacaaagaccaaaggacggtgaaaaaatcaccataacctccggtcacttaagtatatataaatcaaaaattcaaattgttttatatagtaaaaaagactttattaagcatgtccaagaaatttaa

SEQ ID NO: 11350 - protein, 151 aa, Unknown
  Obtained from environmental sample
  misc_feature (1)..(151): Xaa is any amino acid
MAVIKRKNDRAIMIFNPPSNLQWGFGYNIVVNSIDLYNGLKEIKKISDIQKLNSIENYSNYYIDANTINLFDIKNQNNIIKNLTGVYQKGYLYFKKGTKEEKIKLYFYKELQRPKDGEKITITSGHLSIYKSKIQIVLYSKKDFIKHVQEI

SEQ ID NO: 11351 - DNA, 741 bp, Unknown
  Obtained from environmental sample
  misc_feature (1)..(741): n is a, c, g, or t
atgaaaatcttatatattcttgtatttgtattttcgttttttttagaagcacgggattttaaagttgcgtcgtataatgttgaaaatctttttgatttaaaatatgatggaacagagtataaagagtacaaacctaatacaaaaacttgggataaaaactcttttactaaaaaaatagaaaatattgcacaagttatcaatgatctgaatgcagatattatagctttacaagagatagaatctaaagaggcacttaacactctagtaaaaaaagctccccaatataaatatcacacctttcttaaaaaagaaacctcttctgtaggtgttgcacttttaagcatctatcctataaaaaactcaacaaaaattgatgtagattccaatgacaaatattctcgatatattttaaaagctacagttttaattgaagacaaaaagttaataatatttgtcaatcattggcgttcaaaaagagcagcagaaagcaaaagaattatctacgcaatgggattaaaaaaagagattgatagtttggataaaaatgaagattatattattttaggtgacctaaattctaattataatgaatttcaaactttcaaatatgataaaaatttaaatgatagctttggaataacaggtataaatcaaattttaaacactacagatagagaaaactttatccacatagaccatatgcttaacttcaaaaaaaggtacattataacctatggttag

SEQ ID NO: 11352 - protein, 246 aa, Unknown
  Obtained from environmental sample
  DOMAIN (20)...(245): Endonuclease/Exonuclease/phosphatase family
  misc_feature (1)..(246): Xaa is any amino acid
MKILYILVFVFSFFLEARDFKVASYNVENLFDLKYDGTEYKEYKPNTKTWDKNSFTKKIENIAQVINDLNADIIALQEIESKEALNTLVKKAPQYKYHTFLKKETSSVGVALLSIYPIKNSTKIDVDSNDKYSRYILKATVLIEDKKLIIFVNHWRSKRAAESKRIIYAMGLKKEIDSLDKNEDYIILGDLNSNYNEFQTFKYDKNLNDSFGITGINQILNTTDRENFIHIDHMLNFKKRYIITYG

SEQ ID NO: 11353 - DNA, 519 bp, Unknown
  Obtained from environmental sample
  misc_feature (1)..(519): n is a, c, g, or t
ttgagcttttccggtaagacagccctattgagagagatattctcagatgctgtgaaaaatggtaagaaattgattattttcactcagtttgtacagatgctgaagttattgaaagagatgttggacgaccttaatattcagcacgaatatatggatggctccactcgagatcgtcagaaagttatcaataatttcaatgaaaatgataatgtaagagctttcttagttagcttgaaaacaggtggatttggtttgaacctaacagcagccgatactgtgataatagtagatccttggtggaatccgatgggtgaaaaccaggcgattgatcgtgctcacagaatagggcagaccaagaaagtgaacgtgtataaaattattaccaaaggttccattgaagagaagattcttgatctgcaaaatcataagaaagagctttttgaaaatctgatcgaaggtggtagcggtgtattgaaaagtctgacaatagaagatctaaaaaacttgttggaatattag

SEQ ID NO: 11354 - protein, 172 aa, Unknown
  Obtained from environmental sample
  DOMAIN (40)...(116): Helicase conserved C-terminal domain
  misc_feature (1)..(172): Xaa is any amino acid
MSFSGKTALLREIFSDAVKNGKKLIIFTQFVQMLKLLKEMLDDLNIQHEYMDGSTRDRQKVINNFNENDNVRAFLVSLKTGGFGLNLTAADTVIIVDPWWNPMGENQAIDRAHRIGQTKKVNVYKIITKGSIEEKILDLQNHKKELFENLIEGGSGVLKSLTIEDLKNLLEY

SEQ ID NO: 11355 - DNA, 909 bp, Unknown
  Obtained from environmental sample
  misc_feature (1)..(909): n is a, c, g, or t
gtgataaaatccacgttttccgaaaatccttaccgtttaaattttgtggtaagcaaaaataatgataatggttatgtcttacgtccatcctcatcagaattgatctcagctacctacttgggcaaaacatcttatatctttaagaaaaatatagttcacgccaccaattttccttttaatcctgaaatttctgctaaaatttttcatgagggtttagaacttaaggctactgacttggtttatctcttttctgttgtggcacgccaacttagtcttatcaaatgctatttggatctggatgaagatatagtggttccaaaactttacaataatgttcccgtgatcacctttaaatttcataaagaggatgaggacatcattatggatggcggattggattatggcgataatgtgatgattcctatgtctgctgtgcgctttcctgcagaattagtacgctttgatcagcagggtgaagaatgttggttttacattccacctcagataaaatatgagatcaaacaattttcggaattactacctcaatctcaatctcatcgtttggaaaataaatcacaattggtgttttctgatgatgataatattgccgctttgaaacaggtgatatttgagcataccaaacctaattgggagattgaattatcggatgaattgaagcaggaatttatctataaagttgttttaaaacctataattaatactcatcagagtaagcatattaactggtttgaatatgatgtacagtacaattataaagatattagttttagtcatgaagagttaaaaaaattcttttcatcgcaagaaaatttatgcgcttgggaagatggtagaatgcttttctttgataataaagtgctttttgaccaagtggatgaacttattgaa

SEQ ID NO: 11356 - protein, 303 aa, Unknown
  Obtained from environmental sample
  misc_feature (1)..(303): Xaa is any amino acid
MIKSTFSENPYRLNFVVSKNNDNGYVLRPSSSELISATYLGKTSYIFKKNIVHATNFPFNPEISAKIFHEGLELKATDLVYLFSVVARQLSLIKCYLDLDEDIVVPKLYNNVPVITFKFHKEDEDIIMDGGLDYGDNVMIPMSAVRFPAELVRFDQQGEECWFYIPPQIKYEIKQFSELLPQSQSHRLENKSQLVFSDDDNIAALKQVIFEHTKPNWEIELSDELKQEFIYKVVLKPIINTHQSKHINWFEYDVQYNYKDISFSHEELKKFFSSQENLCAWEDGRMLFFDNKVLFDQVDELIE

SEQ ID NO: 11357 - DNA, 705 bp, Unknown
  Obtained from environmental sample
  misc_feature (1)..(705): n is a, c, g, or t
ttgaaggaccgggatttttcagggggtaacccccggaattttaaaaaaaaaaccggggggatttttccattcgggcatttcaaaaaaaaactgggacccgggtcaagggagaacaatcatttccccttattgaggggatttacaaaatggtgttgggaaatcaaagggtttgatacggaagatgatccggacacggaatcagaggaaacagacaatctcctgtccgaggagtatgacgtcaaaaacatggtatccaagctcaagacccttatgaccacgtatattgataccgggtccgactataccagcctggtagacctgggccttgaggtttccaaaaacggcaccatgagtctggatgaaaccaagcttgaacaggccatcgcttcaaatcccgaagccgtgcaatcgctttttatcggtgatgcggataaagggattaccggattgggggataccatcaatgacggaattacagacatggtcagttcccagggaatcgtgtccacggaaattgattcggctgaagccaggatggaaagactggacaagaatattcaatccgcaattgagcgcctggataaacggcataaaaccatgacggcccaatttggaaggcttgatacctatatcagccaactgaacagtgaatccgcctttatgcagtcaatgataacatcctttaacaatacaaaagataattag

SEQ ID NO: 11358 - protein, 234 aa, Unknown
  Obtained from environmental sample
  DOMAIN (8)...(216): Flagellar hook-associated protein 2 C-terminus
  misc_feature (1)..(234): Xaa is any amino acid
MKDRDFSGGNPRNFKKKTGGIFPFGHFKKKLGPGSRENNHFPLLRGFTKWCWEIKGFDTEDDPDTESEETDNLLSEEYDVKNMVSKLKTLMTTYIDTGSDYTSLVDLGLEVSKNGTMSLDETKLEQAIASNPEAVQSLFIGDADKGITGLGDTINDGITDMVSSQGIVSTEIDSAEARMERLDKNIQSAIERLDKRHKTMTAQFGRLDTYISQLNSESAFMQSMITSFNNTKDN

SEQ ID NO: 11359 - DNA, 675 bp, Unknown
  Obtained from environmental sample
  misc_feature (1)..(675): n is a, c, g, or t
atggaattaatataccctatgagtttagaaaataaccaatacctaaaattaactagaaatataaattcttcccataaaatgttaaataaaatatttagtaacttattatttttaggtactggtggtcttattttgattattatatatgcttttgctatgtctaaaactttactatttccaattttaagaattactaataaactctcaaatatgaatgaaaactctcttacgcaaatagatacaaaaaagatgcctcaagaatttataccactagctaactctattaatactcttacaacaagaattgaaaatcatgtaaaataccaaaaagagctttttattggggctgcgcatgagcttaaaacaccacttgcagttatgaaactaaaaagccaagtaaccttacggaaaaaaagagagcctgaaaaatatgaagaggttttaaaagtacatcttgaagagatagatgggatgaaccatatgataacttctatacttgacatgngtagacaagagggagcccaatttgaaaagcctgtagagcttgatattgtcaactatcttaaaacaaaagcggaaagctttaaacttttagcctgtgaaaaaaatatcaatttagagtttcatacagagatagatagttttcccaacaattattcaacaaacactttttaa

SEQ ID NO: 11360 - protein, 224 aa, Unknown
  Obtained from environmental sample
  DOMAIN (35)...(104): HAMP domain
  misc_feature (1)..(224): Xaa is any amino acid
MELIYPMSLENNQYLKLTRNINSSHKMLNKIFSNLLFLGTGGLILIIIYAFAMSKTLLFPILRITNKLSNMNENSLTQIDTKKMPQEFIPLANSINTLTTRIENHVKYQKELFIGAAHELKTPLAVMKLKSQVTLRKKREPEKYEEVLKVHLEEIDGMNHMITSILDMXRQEGAQFEKPVELDIVNYLKTKAESFKLLACEKNINLEFHTEIDSFPNNYSTNTF

SEQ ID NO: 11361 - DNA, 384 bp, Unknown
  Obtained from environmental sample
  misc_feature (1)..(384): n is a, c, g, or t
ttgtctttaattctttgctttagattttttattttatttttcataattacttttatacactacaattgtagtttgattatgaattattacataactatacttacacattactattgtagggtgaatatgaataaaaaaattaatgatttaactgctgatgaattgcataaattaattggtgccaatgttgcaaaactgcgaaaaaaagctaatttaagtcaattagctctgtcattagagatgggaaataaatctccaagtcttgttagttctgctgaactatatacaaataaaagacattttaatattgtgcaacttcaaaagattgcaaagattttagatattgatatttgtgagttttttgatgatagtacaataggctaa

SEQ ID NO: 11362 - protein, 127 aa, Unknown
  Obtained from environmental sample
  DOMAIN (63)...(120): Helix-turn-helix
  misc_feature (1)..(127): Xaa is any amino acid
MSLILCFRFFILFFIITFIHYNCSLIMNYYITILTHYYCRVNMNKKINDLTADELHKLIGANVAKLRKKANLSQLALSLEMGNKSPSLVSSAELYTNKRHFNIVQLQKIAKILDIDICEFFDDSTIG

SEQ ID NO: 11363 - DNA, 681 bp, Unknown
  Obtained from environmental sample
  misc_feature (1)..(681): n is a, c, g, or t
gtgagtattggtgaagttaaacgagcattaaaagctgggattccaaaatataagattatattttctggtgttgggaagattgataatgagattagagaagctttacaacttgatattttgatgataaatgttgagagtgaagcagaactaaaaagagttgatatcatagccaaagaacttaaggtagaagctagaatatctatacgagtaaatccaaatgtagatccaaaaacccatccatatatttcaactggactccatgagaataaatttggtgtagatatcaatactgcaaaaagaatgtatatctttgctaaacaaagtgaaaacttagaccctctaggtatccactgtcacatagggagtcagcttacagagttagcacctatcaaagaagctgtaaatatcgttgcagatttagttagaaatataaaatctgcactaaaaattgagttaaagttttttgatgttggtggtggacttggtattgtctatgatgatgagaagcttatagatacttacgaatatgctcaaactgtattagatgctctttttggactggatatcacggtagtgtgtgaaccaggaagatttatcgttggaaatagcggtgtatttgttacgaaagttttatatgaaaaagtaaatggtagcaaaagatttgttatcgtgaggggctag

SEQ ID NO: 11364 - protein, 226 aa, Unknown
  Obtained from environmental sample
  DOMAIN (1)...(202): Pyridoxal-dependent decarboxylase, pyridoxal binding domain
  misc_feature (1)..(226): Xaa is any amino acid
MSIGEVKRALKAGIPKYKIIFSGVGKIDNEIREALQLDILMINVESEAELKRVDIIAKELKVEARISIRVNPNVDPKTHPYISTGLHENKFGVDINTAKRMYIFAKQSENLDPLGIHCHIGSQLTELAPIKEAVNIVADLVRNIKSALKIELKFFDVGGGLGIVYDDEKLIDTYEYAQTVLDALFGLDITVVCEPGRFIVGNSGVFVTKVLYEKVNGSKRFVIVRG

SEQ ID NO: 11365 - DNA, 753 bp, Unknown
  Obtained from environmental sample
  misc_feature (1)..(753): n is a, c, g, or t
atgcttattaaaatcctggaacatgtcggaaaggtaaacacaaaaactccccatgagaatattaaggaaatttatagcagcttaattaaactcgatgaacttaatatgtttatggtgataaagtttttgacctatttgaaattcgatcgggaagagtatgtatattactacaaaaagcatgataaggttctcagcaaaaatattagtaaaataatgacgaccgttatcaaggatacagggaaaggtaaatggctgaccatgaaagatctctatctttatcttgagtatcatgaaaacctctttcttgtttttcccctccaatatgacgatacgactttttatttcaatgagaccgacaccaatttttatgatcagcgtgagagaatagccattaactctgaaaactatttcgacactgtgtttcaaccatttatgcgggcctttttctatgttctggcgtcccttggtatagtcgatttagcgggaacagagccttttaacgatcgctttcactcaaacaagaataagtatctgtccctttttgatggtttggaagcggccaggctgacccctctgggggcctatgcattgggcttaactaaaaaaattccggttcttttaaatgacacagacccttttgaaatccaccttgatgatcagtttctattgattcggactaagggccccgacagggtaagggattttattatccagggtcttgccgaaaaaagtaaaccccgaaaccccccatag

SEQ ID NO: 11366 - protein, 250 aa, Unknown
  Obtained from environmental sample
  misc_feature (1)..(250): Xaa is any amino acid
MLIKILEHVGKVNTKTPHENIKEIYSSLIKLDELNMFMVIKFLTYLKFDREEYVYYYKKHDKVLSKNISKIMTTVIKDTGKGKWLTMKDLYLYLEYHENLFLVFPLQYDDTTFYFNETDTNFYDQRERIAINSENYFDTVFQPFMRAFFYVLASLGIVDLAGTEPFNDRFHSNKNKYLSLFDGLEAARLTPLGAYALGLTKKIPVLLNDTDPFEIHLDDQFLLIRTKGPDRVRDFIIQGLAEKSKPRNPP

SEQ ID NO: 11367 - DNA, 366 bp, Unknown
  Obtained from environmental sample
  misc_feature (1)..(366): n is a, c, g, or t
gtggatttaagtgataagtttaaaggaagttacagtgttaatcttaggattttaactaaaaaatctaagctaggttttgggtatcaagatataaaagagttacgtattcaggatttgcttatcgccaacaaacacaaagaacttatccgaatttattttggcttagataaaatttcttttattgatgaaatcctagaagaaattggcattacccaagatatgaaaattgaaaaaccgggtaaaattgttgatactgacgatagagaagtgctgattaaaaaagcaatggaaaacgttaaagtacaacgcataaaagatagagaagccttcaaaaaaatgatggaaaaagaattggacttgaattaa

SEQ ID NO: 11368 - protein, 121 aa, Unknown
  Obtained from environmental sample
  misc_feature (1)..(121): Xaa is any amino acid
MDLSDKFKGSYSVNLRILTKKSKLGFGYQDIKELRIQDLLIANKHKELIRIYFGLDKISFIDEILEEIGITQDMKIEKPGKIVDTDDREVLIKKAMENVKVQRIKDREAFKKMMEKELDLN

SEQ ID NO: 11369 - DNA, 900 bp, Unknown
  Obtained from environmental sample
  misc_feature (1)..(900): n is a, c, g, or t
gtggatggggaagaatatgttagatttgcagctagtcaaacaaaagatatgcaattaggagatttgcgggttgcgatatttaatcatatactatcaaaacaacttaatgttgaactactagttagaatagaagataccgataaagaaaaaaatatagagggaaaagataaagaagcactagagattttaggactttttagtatagatttttcaagagttgtatatcaaagtgagaatatcaaataccatacacaaatggctatgaaactattgcttgataaaaaagcttttaattgtttttgtagtgatgaagcgttagagcaagataaacaaaaagcaaaaaaagaaggaaaaccatatagctacggtggattttgtgaaacaatcagtgatgaaacaaaattcaactgtaatgctccatttgtagtaagacttaaaaaaccagaacatactataaagtttacagatcttataaaaggtgattgttcgtataagccaaatgaagtagatagttttgtaattttaaaacatgacaaatctcctacatataattttgcatctgctgttgatgatatgttgcatgatatttcaacagttattagaacagaggaacacttatctaatacacctaaacaaattcatgtgcgagagtctttaggatatgataaagagattcaatatatccatataccaagtatttctaaacttgaagaagagaacaacttatctgtaaaataccttattgatgaggggtacttaccagttgctattgcaaattattgcgtacttcttggatataatactccacaagaaatatttactattgaagaggctattgagtggtttgatataaataaactctcccctgaacctggagaatttgatataaataaactttaa

SEQ ID NO: 11370 - protein, 299 aa, Unknown
  Obtained from environmental sample
  DOMAIN (4)...(299): tRNA synthetases class I (E and Q), catalytic domain
  misc_feature (1)..(299): Xaa is any amino acid
MDGEEYVRFAASQTKDMQLGDLRVAIFNHILSKQLNVELLVRIEDTDKEKNIEGKDKEALEILGLFSIDFSRVVYQSENIKYHTQMAMKLLLDKKAFNCFCSDEALEQDKQKAKKEGKPYSYGGFCETISDETKFNCNAPFVVRLKKPEHTIKFTDLIKGDCSYKPNEVDSFVILKHDKSPTYNFASAVDDMLHDISTVIRTEEHLSNTPKQIHVRESLGYDKEIQYIHIPSISKLEEENNLSVKYLIDEGYLPVAIANYCVLLGYNTPQEIFTIEEAIEWFDINKLSPEPGEFDINKL

SEQ ID NO: 11371 - DNA, 696 bp, Unknown
  Obtained from environmental sample
  misc_feature (1)..(696): n is a, c, g, or t
ttggtggtggttggaagccataattatattgagataattgccaatatgaacagtgaaaaaagtgatttctttattgtgaaagatgaaaaaaataaaataattgtccctaaaaaatctgatggacaatttttatttatgcaacatatcataaacctcatgaacaaagaaacaaaaagaggtaaaaaggctcaagcagcaattataagttcagcaactttaataagtactggtaactctagaagtagtgaatctaagataagaaaagctatctttaatgaaggattagtaagtgctgtattagagcaaccaaatgcaatgtttacaaatactgacataagttctcatatatggttttttgatactgataaaagtgatggtattaaaatagtaaaagctgacacaaaagaagcagaactatttagccctcatctagaggctaaagataagatgaagaacagttacagcatacaaaatataaaagatataaaaacttatatagaaagaaaaaaagaatatcaatatatttcaaaaaacattaaattaaaagatttaatagaagtaaatataagtaatgaagttggttctaaagatgaaacagaagatataagttttgatgagcttgaaactgaactaaatagcattatgctagagctatgtgaggattttaaaaataatagtttatttggagtaaaatag

SEQ ID NO: 11372 - protein, 231 aa, Unknown
  Obtained from environmental sample
  DOMAIN (16)...(190): N-6 DNA Methylase
  misc_feature (1)..(231): Xaa is any amino acid
MVVVGSHNYIEIIANMNSEKSDFFIVKDEKNKIIVPKKSDGQFLFMQHIINLMNKETKRGKKAQAAIISSATLISTGNSRSSESKIRKAIFNEGLVSAVLEQPNAMFTNTDISSHIWFFDTDKSDGIKIVKADTKEAELFSPHLEAKDKMKNSYSIQNIKDIKTYIERKKEYQYISKNIKLKDLIEVNISNEVGSKDETEDISFDELETELNSIMLELCEDFKNNSLFGVK

SEQ ID NO: 11373 - DNA, 630 bp, Unknown
  Obtained from environmental sample
  misc_feature (1)..(630): n is a, c, g, or t
atgattcatggtatatgtcctgctgtgaagtgtccagaaggaagagaaaagaaatgttccttatgcccttatttaataacaggtaagctatttttaaatggtataacattgaaagtgaatcaagcatttgctaattttaatagagattctatgcaaaaacaggaggaatcaaaaaaaggttataaaaaccaagctcttgcagaatccttagaagttacacttgaagagatattgggatgggtagaaataatagaaaagataaatcttgaaatcaataatacaggtaatccaaacgagcaagggaaagaactgtctatatataaaaaaagtgctataggcgtagaaataatagaaaaagaattagcgtatcttaaaaatgcctatgattccaaaataataggtgtagaacaagatatagtgggactcaagcacttaacaataaaagctatgaaaattgctgtacaaatgaatgactatgataaagttgattttttatcagataacgaagaggaatcgatagattacctaatgaaatattataaaggaaatttattacagagaactagtgttgtaaatttcatatcaacagttaaagacattaagagattagaagctaataatttacagtaa

SEQ ID NO: 11374 - protein, 209 aa, Unknown
  Obtained from environmental sample
  misc_feature (1)..(209): Xaa is any amino acid
MIHGICPAVKCPEGREKKCSLCPYLITGKLFLNGITLKVNQAFANFNRDSMQKQEESKKGYKNQALAESLEVTLEEILGWVEIIEKINLEINNTGNPNEQGKELSIYKKSAIGVEIIEKELAYLKNAYDSKIIGVEQDIVGLKHLTIKAMKIAVQMNDYDKVDFLSDNEEESIDYLMKYYKGNLLQRTSVVNFISTVKDIKRLEANNLQ

SEQ ID NO: 11375 - DNA, 729 bp, Unknown
  Obtained from environmental sample
  misc_feature (1)..(729): n is a, c, g, or t
atggaattaatataccctatgagtttagaaaataaccaatacctaaaattaactagaaatataaattcttcccataaaatgttaaataaaatatttagtaacttattatttttaggtactggtggtcttattttgattattatatatgcttttgctatgtctaaaactttactatttccaattttaagaattactaataaactctcaaatatgaatgaaaactctcttacgcaaatagatacaaaaaagatgcctcaagaatttataccactagctaactctattaatactcttacaacaagaattgaaaatcatgtaaaataccaaaaagagctttttattggggctgcgcatgagcttaaaacaccacttgcagttatgaaactaaaaagccaagtaaccttacggaaaaaaagagagcctgaaaaatatgaagaggttttaaaagtacatcttgaagagatagatgggatgaaccatatgataacttctatacttgacatgggtagacaagagggagcccaatttgaaaagcctgtagagcttgatattgtcaactatcttaaaacaaaagcggaaagctttaaacttttagcctgtgaaaaanatatcaatttagagtttcatacagagatagatagtttcacaacaattattcaacaaacacttttaacacaaattatccaaaactttgttcaaaatgctattaaatttaccccgaataaataa

SEQ ID NO: 11376 - protein, 242 aa, Unknown
  Obtained from environmental sample
  DOMAIN (35)...(104): HAMP domain
  misc_feature (1)..(242): Xaa is any amino acid
MELIYPMSLENNQYLKLTRNINSSHKMLNKIFSNLLFLGTGGLILIIIYAFAMSKTLLFPILRITNKLSNMNENSLTQIDTKKMPQEFIPLANSINTLTTRIENHVKYQKELFIGAAHELKTPLAVMKLKSQVTLRKKREPEKYEEVLKVHLEEIDGMNHMITSILDMGRQEGAQFEKPVELDIVNYLKTKAESFKLLACEKXINLEFHTEIDSFTTIIQQTLLTQIIQNFVQNAIKFTPNK

SEQ ID NO: 11377 - DNA, 654 bp, Unknown
  Obtained from environmental sample
  misc_feature (1)..(654): n is a, c, g, or t
ttgtccaaaatttcaaatccaaaattcaaaactcaacttgatgatccagcttttgttatctttacaagtgggacgagtggacctagtaagggagctttattttctcatagaagagcaattggagctggaattgcttggagtttaagaacaggtatgacaagtagtgataactgttatattccacttcctttatatcatgggaatgctttagctgttgcttttagcagtgttatttttgcaaatgcaacagcaactctacggataaaattttcaactacacatttttttgaagatataaatagttataaatgtaattatatggtttatattggggagctttggagatatatactaaaaagatatgacacaaatcccaataagtatttaaaagtgatatttggaaatggtttaacaaaaaaactgtggaataaagttgtagaacagtttaatataactcatgtagtagaacattttggctcaaccgagatgccagcaggtgctttgacaaattggtttgacaaagaggggtattgtggctatttacctgcggatgacccaagacttaatgagatggtactagtagatgagaactacaaagtagtttcttatgggaaaaagtggtcaagcacttttaaagtcctcgagccaatctga

SEQ ID NO: 11378 - protein, 217 aa, Unknown
  Obtained from environmental sample
  misc_feature (1)..(217): Xaa is any amino acid
MSKISNPKFKTQLDDPAFVIFTSGTSGPSKGALFSHRRAIGAGIAWSLRTGMTSSDNCYIPLPLYHGNALAVAFSSVIFANATATLRIKFSTTHFFEDINSYKCNYMVYIGELWRYILKRYDTNPNKYLKVIFGNGLTKKLWNKVVEQFNITHVVEHFGSTEMPAGALTNWFDKEGYCGYLPADDPRLNEMVLVDENYKVVSYGKKWSSTFKVLEPI

SEQ ID NO: 11379 - DNA, 885 bp, Unknown
  Obtained from environmental sample
  misc_feature (1)..(885): n is a, c, g, or t
ttgccgcaagaaaaagcggacaactctgtcaaaccaaatgagaagaaaaaagctctagtagagattatcaacgactataacactcagtacggcacaaaccacgacataaacaactttgatacctactaccaagatgtacaacaacggatcaaagaccagcagtattcaaaccaagattatcctcataaaaacaagatagatataaccatagtagttgatatgctcctaactggatttgactctaaatatctaagtactctctatgtagataaaaacctaaaatatcatggacttatccaagcattctcaagaacaaacagaatattaaacgacaccaaaccttatggtaatatcttagattttagagcacaagaggctgaagtagataaggcgatgatactcttctcaggcaaagaagataaagagcaagccaaaaagatatggcttgtggatgctgctcctgtcgtgatagagaaacttgaccacgctgtaactgccatagagagctttatgacttcaaaaggacttgataacactccccaagatgtcaataacctacaaggggatgatgataaagcacgatttatcaatctctttaaagaggtacaacggctaaaaacccaactagaccaatacacagacctaagagatgaggacaaagaggctatcgaagaagtgatacccaaagatacccttagagcttttaaaggtgtctatcttgaaacagcgtcaaaactcaaagcactgcaagataaaagcaaaggtgaaacttctgatttgatagaacagcttgattttgagtttgtcctttttgcctctgcggtgattgactatgactatattatgagccttattgctaatacacaggtacaacaactgaaaacc

SEQ ID NO: 11380 - protein, 295 aa, Unknown
  Obtained from environmental sample
  misc_feature (1)..(295): Xaa is any amino acid
MPQEKADNSVKPNEKKKALVEIINDYNTQYGTNHDINNFDTYYQDVQQRIKDQQYSNQDYPHKNKIDITIVVDMLLTGFDSKYLSTLYVDKNLKYHGLIQAFSRTNRILNDTKPYGNILDFRAQEAEVDKAMILFSGKEDKEQAKKIWLVDAAPVVIEKLDHAVTAIESFMTSKGLDNTPQDVNNLQGDDDKARFINLFKEVQRLKTQLDQYTDLRDEDKEAIEEVIPKDTLRAFKGVYLETASKLKALQDKSKGETSDLIEQLDFEFVLFASAVIDYDYIMSLIANTQVQQLKT

SEQ ID NO: 11381 - DNA, 321 bp, Unknown
  Obtained from environmental sample
  misc_feature (1)..(321): n is a, c, g, or t
ttgtttagatttttttatgaagaaaataacttaaaaactgaagatgaaagtggtagaagattatttttggggaaagatttttttactaatggtaatagtaaatgtggtgaatatcaggctaaagaacaaaataaatgtagcaagttgtctattatagatgatagagtttttaaaaaagatgatttagaacatacaagttctgtcgttctttcaaagaatgatttttcaaagaatattttagaagaaaaagaaaatttcaataatttcaatattgaaaattttaaaaaaatatttgatcttattgagaagataataaaatga

SEQ ID NO: 11382 - protein, 106 aa, Unknown
  Obtained from environmental sample
  misc_feature (1)..(106): Xaa is any amino acid
MFRFFYEENNLKTEDESGRRLFLGKDFFTNGNSKCGEYQAKEQNKCSKLSIIDDRVFKKDDLEHTSSVVLSKNDFSKNILEEKENFNNFNIENFKKIFDLIEKIIK

SEQ ID NO: 11383 - DNA, 786 bp, Unknown
  Obtained from environmental sample
  misc_feature (1)..(786): n is a, c, g, or t
atgtttaaaaacagagcaaaagtggcacttgataaagatggagagatcaccgctttggaagcaaaggtaacaggacaatcaatcgttgtaaacacttttatggagggttcaagaaaaaacggtattgagcattttcaaacagaagggcttaccgataatccttatacgattgataataatgatatgcaaatatataccccaaactcccctatccaatgtactttttttagatcggttgggcattcacaaacagctccaactattgaggggatcatagatgaagcggcatttgcagcaaaaaaagatcctattttatatcgtttgaatcttttaaatgacctatcttctataaaagtcttagaagatgtagctaaaatatctaattggaaaaatcgtaagaaagagaaaaatgtaggttatggagttgcttttgttaaatcatttggaactctatgtgcccaagttgtaaaagtacgagtaaagggcaatgattttaaagtggagaaagtgtggtgcagtgtagattgcggttttgcctttaaccctttaaatgttgaaaaccaaatgataagctcgatcaattttggtatcgctatggttaaatatagtgagatcactattaaaaacggtgaagcggagcaaagcaacttttttgattatagagtttctacgatttccgatgcaccagaaatagaagtaagtattatcaattcgggtaatcctgtagggggtataggagaacctggtgttccagcaattatatctgctataccaaatgctaattga

SEQ ID NO: 11384 - protein, 261 aa, Unknown
  Obtained from environmental sample
  misc_feature (1)..(261): Xaa is any amino acid
MFKNRAKVALDKDGEITALEAKVTGQSIVVNTFMEGSRKNGIEHFQTEGLTDNPYTIDNNDMQIYTPNSPIQCTFFRSVGHSQTAPTIEGIIDEAAFAAKKDPILYRLNLLNDLSSIKVLEDVAKISNWKNRKKEKNVGYGVAFVKSFGTLCAQVVKVRVKGNDFKVEKVWCSVDCGFAFNPLNVENQMISSINFGIAMVKYSEITIKNGEAEQSNFFDYRVSTISDAPEIEVSIINSGNPVGGIGEPGVPAIISAIPNAN

SEQ ID NO: 11385 - DNA, 576 bp, Unknown
  Obtained from environmental sample
  misc_feature (1)..(576): n is a, c, g, or t
gtgtttgatattcccaaagaggaagttactccagatcagcgtagatatgcaaagatcataaattttggtttaatgtatgggatgggatctttccgaatttcacaggagctaaatatttcccgacaagaagcaaaagaatttatagaaaactatttcaataaatttccaactatcaaagaatatttgcattcaggcattcagaaagcaaccatagatggatttgttacaacaatctatggcaggaagctgttcctaccaaatttatacagttccaataaaatgttggtagaaggtgcaaaacgagttgctaccaacatgccaattcagggaagtgcagccgatattattaagattgccatgattacattgcacaaaagaatctataataatccggaaattaagatgataatacaagttcatgatgaactcgtttttgagatagaaaaggataaattggaagtagcaaaaaaaataattatagaagagatggaaaaagcaatcccagaaaaatatagaaatattgtaccgctgattgtagatgttggagttggacaaaactggtatgaagcacactag

SEQ ID NO: 11386 - protein, 191 aa, Unknown
  Obtained from environmental sample
  DOMAIN (1)...(190): DNA polymerase family A
  misc_feature (1)..(191): Xaa is any amino acid
MFDIPKEEVTPDQRRYAKIINFGLMYGMGSFRISQELNISRQEAKEFIENYFNKFPTIKEYLHSGIQKATIDGFVTTIYGRKLFLPNLYSSNKMLVEGAKRVATNMPIQGSAADIIKIAMITLHKRIYNNPEIKMIIQVHDELVFEIEKDKLEVAKKIIIEEMEKAIPEKYRNIVPLIVDVGVGQNWYEAH

SEQ ID NO: 11387 - DNA, 624 bp, Unknown
  Obtained from environmental sample
  misc_feature (1)..(624): n is a, c, g, or t
atgtgtcataaaataggtgctgtagttttagctgagggtgttgaaaagaataatgaaatagtaacttgtatgacaaaagacatagatatttatcaaggttttttcttttcaaaagcacaaaatagcattgataaaaatataaatgatatagtagtagataaaatagagataattcacaaagaatataaactattactaaaagagtattacgaaaaagagaaaaaacttttaaaaagatcaaaaaaaatcattaaaaaaacattagatattttaaatagtaatacacaagattatagaaaacagataacacaaataattaaaaacgataatcacatagaagcgatataccttcttgatttagagagtggattacaaattggggagacaattatagaagagataaatcaaagattgttatacagccctacaagtgatggacatgaccatagttttaaagagtattatttatatacaaaagactcaaaaaataaggaatatttaacagataagtatatctcaaaagctactggtaatatgtgtaatacatactgtttaaaaataaacttacaagaggcaaattatattttgtgttgtgatatagttgatgaaaagaatataatataa

SEQ ID NO: 11388 - protein, 207 aa, Unknown
  Obtained from environmental sample
  misc_feature (1)..(207): Xaa is any amino acid
MCHKIGAVVLAEGVEKNNEIVTCMTKDIDIYQGFFFSKAQNSIDKNINDIVVDKIEIIHKEYKLLLKEYYEKEKKLLKRSKKIIKKTLDILNSNTQDYRKQITQIIKNDNHIEAIYLLDLESGLQIGETIIEEINQRLLYSPTSDGHDHSFKEYYLYTKDSKNKEYLTDKYISKATGNMCNTYCLKINLQEANYILCCDIVDEKNII

SEQ ID NO: 11389 - DNA, 618 bp, Unknown
  Obtained from environmental sample
  misc_feature (1)..(618): n is a, c, g, or t
atgcgacctttataccaagaggttattttaccaaacctttgttacattggtggaggtggagaaatgatttattggctgcaattaaaatctaattttgaagcgcaaaaagtggtttttcctattttattacttcgtaattcggctttaattaaatctcaaaaacaagcttcaaaacttgaaagtttacaaatttcaaatcgcgatttatttttagatagacattcttttattaataagaaagttcgaaatatttcaaatatagatattgatttttctgagcaaattcaacatttaaaaaaacagtttaaagcactttttgatttagcagaacaaacggataaatcgtttataggtgctgtagaagctcaagaggtaaaacaaattaaaggattaaaacatcttgaaaaacgcttgttggtagcacaaaaacgaaaattagcagatcaaatagagcgctgtactgtactacaagaacaattgtttcctggtgaaagtttacaagaacgaaacacaaatttttcagaattatacttagaatatggagatcagttaattttagaacttactaaagttttgcaaccgcttaaaggcgaatttttaatattaaatttaaaataa

SEQ ID NO: 11390 - protein, 205 aa, Unknown
  Obtained from environmental sample
  misc_feature (1)..(205): Xaa is any amino acid
MRPLYQEVILPNLCYIGGGGEMIYWLQLKSNFEAQKVVFPILLLRNSALIKSQKQASKLESLQISNRDLFLDRHSFINKKVRNISNIDIDFSEQIQHLKKQFKALFDLAEQTDKSFIGAVEAQEVKQIKGLKHLEKRLLVAQKRKLADQIERCTVLQEQLFPGESLQERNTNFSELYLEYGDQLILELTKVLQPLKGEFLILNLK

SEQ ID NO: 11391 - DNA, 711 bp, Unknown
  Obtained from environmental sample
  misc_feature (1)..(711): n is a, c, g, or t
ttggtaactacctctttaaaatatagtacgcaattttatcaaaaacagttctcttcatatatcacaacttgtggaactacaagaatacctaaaaatgcaattgaacaagaaaagtttgaaagctatacagattatatggattttggatttgaaaaagataatgacggatacttttttaaaataggttcagttgtagatagttatggtatttgtaaaagtatgacagaaaatatccaaaccaactttaactatgaagtaaagagtttagagtataaagataatttgtggattgttaacggagagtttaaaacaaaaaatattattcttacaacaggatatgagacaaaattattggatcagttttatctcaatattcgagctgtgtggggaagaagaatagatattttgacctctacacaagtatcttataattatcataaagagtgttccgtatcaaaaagtacaaaaaaggatgataagtttttagtatctattggtgcaacacaccatagagataaaagagatgttgaagatattgaacacaatcatcaagagttattacaaaaagcaagaggaataatacaacttgaaaatatagagatagttaaagattattatggagcaagagctagcagtgtggattattttccaatagtaggggagttgattgatggtgaagcaacaattgaagagtttccttatctaaaataa

SEQ ID NO: 11392 - protein, 236 aa, Unknown
  Obtained from environmental sample
  misc_feature (1)..(236): Xaa is any amino acid
MVTTSLKYSTQFYQKQFSSYITTCGTTRIPKNAIEQEKFESYTDYMDFGFEKDNDGYFFKIGSVVDSYGICKSMTENIQTNFNYEVKSLEYKDNLWIVNGEFKTKNIILTTGYETKLLDQFYLNIRAVWGRRIDILTSTQVSYNYHKECSVSKSTKKDDKFLVSIGATHHRDKRDVEDIEHNHQELLQKARGIIQLENIEIVKDYYGARASSVDYFPIVGELIDGEATIEEFPYLK

SEQ ID NO: 11393 - DNA, 597 bp, Unknown
  Obtained from environmental sample
  misc_feature (1)..(597): n is a, c, g, or t
atggtaaataacatattaataaacctcaacaaagttgcagtaaaaattattttactcgctttcttgttattgccattattctctaatgctcaattttcgtttacgagtgagttagataaattaaattatgcatcaccgaaaacctatgaaattggtggcattactgtttcaggagctgaatcttttagcgggcaagcaattatttccttatctggttttgttgtaggacaagaaattaaagtgcccggagatgctgttacaggtgcaattaagaaactttgggatcaaaatctttttagcgaaattgaagtaagggcagtaaaaatagaggggactaaaatatttttaaatataaatgtaaaggaacttcctaggttatataaatttaagtttagaggaattaaaaagggcaaacaaaaatcattaagagaggaaattctacttacaacaggaatggtagtaaatgagaatttactaatgaataccaaaaataaaattaagtcttactttgttgctaaagggtttttaactaccgaagtaaaaatacctcaagaggaagatacactcagacaaaacaatgttattcctgaactttga

SEQ ID NO: 11394 - protein, 198 aa, Unknown
  Obtained from environmental sample
  misc_feature (1)..(198): Xaa is any amino acid
MVNNILINLNKVAVKIILLAFLLLPLFSNAQFSFTSELDKLNYASPKTYEIGGITVSGAESFSGQAIISLSGFVVGQEIKVPGDAVTGAIKKLWDQNLFSEIEVRAVKIEGTKIFLNINVKELPRLYKFKFRGIKKGKQKSLREEILLTTGMVVNENLLMNTKNKIKSYFVAKGFLTTEVKIPQEEDTLRQNNVIPEL

SEQ ID NO: 11395 - DNA, 330 bp, Unknown
  Obtained from environmental sample
  misc_feature (1)..(330): n is a, c, g, or t
ttgccgtggactaaaaaaatcgctcgagaattaaacgttcctgttcttgctttatcccagttatctcgtgccgtagaagccgaaaacccaccgataccaaaactatctcatctgcgtgactctggatcaatcgagcaagatgcagatattgtaatgtttgtatatcgtgaagattattataataaagaaagcactaaacaaaacgtaacagatatttttatttcaaaacatcgtaatggtgcaacgggatcttttgaattatttttcgagaaaacccaagccagttttaaaaatttagacaaagatcatattagtttgccacaaagttaa

SEQ ID NO: 11396 - protein, 109 aa, Unknown
  Obtained from environmental sample
  misc_feature (1)..(109): Xaa is any amino acid
MPWTKKIARELNVPVLALSQLSRAVEAENPPIPKLSHLRDSGSIEQDADIVMFVYREDYYNKESTKQNVTDIFISKHRNGATGSFELFFEKTQASFKNLDKDHISLPQS

SEQ ID NO: 11397 - DNA, 480 bp, Unknown
  Obtained from environmental sample
  misc_feature (1)..(480): n is a, c, g, or t
atgcaaaaacttgcctttgaagttttagagaccacaagaaacatgccctttaaacttccaagtgatgctatttatatcttaagggttagtgctattattgaaggattgggaactacttatatagaaaacttcaatggaataaaagatatcttgccaatattacaaaaaaatcttccaaaagcccttggtgcaaaagatactattactgagacaattattgatgaagtaaaagatttaccattttttgtaaaggatttaaaaaatgtagtcaaaaaagccagtgaaggaaatcttgaaattgaaatttcaaataatcaattggaatatgttgccaaagaattaaaaagttatctaaaaggtatcaccaactctttaatccttgtgctatctagcttctttattattttgtatgataaagatttaaaaagctttgcattaattcttttcctagcaggtataataaaacttttttataaatag

SEQ ID NO: 11398 - protein, 159 aa, Unknown
  Obtained from environmental sample
  misc_feature (1)..(159): Xaa is any amino acid
MQKLAFEVLETTRNMPFKLPSDAIYILRVSAIIEGLGTTYIENFNGIKDILPILQKNLPKALGAKDTITETIIDEVKDLPFFVKDLKNVVKKASEGNLEIEISNNQLEYVAKELKSYLKGITNSLILVLSSFFIILYDKDLKSFALILFLAGIIKLFYK

SEQ ID NO: 11399 - DNA, 474 bp, Unknown
  Obtained from environmental sample
  misc_feature (1)..(474): n is a, c, g, or t
atggttgcggtaagatattctcataggttaatatgtgatggggatttttgctcatggttgcatgctcaaccttcaaaacaaacaattctctcgagattaatgcacatcaaagcctcttcaaaagattggaaaaaaacacataatgttattttaaaaatcgaggccgatgcctgttctgggaaaatagaactcaaatatctagaggctgcatttaaggtaatggaagatccaaattttttagtaaattatggtgggaggacatcaaaaaatattgtttttggaatagatttaacaagtgatgtgccctttaagtgctaccttctaacttctccaaacaaggagcaagaatataagaataatccccacaatcaaggaatcaataatttcgaagtaatttctgggcagagggcaatcaatgttataaattctttttttaatgcattcgttgctgcaagagaccaagaaaggggataa

SEQ ID NO: 11400 - protein, 157 aa, Unknown
  Obtained from environmental sample
  misc_feature (1)..(157): Xaa is any amino acid
MVAVRYSHRLICDGDFCSWLHAQPSKQTILSRLMHIKASSKDWKKTHNVILKIEADACSGKIELKYLEAAFKVMEDPNFLVNYGGRTSKNIVFGIDLTSDVPFKCYLLTSPNKEQEYKNNPHNQGINNFEVISGQRAINVINSFFNAFVAARDQERG

SEQ ID NO: 11401 - DNA, 666 bp, Unknown
  Obtained from environmental sample
  misc_feature (1)..(666): n is a, c, g, or t
atgacaatcagtaaaaataaattacttatagcatcacttctcagtgttgcctttacaactacaaatgcatctgaaaatttaggaattattagcgtagagtcatctacaattgatgataaatttgccttaaaacgaaatgaagtatctcctacttcaacaataagtggcgaaaagattgacgaatcacatgtagaaaatgtccaaagagttttacaaagcataccaggtattactactgagttgcaaggtggtgactctttaaaaatacatatacgtggtgtagaaaatcaggtattcatgggtgaaaagccaggtgttgctatcgtaatagacggtgttcctgtatttgagagaaccggcaaagtaaatatcgatatggataatatcgaaagtatcaaagttattaaaggcggtgcgtcatatctatttggtgatgatgccctctctggcgcagttataataacaacaaaaagaggtgcgaaaaatgccggtattaaattagatagtgaatttggatcgtatggatatagaaagtacttagctaaatttggtgattcagcagaaacttataactactattttccagcctctgagagatcaaaagatggttatcatgaagatccagactataagaaacaatatttaaatggtaaatttccaaactaa

SEQ ID NO: 11402 - protein, 221 aa, Unknown
  Obtained from environmental sample
  SIGNAL (1)...(19)
  misc_feature (1)..(221): Xaa is any amino acid
MTISKNKLLIASLLSVAFTTTNASENLGIISVESSTIDDKFALKRNEVSPTSTISGEKIDESHVENVQRVLQSIPGITTELQGGDSLKIHIRGVENQVFMGEKPGVAIVIDGVPVFERTGKVNIDMDNIESIKVIKGGASYLFGDDALSGAVIITTKRGAKNAGIKLDSEFGSYGYRKYLAKFGDSAETYNYYFPASERSKDGYHEDPDYKKQYLNGKFPN

SEQ ID NO: 11403 - DNA, 549 bp, Unknown
  Obtained from environmental sample
  misc_feature (1)..(549): n is a, c, g, or t
ttgccagaaaccgaaattgaacaaaatgggctggtggacagagagcaattgctggatatcaccggaagaagcagaaaagttcaaatgcaattggtcagggaattcggcgtgactgactaccctgctcctgccggaggatgtctgttaaccgatataggattttccaaccggttacgagatctgatgatggtccagaaaacatttgaaaaaagagaactcttctatttgaagaatggccgccatttcaggctggataataaaaccaagatcattgtcggtcggtctatacatgacaacaagcatcttctaaaacactttgattcccaaaaagatatattgatcaagcatgcaactctggctagccctgatgtaattctcaccggagataagaacagcaaaaatattcaaactgctgccatgatctgtgccagttacaccaaggcaaaatccggagaaatatcaggcatccatatcattgacgacaataacaggcaaaccatccaggttgatactgtcaaatctgaagcctacaaaggtttaatgatctaa

SEQ ID NO: 11404 - protein, 182 aa, Unknown
  Obtained from environmental sample
  misc_feature (1)..(182): Xaa is any amino acid
MPETEIEQNGLVDREQLLDITGRSRKVQMQLVREFGVTDYPAPAGGCLLTDIGFSNRLRDLMMVQKTFEKRELFYLKNGRHFRLDNKTKIIVGRSIHDNKHLLKHFDSQKDILIKHATLASPDVILTGDKNSKNIQTAAMICASYTKAKSGEISGIHIIDDNNRQTIQVDTVKSEAYKGLMI

SEQ ID NO: 11405 - DNA, 768 bp, Unknown
  Obtained from environmental sample
  misc_feature (1)..(768): n is a, c, g, or t
ttgttttctgtaatcaaaaagtggcttatttataccaaagtaccccagaacagatggtgggaaaagacgactattttttttactaaaaatagggaacaggccgatttcttcttaaaaagtgctcaagacattatggaccgttttgaaaaagaagtggtttatgaatcgtcaatggacacgaacaccggcgaggttcgtcattttagttcaaccaaaatcccctttaaagacactcgaaataattgcaagattgctatttttgctaaagacataaccgatatcacccgccttaaagaaggggcggacagaaaccaaaaacgtcttgagcatgtactagatgtttccgaggaagggttatgggaatggaacattcaaaccaaccaggtgctgcataataagcgctgggaaaacatcattggtattgagtcgagccgagaaacctttattgagtttgaagcctgtattttgcaagaagataaagcgaaggtgggtcaagcgctggacttgttgttaaccaaaagccaaccttacaatattgagttccgtatgaaacgccccgacggaaaagtcatctgggtatgggaccgtggtcgagtggctgaggtggatgaaaatggtgatccgatttggttagtgggcatcattttagacattacgacggaaaagttgaatcagcagaaaattgaacgtctcgcgtattacgacagcttaacaggccttgttaaccgaactcagttagaggttgagttggatgaagtcattcagtaa

SEQ ID NO: 11406 - protein, 255 aa, Unknown
  Obtained from environmental sample
  DOMAIN (178)...(221): PAC motif
  misc_feature (1)..(255): Xaa is any amino acid
MFSVIKKWLIYTKVPQNRWWEKTTIFFTKNREQADFFLKSAQDIMDRFEKEVVYESSMDTNTGEVRHFSSTKIPFKDTRNNCKIAIFAKDITDITRLKEGADRNQKRLEHVLDVSEEGLWEWNIQTNQVLHNKRWENIIGIESSRETFIEFEACILQEDKAKVGQALDLLLTKSQPYNIEFRMKRPDGKVIWVWDRGRVAEVDENGDPIWLVGIILDITTEKLNQQKIERLAYYDSLTGLVNRTQLEVELDEVIQ

SEQ ID NO: 11407 - DNA, 720 bp, Unknown
  Obtained from environmental sample
  misc_feature (1)..(720): n is a, c, g, or t
atggaaaaacttcaatttaatccaaaagatgcaatagcagttacaacttcagcaatgcttcaggcaaaaaactccttatatattcttcaacaaatacaaaaggaaaccggaatctcttttactattattagtggagatgaagaagctcaactcacacttcttggacttcaatatagtttaaaaaaggaaagatttaatagtgaaaatattattttggttgatattggtggtggaagtaccgagatagtttttgtaaaagacaatattccaatttatcaaagttttgaagttggtattgttaccctaacacaatctttgaataaaaaagatattttaactcaatttgcaaaagatatacaaaatcatattaactctttatcttttgatatagactctttacaacttattgcaacagcaggaacaccaacaacaattgcagcacttaaacacaatttaaattataaaacttatgataaaactataattaatggtacaaaagtatatgtgaaagatttggattattataagaattatttacaatcaatctctttagatgaagctgagattttaacaggaacaaatcgcttgcagtatataggttcagggatagatattttcaaacttatttatacagtattaaaaaaagagttttcaattgtatttgatgagggcttacgagaagggattgtagtagataagtttttaagtttacaaagatag

SEQ ID NO: 11408 - protein, 239 aa, Unknown
  Obtained from environmental sample
  DOMAIN (1)...(237): Ppx/GppA phosphatase family
  misc_feature (1)..(239): Xaa is any amino acid
MEKLQFNPKDAIAVTTSAMLQAKNSLYILQQIQKETGISFTIISGDEEAQLTLLGLQYSLKKERFNSENIILVDIGGGSTEIVFVKDNIPIYQSFEVGIVTLTQSLNKKDILTQFAKDIQNHINSLSFDIDSLQLIATAGTPTTIAALKHNLNYKTYDKTIINGTKVYVKDLDYYKNYLQSISLDEAEILTGTNRLQYIGSGIDIFKLIYTVLKKEFSIVFDEGLREGIVVDKFLSLQR

SEQ ID NO: 11409 - DNA, 507 bp, Unknown
  Obtained from environmental sample
  misc_feature (1)..(507): n is a, c, g, or t
ttggataaactttcctacttttcggattattttttcaaaattatgttagcaccaatagattggataattgtaggattgtttttatcacttagtctttatataggtataaagtttaaaggtaaatcaagtggatcattaacagatttttttcttgctggaagaaatttgccttggtatatagcaggaatttctatggtggcaaccacctttgctgctgatacacctttgtgggtggcagaagtgataaaacaaaatggtgtttctggtaattggctttggtggaacatgttaataggagggatgttaactactttcttttttgccaaattgtggcgtaaagccaatgtgttaacagagttagagtttatagaacttcgatattcaggaaaaacagctaaactgttcaggaactttaaagctttttatttaggcattttttttaattgtattgttataggatggggtaaatgccagctatgcctgaaaatattaaatgttgttttttaa

SEQ ID NO: 11410 - protein, 168 aa, Unknown
  Obtained from environmental sample
  misc_feature (1)..(168): Xaa is any amino acid
MDKLSYFSDYFFKIMLAPIDWIIVGLFLSLSLYIGIKFKGKSSGSLTDFFLAGRNLPWYIAGISMVATTFAADTPLWVAEVIKQNGVSGNWLWWNMLIGGMLTTFFFAKLWRKANVLTELEFIELRYSGKTAKLFRNFKAFYLGIFFNCIVIGWGKCQLCLKILNVVF

SEQ ID NO: 11411 - DNA, 438 bp, Unknown
  Obtained from environmental sample
  misc_feature (1)..(438): n is a, c, g, or t
atgaaattaaagaaaaatataaatttcatggaagttactcatattgagcatattgggattgcagtagaaaatctcgaagatggcattcgttattacgaagatatactaggactgaaatgttatggtatagaggaagttgctgatcaaaaagtaagaacagccttctttaaaattggtgatgttaaaattgaattattagaaagtacttcacctgatggacctattggtaaattcatagaaaaaaaaggacctggtatgcatcatatggcatttgcggtaaataatatcgaagatagccttaacgaagcagccgataaaggtattagggtgatagataaaacaccacgaaaaggtgccgaaggattagaaattgggtttttacatccaaaatctacattaagtgtgttaactgaactttgcgaggataaaaacaaataa

SEQ ID NO: 11412 - protein, 145 aa, Unknown
  Obtained from environmental sample
  DOMAIN (14)...(139): Glyoxalase/Bleomycin resistance protein/Dioxygenase superfamily
  misc_feature (1)..(145): Xaa is any amino acid
MKLKKNINFMEVTHIEHIGIAVENLEDGIRYYEDILGLKCYGIEEVADQKVRTAFFKIGDVKIELLESTSPDGPIGKFIEKKGPGMHHMAFAVNNIEDSLNEAADKGIRVIDKTPRKGAEGLEIGFLHPKSTLSVLTELCEDKNK

SEQ ID NO: 11413 - DNA, 624 bp, Unknown
  Obtained from environmental sample
  misc_feature (1)..(624): n is a, c, g, or t
atggattacattgtaaaaccttttattatggatgagctagtgcgaaagatttatcactatgatgaatttaaaaaattaaaacagatgaaaaaaaatcttacaaactatatcgactttgctttttataatattgaacatgatgtggctattccacaaactcttccatttgcaattgagacaaatgaccaaagagttgcagataaaatagttttagaagttgcacaaagactagataaaactattaaatttatctcattagagaacaatactaaaattgaaccaaacgattttaaagatgagttactctatatttacgatttccactatgttaaaaaaagttcaaaagatttaatcctaaaaacaatagaaaattttgatgttatactctcatctttagaagatttaggagatatcccttatcctaagatagaattaaaaatagcgaataaactctcaacagttgattcaatacttacaattaacgattatgtaaaacttatggttaccagttttcaagacaagtatccagatacagaacttagtcgtagacttggaattagtagaaaatctctttgggaaaaaagaaaaaaatttggtatagagaaagataaaggtgataaatag

SEQ ID NO: 11414 - protein, 207 aa, Unknown
  Obtained from environmental sample
  misc_feature (1)..(207): Xaa is any amino acid
MDYIVKPFIMDELVRKIYHYDEFKKLKQMKKNLTNYIDFAFYNIEHDVAIPQTLPFAIETNDQRVADKIVLEVAQRLDKTIKFISLENNTKIEPNDFKDELLYIYDFHYVKKSSKDLILKTIENFDVILSSLEDLGDIPYPKIELKIANKLSTVDSILTINDYVKLMVTSFQDKYPDTELSRRLGISRKSLWEKRKKFGIEKDKGDK

SEQ ID NO: 11415 - DNA, 651 bp, Unknown
  Obtained from environmental sample
  misc_feature (1)..(651): n is a, c, g, or t
gtgctgggagttagcaattacctgattaaagagataaagatagatgttatattgagtaaattgatacaaaaatatccagatatcaattatatatttacaggtcttaaaaggcatctccttacagaactattttctaaaagaaaatcacctctatatgatacagttagtttattggaattaaagccaattccaatagagttattttataaatttgtcaatgaaaagttcaacggaagacttgattttgtacattttgagtatatatataatatgacagatggggaatctaagcttatacaagaattttgttattatctttatcatgatgaatcaaataataaaaatcacaagattactcaagaagatatagacaaagtatgtcaggttcatcttgagagtaaaagtggttattttagaatgcttttggatcgtttgagtttacctcaaaaagtagctttaaaagctgtaattatttgtgatggtaccgagctatatacaaaagagaccctttttaaacttcaaacaactaaatcatcgcttaatactgcaataagaaatttatacaaagatgagataattgataaagagaataataagtattatattacaaacagatgttttgaactttggtgtagaaaaaagtttttataa

SEQ ID NO: 11416 - protein, 216 aa, Unknown
  Obtained from environmental sample
  misc_feature (1)..(216): Xaa is any amino acid
MLGVSNYLIKEIKIDVILSKLIQKYPDINYIFTGLKRHLLTELFSKRKSPLYDTVSLLELKPIPIELFYKFVNEKFNGRLDFVHFEYIYNMTDGESKLIQEFCYYLYHDESNNKNHKITQEDIDKVCQVHLESKSGYFRMLLDRLSLPQKVALKAVIICDGTELYTKETLFKLQTTKSSLNTAIRNLYKDEIIDKENNKYYITNRCFELWCRKKFL

SEQ ID NO: 11417 - DNA, 441 bp, Unknown
  Obtained from environmental sample
  misc_feature (1)..(441): n is a, c, g, or t
gtggaaagaatatttaactatataaaagtaagtgatacaatctcaacttctggacaacctttaaaaaagcaatttaaaaaaatagcaaaagagggctttgaagtgattataaatcttggattaaatactcatccagaagctttaaaagaggaagataaaattgtttcaaagaatggaatgatttattttcatattcctatatcatgggaagaaccagaaattgatagacttaaactttttttgatacttcttgaaagtttacaaaaggaaaataaaaaagtttttatacattgtattaaaaattatagagtatctgtctttatctataaatataaaaaagatattttaaaacaaaaagatgcaaaacttgtagccccaaaagaatataaaccaaatgaagtttgggaaaaagttttaaaatctaaaaatataaagaggtaa

SEQ ID NO: 11418 - protein, 146 aa, Unknown
  Obtained from environmental sample
  misc_feature (1)..(146): Xaa is any amino acid
MERIFNYIKVSDTISTSGQPLKKQFKKIAKEGFEVIINLGLNTHPEALKEEDKIVSKNGMIYFHIPISWEEPEIDRLKLFLILLESLQKENKKVFIHCIKNYRVSVFIYKYKKDILKQKDAKLVAPKEYKPNEVWEKVLKSKNIKR

SEQ ID NO: 11419 - DNA, 381 bp, Unknown
  Obtained from environmental sample
  misc_feature (1)..(381): n is a, c, g, or t
ttgtataattcatcctatttatttcaaaatggtactttacaaatagcaaataaagtagttttagtaccatttggtgaagctgtaccaatgcctgaaaaaattaaaaactggatcaatgatactttttatgatggagcaaaagattatatcacagcatcaaaaccgacaacatttactattaaaaatataaaatttagaaatgcaatctgttatgaagctacaaccgataaaatatatactgatatggacacgcaatatgctatagctatctcaaataatggatggtttaccccatcaatacaaccaacactacaacaacttctaatgaaatattatgaaaataaatatgatataatgatacttgatgtatcaaatcaataa

SEQ ID NO: 11420 - protein, 126 aa, Unknown
  Obtained from environmental sample
  misc_feature (1)..(126): Xaa is any amino acid
MYNSSYLFQNGTLQIANKVVLVPFGEAVPMPEKIKNWINDTFYDGAKDYITASKPTTFTIKNIKFRNAICYEATTDKIYTDMDTQYAIAISNNGWFTPSIQPTLQQLLMKYYENKYDIMILDVSNQ

SEQ ID NO: 11421 - DNA, 471 bp, Unknown
  Obtained from environmental sample
  misc_feature (1)..(471): n is a, c, g, or t
atggaacaactcaaaaacatattgctttatttatttgccttctcggtgcttttacttcacccaagtttaaacaacgaaaagaatcctttatcttgtattcattaccttgcttatggtaatactttcaaattaaaatttgatgatactattgataaggacaagttatacattaagtggacctgcgaaaaccaacatgctaattgtaaagaattagacatttttataggagggaaaaaagttaacaccattccttttgaatctggacaacaagaacttattgtttattataacaacaaacttattgggaagttagagcaaactaaaacaaaagaaaagcatgctcatacttactttgtaagtttaaatagtatagaaagtaatagtatagaatttaaaggtgaaattactgggccatcatcagctgtagcaacaatggttacttcattaagtaatttaatttctcagcattaa

SEQ ID NO: 11422 - protein, 156 aa, Unknown
  Obtained from environmental sample
  misc_feature (1)..(156): Xaa is any amino acid
MEQLKNILLYLFAFSVLLLHPSLNNEKNPLSCIHYLAYGNTFKLKFDDTIDKDKLYIKWTCENQHANCKELDIFIGGKKVNTIPFESGQQELIVYYNNKLIGKLEQTKTKEKHAHTYFVSLNSIESNSIEFKGEITGPSSAVATMVTSLSNLISQH

SEQ ID NO: 11423 - DNA, 411 bp, Unknown
  Obtained from environmental sample
  misc_feature (1)..(411): n is a, c, g, or t
atgaaaaatgaatatatactaagtgcttttgaaaaagatagtaactctagcttagctgaattgtttttacaagtacgagattttataaaaatttgtataggaaatagagttaaagaaaaatatagagaaaatataacctcctatttttctacagagggtggatattgctatttaaaagcttatgaagagtatattcatattggttggtttcgtggtgtaaatatagatgacaaatataaccaactctttggaagtgcaaaaacaatacgaggacaaaaagtatataaacttgataaaatcacaagagatgctattagatattatgttgaacaaactttgatatttttaatagaacataatgagttgatgaagatgaaaaaagggataaaaaaatatgatagagaactttga

SEQ ID NO: 11424 - protein, 136 aa, Unknown
  Obtained from environmental sample
  misc_feature (1)..(136): Xaa is any amino acid
MKNEYILSAFEKDSNSSLAELFLQVRDFIKICIGNRVKEKYRENITSYFSTEGGYCYLKAYEEYIHIGWFRGVNIDDKYNQLFGSAKTIRGQKVYKLDKITRDAIRYYVEQTLIFLIEHNELMKMKKGIKKYDREL

SEQ ID NO: 11425 - DNA, 312 bp, Unknown
  Obtained from environmental sample
  misc_feature (1)..(312): n is a, c, g, or t
atgatagagaactttgaatttacaactgtgattttaaatcatgaccagtatgatggtatcacgatagatagttcatcaataccaaacaatgtactggagtttgaaaaagagttatgtttgattatagaaaaaattgaaaataaaaaacttttatgggtaaaactctctattgaacaatctaaatttatcccagtgcttacaaaacataactttgttttccatcattgtaatgaaagagattttacctttgtaaaaagaccttatgtaaaacctgttatccccacagctacaaatcatactcctggggttggg

SEQ ID NO: 11426 - protein, 104 aa, Unknown
  Obtained from environmental sample
  misc_feature (1)..(104): Xaa is any amino acid
MIENFEFTTVILNHDQYDGITIDSSSIPNNVLEFEKELCLIIEKIENKKLLWVKLSIEQSKFIPVLTKHNFVFHHCNERDFTFVKRPYVKPVIPTATNHTPGVG

SEQ ID NO: 11427 - DNA, 402 bp, Unknown
  Obtained from environmental sample
  misc_feature (1)..(402): n is a, c, g, or t
atgaataaaaaattaggaagtaatatatctataaaaagaataagcttttttaatagaaacccaaatgcctaccctcaaaaagatgaagtaaatattttaaaagcatttgatcttatcgaaagatctgctgcatatatgcctaaagagattgtacaagcaatgggatataacacctataaagtctatttcccagcaacaatgtcaagtaaatcatgtaaaaaatgccatggtgaaaaaagtattgtaaatcctaaaattcaaaaactttttgaagataactatccttatgacaaagcatacgggtttaaaagtggggaagttagaggagccgtagtcgtaacggtaaaaatagaagataataatataaatatagaaaaaaggaatgaaaatgaaaataaataa

SEQ ID NO: 11428 - protein, 133 aa, Unknown
  Obtained from environmental sample
  misc_feature (1)..(133): Xaa is any amino acid
MNKKLGSNISIKRISFFNRNPNAYPQKDEVNILKAFDLIERSAAYMPKEIVQAMGYNTYKVYFPATMSSKSCKKCHGEKSIVNPKIQKLFEDNYPYDKAYGFKSGEVRGAVVVTVKIEDNNINIEKRNENENK

SEQ ID NO: 11429 - DNA, 696 bp, Unknown
  Obtained from environmental sample
  misc_feature (1)..(696): n is a, c, g, or t
atgaaacataaccattttgacaccatcaaacaaagtcttaaacgacaccatctattttcaaagctaactgacctgcagatagacagagtctgtaagttcagccagttacaccagctcgatgatggtcagatgctttttaaccagtcggataaagtcacctccttttacatggtactaaatggaaagataaaactgtttcgcatgtcgccagatgggcaggaaaaaattatcgagatcgttaaatcaggacaggtcttcgctgaagcactgatgttcgctggccatgctgactatccagtaagttcagcagcgctcagtgataccactgttatcagtatcaatgctaaaaaattctacgagatgctctgggactcgactgcaacctgcctgctattattaggtgatatgagtttgcgcctcagaggactggtcagtgaaatcgataaactgacactacacaacggtacctgccgtgttgcttcttatctacttcaagagatgtcggaagataaagaagattttgaactggacgtagctaaaaatattattgctgcacgactatctataaagccagaaactttctcacgcatcatcaaaagccttaaagataaggaaatccttagcattcagggaaactgcataaccgtccacgacagggaaaacactaaaaaagatgacccccgtttaaatttctaa

SEQ ID NO: 11430 - protein, 231 aa, Unknown
  Obtained from environmental sample
  DOMAIN (33)...(127): Cyclic nucleotide-binding domain
  misc_feature (1)..(231): Xaa is any amino acid
MKHNHFDTIKQSLKRHHLFSKLTDLQIDRVCKFSQLHQLDDGQMLFNQSDKVTSFYMVLNGKIKLFRMSPDGQEKIIEIVKSGQVFAEALMFAGHADYPVSSAALSDTTVISINAKKFYEMLWDSTATCLLLLGDMSLRLRGLVSEIDKLTLHNGTCRVASYLLQEMSEDKEDFELDVAKNIIAARLSIKPETFSRIIKSLKDKEILSIQGNCITVHDRENTKKDDPRLNF

SEQ ID NO: 11431 - DNA, 813 bp, Unknown
  Obtained from environmental sample
  misc_feature (1)..(813): n is a, c, g, or t
gtggtacgtcgtgttgaaacaataaaaaagccttggaatggactgcaaaaacttgtggctggtgaaattttttcaatagaaaaacatccgaacgcaacaaagttagtgatttgttctgtaaatatcgggaacgaagtaaaaacaatcatcactggtgatccaactgtgaaagttggtcatgttgttcccatagccattgataacgtcaaattattcaatggcaccataattaaaacttcagagttgagaggcgttagatccgagggtatgatgtgttcacttgaagaaatcggacttgaagaaaaatcaacagcggtatataaacttccaaacgacgtaaaagctggatgcaatctttatgaatatttcaatctggaagattccatattcgatttagaaataactgcaaataggccagatgagttatctatgattggtgtagcacgcgagttacaaacattattcagaggaaaagaaacaataaaattaccaaatacaaaatacaaagaatcagaagaaaaaacaaaggattcaattaacattatcatagacaaaccagaagaatgtacaagatacatgtcattggtacttagaaacattgaggttgcaaagtcaccattatggcttagaagacaccttgtttctattggtcttagacctatcaatgttatcgtagatgctacaaattttgtattgatggaaactggacatcccgttcatgcttttgatttgaataaattgtcacaaccacaaattgtggtcagacacgcaaaaaaaaaaaaagaatgttgcttctcaatggaagtaaattga

SEQ ID NO: 11432 - protein, 270 aa, Unknown
  Obtained from environmental sample
  DOMAIN (188)...(270): B3/4 domain
  misc_feature (1)..(270): Xaa is any amino acid
MVRRVETIKKPWNGLQKLVAGEIFSIEKHPNATKLVICSVNIGNEVKTIITGDPTVKVGHVVPIAIDNVKLFNGTIIKTSELRGVRSEGMMCSLEEIGLEEKSTAVYKLPNDVKAGCNLYEYFNLEDSIFDLEITANRPDELSMIGVARELQTLFRGKETIKLPNTKYKESEEKTKDSINIIIDKPEECTRYMSLVLRNIEVAKSPLWLRRHLVSIGLRPINVIVDATNFVLMETGHPVHAFDLNKLSQPQIVVRHAKKKKECCFSMEVN

SEQ ID NO: 11433 - DNA, 804 bp, Unknown
  Obtained from environmental sample
  misc_feature (1)..(804): n is a, c, g, or t
ttggaatgggttttaaaaagattggcttatctgattcagaaattaacaaattgtactgtttctaaagatcctgttgattgttacccaacaaaaaaagctccagtaactataaaattaaggaatgaacgagtttcaaaaatattgggtatgccatactttgaggacgatatagaatccattcttgaaaatttaggaatgaaccttgaaagggtaaatagtaacacttcagatgatatttgttggaaagtcgaaattccttcttatagaggagatctcgaaagagaaattgatttaatcgaagaaatcggaagaatttcaagttatgaaaatctcccaggcgttttgcccatattgaccagtaaaggacaaggtagaagtagtttccaaaaattcagatatgatattagagacatcacacttgctttgggttataatgagatatgcccattatcatttattgatcctgacgacattgacaaatttaatttaaaagaacatccttggtcaaaaaattccataaaacttttaaaaccattatcaagagatatttcgattttgcagacaacacagataatctcgttagttaaaactctatcatacaatttcactcatcaaactatagatgcaaaactttttgagataggcgtaatttttgaaaaaacagaaaatggttacgctgaaaaagaattgctaacatttggtagtattgggcaagaacatcccgctgattacacaaataaaaaaatgatagatttttattcactcaagggaaatgtagaggagttatttgatgtttgggaatag

SEQ ID NO: 11434 - protein, 267 aa, Unknown
  Obtained from environmental sample
  DOMAIN (34)...(108): tRNA synthetase B5 domain
  misc_feature (1)..(267): Xaa is any amino acid
MEWVLKRLAYLIQKLTNCTVSKDPVDCYPTKKAPVTIKLRNERVSKILGMPYFEDDIESILENLGMNLERVNSNTSDDICWKVEIPSYRGDLEREIDLIEEIGRISSYENLPGVLPILTSKGQGRSSFQKFRYDIRDITLALGYNEICPLSFIDPDDIDKFNLKEHPWSKNSIKLLKPLSRDISILQTTQIISLVKTLSYNFTHQTIDAKLFEIGVIFEKTENGYAEKELLTFGSIGQEHPADYTNKKMIDFYSLKGNVEELFDVWE

SEQ ID NO: 11435 - DNA, 426 bp, Unknown
  Obtained from environmental sample
  misc_feature (1)..(426): n is a, c, g, or t
ttggaacctgattctcataattggctaatcggaaataaaattctttataactcagaggcactacactttcactcacttagtgaaaataatgttattaaggataatgtaattatgggtaacatcgaagatattgtaaatgacagtagaggaagtaaaacgaatgaaaatgagattgtaggaaattactgggataagtatgaagggtttgataaaaatggtgataacatcggtgatacttcacataaaatctaccagtatgctgatcagatgtgggtatacaaccctgatgttaaatttttttacggatctcctgtaatatctctgctaaattttttagctaaattggctccgtttacaaaaccactttttttactagaggatcaagaaccaaaaatatcaattaagggatctgcatggcaacagtaa

SEQ ID NO: 11436 - protein, 141 aa, Unknown
  Obtained from environmental sample
  misc_feature (1)..(141): Xaa is any amino acid
MEPDSHNWLIGNKILYNSEALHFHSLSENNVIKDNVIMGNIEDIVNDSRGSKTNENEIVGNYWDKYEGFDKNGDNIGDTSHKIYQYADQMWVYNPDVKFFYGSPVISLLNFLAKLAPFTKPLFLLEDQEPKISIKGSAWQQ

SEQ ID NO: 11437 - DNA, 774 bp, Unknown
  Obtained from environmental sample
  misc_feature (1)..(774): n is a, c, g, or t
atgaaacaccccgcagctcagaaatactacaattcagtaatcgaactactcgcagaatggggactcgacttcgtaaaatatgatgacatcgaagaacaccccgcggaaatcgaagcagtcgcacgtgcaattaacaataccaaaagagatatcgtctttagcatctcaccaggtaacaaagtaaacctagataacataacaacctatcggatggccaacatgcttcgatctagtggtgacatctgggacaacagagaaagcatcgaaaagactttcaaagcctgggagctaatgcagaaatttggtggtagaggcttttggatcgacctcgacttgatcccatttggaaaccttgatgtccatgacaaagaaaaagcaagaacagacaacttcacccccgaccagagatatacctttataacccaacggtctttagcagcatcgccattgttcataagcggtgaattaacaacaatgagcgatgagatactggacattattaccaacaaagaaatgctaaaatgcaatcagaatggcgtaaccggaaaattagttgcccgaggcgacaatatcgatatctggaaaaccaaaaacaagaaaaaacaagacaaaggctgggtcggtattttcaacagaaacgaaacaccaaaaaaattctccgtaacaaagaaacaaatgaagctagacccgaaaaccaagtacagcttctacgatatctggaacaaaaagaaagttaaaaatgcagacccctaccagttcaatatccccagctga

SEQ ID NO: 11438 - protein, 257 aa, Unknown
  Obtained from environmental sample
  misc_feature (1)..(257): Xaa is any amino acid
MKHPAAQKYYNSVIELLAEWGLDFVKYDDIEEHPAEIEAVARAINNTKRDIVFSISPGNKVNLDNITTYRMANMLRSSGDIWDNRESIEKTFKAWELMQKFGGRGFWIDLDLIPFGNLDVHDKEKARTDNFTPDQRYTFITQRSLAASPLFISGELTTMSDEILDIITNKEMLKCNQNGVTGKLVARGDNIDIWKTKNKKKQDKGWVGIFNRNETPKKFSVTKKQMKLDPKTKYSFYDIWNKKKVKNADPYQFNIPS

SEQ ID NO: 11439 - DNA, 624 bp, Unknown
  Obtained from environmental sample
  misc_feature (1)..(624): n is a, c, g, or t
gtgaacaaaattttcaattcaaaagtaacgccttttggtggcatccacctaatacatgaacaactttttgcacacggcgcaattgatttcattgataatcaacttggtgcaagagtaaaaactattggttataattactccgatattttattaagtcgtatttatactacattttgcggtggtaatgccacagaggatgtaaattatgtaagagataatacgcttaattaccttaaaggaattggcattccatcagccgatactatattacgaggagatgttgaattatcagtgccttgtgaatacattgaaacagcatcaggtaaagcaaacaaaatcaatgttaatacaggtatgaatgaatttcttattaacagtgcaatagaattcaatcaattaaatcctaaggacaaggatttgatttatgattttgaccaccagtttatccctgccgataaatacgatgcacaatatagctacaaaaataaaaaaggctactttccaggcgtagcaactatttcaaacattcctgtttacattgaagggcgtaatgggaattgtaatgtaaaaacaggaacaggcttgcaactcaccaaacgagccattaaaagcattggcaaatag

SEQ ID NO: 11440 - protein, 207 aa, Unknown
  Obtained from environmental sample
  misc_feature (1)..(207): Xaa is any amino acid
MNKIFNSKVTPFGGIHLIHEQLFAHGAIDFIDNQLGARVKTIGYNYSDILLSRIYTTFCGGNATEDVNYVRDNTLNYLKGIGIPSADTILRGDVELSVPCEYIETASGKANKINVNTGMNEFLINSAIEFNQLNPKDKDLIYDFDHQFIPADKYDAQYSYKNKKGYFPGVATISNIPVYIEGRNGNCNVKTGTGLQLTKRAIKSIGK

SEQ ID NO: 11441 - DNA, 468 bp, Unknown
  Obtained from environmental sample
  misc_feature (1)..(468): n is a, c, g, or t
gtggcggtcattgtttctacagacagaaaaaacacaatagacatcaatgtatcttgcttaggcagaattacaaaacaaaatataacacaagctatcggaagcaaggttgaggatagaacgattttatgtacagatggtcatgttagctataaaggttttgctatagataattctattgaacatcatgtccttagagctaatataaagcaatttacaaaacagaagaagtttcatattcaacacgtaaactctatgcacagtcgtatgaaaaattggattgacaaccaattactaggtgttgcatccaaatatttgcagggttatatgaattggtttcatgttaaagaaaaatttacggaatctgaatttattgatagaataattgagctaagcgctgtcaatacagatgcagcaaggaattataagaatattgaaaagaattatgctgatttaatacaattagcatag

SEQ ID NO: 11442 - protein, 155 aa, Unknown
  Obtained from environmental sample
  misc_feature (1)..(155): Xaa is any amino acid
MAVIVSTDRKNTIDINVSCLGRITKQNITQAIGSKVEDRTILCTDGHVSYKGFAIDNSIEHHVLRANIKQFTKQKKFHIQHVNSMHSRMKNWIDNQLLGVASKYLQGYMNWFHVKEKFTESEFIDRIIELSAVNTDAARNYKNIEKNYADLIQLA

SEQ ID NO: 11443 - DNA, 468 bp, Unknown
  Obtained from environmental sample
  misc_feature (1)..(468): n is a, c, g, or t
atgtggaaaatcatttcagtatttacatatcttctttgcttatctttggcaatatatgctaataatgatgagctagaagttaagatagttaataatagcaagattgaacttaaacctggttcaaatgcaaatatggctatttggctaattaacaattctgattttgacaaagaagtactattgaaaattacaacaccccaaggactgagtttgttatcagactactcctcggtaattgttgaaagatcaagcaaaaaattaaaaatattcagtttttatgtaaacgaatccgccaaggtgggcgattatagcatttcaattgaggcatacaatacagagggcgaaaagatagacgatttagaaattcaaatttatgtagtccctaaatatgaactcttttacaaagttatggatgctccccactttgtgttttctggccatactgttagtgtagggtttataatccca

SEQ ID NO: 11444 - protein, 156 aa, Unknown
  Obtained from environmental sample
  misc_feature (1)..(156): Xaa is any amino acid
MWKIISVFTYLLCLSLAIYANNDELEVKIVNNSKIELKPGSNANMAIWLINNSDFDKEVLLKITTPQGLSLLSDYSSVIVERSSKKLKIFSFYVNESAKVGDYSISIEAYNTEGEKIDDLEIQIYVVPKYELFYKVMDAPHFVFSGHTVSVGFIIP

SEQ ID NO: 11445 - DNA, 720 bp, Unknown
  Obtained from environmental sample
  misc_feature (1)..(720): n is a, c, g, or t
atgcagtttaaaaaagatgaattagaaaaactctcaaaactacactgtgatacacttctatctcttgctatcattgcaccatcaagttatgaagatttgcgacttttcaatgatgtaaaaacaactccacaacttatagatgcaactatagaacatgtctcaaaaactcctcgcactgttcaaatcacactatatgcacataatcttggatttaaagttcaagccgttcttttttcaccaaaaccatacatggctagagcttatgtggttggtgagcgtaactattattatggaaaaatagattttaatgcaggtcatgctcagatctctcatcctaaaaaagtgactaatgtcggggagatcatagcaaagtacaagagtgtgataagagccgatattatgagtaaattcatctcaaaaatgattacaaaagatagtttactttcaactggacttcctgaaaaaattgcagatactattttagatatacactttgtaaaagatactcctctttatgaaaatgggaactataatacaaaagcactctatgcactaaagtttacagaaatttatgattacatgcagagactctcaaaaaaacgtcacttttttgaatcaaaagttagttgttttggagattatattgagtggagtaaaacacttccctttactttaacccatgaacagatcaaagcgatagaagatataaaaaagatttag

SEQ ID NO: 11446 - protein, 239 aa, Unknown
  Obtained from environmental sample
  misc_feature (1)..(239): Xaa is any amino acid
MQFKKDELEKLSKLHCDTLLSLAIIAPSSYEDLRLFNDVKTTPQLIDATIEHVSKTPRTVQITLYAHNLGFKVQAVLFSPKPYMARAYVVGERNYYYGKIDFNAGHAQISHPKKVTNVGEIIAKYKSVIRADIMSKFISKMITKDSLLSTGLPEKIADTILDIHFVKDTPLYENGNYNTKALYALKFTEIYDYMQRLSKKRHFFESKVSCFGDYIEWSKTLPFTLTHEQIKAIEDIKKI

SEQ ID NO: 11447 - DNA, 564 bp, Unknown
  Obtained from environmental sample
  misc_feature (1)..(564): n is a, c, g, or t
atgatggagaaggagtttaaggtatataccaaaacaggggatgacggaacaaccggattggttggcggaacgcgtgtgaaaaaatatgatatccgtttagatgcgtatggaaccgttgatgaattaaatgcttacattggagttttgaggtcgtatgtattgcccgataatgttactaaactactgatgcaaattcaaaataagctttttaatattggttcaagattagcttccgacgaaaaaggagaatcttttacagctaatttggtaattactgaagaacatattagaacattggaatttgctattgacaaatttgaagagactcttcccaaactgacacattttattctacccggaggggatctttcagttgcttattgccatgttgcccgtacggtttgtagaagagcagaacgccggattactgaactatcggaacatacgaaagttcaacccgaaataattaaatacattaatcgattgtccgattttttatttgtgctggctcgtaagttagcattcgatataaatgtagatgaagtagtttggacaaaagattaa

SEQ ID NO: 11448 - protein, 187 aa, Unknown
  Obtained from environmental sample
  DOMAIN (8)...(175): Cobalamin adenosyltransferase
  misc_feature (1)..(187): Xaa is any amino acid
MMEKEFKVYTKTGDDGTTGLVGGTRVKKYDIRLDAYGTVDELNAYIGVLRSYVLPDNVTKLLMQIQNKLFNIGSRLASDEKGESFTANLVITEEHIRTLEFAIDKFEETLPKLTHFILPGGDLSVAYCHVARTVCRRAERRITELSEHTKVQPEIIKYINRLSDFLFVLARKLAFDINVDEVVWTKD

SEQ ID NO: 11449 - DNA, 558 bp, Unknown
  Obtained from environmental sample
  misc_feature (1)..(558): n is a, c, g, or t
ttgtctaaaaaatggaggacaatgaaatcagcaacattactacaggaattagcagctaaaattgagcaacacatcaattttgttaaatcaatacaacacctacctcaggaagtacttacccgcagaaagtcacccgaaagttggaatattttagaatgtttagagcatttaaaccgatatggcgattattatatccctgagatagaaaaagccataacaacttccaatacaacaagtgaagcaacttttaaaagtggttggttgggtaattattttgcaaacagtatgctccccaaagaaaagctaaacaaaatgaaaacctttaaggataaaaatcctttgcatagcgatttagacaattcggtaataagcctttttctagagcagcaaacacaattattggaattgctagataaagcaaataaagtaagtttaaacaaagtaaaagtgaaggtgagcatcgcccaatggctaacaattaaactaggagatacttttcgttttgttattttccacaacgaacgacatataaagcagatggagagattagccccctaa

SEQ ID NO: 11450 - protein, 185 aa, Unknown
  Obtained from environmental sample
  misc_feature (1)..(185): Xaa is any amino acid
MSKKWRTMKSATLLQELAAKIEQHINFVKSIQHLPQEVLTRRKSPESWNILECLEHLNRYGDYYIPEIEKAITTSNTTSEATFKSGWLGNYFANSMLPKEKLNKMKTFKDKNPLHSDLDNSVISLFLEQQTQLLELLDKANKVSLNKVKVKVSIAQWLTIKLGDTFRFVIFHNERHIKQMERLAP

SEQ ID NO: 11451 - DNA, 420 bp, Unknown
  Obtained from environmental sample
  misc_feature (1)..(420): n is a, c, g, or t
atgaaatttaataggataaaaataataatagtaggggtgttaattatggcagaaacattgatggctggttttacaactttaaaaacagcacaagttgaagaggcacttaaaaatggtgcgatagttatagatataagaagacccgatgagtgggaacgatttggtatcatcaaaggaagtcacaaactcactttttttgatgggcaagggagatacgatatcaacgcttggatggcaaaatttactaaaatagtaacctcaaaagatcaaccatttattttagtgtgtgcccatgcaaatagaactaaagctgttggagaactacttgggattcaacttggatataagtatgtgcaagaacttgatggtgggataaactatggttggattgataagggattggaaactgtaaaagagtag

SEQ ID NO: 11452 - protein, 139 aa, Unknown
  Obtained from environmental sample
  misc_feature (1)..(139): Xaa is any amino acid
MKFNRIKIIIVGVLIMAETLMAGFTTLKTAQVEEALKNGAIVIDIRRPDEWERFGIIKGSHKLTFFDGQGRYDINAWMAKFTKIVTSKDQPFILVCAHANRTKAVGELLGIQLGYKYVQELDGGINYGWIDKGLETVKE

SEQ ID NO: 11453 - DNA, 339 bp, Unknown; identical to SEQ ID NO: 9121
  Obtained from environmental sample
  misc_feature (1)..(339): n is a, c, g, or t

SEQ ID NO: 11454 - protein, 112 aa, Unknown; identical to SEQ ID NO: 9122
  Obtained from environmental sample
  misc_feature (1)..(112): Xaa is any amino acid

SEQ ID NO: 11455 - DNA, 306 bp, Unknown
  Obtained from environmental sample
  misc_feature (1)..(306): n is a, c, g, or t
ttgggtaaatttttttttgcaaaccggtttgcttccccaaagaaaaagctaaacaaaaatgaaaaccttttaaggataaaaaatcctttgcatagcgatttagacaattcggtaataagcctttttctagagcagcaaacacaattattggaattgctagataaagcaaataaagtaagtttaaacaaagtaaaagtgaaggtgagcatcgcccaatggctaacaattaaactaggagatacttttcgttttgttattttccacaacgaacgacatataaagcagatggagagattagccccctaa

SEQ ID NO: 11456 - protein, 101 aa, Unknown
  Obtained from environmental sample
  misc_feature (1)..(101): Xaa is any amino acid
MGKFFFANRFASPKKKLNKNENLLRIKNPLHSDLDNSVISLFLEQQTQLLELLDKANKVSLNKVKVKVSIAQWLTIKLGDTFRFVIFHNERHIKQMERLAP

SEQ ID NO: 11457 - DNA, 633 bp, Unknown
  Obtained from environmental sample
  misc_feature (1)..(633): n is a, c, g, or t
gtgagttttttaaagatatcccaaattgattataaaaggtttgttttttcaaaaaaagctatacttattaattctaataaaataaataatgataaatacaaactaagtgatgtaacaacagactataagtttggtaaaatagtgtctttaaatgaaaatagttatgaatttatcccaaatgtatattttgatattaaaacaccagttttgataaagtttcaagcttatgatgcaggagatgtttataactctacatcaactctaaacttttataagttagtggtaaacgagcagttaaatgaagatactaccacaacatcatggttagaaaatatcataagttttgatactattcaaaccaataaaaattttaaaattcagtatgatagtaaaccgtatgtagaagtgaaatatactcttaataaagcccctttaattgaacaaacaaaaacttttatcaaaaaaatatttatatattcttttagtttatttataattactattattatattatatgttttttatacccaagtagtaaaaaaagatattgagaaacctatagcaaaaataggtggttatgtggatgatattttaaataactcaatatgtgcgattagagaaagtaaatactaa

SEQ ID NO: 11458 - protein, 210 aa, Unknown
  Obtained from environmental sample
  misc_feature (1)..(210): Xaa is any amino acid
MSFLKISQIDYKRFVFSKKAILINSNKINNDKYKLSDVTTDYKFGKIVSLNENSYEFIPNVYFDIKTPVLIKFQAYDAGDVYNSTSTLNFYKLVVNEQLNEDTTTTSWLENIISFDTIQTNKNFKIQYDSKPYVEVKYTLNKAPLIEQTKTFIKKIFIYSFSLFIITIIILYVFYTQVVKKDIEKPIAKIGGYVDDILNNSICAIRESKY

SEQ ID NO: 11459 - DNA, 726 bp, Unknown
  Obtained from environmental sample
  misc_feature (1)..(726): n is a, c, g, or t
gtggtacttgaaactgtttctcaaagcaataatgtaaaagctgcaagagaaaaagtgatacagtctaatataaaactagatgatgcatatgctggatatttgccatcaattgatggaacctataaaagtgcaagaactgagacaaaaccaggagatgatggaaaaactaacaaatattttggagatgaaagttataaactatcagtaagacagaatatctatgcaggtggggacacttatactgagattaaaagtttagaaaaaaaatatgaggtagcaaaaaatgcttataggcttgttatagcaaaagagatagaaaatgcaataaaagcttattttgatgtactatttaacttcaactccttaactgtaaatatagaaaatatggatagattacaagaagttttagagattgtaaatattaaatatgaatcaggtgctactacaattggagatttaagtagtattaaagcgaatgtttcaaatgcagaatcaaagcttattaagatacagtcaaaatttaatgagtctttagagtattataaatatattgttggtgatgaatttgtaaaaacattcccttatgaggaaagctttgatacatctattgatgattttgatcaaattgttcaaaatgctatagaaaataatattaatataaaaacttataaattaaatattgaatctcaaaaatatcaactgttaaactccaaaatctggatttaa

SEQ ID NO: 11460 - protein, 241 aa, Unknown
  Obtained from environmental sample
  DOMAIN (3)...(186): Outer membrane efflux protein
  misc_feature (1)..(241): Xaa is any amino acid
MVLETVSQSNNVKAAREKVIQSNIKLDDAYAGYLPSIDGTYKSARTETKPGDDGKTNKYFGDESYKLSVRQNIYAGGDTYTEIKSLEKKYEVAKNAYRLVIAKEIENAIKAYFDVLFNFNSLTVNIENMDRLQEVLEIVNIKYESGATTIGDLSSIKANVSNAESKLIKIQSKFNESLEYYKYIVGDEFVKTFPYEESFDTSIDDFDQIVQNAIENNINIKTYKLNIESQKYQLLNSKIWI

SEQ ID NO: 11461 - DNA, 834 bp, Unknown
  Obtained from environmental sample
  misc_feature (1)..(834): n is a, c, g, or t
atgctgggtattgatctcttagagggtgagtatgattttgagaactggcttgaagcagtaagcggttttgaagacgagagcgaaaaaggtaaaaggtgtaaaatatgttttgacaaacgttttgacgtagcttcaaaaaaagcacaagaactaaaagagaacaagtttaccactacactactggtaagtcctcttaaatcacaacaacagctaaaaaaaagcggtgatgttttttatgaatcgcatggcgtagaatttatatcagttgattataggagtggcggagggagtcaagatcaatctcgtgttacaaaagagaatcaactatatcgtcaagattattgcggttgtatatatggactttctaaacagcgtaaacaacaaaatattttcatggatgagatgatcagttccatctcaaaacagatacagccatcttccattgaagatagaattgaactatataaagaaagagagaagttagaaaaatcaaatattttatataaaatagttacatataagtttttaaattatagacagtttaatgcaaaagttgaaagaaagaaagagatagttccatcatattttttaagttattcaactcttaagcgtaaaaaagctgatggaagggtagagtttgaaatagatggtatacactattttaaccgagaagagataaaatttatatcgcttgaaaaatttaactattctcttgggaaaaattatgcaacaatagaggagttaatcttcaatgcacccactgtgtacgaggagataaatcttagaaaacaacttctggatgatagatactctctctcacctatcatagtttag

SEQ ID NO: 11462 - protein, 277 aa, Unknown
  Obtained from environmental sample
  DOMAIN (1)...(151): Uncharacterized BCR, COG1636
  misc_feature (1)..(277): Xaa is any amino acid
MLGIDLLEGEYDFENWLEAVSGFEDESEKGKRCKICFDKRFDVASKKAQELKENKFTTTLLVSPLKSQQQLKKSGDVFYESHGVEFISVDYRSGGGSQDQSRVTKENQLYRQDYCGCIYGLSKQRKQQNIFMDEMISSISKQIQPSSIEDRIELYKEREKLEKSNILYKIVTYKFLNYRQFNAKVERKKEIVPSYFLSYSTLKRKKADGRVEFEIDGIHYFNREEIKFISLEKFNYSLGKNYATIEELIFNAPTVYEEINLRKQLLDDRYSLSPIIV

SEQ ID NO: 11463 - DNA, 591 bp, Unknown
  Obtained from environmental sample
  misc_feature (1)..(591): n is a, c, g, or t
atgcaacaaaagatggaggatattattgggtgtttgcaacagtatttctatttgagagttgtgatggttctaaaggatacttatcttgtagaagaaaaccttcaaaacttgaaatcaaagatgctgaagctttatataaagagtggtcaaatgaaaaatagcacaaaaacaaccctagaacttctttctaaaagaattatagaatatataaaagagcaccttaatatggaaaaaattgattctaattttactatagaggaagtaagcaaaatagagtatgacaatatctctacatttatctctttaagtggagatttaagtggaactattgggttgagcatatcanataattttgcaaatttattagtcaatagttttatttttggagaggttgatgaggctactttaagagaattggcaactganaatgtagcagaaacacttaacataacacttggaaatattatcaaagacttagaagaagtaaaggcaggaggtaaagtagatatttcaacaccgtatacactacataatagtgtaagtattactaaaaaagaaaatgggacaatggatttaagtcaaataaaatat

SEQ ID NO: 11464 - protein, 197 aa, Unknown
  Obtained from environmental sample
  misc_feature (1)..(197): Xaa is any amino acid
MQQKMEDIIGCLQQYFYLRVVMVLKDTYLVEENLQNLKSKMLKLYIKSGQMKNSTKTTLELLSKRIIEYIKEHLNMEKIDSNFTIEEVSKIEYDNISTFISLSGDLSGTIGLSISXNFANLLVNSFIFGEVDEATLRELATXNVAETLNITLGNIIKDLEEVKAGGKVDISTPYTLHNSVSITKKENGTMDLSQIKY

SEQ ID NO: 11465 - DNA, 378 bp, Unknown
  Obtained from environmental sample
  misc_feature (1)..(378): n is a, c, g, or t
atggcaaaagtattagtagtagatgattcaaaagtcatgagaatcaatataggaaatatgttaaaaaaaatagggcatgaagttgttgcagaagcagataatggatttacagctattgagatgtacaaaacacatcttccagattttgttacaatggatataacaatgcctcctattaatggagtatacgatgggattgaagcagtgggaattatcaaaaaaaaatttcctgaagcaaaagtgataatggcgacctcccatggagataaagataaaataattaaagcaattaaaaatggtgcatcaaattatcttcttaaacctataaaagttgaaaaacttcaagaagtgatagggaaaataggcattataaactaa

SEQ ID NO: 11466 - protein, 125 aa, Unknown
  Obtained from environmental sample
  DOMAIN (2)...(125): Response regulator receiver domain
  misc_feature (1)..(125): Xaa is any amino acid
MAKVLVVDDSKVMRINIGNMLKKIGHEVVAEADNGFTAIEMYKTHLPDFVTMDITMPPINGVYDGIEAVGIIKKKFPEAKVIMATSHGDKDKIIKAIKNGASNYLLKPIKVEKLQEVIGKIGIIN

SEQ ID NO: 11467 - DNA, 369 bp, Unknown
  Obtained from environmental sample
  misc_feature (1)..(369): n is a, c, g, or t
atggaactaataccaaatgatgtaccactagaggtcgaagcaaaagtattaaatagagatattggatttattcaaataggacaaaaagttaaagttaaacttgatagttttaaattcacaaagtatgggtatatagaaggtgaagtaacgaatatagaaaaagcatctattttggatgaaaacttgggtgagatataccctataataatacaacttaatacagatattatgaaggttgataataaatatattaaattaatacctggtatgacttgttccgttgatataaaaatagggaaaagacaattaatagattatattatatctccaatgataagatatcaagatgaagctttacgtgaaaagtaa

SEQ ID NO: 11468 - protein, 122 aa, Unknown
  Obtained from environmental sample
  misc_feature (1)..(122): Xaa is any amino acid
MELIPNDVPLEVEAKVLNRDIGFIQIGQKVKVKLDSFKFTKYGYIEGEVTNIEKASILDENLGEIYPIIIQLNTDIMKVDNKYIKLIPGMTCSVDIKIGKRQLIDYIISPMIRYQDEALREK

SEQ ID NO: 11469 - DNA, 498 bp, Unknown
  Obtained from environmental sample
  misc_feature (1)..(498): n is a, c, g, or t
ttgccaaattttaagtccgaatggtatccaaaatttatctataccattaaaagtgttaaaaaaagaaagacctatcaagcaaccaaaattgcttatgtagaaaattggcaagtgatgcattggcgttctttagaggctgcttacagaagctctccatattttgaattttatgaagaccatattgctcctttcttccttgaaaaaaaatatgaatatttacacgaactcaatttagcattaaacgagttaattattaaactcattaatattcctgtaaacgtggagcttaccacttcatttgaaaaaaatccagaaaaatctaccgactataggggaataatgtcttctaataaaatacctaagaatttagaattcaaaccttacattcaggtatttagcgacagacatccatttatgcccaacctcagcattttagatttactgttcaaccaaggaccaaatagcatcagctacttaaaagggataaaggagatttaa

SEQ ID NO: 11470 - protein, 165 aa, Unknown
  Obtained from environmental sample
  misc_feature (1)..(165): Xaa is any amino acid
MPNFKSEWYPKFIYTIKSVKKRKTYQATKIAYVENWQVMHWRSLEAAYRSSPYFEFYEDHIAPFFLEKKYEYLHELNLALNELIIKLINIPVNVELTTSFEKNPEKSTDYRGIMSSNKIPKNLEFKPYIQVFSDRHPFMPNLSILDLLFNQGPNSISYLKGIKEI

SEQ ID NO: 11471 - DNA, 966 bp, Unknown
  Obtained from environmental sample
  misc_feature (1)..(966): n is a, c, g, or t
atggttcagaacattttaaaaagagacggatctcatagagaatttagagcctttaaaattgaagatgccataaaaaaagcatttgatagtgagcatacaaattatgataatagaatctttttaaacgtgatgggaaaattagaagttaaagagactatagctgttgaggatgttcaagacttaatagaaaaagagctatacaaatcgaactattttgaagttatgcgctcatttattttataccgtcatatgcataaaatgcaaagagagagagttcttgatgatgatactacatatatcaattcaacgcaaactatagaagagtacatcaacaaaagtgactggagaattaaagcaaactcaaatacaggatactcaaatgcgggacttgtaaataatagcgcaggaaaagtcattgcaaattactggctagataaaatttactctaaagaagaaggttatgctcatagaaacggcgattatcatattcatgatctggactgtttaacagggtattgtgctggatggagtttaagagtacttcttgatgagggttttaacggtgtaagaggaagagtagagagtgatgcgcctaaacattttcgtgaagcactaggacagatggcaaacttcttgggaatactccaaagtgaatgggctggagcacaagctttttcatcatttgatacctacttggcaccatatgtttttaaagataagttgtcatacaaagagatcaaaaaagctgtaagaagttttatctataacctaaatgttcctgctcgttggggacagtcaccatttacaaatataaccatagactggactgtaccagatgatctaaaagatcaaattcccactagagagcagattcatctatttaaagggtttgtagaattccccactctgggaattggcaaaatgaccgcggatgtggacaaacctgaaaattatgggggtaccaac

SEQ ID NO: 11472 - protein, 322 aa, Unknown
  Obtained from environmental sample
  DOMAIN (3)...(89): ATP cone domain
  misc_feature (1)..(322): Xaa is any amino acid
MVQNILKRDGSHREFRAFKIEDAIKKAFDSEHTNYDNRIFLNVMGKLEVKETIAVEDVQDLIEKELYKSNYFEVMRSFILYRHMHKMQRERVLDDDTTYINSTQTIEEYINKSDWRIKANSNTGYSNAGLVNNSAGKVIANYWLDKIYSKEEGYAHRNGDYHIHDLDCLTGYCAGWSLRVLLDEGFNGVRGRVESDAPKHFREALGQMANFLGILQSEWAGAQAFSSFDTYLAPYVFKDKLSYKEIKKAVRSFIYNLNVPARWGQSPFTNITIDWTVPDDLKDQIPTREQIHLFKGFVEFPTLGIGKMTADVDKPENYGGTN

SEQ ID NO: 11473 - DNA, 813 bp, Unknown
  Obtained from environmental sample
  misc_feature (1)..(813): n is a, c, g, or t
atgattgaaagtggatttacttttaaagagaaggttttaacagaagaggatgctatcttacaacaagaaaagtttatctcttctttgcaaaataatattgatgtactctttgataatgattatttaataggtgaatttaaaaaaatcatatctgaatacggtgaaattactagagaaaatattagagtaatagaaaaggattggtataaattaaatgggtctgggaatttcattgaaaccaaaatttctattttaagccatattctgtttaaaatgagtgtttcgaaaattgatgaggaatattttaagaattgtttggaggacaaaaatttagttttaacaaaacttcaattcttaattgaacgatataaaagctctaatcggaatattaatatttcagacaaacaaaaagaaattatcaattcttggattaccgatattgttgtcaatattaattttgagcagattatcaaacttcatagtgaagggttttacagccaacatccagatttcgataaattaaaaacagtattttattatcaaaaattactaagcatttcccttccaaaagaattcttactaaatagtttaagattttatgagttggataaatctagtgagcttgacgagagtttctattatctcaaaaaattaattgataataacaatgcttttgatgctcaaattgtctctaaaataggagcagggaatccatttgcgttttctttatccaagcatattggcctatgcaataaaaatataaatttagaagaaacctaccaactttataaggaaaatatttttaaaaaataa

SEQ ID NO: 11474 - protein, 270 aa, Unknown
  Obtained from environmental sample
  misc_feature (1)..(270): Xaa is any amino acid
MIESGFTFKEKVLTEEDAILQQEKFISSLQNNIDVLFDNDYLIGEFKKIISEYGEITRENIRVIEKDWYKLNGSGNFIETKISILSHILFKMSVSKIDEEYFKNCLEDKNLVLTKLQFLIERYKSSNRNINISDKQKEIINSWITDIVVNINFEQIIKLHSEGFYSQHPDFDKLKTVFYYQKLLSISLPKEFLLNSLRFYELDKSSELDESFYYLKKLIDNNNAFDAQIVSKIGAGNPFAFSLSKHIGLCNKNINLEETYQLYKENIFKK

SEQ ID NO: 11475 - DNA, 384 bp, Unknown
  Obtained from environmental sample
  misc_feature (1)..(384): n is a, c, g, or t
ttgtttttagataatatagagaaagtagggttgtctaaaatgagatatctagacattaaaaattatacctcaaatagtgatgacgaattattaaaaaaattatattttattttttactctaaagaagttgataggtttgattcatatcacgccagaactttctttttttcttatatcgtgaatataggaatcaaacatttagataattttgatagaataaataatcttttaaaagaaataaaggaaatagaaaaaacaaaaggtaatgatttattctatataaatcttttaatagatgactttaacaacagttatattttaagtaaatctaagccttttacacttcaggaggcagtagatagatgttctcaattaatggaataa

SEQ ID NO: 11476 - protein, 127 aa, Unknown
  Obtained from environmental sample
  misc_feature (1)..(127): Xaa is any amino acid
MFLDNIEKVGLSKMRYLDIKNYTSNSDDELLKKLYFIFYSKEVDRFDSYHARTFFFSYIVNIGIKHLDNFDRINNLLKEIKEIEKTKGNDLFYINLLIDDFNNSYILSKSKPFTLQEAVDRCSQLME

SEQ ID NO: 11477 - DNA, 609 bp, Unknown
  Obtained from environmental sample
  misc_feature (1)..(609): n is a, c, g, or t
atgagtgaaaaaaacattatatggcataatcagcatgtaaaaaaagaggatcgctcaaaactcaaaactcaaaagccttgcatactctggtttacggggctaagcggaagcggtaaatcaaccatagcaaatgcacttgagttgaaacttcacgagaaagactatcatacatatctactagatggcgataacataagacatggattaaactctgatcttggatttgatgaaattagcagagttgaaaacattcgccgtatcggtgaagtggcaaaactctttgtagatagcggaactattgttttatctgcttttatatctccatttataagtgacagagagagagtaaaaaagttagttgaagaggatgaatttatagaaattttcgtagatactccacttgatgtttgtgaaagcagagatccaaaaggactatacaaaaaaagcagagttggggagatatccgactttacagggatcagttcaccttatgaaaaacctacaaatccatccctacggattaaaaaccaagaatgccctgttgagctttgtgtgagacaaaattttaaaggcagctggaaagaaaaaggggtaatcaaatggggttaa

SEQ ID NO: 11478 - protein, 202 aa, Unknown
  Obtained from environmental sample
  DOMAIN (25)...(181): Adenylylsulphate kinase
  misc_feature (1)..(202): Xaa is any amino acid
MSEKNIIWHNQHVKKEDRSKLKTQKPCILWFTGLSGSGKSTIANALELKLHEKDYHTYLLDGDNIRHGLNSDLGFDEISRVENIRRIGEVAKLFVDSGTIVLSAFISPFISDRERVKKLVEEDEFIEIFVDTPLDVCESRDPKGLYKKSRVGEISDFTGISSPYEKPTNPSLRIKNQECPVELCVRQNFKGSWKEKGVIKWG

SEQ ID NO: 11479 - DNA, 756 bp, Unknown
  Obtained from environmental sample
  misc_feature (1)..(756): n is a, c, g, or t
ttggattttgataaattatctattacagatgacatcgatagttttattaaacttgatgcaataaaagaacaagcaataaaaaacaaagatatagatgcattagaccaggtgtataaaaaagagaaaccgattatcttatcagagactattaaagaatatggttatgctttaaatgttaattcaaaagatataaataaagagttatggaatgagtttaacggaacagtaaaagattatgatggctttggtgaacatcatgtaaaaaacatacctgattataaagataagtttattgaaaagtatttagaaaatgttgaacttgaatataccatggaaaagttatctcaagaagttgaaacacaagaagaatataatcaattggaaaatgatgtaaaagagtttgaaagtttaattgcagattttaaagaagagctacaagagcaaaagataatagaagaatataaaaaaagtattgacaacattgttaatgatcttaatgatggaaaatttaaaactgctcgagagaaaataaacaatacagagtttaatagtgaactagataaaaaaagtattgagaatatttatagtttggctatagatcaatatagtagtgatgaaaaattagaagctgtaaaagctcgaattgatgaacaaaaagagatattgcataaaagctatgaagctaatccaagtgaaacgatttattataattttaataaggaccaaaatatactattggaaataagaaagaaataa

SEQ ID NO: 11480 - protein, 251 aa, Unknown
  Obtained from environmental sample
  misc_feature (1)..(251): Xaa is any amino acid
MDFDKLSITDDIDSFIKLDAIKEQAIKNKDIDALDQVYKKEKPIILSETIKEYGYALNVNSKDINKELWNEFNGTVKDYDGFGEHHVKNIPDYKDKFIEKYLENVELEYTMEKLSQEVETQEEYNQLENDVKEFESLIADFKEELQEQKIIEEYKKSIDNIVNDLNDGKFKTAREKINNTEFNSELDKKSIENIYSLAIDQYSSDEKLEAVKARIDEQKEILHKSYEANPSETIYYNFNKDQNILLEIRKK

SEQ ID NO: 11481 - DNA, 885 bp, Unknown
  Obtained from environmental sample
  misc_feature (1)..(885): n is a, c, g, or t
gtgtggggagtggtgctaacctctcctttcggggaaccccttctaccttcttcttttgtcccccctgcattcccctttccctctccaaccccttggtcaccgtcttggttttttgtccggcatttcaaaaactcgtctttggcgagatataaggggattccccttcaaaattttaccacccctccaaatgcttttatcagtagttcccgggagattttaccaaaggaggaagttttctcaactgctcaaaaacatttttcttcttttaacaccagtgaaattagtaaagagattacagaaacccttcaccaggtagagccaaagcaagatgggggaaaaagagttgttatacacaaagattctcaagtagagattttagctataaactttcatattccaaactttttagataaagatcaagtagcactttctgcacttagtgagcttttaagtagtggaaaaagtagtaggctaaatgaactattaatagataaaaaacaaatggtaaacacaatttatgcttataatatggagttaaaagacccaggggtttatctatttttagcagtttgtaacccaggggttaaagctgtggatgttgaaaaagagatttggaaagagataaaaaatatacaaaaaggtgatgtgaaaaaatctgaacttgcaaaaattaagaaaaacacaaaatcagactttatattttctctagaaagctctagtagtgtagcttctttatatggaagttatcttatccgtggtgatatctctccacttatgaattatgaagaagatattaaaaacttacaaacaaaagatataatagaagttgcaaaaaaataccttactaaaaacaactctacaacaatgattttaaaacaagattaa

SEQ ID NO: 11482 - protein, 294 aa, Unknown
  Obtained from environmental sample
  DOMAIN (71)...(228): Peptidase M16 inactive domain
  misc_feature (1)..(294): Xaa is any amino acid
MWGVVLTSPFGEPLLPSSFVPPAFPFPSPTPWSPSWFFVRHFKNSSLARYKGIPLQNFTTPPNAFISSSREILPKEEVFSTAQKHFSSFNTSEISKEITETLHQVEPKQDGGKRVVIHKDSQVEILAINFHIPNFLDKDQVALSALSELLSSGKSSRLNELLIDKKQMVNTIYAYNMELKDPGVYLFLAVCNPGVKAVDVEKEIWKEIKNIQKGDVKKSELAKIKKNTKSDFIFSLESSSSVASLYGSYLIRGDISPLMNYEEDIKNLQTKDIIEVAKKYLTKNNSTTMILKQD

SEQ ID NO: 11483 - DNA, 390 bp, Unknown
  Obtained from environmental sample
  misc_feature (1)..(390): n is a, c, g, or t
ttgnaacacggtatacattttttaaagttatatttttctgtttcaaaagatgaacaagcaaaaagatttgaagagagagaagaaaatcctttaaaacaatggaaattgagtgaaatagatatccagatgcaagaaagatgggatgagttcacagcgaaaaaatatagaatgttaaaagaaacaaatacaaaaaaatctccatggactattatacgaagtgatgataagtttatagcacgatacaatgctattaaaacaattttaaacaaagttgattatgaaggaagaggtacaagaatagattttacagttgatccggatattgttatctccgcagaaaaagaactagaaaatatgaaccaaactgcaaacaagatttcacaaggttaa

SEQ ID NO: 11484 - protein, 129 aa, Unknown
  Obtained from environmental sample
  DOMAIN (1)...(99): Domain of unknown function (DUF344)
  misc_feature (1)..(129): Xaa is any amino acid
MXHGIHFLKLYFSVSKDEQAKRFEEREENPLKQWKLSEIDIQMQERWDEFTAKKYRMLKETNTKKSPWTIIRSDDKFIARYNAIKTILNKVDYEGRGTRIDFTVDPDIVISAEKELENMNQTANKISQG

SEQ ID NO: 11485 - DNA, 786 bp, Unknown
  Obtained from environmental sample
  misc_feature (1)..(786): n is a, c, g, or t
atgatacaatttcaacaaaattttaaacaacagcttacaaaaaaagagattaaagtaattgatgagactttttctattttaaaagaggaaaaagattctaatagtattggttattataaactttatgaaacatcacaagatattcttaaaggtgtaaaaagatataaaaaagagaataaatacttaaagaataaaaaaataaaaaatattgttgttgtaggtattggtggttctagtttgggtaccaaagctgtatatgagcttttaaaattaaaacaaaaatcaactataaatttaatatttttagaaaatgtagatcctttggatattgcttcaaaaacaaaagatattaaaaaaacaaattcactgtttattgtaatatcaaaatcgggttcaactattgaaactatctctatttttaaatatgttttagaaaaatttaatttagatttgaaaaaagataacagtagattaattgcaattacagataaaggttcaaacttatcaaagttagcaataaaaaataatatacctcaatttaatataccacttaatgtgggtggaagattttctgtattaagtgctgttggtattgtacctttagttcttgctggatataaagttgaaaaaactttagaaggttctaaaatttttatagaatcattttttgataaaaaagaaaatcacttactccaaaaagcatattactattttaaaaataaagataaatactgtatcaatacactttttagctattctacatattctcgacctcagccgatctga

SEQ ID NO: 11486 - protein, 261 aa, Unknown
  Obtained from environmental sample
  DOMAIN (5)...(261): Phosphoglucose isomerase
  misc_feature (1)..(261): Xaa is any amino acid
MIQFQQNFKQQLTKKEIKVIDETFSILKEEKDSNSIGYYKLYETSQDILKGVKRYKKENKYLKNKKIKNIVVVGIGGSSLGTKAVYELLKLKQKSTINLIFLENVDPLDIASKTKDIKKTNSLFIVISKSGSTIETISIFKYVLEKFNLDLKKDNSRLIAITDKGSNLSKLAIKNNIPQFNIPLNVGGRFSVLSAVGIVPLVLAGYKVEKTLEGSKIFIESFFDKKENHLLQKAYYYFKNKDKYCINTLFSYSTYSRPQPI

SEQ ID NO: 11487 - DNA, 519 bp, Unknown
  Obtained from environmental sample
  misc_feature (1)..(519): n is a, c, g, or t
atgcttaactcgagcatgaaaacagtttttttaattcttatatttgttacatcaatttttgcctcatccatcgagatgaactatcaagaactcaacaaagagatagataaaatatctctagatttaactccagaagagaaagtatcgctatactttcttgttctatcaacgcatgaaaatattacaacgtccctctctttagataaaacaaaagtatcttctttagaaacactacaaaaccgtacacttaaaactttttctgctctacatgaaaacaactcaaatatagatgcaagccagattaaaagaatgaaagagttatatacaaagataatcaaagagggtcaagaacttataaaaaaactctctaaaacttctaaagacaaaattatatatcaagacaaaatagtctatcaagataaaattatcttcaaagataaaataatttataaagataaaactgtagaaaagtcttctcttagtctaagtgttttatttggagtagttggaatattatag

SEQ ID NO: 11488 - protein, 172 aa, Unknown
  Obtained from environmental sample
  misc_feature (1)..(172): Xaa is any amino acid
MLNSSMKTVFLILIFVTSIFASSIEMNYQELNKEIDKISLDLTPEEKVSLYFLVLSTHENITTSLSLDKTKVSSLETLQNRTLKTFSALHENNSNIDASQIKRMKELYTKIIKEGQELIKKLSKTSKDKIIYQDKIVYQDKIIFKDKIIYKDKTVEKSSLSLSVLFGVVGIL

SEQ ID NO: 11489 - DNA, 618 bp, Unknown
  Obtained from environmental sample
  misc_feature (1)..(618): n is a, c, g, or t
ttggctgaggtttgtgcattaagcgacagaattgaagcttggaataaatatggatttagatttaacagtgaaacaggcaactatgatggatatgaacaaggttcagaatttattgattatattaatcaaaaaaatatagggaatacttcaaatgattgctggcaaaaatcattaatagaattaattggactaaaatggaataatcaaaactatatcttaggatataaaccaaaaagtaaagtagaatttgatgttggattaaattatgaggtgggcaaaaaatggccactaaaagcaatgccaataaaaaaatggaagaagttatcacacaagctagaaaataagaacattaaagtttcatggcaagagggactaaatagtatttatgattatatagagtggataaattcttgtgacaccataatcactcaagatagtctaggacttcacttggccttggcattaaacaaaaaagtaatagctcttttcggtcccacatcttcaaaagaagtttgttttcataaaaataattatatcataaatgcaccaagtaaagatatgcataatattgatataaatttaatttacgattggtatataaataataatgataagtaa

SEQ ID NO: 11490 - protein, 205 aa, Unknown
  Obtained from environmental sample
  misc_feature (1)..(205): Xaa is any amino acid
MAEVCALSDRIEAWNKYGFRFNSETGNYDGYEQGSEFIDYINQKNIGNTSNDCWQKSLIELIGLKWNNQNYILGYKPKSKVEFDVGLNYEVGKKWPLKAMPIKKWKKLSHKLENKNIKVSWQEGLNSIYDYIEWINSCDTIITQDSLGLHLALALNKKVIALFGPTSSKEVCFHKNNYIINAPSKDMHNIDINLIYDWYINNNDK

SEQ ID NO: 11491 - DNA, 486 bp, Unknown
  Obtained from environmental sample
  misc_feature (1)..(486): n is a, c, g, or t
atgataagtaaactagactctcataaaatcaactatcatccaaaagagatagcagatatgtttgctggaaaactagaagcacccatatatgttgagatatctccaacaggtatttgtaatcataaatgtcttttttgtcattataactatttagggcatgaagggaaatttcaaaaaggtaaaataccagaacttataaaagagtttgctcaaatgggtgttaagtcattggtatttgcgggtaatgaagaaccaacacttcatgtggatactattgaaagcatccagttatctaaagagttaggtttggatgtagcactaagtacaaatggtgcattacttaaagaaagacattttgaggatcttgcaaaaaaacctacatggaataccaatttccttttaatgccaggaagtagtgaaaattattgcttatgttcatccaaccaaaaagggaggaatttaataaaagtagttgaaaatttttaa

SEQ ID NO: 11492 - protein, 161 aa, Unknown
  Obtained from environmental sample
  misc_feature (1)..(161): Xaa is any amino acid
MISKLDSHKINYHPKEIADMFAGKLEAPIYVEISPTGICNHKCLFCHYNYLGHEGKFQKGKIPELIKEFAQMGVKSLVFAGNEEPTLHVDTIESIQLSKELGLDVALSTNGALLKERHFEDLAKKPTWNTNFLLMPGSSENYCLCSSNQKGRNLIKVVENF

SEQ ID NO: 11493 - DNA, 858 bp, Unknown
  Obtained from environmental sample
  misc_feature (1)..(858): n is a, c, g, or t
ttgggccatattaaaaaattccatccaattggaacctggttaatttttattttaggggataaacttgaaacaaattttcaaatacctttggaaaaaattttttggcatattgcatatttatcagggtcaccacatgtaggctctgccctaagttgtacagatatatgggttactttgtactttgatatattaaagctagaagattatgaaaatagagatctctttttgttatcaaaagcacattctgctatggccttatattctacgatgtatgaaaaaggttttttgacaaaagaagagttagagggatattatcaaaataatggaacattaccagcacatacagataaaaatacaaatccatatatagagataagtgccggaagtttaggacatggactgccaatggctttaggtatggcacactccttaaaacttaaaaaaagtgatagaaaagtgtttgttcttatgggagatggagaatcacaagagggaagtgtttgggaggcggcgatgttagcacctcatttgaatctagataatttaactgtatttattgatagaaataatcttcaagggtatggaagagcgagtgatattttatcttatgaaccaatagatgataaatttaaagcatttaactgggaagtattaagagttgatggacacaaccataatgccattaaggaagctgtagaatttaaaacggataaacccaaaatgattatttgtgatacaacaaaagggaaagatgtaagttttatggaagataagcttatttggcactattatgtggttactgatgagattaaattagaagcattacaagagttagaggataaattcaatgagaaatag

SEQ ID NO: 11494 - protein, 285 aa, Unknown
  Obtained from environmental sample
  DOMAIN (29)...(282): Transketolase, thiamine diphosphate binding domain
  misc_feature (1)..(285): Xaa is any amino acid
MGHIKKFHPIGTWLIFILGDKLETNFQIPLEKIFWHIAYLSGSPHVGSALSCTDIWVTLYFDILKLEDYENRDLFLLSKAHSAMALYSTMYEKGFLTKEELEGYYQNNGTLPAHTDKNTNPYIEISAGSLGHGLPMALGMAHSLKLKKSDRKVFVLMGDGESQEGSVWEAAMLAPHLNLDNLTVFIDRNNLQGYGRASDILSYEPIDDKFKAFNWEVLRVDGHNHNAIKEAVEFKTDKPKMIICDTTKGKDVSFMEDKLIWHYYVVTDEIKLEALQELEDKFNEK

SEQ ID NO: 11495 - DNA, 732 bp, Unknown
  Obtained from environmental sample
  misc_feature (1)..(732): n is a, c, g, or t
atgagatatctattttccctttttatcttcactacattaatttttgcagaagtaaaaatcaatctttctcacacaaatataaaacacggtacatcgtttgctgtgatacttcaaagtgataaaaacttatcacaagctccaaatgtgatttttaaagataaaacttatcagatgtttactatcaatggaagtattcaaaactatgaggtttttctccctgttgattatcataatccaaaacaaaaagagaatgtacaggtaagatacttagaagatgagcagttagtaaagaaaaatacctctataaatatcattgatggaaaatatcgacaaaatgagattataaaagttgccaaagggaaagtaacactttcttcaaaaaacaaagaaaaaacagccaaagagtacaatcaagtttttaaaaatgtttactcagtggttactttatatgatttaacaaacaactcaacttttcaacttcctatggatagtaaaattacaagtgcttttggaaatgctagagtttataatggtgttgcaaaaagttatcatactggaactgattttagagcaagtgtaggggatgaagtaaaaacttcaaatgatgggaaagtggttcttactaaggatagattttatctagggccgggttatcttacaaagaccatgggaagaggagcttatacctacccactctccctttggagtaagatattacgccaaagagggtga

SEQ ID NO: 11496 - protein, 243 aa, Unknown
  Obtained from environmental sample
  SIGNAL (1)...(16)
  misc_feature (1)..(243): Xaa is any amino acid
MRYLFSLFIFTTLIFAEVKINLSHTNIKHGTSFAVILQSDKNLSQAPNVIFKDKTYQMFTINGSIQNYEVFLPVDYHNPKQKENVQVRYLEDEQLVKKNTSINIIDGKYRQNEIIKVAKGKVTLSSKNKEKTAKEYNQVFKNVYSVVTLYDLTNNSTFQLPMDSKITSAFGNARVYNGVAKSYHTGTDFRASVGDEVKTSNDGKVVLTKDRFYLGPGYLTKTMGRGAYTYPLSLWSKILRQRG

SEQ ID NO: 11497 - DNA, 438 bp, Unknown
  Obtained from environmental sample
  misc_feature (1)..(438): n is a, c, g, or t
ttggcgcacatggagcgcatgcaggtagaatctttgcaagatgagggagttgaaaatattactaaagagaaatcattaaatattttcacacaagatatcatattagaacaggttaaatctctcagacttataaaacaaccttatgatctatatgagatgtttcacaatatcgagccactcaataattctaaactaccatctaaacaagagagctatcttgccataactagagtaaattacagagttcacataatcaaaatccaaccatggcaatactactttttagaagcatgtaaaaatcagatttcactaaataatgccatagatatagcagctaaaaagatgcaaacgactccaaaaagtttaagagcaaaactaattttttggctaccgatagcacaaaatatggcttttgttaaatttagttcagttatataa

SEQ ID NO: 11498 - protein, 145 aa, Unknown
  Obtained from environmental sample
  misc_feature (1)..(145): Xaa is any amino acid
MAHMERMQVESLQDEGVENITKEKSLNIFTQDIILEQVKSLRLIKQPYDLYEMFHNIEPLNNSKLPSKQESYLAITRVNYRVHIIKIQPWQYYFLEACKNQISLNNAIDIAAKKMQTTPKSLRAKLIFWLPIAQNMAFVKFSSVI

SEQ ID NO: 11499 - DNA, 414 bp, Unknown
  Obtained from environmental sample
  misc_feature (1)..(414): n is a, c, g, or t
atgcttgatatggatcattttaaatctgtaaatgatgaatatggtcatgatattggtgacttagtattaaaagaactaggaaaaattttaagtgaaaatgtaagagaatcagatattgttgtaagatatggaggagaagagtttattatacttcttattggggtagataatgaagaatctgtacttgaagtagcaaataaaatacgaacaaaagtcagtaaaaatgaaatcaatgtatatgctggaaataaattaagaaaaactgtaagtattggtttttctatgtttcctgaagactctacaaactttgatatagtgctaaaaaatgccgatattgcactttatgaggcaaaagagaaagggagagatcaagttataagatttcaagagaaggttcaagtagaactattttaa

SEQ ID NO: 11500 - protein, 137 aa, Unknown
  Obtained from environmental sample
  DOMAIN (1)...(124): GGDEF domain
  misc_feature (1)..(137): Xaa is any amino acid
MLDMDHFKSVNDEYGHDIGDLVLKELGKILSENVRESDIVVRYGGEEFIILLIGVDNEESVLEVANKIRTKVSKNEINVYAGNKLRKTVSIGFSMFPEDSTNFDIVLKNADIALYEAKEKGRDQVIRFQEKVQVELF

SEQ ID NO: 11501 - DNA, 471 bp, Unknown
  Obtained from environmental sample
  misc_feature (1)..(471): n is a, c, g, or t
atgagagccttaggaaggtatttctatctcaacaaagataaagatactagggaaaaagagggtattagtattgaagatttgggaatgcctaaaaatgtggatataaaactcctttttgttgtagatagtaaggtaaattaccatgatgtagaaattccattaattgcacttaatcctccaagttcaatcaaaataaaaaatatgaaagtaagttttgaagctaaactcacaggtgtagatgaaagtgaaaaaaaagagcaaggattctttaaattctttaaaacaaaagatggagaaaaaacacttgaaaaagagactaatgatgcacccaaaggaccaattttactagatttatctggagataaaaatagtggtggtatggcaaagatagaaattgagtttatcaattctgatgttcctgaaacttttgcacgaatcaatgatcatattgtaaaaagttttccattttaa

SEQ ID NO: 11502 - protein, 156 aa, Unknown
  Obtained from environmental sample
  misc_feature (1)..(156): Xaa is any amino acid
MRALGRYFYLNKDKDTREKEGISIEDLGMPKNVDIKLLFVVDSKVNYHDVEIPLIALNPPSSIKIKNMKVSFEAKLTGVDESEKKEQGFFKFFKTKDGEKTLEKETNDAPKGPILLDLSGDKNSGGMAKIEIEFINSDVPETFARINDHIVKSFPF

SEQ ID NO: 11503 - DNA, 882 bp, Unknown
  Obtained from environmental sample
  misc_feature (1)..(882): n is a, c, g, or t
ttgtggtgggagaatgaaagagacgtaagctttgatgaaactataaagcaaacaaatgaggtagaaaatgtagtctatcatacaacaacacaagcagatgatgctaaacctacaatatttatagaccccgtatcaaaaaagtatgttatagcatcactcaaagatgaaactttagataaattaaaagaaaaatttggtacagatgatattatagaaaaagaagatgggagtatcagacttacaggtgatgcagaagcttttgtatctggatggttcgcagatattgcttataaaagagactttttaattgcagataaaaatagtgatggaaagcttaatgaagatgagtataactatactcgaaataactttagtattaaatgttttgctatcacagaatctctctctggaagtaaaaaactattaagcgttggtgaaaaaataacagaagataatatgtatgtacacagtaataatacacagggttactacagaaactatcaagggtctaatactgtagattcattagatgatgaattaaatacaaccttacaagtagataaggattttaatggagagatgagtttaaaggaagcgtacagtgctaaaggaaatactgtagaagcgactgttttagaagaccttgagatattaggaatcacgacagtatcatctgatttagatactagtgattttgattttatccttaattttatacttgatatgttttttcaaaaagatgaaaaagaacaagaacaagaggagattatattaaaagtaaaagagatgctaaactctatgaaagagancaatagtgatgatatagaaaaagtttacactgaagaacatttaaaacatattcaagcttttaaaggaaaataa

SEQ ID NO: 11504 - protein, 293 aa, Unknown
  Obtained from environmental sample
  misc_feature (1)..(293): Xaa is any amino acid
MWWENERDVSFDETIKQTNEVENVVYHTTTQADDAKPTIFIDPVSKKYVIASLKDETLDKLKEKFGTDDIIEKEDGSIRLTGDAEAFVSGWFADIAYKRDFLIADKNSDGKLNEDEYNYTRNNFSIKCFAITESLSGSKKLLSVGEKITEDNMYVHSNNTQGYYRNYQGSNTVDSLDDELNTTLQVDKDFNGEMSLKEAYSAKGNTVEATVLEDLEILGITTVSSDLDTSDFDFILNFILDMFFQKDEKEQEQEEIILKVKEMLNSMKEXNSDDIEKVYTEEHLKHIQAFKGK

SEQ ID NO: 11505 - DNA, 684 bp, Unknown
  Obtained from environmental sample
  misc_feature (1)..(684): n is a, c, g, or t
ttgatggtagcacgaaaatataatgatgaatatataagtttaatctgcgcattatttgcttatggaaatgcaaataaaatagtggaatttttaagttcattaaacttttcacttttagaatgcaatgaagaaattataaaaaaagagttgcaaaatcactattatagatttcaaaacacacaagatattagtagtttttttattgcaataaaaagattaaaacaaaaagatagtttagagaatatctttaaaaaagggtatttaaaagaagctaatattttagaagggatagcttcaattatacaaagtgtattagaagtttatgagtattatagcgaagggtacaaatttttagttggtacagcaccaaagcgagataaacaaggtgttattaaacatatgggaaattctccatataagagatacaatatgtttttacgatggatggtaagagatgattgtcttgatatgggattgtggaaaggtgtagataaaaaagatttaatacttcctttggatacccatacttttaaagtatcccaaaagcttggacttctgactcgtaaaacttacgatttaaagtcagcaatactgataacagaaaaacttcgaaagtttgaaccaaaggatcctattaagtatgactttgctttatatagaatagggcaggaaaataaaatttaa

SEQ ID NO: 11506 - protein, 227 aa, Unknown
  Obtained from environmental sample
  misc_feature (1)..(227): Xaa is any amino acid
MMVARKYNDEYISLICALFAYGNANKIVEFLSSLNFSLLECNEEIIKKELQNHYYRFQNTQDISSFFIAIKRLKQKDSLENIFKKGYLKEANILEGIASIIQSVLEVYEYYSEGYKFLVGTAPKRDKQGVIKHMGNSPYKRYNMFLRWMVRDDCLDMGLWKGVDKKDLILPLDTHTFKVSQKLGLLTRKTYDLKSAILITEKLRKFEPKDPIKYDFALYRIGQENKI

SEQ ID NO: 11507 - DNA, 711 bp, Unknown
  Obtained from environmental sample
  misc_feature (1)..(711): n is a, c, g, or t
atgcaacaggttcaaatgatgcttagtgctatgataaaaaaagagtttttactggttttaagagacaagcatgcacttgcagctttatttgtaatgcctgctatttttatattaatcatgtcagtagctatgcgagatcaattttctacaaaaaacatcgagttcactttttttgtagtggactcagacaaaagtgagattagtaaaaagattatcttagagattaaaaaagataaaaacttcactatattaaacgacaaagaagatgctgaatttatagttaatatccctaaagactactctgagaaactggaaaaaaaagtccaaataactataaaagactcaatacaaagcaataaaattgaaatatttaagtccatgctttctaagcatctactgagtgcaagattcaacgctctaggattagatatagatatttctaccgataagctctacaatataaaatacaataaactcaaaaatatacccaattccacacaacaaagtgtacctgcttggatagtttttggaatgttctttatcatcattcctatgtcaaccatctatgtgaatgagagaaaacaaaacactctcgctagactaaattctatgaatgtttcacttttttccatgacctctctcaaaaagcataccctacctttctataaatcaagtccaagtgtggataatgcttggagtagaatcttttta

SEQ ID NO: 11508 - protein, 237 aa, Unknown
  Obtained from environmental sample
  misc_feature (1)..(237): Xaa is any amino acid
MQQVQMMLSAMIKKEFLLVLRDKHALAALFVMPAIFILIMSVAMRDQFSTKNIEFTFFVVDSDKSEISKKIILEIKKDKNFTILNDKEDAEFIVNIPKDYSEKLEKKVQITIKDSIQSNKIEIFKSMLSKHLLSARFNALGLDIDISTDKLYNIKYNKLKNIPNSTQQSVPAWIVFGMFFIIIPMSTIYVNERKQNTLARLNSMNVSLFSMTSLKKHTLPFYKSSPSVDNAWSRIFL

SEQ ID NO: 11509 - DNA, 432 bp, Unknown; identical to SEQ ID NO: 6983
  Obtained from environmental sample
  misc_feature (1)..(432): n is a, c, g, or t

SEQ ID NO: 11510 - protein, 143 aa, Unknown; identical to SEQ ID NO: 6984
  Obtained from environmental sample
  DOMAIN (3)...(108): Type I restriction modification DNA specificity domain
  misc_feature (1)..(143): Xaa is any amino acid

SEQ ID NO: 11511 - DNA, 489 bp, Unknown
  Obtained from environmental sample
  misc_feature (1)..(489): n is a, c, g, or t
atggctgaaaatagaaagttatatctaaaaatactaacaaacttttatactaaatataaagatttaaaactagaagttttagataaagaagagttagaaagaacagcccatactatcaaaggactctcagcaaatataggagctataaatttaagtaatatttcaaaaaaaacagaagagtcattggacaaaaatctttttggtgaattttacgaagagttggataaagtcataagagagctaaaagctttaactcataatgaactaactcaaaatcttttagaaatagatagtacaagaagagataaactatttgactcactaaaagagtttgctactaaaagaaaagcaaaacagtgtaatgatatacttagtgaatttgaaaaatatgaattaacaaaaaaagataaagaagtaatagttcaaatcaaagagttattaaataaaagagattataaaaatataaacaaaagaataagtcgtctttaa

SEQ ID NO: 11512 - protein, 162 aa, Unknown
  Obtained from environmental sample
  DOMAIN (6)...(84): Hpt domain
  misc_feature (1)..(162): Xaa is any amino acid
MAENRKLYLKILTNFYTKYKDLKLEVLDKEELERTAHTIKGLSANIGAINLSNISKKTEESLDKNLFGEFYEELDKVIRELKALTHNELTQNLLEIDSTRRDKLFDSLKEFATKRKAKQCNDILSEFEKYELTKKDKEVIVQIKELLNKRDYKNINKRISRL

SEQ ID NO: 11513 - DNA, 555 bp, Unknown
  Obtained from environmental sample
  misc_feature (1)..(555): n is a, c, g, or t
atgaaaacagaaagaaaaaaagagctattagaggctttaaagaatatcccagattatagagtagatgtaggtaaaatagagtatcccctatacgaagtattatttatgacactatttgcattacttaaaggcaatacaacttttaaagatatttttgtttggatgacatttaacaaagagaatgaaatactcaaagaagtatttgaaaaagagaagataaatgtaccttctcgttctacattgcataccttacttattaacacagataacaatgccttagaagctgtttttagagaatatttttttgagtatattcttcaaaagagtattgcaattgatgggaaatggctcagaggaagtgatgttaatggacaatatacacaagagtcccataaagccatacttaatattttagataaagatatcaaaattgtttttgcacataaatttttagataaaaataaaaagagtgagataagagcacttcaagagatacttgatgataaactttttagtggtgagggtcaaatcttctcattttcgagccgattctga

SEQ ID NO: 11514 - protein, 184 aa, Unknown
  Obtained from environmental sample
  misc_feature (1)..(184): Xaa is any amino acid
MKTERKKELLEALKNIPDYRVDVGKIEYPLYEVLFMTLFALLKGNTTFKDIFVWMTFNKENEILKEVFEKEKINVPSRSTLHTLLINTDNNALEAVFREYFFEYILQKSIAIDGKWLRGSDVNGQYTQESHKAILNILDKDIKIVFAHKFLDKNKKSEIRALQEILDDKLFSGEGQIFSFSSRF

SEQ ID NO: 11515 - DNA, 504 bp, Unknown
  Obtained from environmental sample
  misc_feature (1)..(504): n is a, c, g, or t
ttgaaaaaatggaaagtagccgacgattgttttgtttatatcctaagaaataatctaactcatttgattgagaaaatcgtaaaagatttcaaattagatgcaagatttgtggcaaccctttttgctcataagcttaaatattgtgaaggtcacctcaactcatctcaaccatttgattataagagtgtttataatctgattaaattcgtaaaagactctaatctcgaaaatgagattttaaaaaagatgcttccaatctattatgaacatcctcaaatggagatgggatcaatactgagaacaaccggatataaagaggtatctaaaaaaagtattcttgatgaagcagaaaagctcaaaggaatgttcaataatattagatataagcacaataaatctgaaacggctgaaacggattggataatgggcaatatcaaacccattgctcttggcaatatgagcctggcagaacttcgtaaagaagtcgataaaattattacatag

SEQ ID NO: 11516 - protein, 167 aa, Unknown
  Obtained from environmental sample
  misc_feature (1)..(167): Xaa is any amino acid
MKKWKVADDCFVYILRNNLTHLIEKIVKDFKLDARFVATLFAHKLKYCEGHLNSSQPFDYKSVYNLIKFVKDSNLENEILKKMLPIYYEHPQMEMGSILRTTGYKEVSKKSILDEAEKLKGMFNNIRYKHNKSETAETDWIMGNIKPIALGNMSLAELRKEVDKIIT

SEQ ID NO: 11517 - DNA, 333 bp, Unknown
  Obtained from environmental sample
  misc_feature (1)..(333): n is a, c, g, or t
atggggaccaaaagaaattttttaattaaggcaatttttggtggaaatatccctttcaatttgggagataacaataagaataaaagtattcaaataaaaaatgattttgaaaacttattacaaaaattaaaagactatgacttaaactctgaagacttaaaggatttaaaagagtcaatagaagaagataaaacaataataaatcatgaaaaaaaagaatttggtaaaaatgtaaagagttggttagaaaaaatatcaacaaaaactagagataaagtagcgatggatggaatcattgaaggattatatgacttttatggatggttgacataa

SEQ ID NO: 11518 - protein, 110 aa, Unknown
  Obtained from environmental sample
  misc_feature (1)..(110): Xaa is any amino acid
MGTKRNFLIKAIFGGNIPFNLGDNNKNKSIQIKNDFENLLQKLKDYDLNSEDLKDLKESIEEDKTIINHEKKEFGKNVKSWLEKISTKTRDKVAMDGIIEGLYDFYGWLT

SEQ ID NO: 11519 - DNA, 438 bp, Unknown
  Obtained from environmental sample
  misc_feature (1)..(438): n is a, c, g, or t
gtgaaagaattaaaaatattcacctataaaggtcataaccgaattgacgaaatacaaaaaattggctccctaacggatatcaaaaaaggaggttatacggttatcacttacagcggcaacgggtggcacaaaaacaatatcaccgcccttggtattcccttttttgaaacaagcgaagtgcataatgtctggaagatgctggccgcaagaagaggagaccttgtcattgaatggccggttggggtagaaaccgtccttgataaagatggcatgacagataagattgttgaaacccgggtatctatcgaatccatgccgtttcacctgatgatcaatacgcaatccgggtataaacatatccttgtcgaatttaatggtattataaagcaaatgctggacgatggaacgataaacaaaattattcaaaaatattattaa

SEQ ID NO: 11520 - protein, 145 aa, Unknown
  Obtained from environmental sample
  misc_feature (1)..(145): Xaa is any amino acid
MKELKIFTYKGHNRIDEIQKIGSLTDIKKGGYTVITYSGNGWHKNNITALGIPFFETSEVHNVWKMLAARRGDLVIEWPVGVETVLDKDGMTDKIVETRVSIESMPFHLMINTQSGYKHILVEFNGIIKQMLDDGTINKIIQKYY

SEQ ID NO: 11521 - DNA, 552 bp, Unknown
  Obtained from environmental sample
  misc_feature (1)..(552): n is a, c, g, or t
atggaaaaaggggaaattacaattaaagtcgctgataaaattacaactggccatataatgccagctggtgcaagactaaaatatagatcaaatattcctgcttattccgaatttgtatttgaaaatgttgatccaagttttgctactagatgcaaggataataaggaaaaaggtatcggtaatttcatcgttgctggggcttcctatggtcagggttcttcaagagagcatgcagcaatttgtccaatgtatcttggagtaaaagtagtattagccgtgtcaattgagagaattcaccaaaataatttatgcaattttggaattgttccattaacatttatttatgaaaaggattatataaatattgaaaagggtgagtccattttacttgaagatttaccagatcaaattaccatggcttatttagaaaacaatcctgtgattgttaaaattggtcaaagacatattaaaatgaaatgtgatattactaaagatcaacttgatatgttattagttggtggtttattgaatgttttaaaagataaaaaataa

SEQ ID NO: 11522 - protein, 183 aa, Unknown
  Obtained from environmental sample
  DOMAIN (4)...(116): Aconitase C-terminal domain
  misc_feature (1)..(183): Xaa is any amino acid
MEKGEITIKVADKITTGHIMPAGARLKYRSNIPAYSEFVFENVDPSFATRCKDNKEKGIGNFIVAGASYGQGSSREHAAICPMYLGVKVVLAVSIERIHQNNLCNFGIVPLTFIYEKDYINIEKGESILLEDLPDQITMAYLENNPVIVKIGQRHIKMKCDITKDQLDMLLVGGLLNVLKDKK

SEQ ID NO: 11523 - DNA, 375 bp, Unknown
  Obtained from environmental sample
  misc_feature (1)..(375): n is a, c, g, or t
atgaaatctgatataataatttttggtgctggagggcacacccgttcattaattccattaattcgtgctaatgggtacgggatttctgctatttacgacaattcttttttagctggagaggaagaaaagattgatgatgttttgattgttgggaagattgatgcttttaaaggagatttgaaaatagttttgtcgtttggcgatggaaaaataagaagtgaatttcttaatttattcaaaacaaatattttgaacgaaaacctgatacataaatcagcaattattgagagtagcacaaaaattgaaaattcgaatcagatttttgcaggagtattgataaatgctcaggtaaaaataggcacaaacaatatttaa

SEQ ID NO: 11524 - protein, 124 aa, Unknown
  Obtained from environmental sample
  misc_feature (1)..(124): Xaa is any amino acid
MKSDIIIFGAGGHTRSLIPLIRANGYGISAIYDNSFLAGEEEKIDDVLIVGKIDAFKGDLKIVLSFGDGKIRSEFLNLFKTNILNENLIHKSAIIESSTKIENSNQIFAGVLINAQVKIGTNNI

SEQ ID NO: 11525 - DNA, 486 bp, Unknown
  Obtained from environmental sample
  misc_feature (1)..(486): n is a, c, g, or t
ttgaaaatcaattttgatgctattttttcaaatgcagtattacattgggtaaaggatagtgaaatagccatacaaaagataaataaagctcttaaaaaagatgctagatttgtagctgaatttggtggttatggaaatattcagaatttaatgattgccatggaaaaagtttttaataataatccttcttggggagagtttaatagcccttggatatttccaaaagatacagaatataaagaactgttagagaaaaatggctttaaagtagactatattgaattaatacaaagaccaacacaaatagacgatatcacaaattggttggatgtgtttgcaaatggaattactgaaaatttaagtgcagaagaaaaaataaaatttaaagaagaagtaacaaagttactaaaaccaatacaatacaatgaaaaagatggttggagtgctgattatgttagacttcgagtaaaagctgttaaagtatag

SEQ ID NO: 11526 - protein, 161 aa, Unknown
  Obtained from environmental sample
  misc_feature (1)..(161): Xaa is any amino acid
MKINFDAIFSNAVLHWVKDSEIAIQKINKALKKDARFVAEFGGYGNIQNLMIAMEKVFNNNPSWGEFNSPWIFPKDTEYKELLEKNGFKVDYIELIQRPTQIDDITNWLDVFANGITENLSAEEKIKFKEEVTKLLKPIQYNEKDGWSADYVRLRVKAVKV

SEQ ID NO: 11527 - DNA, 360 bp, Unknown
  Obtained from environmental sample
  misc_feature (1)..(360): n is a, c, g, or t
atgagttttaaaaaatatagacaatatcctattgtcaaaaatatagttcgccaatggccaaataacagcataacaaaagcaccgatttattgttctgtggatttaagagatggaaatcaagctttaataaatccattgagtgtggagcagaagttagagtattttcactatttagtanagatgggatttaaacatattgaggtgagttatcctagtgctagtgatacagattttgaatttacgagaaagattatagaggaggatttagttcctgatgatatttttatcccaagtgttaaatccctgcaccgaaaagagtttgatacaaaagaagtgtgggagccattgagaaggtgctaa

SEQ ID NO: 11528 - protein, 119 aa, Unknown
  Obtained from environmental sample
  misc_feature (1)..(119): Xaa is any amino acid
MSFKKYRQYPIVKNIVRQWPNNSITKAPIYCSVDLRDGNQALINPLSVEQKLEYFHYLVXMGFKHIEVSYPSASDTDFEFTRKIIEEDLVPDDIFIPSVKSLHRKEFDTKEVWEPLRRC

SEQ ID NO: 11529 - DNA, 795 bp, Unknown
  Obtained from environmental sample
  misc_feature (1)..(795): n is a, c, g, or t
ttggattccattaaaatttacggggctggaaggtcaaactttccgggaagggccctaacccattctataattttctcccagggatttcttttggcccatacactttgggataatgtcataaatgaattcaaagatacatattactgtatctcctatgatattaggggctttggtaattcccagtgtaatacaggacaatacacaatggaaagctatgtagaagatttagaaaatataatcttaaagttacagttggacaaaccaatcctttgtggtttttctatgggtggctatattacacttagggcaaatgaaaaacaaccaacaaactataaagcactgatatttgctaatacagctacaaatagtgataatgatgaggcaaaattaaaacgctctggtgctatttctagtattgataaagatggggttgaaccttttttagagaagttttttagtgtagcttttagtgaaaagtatactaaaaaagagccagtaagagtagaagagcttaaagataaaattatgcactttaatcctatgggaataaaaggtgggcttttggctatggttagtagaactgataccactcaaagcttacaaaaaatagatatccctgtgttgttgataagtggtgaaaacgacaaagttatatcgcctgatattatggagcaaatggcaaacgatataaaaaatagtacactggtatctttaagtgatagtggacatgtaagtatgcttgaaaagccagaccaatttaataatgctcttaaagtatttctagaaactttttaa

SEQ ID NO: 11530 - protein, 264 aa, Unknown
  Obtained from environmental sample
  DOMAIN (3)...(263): Ndr family
  misc_feature (1)..(264): Xaa is any amino acid
MDSIKIYGAGRSNFPGRALTHSIIFSQGFLLAHTLWDNVINEFKDTYYCISYDIRGFGNSQCNTGQYTMESYVEDLENIILKLQLDKPILCGFSMGGYITLRANEKQPTNYKALIFANTATNSDNDEAKLKRSGAISSIDKDGVEPFLEKFFSVAFSEKYTKKEPVRVEELKDKIMHFNPMGIKGGLLAMVSRTDTTQSLQKIDIPVLLISGENDKVISPDIMEQMANDIKNSTLVSLSDSGHVSMLEKPDQFNNALKVFLETF

SEQ ID NO: 11531 - DNA, 681 bp, Unknown
  Obtained from environmental sample
  misc_feature (1)..(681): n is a, c, g, or t
atgaccgatgaggtggaagttcttattagagatttctttcataatcctattaatatttcaatagctgtaagtggaaccagattggataatattgaacagcaatgttattcaacacaaaatttcaatacaaaggttaacctactgtcgtttttattggaagaaaaggaggagtttagtaaggtattggtttttatgtcaagtaaaaagtatgccgacaagctattcgaatctttagaagagaagtatggatcgcaaatggcgataattcatagtaataaatcacaaaactatcgtattcggtcactgcaaaaattttctgatggtgagaaacgtattttaatctcaacagatgttatggcacgtggtatcgatattgatgatattacacatgttataaactttgatacaccatcattccctgaaaactatatgcaccgtattgcgcgtactggtagagctgaaaaaaaaggtaaatcaattctcttccacacagaagaggaaacttctttcagagattcccttgaattgttaatgaaatatgaacttccagtggtagattttcctgaacaagtttcagtatcaagtgaactcattggagatgaggttcctaaatctgttgatggagcaagtgttaagtcctgtaagattactgagaaaaggcttttcctgaaaaaaaattga

SEQ ID NO: 11532 - protein, 226 aa, Unknown
  Obtained from environmental sample
  DOMAIN (78)...(154): Helicase conserved C-terminal domain
  misc_feature (1)..(226): Xaa is any amino acid
MTDEVEVLIRDFFHNPINISIAVSGTRLDNIEQQCYSTQNFNTKVNLLSFLLEEKEEFSKVLVFMSSKKYADKLFESLEEKYGSQMAIIHSNKSQNYRIRSLQKFSDGEKRILISTDVMARGIDIDDITHVINFDTPSFPENYMHRIARTGRAEKKGKSILFHTEEETSFRDSLELLMKYELPVVDFPEQVSVSSELIGDEVPKSVDGASVKSCKITEKRLFLKKN

SEQ ID NO: 11533 - DNA, 420 bp, Unknown
  Obtained from environmental sample
  misc_feature (1)..(420): n is a, c, g, or t
atggagcttaaggaaaaaaatgatctcataaaaagacactttaaagagattgaacttctaaaaaaacattccaataatgatgattattatataggttggcaaagagaattaaagaaaaaagaaaaacttcaagaacaagtaaatgcatatgaagaaaaaatcaaagatatagaagaactttataaaagacgtattgataaatttcttttagagaaaagagagaatgatgaagtattgataaaaaaaaataatcaaattagaacactctcagatgaaaaaaatacactttatgaacaagttgataactttaaattagatataaaagaaaaaatatcttatgttgagcaacttcaaaaaagaaatcaagaattagaagatattttaacacacaaagaggagcaaattcaaaaactaaaataa

SEQ ID NO: 11534 - protein, 139 aa, Unknown
  Obtained from environmental sample
  misc_feature (1)..(139): Xaa is any amino acid
MELKEKNDLIKRHFKEIELLKKHSNNDDYYIGWQRELKKKEKLQEQVNAYEEKIKDIEELYKRRIDKFLLEKRENDEVLIKKNNQIRTLSDEKNTLYEQVDNFKLDIKEKISYVEQLQKRNQELEDILTHKEEQIQKLK

SEQ ID NO: 11535 - DNA, 357 bp, Unknown
  Obtained from environmental sample
  misc_feature (1)..(357): n is a, c, g, or t
atgtataaatttattaatagattatctacagaaacaaagtttcattttaatcagtttgtggcacagtttgggttcattttaatagctattgttgggtatttataccatgatagcttaaatactctgatagtactcaacattatttttgctattttatttataattataaaccatatgtttattcaatcagcaaaacaaagagcggaaagatttaagagatattttgaaaacttcttaaaatttgtctcttttgaaacaaatacatatcaaccagcagttatttatggaaaaaatgaaaatacagatatgcttcaaatgcttaaggaaaccgcaaaaaaatatgataaaaaaccttaa

SEQ ID NO: 11536 - protein, 118 aa, Unknown
  Obtained from environmental sample
  misc_feature (1)..(118): Xaa is any amino acid
MYKFINRLSTETKFHFNQFVAQFGFILIAIVGYLYHDSLNTLIVLNIIFAILFIIINHMFIQSAKQRAERFKRYFENFLKFVSFETNTYQPAVIYGKNENTDMLQMLKETAKKYDKKP

SEQ ID NO: 11537 - DNA, 870 bp, Unknown
  Obtained from environmental sample
  misc_feature (1)..(870): n is a, c, g, or t
atggcagtagctaatagtcctgctactatatataatccgttatttatatatggtggagttggattaggtaaaacccacctaattcatgcaattggtaatgaaattagaaataacaatactaatattaatgttagttattattcttccgaaaaatttactaatgaacttattaattcaattagatatggaaaaatggatgaatttagaaataaattcaggtcgatcgatgttttattaattgatgatgttcaatttattgcgggtaaagaaagaacccaagaagagtttttccatacatttaattcactttatgaatcacataaacagatagttgttacatctgataaatttccaaaagaaattccaggattagaagaaagattaagatcacggtttgaatggggtcttatagcagatattcaaccaccagatattgaaacaaaacaagctattttagaagcaaaagctgatcaaaataaaattatattaccaaaagatgttgctttatttttatcaaactcagttattaataatattagagaactagaaggatatttagtaagaattggtgcttactcaagtttaacatcaacaccaataacaattgaaatggcaaaaaatattcttaaagatattattgttgaatctagtaaagaattaactattgaagatatacaaaaaaaggtagcaatacatttcaatttgaaagtgtcagatatgaaatcagctaaaagaattaaaacaatagttttacctcgacaaatagctatgtatctttgtccgacattaacatcgagttcatttcccgaaattggaaaccattttggcggtaaagatcattcacagttatacccgcatttagaaaaatag

SEQ ID NO: 11538 - protein, 289 aa, Unknown
  Obtained from environmental sample
  DOMAIN (1)...(281): Bacterial  dnaA  protein
  misc_feature (1)..(289): Xaa is any amino acid
MAVANSPATIYNPLFIYGGVGLGKTHLIHAIGNEIRNNNTNINVSYYSSEKFTNELINSIRYGKMDEFRNKFRSIDVLLIDDVQFIAGKERTQEEFFHTFNSLYESHKQIVVTSDKFPKEIPGLEERLRSRFEWGLIADIQPPDIETKQAILEAKADQNKIILPKDVALFLSNSVINNIRELEGYLVRIGAYSSLTSTPITIEMAKNILKDIIVESSKELTIEDIQKKVAIHFNLKVSDMKSAKRIKTIVLPRQIAMYLCPTLTSSSFPEIGNHFGGKDHSQLYPHLEK

SEQ ID NO: 11539 - DNA, 450 bp, Unknown
  Obtained from environmental sample
  misc_feature (1)..(450): n is a, c, g, or t
atggtggctttatttttatcaaactcagttattaataatattagagaactagaaggatatttagtaagaattggtgcttactcaagtttaacatcaacaccaataacaattgaaatggcaaaaaatattcttaaagatattattgttgaatctagtaaagaattaactattgaagatatacaaaaaaaggtagcaatacatttcaatttgaaagtgtcagatatgaaatcagctaaaagaattaaaacaatagttttacctcgacaaatagctatgtatctttgtcgacaattaacatcgagttcatttcctgaaattggagaccattttggcggtaaagatcattcaacagttatacacgcaattagaaaaatagaaaaaaatatggaggaagataattatctacgcaccactattaaaacaataagaaacactcttttaccaacctag

SEQ ID NO: 11540 - protein, 149 aa, Unknown
  Obtained from environmental sample
  DOMAIN (1)...(125): Bacterial  dnaA  protein
  misc_feature (1)..(149): Xaa is any amino acid
MVALFLSNSVINNIRELEGYLVRIGAYSSLTSTPITIEMAKNILKDIIVESSKELTIEDIQKKVAIHFNLKVSDMKSAKRIKTIVLPRQIAMYLCRQLTSSSFPEIGDHFGGKDHSTVIHAIRKIEKNMEEDNYLRTTIKTIRNTLLPT

SEQ ID NO: 11541 - DNA, 837 bp, Unknown
  Obtained from environmental sample
  misc_feature (1)..(837): n is a, c, g, or t
atgtggagctattttcccccattctcatggtggaaaaagtttccccggtggaaaatcattgaatccggaaatagctgtaaagaggataaagccagttttttttgttggaaatcaaaacagatgtattttaagccctccctgataaatacagagagagtaattaataaaactatacgattcgctctgaaaggcttcaagttttcatatttaattgtaaaatcattgattgtccggtttttgttcacaaaaaatttgcctggtcaggaatttgatacttttggcagaaaattgtcaattacatttttaatcaaaagggattttacccattttgtaaaattattatgcaaccctgtaagtattgtcagatattttgaatttccatttgtgcacgaagctgttgactggaatttagcaaataagtgtcttgatatatcaagcccccggcttctttttgtctatttactgaagcgataccctgatttgcatgttgatatcatcaacccggatgacggtgatttaaaagaaactgaaaaattcattaaagtagctaatctacatggaagaacgaacattcacaatattgatgcaaccaggaagcttccttttccagatgactgttttgatattattacttcggtcagtgtgtttgaacatatgtcaaaggatggggataagcatgctatgcaagaggcatggcgggttttaaaaccaaagggaaagttgattctcacgttcccgtgttcaaggaattcctatgaggaattttgcgagaaggatgtctatggattaaacaaaggcactaaaaaagagaaatattttttccaaacggatttatga

SEQ ID NO: 11542 - protein, 278 aa, Unknown
  Obtained from environmental sample
  misc_feature (1)..(278): Xaa is any amino acid
MWSYFPPFSWWKKFPRWKIIESGNSCKEDKASFFCWKSKQMYFKPSLINTERVINKTIRFALKGFKFSYLIVKSLIVRFLFTKNLPGQEFDTFGRKLSITFLIKRDFTHFVKLLCNPVSIVRYFEFPFVHEAVDWNLANKCLDISSPRLLFVYLLKRYPDLHVDIINPDDGDLKETEKFIKVANLHGRTNIHNIDATRKLPFPDDCFDIITSVSVFEHMSKDGDKHAMQEAWRVLKPKGKLILTFPCSRNSYEEFCEKDVYGLNKGTKKEKYFFQTDL

SEQ ID NO: 11543 - DNA, 303 bp, Unknown
  Obtained from environmental sample
  misc_feature (1)..(303): n is a, c, g, or t
atgcagtatgaaagtgatgccgactataaaaatgtcagcgtattttttaagctggatgatggcgttgaattctacagtgacaacgaagaatttcgagcaatgaaaagctatgcctggattggcaacctcaaaaaaggtgtcaaccgaataccgttcgttgtcgaggttacaaaacagggaaaatggaaaatatcgaccgatgcaagatacaacggtttcagtcacagacacagcatagaacttgatacagacgacaaaaaggtcagtatctcaatgtatagtctctcgtctgaaaagatatga

SEQ ID NO: 11544 - protein, 100 aa, Unknown
  Obtained from environmental sample
  misc_feature (1)..(100): Xaa is any amino acid
MQYESDADYKNVSVFFKLDDGVEFYSDNEEFRAMKSYAWIGNLKKGVNRIPFVVEVTKQGKWKISTDARYNGFSHRHSIELDTDDKKVSISMYSLSSEKI

SEQ ID NO: 11545 - DNA, 483 bp, Unknown
  Obtained from environmental sample
  misc_feature (1)..(483): n is a, c, g, or t
ttggatttagaaacttattttaaaaaggtagtttccccaggattaaaagatgtggattcaaattgggatattcctgggatccaggatgttcaaaaattatatagtgggcaaaggtttataaaacttttttatccgcatttaaaagatgtagaagagattgaagagttttattttaatctccttgatacactagcacacaagatggtaaagcaaaatcctaaaagagcaataattgagaactatgtacagttatgtgaacatgaaggacgattacatactgaatatgaatgtttattatgtgaagagattattgaaaatgatatatcattagtaagaagttttttaccaactcatgctaaatgcagttacagtaaaagattttccatcaataagataaaagagctgtttgaagaaaaaagttcattacagttaagtgatgaagaggtagagtatttatgggatattttactgcaaggtttataa

SEQ ID NO: 11546 - protein, 160 aa, Unknown
  Obtained from environmental sample
  misc_feature (1)..(160): Xaa is any amino acid
MDLETYFKKVVSPGLKDVDSNWDIPGIQDVQKLYSGQRFIKLFYPHLKDVEEIEEFYFNLLDTLAHKMVKQNPKRAIIENYVQLCEHEGRLHTEYECLLCEEIIENDISLVRSFLPTHAKCSYSKRFSINKIKELFEEKSSLQLSDEEVEYLWDILLQGL

SEQ ID NO: 11547 - DNA, 564 bp, Unknown
  Obtained from environmental sample
  misc_feature (1)..(564): n is a, c, g, or t
atgacaagtataataatttccataattagtactctaattgcacttttatcattttatattgtgtttgtgaattttaaaaaagacaaaccccaattggaaatatactatgacataatgtgtaatacggaccggactaaagagtggattagagttttttttattaatactggacgcagggctacctgtattagaagtattggttattttgattggacactaggtacatatctttcaaaaggtggcgataaatatgagcaaatcttaaaagaaggtgagtttggaagttatgacatcgaaataaactcaaatgaacagtggagaattaagacaatatttgtatcagactattttaataatacttgggaagttagttcaaaaaagatgaagtttttgcacgattctgctcataattataaacgtgactattcaaaaattgggagtaactttaagaaaagacttgaagcgtccttgaatgaatatttgagatttcttgagaaaaataattattcaaatagcacaaaagaaattagacattttaaggaaacaggagaaattaaagattaa

SEQ ID NO: 11548 - protein, 187 aa, Unknown
  Obtained from environmental sample
  misc_feature (1)..(187): Xaa is any amino acid
MTSIIISIISTLIALLSFYIVFVNFKKDKPQLEIYYDIMCNTDRTKEWIRVFFINTGRRATCIRSIGYFDWTLGTYLSKGGDKYEQILKEGEFGSYDIEINSNEQWRIKTIFVSDYFNNTWEVSSKKMKFLHDSAHNYKRDYSKIGSNFKKRLEASLNEYLRFLEKNNYSNSTKEIRHFKETGEIKD

SEQ ID NO: 11549 - DNA, 426 bp, Unknown
  Obtained from environmental sample
  misc_feature (1)..(426): n is a, c, g, or t
atgaaatcgcaaacaatgaaaacatataaaaatggctcaactgaatatattgaaaaacgggtttttaatggacaactagggatggtaataaaaatcgatcatgagaataaaaaactcttagtactttatccaactgatgatatggtagtattttatgattttgatacacttgatagtttaatctctttagcttattgtttaaccattcataaaacacaaggtatggagtatgaaaatgcacttatacctatgagctttagccactttattatgcacaatacaaaactactttatacggcaattaccagagctaaaagtatgtgttatgtaataggagaagatgaggcttttacaagtgcttgtaagaagttagagataacaaaccgccaaactgttattgatgatttattatttaaaaagagctaa

SEQ ID NO: 11550 - protein, 141 aa, Unknown
  Obtained from environmental sample
  misc_feature (1)..(141): Xaa is any amino acid
MKSQTMKTYKNGSTEYIEKRVFNGQLGMVIKIDHENKKLLVLYPTDDMVVFYDFDTLDSLISLAYCLTIHKTQGMEYENALIPMSFSHFIMHNTKLLYTAITRAKSMCYVIGEDEAFTSACKKLEITNRQTVIDDLLFKKS

SEQ ID NO: 11551 - DNA, 306 bp, Unknown
  Obtained from environmental sample
  misc_feature (1)..(306): n is a, c, g, or t
atgatggatactaacgaatcttttaaattatcgggaactctcaaaaaaatacttttctataatcaagaaaacaactattatattgccgtattagaaaatgatcaaaagatttgtggacaatattttgatacagatttagaaaaacttgtaggaagtgaagttataatcactggtcgatggaatactcataaaaaatatggtgttcagtttgtatttacctcccttgaaatcaaagaagcggagatatatttctttttaacaaaaatagttaaaggtatctcaaaaaaaactagctctttaaattga

SEQ ID NO: 11552 - protein, 101 aa, Unknown
  Obtained from environmental sample
  misc_feature (1)..(101): Xaa is any amino acid
MMDTNESFKLSGTLKKILFYNQENNYYIAVLENDQKICGQYFDTDLEKLVGSEVIITGRWNTHKKYGVQFVFTSLEIKEAEIYFFLTKIVKGISKKTSSLN

SEQ ID NO: 11553 - DNA, 438 bp, Unknown
  Obtained from environmental sample
  misc_feature (1)..(438): n is a, c, g, or t
atggcaataattgtagacaaggtacaaaaaagaaaagatatcgcactttcttgtatagatttacttctagaaaaaggtattaagaagttaactgtatctgaagtagcaattcaagcaggtgtttcaaagggaagtatttatgattactttgaaaacaaagaagatattgtttttgagattattagaaatgatatagaaaattatcaaaataacctttatgaacagataactcctactatatcaacaagagaaaaagtttttttgttatttgattttttgttaagtgaaaatgatatgtttcaaaaacatcaaaatatatataaagagtatgtgagtataaatttaggaactcataatgataatatgagtgaatttaataaagagtgttctgttttttttaaaacaactatagaaaagcttaaaaagaggggaaactaa

SEQ ID NO: 11554 - protein, 145 aa, Unknown
  Obtained from environmental sample
  DOMAIN (14)...(60): Bacterial regulatory proteins, tetR family
  misc_feature (1)..(145): Xaa is any amino acid
MAIIVDKVQKRKDIALSCIDLLLEKGIKKLTVSEVAIQAGVSKGSIYDYFENKEDIVFEIIRNDIENYQNNLYEQITPTISTREKVFLLFDFLLSENDMFQKHQNIYKEYVSINLGTHNDNMSEFNKECSVFFKTTIEKLKKRGN

SEQ ID NO: 11555 - DNA, 738 bp, Unknown
  Obtained from environmental sample
  misc_feature (1)..(738): n is a, c, g, or t
atgataaatgaactcaaagagttaaatatgaatttagaaaaaaaagttcaaaatagaactcaaaaactacaaaagtcagaacagtttgcacattcacttgtagaaaaacaagataaatttataaaaaatgcaattcatgagataaatacccctttgagtattattattactaatattgatctttttaaactcaaaaatggtgaaaatagatatctctccaagattgaagcgggttctaaaattatacataatatttataatgacctctcttatttagtaaaaaaagatagaatagaatataaaccgacaaatattaatttttcagattttttaaaatatagagtagatttttttgatgagatagccttgggaaataatttacaatttgatattcaaatagaggataatctttatatatattttaatgatactcaattgcaaagagtgtgtgataatagtttatcaaatgctattaagtatagttatgaaaagggggttatctttatatcattgataaaacaaaatgatgttataatcttttctataaaaaatgagggtaattcaatagataatcctttgaaattgtttgagagatattatagagaaaatgatgctagaggtggatttggtttgnggttaaatataataaaagagatttgtgataataacaatgtgcatatagatgtaaaatcagaaaataatataacacaatttgtttatagttttcaattaaaatag

SEQ ID NO: 11556 - protein, 245 aa, Unknown
  Obtained from environmental sample
  DOMAIN (36)...(98): His Kinase A (phosphoacceptor) domain
  misc_feature (1)..(245): Xaa is any amino acid
MINELKELNMNLEKKVQNRTQKLQKSEQFAHSLVEKQDKFIKNAIHEINTPLSIIITNIDLFKLKNGENRYLSKIEAGSKIIHNIYNDLSYLVKKDRIEYKPTNINFSDFLKYRVDFFDEIALGNNLQFDIQIEDNLYIYFNDTQLQRVCDNSLSNAIKYSYEKGVIFISLIKQNDVIIFSIKNEGNSIDNPLKLFERYYRENDARGGFGLXLNIIKEICDNNNVHIDVKSENNITQFVYSFQLK

SEQ ID NO: 11557 - DNA, 855 bp, Unknown
  Obtained from environmental sample
  misc_feature (1)..(855): n is a, c, g, or t
gtgcaggtggaaaaatttaatcatataagcgcgtcatcttttggtttagcaaaaggtgaggagcttttaagcgatgacgcttatgagtttaaaacattttcttcacactctatcgcagtcttatgcgatggagtaggcagcgccttagagggtcgctcagccgcaaatcacatagtcaaatctcttattacaaattttaaaaaccgcccaaaaagctggtcgatagaaaaatcactacacactttcatcacaaatataaatagaattctctacaaagagtccatgcaaaaatatgagtctattgagtatctctcaacgctttgtgttgtggtgattgagggtgatcgtatttatggagccaatgttggagactctagaatatatctgtgtcgtgataacaaactcacacaacttagtattgatcataatgaagatgatcaagatcatgttttaacgaaagccgtggggcttgaagaggaagttgaaccatactattttgaaaataatctgaaaaagggtgacaagcttctactttgcagtgacggtctttacaacactttagatgaagatgagatcaaagatcaacttaaactaaatgcaacaactctcataaaaagagcagataanaaatcgaactcctctttggctgatgacacttcggctatagtgattcagattaacagtgcagatgagatagcgactcttagagcgttacctttagagattccacaaaaactttcagtaggccatgtaatagatggatatatcttaaaaaaatctcttattcaaaacaatagaacttggctctgctttaaagagggaaaagagtatgttttgaaaatttcctccagttga

SEQ ID NO: 11558 - protein, 284 aa, Unknown
  Obtained from environmental sample
  DOMAIN (33)...(227): Stage II sporulation protein E (SpoIIE)
  misc_feature (1)..(284): Xaa is any amino acid
MQVEKFNHISASSFGLAKGEELLSDDAYEFKTFSSHSIAVLCDGVGSALEGRSAANHIVKSLITNFKNRPKSWSIEKSLHTFITNINRILYKESMQKYESIEYLSTLCVVVIEGDRIYGANVGDSRIYLCRDNKLTQLSIDHNEDDQDHVLTKAVGLEEEVEPYYFENNLKKGDKLLLCSDGLYNTLDEDEIKDQLKLNATTLIKRADXKSNSSLADDTSAIVIQINSADEIATLRALPLEIPQKLSVGHVIDGYILKKSLIQNNRTWLCFKEGKEYVLKISSS

SEQ ID NO: 11559 - DNA, 336 bp, Unknown
  Obtained from environmental sample
  misc_feature (1)..(336): n is a, c, g, or t
ttggaagaggagagaaaaatgttatccgactctttgtcagagtttggtcttacgttagtaggtgaagctgaaaatggtttggtagcttatgagaagtatgttgagctgaaacctgatcttattactatgaatatcaatatgcctgtattagatggtattagcgccgttaaaaaaattatcggagattttcctcatgcaaaaattatgatggtatcgtacaatgatgacagaactatagcttatgaagctataggttcaggagctttagatttttttctaaaaactgatgatattggaactttgaaatcaaagttatttagtgcgttaggtttatag

SEQ ID NO: 11560 - protein, 111 aa, Unknown
  Obtained from environmental sample
  DOMAIN (5)...(111): Response regulator receiver domain
  misc_feature (1)..(111): Xaa is any amino acid
MEEERKMLSDSLSEFGLTLVGEAENGLVAYEKYVELKPDLITMNINMPVLDGISAVKKIIGDFPHAKIMMVSYNDDRTIAYEAIGSGALDFFLKTDDIGTLKSKLFSALGL

SEQ ID NO: 11561 - DNA, 336 bp, Unknown
  Obtained from environmental sample
  misc_feature (1)..(336): n is a, c, g, or t
ttggcaaccgactatttagtaaaaaagggctttataatcgtacaaaacaactatcgttgtttttctggagagattgacataattgcagaaaaaaaagatttattgataatagtagaggttaaatcaaggacaacaatagggtcagaagagaccttactatcaattactaaatctaaacaaagaaagataagcagagcaactgctgattttatggaaaaaaatcaacagttctctgaacattttattaggtttgatatcataactgtaaacaagcatgctatctatgatgaatatagcataactcattatgataatgcctttagttatttattttaa

SEQ ID NO: 11562 - protein, 111 aa, Unknown
  Obtained from environmental sample
  DOMAIN (1)...(90): Uncharacterised protein family UPF0102
  misc_feature (1)..(111): Xaa is any amino acid
MATDYLVKKGFIIVQNNYRCFSGEIDIIAEKKDLLIIVEVKSRTTIGSEETLLSITKSKQRKISRATADFMEKNQQFSEHFIRFDIITVNKHAIYDEYSITHYDNAFSYLF

SEQ ID NO: 11563 - DNA, 759 bp, Unknown
  Obtained from environmental sample
  misc_feature (1)..(759): n is a, c, g, or t
ttggaaatttcggattcttttaaaaaacaagttggattattttggaaaaaaggtggattctcaaattcagaaattgctaacatttaccccagggataggatatccaaaatcttcctaaaggggatctatttcgttactgtaaagtcccctgataatttcaaaaataatagaagcttacctgatttctctatctcagattatcctggagagacttatgccgttcttgctaagcgtgaggatgaatataaattaatgaaatactttggctacgataaaactcctaactcttggagtgactactctaatgctaaaaaaagacaagaaattaataaattctggtttagatatgcaaatgacgcaaatttaccagtaaataaattaatctctacacttaaagaaagagttgattattctaacctaaaattctctcatcataaacatggttggacttcggacagaggtaaagtatatatcctctacggtgctccggatgatatagaaaaatttctcgttggtgaattagatgctacggataaatacgactctgacgcccttcttgaaagaaaagctatctttaatgataaagaatatgaaatctggagatactcttcaaaaagattagccagctatacttttttcgatgttagtatgaataatggtcataaacttatttatgtctataacgatgatgcgattccggtatcttcagattacaaattctatctcggaaatgatttcgatgaagagagattaaaataa

SEQ ID NO: 11564 - protein, 252 aa, Unknown
  Obtained from environmental sample
  misc_feature (1)..(252): Xaa is any amino acid
MEISDSFKKQVGLFWKKGGFSNSEIANIYPRDRISKIFLKGIYFVTVKSPDNFKNNRSLPDFSISDYPGETYAVLAKREDEYKLMKYFGYDKTPNSWSDYSNAKKRQEINKFWFRYANDANLPVNKLISTLKERVDYSNLKFSHHKHGWTSDRGKVYILYGAPDDIEKFLVGELDATDKYDSDALLERKAIFNDKEYEIWRYSSKRLASYTFFDVSMNNGHKLIYVYNDDAIPVSSDYKFYLGNDFDEERLK

SEQ ID NO: 11565 - DNA, 879 bp, Unknown
  Obtained from environmental sample
  misc_feature (1)..(879): n is a, c, g, or t
gtgttttacgcgttatttagtgctttgtcttttatagcattaattccaatgttagacgttttatttgaacaagacaaaataaaagcaattaaggaacctgtttataccggaatttctggaattaaagattattataaagattttctttcatttaaagttcacgaatttgcacaagacgatgcttcaaaagctttgatgttagtcattgttttagtgattgttttatttctgctaaaaaatattttcaggtatttagcaatgtatgctatcacttttttaagaaatggtgtacttaaagatattcgaaacgagctatataaaaaaataatgaagttgccaatttcgttcttttcagaaaaaagaaaaggagatatattggctagagctggcgcagatgtattagaaattcagcattcatttctttcggtgttagaattaatttttagagaacctttaaccattctatttactattataatgatgcttttaataagtgcaaaacttactttatttgtatttatttttattcctatttcaggatttattatttcaagtattggtaaaagcttaaaacgtaaatcggatttagttcagaaagaacaaggtatttttctttctactttagaagaaacacttagcggattaaaaattataaaaggctttacggctgaaaaattattcggaaaaaaattcagtgaatccactcagcgatttttcaactattcaaacactcttttaaatcgtcaaaaccttgcttcaccaactttccgaatttttaggaattactggaataactatattaatatgggatggagggaaaagggggttgaaagatggtaccttagacaggagttcgttcataccctatatggggtttag

SEQ ID NO: 11566 - protein, 292 aa, Unknown
  Obtained from environmental sample
  DOMAIN (1)...(292): ABC transporter transmembrane region
  misc_feature (1)..(292): Xaa is any amino acid
MFYALFSALSFIALIPMLDVLFEQDKIKAIKEPVYTGISGIKDYYKDFLSFKVHEFAQDDASKALMLVIVLVIVLFLLKNIFRYLAMYAITFLRNGVLKDIRNELYKKIMKLPISFFSEKRKGDILARAGADVLEIQHSFLSVLELIFREPLTILFTIIMMLLISAKLTLFVFIFIPISGFIISSIGKSLKRKSDLVQKEQGIFLSTLEETLSGLKIIKGFTAEKLFGKKFSESTQRFFNYSNTLLNRQNLASPTFRIFRNYWNNYINMGWREKGVERWYLRQEFVHTLYGV

SEQ ID NO: 11567 - DNA, 363 bp, Unknown
  Obtained from environmental sample
  misc_feature (1)..(363): n is a, c, g, or t
atggtcgacatcaataaactgctgacagaattagacaccttgtttaataattcgctctacaaggccggccgaataaaatcaatcttgaacttagacagacaaatacctattctctgctgtcccaaagataagctgaagcaaatactcattaacattatcaaaaatggcgttgaagccatgcaaaatagtggcgaggtgatcattacgagcagagataatgtctaccaaaatggcaaacagtatgttgaaataacaattcaagacaatggaccgggcattgatgctgaaatattgaaaaacctgtttaagccagtcactagcaccaaagaagggcactcaggatttagggctatccattgttaa

SEQ ID NO: 11568 - protein, 120 aa, Unknown
  Obtained from environmental sample
  DOMAIN (40)...(118): Histidine kinase-, DNA gyrase B-, and HSP90-like ATPase
  misc_feature (1)..(120): Xaa is any amino acid
MVDINKLLTELDTLFNNSLYKAGRIKSILNLDRQIPILCCPKDKLKQILINIIKNGVEAMQNSGEVIITSRDNVYQNGKQYVEITIQDNGPGIDAEILKNLFKPVTSTKEGHSGFRAIHC

SEQ ID NO: 11569 - DNA, 675 bp, Unknown
  Obtained from environmental sample
  misc_feature (1)..(675): n is a, c, g, or t
ttggtacttgagactttatgtcgtagagctaatcattctacagaaacaaaaaactatttaagaactagacatatttacaaacttttaagcacgcagcactttatggacataacaaaaaaagagtttaaccatactgtacattcagagcatctctcaacaaactcatatcccacaataacatataagaaaagtattataaactatatactttctatcccagagttaaataaaaaagctaatagctttgatcctattctaaataaactcatagaatcaaaaagtaaaatcgcactctttaaagatatgatagatgatgatataagaaaccttatcactatatttaaatttacagtttatcaacctggtgagacaattataaaagaaggtgaagttagcacagatatatttttcatattagaaggtgaatgtagagctaccgtcaataaaagcagtgtaggtattttaaaaaagaatcaaatttttggtgaatttgcttttttactaggtaaacctagaagtgctacaattaaagcagttaataagactactatagttaaatttaaatttgatgaacaattatttcgtaaatacccctttagtttttcaatgctttacaaaaatatcacagaacaattaattataaagataacaaatataaataaattaagaaaatag

SEQ ID NO: 11570 - protein, 224 aa, Unknown
  Obtained from environmental sample
  DOMAIN (113)...(199): Cyclic nucleotide-binding domain
  misc_feature (1)..(224): Xaa is any amino acid
MVLETLCRRANHSTETKNYLRTRHIYKLLSTQHFMDITKKEFNHTVHSEHLSTNSYPTITYKKSIINYILSIPELNKKANSFDPILNKLIESKSKIALFKDMIDDDIRNLITIFKFTVYQPGETIIKEGEVSTDIFFILEGECRATVNKSSVGILKKNQIFGEFAFLLGKPRSATIKAVNKTTIVKFKFDEQLFRKYPFSFSMLYKNITEQLIIKITNINKLRK

SEQ ID NO: 11571 - DNA, 618 bp, Unknown
  Obtained from environmental sample
  misc_feature (1)..(618): n is a, c, g, or t
atgattctaatgatgctcaataatctaaaaagagccgatcaggaagtgcgtcaaggtatttggaaaagacctgaaaacagagggcatgaattaatgggaaaaacctttggaataattggttatgggtacatgggcaaagctgttgcgcagcgcttgaaaggttttggtgtggaggtaatcgcttacgataagtatttaaagaattactcggatgaaaatgcaaaagaggtgtcgctggaagagttgaaagaaaagagtgattttatctctcttcatttaccgcaagcagaggaaacgatcaactatgtagctgacaattttattaactcatgtggtaaaccattttatctaatcaatacagcaagaggaaagtctgttgataccaagtcattgatgactggaatagacaatggaaaagttctaggtgcttgcttggatgtcttggagtttgaaagttcatcatttgaaacttccgccatttcaaatccagtttttcaagaacttgtcaaaagtgataaggtattattgtcgccacacattggaggttggacttttgagtcagatttcaaaatgggagatttcctttcaaaaaaaattcttaaccattataacaattag

SEQ ID NO: 11572 - protein, 205 aa, Unknown
  Obtained from environmental sample
  DOMAIN (1)...(179): D-isomer specific 2-hydroxyacid dehydrogenase, NAD binding domain
  misc_feature (1)..(205): Xaa is any amino acid
MILMMLNNLKRADQEVRQGIWKRPENRGHELMGKTFGIIGYGYMGKAVAQRLKGFGVEVIAYDKYLKNYSDENAKEVSLEELKEKSDFISLHLPQAEETINYVADNFINSCGKPFYLINTARGKSVDTKSLMTGIDNGKVLGACLDVLEFESSSFETSAISNPVFQELVKSDKVLLSPHIGGWTFESDFKMGDFLSKKILNHYNN

SEQ ID NO: 11573 - DNA, 423 bp, Unknown
  Obtained from environmental sample
  misc_feature (1)..(423): n is a, c, g, or t
gtgaaagcaaatatgttgaaaataatgaaactagttgagaaatattcaatatttccttttggtaagatgaataataaacgaagcattacatttgttgggaatcttgtaggatttattgatagaataatagaaaaaaaagcatctggaatatttatttcaatggatgaaaaatctgtttctacaactgaactgattaattgtttggcaaaatcttttgataagaaagtgttgatgtttaaattacccttcttatgtaagaaaattggatcatttttcttaccaaacctttttaatagattatatgaatcattggaatttgataatactaaaacaaaagttgaattgaattataagcctccttattcaactaatgatggaataaaaaagatggttttatcctataggtataataaaaacatataa

SEQ ID NO: 11574 - protein, 140 aa, Unknown
  Obtained from environmental sample
  misc_feature (1)..(140): Xaa is any amino acid
MKANMLKIMKLVEKYSIFPFGKMNNKRSITFVGNLVGFIDRIIEKKASGIFISMDEKSVSTTELINCLAKSFDKKVLMFKLPFLCKKIGSFFLPNLFNRLYESLEFDNTKTKVELNYKPPYSTNDGIKKMVLSYRYNKNI

SEQ ID NO: 11575 - DNA, 342 bp, Unknown
  Obtained from environmental sample
  misc_feature (1)..(342): n is a, c, g, or t
ttgtacgtatcaaagggtaatataaaagggataatagactctttatctgtatataaaagtattagtgagagaatagataaaatagggtatgttatctctactgggtatatacagcagttgaattttttagctaaaaaatgtgaatctaaacctaaagtacttttaaaatatataaatagatatattagtatgtttggaaatgacgataatattttagcatatttggattatttaattgagacatatcatatagagtatgatgagacggaattaggattaaataccccaagttatacgagatggacaactattgaattacctgaaaaaatatttgaaatgtag

SEQ ID NO: 11576 - protein, 113 aa, Unknown
  Obtained from environmental sample
  misc_feature (1)..(113): Xaa is any amino acid
MYVSKGNIKGIIDSLSVYKSISERIDKIGYVISTGYIQQLNFLAKKCESKPKVLLKYINRYISMFGNDDNILAYLDYLIETYHIEYDETELGLNTPSYTRWTTIELPEKIFEM

SEQ ID NO: 11577 - DNA, 552 bp, Unknown
  Obtained from environmental sample
  misc_feature (1)..(552): n is a, c, g, or t
atgaattataatggacaaataatgcaaaaagcgatttttttagatagagatggtgttataaatatagaaaaaaattatgtttctaaaatcgaagatttccagtttattgatggtgtttttgatacattaaaacatttacaaaatagtggttataaactctttatcatcacaaatcagtcaggtataggtaggggatattatactaaagatgattttgataaattaacatcatggatgttaagtgaatttgaaaaaaaacaaatctctatttctcaagtagaacattgtcctcacaatccagatgagatgtgcctttgtagaaaaccaaaaagtggtatgatagataatattttaaaaaaccataaaattgacttggaaaaatcttggcttataggagataaagaatcagacatattatgtgcaaaaaatgctggtataaaaagtacaattcaagtaaaaactggacatgcttttgctgaagaaaatagccctgcagattttgtatgtgactcaataaaagaagtaaaagatataattactccttctctctaa

SEQ ID NO: 11578 - protein, 183 aa, Unknown
  Obtained from environmental sample
  misc_feature (1)..(183): Xaa is any amino acid
MNYNGQIMQKAIFLDRDGVINIEKNYVSKIEDFQFIDGVFDTLKHLQNSGYKLFIITNQSGIGRGYYTKDDFDKLTSWMLSEFEKKQISISQVEHCPHNPDEMCLCRKPKSGMIDNILKNHKIDLEKSWLIGDKESDILCAKNAGIKSTIQVKTGHAFAEENSPADFVCDSIKEVKDIITPSL

SEQ ID NO: 11579 - DNA, 570 bp, Unknown
  Obtained from environmental sample
  misc_feature (1)..(570): n is a, c, g, or t
gtgatgaaaagggaatgtatttcctattatacccgacctaaaaacaagttctttaggaaagtcaattcgttagaggattatgacaattaccaagactatatggtggggtatgatcccttaaaagatggggaaacgctgcgagatcaggaagcggaacaaaaagccttcggcctaatcaaaagtgtattgcccctattgaatgcagagagaaggcatctaattgaactctgccttacctatggctttcaatataaggccattgccgaagccatgggaaagggcattaccgaaaccagcaacaaaataaaacaagctattgaggacataaaaaccattattaatcaaggaagctcgattgaaactggacaaaaaaaagttgttggaatcaaggttcagggtgccatgaccaaggaacaagcaaaagtgctggaactacgatgtgaacaaaagctttctttcgctacgatctccaaggagcttaatctgtcccaaaaagaagttcaccatgaatttatgatagcctatagactcatgcagaagaaacatgaacagcaactggaatccgcttga

SEQ ID NO: 11580 - protein, 189 aa, Unknown
  Obtained from environmental sample
  misc_feature (1)..(189): Xaa is any amino acid
MMKRECISYYTRPKNKFFRKVNSLEDYDNYQDYMVGYDPLKDGETLRDQEAEQKAFGLIKSVLPLLNAERRHLIELCLTYGFQYKAIAEAMGKGITETSNKIKQAIEDIKTIINQGSSIETGQKKVVGIKVQGAMTKEQAKVLELRCEQKLSFATISKELNLSQKEVHHEFMIAYRLMQKKHEQQLESA

SEQ ID NO: 11581 - DNA, 600 bp, Unknown
  Obtained from environmental sample
  misc_feature (1)..(600): n is a, c, g, or t
atgccttatacaaatatattattagaggaaacaatcacaagaatatatataagtaatatgtctttaacagctgaatttgatagtttaattaaattacataaagattattttaatgagtcattaagagaatacaaaattattcaatatattttatttattctcataagtagtcttcttatgtatctttttttacaagtaaaaccccttctttcttttatacaaaagtttatgaattctgcaaataatattatccaaaagaatacaattagcgagttagaaccaattaatataaaagttcataataaagatattcaaaatgtagcaaacaatttcaatagtttggtacaaaacattaatagttctattgaacaaggatatactgcaatagattatacttcaaattctttagaaaatattgaaaataatattgaggtatttttaatactattaaatgaaatgaatgataaaaaaaagattgatattgatatggcaaaaaaagaagatgccgttattcaatctttagaagaattaatgaatattgcttcaaaattaaaagatttacaatctaaattaaaggacttaatacaacataaaaaataa

SEQ ID NO: 11582 - protein, 199 aa, Unknown
  Obtained from environmental sample
  misc_feature (1)..(199): Xaa is any amino acid
MPYTNILLEETITRIYISNMSLTAEFDSLIKLHKDYFNESLREYKIIQYILFILISSLLMYLFLQVKPLLSFIQKFMNSANNIIQKNTISELEPINIKVHNKDIQNVANNFNSLVQNINSSIEQGYTAIDYTSNSLENIENNIEVFLILLNEMNDKKKIDIDMAKKEDAVIQSLEELMNIASKLKDLQSKLKDLIQHKK

SEQ ID NO: 11583 - DNA, 936 bp, Unknown
  Obtained from environmental sample
  misc_feature (1)..(936): n is a, c, g, or t
atgcctccatatatgcaagatttatcagattctggtaaaggtgtatctgatggtgggggatttacaaactcatttaacacagaaatgtacactggtggaattgaagttggtatgccaccaaatgaagctggtatgagtagatttgatactgattttttacatgtatataactgggaaaaattagcaaaacttgcgaaagatccaaaaaatgtaaaagttgttaataatcatagaatcatacctatggatattgctgttaaaaataatgctttatttttaattcctgaacctaaatcacctcacggtgtagatgtttcacctgatggtgaatatattacagtttgtggaaaattagatacacatgcttcagtatataaatggagtaaaattaaaaaattaattgatgctaaagaatatattggaaaagatccatatggtattcctattttagatatgaaaaaatctttacatggtcaagttgaattaggtcttggaccattacataatcaatattcaaatgttgatggtgaaatttatacttcactttatgttgactcacaaatcgtaaaatggaactataaagatcttaaagttttggataaagaaaatgttcattataatgttggacatttatgtggtatggagggtaaatctgctgacccacaaggtaagtatattatttctttaaataaacttgctattgatagatttcaaaatgttggtccacttcacccacaaaatcatcagttaattgatattagtggtaaaacaatggatctacttgtagatatgcctttacctttaggtgaaccacatcaagctgttgcaattagagctactaaattacacccacatgtaagatatccaatgggtacaaatgttacaacaggtgaacaacatgttggtaaaactttagctgtctcgagccgaatctga

SEQ ID NO: 11584 - protein, 311 aa, Unknown
  Obtained from environmental sample
  misc_feature (1)..(311): Xaa is any amino acid
MPPYMQDLSDSGKGVSDGGGFTNSFNTEMYTGGIEVGMPPNEAGMSRFDTDFLHVYNWEKLAKLAKDPKNVKVVNNHRIIPMDIAVKNNALFLIPEPKSPHGVDVSPDGEYITVCGKLDTHASVYKWSKIKKLIDAKEYIGKDPYGIPILDMKKSLHGQVELGLGPLHNQYSNVDGEIYTSLYVDSQIVKWNYKDLKVLDKENVHYNVGHLCGMEGKSADPQGKYIISLNKLAIDRFQNVGPLHPQNHQLIDISGKTMDLLVDMPLPLGEPHQAVAIRATKLHPHVRYPMGTNVTTGEQHVGKTLAVSSRI

SEQ ID NO: 11585 - DNA, 615 bp, Unknown
  Obtained from environmental sample
  misc_feature (1)..(615): n is a, c, g, or t
gtgagtgtagatatatttgatgtggataattatatagcaaattntgcagcacaaaataagatgagtgcattagagtttaaatcacttattagacaacaacaagattatgatgcatttgaaaagaaagttaaagagcaacttcttcatcaaaaacttgtacgaaaaatagcaacaggtaatatcaaaattgctacagaagatgatattaaaatctattatgaaaataacaaagagcaatttactcttgcaaatcaaatagaggtagtggcttatatttcaaaaagtaaagagttattaaatgagataaaagcaaatccaatgatgaataacactaatgtagtaagtcaagtattaagtttaaaacaaaatgaattaacacctcaagttaaatatataataaatacaacagcagtaaatcaatttagtgcaatatttgctcaaaatcaacaatacaatatgttttttataaaagaaaagaatgatattcaaacattgtctttagaacaaacaaaagagcagatttttcaaaaaataatggaacaaagagaacaaaattaccttaatgaatattttgaaacacaaaaaataaccgcgaagataaaagtattaagatag

SEQ ID NO: 11586 - protein, 204 aa, Unknown
  Obtained from environmental sample
  misc_feature (1)..(204): Xaa is any amino acid
MSVDIFDVDNYIANXAAQNKMSALEFKSLIRQQQDYDAFEKKVKEQLLHQKLVRKIATGNIKIATEDDIKIYYENNKEQFTLANQIEVVAYISKSKELLNEIKANPMMNNTNVVSQVLSLKQNELTPQVKYIINTTAVNQFSAIFAQNQQYNMFFIKEKNDIQTLSLEQTKEQIFQKIMEQREQNYLNEYFETQKITAKIKVLR

SEQ ID NO: 11587 - DNA, 552 bp, Unknown
  Obtained from environmental sample
  misc_feature (1)..(552): n is a, c, g, or t
ttgtggaatgagtttgaaatttttagattttttgttgataatgcaaggatgaactgtgttctttttgttttaattttttctattggtatttactcttatatgaaaatgccaaaagagatattcccaacatttgatatggatatgatctcgattagtggttcttacactggtgctagtgttgatatacttgataaaatggccgttacagagatagaagacaatgtaaaatctttagaaggtgtgattgaaactactacagtaataagtcctgggaaattttctattattttagagctacaaaaagggaaagatagatataacatagctgataaagttaaggatgcagtagctttaactaaaggagaccttcccattgatatggatgaaccaactgtaagtgtaatagatagaagtagagatcttataaatatctcgcttacttctgaaaaactcaatgtagatcaaatgaaaaaatttgcagatgattttaaaagtgaaattctaaccattagtggtattagtgaagtttccggatctgaagatagtggataa

SEQ ID NO: 11588 - protein, 183 aa, Unknown
  Obtained from environmental sample
  misc_feature (1)..(183): Xaa is any amino acid
MWNEFEIFRFFVDNARMNCVLFVLIFSIGIYSYMKMPKEIFPTFDMDMISISGSYTGASVDILDKMAVTEIEDNVKSLEGVIETTTVISPGKFSIILELQKGKDRYNIADKVKDAVALTKGDLPIDMDEPTVSVIDRSRDLINISLTSEKLNVDQMKKFADDFKSEILTISGISEVSGSEDSG

SEQ ID NO: 11589 - DNA, 549 bp, Unknown
  Obtained from environmental sample
  misc_feature (1)..(549): n is a, c, g, or t
atgacagatcggctgagtgatgatacactttgtggagggggagctggtcaacttatgtttccccagccactttttgatttgcttgatgagataaaaacaaaagataaagatgcttatattatctttccactagcagcagcaaaaccttttaaacaatcagatgctatacgattagctaaaaaaaaacatattgtgatggtaagtggtagatatgaaggaattgatgaaagagtcatagaaacttatgccaatgaagtttttagtataggtgactatatcttaacgggaggtgagttagcatcaactgtgatagcagatgctataagtagaaactatgatggtgtacttggaaataatgagtccttagatgaagaaagttacaacctaaatgaagacaataaactcacccttgaagctccatcttttacaaaacctatagattttaacaatttaagagtgccttcagaattattaaagggaaatcacgctaaaattcgcaacttaaaatcaaaactgtctaggtgcaaaactaagtactttagaccataa

SEQ ID NO: 11590 - protein, 182 aa, Unknown
  Obtained from environmental sample
  DOMAIN (2)...(182): tRNA (Guanine-1)-methyltransferase
  misc_feature (1)..(182): Xaa is any amino acid
MTDRLSDDTLCGGGAGQLMFPQPLFDLLDEIKTKDKDAYIIFPLAAAKPFKQSDAIRLAKKKHIVMVSGRYEGIDERVIETYANEVFSIGDYILTGGELASTVIADAISRNYDGVLGNNESLDEESYNLNEDNKLTLEAPSFTKPIDFNNLRVPSELLKGNHAKIRNLKSKLSRCKTKYFRP

SEQ ID NO: 11591 - DNA, 765 bp, Unknown
  Obtained from environmental sample
  misc_feature (1)..(765): n is a, c, g, or t
ttgaattttggaaggagaaccctgacttttcatttggggaaactgttttttccctttttaccaaggggtccaaattctcagcaggtttatgattatttcgggcatttatgggtatttactcaatttacaaaaagaaagatgtatagatttatcatatttgtagtacttgcagcaacattaaccagttgttcaattaatttaatgcaggagaatcaactcctgacgttagagaataatctccagaaatgggaaaaattcagatttgatggtgttatagaaataaaccatcaaaacctgtcgctacacaagtattttactttgagaaaagaagatgaaattgccagactcgatatttatgattccggcctgttagggatgaaacctaatccttttatctctgtttactatgactctcttattcaggcacgagtaccggattcagccgaaataaaggttttaaaacccgaagactatcctgattacttcagttattttcttttatttaaaaccttgaatgatcttaaagagaagaaaaaggacatcattaaagagaaacaatatagtaatgatttccaagagttttattttgataatcaacagagaattgagagaattattttaaagaaagataaaattgagatattgctgacttataaagatgaactacaagaaatcaaaatcagaaaaggtctgaaggaaattgcgaatctgacaattgatgatgtgggttttgagtttagtaagatatctcctctaataaaatag

SEQ ID NO: 11592 - protein, 254 aa, Unknown
  Obtained from environmental sample
  misc_feature (1)..(254): Xaa is any amino acid
MNFGRRTLTFHLGKLFFPFLPRGPNSQQVYDYFGHLWVFTQFTKRKMYRFIIFVVLAATLTSCSINLMQENQLLTLENNLQKWEKFRFDGVIEINHQNLSLHKYFTLRKEDEIARLDIYDSGLLGMKPNPFISVYYDSLIQARVPDSAEIKVLKPEDYPDYFSYFLLFKTLNDLKEKKKDIIKEKQYSNDFQEFYFDNQQRIERIILKKDKIEILLTYKDELQEIKIRKGLKEIANLTIDDVGFEFSKISPLIK

SEQ ID NO: 11593 - DNA, 471 bp, Unknown
  Obtained from environmental sample
  misc_feature (1)..(471): n is a, c, g, or t
ttgaagaaattgaataatccatacagaaaaatgccaggatataattgctttggatgctctgatagaaatgattcggggttgcaaatggaattttacgaagagggtgagtacattatatcaaaatggcagccaaaagctgactttcaaggttactttgatattctgcatgggggaattcaggctactatgatagatgagatctcaagctgggttgtctttgtgaaatgtaaaactgcaggagttacctcatcacttaatgtaaaatacaaaagacctgtatatgtaaacaaggatggaaccattactttaaaagctaaactttcgagaatgcgaaggaatattgctataataaaagtgagtttatttgatcaggaagatagactttgtgcagaaggggaggttaactttttcacttttcataaagataaagctaagaaagaactcagctatcctgaaccagatgaattttaa

SEQ ID NO: 11594 - protein, 156 aa, Unknown
  Obtained from environmental sample
  DOMAIN (52)...(130): Thioesterase superfamily
  misc_feature (1)..(156): Xaa is any amino acid
MKKLNNPYRKMPGYNCFGCSDRNDSGLQMEFYEEGEYIISKWQPKADFQGYFDILHGGIQATMIDEISSWVVFVKCKTAGVTSSLNVKYKRPVYVNKDGTITLKAKLSRMRRNIAIIKVSLFDQEDRLCAEGEVNFFTFHKDKAKKELSYPEPDEF

SEQ ID NO: 11595 - DNA, 825 bp, Unknown
  Obtained from environmental sample
  misc_feature (1)..(825): n is a, c, g, or t
atgacagatcggctcagattctggttttggacaatggcctgcaatgatgaagatgtattaaaaaatcacagcaactggtataatattaataaattgggagagtcctcggcatcttccccaccttatgttggttactacagatggctttgtcccaacaatccagaggttttaccttttcttaaaatgcgtctgaaacaatatcttgatctcgattatatttccggaatttctttagattatatacgctatcccgatgttattctgccagaagctttacaaccaaaatataacctggttcaagatactgaacttccgcagtttgatttctgttactgcccccattgtctggaaaaatttaaagaaaagacctcattagatgcttttaagttaaaatcaatcgaggaaaaaaatctctgggatagatttagagagaacagcattaccatgatagttaatgagttagcaaaatttattagaagtcataagaaagaggtctcagcttctgtattcccttcacctgcaattgcccggaaattagtaaggcagtactggccggactgggatcttgatcgtattctaccaatgaattacaacaacttctataataaagataccaagtggatttatgatattgttttggaaggtaaaaagactttatcaggtaagatagattatttttctgcagtatatttgccggcgttaaatttggagcaatttaaagccagcatagattattctcttaaagccggatctgatggaatagcgatttttaatctctttttcatcaaaaataatcattggaaaattttggatcagtttatttaa

SEQ ID NO: 11596 - protein, 274 aa, Unknown
  Obtained from environmental sample
  misc_feature (1)..(274): Xaa is any amino acid
MTDRLRFWFWTMACNDEDVLKNHSNWYNINKLGESSASSPPYVGYYRWLCPNNPEVLPFLKMRLKQYLDLDYISGISLDYIRYPDVILPEALQPKYNLVQDTELPQFDFCYCPHCLEKFKEKTSLDAFKLKSIEEKNLWDRFRENSITMIVNELAKFIRSHKKEVSASVFPSPAIARKLVRQYWPDWDLDRILPMNYNNFYNKDTKWIYDIVLEGKKTLSGKIDYFSAVYLPALNLEQFKASIDYSLKAGSDGIAIFNLFFIKNNHWKILDQFI

SEQ ID NO: 11597 - DNA, 459 bp, Unknown
  Obtained from environmental sample
  misc_feature (1)..(459): n is a, c, g, or t
atgaaacttgatactagtgcagcagtagtgcatgaaactatctatcgttatatctacgctaataaatccaatggtggcaagttgtatacatatctcagacataaaaacaagaagtatcatcatagaagtaatgactatcattcccgtggtacaatcatagaccgtgtaatgatagataaaagaccaaagatagtagagaaaaaaagtagaattggagaccttgagatagatacagttattggtaaagatcataaaggtgcgttagtcacggttgttgatagaaaatcaaagtttgtgcttatcaaaaatgttccatctaaagaagcaagtgtagttacccaagctctcatagaaatgatacaacccgtcaaagcgattactaaaataatcacaagcgataatggtaaagagttcgcatatcataagcaagtatcggctgcacttgatactgatttttaa

SEQ ID NO: 11598 - protein, 152 aa, Unknown
  Obtained from environmental sample
  misc_feature (1)..(152): Xaa is any amino acid
MKLDTSAAVVHETIYRYIYANKSNGGKLYTYLRHKNKKYHHRSNDYHSRGTIIDRVMIDKRPKIVEKKSRIGDLEIDTVIGKDHKGALVTVVDRKSKFVLIKNVPSKEASVVTQALIEMIQPVKAITKIITSDNGKEFAYHKQVSAALDTDF

SEQ ID NO: 11599 - DNA, 528 bp, Unknown
  Obtained from environmental sample
  misc_feature (1)..(528): n is a, c, g, or t
ttgtttaggatttcggctgagaagtggtatcaatatgtaacaattgcatctattatacaaaaagaatctgcttcaaaagaggagatgcaccttgtttctagtgttatacataaccgtatcaacaaaggtatgaaacttcaaatggatggaacattaaattatggaaaaaattcacatattactgttacaccacagatgatcaaaaatgatacttcacaatataatacctacaaaagaaaaggggtaccagataatccaatttgtgctattgagtttgaagcaattcgctcagcaatttttccaacaaaaacaagttatctctattttatgagatctacagatggaaatagtcataatttttcctcgtcttacaaagagcatatagcaaatattagaaatgtacaaaagaacaatagaagtcctaaaaagaaacaaactagtataaatcaaacaaaaaaaatcaaacagaaacaacaaacagttgaaaagtcagtttttaaaagggatttaaaagcattatggaaataa

SEQ ID NO: 11600 - protein, 175 aa, Unknown
  Obtained from environmental sample
  DOMAIN (1)...(137): Aminodeoxychorismate lyase
  misc_feature (1)..(175): Xaa is any amino acid
MFRISAEKWYQYVTIASIIQKESASKEEMHLVSSVIHNRINKGMKLQMDGTLNYGKNSHITVTPQMIKNDTSQYNTYKRKGVPDNPICAIEFEAIRSAIFPTKTSYLYFMRSTDGNSHNFSSSYKEHIANIRNVQKNNRSPKKKQTSINQTKKIKQKQQTVEKSVFKRDLKALWK

SEQ ID NO: 11601 - DNA, 399 bp, Unknown
  Obtained from environmental sample
  misc_feature (1)..(399): n is a, c, g, or t
atgaatctttttaatggaatgtatgatactagaaactatcaacagacaaagataaataaaagagttgaaaaattaactcttgataaacttcaaaaagatatcaagcaaaatataaaaaacagagtagataaagtagtaacttttcataaaattcttcaaatatatccagatatattagaaacaaaaaaatttgcactggagggtatgagagaaagattccaaagaggtacaaaatctatcatagatcttctagatgaagaaaataaatattttgaaaaaataaataaatatacagagtatcagtatcaatttgtaattgagtatgcaacacttaagcaatatacaaatagtttaaataatgaatttataaaaaaagtaaatggatttttatatgagtaa

SEQ ID NO: 11602 - protein, 132 aa, Unknown
  Obtained from environmental sample
  misc_feature (1)..(132): Xaa is any amino acid
MNLFNGMYDTRNYQQTKINKRVEKLTLDKLQKDIKQNIKNRVDKVVTFHKILQIYPDILETKKFALEGMRERFQRGTKSIIDLLDEENKYFEKINKYTEYQYQFVIEYATLKQYTNSLNNEFIKKVNGFLYE

SEQ ID NO: 11603 - DNA, 354 bp, Unknown
  Obtained from environmental sample
  misc_feature (1)..(354): n is a, c, g, or t
atggatttttatatgagtaataaaatagagataaaaaatgaattgattcattcatttttgttaatgactagaatgatgaatcttgaaataagttatgatgatattcttcataaggttggaagtgaagaagaaattatagaggaagatatagtttatgttgccaatgaatattttggtttaaaaataaaagtagtaaatgttaagttagaaaagttatcaaaaaatcctctccctgcaattgtgaaattaaaaggtgataaatattctatacttttttctatagatgataaagagtgtgaaatatatgattttaatgaatcaaaaaagataaaacttgcattaaaagatttttga

SEQ ID NO: 11604 - protein, 117 aa, Unknown
  Obtained from environmental sample
  misc_feature (1)..(117): Xaa is any amino acid
MDFYMSNKIEIKNELIHSFLLMTRMMNLEISYDDILHKVGSEEEIIEEDIVYVANEYFGLKIKVVNVKLEKLSKNPLPAIVKLKGDKYSILFSIDDKECEIYDFNESKKIKLALKDF

SEQ ID NO: 11605 - DNA, 723 bp, Unknown
  Obtained from environmental sample
  misc_feature (1)..(723): n is a, c, g, or t
ttgatgcatacaaaaaataaacccgtattaataacaggagcagaagaacaatcatttgattttattaaattattacaaaataatggttttaatacaattttattaccattaatccagcttcaggctatcaattcatctcaactactctcggtttttaattctattaaatttaattggttagtatttactagtagtaatgcagcttcatattttttagagacaatatcaccattaaaattagcaggaattaaaattgctgctgttggaaaaaaaactgccgattgcatagaagataatggattggaaattgactttataccatcagattttactgctgaaactttaggaaacgaaattcctgtattgcctaacgaaaaagtatttattcctcattcagaattgtcaaataatagcttagaggaacaacttaaaattaaaaatgcgttggttgaaacgttagtaatttacgataatcaaataattagttataccactgatgaattaagtaaagtacttaataaacctatagattttattacatttacgagtggctcgtgtgttaaagcatatatcaataataagatacatttgccaaacgcaaaaataatttgtattggaccatctactgctaaagtagctagagaaaataacttagaagttgctgccatccctaatgaatacacagttgaaggaatggtagaggaaataaagaaattaagttaa

SEQ ID NO: 11606 - protein, 240 aa, Unknown
  Obtained from environmental sample
  DOMAIN (16)...(235): Uroporphyrinogen-III synthase HemD
  misc_feature (1)..(240): Xaa is any amino acid
MMHTKNKPVLITGAEEQSFDFIKLLQNNGFNTILLPLIQLQAINSSQLLSVFNSIKFNWLVFTSSNAASYFLETISPLKLAGIKIAAVGKKTADCIEDNGLEIDFIPSDFTAETLGNEIPVLPNEKVFIPHSELSNNSLEEQLKIKNALVETLVIYDNQIISYTTDELSKVLNKPIDFITFTSGSCVKAYINNKIHLPNAKIICIGPSTAKVARENNLEVAAIPNEYTVEGMVEEIKKLS

SEQ ID NO: 11607 - DNA, 498 bp, Unknown
  Obtained from environmental sample
  misc_feature (1)..(498): n is a, c, g, or t
atggcaaaaattaaatttaaaggaaacgaaataaatacaagtggaacacttccaaatgttggttcgcaggcaaaagattttcagttagtagcaactgacttaagtaccaaaacattaaatgactttaaaggaagtaaattaatattaaatatttttccaagtattgatacaggtatttgtgccgaatcagtaagaaactttaataaaaaggcagcagacttagacaacacaaaagtattgtgtatttctagagatttaccttttgctcaaaaaagattttgtggagcagaaggaatagaaaatgtagaaatgttatctgattttaaaacaggacaatttggcaaagattacggactagaaatgcttgaaggacctttagcgggattaagttctagatgtattgttgttttggatgaaacaggaaaggtagtttatacagaacaagtagaagatattgttatagaacctaattatgaaaaagctttagcaagtatttaa

SEQ ID NO: 11608 - protein, 165 aa, Unknown
  Obtained from environmental sample
  DOMAIN (20)...(162): AhpC/TSA family
  misc_feature (1)..(165): Xaa is any amino acid
MAKIKFKGNEINTSGTLPNVGSQAKDFQLVATDLSTKTLNDFKGSKLILNIFPSIDTGICAESVRNFNKKAADLDNTKVLCISRDLPFAQKRFCGAEGIENVEMLSDFKTGQFGKDYGLEMLEGPLAGLSSRCIVVLDETGKVVYTEQVEDIVIEPNYEKALASI

SEQ ID NO: 11609 - DNA, 345 bp, Unknown
  Obtained from environmental sample
  misc_feature (1)..(345): n is a, c, g, or t
ttgtatcaanatgggaagaaacaaacagaatttgatatggctgaacaaatatataaaagattggctaatacatataaaatagatacaattttcgatgatagaaaagggaaaaaagatacatatggttctaagatggctgattttgaactgattggtttcccttatgctgttgttgttgggaaaaaacttcaagatggatttgttgaaataattgcaagaaaaactggagaaaaagcagaagtttctattgataatatagactatttatgtcaaataattaattcgcttaaaaatgaagattatagtatcaaagatgctgtaaattttgtagataataaaaaataa

SEQ ID NO: 11610 - protein, 114 aa, Unknown
  Obtained from environmental sample
  DOMAIN (3)...(93): Anticodon binding domain
  misc_feature (1)..(114): Xaa is any amino acid
MYQXGKKQTEFDMAEQIYKRLANTYKIDTIFDDRKGKKDTYGSKMADFELIGFPYAVVVGKKLQDGFVEIIARKTGEKAEVSIDNIDYLCQIINSLKNEDYSIKDAVNFVDNKK

SEQ ID NO: 11611 - DNA, 381 bp, Unknown
  Obtained from environmental sample
  misc_feature (1)..(381): n is a, c, g, or t
atgaatattgaatttttaaattcaataagggaaaacaacactacaaaagaggggatgaagtttttatatgaaactttatctctacaagaacaaaaatgttgggatgagacaacccaacaaaacatcacaaactttggagaactcttttctcttaaagcaaaacaaactccaaaacaaatagttatcaatgaggttgatacaaacaattcatatacttatgaagagttagaacttagctcanacaaaataaaaaaatttttacttaatacaacacaagagtatcaaattgggataaactatcctaatagttttgagttcttggcaccggtgataggtatcaataagggcgggaaaattagccaatacttttttaacaattag

SEQ ID NO: 11612 - protein, 126 aa, Unknown
  Obtained from environmental sample
  misc_feature (1)..(126): Xaa is any amino acid
MNIEFLNSIRENNTTKEGMKFLYETLSLQEQKCWDETTQQNITNFGELFSLKAKQTPKQIVINEVDTNNSYTYEELELSSXKIKKFLLNTTQEYQIGINYPNSFEFLAPVIGINKGGKISQYFFNN

SEQ ID NO: 11613 - DNA, 684 bp, Unknown
  Obtained from environmental sample
  misc_feature (1)..(684): n is a, c, g, or t
atgctaatcatgggatatcagatcgataaaatcacccaacaaagagttgaggctcttatcactcaaaaatatcttcaagatgcaaaaaaagtattttcactctttgcaacactaaacacaaatcaagtagagaagagactcaactctctaaacttaacaagagtagatattgcaatagacaactccacaacaaccatcttaaaacagccgcactcttttggagagcttcaaattttaaaaactcaaaattccaaatatctgctctatattagatacttagatgagagcattatgctcagtgacactcaactgcaaaaaagctcacatgaacagtggttacttaatgctctggtagtgcttgatattgttgtactgattgctatatttttgattatattgaaaattctttctccattaaaagtactaattgctaaaatgcaaaaattcacacaaggcgactttaagagtcgtatagaggtaaaaagcagtgatgagattggaaatgtagcaaatacttacaacaccatggcgcaaaatatagaaaatctcataacttcaagagaggagtttttaagagatatcagccatgaacttagaactcctatctctaaaggactttttgctgttgagacacttgaggattcgcaagctaaacgtcttattgaaaaatcatctccgagctga

SEQ ID NO: 11614 - protein, 227 aa, Unknown
  Obtained from environmental sample
  DOMAIN (113)...(182): HAMP domain
  misc_feature (1)..(227): Xaa is any amino acid
MLIMGYQIDKITQQRVEALITQKYLQDAKKVFSLFATLNTNQVEKRLNSLNLTRVDIAIDNSTTTILKQPHSFGELQILKTQNSKYLLYIRYLDESIMLSDTQLQKSSHEQWLLNALVVLDIVVLIAIFLIILKILSPLKVLIAKMQKFTQGDFKSRIEVKSSDEIGNVANTYNTMAQNIENLITSREEFLRDISHELRTPISKGLFAVETLEDSQAKRLIEKSSPS

SEQ ID NO: 11615 - DNA, 765 bp, Unknown
  Obtained from environmental sample
  misc_feature (1)..(765): n is a, c, g, or t
atgaatacccaaagattatatatacaagaacacgagccattgaattttacatttcatcaaaataaatatgattttattgttaatgagataccaagtattgagtttaaaaatagaggaaactttttgattttaaaaatcaaaaaacaacatctctccacatgggagttattaggttatatctctacaactttagatatagatgaacatctaatagggtatgctggattaaaagataaaaatgcaacaacaacacaatatatctcaatacctatgaataaaagtagagatattgaatatttaaatagtaaaaatgtcaccatattggaaacttacaaacatgacaaaaaattaaaaataggtgatttaaaagcaaatagatttaaaatcattttaaaagatgtaaaacaagaggaattaccaaaaatatatcaaacaatctcccaaatacaaaagcatggtatgcctaactattttggatatcaaagatttggacaagagtgtagttttgaaaagacaaagcgagttgtttatggcgaagagataataagtgataaaaaacttaataagtttttaaaactagcatatccaagtttttttttcaatgggatgttaaaaaaaaagaaaggagcttttcaaaagagccaaaagagtaataaacctttcccacttggtggggaaatttgcaaccttcctgaaagaaacggtgggaacaaggatgccttcccgggagaaaaatttttaagggcccaaaagggtaagccttga

SEQ ID NO: 11616 - protein, 254 aa, Unknown
  Obtained from environmental sample
  DOMAIN (3)...(254): tRNA pseudouridine synthase D (TruD)
  misc_feature (1)..(254): Xaa is any amino acid
MNTQRLYIQEHEPLNFTFHQNKYDFIVNEIPSIEFKNRGNFLILKIKKQHLSTWELLGYISTTLDIDEHLIGYAGLKDKNATTTQYISIPMNKSRDIEYLNSKNVTILETYKHDKKLKIGDLKANRFKIILKDVKQEELPKIYQTISQIQKHGMPNYFGYQRFGQECSFEKTKRVVYGEEIISDKKLNKFLKLAYPSFFFNGMLKKKKGAFQKSQKSNKPFPLGGEICNLPERNGGNKDAFPGEKFLRAQKGKP

SEQ ID NO: 11617 - DNA, 528 bp, Unknown
  Obtained from environmental sample
  misc_feature (1)..(528): n is a, c, g, or t
ttgtcgtcggtagacatgcagaaaactgaagataaatttggttctgctttagcaagtgaaagtaatgataaagttaaagtctctattccaggattaagaggaagacctgctaaagaaatttacattaaaactttagcaaatattattcaggcaagaatggaagaaattattgagcatatccattatgaaattaaaaattcaggatacgagaataaattaatttgcggaatagtggttacaggtggtggctctcagttaaaacatattactcaattaatggagtatgttacaggaatggacacaagaattggttatcctaatgagcatttagcaccaaataatgctaatgaaattactagtccgatgtatgcaactagtgtagggcttgttattaaaggatttgaagctatcaataaaaataaagatactagagatgaaattgttggacattctgacaataaaaaaagtggattttttgataggttgcttcatgcaggacacaagtttttagaagatagcgaaaaataa

SEQ ID NO: 11618 - protein, 175 aa, Unknown
  Obtained from environmental sample
  misc_feature (1)..(175): Xaa is any amino acid
MSSVDMQKTEDKFGSALASESNDKVKVSIPGLRGRPAKEIYIKTLANIIQARMEEIIEHIHYEIKNSGYENKLICGIVVTGGGSQLKHITQLMEYVTGMDTRIGYPNEHLAPNNANEITSPMYATSVGLVIKGFEAINKNKDTRDEIVGHSDNKKSGFFDRLLHAGHKFLEDSEK

SEQ ID NO: 11619 - DNA, 642 bp, Unknown
  Obtained from environmental sample
  misc_feature (1)..(642): n is a, c, g, or t
atgaaaaatgagattgatttttttgtttcagatatagatagctcaagaaaaaagtttaaagaacaaaccaataaagagatcaaaaaaagagttgagatagcttataatatagcccaaaatctctacaaaactcatcaaaaagacccaaatattcaaagtattattattgaatctttacgagaattaaagttttataatattggtgatcaatatgtttttatgacaaaaatggatggtacatttttattaaactcaggattaaaacatcttgaaggtaaaaatgtttttgaacttacaacaaaaagtaataaagaatctatccatgctattataaatatgttaaaaaaagagaaacaaggtttctttgattataagtggcaaaaccaccatactctagaatttgaacaaaaaatttcgtactttaaatactttgaaccttttgattgttacattggtactggagtatttgctagtgatatagaagaaaaactaaaaaccaactttttagaaaaaataaatggttttaaatttggtgagaacttacagaactatattttttctgcctcctatgagggtatatcatataccacaccagctattggacaaaatgtatataatactacagatacccctgggggttaa

SEQ ID NO: 11620 - protein, 213 aa, Unknown
  Obtained from environmental sample
  misc_feature (1)..(213): Xaa is any amino acid
MKNEIDFFVSDIDSSRKKFKEQTNKEIKKRVEIAYNIAQNLYKTHQKDPNIQSIIIESLRELKFYNIGDQYVFMTKMDGTFLLNSGLKHLEGKNVFELTTKSNKESIHAIINMLKKEKQGFFDYKWQNHHTLEFEQKISYFKYFEPFDCYIGTGVFASDIEEKLKTNFLEKINGFKFGENLQNYIFSASYEGISYTTPAIGQNVYNTTDTPGG

SEQ ID NO: 11621 - DNA, 504 bp, Unknown
  Obtained from environmental sample
  misc_feature (1)..(504): n is a, c, g, or t
atgagtaaagatcttaaactacctgttgttttagattataaaacgccagaaagtttaggaaacgatcgtttagctgcagtttgtggtgctaaatttttatttccaaatcaaaatgtgttaataattgatgctgggacagcaataacttacgatattctgcgtaaagacgggaaatatttgggcggaaatatctctcctggcattattataagatataagagtttaaatacttttactaaaagattaccgttaatagatttcagactttgtttttctggaataggcaaaagcaccgaagatgcgatacacaaaggaatacagttcggtgtgttggctgaagcgcaagcttatattacagagtggaaaacaaaacttggtgagttaaaagtgatctttaccggaggagattcacagttttttgataattcgtttaaaagtaacatttttgtcatgccggaattagttgctgttggattgaaaagtttattagaaatcaatgcgtag

SEQ ID NO: 11622 - protein, 167 aa, Unknown
  Obtained from environmental sample
  DOMAIN (1)...(120): Bordetella pertussis Bvg accessory factor family
  misc_feature (1)..(167): Xaa is any amino acid
MSKDLKLPVVLDYKTPESLGNDRLAAVCGAKFLFPNQNVLIIDAGTAITYDILRKDGKYLGGNISPGIIIRYKSLNTFTKRLPLIDFRLCFSGIGKSTEDAIHKGIQFGVLAEAQAYITEWKTKLGELKVIFTGGDSQFFDNSFKSNIFVMPELVAVGLKSLLEINA

SEQ ID NO: 11623 - DNA, 387 bp, Unknown
  Obtained from environmental sample
  misc_feature (1)..(387): n is a, c, g, or t
atgtcatcgaactgttcttcaattagatattttcttagaatatcattccatgcttgttctctaacttgcgtcattgtttccgcatcaatagttgaagtacgttgtgcaatcttaagccactcttcgtgtcttgtcgatatttgggtatattcttcgtacgcaacatctgtcccatttatttcagcaatattggtaggattacttttaaaaagtgcatcaaaagtgctagggtcaatcacgaaaaggaacaatgcaactcctacgaatataagtacgaaaacaccagctttgtttctaatcttttgtaaaatagccattaaattggatgttttaaatgttaaaactcataaaatattaggctgcgaatataataaaaataaaaagtaa

SEQ ID NO: 11624 - protein, 128 aa, Unknown
  Obtained from environmental sample
  misc_feature (1)..(128): Xaa is any amino acid
MSSNCSSIRYFLRISFHACSLTCVIVSASIVEVRCAILSHSSCLVDIWVYSSYATSVPFISAILVGLLLKSASKVLGSITKRNNATPTNISTKTPALFLIFCKIAIKLDVLNVKTHKILGCEYNKNKK

SEQ ID NO: 11625 - DNA, 387 bp, Unknown
  Obtained from environmental sample
  misc_feature (1)..(387): n is a, c, g, or t
atggatttaatattagacataggaaatacattcactaaattatattttttcgaagcaagtaacttggttaaaacatttacagtaaagaattacgaaagctttgaagagattacagaatttaataatatcagtagatgtattattgcaagtactggtagcgatagcttttggaaagattttttaaccaaaagaaaaatcgcttttattactatgagtaaagatcttaaactacctgttgttttagattataaaacgccagaaagtttaggaaacgattcgttagctgcaggttgtggtgctaaatttttatttccaaatcaaaatgtgttaataattgatgctgggaccagcataacttacgatattccgcgtaaagaccgggaaata

SEQ ID NO: 11626 - protein, 129 aa, Unknown
  Obtained from environmental sample
  misc_feature (1)..(129): Xaa is any amino acid
MDLILDIGNTFTKLYFFEASNLVKTFTVKNYESFEEITEFNNISRCIIASTGSDSFWKDFLTKRKIAFITMSKDLKLPVVLDYKTPESLGNDSLAAGCGAKFLFPNQNVLIIDAGTSITYDIPRKDREI

SEQ ID NO: 11627 - DNA, 756 bp, Unknown
  Obtained from environmental sample
  misc_feature (1)..(756): n is a, c, g, or t
gtgttcatcattttttatcttattactatcaacaatctaaaagcccctattcaatcacttattgtaacccctaatattatatttatgattattggcttatttataagttctactttcatatttattggttcaataatgatactcggtatcccatttatcaatatacttatgagcttattattcaaaatagtaatatacattaaatattattatcatattctcctacataatcgtgataaactatttttaaaaaaatattatattagtcacgtgttatggattcaaaaagaagaaccagtatttttaatgaagttgtcatcacggatacttgctatagttttatattctataatagctttttatccaatatcttcaacaataaaactttcatatccaaattcagtttttccaaaatatgaatcaatatcatatatgcttgcttcaacttatcatactgtaacaggctttccaaaattatataaaaagaatgaaaaactaaacatagccattggatatgataatgtatatgtatattattatcctctagaagaatttaatattaataaagaggttttattatgtaaagacataaataactctgtgcataattaccaaaatctatacacatttattaaaacttttgatgcttataatacacatgacattgaattaggaagtaataaagattcaaatgtaagttggtcttcattttcatctgaagaatataaaaactatttaaataaaatatgtaaataa

SEQ ID NO: 11628 - protein, 251 aa, Unknown
  Obtained from environmental sample
  misc_feature (1)..(251): Xaa is any amino acid
MFIIFYLITINNLKAPIQSLIVTPNIIFMIIGLFISSTFIFIGSIMILGIPFINILMSLLFKIVIYIKYYYHILLHNRDKLFLKKYYISHVLWIQKEEPVFLMKLSSRILAIVLYSIIAFYPISSTIKLSYPNSVFPKYESISYMLASTYHTVTGFPKLYKKNEKLNIAIGYDNVYVYYYPLEEFNINKEVLLCKDINNSVHNYQNLYTFIKTFDAYNTHDIELGSNKDSNVSWSSFSSEEYKNYLNKICK

SEQ ID NO: 11629 - DNA, 345 bp, Unknown
  Obtained from environmental sample
  misc_feature (1)..(345): n is a, c, g, or t
ttggattatttaaaaaagatatatgaagagcagactaaacctatagtaaagttagtagatgagcaatatattttaaatagtaaatacaaaataggaactataattcttattaatgataatgccatactgaatcttacaaacaatagttctcaaaaaatatatatagaccatgataaccttaatggtgcatacaatcatgatattgttttagtacaagttatcttcaatccaaaagggagaacaaaagcaaaagtgattcaaatacttgagccgttcaatcatagtattctttgttttgtaaaaaattccaaatctttataccagaaaaagaaaatgcttttatag

SEQ ID NO: 11630 - protein, 114 aa, Unknown
  Obtained from environmental sample
  misc_feature (1)..(114): Xaa is any amino acid
MDYLKKIYEEQTKPIVKLVDEQYILNSKYKIGTIILINDNAILNLTNNSSQKIYIDHDNLNGAYNHDIVLVQVIFNPKGRTKAKVIQILEPFNHSILCFVKNSKSLYQKKKMLL

SEQ ID NO: 11631 - DNA, 789 bp, Unknown
  Obtained from environmental sample
  misc_feature (1)..(789): n is a, c, g, or t
atggttgaatttcacccgtctgtagttattttagatgaagcagatgagatgcttgatatgggatttttagatgatattaatgaaatatttacttatcttccaaaagagcgtcaaacactactattttcagcaactatgccaactcctattaaaaaacttgctgagaaaattttagttaatcctgaattcattgcaatcactagagatgagaaaacaaatactgatattgctcaagagtactatgtaattgacgagaatgagcgtgatgatgcaattatccgccttatggatgctggtgaagctgaaaaaagtgttgtattttgtcgtactaaaaaagaggttgatagattaagtaatgtcctttcagctgcgggttacagtgcaaaaggtcttcatggagatatggaacaacgtactcgtgaaagtgtaattaaaggactaaaaactgatgcaatagatgttttagttgctacagatgttgcagctcgtggtattcatattgataatgttactcatgtattcaactaccatattccttttgattcagagagttatgtacatagaatcggtcgtactggacgtgcaggtaacaagggtgttgcaattacacttgtaactccactagagtttaaagagcttcaacgtattaaaagtaaagttggaactactatgaaacatgcttttattcctagtaaagtagaagtaaaagaggcacaacttggtaaatttgtaaactctattgagaatcaaaaatttatgatgaagcacacaaagttctcgatcttctag

SEQ ID NO: 11632 - protein, 262 aa, Unknown
  Obtained from environmental sample
  DOMAIN (120)...(196): Helicase conserved C-terminal domain
  misc_feature (1)..(262): Xaa is any amino acid
MVEFHPSVVILDEADEMLDMGFLDDINEIFTYLPKERQTLLFSATMPTPIKKLAEKILVNPEFIAITRDEKTNTDIAQEYYVIDENERDDAIIRLMDAGEAEKSVVFCRTKKEVDRLSNVLSAAGYSAKGLHGDMEQRTRESVIKGLKTDAIDVLVATDVAARGIHIDNVTHVFNYHIPFDSESYVHRIGRTGRAGNKGVAITLVTPLEFKELQRIKSKVGTTMKHAFIPSKVEVKEAQLGKFVNSIENQKFMMKHTKFSIF

SEQ ID NO: 11633 - DNA, 444 bp, Unknown
  Obtained from environmental sample
  misc_feature (1)..(444): n is a, c, g, or t
atgagcccagctgaatttatctcttacatgaaaaaagagggtaaaactatatctggcatcgggcatcgtgtaaaatctgtacgtaatccagatttacgcgtaagtggtcttaaaaagtttgcagctgagagtttcccacaaactccacttttagactttgctcttgaagtagaaaaattaactacatcaaaaaaagataaccttatcttaaacgttgatggtactattggtatcttaatggtagatatgtggcgtgctcttggatatagtgaagatgagatcgacggatttattgatgctggtgcactgaatgcatttttcgtagttggacgttcaatcggatttattggacatatccttgatgaaaaacgtttaggaatgccaatgtatcgtcaccctacatctgatattttatataatgtagaaaaagcagaagagatttaa

SEQ ID NO: 11634 - protein, 147 aa, Unknown
  Obtained from environmental sample
  misc_feature (1)..(147): Xaa is any amino acid
MSPAEFISYMKKEGKTISGIGHRVKSVRNPDLRVSGLKKFAAESFPQTPLLDFALEVEKLTTSKKDNLILNVDGTIGILMVDMWRALGYSEDEIDGFIDAGALNAFFVVGRSIGFIGHILDEKRLGMPMYRHPTSDILYNVEKAEEI

SEQ ID NO: 11635 - DNA, 495 bp, Unknown
  Obtained from environmental sample
  misc_feature (1)..(495): n is a, c, g, or t
atgcaacggtcatttataagagaaatactagaatcaatagacaacgaaactatatcatttgcagggggattgcctgatgagagtttgttccctattgaagatttagcaaaagctagtgagcaagtatttaaaaataaaaaacattttcaatatactataagtaatggtatcacacctttacgagaaaagatagcaaagttttatagtgatgagggttttgaaacaaaaccttcaaacatccttataactacaggaagtcaacaagcgctttttatcatagcaaagtattttcaaaacaaagagatagttatagaaaagccttcttatttaggtgctgtaaatatttttaagatgaataatttatctatgagaccagtagctttggattatgatgggataaatataaaagagtttataaatatatatccctctataaaactaggctacttaataccaaatttccaaaatccaaaagcttccttggtattcccaaaa

SEQ ID NO: 11636 - protein, 165 aa, Unknown
  Obtained from environmental sample
  misc_feature (1)..(165): Xaa is any amino acid
MQRSFIREILESIDNETISFAGGLPDESLFPIEDLAKASEQVFKNKKHFQYTISNGITPLREKIAKFYSDEGFETKPSNILITTGSQQALFIIAKYFQNKEIVIEKPSYLGAVNIFKMNNLSMRPVALDYDGINIKEFINIYPSIKLGYLIPNFQNPKASLVFPK

SEQ ID NO: 11637 - DNA, 390 bp, Unknown
  Obtained from environmental sample
  misc_feature (1)..(390): n is a, c, g, or t
ttgcgctcggatatttatataatacacctgaaaaatctggatagtattgcaaatgctgatagtattaaaggattgattaatcagtcgatcgatgaaaatactgttaaaaaagatgcattgttttacacagaacctaaaaaggagaatgttaaacaaaaatattcagagtttcatattattgccggaagtttcaagaaaatggaaaatgctgagaaattttcagcaaaacttaagaataaagggtataatcctgaaataattcaatctgaaaaaaatctaataagaatatcaatttactcattcacagatgaaacattagctttaaaaaaattataccgacttcgtgaaaaatcaaaaattaaatcggtgtggattttaaaatccatttag

SEQ ID NO: 11638 - protein, 129 aa, Unknown
  Obtained from environmental sample
  DOMAIN (53)...(88): Sporulation related repeat
  misc_feature (1)..(129): Xaa is any amino acid
MRSDIYIIHLKNLDSIANADSIKGLINQSIDENTVKKDALFYTEPKKENVKQKYSEFHIIAGSFKKMENAEKFSAKLKNKGYNPEIIQSEKNLIRISIYSFTDETLALKKLYRLREKSKIKSVWILKSI

SEQ ID NO: 11639 - DNA, 498 bp, Unknown
  Obtained from environmental sample
  misc_feature (1)..(498): n is a, c, g, or t
gtgaggaacacgaccggggaatcaaggaggcggttaaacggctttgaattagaacaagaaggctttccacatacagtattaccggttaatacgggtggcttattaatgcaaaaaggcatggttgacatggtaattgttggcagtgacaggacaagtgccaagggagatgttgccaataaaattggcacttatttaaaagcattagcagcacacgataataatattcctttttatgttgccttacctttatcaaccatagattggaatattaataacggagtaaaagaaattcctattgaacaacgtgatccagaagaagttaaatatattgaaggatgggccaataataaaattacaaaggttcgtattatgcctgagaatagcccagttttaaattatggatttgatgttactcctgcaaaatatgttactgcgctgattactgagaatggaacgtgtaaaaccaataaagctgacattgcaaaactaaaaaaatga

SEQ ID NO: 11640 - protein, 165 aa, Unknown
  Obtained from environmental sample
  DOMAIN (1)...(157): Initiation factor 2 subunit family
  misc_feature (1)..(165): Xaa is any amino acid
MRNTTGESRRRLNGFELEQEGFPHTVLPVNTGGLLMQKGMVDMVIVGSDRTSAKGDVANKIGTYLKALAAHDNNIPFYVALPLSTIDWNINNGVKEIPIEQRDPEEVKYIEGWANNKITKVRIMPENSPVLNYGFDVTPAKYVTALITENGTCKTNKADIAKLKK

SEQ ID NO: 11641 - DNA, 636 bp, Unknown
  Obtained from environmental sample
  misc_feature (1)..(636): n is a, c, g, or t
ttggctgagaaagtagagaagtgcacattctcaggccttgaaattacaaaactagctaaaagagtaagtggtgtttggatagtaaatatcaaaaccaaagatataatctcatttgtagagtttacaagtggacttgatgaagtgtttgctataacagtagtgcctcatagaaaagtagagatgctagactttaatagtgaccagtcaaaagcaaactatatgatttccccagaagatattgaacaagtaagaatgcctgaaacaaagatagagatggcagccccacactttgaaaaaggtaatgatttttttaatgaaaataaaaaagaggaagctattatccactttcaaaaagctttagagatacaaagtgattatttacctgcaacatttaatctagcaatttgtttaggagacttagaaaaatacgatgaagcagaagctattttacaagaggttatagataaagatgcttcaatactacaaagttatgattcattaggatttatctattataaaaaaagagattttaaaaaagctcaggagaactttcaaaagattcttgaattagaccctagtaatactaaagctaaggactctttagagattttagaaagagaaaaaaataggaaataa

SEQ ID NO: 11642 - protein, 211 aa, Unknown
  Obtained from environmental sample
  DOMAIN (93)...(126): TPR Domain
  misc_feature (1)..(211): Xaa is any amino acid
MAEKVEKCTFSGLEITKLAKRVSGVWIVNIKTKDIISFVEFTSGLDEVFAITVVPHRKVEMLDFNSDQSKANYMISPEDIEQVRMPETKIEMAAPHFEKGNDFFNENKKEEAIIHFQKALEIQSDYLPATFNLAICLGDLEKYDEAEAILQEVIDKDASILQSYDSLGFIYYKKRDFKKAQENFQKILELDPSNTKAKDSLEILEREKNRK

SEQ ID NO: 11643 - DNA, 672 bp, Unknown
  Obtained from environmental sample
  misc_feature (1)..(672): n is a, c, g, or t
ttggctaaaaacgattggattgaagtactagatatttttaacactacaagtaaaaactatttaattgagtttttagattctcaagataagttttgtcctagtaatcatcatattaatatttttgacaaagatgccaatgcttttagctcacaattacttaacaaaccaaagcctgggaattggataccaatttataaaaaagaagatttaccagaatattttctcaataataatttgatgccaattcgttgtggtcaagcagagttttttttctttaaaggaaatatattttttgatttaacctctattgactttaatacaattgatataaacaatcttacgcaaattgatagttttctcccattgactttagaaaagtttcacaaaaatgaaaatgcttatttaaacaaagcattatctataggaattctaaatcattttatagatgatgatttaattaatcgtcgattattatatggtcaatttggtaagataaaaacaaattttgaattagagtttaaaacatctcatggtgttaaagagataaataaaggtttccaatttgaaatagattttgtattagaaaataaagatgagattattatttttgaagcanaacaaggttctaagtcaagaacaacattttctttattgcaatatattatccattaa

SEQ ID NO: 11644 - protein, 223 aa, Unknown
  Obtained from environmental sample
  misc_feature (1)..(223): Xaa is any amino acid
MAKNDWIEVLDIFNTTSKNYLIEFLDSQDKFCPSNHHINIFDKDANAFSSQLLNKPKPGNWIPIYKKEDLPEYFLNNNLMPIRCGQAEFFFFKGNIFFDLTSIDFNTIDINNLTQIDSFLPLTLEKFHKNENAYLNKALSIGILNHFIDDDLINRRLLYGQFGKIKTNFELEFKTSHGVKEINKGFQFEIDFVLENKDEIIIFEAXQGSKSRTTFSLLQYIIH

SEQ ID NO: 11645 - DNA, 315 bp, Unknown
  Obtained from environmental sample
  misc_feature (1)..(315): n is a, c, g, or t
atgatttgtggggttagagtaatgaacgaaaatttagcatacataatcgaatgggccatatggtctaatttggatagaattacagaattggagcttgttctacttaaaggacatcagcacatcgaaataataattgatactgttttatccgaaaacgggattaagaattgcgaagatttatccttttacaaaaagacaaaggagctgaaaatcattggaagcaaatctaatggtaacagcaagattattacagacaagttgtttgaattgaataaaatcaggaataaattagctcacgaactcgaattgaaataa

SEQ ID NO: 11646 - protein, 104 aa, Unknown
  Obtained from environmental sample
  misc_feature (1)..(104): Xaa is any amino acid
MICGVRVMNENLAYIIEWAIWSNLDRITELELVLLKGHQHIEIIIDTVLSENGIKNCEDLSFYKKTKELKIIGSKSNGNSKIITDKLFELNKIRNKLAHELELK

SEQ ID NO: 11647 - DNA, 474 bp, Unknown
  Obtained from environmental sample
  misc_feature (1)..(474): n is a, c, g, or t
ttgataatcatgcaaaacaataaaacccttaattacataaaagacgctctaagcaacatgccaacagactggttaaatctaaccacgcatcgtttagatatttataacgagaaattagctaaaacacagtttttagatacgtttgagaacctatataaaaacaataattcagaaccttcagcattaagcgaattaccaaccgcttacgattatattcgtttaggtcatccgttatcttgtattttagaatggggaattgcgaatttaaatgacattaaagcagacaacgtgattagtttttcgtcacaaacgggtcctgtgttgtcaattttaagaacaaatttattagaaaaacaaaaagaccccaaattgtatataccgggcgacctttccagaaatttttccaaggctgaaatccctccagccaggtccctttggttaatcatttccaatggtccaaaaaaagtaaaatag

SEQ ID NO: 11648 - protein, 157 aa, Unknown
  Obtained from environmental sample
  misc_feature (1)..(157): Xaa is any amino acid
MIIMQNNKTLNYIKDALSNMPTDWLNLTTHRLDIYNEKLAKTQFLDTFENLYKNNNSEPSALSELPTAYDYIRLGHPLSCILEWGIANLNDIKADNVISFSSQTGPVLSILRTNLLEKQKDPKLYIPGDLSRNFSKAEIPPARSLWLIISNGPKKVK

SEQ ID NO: 11649 - DNA, 456 bp, Unknown
  Obtained from environmental sample
  misc_feature (1)..(456): n is a, c, g, or t
atggaaaaaatagaaaagtacgaccgtaaaaaactagaaaaggtaattactataagtaaggaaattgccatcacactaatatcattattcgctggatgtggaggatccagtctcggctatgagatggcagggttcttagaactcctggcaatcgagtgggagtctcacgctaggaaagtgttcgctctcaactttccaaatgtccaacttaagaacatcgatattggaaagttaacaggaaagcaactgttgaagctgatcaacaagaagcgtggagaattggatgtatttgatgcatcaccaccttgtcaaggattttctgcatctgatacacgtagggatgtaaataacgagaaaaacaaactctacttcaagaccatagagttaatcgatgaagtacaaccaaaagtattctgtatagaaaagcgttttagggatgagaaggaggtaaaatga

SEQ ID NO: 11650 - protein, 151 aa, Unknown
  Obtained from environmental sample
  misc_feature (1)..(151): Xaa is any amino acid
MEKIEKYDRKKLEKVITISKEIAITLISLFAGCGGSSLGYEMAGFLELLAIEWESHARKVFALNFPNVQLKNIDIGKLTGKQLLKLINKKRGELDVFDASPPCQGFSASDTRRDVNNEKNKLYFKTIELIDEVQPKVFCIEKRFRDEKEVK

SEQ ID NO: 11651 - DNA, 483 bp, Unknown
  Obtained from environmental sample
  misc_feature (1)..(483): n is a, c, g, or t
atggtcagattggctcgagttctcttttcaaagaacagaaattctaaaagtatcgttgtcacaaagaaaaaacatacttcaagtaaaaagaaaggggttgagtggattggtaatgatgatcaactcgctatattatttgatgaattgattgagactaaaattatggaaccaatcaataatggcaacaaaaaagaattttttgattttttcaaaggagttttaatgaaaagaaattcttttcgatggaagaaaaatataaatctaatcgcttatttattcgaggagttaaaaacttctaatttaatagatgcatggaattgtaattacaattcagttattcgtaattatggttttttcgtgtcaaataaaaataatccaatcctttctttaaagcataacaaaaatcaatatcttaataatgagataggtaaacctattaactatacatctatagatactattatttctaaacttataaagtaa

SEQ ID NO: 11652 - protein, 160 aa, Unknown
  Obtained from environmental sample
  misc_feature (1)..(160): Xaa is any amino acid
MVRLARVLFSKNRNSKSIVVTKKKHTSSKKKGVEWIGNDDQLAILFDELIETKIMEPINNGNKKEFFDFFKGVLMKRNSFRWKKNINLIAYLFEELKTSNLIDAWNCNYNSVIRNYGFFVSNKNNPILSLKHNKNQYLNNEIGKPINYTSIDTIISKLIK

SEQ ID NO: 11653 - DNA, 693 bp, Unknown
  Obtained from environmental sample
  misc_feature (1)..(693): n is a, c, g, or t
atgaagatgaacagttttcattttatcatacttaaaagggaagagatgaacgaaaacaattatttattgccattatataatagattagatgtctcatttgtaaaaggtaaaaattccattttatatgatgaaaaaaagagagattatgttgatttttcttcagggattggtgtgaatagtttgggttattgtgataaaaaagttgttaaaacgataactaaacaagccaatcaaattttacacacatcaaatatttaccatataaagtcacaagaaaaatgtgcgaaaaaaatagttacattaagcacctatgatatgcagtgttatttttgtaatagtggtgcagaagcaaatgaaagtgccattaaactggctcgaaaatatggaaatacagctttttgtaaaacaaagtataaaattataactattaaaaactcgtttcatggaagaacaatagcaactttaaaagcaacagcacaagaggaaaaacataaatattttggaccttatcctgatggatttgtttatgctgataatataaatgaggcgataaacttaatagatgatgacactgttgcagttatgcttgaattgattcaaggggaaggtggcatctttatgcaagataaagagcaagtaaaaaagttaagtgaggtattgaaaaaaaaagaaattattattgataatagatga

SEQ ID NO: 11654 - protein, 230 aa, Unknown
  Obtained from environmental sample
  DOMAIN (20)...(230): Aminotransferase class-III
  misc_feature (1)..(230): Xaa is any amino acid
MKMNSFHFIILKREEMNENNYLLPLYNRLDVSFVKGKNSILYDEKKRDYVDFSSGIGVNSLGYCDKKVVKTITKQANQILHTSNIYHIKSQEKCAKKIVTLSTYDMQCYFCNSGAEANESAIKLARKYGNTAFCKTKYKIITIKNSFHGRTIATLKATAQEEKHKYFGPYPDGFVYADNINEAINLIDDDTVAVMLELIQGEGGIFMQDKEQVKKLSEVLKKKEIIIDNR

SEQ ID NO: 11655 - DNA, 720 bp, Unknown
  Obtained from environmental sample
  misc_feature (1)..(720): n is a, c, g, or t
ttgagggatttggtttatgctgataatataaatgaggcgataaacttaatagatgatgacactgttgcagttatgcttgaattgattcaaggggaaggtggcatctttatgcaagataaagagcaagtaaaaaagttaagtgaggtattgaaaaaaaagaaattattattgataatagatgaagttcaaacaggtgtttatagaagtggaaaatttttaatgtcacatcattatgagattagaccaaatattataactttagcaaaaggcttagcaacaggagttccaatagggctgatgatgacagatgtaagaaatgttttaaagcaaggtgatcatggttcaacttttggaggaaatcactttgcgacaactgtgtcaattaaggttttaaatattttagaaaaatataaaaatagtggaaaacttgaatcaaatattaactattttaatgattatttagactactttatagaaagatatccatctttgtttttatcaaaaaatggctttggttttatgcttggactcaaacttaaagatgaaacaaagctcaatgagattgtaaagttatctttaaagcagggtgttttagtactaaaatcaggaaaggatatagtgcgatttttaccaccattgaatatatcaaaaaaagagatagaaatgggatttaaaagatttgaaaaggttgtaacaaaattgaaaggaaaaaatatatga

SEQ ID NO: 11656 - protein, 239 aa, Unknown
  Obtained from environmental sample
  DOMAIN (1)...(235): Aminotransferase class-III
  misc_feature (1)..(239): Xaa is any amino acid
MRDLVYADNINEAINLIDDDTVAVMLELIQGEGGIFMQDKEQVKKLSEVLKKKKLLLIIDEVQTGVYRSGKFLMSHHYEIRPNIITLAKGLATGVPIGLMMTDVRNVLKQGDHGSTFGGNHFATTVSIKVLNILEKYKNSGKLESNINYFNDYLDYFIERYPSLFLSKNGFGFMLGLKLKDETKLNEIVKLSLKQGVLVLKSGKDIVRFLPPLNISKKEIEMGFKRFEKVVTKLKGKNI

SEQ ID NO: 11657 - DNA, 519 bp, Unknown
  Obtained from environmental sample
  misc_feature (1)..(519): n is a, c, g, or t
atgattagagaatttgatgtaacactaaaaggaattgaagagagtgaccttgataaagttctcacgtggagaaatagcgatcacataagaaaatatgctctaaatccggagattatcacctatgaagagcataagagatggtttgattcgttaaaatctaaaggtgacagatacttcataataaaaaaagaggatcaagatgtaggtcttatctgggcaaagggtataacagatgagagttgtgaaactggattttatctccatgactggagtgtacaaaacactctttttgcttatcgagtttcaattaccctgaacaactacctcttctatgcaaagagtctaaaatatatctactgtgatattttagatacaaacgatcgctccatcagatttagtctctctcttggatatgaaaaatatgatcaatatgagaaacatggcgtgtatagattaaaatcagaagattacaaaaagaaaagctcaaaaattataaaactcctaacaaaaaagaaataa

SEQ ID NO: 11658 - protein, 172 aa, Unknown
  Obtained from environmental sample
  misc_feature (1)..(172): Xaa is any amino acid
MIREFDVTLKGIEESDLDKVLTWRNSDHIRKYALNPEIITYEEHKRWFDSLKSKGDRYFIIKKEDQDVGLIWAKGITDESCETGFYLHDWSVQNTLFAYRVSITLNNYLFYAKSLKYIYCDILDTNDRSIRFSLSLGYEKYDQYEKHGVYRLKSEDYKKKSSKIIKLLTKKK

SEQ ID NO: 11659 - DNA, 396 bp, Unknown
  Obtained from environmental sample
  misc_feature (1)..(396): n is a, c, g, or t
atgcttaaaaaagaattatatataagaaatattttattagtagttgtattactaatactagttatatttgggattataatatcactttatcaatataaattaattaccaatgatattaatagtgatatgaaaattcaaaatagttgtgtccataaaacttttaatctttttttaactactttacaaaaggatattagtgtaaagtctgactttatgctttcactgcctaatgttactaatacttttaaacaaagagatagagaaaaactttattcattggttaaagatagttatactcaaatgaccttacaaaataaatatgtaaaaatcatgacttttcgtcttaacgatggtagtgtttttaagatacacaaccgccgccgccattntatttaa

SEQ ID NO: 11660 - protein, 131 aa, Unknown
  Obtained from environmental sample
  misc_feature (1)..(131): Xaa is any amino acid
MLKKELYIRNILLVVVLLILVIFGIIISLYQYKLITNDINSDMKIQNSCVHKTFNLFLTTLQKDISVKSDFMLSLPNVTNTFKQRDREKLYSLVKDSYTQMTLQNKYVKIMTFRLNDGSVFKIHNRRRHXI

SEQ ID NO: 11661 - DNA, 375 bp, Unknown
  Obtained from environmental sample
  misc_feature (1)..(375): n is a, c, g, or t
ttgcttaacggatacagggatttgattgtttacaccaaggcttacgaattatcaatatctatatactatttgagtacagaattccctaaagaagagacttattcattaacttcacagattagaagatcttcaagatcagtggcagctaatatttgcgaagcatgggcaaaaagaacttataggaaagctttcataaataaacttacagatagcttaggtgaatcaaatgaaacagaacattggctaaagactgcctatgatattggatatattgaggaagaaaaatgtcttaatcttttgggcagatgccaagaagtccagaaaatgctggcaagtatgatcagaaaacctgataaattcctatcaaatcattaa

SEQ ID NO: 11662 - protein, 124 aa, Unknown
  Obtained from environmental sample
  DOMAIN (3)...(113): S23 ribosomal protein
  misc_feature (1)..(124): Xaa is any amino acid
MLNGYRDLIVYTKAYELSISIYYLSTEFPKEETYSLTSQIRRSSRSVAANICEAWAKRTYRKAFINKLTDSLGESNETEHWLKTAYDIGYIEEEKCLNLLGRCQEVQKMLASMIRKPDKFLSNH

SEQ ID NO: 11663 - DNA, 549 bp, Unknown
  Obtained from environmental sample
  misc_feature (1)..(549): n is a, c, g, or t
atgaaaaaaagccgtacttactacatcttcctcatcgccgatatcttcatcgtcgctttagcttttacttatgtcgcttggttaaagcctgcaactaagagaattgttatacctcaatattggcgcccattccttggttttttgactttctggatattaacatcaatgttgggagataaatatgctttaggcaagtgtgaaagttttaaagatgtattaatcaatgtaatccggaacaattttctattcacagcaataattaccatctctatggttgtattccatttctttgactattccaggcttatagtctttggtacaatagctgttgctacatctttagagatactatttgttggcttgtgttatttccataataaaggaatggataccgatggatttgaggtatcaatctttaattcagctaggttgataagtccatttggcagggatgtaacacctaaaccaccgccaccaccatttatccgtaagaaatctttggagaactctgtactcttagatctaaaagatccgatatctaaaaaatga

SEQ ID NO: 11664 - protein, 182 aa, Unknown
  Obtained from environmental sample
  misc_feature (1)..(182): Xaa is any amino acid
MKKSRTYYIFLIADIFIVALAFTYVAWLKPATKRIVIPQYWRPFLGFLTFWILTSMLGDKYALGKCESFKDVLINVIRNNFLFTAIITISMVVFHFFDYSRLIVFGTIAVATSLEILFVGLCYFHNKGMDTDGFEVSIFNSARLISPFGRDVTPKPPPPPFIRKKSLENSVLLDLKDPISKK

SEQ ID NO: 11665 - DNA, 513 bp, Unknown
  Obtained from environmental sample
  misc_feature (1)..(513): n is a, c, g, or t
ttgtgccggttgcgatttgatcgtagtggattagttataatgacttcagggttagagcctattgcacatgaagcagagaaactatttatagaaaatattaaaaaagagatggcactagaagagagagttcatgagatagtggatgagaatgaagaggagatagatttttatctagctgatgagagacaactattttttatgattaaaaagaaacttgcacaggaatatggtgttattttatcttatgaagacagatactctgatctttcacataaaatcttagatgagctttatgaagaggatctgattaattatgaagtaagtgaaaacagaattaaaaatgttatttatgattcaattacatcatttatctcagatacatcagagatagaaaatgctgtatatgacaagataaaaacctataaaagagagcttatccctggtagtgatgattatgaaattttatatgaaaaactttacaaagaagagttgttaaaaagaggtatggagtaa

SEQ ID NO: 11666 - protein, 170 aa, Unknown
  Obtained from environmental sample
  DOMAIN (2)...(170): Protein of unknown function (DUF507)
  misc_feature (1)..(170): Xaa is any amino acid
MCRLRFDRSGLVIMTSGLEPIAHEAEKLFIENIKKEMALEERVHEIVDENEEEIDFYLADERQLFFMIKKKLAQEYGVILSYEDRYSDLSHKILDELYEEDLINYEVSENRIKNVIYDSITSFISDTSEIENAVYDKIKTYKRELIPGSDDYEILYEKLYKEELLKRGME

SEQ ID NO: 11667 - DNA, 612 bp, Unknown
  Obtained from environmental sample
  misc_feature (1)..(612): n is a, c, g, or t
ttggagaaacaactctattatggatccataaccgctatggacactcaaatgggtaggttatggagcactttggaaagcctcggtgtacaaaaaaacaccataatcctgttttgtagtgacaatggccctgaaagtagtacgccaggcagtgcgggaccgtttcggggaagaaaaagaagtttgtatgaaggaggtcttagagtacctgcttttatgatttggaaagatcaactgagtgcccataaagtagatgtagccatgacaacaagtgatatcttgcctacaatacttgatgcacttgatatagaatatccagatgagaggccgttggatgggattagtcttttgccgtatataaatgaagaaggtaaagagagggaaatgccgatagggtttatatatatgaacaaaatatcatgggtatctaatcaatacaaacttataagtactgataatggtaaaaattttgaactttatgacttgaaagaagataaaggggaaaaagtggatataggagaacagatgcctgaacaagttaaaattatgaaaaacgagttagacatttggctagcctcggtaaaaaagagtaaaaatggaggggattataaataa

SEQ ID NO: 11668 - protein, 203 aa, Unknown
  Obtained from environmental sample
  misc_feature (1)..(203): Xaa is any amino acid
MEKQLYYGSITAMDTQMGRLWSTLESLGVQKNTIILFCSDNGPESSTPGSAGPFRGRKRSLYEGGLRVPAFMIWKDQLSAHKVDVAMTTSDILPTILDALDIEYPDERPLDGISLLPYINEEGKEREMPIGFIYMNKISWVSNQYKLISTDNGKNFELYDLKEDKGEKVDIGEQMPEQVKIMKNELDIWLASVKKSKNGGDYK

SEQ ID NO: 11669 - DNA, 546 bp, Unknown
  Obtained from environmental sample
  misc_feature (1)..(546): n is a, c, g, or t
atgtctaactctttatctagccacccttggctctctcaactacctgaagaaactttggcaaaaatatctgacaaaataaaagagtttgaattatcagaaaatactgtaatagattggttttcaaactttaacactaaagagcagtacgaactggcacttaaaatattttttctcatagattaccgtacaaataaaagatcaatcgacaccatcaaaacatatgaaacacagataaatcagtcaatgcataaactaaaacgtgacaacatagttttaataagttcagatgaaaatacagatagttcaaaccgttttatttacgatatagctaaagagtggaaaatcactgagttaaatgtttttagaaaatcagaactaacaaacgacaccataaccgacaaacaaaacttttttatattttttaacgatacccatggaactggaaatcagtttgttcgggagtttaaagataccattgctactatcggtgaagagaactgtgcaattataagcattactatgacagatgtagcactaaaaaattaa

SEQ ID NO: 11670 - protein, 181 aa, Unknown
  Obtained from environmental sample
  misc_feature (1)..(181): Xaa is any amino acid
MSNSLSSHPWLSQLPEETLAKISDKIKEFELSENTVIDWFSNFNTKEQYELALKIFFLIDYRTNKRSIDTIKTYETQINQSMHKLKRDNIVLISSDENTDSSNRFIYDIAKEWKITELNVFRKSELTNDTITDKQNFFIFFNDTHGTGNQFVREFKDTIATIGEENCAIISITMTDVALKN

SEQ ID NO: 11671 - DNA, 663 bp, Unknown
  Obtained from environmental sample
  misc_feature (1)..(663): n is a, c, g, or t
gtgtccaccaggaaattatccaggaaaaaaagtttgaggggtttagttagatatatcgatgaagatggaaaagtatactcaccctttttctttttagaagttgcaaaaagatcaagactctaccctgaaataacaaaaaccgtaattacaaaagcttgtaaaactttttcaaacagagatgaaaaatttagtatcaacctctcaatagaagatattttaaatgtctcaacaatagagtttttaattcaagaggttaaaaaatacaaccttgaaagacagctaattgtggaaattttagaatcagagggtatagataattatggctctgttataaatgtgattgaaaatttaaaaacaaacggagttgagatagccattgatgattttggaacaggatattctaactttgcatatctgataagcttagatattaatactctaaaaatagatggctcacttgtcaaagatatagatacaaatctcagctctaaagctatcgtaaaatcaattgtaagttttgcaaaagagctaaatataagaactgttgctgaatttgtatcatcagagaacatatataatgtaatcaaagagattggagtagactatgctcaaggatactacctgagcgaaccaatacctttcgatcagctcccaaacaaataa

SEQ ID NO: 11672 - protein, 220 aa, Unknown
  Obtained from environmental sample
  DOMAIN (4)...(211): EAL domain
  misc_feature (1)..(220): Xaa is any amino acid
MSTRKLSRKKSLRGLVRYIDEDGKVYSPFFFLEVAKRSRLYPEITKTVITKACKTFSNRDEKFSINLSIEDILNVSTIEFLIQEVKKYNLERQLIVEILESEGIDNYGSVINVIENLKTNGVEIAIDDFGTGYSNFAYLISLDINTLKIDGSLVKDIDTNLSSKAIVKSIVSFAKELNIRTVAEFVSSENIYNVIKEIGVDYAQGYYLSEPIPFDQLPNK

SEQ ID NO: 11673 - DNA, 783 bp, Unknown
  Obtained from environmental sample
  misc_feature (1)..(783): n is a, c, g, or t
ttggatgaaaataataacattgtagaatttatatctattaaaaatgatgtcacctctcttgtaaaacatcaagacattcttcaacaccaaataaataccgatcttcttactcaaataccaaatcgtgttaaacttaacagtgatctatacaatcttttaactccgtcaattattttggtagatattgataagtttaaagaggtaaacaatctatttggtctctactttggtgatcaaattcttatctatttagctcaaacactaaaaaagatatgtgatctgataggttttacctactatcgtatatctgcagatgagtttattcttctagcagataatcaaaaagaagaagatttaatagaagttgttaaaaaagttatgacatttttaaatgattatccatttgagcataacggaataagttttaatattcagctatcatttggtatcgcattatcttcaaatgagcgtgaaaaaaacatgttacttgccatggcagatgcagctatgcaaactgcacgtaaatctccaagttcatatggagtttactccataaatgaagatcctcaaaaagagtatgaaaataactttacctggaatcaaaatcttaaaaaagcgttagcagaagatagaataactatctattatcaacctatcgtatcaacagtaaataatcaagaaaaaaagtatgagtgtttagttagatatatcgatgaagatgggaaagtatactcacccttttttcttttagaaatttgcaaaaagatcaagactctaccctga

SEQ ID NO: 11674 - protein, 260 aa, Unknown
  Obtained from environmental sample
  DOMAIN (27)...(180): GGDEF domain
  misc_feature (1)..(260): Xaa is any amino acid
MDENNNIVEFISIKNDVTSLVKHQDILQHQINTDLLTQIPNRVKLNSDLYNLLTPSIILVDIDKFKEVNNLFGLYFGDQILIYLAQTLKKICDLIGFTYYRISADEFILLADNQKEEDLIEVVKKVMTFLNDYPFEHNGISFNIQLSFGIALSSNEREKNMLLAMADAAMQTARKSPSSYGVYSINEDPQKEYENNFTWNQNLKKALAEDRITIYYQPIVSTVNNQEKKYECLVRYIDEDGKVYSPFFLLEICKKIKTLP

SEQ ID NO: 11675 - DNA, 459 bp, Unknown
  Obtained from environmental sample
  misc_feature (1)..(459): n is a, c, g, or t
atgtttttttatagtataatcccaacaataaaaaagaaggttgatatattggttgcaatagttgattataatatgggaaatttagcaagtgtttataatgcttgtaagctaatagatgcagatgctacaatagtaaaagacccaactaaattaaaagattttaatagaataatacttccaggtgttggtgcttttggagatgctatggaacatttaaaatctacagggatgtacgatgcagtaaaagagtttgcatctagtggaaaaccaattattggtatctgtttaggtatgcaattattatttgaaagtagtgaagagtttggcgatacacaaggtttaggactaattcctgggaaagttgtaccatttgataaatcaagaatggatatggatgaccacaaagtaccacatgggggctggaataagatattcaataaaccaaataaacttttttga

SEQ ID NO: 11676 - protein, 152 aa, Unknown
  Obtained from environmental sample
  DOMAIN (19)...(152): Glutamine amidotransferase class-I
  misc_feature (1)..(152): Xaa is any amino acid
MFFYSIIPTIKKKVDILVAIVDYNMGNLASVYNACKLIDADATIVKDPTKLKDFNRIILPGVGAFGDAMEHLKSTGMYDAVKEFASSGKPIIGICLGMQLLFESSEEFGDTQGLGLIPGKVVPFDKSRMDMDDHKVPHGGWNKIFNKPNKLF

SEQ ID NO: 11677 - DNA, 471 bp, Unknown
  Obtained from environmental sample
  misc_feature (1)..(471): n is a, c, g, or t
atggcaaaaaaagtattatttgtatgtattcataacagcgcaagaagtcaaatagcagaagaacttttacgaaagtatggagaaaatgagtttgaggtgcaaagtgcaggatttgaaccagcagggattaatcctctagcaattgaaatattaagagaggaaaacattaatatagatgggaaagaaacaaactctgtttttgacctttttaaggcggggaaaactttcaattatgttattacagtatgtgatgagggaaatgcccaaagatgtccattatttccaggtcttaactatcgaattcattggagttttgaagacccaagtagttttacaggaagggatgaggagagattagcaaaaacaagaaccgtaaaagagcagataaaaaaagaagttcttcaacttatagagcttgtaaaaactggtcagttaaaagataattttccaacaacatggaaagtaggataa

SEQ ID NO: 11678 - protein, 156 aa, Unknown
  Obtained from environmental sample
  DOMAIN (3)...(139): Low molecular weight phosphotyrosine protein phosphatase
  misc_feature (1)..(156): Xaa is any amino acid
MAKKVLFVCIHNSARSQIAEELLRKYGENEFEVQSAGFEPAGINPLAIEILREENINIDGKETNSVFDLFKAGKTFNYVITVCDEGNAQRCPLFPGLNYRIHWSFEDPSSFTGRDEERLAKTRTVKEQIKKEVLQLIELVKTGQLKDNFPTTWKVG

SEQ ID NO: 11679 - DNA, 759 bp, Unknown
  Obtained from environmental sample
  misc_feature (1)..(759): n is a, c, g, or t
ttgaataagagaaccggggagatattgatggatttgacttttactcaccctttagttattgataaagtcgagaaaaaaaaggttcaagaaccgaaggttccaaagaatagaaatacgaacccagatcaaagagataaatttgcatctaaggggggtagattttttaaattaaaagaaattttgccacgaggtcttgagaataatacgcttagaagaatgaaagaaaaagagaaaaaagtaaagaaaaaaaagattaaaacagtttctgaatattcaaaaatctctagtcaattattttctaaaacttccagaagattacttggacaaaaatctttttcacaaatggaagataatcttaaaaaagcgaatcttgatttcacgcctggtgggtatttatcgattattttaatgaccagttttttatcttgttttgttgctgcatttctttttttatttttcttgttttttgattttggggcaacactcccaattataaccagagcccaagatgcaattaatattcgtttttttaaagtcatctggatattatttataatccctattggaacttttttgttaatgtatatatatcctggaatggaaaagaaatctgcagaacaaagaattgatacagaattaccttttgctactattcatatggctgcgatttcagggtcgatgattaatccaattaatatttttaaaataatttcttctactaaagaatatcctgcgcttgagaaagagttaccaagatga

SEQ ID NO: 11680 - protein, 252 aa, Unknown
  Obtained from environmental sample
  misc_feature (1)..(252): Xaa is any amino acid
MNKRTGEILMDLTFTHPLVIDKVEKKKVQEPKVPKNRNTNPDQRDKFASKGGRFFKLKEILPRGLENNTLRRMKEKEKKVKKKKIKTVSEYSKISSQLFSKTSRRLLGQKSFSQMEDNLKKANLDFTPGGYLSIILMTSFLSCFVAAFLFLFFLFFDFGATLPIITRAQDAINIRFFKVIWILFIIPIGTFLLMYIYPGMEKKSAEQRIDTELPFATIHMAAISGSMINPINIFKIISSTKEYPALEKELPR

SEQ ID NO: 11681 - DNA, 429 bp, Unknown
  Obtained from environmental sample
  misc_feature (1)..(429): n is a, c, g, or t
ttgttcaaattaatgggaatttactcatatattataactagagattatggattcgccccaaaccccttttatgggtatggtacattggctacatgcaaacctggaataagaaaaggagcatctgtcggtgattgggtattaggtacagggtcttgtgataagagagatgatagtctgtgtcaaaaaatgatatatgctatgcaggttcaagaaatcctaacacttaatgattattgggaagataatagattttataatacacgacctgtaatgaatggaagtaaaaaacaaatgtatggagataatatatatcattatgatagtgtgaaaagaattttcatacaagaaaatccccatcatattttaaaaaacggggaaaacaatttttgtaaatttccgaaaggacccaaacgggaagaatgtttttaa

SEQ ID NO: 11682 - protein, 142 aa, Unknown
  Obtained from environmental sample
  misc_feature (1)..(142): Xaa is any amino acid
MFKLMGIYSYIITRDYGFAPNPFYGYGTLATCKPGIRKGASVGDWVLGTGSCDKRDDSLCQKMIYAMQVQEILTLNDYWEDNRFYNTRPVMNGSKKQMYGDNIYHYDSVKRIFIQENPHHILKNGENNFCKFPKGPKREECF

SEQ ID NO: 11683 - DNA, 570 bp, Unknown
  Obtained from environmental sample
  misc_feature (1)..(570): n is a, c, g, or t
ttgatattatctcaaattgaagagtatcctattttctttaaagaaaatcctgatctcaatgaaattcggaaagttgcaaaccaagttccatttttaatgtcatatatcttctctcctcatgaaatagaaaattctatgagtggtgttagtgggccttttacagatgatccaatttttgaatcgaatctacttaaaagcatcgaaaataataaagcgtacgattttaagatggtggatgattttagtgatgataaatgcatgtatctttttacaaagctcatgtttgcctatgccatcattctaaaaaaattctataattcagatataagtatggattatttcattcgatatagattggataacaaacttaatggtttagtcaaatatttcaaattcgattttgactcaacttatatcgatgtcaaatacaaaaataaattagttgaactttcagatgatgatattaagaaactcataaataatccatcggatatggatttatggcttaaaatgttgcctttagatcaatttgagtttacaggtttcatgaaatacaaatttgtgacgtaa

SEQ ID NO: 11684 - protein, 189 aa, Unknown
  Obtained from environmental sample
  misc_feature (1)..(189): Xaa is any amino acid
MILSQIEEYPIFFKENPDLNEIRKVANQVPFLMSYIFSPHEIENSMSGVSGPFTDDPIFESNLLKSIENNKAYDFKMVDDFSDDKCMYLFTKLMFAYAIILKKFYNSDISMDYFIRYRLDNKLNGLVKYFKFDFDSTYIDVKYKNKLVELSDDDIKKLINNPSDMDLWLKMLPLDQFEFTGFMKYKFVT

SEQ ID NO: 11685 - DNA, 660 bp, Unknown
  Obtained from environmental sample
  misc_feature (1)..(660): n is a, c, g, or t
ttgattttagcaaatcctccatttaagggttcactagattttgaagaggttgcaaaaccgattttagatgtagcaaaaacaaaaaaaacagaactgctctttttatcgcttatgttaaaaactttaaaagacagtggcagatgtgcggttattgttcctgatggagttttgtttggttctacaaaatcgcatcaagagataagaagtgaaatagtctcaaaccaacagctagatgctatcatctccatgccaagcggtgtatttaaaccttatgcgggtgtcagcacggctatcatgatttttacaaaaacaaacggacataaaaatgacaaagtttggttttatgacatgcaaaatgacggatacactcttaatgacaacagacaagagtgtgatggttctgacattccagacatactggctaggtttaaaaatttcgatgctgagaaaaaacgagagagaacggacaaaagcttttttgttcccgtgagtgagatagaagcaaataattatgacctaagtatcaacagatacaaagagatagtttacgaaactataaatcatgctaagccgatagagatcataatagatatagaaaaaatagataagaaaatctcacaagggcttaaagagttaaaagggatgatacatgaaagataa

SEQ ID NO: 11686 - protein, 219 aa, Unknown
  Obtained from environmental sample
  DOMAIN (12)...(172): N-6 DNA Methylase
  misc_feature (1)..(219): Xaa is any amino acid
MILANPPFKGSLDFEEVAKPILDVAKTKKTELLFLSLMLKTLKDSGRCAVIVPDGVLFGSTKSHQEIRSEIVSNQQLDAIISMPSGVFKPYAGVSTAIMIFTKTNGHKNDKVWFYDMQNDGYTLNDNRQECDGSDIPDILARFKNFDAEKKRERTDKSFFVPVSEIEANNYDLSINRYKEIVYETINHAKPIEIIIDIEKIDKKISQGLKELKGMIHER

SEQ ID NO: 11687 - DNA, 810 bp, Unknown
  Obtained from environmental sample
  misc_feature (1)..(810): n is a, c, g, or t
ttgccgatacttttagaaatagatgtcgtgcattttgaaaactctaacgatgagttaaaagagaatgttttaagagatgagaagctgttttttgttagaaaagtgaaaatgaaagatattactctatttgttaaaaatggattaacagtaaaacaagataaagataaaaagcttggttgtcctattactagaattgaaacgatttcacatggtgtaattaattttgatgctgttggatatgcaaatttaaataaagatgagtatgaaaattggttactacataaaggtgatattttaataagtcatataaatagtgaaaaacatttaggcaaatctgcaatatatactgatgataaagtgattattcatggtatgaatttattgaatttaagagttaaagaaaatattcattctaaatatatattttattatttaaaatctgatctatataaaaaatcaattaacaaaataatgaaaaaatctgtaaatcaagctagcttttctttgtcaggctttaatgatattgatgtgctattaccatcattaacaaaacaaaaagagatagctaaaactttagacaaagcgaaagagcttatagatttgcgaaaagagtccataacaaaactggatgaactctctaaatctatttttattgatatgtttggtgacccagttagtaatcctatgaaatgggacgtaactacattaagtgatttaagtgttacattagaaggtggacaaaatattgccgaagaccaaagtggtaatactgttaaaaatcgtattctgaaaattagtgcaatactctag

SEQ ID NO: 11688 - protein, 269 aa, Unknown
  Obtained from environmental sample
  DOMAIN (32)...(197): Type I restriction modification DNA specificity domain
  misc_feature (1)..(269): Xaa is any amino acid
MPILLEIDVVHFENSNDELKENVLRDEKLFFVRKVKMKDITLFVKNGLTVKQDKDKKLGCPITRIETISHGVINFDAVGYANLNKDEYENWLLHKGDILISHINSEKHLGKSAIYTDDKVIIHGMNLLNLRVKENIHSKYIFYYLKSDLYKKSINKIMKKSVNQASFSLSGFNDIDVLLPSLTKQKEIAKTLDKAKELIDLRKESITKLDELSKSIFIDMFGDPVSNPMKWDVTTLSDLSVTLEGGQNIAEDQSGNTVKNRILKISAIL

SEQ ID NO: 11689 - DNA, 795 bp, Unknown
  Obtained from environmental sample
  misc_feature (1)..(795): n is a, c, g, or t
atggctcggcctttaagtagcgatggtattttatatagaggatggtgcaagaagatagactcatttgaatcacaagaagttgatgtgtatattgatgggaagttgatagagactattaaatcaaataaatcaaatgagtatatttacaacatatataaagattcaaaattaggctttgtatatgttttagatgagatgtgttttgataatggaaatcattccataaattttgttgtttcagaaacaaaagaaaaattagaatgtaatgtgaaaacctttaaagtaagtcctaaacaaaaagaaatattatctcagtatagatttatcacatctttagagaatgatttagatatagaaaaattaagaacattgtatggtaaaaattcaataggctttttagctattgatgataatttagaagatgaaacttttgtaaattatataaaagagttaactgtaagattttcaaaaattagtataaaagttttttcttttagtgatcaaaatagagagtgtgcagaaagaatttttaaagaatttgaaaatataaagattttgtataaatcaaacaatatagctgactttgttgaaaatattgaaatatttattcactatcaaggtaatacagtcggtacattaaacaagagtttgattcagtattgcctaaatatacatattatttattatagttcagaaagtaattataaaaaagtatctgatctgaatgaggttaatataccaatgtataataattttttgaactatattagagaagctggatatattccattttga

SEQ ID NO: 11690 - protein, 264 aa, Unknown
  Obtained from environmental sample
  misc_feature (1)..(264): Xaa is any amino acid
MARPLSSDGILYRGWCKKIDSFESQEVDVYIDGKLIETIKSNKSNEYIYNIYKDSKLGFVYVLDEMCFDNGNHSINFVVSETKEKLECNVKTFKVSPKQKEILSQYRFITSLENDLDIEKLRTLYGKNSIGFLAIDDNLEDETFVNYIKELTVRFSKISIKVFSFSDQNRECAERIFKEFENIKILYKSNNIADFVENIEIFIHYQGNTVGTLNKSLIQYCLNIHIIYYSSESNYKKVSDLNEVNIPMYNNFLNYIREAGYIPF

SEQ ID NO: 11691 - DNA, 828 bp, Unknown
  Obtained from environmental sample
  misc_feature (1)..(828): n is a, c, g, or t
ttggttttccctttttgcaaactctttttaccaattccaccccaaaattttgcttccacctccaaactaataaaatcaaaaaggaataccaatcaatggaataacaataaatatatgcaattagcaattgataaagcatggagatatcaactattaacttatccaaatccagctgttggagcaacagttgtaaaagatggtaaagtactatctgtagaagcccataaaaaagctggtatgccccatgcagaagtattagcactcaaagaggcatatcttacacaatataaagatcctatattagagaagctagaatcatctttagagattcataactatttaatagcaaatcataaaagtttttttaaagattgtgaaatctatgttacactagaaccttgtaatcatacagggaaaacacctgcttgtgcaatattattagaagcagttgggataaaaaaagtcactattggaacaatagattgtaataatgaagcaacaggtggtttacaaagattaagagatgctagtatagaaactgaagttggtatttgtaaagagcaaagtgatgatttactttatccttttaaaaaatggcaaaaagataattttgttttttttaaactagcaatgagagcagatgggacagttgaaggcggatatataactacgaaggactctttaaaagtagtacatgagataagaaataatctagatttattagttataggtggagaaacagtaagaacagatagaccaactttagattcacgatttgcaacaacgaataatcctccagatattttaatatattcaaaaagaagatga

SEQ ID NO: 11692 - protein, 275 aa, Unknown
  Obtained from environmental sample
  DOMAIN (33)...(159): Cytidine and deoxycytidylate deaminase zinc-binding region
  misc_feature (1)..(275): Xaa is any amino acid
MVFPFCKLFLPIPPQNFASTSKLIKSKRNTNQWNNNKYMQLAIDKAWRYQLLTYPNPAVGATVVKDGKVLSVEAHKKAGMPHAEVLALKEAYLTQYKDPILEKLESSLEIHNYLIANHKSFFKDCEIYVTLEPCNHTGKTPACAILLEAVGIKKVTIGTIDCNNEATGGLQRLRDASIETEVGICKEQSDDLLYPFKKWQKDNFVFFKLAMRADGTVEGGYITTKDSLKVVHEIRNNLDLLVIGGETVRTDRPTLDSRFATTNNPPDILIYSKRR

SEQ ID NO: 11693 - DNA, 363 bp, Unknown
  Obtained from environmental sample
  misc_feature (1)..(363): n is a, c, g, or t
atgtgtaagccttttagttttaaagagttgcaagcaagagcaacagcactttatagaagatcaatctccttaaatacaaatattatacaaataaaagatctcactattgatattgatgcaaaaaatgtaaaaaaagatgatgtggatatacttttaacccaaaaagagtatgagcttttactatttttaatcaaaaataaaaatagaacagtttcaaatagcatgatagaagagcaactctggagtaatgaagagtatataaatagtaatgtgatacaagtcactatttataatttaagaaaaaaaatatcaaaagattttattaaaagttcaagaggactagggtatagaattgaagtttaa

SEQ ID NO: 11694 - protein, 120 aa, Unknown
  Obtained from environmental sample
  DOMAIN (47)...(118): Transcriptional regulatory protein, C terminal
  misc_feature (1)..(120): Xaa is any amino acid
MCKPFSFKELQARATALYRRSISLNTNIIQIKDLTIDIDAKNVKKDDVDILLTQKEYELLLFLIKNKNRTVSNSMIEEQLWSNEEYINSNVIQVTIYNLRKKISKDFIKSSRGLGYRIEV

SEQ ID NO: 11695 - DNA, 348 bp, Unknown
  Obtained from environmental sample
  misc_feature (1)..(348): n is a, c, g, or t
ttgaagtttaatagtttaaaaacaaaagtactattttggtttggggcggcaaccttacttgttcttatcttatttaatgttgcaatttatcattttttagaacaaaatacaagattaagtattcaaaataaactctataataaagctgtgtttataaatgatagtattaaagcaaaaaaatcagtaaaagagttgttggaaaacaaagagttagaatcatttgatgtggcaattataaaagagaataagattatatttaaaaagggggatatggcttttgagccattattaccttttttaaaagataaaaagtcgttttttgtttttaatcaagggggatgtttttaa

SEQ ID NO: 11696 - protein, 115 aa, Unknown
  Obtained from environmental sample
  misc_feature (1)..(115): Xaa is any amino acid
MKFNSLKTKVLFWFGAATLLVLILFNVAIYHFLEQNTRLSIQNKLYNKAVFINDSIKAKKSVKELLENKELESFDVAIIKENKIIFKKGDMAFEPLLPFLKDKKSFFVFNQGGCF

SEQ ID NO: 11697 - DNA, 366 bp, Unknown
  Obtained from environmental sample
  misc_feature (1)..(366): n is a, c, g, or t
atgcaaatagaaaaaataattttggaaaataatttaaaacttactgatgcaagagtaaatattttaaaaatatttacttctgccaagaaacctctttcatatgatgatttaaagaataggcttaaaatggataaagctaccttctatagaaatatgtcaaaatttgaagaagaatctatagtaaatgcctttgagtcaaatgataaaaaaagatattatgaaattaaaagaaaaccacattctcactttatatgtaatatttgtaatgatatagaatgcatatactcttttagtgatataaaaatgaagggttatgttatagaagatataattttaaaaggtatatgtaaaaaatgcaacaaatag

SEQ ID NO: 11698 - protein, 121 aa, Unknown
  Obtained from environmental sample
  DOMAIN (9)...(115): Ferric uptake regulator family
  misc_feature (1)..(121): Xaa is any amino acid
MQIEKIILENNLKLTDARVNILKIFTSAKKPLSYDDLKNRLKMDKATFYRNMSKFEEESIVNAFESNDKKRYYEIKRKPHSHFICNICNDIECIYSFSDIKMKGYVIEDIILKGICKKCNK

SEQ ID NO: 11699 - DNA, 729 bp, Unknown
  Obtained from environmental sample
  misc_feature (1)..(729): n is a, c, g, or t
atggataatacaaatcaatatctaccaatagataaaattattatagaacataacaataattttttatttaatttatatacgaaaagcacaaaagatgaagaggctagattagtatatgaaaatggcgttgatttatcaataaatgacgctaaaaatcttcttgactatccttttttatatgttgaaaaagagaaaaaaggcgtttatcaggattattataaaaattacatagaacaaaagattatacctaagaatatgaaatctttttatgaagatgtaagtaaaaatataaatagtttatttgataatccagaatcaatagaaaatgtaaaagaggcaaaagtagttgtaacagatatggtaaatactattcttcaagatgattttaaagttgaatcatttgtatcaatattatctagtgattattatacccatactcattcattaaatgtaagtgtatattccttatgtatagggaaacatatggggatggataaaaaacttttagaagaactaggaatttcagctttactccatgacttaggaaagactaaaattaatccagaaattattaataaaaatggaaaactaacagaccaagagtttaaagaagtacagaatcatccattttatggatggttattagcaaaaaaatgtggaattacaaatacaaatatattagcaggaattcgtaatcaccatgaaaaaattgatgaacaggaatcctga

SEQ ID NO: 11700 - protein, 242 aa, Unknown
  Obtained from environmental sample
  DOMAIN (144)...(241): HD domain
  misc_feature (1)..(242): Xaa is any amino acid
MDNTNQYLPIDKIIIEHNNNFLFNLYTKSTKDEEARLVYENGVDLSINDAKNLLDYPFLYVEKEKKGVYQDYYKNYIEQKIIPKNMKSFYEDVSKNINSLFDNPESIENVKEAKVVVTDMVNTILQDDFKVESFVSILSSDYYTHTHSLNVSVYSLCIGKHMGMDKKLLEELGISALLHDLGKTKINPEIINKNGKLTDQEFKEVQNHPFYGWLLAKKCGITNTNILAGIRNHHEKIDEQES

SEQ ID NO: 11701 - DNA, 549 bp, Unknown
  Obtained from environmental sample
  misc_feature (1)..(549): n is a, c, g, or t
gtgaggtgtcttccaaacggtgtacatggagcaaatagacttggaggaaactctttattagagattatacccttgggtaggctttgttctaacaatgtgctttctacactaaatggtacaactatagagcaaaaagaatattttacatatcaagaagatataaagaatattgatacaattttatcacttccaaatgagattgatttttataatattaagaaacttttaggggtagagttttataaaaatgtaggactttttagaacaaaagagaaactagaaaccactttaaaaaaagtacaacagtggaaagagcaacttccaaaaatgggagtaacagataaatcaaaaaagtacaatactaatcttttagaatttatagagttttcaaatatgttacaactttcagaagttgttattttaagtgcccttaaaagagaagagagtcgaggggcacattatagaagtgattatccacacgaagtcaaaagttttgcaaaaaaaattgtaagcaaaaataaaaaaacactacaagtggagtttatatga

SEQ ID NO: 11702 - protein, 182 aa, Unknown
  Obtained from environmental sample
  DOMAIN (73)...(176): Fumarate reductase/succinate dehydrogenase flavoprotein C-terminal domain
  misc_feature (1)..(182): Xaa is any amino acid
MRCLPNGVHGANRLGGNSLLEIIPLGRLCSNNVLSTLNGTTIEQKEYFTYQEDIKNIDTILSLPNEIDFYNIKKLLGVEFYKNVGLFRTKEKLETTLKKVQQWKEQLPKMGVTDKSKKYNTNLLEFIEFSNMLQLSEVVILSALKREESRGAHYRSDYPHEVKSFAKKIVSKNKKTLQVEFI

SEQ ID NO: 11703 - DNA, 453 bp, Unknown
  Obtained from environmental sample
  misc_feature (1)..(453): n is a, c, g, or t
atgcctataggtacaaaaatactttcattttgtgttgtaatctctgctttacttatttttaatgggtgtagcgagaagaaggaggaggattcaaaacagagtcgctggtatactcaagagatgattcaaaaaggaaagccactttatgatcaaaactgtgcttcatgtcatggtttaaaaggtcagggagtaattttaccttggactcaaaagatgtctaacggaagatatccacctccacctctaaataatgatgcacatgcatggcaccatccacttaacgcattgaggtttacaatacaaaatggtggtaagtatgttggtggagttatgcctgcattcaatgaaaaacttaatgatgaagatacagataatattattgcatattttcaaaacttttggagtgatgaattttatgaagagtggctcaaacgtggtggactaacaaaatga

SEQ ID NO: 11704 - protein, 150 aa, Unknown
  Obtained from environmental sample
  DOMAIN (43)...(134): Cytochrome c
  misc_feature (1)..(150): Xaa is any amino acid
MPIGTKILSFCVVISALLIFNGCSEKKEEDSKQSRWYTQEMIQKGKPLYDQNCASCHGLKGQGVILPWTQKMSNGRYPPPPLNNDAHAWHHPLNALRFTIQNGGKYVGGVMPAFNEKLNDEDTDNIIAYFQNFWSDEFYEEWLKRGGLTK

SEQ ID NO: 11705 - DNA, 312 bp, Unknown
  Obtained from environmental sample
  misc_feature (1)..(312): n is a, c, g, or t
ttgattttaggtggagatgataaaggtgttgatttaaatcctttgtttcaagaaataataaaatataatgtaataatatttgcaattggtacaaatactcaaaaactcattgagttatcaaaaaaatataatatcgtttgtaaaagttgtaatactttagaggaagctgtaaaaaagattacagaaaactttggatataaagttgaagactcaataaatatgctttcaccagcagcagcatctttagatcagtttaattcttatgtacatagagggactgaatttaagcgtttaatagctgaaaatagttga

SEQ ID NO: 11706 - protein, 103 aa, Unknown
  Obtained from environmental sample
  misc_feature (1)..(103): Xaa is any amino acid
MILGGDDKGVDLNPLFQEIIKYNVIIFAIGTNTQKLIELSKKYNIVCKSCNTLEEAVKKITENFGYKVEDSINMLSPAAASLDQFNSYVHRGTEFKRLIAENS

SEQ ID NO: 11707 - DNA, 435 bp, Unknown
  Obtained from environmental sample
  misc_feature (1)..(435): n is a, c, g, or t
gtgacttggtctttaaatacaccactaattataaaaaatgaggaacatctaacagcatcacttgaacagagaattgatagtgcaagagctttagcaaacaaaggtgttcttgtgggatttcactttcatccaattgttgtttataaagattatttaaatgattataaaaaaatatatgatactttaattgaaacttttactcacgaggaagtggtattaatatcaatgggaacattaacttttataaagcctgtaattaaacaacttcgaacaagagagatgaaaactaaaatactacaaatgccttttgagacaatcaatggaaaacaatcttatagtatagagacaaaaaaagagatgttttcacatctctataatagttttaaatcttggcatgggaaagtctatttttatatgtgtatggaagctacatag

SEQ ID NO: 11708 - protein, 144 aa, Unknown
  Obtained from environmental sample
  misc_feature (1)..(144): Xaa is any amino acid
MTWSLNTPLIIKNEEHLTASLEQRIDSARALANKGVLVGFHFHPIVVYKDYLNDYKKIYDTLIETFTHEEVVLISMGTLTFIKPVIKQLRTREMKTKILQMPFETINGKQSYSIETKKEMFSHLYNSFKSWHGKVYFYMCMEAT

SEQ ID NO: 11709 - DNA, 369 bp, Unknown
  Obtained from environmental sample
  misc_feature (1)..(369): n is a, c, g, or t
gtgcaattacatcaaccttacaccacagaagatattatagaattagataaagatggttttattctcgttggacgtagtagtaagctgattaaaattgcaggaaaaagaatttcagccgtacaaatagagaatattctagagaccatacctgatgttaataaagctatagtagaaatagtacacaaaaaagagcttttaagaagtgaacagataataattaccattgaagccgatgacaagatagacaaaaaaaccataaaaaataaaataagtgattattacggtgttttaacaataccatttagtgttaattatgttgataaaatcaactactcggcaatgggcaaaaaactcttatttaaatcatag

SEQ ID NO: 11710 - protein, 122 aa, Unknown
  Obtained from environmental sample
  misc_feature (1)..(122): Xaa is any amino acid
MQLHQPYTTEDIIELDKDGFILVGRSSKLIKIAGKRISAVQIENILETIPDVNKAIVEIVHKKELLRSEQIIITIEADDKIDKKTIKNKISDYYGVLTIPFSVNYVDKINYSAMGKKLLFKS

SEQ ID NO: 11711 - DNA, 627 bp, Unknown
  Obtained from environmental sample
  misc_feature (1)..(627): n is a, c, g, or t
atggaaaataaaagaatagatgagattgttttacagataaaagaacttgaagatgagcttcttgaggagtttaagaaaaaagaggagcagtttttttacagaatagaaaatgaaaaagtgaaatttcaagaaagagttattaaagagggaaaatctaaaataataagttctataaaatatctttcatcttttccattgggggttattcttaccattccttttatttgggctatgattattcctatagttatgacagatatatttgtaagtatctatcaagctatttgtttccctatttataagataccaaaagtaaaacgaaaagagtatgtgataattgatagatataatctcttttatcttgacagggtacaaaaaataaattgttggtattgtgaatattttaatggtgttgttgcatatgtaagagagatagctgcccgaacagaacagttttggtgtcccataaaacattcaaaatcattaaaagagaaacactcacgatatgataatttttttgattttggtgactatataaaatatcgagatgaaatagaaaatcaaaggttgaattttgatgatttattagagaagaaagaagagcaaaaaaaggagacagatgtataa

SEQ ID NO: 11712 - protein, 208 aa, Unknown
  Obtained from environmental sample
  misc_feature (1)..(208): Xaa is any amino acid
MENKRIDEIVLQIKELEDELLEEFKKKEEQFFYRIENEKVKFQERVIKEGKSKIISSIKYLSSFPLGVILTIPFIWAMIIPIVMTDIFVSIYQAICFPIYKIPKVKRKEYVIIDRYNLFYLDRVQKINCWYCEYFNGVVAYVREIAARTEQFWCPIKHSKSLKEKHSRYDNFFDFGDYIKYRDEIENQRLNFDDLLEKKEEQKKETDV

SEQ ID NO: 11713 - DNA, 798 bp, Unknown
  Obtained from environmental sample
  misc_feature (1)..(798): n is a, c, g, or t
gtgaatttgggcaaatatgcatctgaaaatattggttcgattatgaatgagtttgaaaagtatttttctgttgttcttgatgaaccaatcctatttgtaatctacaataaacttggtgattttagacaaagcaatgtcggtcttgaaactggaaatatagaatttaatgtcggaggacaaatacaactcgttgacaacaaggtgtttatattttacgatggtaatcatcaaaaatttgacaaaacaatacgagaagttattgcaagattatatatccgaaaaattctatatggaacagcttttacagacaaattagctaattctgcattattaaatgttcctgcttggttcgaagaaggattaatatcctacgtagcacaaccctatgatatcgacgtttttaattcggtacaggatatgttagaaaacaaaaaaagaatcaatttcaatcacctgacaggacaagatgcaatcaatattggtcattccttttggtattatattgctgataattatggagatgatgttatctcaaatatgttgtatttttctaaaattagtaaaagcataaaaaatgcagtttattttgttcttggagaaactctaaaaacaataaccatcagttggcaagaatattacaaagataaatttgacattgaaaacacaaccagccctgactttgcaaatgaagtttacaaaacaaaaacagaaaagagtctctcaaaattttcaaatttagtcctgaatggccaaaaaaatttgctttttggaagaaaatttcccaaggaaaaaatttaa

SEQ ID NO: 11714 - protein, 265 aa, Unknown
  Obtained from environmental sample
  misc_feature (1)..(265): Xaa is any amino acid
MNLGKYASENIGSIMNEFEKYFSVVLDEPILFVIYNKLGDFRQSNVGLETGNIEFNVGGQIQLVDNKVFIFYDGNHQKFDKTIREVIARLYIRKILYGTAFTDKLANSALLNVPAWFEEGLISYVAQPYDIDVFNSVQDMLENKKRINFNHLTGQDAINIGHSFWYYIADNYGDDVISNMLYFSKISKSIKNAVYFVLGETLKTITISWQEYYKDKFDIENTTSPDFANEVYKTKTEKSLSKFSNLVLNGQKNLLFGRKFPKEKI

SEQ ID NO: 11715 - DNA, 801 bp, Unknown
  Obtained from environmental sample
  misc_feature (1)..(801): n is a, c, g, or t
atggccaaggatgtcgaaaaggcaatttttgataaagagggtgatgggaaatatattaaggtccacaaaatcacacagaaagatgacaaggatatcgctgacctgtggctgatcaatgaccgtgtgaaatttgctgagcggcacagggagatcctggaggctttaggcgagttcaccttccggaggatgctgtggcgatttaatgacaaaggtgaagtggaactcgcgcagccattacgtcctgaggagcagtattggaaagaggagaaaatggagggcaagaatgggttccagaagaagatactgacattcgattatgccaactgcttcacatttcttcagaaccgaggttactggcgtatacagatgaagtcaggtgaatttcgctttgtcaagatcaatggcccagtggtggaggtggtggacaattaccacatcaaagactttgtaactgagttcacccgggtgctggataataagaaggatgtcttgaatatgatttaccggggcggtcctcagtacttgggacatgagaagctatccaacctgcagtatacttacccgttgttcgaacgtgctgagcggaccagtcaatgcttatttttcaaggataaaatttggaagatcaacaatgagggggtcaatgagcttcgttaccctgagatgaaaaacaaagtatggaaggacaaaattattgattttgatgctgagttaaccgatgagctcatcaaggtaaccaggattacttcacagaatggctccgaatatccggactatccccccgggggactttcacattga

SEQ ID NO: 11716 - protein, 266 aa, Unknown
  Obtained from environmental sample
  misc_feature (1)..(266): Xaa is any amino acid
MAKDVEKAIFDKEGDGKYIKVHKITQKDDKDIADLWLINDRVKFAERHREILEALGEFTFRRMLWRFNDKGEVELAQPLRPEEQYWKEEKMEGKNGFQKKILTFDYANCFTFLQNRGYWRIQMKSGEFRFVKINGPVVEVVDNYHIKDFVTEFTRVLDNKKDVLNMIYRGGPQYLGHEKLSNLQYTYPLFERAERTSQCLFFKDKIWKINNEGVNELRYPEMKNKVWKDKIIDFDAELTDELIKVTRITSQNGSEYPDYPPGGLSH

SEQ ID NO: 11717 - DNA, 663 bp, Unknown
  Obtained from environmental sample
  misc_feature (1)..(663): n is a, c, g, or t
ttggatttgcaaaaaatgtttaaagatccaaagcccatgcaaaccatcagtactggcgtttatgatcttaccttcaaatccagtgtgcctatttttcaccataaaaagtttattggggtgtttgaaaccattgccaagttcaactccatcgcattcaagctcaaacaaaaaaacatcgatccagtttttttagtggataaaagttatcacgcacaacttaaaagaccctttacccaaacctttttagacgactattacgttgcgaacttaaatgccaatccggaacgcattcaggacatcaagcaaaatcgacttattcaatacagtcatcaacctcttcacgcttcctattacgtcgaccaacaaaaacagcaactaatcacttattacaacctgcccaatctgaataatgagccaatggggcatttctttttattttatcctttggataaaatcgaaaccgatcagctgtcagccaataaattcagcctctacttttatgcggcaattggatatttattctttttaatcatttatttctaccaacttaataaacgtgaaaaaactcanattaccgaattcaatcaacgcctaaccgaatctgttcaccaaaaaacgcgtcaactaacgcatcagaaatatttcttacaaaacctttattga

SEQ ID NO: 11718 - protein, 220 aa, Unknown
  Obtained from environmental sample
  misc_feature (1)..(220): Xaa is any amino acid
MDLQKMFKDPKPMQTISTGVYDLTFKSSVPIFHHKKFIGVFETIAKFNSIAFKLKQKNIDPVFLVDKSYHAQLKRPFTQTFLDDYYVANLNANPERIQDIKQNRLIQYSHQPLHASYYVDQQKQQLITYYNLPNLNNEPMGHFFLFYPLDKIETDQLSANKFSLYFYAAIGYLFFLIIYFYQLNKREKTXITEFNQRLTESVHQKTRQLTHQKYFLQNLY

SEQ ID NO: 11719 - DNA, 525 bp, Unknown
  Obtained from environmental sample
  misc_feature (1)..(525): n is a, c, g, or t
atgaaaattattttacttattttttttcttttattaagtttctcttttgcaaatgatagagagttagaagctatatttaaaaaatctaatataaatggtacacttgtattaagcagtttagataacaaagaaaactatatatacaatacaaaaagagccttaacacaatatatcccagcttcaacatttaaaataccaaatacacttatagcacttcaagagcaagtgataaaagatgagtatgaaactataaaatgggatggagtagttcgaacttataaaccttggaatgaaaaccaaaaccttcaaacagcaatagctgtatcgtgtgtatggtgttatgaaaagtttgcacaaaaaataggaaaagagaactatttagaatatttacaaaaaatagactatggaaaccataaagtaggtgatgttgtctcaaagttttggttagagggagatataaaaatatctgcagtacaacaaatagagtttctacaaagactctataaaaatcaattaccattttga

SEQ ID NO: 11720 - protein, 174 aa, Unknown
  Obtained from environmental sample
  SIGNAL (1)...(17)
  DOMAIN (33)...(173): Penicillin binding protein transpeptidase domain
  misc_feature (1)..(174): Xaa is any amino acid
MKIILLIFFLLLSFSFANDRELEAIFKKSNINGTLVLSSLDNKENYIYNTKRALTQYIPASTFKIPNTLIALQEQVIKDEYETIKWDGVVRTYKPWNENQNLQTAIAVSCVWCYEKFAQKIGKENYLEYLQKIDYGNHKVGDVVSKFWLEGDIKISAVQQIEFLQRLYKNQLPF

SEQ ID NO: 11721 - DNA, 501 bp, Unknown
  Obtained from environmental sample
  misc_feature (1)..(501): n is a, c, g, or t
ttgggaaatggaaaaaacccaaaaaacccttttcaaaaccaggcaaatagggcgggtattggtgtggtattgggtgtttatgaaaaaagttttgccccaaaaaaattgggaaaagagaacctatttagaatattttacaaaaaaatagactatggaaaccataaagtaggtgatgtggtctcaaagttttggttagagggagatataaaaatatctgcagtacaacaaatagagtttctacaaagactctataaaaatcaattaccatttgaacaaaaatatatagatatcacaaaaaagatattgatagttgaacaaaatgagaactataccattagagtaaaatctggttggtcaggaacaataggttggtatgttggttatatccaaaaagcaaatacagtttggttttttgcttttaatggtgatataaatagagaaaaattaatctatagaaaacaaatagttatggaagctttaaaaataaaaggtattttatag

SEQ ID NO: 11722 - protein, 166 aa, Unknown
  Obtained from environmental sample
  DOMAIN (5)...(161): Penicillin binding protein transpeptidase domain
  misc_feature (1)..(166): Xaa is any amino acid
MGNGKNPKNPFQNQANRAGIGVVLGVYEKSFAPKKLGKENLFRIFYKKIDYGNHKVGDVVSKFWLEGDIKISAVQQIEFLQRLYKNQLPFEQKYIDITKKILIVEQNENYTIRVKSGWSGTIGWYVGYIQKANTVWFFAFNGDINREKLIYRKQIVMEALKIKGIL

SEQ ID NO: 11723 - DNA, 816 bp, Unknown
  Obtained from environmental sample
  misc_feature (1)..(816): n is a, c, g, or t
ttgaaaacggcaatggatctagattcttctgaagcaattactcttttgatttcttatggttttaatcccaatattatgattgataatcagaatattgctgattatttaatttctactgggcatgaaaatttatctctaccactaatatcaagtggattagatccaaatctattagttaatggtgatagtgagtcaattttgtattgggctgtacttgagaagaatgaagaacttataaagaaaataatttcaagtggtggaaatgtaaattttattaagagaagcaaaaatatctctgttattgatcttgctattagattgttaccagatagctatttgaaatattttattaaagatgatacagatctttctattaagaataaaaaaaatagcagttatttgatgattgcactacaaaataaaaagatagaaacagctattaaattagttaaatctagtgcttatttagaaaaagaatttctgcatgaagattttttattaaaaatagtaatgtattggacagagggatcagaacaggtagcagatattttgttaaataaagataataaaattaatgaacatttacctttatatcaagaagcaataaaaaacttaaatattaacgcagttaaatggttgcttggtcacgggttttccccctattctgaatatatcgatgaataccaatggtacggatataatgccttcaatgaaattgatcttatgcggaagaagttaagatcaattgatttagatcctcatgaaaaagatcagaagattttggatgaaatagagagtattatttctaatccataa

SEQ ID NO: 11724 - protein, 271 aa, Unknown
  Obtained from environmental sample
  misc_feature (1)..(271): Xaa is any amino acid
MKTAMDLDSSEAITLLISYGFNPNIMIDNQNIADYLISTGHENLSLPLISSGLDPNLLVNGDSESILYWAVLEKNEELIKKIISSGGNVNFIKRSKNISVIDLAIRLLPDSYLKYFIKDDTDLSIKNKKNSSYLMIALQNKKIETAIKLVKSSAYLEKEFLHEDFLLKIVMYWTEGSEQVADILLNKDNKINEHLPLYQEAIKNLNINAVKWLLGHGFSPYSEYIDEYQWYGYNAFNEIDLMRKKLRSIDLDPHEKDQKILDEIESIISNP

SEQ ID NO: 11725 - DNA, 717 bp, Unknown
  Obtained from environmental sample
  misc_feature (1)..(717): n is a, c, g, or t
ttgcgaagttatgctcttttacgtatgcgtatgctctactatgtctatgcattggggtatgaagccgcggaaacaggaaaccctattttacgaccaatgccatttgagtaccctcatctagatgaaagctataaactcaccgaacaatactttatgggaagctatttacttgttggtaccttttcaaagtcgatttttttacctgaaggccaatggtatgatatgtggacgggtaaaattcatgcaggtaaaaataagaaaaaggcgattaaaatacctgcagataaaggtggtcacctactactcaaagagggggggattatcccctttgttcctgaacaaaaatacgtgggagaaaaaccctttgagattgttgatcttttaatatttccctcatcgaaaaaatcagaatttactttgacggtggatgatggagttagcttaaattatcgcaaaaatgactgtacgaagttgaaaataagttgtcagcgacgagatggcgtaattgatataacgtttgataaaaaatcaaaaaagaaagattatctcaagggggttacctttaacctgagtttgatatgcggcggtggcatagaatcggttgagattgtggggtcaaagaaaaaactagaattcacagtggataatcgatgcaatattaagattgacaacattgatatacgaaatggcttggagatatattttaacaatgaataa

SEQ ID NO: 11726 - protein, 238 aa, Unknown
  Obtained from environmental sample
  misc_feature (1)..(238): Xaa is any amino acid
MRSYALLRMRMLYYVYALGYEAAETGNPILRPMPFEYPHLDESYKLTEQYFMGSYLLVGTFSKSIFLPEGQWYDMWTGKIHAGKNKKKAIKIPADKGGHLLLKEGGIIPFVPEQKYVGEKPFEIVDLLIFPSSKKSEFTLTVDDGVSLNYRKNDCTKLKISCQRRDGVIDITFDKKSKKKDYLKGVTFNLSLICGGGIESVEIVGSKKKLEFTVDNRCNIKIDNIDIRNGLEIYFNNE

SEQ ID NO: 11727 - DNA, 936 bp, Unknown
  Obtained from environmental sample
  misc_feature (1)..(936): n is a, c, g, or t
ttggtggaggatttggtaaaaaacattcccttttggggaaaagctttgatacaatttattgatgattttggtcaaattgttcaaaatgctatagaaaataatttttattttaaaacttataaattaaatattgattttcaaaaatatcaactgttaaactcaaaatctggatttaaccaaaaagttgatttagaactaagtactgaaaagattactgatcaagaagattttgaagagaatgagagaaataataaagtacaagttgttttatcatataacttttataataaagggagagataaaaataagatattaactatgaactctttagttagagaattgaactatagactcaaagaggagataagaaaactaaagtggacactttctaaacttcatagatcaattgtatctgttacaaatgcttcagtaagtacaaaagcagaagtattagcttcacaagagatggtaaatgcttattgggatggttttaaattaggtgagcaagatttacaagagttattgcaagggcaaagacaattaaatagtgcacagttagatttaatagaaaataaaaaaagtgctattactgattattttaaacttttatctaatacaggggatcttttatcatattttaaacttaatattaatgaagataattttatagattttacaagaagtgattatacaaatttattaaagacacctgctcaggatgctttagtaaatgatttagaaaaaaataaagaaaaagagataacagcaagcatagataataatgtcacagagaatatagatagtaatacaacaattgcagtggatgaaaacttaacaaagatagaagatagcaatacagcagtggtcgccgataataacacaacagctacaaaaaatagtttagatgatttattagagtttgagagtaaattttag

SEQ ID NO: 11728 - protein, 311 aa, Unknown
  Obtained from environmental sample
  DOMAIN (23)...(207): Outer membrane efflux protein
  misc_feature (1)..(311): Xaa is any amino acid
MVEDLVKNIPFWGKALIQFIDDFGQIVQNAIENNFYFKTYKLNIDFQKYQLLNSKSGFNQKVDLELSTEKITDQEDFEENERNNKVQVVLSYNFYNKGRDKNKILTMNSLVRELNYRLKEEIRKLKWTLSKLHRSIVSVTNASVSTKAEVLASQEMVNAYWDGFKLGEQDLQELLQGQRQLNSAQLDLIENKKSAITDYFKLLSNTGDLLSYFKLNINEDNFIDFTRSDYTNLLKTPAQDALVNDLEKNKEKEITASIDNNVTENIDSNTTIAVDENLTKIEDSNTAVVADNNTTATKNSLDDLLEFESKF

SEQ ID NO: 11729 - DNA, 507 bp, Unknown
  Obtained from environmental sample
  misc_feature (1)..(507): n is a, c, g, or t
atgaataaactagtaaaagaaatagagaattctaatttacaagataacacagaaagaataaaaaaaattaacacaaaacaattaattggatttgaaaaaagtagtacgatgtattctttagcaatttctaacatgttatttaggggggatgggaaatctcagatttttaatgaagactttttttcagtggaaacaagtaatatattagataatttacctaataaacctacaattggttttattaaccctccatatggaggtaaggatgctaaagcaaatcccactaaaaaagagattctatttttggaaaggatgttagattattgtagtagatatgggataattattgctccattatccacatattttaaagatgatgttgatcgagatcggatattatcaaaacatacattgaagtatgttataaatatgccgagtgaattatttcaaccaaatgcgtctatacatacagcaattggagtttttgaaacacataagccctcataa

SEQ ID NO: 11730 - protein, 168 aa, Unknown
  Obtained from environmental sample
  misc_feature (1)..(168): Xaa is any amino acid
MNKLVKEIENSNLQDNTERIKKINTKQLIGFEKSSTMYSLAISNMLFRGDGKSQIFNEDFFSVETSNILDNLPNKPTIGFINPPYGGKDAKANPTKKEILFLERMLDYCSRYGIIIAPLSTYFKDDVDRDRILSKHTLKYVINMPSELFQPNASIHTAIGVFETHKPS

SEQ ID NO: 11731 - DNA, 618 bp, Unknown
  Obtained from environmental sample
  misc_feature (1)..(618): n is a, c, g, or t
ttggttgtttcagatcattgtactgtgatttgtattaaagacaaaaacataaaattagataattatatatcattatttttaaaacctattatagagtcaatgaaaaataaatatagttttgctagagaaattaataatgcacgattgaaaaaagagaatatattacttccagttcaagatgacaatactcctgattggaggcttatgaggagttatattaatgatttatctaaaaagattatatataataagaaaaaaagagatacacgaatttttaaaaaacagatagatttaaatgtaaaaaaatggaaaacatttaaaattaaagacgtttttaatctagaaaagggagaaagattaattgttgcaaataggggacaaggggatatgccatttttgacagcatcttctattaataatggtgtttctagttttattgattatgaagtatttaaagataaaaaaaaggtatttgaaaataaaattacagttgatatgttttgtaatgttttttatcaggattttaaatattttagtgatgataatattcatactttattatttaaagataaagaaaatgaccagttttataaaaataaatatgctaattgtgattag

SEQ ID NO: 11732 - protein, 205 aa, Unknown
  Obtained from environmental sample
  DOMAIN (4)...(76): Protein of unknown function (DUF1603)
  misc_feature (1)..(205): Xaa is any amino acid
MVVSDHCTVICIKDKNIKLDNYISLFLKPIIESMKNKYSFAREINNARLKKENILLPVQDDNTPDWRLMRSYINDLSKKIIYNKKKRDTRIFKKQIDLNVKKWKTFKIKDVFNLEKGERLIVANRGQGDMPFLTASSINNGVSSFIDYEVFKDKKKVFENKITVDMFCNVFYQDFKYFSDDNIHTLLFKDKENDQFYKNKYANCD

SEQ ID NO: 11733 - DNA, 450 bp, Unknown
  Obtained from environmental sample
  misc_feature (1)..(450): n is a, c, g, or t
ttgaagcctgcaaggtctagttatatttacaacatgcaaaacaccttcattactatagctaaatttcaatattctacagaagccgaaatcataaaaggccgattggagtctgatggtattcaagtatttctaaaagacaatattaccattgacaccgaccctttggtaagtcaggccattggtggagtaaaacttaaagtactggctaaagacgaagaacaagctagagccattctaaaatcaatcaagatttattctgtagataatgaaggacatcctatggtttgccccaattgcaaaggtgaacatattaaaatgtactccaccattactaattttaaatccttgatgtcttttcttattggtctcctgttctttaccttaccttttagtacacgctaccaatacaaatgcgaagactgtaaaacggaattccctacaacaacttaa

SEQ ID NO: 11734 - protein, 149 aa, Unknown
  Obtained from environmental sample
  misc_feature (1)..(149): Xaa is any amino acid
MKPARSSYIYNMQNTFITIAKFQYSTEAEIIKGRLESDGIQVFLKDNITIDTDPLVSQAIGGVKLKVLAKDEEQARAILKSIKIYSVDNEGHPMVCPNCKGEHIKMYSTITNFKSLMSFLIGLLFFTLPFSTRYQYKCEDCKTEFPTTT

SEQ ID NO: 11735 - DNA, 822 bp, Unknown
  Obtained from environmental sample
  misc_feature (1)..(822): n is a, c, g, or t
atgtatgatgataaaaataaactagaacaagcacttatccctattagtgaagagatgcaaatacatattttcaaaaacttagctggcttatttgagctagatattatccctatacaatatagagaagttgaacaaaatataaatataaatataacatcttcaccttatcaagatatagtagaaacaacaggaaataaagcactagcaaatgaatttatactagcatttaaaaaatctgttaactttaaaagacttcaaaaagatgacactgttgctatagtatttaaacaaaaaattagagaggggagatattttggtacccctgaaatacttggagcttctgttgtaatgaaaagaaaaactcattatatttttcaaaatccagatgataaaagatattataatgaagatgggaaaagtcttactagctttttattaaagatacctcttcgatataaaaggatatcaagtagatttacccaaaaaagatggcatcctatcttaaaaagatatagagctcacttgggagttgactttgcagccccaacagggagaaaaatatttgctactgccgatggaagagttattcacaaagggagaaaaggtggttatggaaaaactgttatgatacgacatagtaatggtttaaaatcactctatggacacctcaatagctatagcaatataaaagttggttcgtggattaaacaaggtactttttattggaagagttggaagtacagggacgaagtaccgggacctccccctaccttttggtcctttaaaaaatggggagagcctataatcccctttgaaaaataa

SEQ ID NO: 11736 - protein, 273 aa, Unknown
  Obtained from environmental sample
  DOMAIN (172)...(255): Peptidase family M23
  misc_feature (1)..(273): Xaa is any amino acid
MYDDKNKLEQALIPISEEMQIHIFKNLAGLFELDIIPIQYREVEQNININITSSPYQDIVETTGNKALANEFILAFKKSVNFKRLQKDDTVAIVFKQKIREGRYFGTPEILGASVVMKRKTHYIFQNPDDKRYYNEDGKSLTSFLLKIPLRYKRISSRFTQKRWHPILKRYRAHLGVDFAAPTGRKIFATADGRVIHKGRKGGYGKTVMIRHSNGLKSLYGHLNSYSNIKVGSWIKQGTFYWKSWKYRDEVPGPPPTFWSFKKWGEPIIPFEK

SEQ ID NO: 11737 - DNA, 807 bp, Unknown
  Obtained from environmental sample
  misc_feature (1)..(807): n is a, c, g, or t
atggtatttactgggcttaaaaaatatgatgaaacaaaagctggtgcatacatgcaaactgagctttttagtgcacatattaatgaaacaatacaagattcaatagatagattaaaatttttaaaaaaaaatcatcatatagaaaatattcatcaagtttttgtagtagatgacgatacaacacttttagcttcaatccctctagaagacttggtcacttatgactttaaactaaaatataaaaaaattttagaaaaaaataaagagaaaaactataaaccaatctctgtagttggtgatgataacattggtgatgttgttaaacaatttgaaaaatacaacctttcagtagtttcagtaataggttataaaaataggttgttagggagaatcactagcgatgatattttggatgtaatagaacaaaatgcaacagaacagatgtatcaactagctggggttgatgaagattatgaacaagatgaggaactatttcaaacaggaagaaaaagagcttcatggttatttataaatcttttaacggcaattatggcatctttagtaattggtttttttgatgaaacaatcaaagagtatattgcactagctattttaatgcctatcgtagcttcaatgggtggaaatgctggaactcaaacacttgcagttatggtgagacaattagcacttggggatatcgatgaatacaatagtaattatgctgtaaaaaaagagatantttttatcactactgaatgggatattatttgctgtaattttaggagctattgcttttgcttggtttga

SEQ ID NO: 11738 - protein, 268 aa, Unknown
  Obtained from environmental sample
  DOMAIN (88)...(141): CBS domain
  misc_feature (1)..(268): Xaa is any amino acid
MVFTGLKKYDETKAGAYMQTELFSAHINETIQDSIDRLKFLKKNHHIENIHQVFVVDDDTTLLASIPLEDLVTYDFKLKYKKILEKNKEKNYKPISVVGDDNIGDVVKQFEKYNLSVVSVIGYKNRLLGRITSDDILDVIEQNATEQMYQLAGVDEDYEQDEELFQTGRKRASWLFINLLTAIMASLVIGFFDETIKEYIALAILMPIVASMGGNAGTQTLAVMVRQLALGDIDEYNSNYAVKKEIXFITTEWDIICCNFRSYCFCLV

SEQ ID NO: 11739 - DNA, 852 bp, Unknown
  Obtained from environmental sample
  misc_feature (1)..(852): n is a, c, g, or t
gtgttntnnnnngtggctcgncgggcgctcttaaataaagagattattaaagagggtatctctttctcaaatgttctttctaatgatgtttataaagaagacactaacctatcggaaaagaaaaagttccttaatgacttctggagcaaagacttaaatctctcccctgccttgaaaggaacaacccttgaggaaaaaattgcaaatattatagcttattttgaagccattgaaaaggatgaaaaagtaggaatatcaattgatggttatgagaaattattatcagatttgggagaaaccttacctaaactaaatcaacaaattaaggaagaattcgaattacaggaagataatgtcttaaaaagctatctactacttgatttcaatataaaacctcgagatattatagagattatatacccaatagatttattagcattttgcaaagcaagagaaatatcaactagaggtaatgaaattcaaaatattcttgatgcttataaagattcagaaaacttatatctagagaattatattaacattggctttcgtgaccttaacctgctcaaagaaaacggtatacgaataaaagaggcaaatttaggattgaaatttgaagagcttacaaaatcaatatttactcaactaggtttcaatgttgatgaacaacttaaaaagcaacttaatactaaaaaagacaaaatagacatccttcttaatctggaaaataatgaattaatactcatccgatgtaaaacagtaaaagaaagcggctataataaatttagtgctgtttccagacaaatgaaagcatatatgaacctagccaaagccaaaccatttcaaaaataa

SEQ ID NO: 11740 - protein, 283 aa, Unknown
  Obtained from environmental sample
  misc_feature (1)..(283): Xaa is any amino acid
MXXXVARRALLNKEIIKEGISFSNVLSNDVYKEDTNLSEKKKFLNDFWSKDLNLSPALKGTTLEEKIANIIAYFEAIEKDEKVGISIDGYEKLLSDLGETLPKLNQQIKEEFELQEDNVLKSYLLLDFNIKPRDIIEIIYPIDLLAFCKAREISTRGNEIQNILDAYKDSENLYLENYINIGFRDLNLLKENGIRIKEANLGLKFEELTKSIFTQLGFNVDEQLKKQLNTKKDKIDILLNLENNELILIRCKTVKESGYNKFSAVSRQMKAYMNLAKAKPFQK

SEQ ID NO: 11741 - DNA, 780 bp, Unknown
  Obtained from environmental sample
  misc_feature (1)..(780): n is a, c, g, or t
ttgctaaaagaatggaaagataatgctgataaacaaactattttagataagattactttatctgatgaggaaatccaaaaaatattccaagcaggaaatttatccagagacgttcaatacaagctacatcaattgctaaaagtcttaatgaaaccactggcaatcagatcgtctggattattagaagattctcaatctcaaccatttgcagggatctataaaacctatatgatccctaataataatgcttctttaaaagagcgacacaatgaattaatgaatgcagtaaaacttgttttttcatcagtattcttaaaaagtgccagacaatacatccgtagtataaatttcaaagttgaagatgagaaaatggcagtaatcatacaagaggttgtgggatccaattttgatgatctatattatcctcatatatctggtgttgcgcaatcgtataactattatcccacagctcatttaaagaataaagacggaatcgcaacaatcgcagttggactggggaaggctgttgttgatggagaaaccaattatattttttgtccaatttatcccaaattatcaataatttcaacagaaaaaatgataaaaagtagtcagaaggaactatatgctttgaatctatcaccgaaggataactcaaatagttttgaagaagatggggtttccaaaattaagatcagaaaattaagaaataatggatcactggctaacctggcttcgatttgggattatgaaaatgatattctaaagatggtagactaa

SEQ ID NO: 11742 - protein, 259 aa, Unknown
  Obtained from environmental sample
  misc_feature (1)..(259): Xaa is any amino acid
MLKEWKDNADKQTILDKITLSDEEIQKIFQAGNLSRDVQYKLHQLLKVLMKPLAIRSSGLLEDSQSQPFAGIYKTYMIPNNNASLKERHNELMNAVKLVFSSVFLKSARQYIRSINFKVEDEKMAVIIQEVVGSNFDDLYYPHISGVAQSYNYYPTAHLKNKDGIATIAVGLGKAVVDGETNYIFCPIYPKLSIISTEKMIKSSQKELYALNLSPKDNSNSFEEDGVSKIKIRKLRNNGSLANLASIWDYENDILKMVD

SEQ ID NO: 11743 - DNA, 480 bp, Unknown
  Obtained from environmental sample
  misc_feature (1)..(480): n is a, c, g, or t
atggtgagtgggtttatctcgagtgaaaaagagtacatttttgagaagatggattatgtggcacttggtcactggcatggcttttcatctgtcggcaaacatgaaaatgtctactacagcggttcacccgagagaataagtttaaatgacaaacgaaactctaaaggttttgtgcagatcaacttagatgacaactctaaaactgcctcactatttggctctacagatatagagttcaaagagataaaaatccgccctatcgtgcaaaaagagatcgattgtgaagattatgagaactcacttgaaagcgttgatgcaaccgatacaaaagatgccatagttgaagtaaaactgaaaaacatcacacccatgcaatcaattgatattcaaaactctcagactcaaagagctattttcagatgccatgagtgtgagcataaaaagagagtcaaaacaaataaaacacctctacgtgtgtga

SEQ ID NO: 11744 - protein, 159 aa, Unknown
  Obtained from environmental sample
  misc_feature (1)..(159): Xaa is any amino acid
MVSGFISSEKEYIFEKMDYVALGHWHGFSSVGKHENVYYSGSPERISLNDKRNSKGFVQINLDDNSKTASLFGSTDIEFKEIKIRPIVQKEIDCEDYENSLESVDATDTKDAIVEVKLKNITPMQSIDIQNSQTQRAIFRCHECEHKKRVKTNKTPLRV

SEQ ID NO: 11745 - DNA, 552 bp, Unknown
  Obtained from environmental sample
  misc_feature (1)..(552): n is a, c, g, or t
atgaaatacaaaataatatttatagcggcctttatggcatttagcactttggttttgtctcaaacaactatcgacaatgtactaatacagatcgaagaaaataatactaaactggctgctctaagaagtagtttggatgctgagaaaattggcaataaaacaggaaggtatttgcaaaacccggaagtggaattttactatatgtggaatagcttaccggaaattagtaatagaactgatatttcaataaaacaggggtttgattttccaacagcatataagcacaggaataatattgctgacctgaaaaatcaacaacttgaaattcaatatagaaaagaaatcagggaattattactggaagcaagattggtttgtctggatttaatttattaccaaactttaaagcatgagctggtacaacgattgaaccatgcatcagatatagcagagttatacaaaaagaagtatgaaaatggggagagcaatattattgaatataataaggttcaactagcattgcttaatattgagaataaggtgagaaaatga

SEQ ID NO: 11746 - protein, 183 aa, Unknown
  Obtained from environmental sample
  SIGNAL (1)...(18)
  misc_feature (1)..(183): Xaa is any amino acid
MKYKIIFIAAFMAFSTLVLSQTTIDNVLIQIEENNTKLAALRSSLDAEKIGNKTGRYLQNPEVEFYYMWNSLPEISNRTDISIKQGFDFPTAYKHRNNIADLKNQQLEIQYRKEIRELLLEARLVCLDLIYYQTLKHELVQRLNHASDIAELYKKKYENGESNIIEYNKVQLALLNIENKVRK

SEQ ID NO: 11747 - DNA, 582 bp, Unknown
  Obtained from environmental sample
  misc_feature (1)..(582): n is a, c, g, or t
gtgagttttgcaggtatggcacaagatagtattgaatctttacaacaaatgattgagaactctttacatgcagattttattattacaactgggggaataagtgttggagaggctgattttacacaagaagcatttgaacaatttgagatggatatattgtttaatggaattagtattaaacctggaaaaccaactatttttggaaaacttggtaatacttatattcttaatcttcctgggaatcctcttgctgctgctttgatatttgaagtgtttggaactatcattattcaaaaactttctggaagcaaagatatatttcataactacatcactacaaaaataagtgaagatttaaaaaataaaaaagggagaacaactataattcctggttggtttgatggagactattttatcccctctaaaaaaagatttcctggtatggttggtgttttgcataagtgtaatagtatgataatactgaataaaaatcttacaggattactcaaagatgatagtgtaaaagttatcccaattaattggaaattttacacagatattcaaaaagatttttttaactaa

SEQ ID NO: 11748 - protein, 193 aa, Unknown
  Obtained from environmental sample
  DOMAIN (112)...(180): MoeA C-terminal region (domain IV)
  misc_feature (1)..(193): Xaa is any amino acid
MSFAGMAQDSIESLQQMIENSLHADFIITTGGISVGEADFTQEAFEQFEMDILFNGISIKPGKPTIFGKLGNTYILNLPGNPLAAALIFEVFGTIIIQKLSGSKDIFHNYITTKISEDLKNKKGRTTIIPGWFDGDYFIPSKKRFPGMVGVLHKCNSMIILNKNLTGLLKDDSVKVIPINWKFYTDIQKDFFN

SEQ ID NO: 11749 - DNA, 969 bp, Unknown
  Obtained from environmental sample
  misc_feature (1)..(969): n is a, c, g, or t
ttggtttgtggtgtggcaattatanaaccgacctatgatgaattagaaaccttggctataagtcatttcaggaacaacaaaactgattctgcaattattattatggaatatgctcttaaaagttttccggaagaaataggaaggtcaacaagaacgctggctcaagtttatacaagagttggtaatttttcaagagcaattgaaatatggaaaattggcattaacaagggctatacctataacctaaataacattgcttatcaaaaatattacaaagacaatgttgattttgaaagacttgctaaaatggagaaaagcaagatggatgcctcacatttaaagcatgaaataatattacccacaggttttaacaataaaaaaacctaccctgtacttttcatttttcatgggaacaacagaaatattgtaaaatcaaaaatctcgtggaaagcaccaataatgactcaggagtttataactgtatttttacagtcatatatcccaagttctcctaccaattttaattgggtacctaatgatgacaaaataaaaaaggagtttaaagaaatttatgatcatgttttaaaaacttatattgtggatgactctaaaataatttttgctggcatgtctgccggaggaaaaaaagctctggaatttacaataaataaagattttcctgccacaggattggtattaaactgcccggtaattccccccaacattacagatgagatgatcacgtattttgttgaaaaaaacaaaaaaattggaatcatacccggcgagaaggattttgcccttaaaaatgccaaaaagctttatttagcaaaatttgatgaaacaagccgggacaaacccaagatcatttataaaataaaggatttagggcccattcttttggccggcaattttttccccaatttattagaaggagattttttgaaggggggggtaattcacaaataa

SEQ ID NO: 11750 - protein, 322 aa, Unknown
  Obtained from environmental sample
  misc_feature (1)..(322): Xaa is any amino acid
MVCGVAIIXPTYDELETLAISHFRNNKTDSAIIIMEYALKSFPEEIGRSTRTLAQVYTRVGNFSRAIEIWKIGINKGYTYNLNNIAYQKYYKDNVDFERLAKMEKSKMDASHLKHEIILPTGFNNKKTYPVLFIFHGNNRNIVKSKISWKAPIMTQEFITVFLQSYIPSSPTNFNWVPNDDKIKKEFKEIYDHVLKTYIVDDSKIIFAGMSAGGKKALEFTINKDFPATGLVLNCPVIPPNITDEMITYFVEKNKKIGIIPGEKDFALKNAKKLYLAKFDETSRDKPKIIYKIKDLGPILLAGNFFPNLLEGDFLKGGVIHK

SEQ ID NO: 11751 - DNA, 801 bp, Unknown
  Obtained from environmental sample
  misc_feature (1)..(801): n is a, c, g, or t
ttggggcccctccgcccacccccccctttttttaaaaccctttccccggatacatttcttacaaggattttttgttgggggaaattttattgggcccttcttctttatttaaggggccacaaaaatgggccaggggaaaaatttaggaaaatctcggccaaaaggatgggaagcacctttttattacccaaaaccaaccaatttattcctttttttttattggaaaatgaaggagattgtgaaaattttttttctccagggcattttaatttccagccgaagaagagggagaaacacaatcttaaaagattaattcttcaacaaaaaggtgaaaagctaaaagttgaaaactctattcaaaaaagagttgaagaagaagtaaaaaagatgatggcatctagtggtggagagaaagatgctcaaaataaaaagctaatccagcttgtaaatgatttagatggagagattaaaaggttaagaaataaaaatatagataataactccagagttgtaacttctgaaaaaaagctccaagaaactatgacaagatttgataatatgcaaattgcatatcaaggaaaaatatcaggtatgaatagtaccattcaaactttggccaaaaaatttgaagacttacttaaaaaaagcaaatcaacatctgaaaaattagagaaatcacaaacatcaataactattttacaaagttatatagatgattacagaaaaaaaatagctgatctagaagatgttattacaagttatgaaaaagagctaaaagattcaaagtcttataagtattaa

SEQ ID NO: 11752 - protein, 266 aa, Unknown
  Obtained from environmental sample
  misc_feature (1)..(266): Xaa is any amino acid
MGPLRPPPPFFKTLSPDTFLTRIFCWGKFYWALLLYLRGHKNGPGEKFRKISAKRMGSTFLLPKTNQFIPFFLLENEGDCENFFSPGHFNFQPKKREKHNLKRLILQQKGEKLKVENSIQKRVEEEVKKMMASSGGEKDAQNKKLIQLVNDLDGEIKRLRNKNIDNNSRVVTSEKKLQETMTRFDNMQIAYQGKISGMNSTIQTLAKKFEDLLKKSKSTSEKLEKSQTSITILQSYIDDYRKKIADLEDVITSYEKELKDSKSYKY

SEQ ID NO: 11753 - DNA, 663 bp, Unknown
  Obtained from environmental sample
  misc_feature (1)..(663): n is a, c, g, or t
atggcagcgtctgtatctaaagaacaagatagtttagaatctatatatgatgttacatctatatacgatgaatatttttcaaatataaaagaggatttggaagcttttaatcatgataatatgttacttactattgctgttgtgtctttctttagggttatagatagaagcaatagtcatcaagtagaacttatagaaaaagcttttaatatttcaattgatgacctgtggaaatgtgttgaagaattaaatcatttagaaatatttgatttatatgaaaatgaagttgtaaaagtatcagatcaaatattatcgacttatctattttacaaaattgtttttgttgataaaaagattccaattgaaatgtttttagaacatttttttccacaatacaaacagaaagttgtagaggttcttaatcctctgttaagtacatttgattctaaatatataattaatgtactaaaagaaccagtaaatcaaatttggaataaatacctaaaagatgaatcaagcttatatgatgtcatgagtgttttttggtttttaaagcaaacagatatattaatttattttaaaaataaaatagatggcttagaagtagaagaaattgatattgataatatagatttttggactagatcaaaaaacaatcaataa

SEQ ID NO: 11754 - protein, 220 aa, Unknown
  Obtained from environmental sample
  misc_feature (1)..(220): Xaa is any amino acid
MAASVSKEQDSLESIYDVTSIYDEYFSNIKEDLEAFNHDNMLLTIAVVSFFRVIDRSNSHQVELIEKAFNISIDDLWKCVEELNHLEIFDLYENEVVKVSDQILSTYLFYKIVFVDKKIPIEMFLEHFFPQYKQKVVEVLNPLLSTFDSKYIINVLKEPVNQIWNKYLKDESSLYDVMSVFWFLKQTDILIYFKNKIDGLEVEEIDIDNIDFWTRSKNNQ

SEQ ID NO: 11755 - DNA, 843 bp, Unknown
  Obtained from environmental sample
  misc_feature (1)..(843): n is a, c, g, or t
atgatgattcgtattttctctccagtggatagttttaatagtaatccagcaaatatctctcaaaaccaaacaacatcatcgcactcattcaagcttgacagtggtgaccatccacattttagctggattcaaaatcttggtaattttgagggggttgcatatacgtattgggacggagaaaaattatcaaatactgatggaacagcatattctccggtagcatcccccgagataaatacacctataattattgcaaaatgtccaagaaatgaaaagaaatattacaattttccaactctactcttagattcaaatggaaacccaaacatcacatggaaaatcatggaggagttcgaaaacaatttttcaaattcgctttgttatctgaaatgggatggcttgaactggacaacattttcagatgaatcagtaacaaccaaaaactatgataataccaaattcttttcacccgacagcatgatttatgattaccgatttgtgctaagcaaagctgagaaaccagttttcctcatagatggtagcaacaagaatctaaaatatttgagatacaatgattcgatatggatgagtgttgatggacaaaaaattaatcttgaaattgatagtgaatccagaatttttaaaacccttgaggaccaaaatatttcaagcgtttcaactaatcttgatgatgatggcatccctcatatttttttccaaaagtatattccaggaaatggatatgaaaaagataggatagaactatattaccagaaatggaatgataaatttcccagaaaaaatggtctcccattttgcagggagttagtgaaggttgattaa

SEQ ID NO: 11756 - protein, 280 aa, Unknown
  Obtained from environmental sample
  misc_feature (1)..(280): Xaa is any amino acid
MMIRIFSPVDSFNSNPANISQNQTTSSHSFKLDSGDHPHFSWIQNLGNFEGVAYTYWDGEKLSNTDGTAYSPVASPEINTPIIIAKCPRNEKKYYNFPTLLLDSNGNPNITWKIMEEFENNFSNSLCYLKWDGLNWTTFSDESVTTKNYDNTKFFSPDSMIYDYRFVLSKAEKPVFLIDGSNKNLKYLRYNDSIWMSVDGQKINLEIDSESRIFKTLEDQNISSVSTNLDDDGIPHIFFQKYIPGNGYEKDRIELYYQKWNDKFPRKNGLPFCRELVKVD

SEQ ID NO: 11757 - DNA, 780 bp, Unknown
  Obtained from environmental sample
  misc_feature (1)..(780): n is a, c, g, or t
ttggctgnagtgcgaccagaacattctgatcttagtggatatcaaactaaagtagatataaatattataggcagcaagatagtggagtctagcagtgcagagtatcttctaaagccaagaaataaaaacaagagtaattactttaatgctgatgaaaacggaaagaagagatattatccgtacatcgcagtaaatgagcatttgtttatgacctttgccaaaaatgaactagcttttaatgttccatacacaggtatagtaaaagcgaaagacgtggactaccattacgttacgaagagatatgacagaatagatggactaaagtataaccaagtggactttgcacaagtactaagtgttagaagtgctgataaatataaaagtagcagtgaagaattatttagagcaatagacaaaaagctgtcatccaaaacttctaaactagaagcgttaatgttctattattacagctatttgattaagcatgctgatttgcatctaaaaaatattggcgcgttagaaattggtaataagaagtatatactagctccgctgtatgacttaatatcggttggtgtctacaatggggaaagtttggatttaggcttgccaatgaaagagccattcaagaaaccaaagaactggaaaattgacgacttctacaagctcgctaaacttgttgggatttcagaagtaatgtttaaaaaagaggctagagcaataacagaaaaatatataactataatgcctgaatatataaagaaactagaaaatttttga

SEQ ID NO: 11758 - protein, 259 aa, Unknown
  Obtained from environmental sample
  misc_feature (1)..(259): Xaa is any amino acid
MAXVRPEHSDLSGYQTKVDINIIGSKIVESSSAEYLLKPRNKNKSNYFNADENGKKRYYPYIAVNEHLFMTFAKNELAFNVPYTGIVKAKDVDYHYVTKRYDRIDGLKYNQVDFAQVLSVRSADKYKSSSEELFRAIDKKLSSKTSKLEALMFYYYSYLIKHADLHLKNIGALEIGNKKYILAPLYDLISVGVYNGESLDLGLPMKEPFKKPKNWKIDDFYKLAKLVGISEVMFKKEARAITEKYITIMPEYIKKLENF

SEQ ID NO: 11759 - DNA, 747 bp, Unknown
  Obtained from environmental sample
  misc_feature (1)..(747): n is a, c, g, or t
ttgtttacaaactggtctgctggaggagagaattcgtatgctttaacgggattacttattttttcgctaaattactctaaggaaaaaaatgattgggcaaacactttagacataggatatggcattcaaaaacaaggcgctctagaatatcgcaaaacggatgatcatattgatttcttatctaaatatggacgaaaagtatcaaaatcattatttattagtgcaatgcttaactttaaaacacaaatgagtgatggaaaaagatatacccctgacaccgccattatctcaaagctaatggctcctggctatttacaaggagcagttggtatggaatataaacctaacgaaaaattctatgctgttttatctccaatagctggcaaattaacaatggttcttgatgatactttatcatctcatggatcatttggtgttgatcctggttcaaaaataagaatggaacttgggggatctgttaatgtcggtgttaaaacagaaattatgaaaaatattagcttaaattcaacccttgggctttttacaaattatcttgaaaatgctcagaatattgatgttgattggaaggttttaataagtatgaaaatcaataattacctttcggcaaatataaatacgcatttaatatttgatgatgatattgcttatgttgatgaaaaaggcgaacatggagcacgagtacagtttaaagaagtttttggtgtagggttaacgtataaattctaa

SEQ ID NO: 11760 - protein, 248 aa, Unknown
  Obtained from environmental sample
  misc_feature (1)..(248): Xaa is any amino acid
MFTNWSAGGENSYALTGLLIFSLNYSKEKNDWANTLDIGYGIQKQGALEYRKTDDHIDFLSKYGRKVSKSLFISAMLNFKTQMSDGKRYTPDTAIISKLMAPGYLQGAVGMEYKPNEKFYAVLSPIAGKLTMVLDDTLSSHGSFGVDPGSKIRMELGGSVNVGVKTEIMKNISLNSTLGLFTNYLENAQNIDVDWKVLISMKINNYLSANINTHLIFDDDIAYVDEKGEHGARVQFKEVFGVGLTYKF

SEQ ID NO: 11761 - DNA, 705 bp, Unknown
  Obtained from environmental sample
  misc_feature (1)..(705): n is a, c, g, or t
atgctgacattagcattttttactgcattttctcagaaagtgccagtaaacatcatcaataaaacagaagaaataaaattagaagtatattatattagagcatacaaaagtgatgttttgaaaatcaatattcaaacagaactcaaaaatgagaaaaaaggcaaatattacgatgtcaaaaatgtaaaattatatcgtcaagatgcaaaagatgattttcaatatattgtcgacaaagaaaatattagcaaacttgatgttgaagtagtagttccgagcgatggaatctacacacttatcgttgatagaggtggaatgaaaaacttcaacaccactctttttgttcaaagacttgctgaaaatgattctatggcaactcttaataaaaaagcaatttatgttaatgttcctgacactgttcatacatatacacaaggagcagaggtttatgaccacataagaacagcaactccgtatacaaagaaacaatttatgcctcaatacaaagaagatcanatatttatggatgtttcttatgctttgagaatagacaatanatatgcaattccaattcaaattccttatgaaataatgaccgattataaaatttcaaaatctattaaatgggggtttatggtgagtgttagtgatgaagttttacaagcattacaggaaaagttgcggaacctgccaccgaagcaatag

SEQ ID NO: 11762 - protein, 234 aa, Unknown
  Obtained from environmental sample
  misc_feature (1)..(234): Xaa is any amino acid
MLTLAFFTAFSQKVPVNIINKTEEIKLEVYYIRAYKSDVLKINIQTELKNEKKGKYYDVKNVKLYRQDAKDDFQYIVDKENISKLDVEVVVPSDGIYTLIVDRGGMKNFNTTLFVQRLAENDSMATLNKKAIYVNVPDTVHTYTQGAEVYDHIRTATPYTKKQFMPQYKEDXIFMDVSYALRIDNXYAIPIQIPYEIMTDYKISKSIKWGFMVSVSDEVLQALQEKLRNLPPKQ

SEQ ID NO: 11763 - DNA, 492 bp, Unknown
  Obtained from environmental sample
  misc_feature (1)..(492): n is a, c, g, or t
atggacagccttcacagggctaacagaacttgcaggagaaacatttgtgggttgggtccacgaattgaagacgagataaaatatgaagttctttctcaaaaagaatatagaaaaatgctcaacaaagaaccttatactacaatgcaaaaaggtcatggttgttttgttagtggagaatttgatatcaaaaatgcaaatgacatttattatcttgttattgaaaatgaacgaagtacaggaggtggtttttgggatgttgctgaatctatcggaaaaacaatgcttagtcaatacgtttatgcaaatgtaaaagtttttgtacaacgaaaagtagaagtaatgtatcaaaaaggatattatgaaaatactttcaaagaagttacaaatccaacttggtctcacacgcaagaccctacaataaaaaaacaagtaatctttgaaacagaaaacaaaccatattatcaacaattaaattcacctactatttattag

SEQ ID NO: 11764 - protein, 163 aa, Unknown
  Obtained from environmental sample
  misc_feature (1)..(163): Xaa is any amino acid
MDSLHRANRTCRRNICGLGPRIEDEIKYEVLSQKEYRKMLNKEPYTTMQKGHGCFVSGEFDIKNANDIYYLVIENERSTGGGFWDVAESIGKTMLSQYVYANVKVFVQRKVEVMYQKGYYENTFKEVTNPTWSHTQDPTIKKQVIFETENKPYYQQLNSPTIY

SEQ ID NO: 11765 - DNA, 813 bp, Unknown
  Obtained from environmental sample
  misc_feature (1)..(813): n is a, c, g, or t
atggatattaaaaaaaatgagacagaagaaaaaagatataaagtatctttaaaagagagaccgaaaacagaaaaagagtcttttgagaagaagattacaaaagagatagaaattgctccgccacttccaaaaggggaacagttaaatgagttaataaaaaaaccgtttaagaagtatgatgaaaaagaggttgtagaacaaaaaaaacaagaggttcttcctcctaaaaaagtttttaaacctataaaagagaaaaaaacagttacgcaaacttttcctgagataaaagattatatcaaaagtgaaacttctgaattcactgtgcctaaagagcaaaacctgacagaggtagaacctgcatataaaggtgagaacagtgatctatttgcaattttaacagaagatacaaaaccacaaaaaagcaaccaaaaaagtactcaaaatctaaaagatagcagtagattaacgcaagatattaaagagctatacggtgatgtatttggcaaactaagcgaaggtgaacaaaaatatatcttagataatcaagagatcatgagacgcattacacaagaggttttaaaccgtgtaggacgggtaaacataccaaacgactttggtgtaaatgcttttaatactgtagagttttacctcatgccaaacggtgatattacagagattaaatatatacaaaanagcggtcacttcatcttagataacacaacaaaagagaccatagagtactcatacagcagatacccccaccctaaacagaaaactcttatcaaaaatggagttggttactacttcagatag

SEQ ID NO: 11766 - protein, 270 aa, Unknown
  Obtained from environmental sample
  misc_feature (1)..(270): Xaa is any amino acid
MDIKKNETEEKRYKVSLKERPKTEKESFEKKITKEIEIAPPLPKGEQLNELIKKPFKKYDEKEVVEQKKQEVLPPKKVFKPIKEKKTVTQTFPEIKDYIKSETSEFTVPKEQNLTEVEPAYKGENSDLFAILTEDTKPQKSNQKSTQNLKDSSRLTQDIKELYGDVFGKLSEGEQKYILDNQEIMRRITQEVLNRVGRVNIPNDFGVNAFNTVEFYLMPNGDITEIKYIQXSGHFILDNTTKETIEYSYSRYPHPKQKTLIKNGVGYYFR

SEQ ID NO: 11767 - DNA, 567 bp, Unknown
  Obtained from environmental sample
  misc_feature (1)..(567): n is a, c, g, or t
atgaatagtgtaactaactcacccgtacaacaaataacttttcaaaatcaatcttttttaatcaaaagagatgatctattgcataaagattttagcggtaataaagcacgaaaattttactactattttattaatgattttccaaatatagacacagttatcagctatggttcaaaccaatcaaatgcaatgtatagtttatcagtattggctaaattaaggggctggaagtttctctattatgtagatcatattccatcttttttaaaagagcatccacaaggaaactataagtatgctatagcaaatggtatgcaaataattgagaacaaatattttcaaaaagaaaactttcaatttaaagagaatgaactttttataaatgaaggtggtgctattgaacaagcacaagttggacttgaaatattagcaaatgagattaaagaatataaaaaaacaaataatttaaaaaatttaaaagtttttctacctagtggtacaggtacaactgccctatttttacaaaagtttttagattgtgaagtttttaacttggcccttgtgtaa

SEQ ID NO: 11768 - protein, 188 aa, Unknown
  Obtained from environmental sample
  misc_feature (1)..(188): Xaa is any amino acid
MNSVTNSPVQQITFQNQSFLIKRDDLLHKDFSGNKARKFYYYFINDFPNIDTVISYGSNQSNAMYSLSVLAKLRGWKFLYYVDHIPSFLKEHPQGNYKYAIANGMQIIENKYFQKENFQFKENELFINEGGAIEQAQVGLEILANEIKEYKKTNNLKNLKVFLPSGTGTTALFLQKFLDCEVFNLALV

SEQ ID NO: 11769 - DNA, 792 bp, Unknown
  Obtained from environmental sample
  misc_feature (1)..(792): n is a, c, g, or t
ttggggttggggaaatacggcagcaagtcaaaatcagggcatcaaacctcaattgtaactccaaattataccctatcttttattatgattggattgtatatgtttgctcgatggtctcaggaaaactttttcaaatacatgatgcaagagtttggcattgatacacttgtgagttattttaaagagaagattcccgacaccacatcacttgtaaatcctgaatataggacacttgaaaatgctagaaaaaagatgacatcaaaactaaataggataaaagcaaaatttgcaacactcacattacaatctgaacctattgaggagaaagcgatggagaaatacatctctcaaaaagaggagcttaaagaagatatagaacaaaaagaaattgaaatagagcggattaagctacaaaagaaatctattccaagaaaaatagcatactccgagcttgctgaaaatgataaatttgataatgttattaatcagcgcaaacactttttagatactattaaattaattgcatatagagcagaaacagctttgtctaatatggccaaagaatatatgtcgcacaaagatgagtccagacttttactcaaacagatttataaaactgatgcaaacttgatagtggatgataaaaaccaaaaactaattgttgaaatacatagattagctcattggaaagacgatgtggtattagagaaattatgtaccgcaatgaaccaaactgaaaccaaattcccagactcaaatctaaccttaaactataaattggtatcaccttaa

SEQ ID NO: 11770 - protein, 263 aa, Unknown
  Obtained from environmental sample
  misc_feature (1)..(263): Xaa is any amino acid
MGLGKYGSKSKSGHQTSIVTPNYTLSFIMIGLYMFARWSQENFFKYMMQEFGIDTLVSYFKEKIPDTTSLVNPEYRTLENARKKMTSKLNRIKAKFATLTLQSEPIEEKAMEKYISQKEELKEDIEQKEIEIERIKLQKKSIPRKIAYSELAENDKFDNVINQRKHFLDTIKLIAYRAETALSNMAKEYMSHKDESRLLLKQIYKTDANLIVDDKNQKLIVEIHRLAHWKDDVVLEKLCTAMNQTETKFPDSNLTLNYKLVSP

SEQ ID NO: 11771 - DNA, 825 bp, Unknown
  Obtained from environmental sample
  misc_feature (1)..(825): n is a, c, g, or t
atggtattgcaacacggggcaggtgaaaaactatttatcgattttgcaggaaagaaattatcgtatgtaaacagggacactggtgaaattatcgaatgccaggtttttgttgcctgcctgccacattcggactattgttttgctatggcggtgcacagccaatgtattaacgattttatttatgctctgggttgttgtttaaacgaaataggcggtgttccgcaggctttggtacccgataatttgaaggctgccgtaataaaagccagccggtacgaacccaacataaaccgggttctggaagactttgctaaccattatgaaacaacggttgcacctgctcgtgtccgaaaaccaaaagacaaagcattggtagaaaaccaggttaaactgatttacagccgggtatatgcaaaattgcgcaaccagcaattcttcgacatacaatcgctgaacaaagcaatcggcgaaaaggtaaaagaacacaaccaaacccggatgcagcaaaaagggtattgccggcaagagaagttcctctcggatgaaaagcaggtgttaaaaccacttcctgccacaaacttcgagattaaatattacaagcagctaaaagttgcccaaaacaaccacatcctgctaagcgaaaacaaacattattacagtgttccttatgtccacattggcagcaaagtaaagcttatttacacccgctcaatggtatatatttatgccaaaggaatccaggtagcagtgcacccgcgcagttacaaaaccggaggatacagtactataaaggaacatctttgttctgatcatcaacattattga

SEQ ID NO: 11772 - protein, 274 aa, Unknown
  Obtained from environmental sample
  DOMAIN (3)...(179): Integrase core domain
  misc_feature (1)..(274): Xaa is any amino acid
MVLQHGAGEKLFIDFAGKKLSYVNRDTGEIIECQVFVACLPHSDYCFAMAVHSQCINDFIYALGCCLNEIGGVPQALVPDNLKAAVIKASRYEPNINRVLEDFANHYETTVAPARVRKPKDKALVENQVKLIYSRVYAKLRNQQFFDIQSLNKAIGEKVKEHNQTRMQQKGYCRQEKFLSDEKQVLKPLPATNFEIKYYKQLKVAQNNHILLSENKHYYSVPYVHIGSKVKLIYTRSMVYIYAKGIQVAVHPRSYKTGGYSTIKEHLCSDHQHY

SEQ ID NO: 11773 - DNA, 684 bp, Unknown
  Obtained from environmental sample
  misc_feature (1)..(684): n is a, c, g, or t
atgcaaatatttggtaaatttgaaacactacacaacttagagtatttaacggaacactatatctattttaataaagaagatgaagttattgatacaaaagagcttcaggtacttttgaaaaatagaagaaagaagattgccggtacaatttttctatacaatcctacatcagcaccaaaaggttatgatctaaatcgtaaactttcactgcaagattatgataattggggtgagtatgaagagcttgtcatggatgatgcacttcaagtttttgaatctaagattaaaaattatgaagggatgttgatagaggtgaagtatctgtttaacttcaacaaagtaaatataattccgacccctgcattagaagagtttgaagctgatttagagacatataactctaatcaagctacaagatatgatagagattttaactatcaagatgtaaaanatatgcgtctatcgggcaagtttgtattttttggctggggacacaaatatgatagacaccatccgcaccttttccactatgcaaaatctatctcaatacaagcacaagcattaggcaaagctatagcttttgtatataatgagacaaaatcacttgaagagagcatagagagtgctagatactttcctcctgtatcttctggaaaaatcaaagctaaagtagcaaatgcataa

SEQ ID NO: 11774 - protein, 227 aa, Unknown
  Obtained from environmental sample
  misc_feature (1)..(227): Xaa is any amino acid
MQIFGKFETLHNLEYLTEHYIYFNKEDEVIDTKELQVLLKNRRKKIAGTIFLYNPTSAPKGYDLNRKLSLQDYDNWGEYEELVMDDALQVFESKIKNYEGMLIEVKYLFNFNKVNIIPTPALEEFEADLETYNSNQATRYDRDFNYQDVKXMRLSGKFVFFGWGHKYDRHHPHLFHYAKSISIQAQALGKAIAFVYNETKSLEESIESARYFPPVSSGKIKAKVANA

SEQ ID NO: 11775 - DNA, 897 bp, Unknown
  Obtained from environmental sample
  misc_feature (1)..(897): n is a, c, g, or t
ttgcaatttaatgactctgctttgattttaggagctctaaatgggatacaaatagtcgccatattaagcattttacaaagttcaccgtactctttaatggctttaaaatcacccagaattagtaaattagaagatataagtggtaaaaaaattgcactatataataatttgaatggaatcgccataaatgccatgttaatgtcacataatattgattatattaaaactcctgttgcttacacattagataaattattaagtggtgaagatgatatgcagactgtatatttatcaaatgagccatatgttgctaaagaagctggattagagatcaccctctttaatccaaaagattatggttttgacggatatggagatattctatttacctctaaaaaaatattaaatagcagacctgatcttgtagaaaaaatgtattcagcaagtaaaaaaggatgggagtatgcattctcacatattgatgagagtgttgatgttatatataatagatacaacactctaaataaaagtaaaaacgcattagcttatgagggcaaaatattaaaatctttaagtggttatggtaaaaattttggagaaattgatgaagacaaaataaggagtattgctcaaatatttagttttatgaacaagggaaaaaataattttgaaaacttggatgagtttatttatagaccagcaaataaagatacagactatgaaacaatatttttcacaaaagaggagttagaatatataaaaaataaaaaaagtgtaaaagtatgtgcacacacaaaagagtttccatttgtaatatttgataaagaagagatcagcggaacatcaatagagtttctaaaactaattaccaatatatctaaattaaatttgaaatag

SEQ ID NO: 11776 - protein, 298 aa, Unknown
  Obtained from environmental sample
  misc_feature (1)..(298): Xaa is any amino acid
MQFNDSALILGALNGIQIVAILSILQSSPYSLMALKSPRISKLEDISGKKIALYNNLNGIAINAMLMSHNIDYIKTPVAYTLDKLLSGEDDMQTVYLSNEPYVAKEAGLEITLFNPKDYGFDGYGDILFTSKKILNSRPDLVEKMYSASKKGWEYAFSHIDESVDVIYNRYNTLNKSKNALAYEGKILKSLSGYGKNFGEIDEDKIRSIAQIFSFMNKGKNNFENLDEFIYRPANKDTDYETIFFTKEELEYIKNKKSVKVCAHTKEFPFVIFDKEEISGTSIEFLKLITNISKLNLK

SEQ ID NO: 11777 - DNA, 723 bp, Unknown
  Obtained from environmental sample
  misc_feature (1)..(723): n is a, c, g, or t
ttgaaagtatcacaaatagtgtacttaaccgaaactccttttaatcaacgagactacaataggtttggtttagatgtatttaagcgtcatgacctaaatgttatggtcatagatcttacagaatatttggataaagatgtttttaagaactatattttagatgaaaatatagtttatccttttgttaaaaaaatggatagttttagtaaaattaaaaaatttatattagagactcataaagatactgtatttatatcttttattggcgattcaagttttaaatcaataaggatcctaaattttttatctaaaaacaataaagaatttggaatactactttcaggtctcctcccttcatcaacatcaaaattatctttgtttgataagcttaaattactttcagtgaaaaaattgctaagaagagtgggcaaggaggttactaaactacttttttatagctataaatactcttttattgttgtatcgggaaaaaagtcattggatttcattaaaaataaatatgaatttaaaaatattattcaaggtcactcatttgactatgatctatttttggatagtagattggacaaaacatttacgctacaagatgattatattgtttttttagatgagtttttcccttttcatccagactatattgcgataggagtagactattcaggatatgcaaaaagttactataaaaaattgtgcaatttttga

SEQ ID NO: 11778 - protein, 240 aa, Unknown
  Obtained from environmental sample
  misc_feature (1)..(240): Xaa is any amino acid
MKVSQIVYLTETPFNQRDYNRFGLDVFKRHDLNVMVIDLTEYLDKDVFKNYILDENIVYPFVKKMDSFSKIKKFILETHKDTVFISFIGDSSFKSIRILNFLSKNNKEFGILLSGLLPSSTSKLSLFDKLKLLSVKKLLRRVGKEVTKLLFYSYKYSFIVVSGKKSLDFIKNKYEFKNIIQGHSFDYDLFLDSRLDKTFTLQDDYIVFLDEFFPFHPDYIAIGVDYSGYAKSYYKKLCNF

SEQ ID NO: 11779 - DNA, 741 bp, Unknown
  Obtained from environmental sample
  misc_feature (1)..(741): n is a, c, g, or t
atgtataacaacaatcatttcaaagaaaacaacctttcattaaaagctattttagataattgggaattacctcaaatttttgaagttaaagataaattagacattcttagagcagataaaataggcgatgaatttaatacacaatacattttcgttggaaatggggatgaatatcaacgactaaaagaaataaaagctaccgaaggaaaaataatagtgcctatcaattttcctgaaccttatgatgtggaagatccttatgaagcattgaaagtagcttattcatctgtaaaacattgggaattggctccttataatttaaaattattagccgacagtgccatcgattttacaattacctcagacggattaaaagataaaaaagatttcttacccaacctaagacaagcagtaaaatacggactaacagaagaaaatgcactaaaagcattaacttataatccggctcaatttattggagaatatgctaatgtaggaagtttagaaaaaaataaattggctaacttcataatcacctcagaaaatatttttgaggaaaaagccattatccacgaaaattgggtaaaaggaaaacaacatatcattaaagattataatgattttgatgttagaggaaaatatgatgttaatgttaacggtaaattatatgaactaaaagtaaatggttctgaagacaaaccacaaggcaccattttcattgttaatggaaaagatacttaa

SEQ ID NO: 11780 - protein, 246 aa, Unknown
  Obtained from environmental sample
  misc_feature (1)..(246): Xaa is any amino acid
MYNNNHFKENNLSLKAILDNWELPQIFEVKDKLDILRADKIGDEFNTQYIFVGNGDEYQRLKEIKATEGKIIVPINFPEPYDVEDPYEALKVAYSSVKHWELAPYNLKLLADSAIDFTITSDGLKDKKDFLPNLRQAVKYGLTEENALKALTYNPAQFIGEYANVGSLEKNKLANFIITSENIFEEKAIIHENWVKGKQHIIKDYNDFDVRGKYDVNVNGKLYELKVNGSEDKPQGTIFIVNGKDT

SEQ ID NO: 11781 - DNA, 732 bp, Unknown
  Obtained from environmental sample
  misc_feature (1)..(732): n is a, c, g, or t
ttgaaagagaaaggaataaaagttggggtagcttcatcaagcaaaaactgtaaagctgttttggaagcaacaaatttgttgcacttaatggaaacaagggttgatggaattgtttcagcagaattaaatctaaaaggaaaacccgaacctgacattttcataaccgcctgcgataatctaggagtaacatacgataaagctgttattgttgaagatgctgtttctggtgttaaagccggagaaaaaggaaactttggacttgttttaggtatagcacgcgaagggaatcaaaatgaactaaaaataaacggtgctgatattgttgttaaagatattgccgaaattggttttaagggtattgaaaattggttttcaaaagatcttgaaaatgataaatggtcattaaattattattcgtataaacccgaaaacgaagcaacacgtgaatcgcttttaactattggtaatggttattttggaacacgaggcgtaatggcagaaaccaatgctaatggaattaattatccaggaacatatattgccggagtttataatagaatgaaatcgtctgttggagacaaaattattgaaaacgaagattttgttaattgtccaaactggctaagtataaattttaaaataggaaacgatgattggatggatttcaataaattgaaaattattgattttcataaaaaattagatttcagaacgcggaattttatcgcgtaa

SEQ ID NO: 11782 - protein, 243 aa, Unknown
  Obtained from environmental sample
  misc_feature (1)..(243): Xaa is any amino acid
MKEKGIKVGVASSSKNCKAVLEATNLLHLMETRVDGIVSAELNLKGKPEPDIFITACDNLGVTYDKAVIVEDAVSGVKAGEKGNFGLVLGIAREGNQNELKINGADIVVKDIAEIGFKGIENWFSKDLENDKWSLNYYSYKPENEATRESLLTIGNGYFGTRGVMAETNANGINYPGTYIAGVYNRMKSSVGDKIIENEDFVNCPNWLSINFKIGNDDWMDFNKLKIIDFHKKLDFRTRNFIA

SEQ ID NO: 11783 - DNA, 624 bp, Unknown
  Obtained from environmental sample
  misc_feature (1)..(624): n is a, c, g, or t
atgtcagttttagacaaagtagatgcagcaacaaatcttgcgaaaaataatgaacttcaacttttggtatttagagttactgacgatagtgatgagtcaccattttatgctattaatgtatttaaaactcgtgaagtaatcgaatcaaaaaaacacaatttaacacaaattccatcaaacaaccctctattagaaggcacaatagtcttacgaggaacacagattcctgtacttaatctacctgagtgggtagataaacatctaactaaagtgcagataaaaaaatctaatattttagtttgtgattttaacggaattattattggtcttagaattatgtctgcatatagagttgtaaaaaagaattggaatgagatgcatgcaccgacatcttactcaaatgccaaagatggttcactcgtgattaatcatacacatcttagtgatggaagtttatgtttggttcttgattatgaaaagttactttcagaagtaatacctcaagctatggtagatacagaatctacacctgtaaatttagaaggaatagatgttccaaaaaaattaaaaacaggaacactttttaatttgctgaggactctaaaactgcaccaaaacatctaa

SEQ ID NO: 11784 - protein, 207 aa, Unknown
  Obtained from environmental sample
  DOMAIN (20)...(166): CheW-like domain
  misc_feature (1)..(207): Xaa is any amino acid
MSVLDKVDAATNLAKNNELQLLVFRVTDDSDESPFYAINVFKTREVIESKKHNLTQIPSNNPLLEGTIVLRGTQIPVLNLPEWVDKHLTKVQIKKSNILVCDFNGIIIGLRIMSAYRVVKKNWNEMHAPTSYSNAKDGSLVINHTHLSDGSLCLVLDYEKLLSEVIPQAMVDTESTPVNLEGIDVPKKLKTGTLFNLLRTLKLHQNI

SEQ ID NO: 11785 - DNA, 423 bp, Unknown
  Obtained from environmental sample
  misc_feature (1)..(423): n is a, c, g, or t
ttgagagaggaaattaagatggatacgcaatcatttgatatacctattcatgatattaaacctctagtagaagttcctgataactcatttgctatttttataacagtagttgttttaggtgtgatcttgttagcggttgttatctattttttatatagacacttcttaaaagctaaaaaaatcaacttgagaaaagtaaactttgaagcactgaaaaatatcgatttcacagagcctaaaaaagcagcgtatgagattacaaaatatggacttatttttgaaaatgattcagagcgaatctatgaggcatatcataatttaaatagtaaattaactccatacaaatataaaaaagaggtgcaaaacatagacgaggagaccttgggttattacaatattttgttagggatgatagatgtataa

SEQ ID NO: 11786 - protein, 140 aa, Unknown
  Obtained from environmental sample
  misc_feature (1)..(140): Xaa is any amino acid
MREEIKMDTQSFDIPIHDIKPLVEVPDNSFAIFITVVVLGVILLAVVIYFLYRHFLKAKKINLRKVNFEALKNIDFTEPKKAAYEITKYGLIFENDSERIYEAYHNLNSKLTPYKYKKEVQNIDEETLGYYNILLGMIDV

SEQ ID NO: 11787 - DNA, 459 bp, Unknown
  Obtained from environmental sample
  misc_feature (1)..(459): n is a, c, g, or t
atgaaaatgaattttagacacaataattttatgaatatactagacaccctcacacaaagaatatcggtacgagcatttttaaaaaaagatgttgaattagaaaaaataagaactatttttgatactgctaaacacgcaccatctggggtcaatatgccaccttggcaagtggcagttgtaagtggtgatcctaaaaaaactattgaaattcatgtgatagaagcttttaaacacagtgaacctgagagagtggaatacctctattatcctctagagtgggaagaaccatacaacactagaagaaaagagacggctcttttagtgcactccactttaaatattaaaaaagaatatagagagacgcttttttctcaggggtcccaaactatcccgcatttgacgccccggtgctcgtggatttttatagggaagaatatcttgaaattggctcttatttag

SEQ ID NO: 11788 - protein, 152 aa, Unknown
  Obtained from environmental sample
  misc_feature (1)..(152): Xaa is any amino acid
MKMNFRHNNFMNILDTLTQRISVRAFLKKDVELEKIRTIFDTAKHAPSGVNMPPWQVAVVSGDPKKTIEIHVIEAFKHSEPERVEYLYYPLEWEEPYNTRRKETALLVHSTLNIKKEYRETLFSQGSQTIPHLTPRCSWIFIGKNILKLALI

SEQ ID NO: 11789 - DNA, 675 bp, Unknown
  Obtained from environmental sample
  misc_feature (1)..(675): n is a, c, g, or t
ttgacggttttgaggatgtttacatctggcattacgtctactgaatctaatgatagtgatgtcaaagagctaagagagaagttaccgtttgtcagtggttgtgactacttggagagaaatcaatttatagaagatgcttacaatttaagtagtgattatagagctgaagagatagatgaacttccattttttaaagatattgatctagaaattttaaaagatgctattttgcaaagaagatcgattagagcttttagagagaactccttgacgagtgcagagtttgattttatttttaaagatattttcgcttttgctaaagtctataaaatagatatttactatacagttcacaatattgtagataaaaaagtaggactttacaaaaatgaagaacttatcaaagagggtgagttctcaagcaattcaggttacctctccctagagcaaaagataggaagctctagtgctatgactatctactttacatcaaatgaggttgaaaagtatcagcaggtaaatatacttagcgggtttttagctcatgttatatacttgaaatctactattaaaatgattggctgcagcggtataggcgcgtactatgatgatgatgtaaaaaactttttaaacacaaaaaacaatattctatatcttttagcagtaggtagataa

SEQ ID NO: 11790 - protein, 224 aa, Unknown
  Obtained from environmental sample
  misc_feature (1)..(224): Xaa is any amino acid
MTVLRMFTSGITSTESNDSDVKELREKLPFVSGCDYLERNQFIEDAYNLSSDYRAEEIDELPFFKDIDLEILKDAILQRRSIRAFRENSLTSAEFDFIFKDIFAFAKVYKIDIYYTVHNIVDKKVGLYKNEELIKEGEFSSNSGYLSLEQKIGSSSAMTIYFTSNEVEKYQQVNILSGFLAHVIYLKSTIKMIGCSGIGAYYDDDVKNFLNTKNNILYLLAVGR

SEQ ID NO: 11791 - DNA, 495 bp, Unknown
  Obtained from environmental sample
  misc_feature (1)..(495): n is a, c, g, or t
atggacataggttattctttaaaattgaagcaaattagcaaaacttcaaaagatctatttgaaattaggcttattgacgaaaataatgatgataatattgaggtaggtttatcagatgtcggatttggaataagtcagttacttccatttattgtgcaaagccttgctaagtctaatcaacttatttccattgaacaacctgaagttcatatacaccctcagttgcaagctgatttaggtgatttattagcacacgctattaagaaacctttgcaaaataaatttattatcgaaacacatagtgaacatttaattctaagacttcaaaaattagttaggttgaaaaaaatcaaaaatagtgacttatcaattatatacgtttcgaagaataataattgtagtattatcaaagaattaaaacttgataaagatggctattttactgatgattggcctgatggattttttcctgaacgtcttaatgaattaatttag

SEQ ID NO: 11792 - protein, 164 aa, Unknown
  Obtained from environmental sample
  misc_feature (1)..(164): Xaa is any amino acid
MDIGYSLKLKQISKTSKDLFEIRLIDENNDDNIEVGLSDVGFGISQLLPFIVQSLAKSNQLISIEQPEVHIHPQLQADLGDLLAHAIKKPLQNKFIIETHSEHLILRLQKLVRLKKIKNSDLSIIYVSKNNNCSIIKELKLDKDGYFTDDWPDGFFPERLNELI

SEQ ID NO: 11793 - DNA, 843 bp, Unknown
  Obtained from environmental sample
  misc_feature (1)..(843): n is a, c, g, or t
ttgattcttgttgagggggcttttatgcaggcaatttctaaatatttggtcttggtaataatattccttttttcctttactgcgaatagcattgctggtgaatatgaaaattatttaaagactcaaaaagattcttttcaaacctataaggatgaaagagatgctgagtttataggatttttgaaagaacaatggaaggaattcaaagttaacaaggggcttgtccaggatactcaaccaaaacctgttaaactaccgattgcaaagcctgtaaaatcagacccggtttctatcgccaaaagtaaacctgtaaaaaaaattatcattcctaagtatattccaggcccaaagactgtagatgaaaaagttcctgctattacagaaaaaacaattgcaattaagatgaatttttatttaacaccccttgttatttatggaagatatgcttttccggatttaatgaatggcaaagttgataaaaatatgattacagatttttggaataaaatgagccagattgattatgattcttttgtctctcagcttatgcaatataagaaaaaattgaaattaaatgactggggctatcaccatattttatatcgtttaggaatgaaacagttctcacaaaataaaaatatggccaaccttttggtatggtttatgtcaacaaaatcaggatatgagaccagaatcggttataatgacagccggatttatttactgatgccgtcaagaaacaggctttatagtgtgccctttctgaccttaaaagagcgaaagtactattctatgacttttgatgaaaaaccggaaaaanntttaaatctcttttacctataa

SEQ ID NO: 11794 - protein, 280 aa, Unknown
  Obtained from environmental sample
  misc_feature (1)..(280): Xaa is any amino acid
MILVEGAFMQAISKYLVLVIIFLFSFTANSIAGEYENYLKTQKDSFQTYKDERDAEFIGFLKEQWKEFKVNKGLVQDTQPKPVKLPIAKPVKSDPVSIAKSKPVKKIIIPKYIPGPKTVDEKVPAITEKTIAIKMNFYLTPLVIYGRYAFPDLMNGKVDKNMITDFWNKMSQIDYDSFVSQLMQYKKKLKLNDWGYHHILYRLGMKQFSQNKNMANLLVWFMSTKSGYETRIGYNDSRIYLLMPSRNRLYSVPFLTLKERKYYSMTFDEKPEKXLNLFYL

SEQ ID NO: 11795 - DNA, 462 bp, Unknown
  Obtained from environmental sample
  misc_feature (1)..(462): n is a, c, g, or t
atgtcgaagcaaaatagcagtaatagacttcttcatgtcgcaaccttgggcaaaactgtcgggttacgaggtgatatgaaacttcatatacaaagtgattttcctgaacagtttaaagatggtgcaacatttatcaccaaaggtgataaaaaagtaaaaatattatccattaatcaagataagtctatggtgcaaatagatggttacatgagcgtagaatcagcaaaagctctaactaacacaaagctatttactacatatgaggatactagagaaaactgtaatcttaatgatggtgagtttttttggtttgatatagttggttgtaaaattgtagaagatggaaaagttttgggagaagtttcagaaattgagagaatctctatcagtgattatttgaaaatagatacagatagtgagttgataaaagcaggtgaaataaaaacatttttagttccctaa

SEQ ID NO: 11796 - protein, 153 aa, Unknown
  Obtained from environmental sample
  DOMAIN (12)...(89): RimM N-terminal domain
  misc_feature (1)..(153): Xaa is any amino acid
MSKQNSSNRLLHVATLGKTVGLRGDMKLHIQSDFPEQFKDGATFITKGDKKVKILSINQDKSMVQIDGYMSVESAKALTNTKLFTTYEDTRENCNLNDGEFFWFDIVGCKIVEDGKVLGEVSEIERISISDYLKIDTDSELIKAGEIKTFLVP

SEQ ID NO: 11797 - DNA, 546 bp, Unknown
  Obtained from environmental sample
  misc_feature (1)..(546): n is a, c, g, or t
gtgtataaagctagaggtaccatcatagaccgagttatgatagacaaacgacctaagatagtagagaagaagaatagaattggtgatcttgaaatagatactgtcataggaaaaaatcatattggtgcattagtcactgttgtagatagaaaatctaaatttacaatgattaaaaatgttcaatcaaaagaagccaaagtggttacagaagctctaatagagatgatacaaccaatcaaaaatatcactcatacaatcacaagtgacaatggaaaagagtttgcatatcacaaagagatttcagctgcactagacactaagttttacttcgctaatccatatcattcatgggaaagaggattaaatgaacacaccaatggtttaatacgtcaatacttaccaaagaaaagtgtgtttacaaatgtttctaaggatgaaattattatgattcagaacagacttaatcacagacctagaaaagtgttaggttataaaacaccttatgaagtttttttcaaggagctgagtcgaaaattagctagttaa

SEQ ID NO: 11798 - protein, 181 aa, Unknown
  Obtained from environmental sample
  DOMAIN (22)...(172): Integrase core domain
  misc_feature (1)..(181): Xaa is any amino acid
MYKARGTIIDRVMIDKRPKIVEKKNRIGDLEIDTVIGKNHIGALVTVVDRKSKFTMIKNVQSKEAKVVTEALIEMIQPIKNITHTITSDNGKEFAYHKEISAALDTKFYFANPYHSWERGLNEHTNGLIRQYLPKKSVFTNVSKDEIIMIQNRLNHRPRKVLGYKTPYEVFFKELSRKLAS

SEQ ID NO: 11799 - DNA, 594 bp, Unknown
  Obtained from environmental sample
  misc_feature (1)..(594): n is a, c, g, or t
atgaaagacatccgtatttgttatgtgggagattcatttgtaaatggtacaggagacccagccaaacttggttggactggaagattaagtgtaagttctcaaaatgacaaaatagatattacacattacaacctagggattagaagagatacatcaaaagatatattaaaaagatgggaagctgaatgtcaagcaagactaccagaaatatcagaaaataaagttgttttctcatttggtgtaaatgatacagttattgaaaatggacaaaaaagagtttcattagaagatagtattgaaaatacaaaaaatatgctaataaatgcatcaaaaaaatatgatgtaattatgattggtatgccaccaattgatgatgaaaaacaaaataaaatcattaaagagttaaataataaatatcaagctttatgtgatgaattaaatattccatatctttcaatatttgaaagattagttaatgataaaatatggaaagatgaagtatcatcaaatgatggtgctcatccaaaagataaaggatatgagatattagctaacttcataaaaaattggagtggctggtggttcaaagactaa

SEQ ID NO: 11800 - protein, 197 aa, Unknown
  Obtained from environmental sample
  DOMAIN (6)...(187): GDSL-like Lipase/Acylhydrolase
  misc_feature (1)..(197): Xaa is any amino acid
MKDIRICYVGDSFVNGTGDPAKLGWTGRLSVSSQNDKIDITHYNLGIRRDTSKDILKRWEAECQARLPEISENKVVFSFGVNDTVIENGQKRVSLEDSIENTKNMLINASKKYDVIMIGMPPIDDEKQNKIIKELNNKYQALCDELNIPYLSIFERLVNDKIWKDEVSSNDGAHPKDKGYEILANFIKNWSGWWFKD

SEQ ID NO: 11801 - DNA, 777 bp, Unknown
  Obtained from environmental sample
  misc_feature (1)..(777): n is a, c, g, or t
ttgtgctggcgacttatctttttttatctgacactcaacgaatcaagaaatcaaattgaacaacttattaaaaaaggttttgtcactgtccaaaataaacaaaaagcaaaaagtggtttgaagcttcaagtaggacaagaggttactgtaatgtttcccgaggttgtaaaagaggaagctttagaggttgattttgatgttgagatagtttttgaagatgaatattttatggttataaataaaccctcaggtgtgatagtgcatggagctcctagtgtaaatgaacctacacttgtagattggttaaagaaaaagaatatttcactctcaacaattagtggagaacagaggcacggaattgtccatagaattgataaagggacaagtggactactggtgattgcaaaaacaaatgaagcccatgaaaagctctcaaaacagttagaaacaaaaactatggggcgatactatttagccattatagatttacctctaaaagatgatataactatagataaaccaatagctagaaatcctcacaataggttgaaaatgggaatagtcgagggtggaaaaaatgctaaaacttcatttgctaaaattgtaacaagtgatgataataattatgaactcatagcagccaaactttatacaggacgaactcatcaaattagagttcatctagaatcacttcaaagacatattttaggggatgcattatatggttttaagggaaatttaaataagcttaaaagagtttatttacatgccttttag

SEQ ID NO: 11802 - protein, 258 aa, Unknown
  Obtained from environmental sample
  DOMAIN (75)...(230): RNA pseudouridylate synthase
  misc_feature (1)..(258): Xaa is any amino acid
MCWRLIFFYLTLNESRNQIEQLIKKGFVTVQNKQKAKSGLKLQVGQEVTVMFPEVVKEEALEVDFDVEIVFEDEYFMVINKPSGVIVHGAPSVNEPTLVDWLKKKNISLSTISGEQRHGIVHRIDKGTSGLLVIAKTNEAHEKLSKQLETKTMGRYYLAIIDLPLKDDITIDKPIARNPHNRLKMGIVEGGKNAKTSFAKIVTSDDNNYELIAAKLYTGRTHQIRVHLESLQRHILGDALYGFKGNLNKLKRVYLHAF

SEQ ID NO: 11803 - DNA, 333 bp, Unknown
  Obtained from environmental sample
  misc_feature (1)..(333): n is a, c, g, or t
atgaaagagtttattattagacacaaaaaaatattatcaagagtagcaggggttttacttattttgctggcagttttgagccttttttgggataacaccgataaaaaatatgtttattcaagcggaacttcatcgtctgaaaattttgcgatcatagagtcagtcattaatacaagtcgaaaaacaacaaacaaaaagcctacatcatcaattaaagagatttatgagcaaaagcagcaagaaaatctgaggtatatgttgataatcatacttatttcaggtgttttcttttttatatatagttttattagctcaaaaaaagagggcaagtag

SEQ ID NO: 11804 - protein, 110 aa, Unknown
  Obtained from environmental sample
  misc_feature (1)..(110): Xaa is any amino acid
MKEFIIRHKKILSRVAGVLLILLAVLSLFWDNTDKKYVYSSGTSSSENFAIIESVINTSRKTTNKKPTSSIKEIYEQKQQENLRYMLIIILISGVFFFIYSFISSKKEGK

SEQ ID NO: 11805 - DNA, 759 bp, Unknown
  Obtained from environmental sample
  misc_feature (1)..(759): n is a, c, g, or t
ttgggatatcataatactgaagatgaagaggaagcttttttgtatttgatggatttatggtatgaacagagttatgattcgtttggacaatttattacagctatcttaataaattttgctgaatggcattcaacaaaaattgatttcactcctattcatcataatttaaagcaaattggaataaaagataaaattttacttgatttcacaaaagacgcaagaaaaattagagattctaaacctgaaaaaattgaagaaaaactgattgaaactaaaaatactccaaaaataaaaaccgattctaaaaaagtatttatagttcacggacacgatgaaaaagcaaggttgccactaagtaaaatattgaaagatgacttaggttttgagcctgtaattttacaagaagaaccaaacgtaagtttagaaactattatcacaaaatttgaaagacttgccaaagattgttcagcagcaattattttatttactcctgatgacgaagcatatggtaaattaagagcaagacaaagtgttattttagaattaggctattttctcggcaaatttcaatgccaaccgaatagaagaataattataattaacactggagaaatagaaataccttctgatatctctggagttatatatcttgaatattttaaaaatatgagagagatattttatgacttaaaaaacaatttgaaacttggggacataaattataaaagaacatctgctaacatcgtgtataagatatag

SEQ ID NO: 11806 - protein, 252 aa, Unknown
  Obtained from environmental sample
  misc_feature (1)..(252): Xaa is any amino acid
MGYHNTEDEEEAFLYLMDLWYEQSYDSFGQFITAILINFAEWHSTKIDFTPIHHNLKQIGIKDKILLDFTKDARKIRDSKPEKIEEKLIETKNTPKIKTDSKKVFIVHGHDEKARLPLSKILKDDLGFEPVILQEEPNVSLETIITKFERLAKDCSAAIILFTPDDEAYGKLRARQSVILELGYFLGKFQCQPNRRIIIINTGEIEIPSDISGVIYLEYFKNMREIFYDLKNNLKLGDINYKRTSANIVYKI

SEQ ID NO: 11807 - DNA, 744 bp, Unknown
  Obtained from environmental sample
  misc_feature (1)..(744): n is a, c, g, or t
ttggtaactacctctttaaaatatagtacgcaattttatcaaaaacagttctcttcatatatcacaacttgtggaactacaagaatacctaaaaatgcaattgaacaagaaaagtttgaaagctatacagattatatggattttggatttgaaaaagataatgacggatacttttttaaaataggttcagttgtagatagttatggtatttgtaaaagtatgacagaaaatatccaaaccaactttaactatgaagtaaagagtttagagtataaagataatttgtggattgttaacggagagtttaaaacaaaaaatattattcttacaacaggatatgagacaaaattattggatcagttttatctcaatattcgagctgtgtggggaagaagaatagatattttgacctctacacaagtatcttataattatcataaagagtgttccgtatcaaaaagtacaaaaaaggatgataagtttttagtatctattggtgcaacacaccatagagataaaagagatgttgaagatattgaacacaatcatcaagagttattacaaaaagcaagaggaataatacaacttgaaaatatagagatagttaaagattattatggagcaagagctagcagtgtggattattttccaatagtaggggagttgattgatggtgaagcaacaattgaagagtttccttatctaaaaaatggtacaaatgtagaatcaaaaaggatttactag

SEQ ID NO: 11808 - protein, 247 aa, Unknown
  Obtained from environmental sample
  misc_feature (1)..(247): Xaa is any amino acid
MVTTSLKYSTQFYQKQFSSYITTCGTTRIPKNAIEQEKFESYTDYMDFGFEKDNDGYFFKIGSVVDSYGICKSMTENIQTNFNYEVKSLEYKDNLWIVNGEFKTKNIILTTGYETKLLDQFYLNIRAVWGRRIDILTSTQVSYNYHKECSVSKSTKKDDKFLVSIGATHHRDKRDVEDIEHNHQELLQKARGIIQLENIEIVKDYYGARASSVDYFPIVGELIDGEATIEEFPYLKNGTNVESKRIY

SEQ ID NO: 11809 - DNA, 978 bp, Unknown
  Obtained from environmental sample
  misc_feature (1)..(978): n is a, c, g, or t
atgggtaggatcggctcgagatcaactgcactgattggttcttttgatgaggagtttttagagcttccagaagaggtaatcataggttctatgaaagagcatcaaagatattttgcagtatataaagatggtaaaattacaaataaatttatcgtagtttctaactcttatacaaaagatttttcatatatagttgcaggaaatgaaagagttttaagaccaagactaagtgatggtatgttcttttggaaaaatgatattaaaaatggactgaacaatgaggaacttaaaagggtgagttttgtggatggtttaggttctatttttgataaatgtcaaagagaagcttttatagcacaattgttagctactcaatttgatatggaagaggatagagctttattagaggaagctatgatgattagtaaagctgaccttattacggatatggtatatgagtttactgatttacaagggattatgggatattactatgctaaaaaagaggggagagatgaccttgtagcacttgctttaaaagaacaatatcttccagatggagagacaagccaaacaccatcaaatacttttagttgtgtagttgccttaagtaataagcttgataatcttatgggactgtttagtgttggtatgattccaacaggaagtagagatccatttgccttaagacgagcagctttaggattgtttagaatagctattgagcataagcttcatgttgatatagaatcaattattgataactcaatggaaaaatacccttctttagataaagcacaactcatggagtttttaaacgaaagattatataaactctatagcaaagtaaatcccagtgtcataaaagctgtacttaatagggatggccaaaaaaacctttttagtataagtttaaaaataaaagctttaaatccaatagtaaatagcagtggatttaaaaagttgagtgataccctt

SEQ ID NO: 11810 - protein, 326 aa, Unknown
  Obtained from environmental sample
  DOMAIN (1)...(298): Glycyl-tRNA synthetase beta subunit
  misc_feature (1)..(326): Xaa is any amino acid
MGRIGSRSTALIGSFDEEFLELPEEVIIGSMKEHQRYFAVYKDGKITNKFIVVSNSYTKDFSYIVAGNERVLRPRLSDGMFFWKNDIKNGLNNEELKRVSFVDGLGSIFDKCQREAFIAQLLATQFDMEEDRALLEEAMMISKADLITDMVYEFTDLQGIMGYYYAKKEGRDDLVALALKEQYLPDGETSQTPSNTFSCVVALSNKLDNLMGLFSVGMIPTGSRDPFALRRAALGLFRIAIEHKLHVDIESIIDNSMEKYPSLDKAQLMEFLNERLYKLYSKVNPSVIKAVLNRDGQKNLFSISLKIKALNPIVNSSGFKKLSDTL

SEQ ID NO: 11811 - DNA, 501 bp, Unknown
  Obtained from environmental sample
  misc_feature (1)..(501): n is a, c, g, or t
atgcttccgagtaaaaatgggattgagatacttcaatcaattagagaaaaaaacatcactactcctattattatgcttactgcaaaagatgagattgacaatagagttttaggacttactaatggtgcagatgactatatgtgtaagccttttagttttaaagagttgcaagcaagagcaacagcactttatagaagatcaatctccttaaatacaaatattatacaaataaaagatctcactattgatattgatgcaaaaaatgtaaaaaaagatgatgtggatatacttttaacccaaaaagagtatgagcttttactatttttaatcaaaaataaaaatagaacagtttcaaatagcatgatagaagagcaactctggagtaatgaagagtatataaatagtaatgtgatacaagtcactatttataatttaagaaaaaaaatatcaaaagattttattaaaagttcaagaggactagggtatagaattgaagtttaa

SEQ ID NO: 11812 - protein, 166 aa, Unknown
  Obtained from environmental sample
  DOMAIN (93)...(164): Transcriptional regulatory protein, C terminal
  misc_feature (1)..(166): Xaa is any amino acid
MLPSKNGIEILQSIREKNITTPIIMLTAKDEIDNRVLGLTNGADDYMCKPFSFKELQARATALYRRSISLNTNIIQIKDLTIDIDAKNVKKDDVDILLTQKEYELLLFLIKNKNRTVSNSMIEEQLWSNEEYINSNVIQVTIYNLRKKISKDFIKSSRGLGYRIEV

SEQ ID NO: 11813 - DNA, 642 bp, Unknown
  Obtained from environmental sample
  misc_feature (1)..(642): n is a, c, g, or t
atggaacgtggctgtgcatttaaacagccggaaggagtttttatcgatttagattttctgaaaactctacctaaaaaacaaatccaaaatgggttgggtgaaataattaaatatggaatcataaaagataaatttttgtttgcgatgcttgaggataatatagacaagattttcaagttaaacctagaaattatggaaaaaattatttttcgatgtgcgcaaataaaagcaaaagttgtagaaaaagatgaatttgataaaaaggatatccgaataatattaaattatgggcataccttggcacatgctattgaaaccgccactaactatacaaatgaatactttcgtggtgaagctgttgccttacgcatgctaatggcttcagatattgctgttaatttggatatgttcactcagcctaatttcgatagattgaaaattcttttaatagcagcagggctaccaacgtttgtaaaaggagtttctcttagcaaaattcaaagtgtttatttgcttgataaaaaatttacgaaaggaacaacacgttttgttttgcctagaagtattggaaaagttgttgttgttgatgatctcccagaactattaataaaaagcgttgtaaaaaaatatgttaggaaataa

SEQ ID NO: 11814 - protein, 213 aa, Unknown
  Obtained from environmental sample
  DOMAIN (1)...(208): 3-dehydroquinate synthase
  misc_feature (1)..(213): Xaa is any amino acid
MERGCAFKQPEGVFIDLDFLKTLPKKQIQNGLGEIIKYGIIKDKFLFAMLEDNIDKIFKLNLEIMEKIIFRCAQIKAKVVEKDEFDKKDIRIILNYGHTLAHAIETATNYTNEYFRGEAVALRMLMASDIAVNLDMFTQPNFDRLKILLIAAGLPTFVKGVSLSKIQSVYLLDKKFTKGTTRFVLPRSIGKVVVVDDLPELLIKSVVKKYVRK

SEQ ID NO: 11815 - DNA, 687 bp, Unknown
  Obtained from environmental sample
  misc_feature (1)..(687): n is a, c, g, or t
ttgcctaaaactgataccgttcaggaagttttccctaattcatttgttttctataaaccaaaggatgttgtaagtggcgattttccttggatgttcgaaaaaggtgatattacatatatagctgcagttgactgtacaggacatggtgttcctggcgcacttctgtcttttattggatattttcttcttaataatattgttgatcatgatatagatttctcagcaggagaaatattagatatgtttcaccaacgtgttagaactaccttgcgacaagataaagatggagctaatagtcgtgatggtatggatatagctttctgtaaaataaataaaaaaacaaataaaattgaatattcaggagctcacagacctttgtatttatttagaaatgaggagctaatacaatttaagggtgatagaaaagcaattggaggtatacctcacccgaaaaaaaaggaacagaatttcacaaattacgtagtagatattaataagaacgataagatattctttttctctgatggattgcctgatcaaatgggtgggcctgatggtaaaaaatatcaagcaaaaagaattagagagcatattgtaaacaataataatttttctatgaatgaatattctgattattttgccaaagatttttatgattggaaagatgaacacaaaccaaatagatga

SEQ ID NO: 11816 - protein, 228 aa, Unknown
  Obtained from environmental sample
  DOMAIN (34)...(225): Stage II sporulation protein E (SpoIIE)
  misc_feature (1)..(228): Xaa is any amino acid
MPKTDTVQEVFPNSFVFYKPKDVVSGDFPWMFEKGDITYIAAVDCTGHGVPGALLSFIGYFLLNNIVDHDIDFSAGEILDMFHQRVRTTLRQDKDGANSRDGMDIAFCKINKKTNKIEYSGAHRPLYLFRNEELIQFKGDRKAIGGIPHPKKKEQNFTNYVVDINKNDKIFFFSDGLPDQMGGPDGKKYQAKRIREHIVNNNNFSMNEYSDYFAKDFYDWKDEHKPNR

SEQ ID NO: 11817 - DNA, 702 bp, Unknown
  Obtained from environmental sample
  misc_feature (1)..(702): n is a, c, g, or t
atgatggcaacagatatttatccaaatcgtatctctctagcaaaagagaaactcaaacaaatcatagcaatgagccaaaatacaacaataggagttctactttttgcaaaagactcttttgtattaagtcctgttacggaggattttatctcattaaactatatagtaaaaaaccttgaaacagatcttaattttccaaatggttcaaatatctttgctacacttgatgctacaaactatatgcttgaagatttcaatgtaaaaaatcttataattttaagtgatggtggaaatagtaatgactttaaagaggagatagagtatgctcaagataaaaacatcgctgtatatactataggagttgctacaaaaaaaggtgctgtgataccagataaacaaggtggatatttaaccaatgaagatgggaatatagtaactgtaacactcaatgaatcaataaaaaacttaagccttcaaacaaatggtggctatgtggattttagtttagataatagcgatgtaaaagcgatacttaacagaattaatacacagtcacaaaaagaggagctttcagttcaaaagtttaaaacatacactgagcttttttattatccattggctttaggattatttttctttttattagcttggagttcactcccaacaagaatcttcaaaaaaaatatagcagtattcctttag

SEQ ID NO: 11818 - protein, 233 aa, Unknown
  Obtained from environmental sample
  misc_feature (1)..(233): Xaa is any amino acid
MMATDIYPNRISLAKEKLKQIIAMSQNTTIGVLLFAKDSFVLSPVTEDFISLNYIVKNLETDLNFPNGSNIFATLDATNYMLEDFNVKNLIILSDGGNSNDFKEEIEYAQDKNIAVYTIGVATKKGAVIPDKQGGYLTNEDGNIVTVTLNESIKNLSLQTNGGYVDFSLDNSDVKAILNRINTQSQKEELSVQKFKTYTELFYYPLALGLFFFLLAWSSLPTRIFKKNIAVFL

SEQ ID NO: 11819 - DNA, 417 bp, Unknown
  Obtained from environmental sample
  misc_feature (1)..(417): n is a, c, g, or t
atgaaaaatctattgaaaaatcaaaacaacacggttgttttagttgaatcaaaagcgcaagtggcaaatacactactaacacaaatcaaaggttccaatccatacggaataggttggagaccgccacaagagcacgaggagaaaaaatacactgagaaaactgtgtacaatctgaatagtgaagcacaaaaatatttcaaagatggttatgtatgtttaggaaaagcaaaaataaatgaagtgataagttttactgaaccaataacaataagctcatataaattaacaaatgtgaaattctcatatactattgaagatcttccaaattgggtgaacatagaggataatattaaaactaaaaatatagagctatatttaaaagataacaaatgggaacacaaatcaagttcattttaa

SEQ ID NO: 11820 - protein, 138 aa, Unknown
  Obtained from environmental sample
  misc_feature (1)..(138): Xaa is any amino acid
MKNLLKNQNNTVVLVESKAQVANTLLTQIKGSNPYGIGWRPPQEHEEKKYTEKTVYNLNSEAQKYFKDGYVCLGKAKINEVISFTEPITISSYKLTNVKFSYTIEDLPNWVNIEDNIKTKNIELYLKDNKWEHKSSSF

SEQ ID NO: 11821 - DNA, 357 bp, Unknown
  Obtained from environmental sample
  misc_feature (1)..(357): n is a, c, g, or t
atgagtaacaaatctgtgatttcaacactaataataagcatattctttacagcttgtacggatcaaaaagaagcaaataatcaaaactttacaaatgcacttaacgaatatgttaaaactggtaaacaccaattaaattgttttcatgttggttataattttcccttaattaaaaatacatttaatgaaaaatctattgaaaaatcaaaacaacaaggttttttagttgaatcaaaagcacaagttgcaaatacactactaacacaaatcaaagggttcaatccatacggaataggttggagaccgcccaaagaaccagaagaaaaaaataccctgaaaaaactgtttacaatctga

SEQ ID NO: 11822 - protein, 118 aa, Unknown
  Obtained from environmental sample
  SIGNAL (1)...(18)
  misc_feature (1)..(118): Xaa is any amino acid
MSNKSVISTLIISIFFTACTDQKEANNQNFTNALNEYVKTGKHQLNCFHVGYNFPLIKNTFNEKSIEKSKQQGFLVESKAQVANTLLTQIKGFNPYGIGWRPPKEPEEKNTLKKLFTI

SEQ ID NO: 11823 - DNA, 936 bp, Unknown
  Obtained from environmental sample
  misc_feature (1)..(936): n is a, c, g, or t
ttgatcgccgggtatacgntctgccctcagacagttttgccccttgtcaatacacaaaacattgaaaaagagtattttgagatcatcatcatctcattgatacagatcgtctcaaaggcaccctttgtctatctcggtgaaaatgaagagatagagatctttgccaacataaccggaggcatcgtttttgaaaaagagtcggccatggcccatgccgatctcgccctgcgtgaagccaaaagcttacacagggactacatcatctaccatgacggtatgcgtcaggagatagcctataaaaacaatatggagtgggtacaaaagatcaaaacagccattgcacgagacaagatcattccctacttccagcctatcatcaataaccacactaaaaagattgaaaagtacgagtgtctggtccgtcttgttgatgaacaaaaacaggtcatatcgcctttttactttcttgacatagccaaacagtcacgactctatgagtctattaccaagatcatgatcaaaaaatcgtttcaggctttcagcagcaatgattatgagtttagtattaacctctccatcgaagatattacagactacaatctttttggctatatcaaaagtatgctaagcatataccctcttgccaaacgtgtctgttttgagatacttgagacagaaaagatcgaagattatgcggtcatatccaacttcgtaagcgaagtaagagagctgggatgcaaggtcagtatcgatgacttcggctccgggtactcaaacttctcgcatcttctcaacttgaattttgactacctgaaaatcgatgccctcctcctcaaagatatacctatccaccaaactaaaccgatcttcgtaacgacgattgtccccctttgccaaggagctggggcatccaagacaatcggaagagtttggtag

SEQ ID NO: 11824 - protein, 311 aa, Unknown
  Obtained from environmental sample
  DOMAIN (101)...(306): EAL domain
  misc_feature (1)..(311): Xaa is any amino acid
MIAGYTXCPQTVLPLVNTQNIEKEYFEIIIISLIQIVSKAPFVYLGENEEIEIFANITGGIVFEKESAMAHADLALREAKSLHRDYIIYHDGMRQEIAYKNNMEWVQKIKTAIARDKIIPYFQPIINNHTKKIEKYECLVRLVDEQKQVISPFYFLDIAKQSRLYESITKIMIKKSFQAFSSNDYEFSINLSIEDITDYNLFGYIKSMLSIYPLAKRVCFEILETEKIEDYAVISNFVSEVRELGCKVSIDDFGSGYSNFSHLLNLNFDYLKIDALLLKDIPIHQTKPIFVTTIVPLCQGAGASKTIGRVW

SEQ ID NO: 11825 - DNA, 759 bp, Unknown
  Obtained from environmental sample
  misc_feature (1)..(759): n is a, c, g, or t
gtgcttaaagtttgcaaacgtttaagtaaaacagttaaggaaactattgaagaaaaccactttccgttagtactttccggagatcattcttctgcattggggactattagtggattaaaatgtgctcatcccgataaacgtattggcgtggtttggatagatgctcatggcgatttgcattctccatacactactccatcaggtaatattcacggaatgcctttagctgctgctttggcagatgataatttagacagaaaagtaaatgaagttaaggaagaaactcatgataattgggaaggaatgaaaaatattggtggaatttctccaaaagtattgcatgaagatgtcgtgttttttggagtgagagatacggaagaaccggaagattattgcatgtcgaaaaatggcatgaaaaactacaaagtagaagaagttaggtttagagggttagaagtatgtgttaaagaagcattggagaaacttaaaaattgcgattacatttatatttcttttgatgtggattcaatggattgcgatttaatttctaaaggcacaggaactcctgtatctaaagggtttgaccaatatgaagtgaaaaacattattaatgcgttgatagaaagtaacaaagtaatttgcttagaagtagtggaagtaaaccctactttagataataaaggaaatgtaatggcagaaactgcttttgaagtggtgaatgatgtcaccaaaaatattgaaactaaattatcaatatga

SEQ ID NO: 11826 - protein, 252 aa, Unknown
  Obtained from environmental sample
  DOMAIN (1)...(247): Arginase family
  misc_feature (1)..(252): Xaa is any amino acid
MLKVCKRLSKTVKETIEENHFPLVLSGDHSSALGTISGLKCAHPDKRIGVVWIDAHGDLHSPYTTPSGNIHGMPLAAALADDNLDRKVNEVKEETHDNWEGMKNIGGISPKVLHEDVVFFGVRDTEEPEDYCMSKNGMKNYKVEEVRFRGLEVCVKEALEKLKNCDYIYISFDVDSMDCDLISKGTGTPVSKGFDQYEVKNIINALIESNKVICLEVVEVNPTLDNKGNVMAETAFEVVNDVTKNIETKLSI

SEQ ID NO: 11827 - DNA, 465 bp, Unknown
  Obtained from environmental sample
  misc_feature (1)..(465): n is a, c, g, or t
gtgtatgtgatgaaaattttgttgcttatttcaatacttttttactgcctccttgcaaacagtgcaaatgaattaatacatgaagactctccatatctgaagcaacacgcttacaatcctgtcaaatggcttccttggggtgatgaagctttagagttggcgaagagagaacataagcctatatttctctccatcggctacagcacctgtcactggtgccatgtaatggctagagagtcatttgaaaatgaagagattgcaaaacttttaaatgattatttcattccaataaaagttgatcgtgaagagatgcctcatctggacatatactatcaagaacttcatataaaactgaaaaaacgctcaggtggttggcctcttagtgcatttttagatgaggatgcaaatcctttttttgtgggtacctatattcctcccaaagatacagcaagattgaaggtatga

SEQ ID NO: 11828 - protein, 154 aa, Unknown
  Obtained from environmental sample
  SIGNAL (1)...(19)
  DOMAIN (21)...(93): Protein of unknown function, DUF255
  misc_feature (1)..(154): Xaa is any amino acid
MYVMKILLLISILFYCLLANSANELIHEDSPYLKQHAYNPVKWLPWGDEALELAKREHKPIFLSIGYSTCHWCHVMARESFENEEIAKLLNDYFIPIKVDREEMPHLDIYYQELHIKLKKRSGGWPLSAFLDEDANPFFVGTYIPPKDTARLKV

SEQ ID NO: 11829 - DNA, 372 bp, Unknown
  Obtained from environmental sample
  misc_feature (1)..(372): n is a, c, g, or t
ttgaaattgcctgaaacttaccgtaatctgatagaggaagatataattgatgattattcaatgggttatgcatcattagttgggtttagagccggaatatgtgattcgtataatttttatgatcttgatattgaggtggaaactaaactccgaatccatccctttatggtaatggatggtacattaaaagattatatgggattaacacccaccgatgctattgaacaaatccgaaaattgattaatgaagttaaaaaggttaacgggactttttcttcattatggcataatgaaccattaagtgatgaaaaacgatggaaaggatggcgtaaagtatatgaagaattgttgaaaatggcagctgaagattaa

SEQ ID NO: 11830 - protein, 123 aa, Unknown
  Obtained from environmental sample
  misc_feature (1)..(123): Xaa is any amino acid
MKLPETYRNLIEEDIIDDYSMGYASLVGFRAGICDSYNFYDLDIEVETKLRIHPFMVMDGTLKDYMGLTPTDAIEQIRKLINEVKKVNGTFSSLWHNEPLSDEKRWKGWRKVYEELLKMAAED

SEQ ID NO: 11831 - DNA, 753 bp, Unknown
  Obtained from environmental sample
  misc_feature (1)..(753): n is a, c, g, or t
ttgactattcaattcgctgctgttattacaactgcacatagtgatgcagattttttaaaagaggcaattcaactaagagttaggggatatgttacaaaacctttaaaaataaatgatttaatagatactattagcatagcagcagaaccaaaatatttaaaagatccactagaggttttaaataagcaattatctttagaggttgaggagaaaacactagagttacgatctattttagactctcaagaaaatatgatacttgttttcaatgaatacaatgtatcctctgcaaataaaacatttttagagttttttgagctagaaactattgaagattttattgcaaatgataaatcaataaacagttactttatagaagaagaagagtatttttatacaaaagaaaatgactggatatctgaaataatgaaacttgatgatatgaaaagggtagttcgtattaaacacgcttcatatgaagataaaatctttagagtagatattaaaacatttttttatgaaacaaaacattatgttgtatctttcactgatatcacagaactaagagaatacacatacgaattacaatatagagcacctcatgatagtttaacaaaactgtacaatagacaaaaattaagtgaggaactctcaaaagagatattaggggagaacagatatccacataacttatctattttagtgtttgatattgaaacctttaaaaatatccatgaacccctagggccatga

SEQ ID NO: 11832 - protein, 250 aa, Unknown
  Obtained from environmental sample
  misc_feature (1)..(250): Xaa is any amino acid
MTIQFAAVITTAHSDADFLKEAIQLRVRGYVTKPLKINDLIDTISIAAEPKYLKDPLEVLNKQLSLEVEEKTLELRSILDSQENMILVFNEYNVSSANKTFLEFFELETIEDFIANDKSINSYFIEEEEYFYTKENDWISEIMKLDDMKRVVRIKHASYEDKIFRVDIKTFFYETKHYVVSFTDITELREYTYELQYRAPHDSLTKLYNRQKLSEELSKEILGENRYPHNLSILVFDIETFKNIHEPLGP

SEQ ID NO: 11833 - DNA, 480 bp, Unknown
  Obtained from environmental sample
  misc_feature (1)..(480): n is a, c, g, or t
atgtttaatgaaaaacgagaaatagcaggattaagcaaaactcagtttgaaagactcgcaaatattcaaagacgtagtttggatggaatcctggataaaacttcaaaacagacagatgtcgtcaatttacttaaactcggagagttcttggatttatcattagaagaattaatgattctccatttcaaagatagacatgtagaagaaataaaagaattacaaaattcaatggaaataacatttatgaataaacatttcgaccttaaaaacatatcttctcttggattcattgaaaaagactcctctattgaggatctgaaaaacagaatctgtgaatttttccaactcaagagtatttacgattatgaaaatgaactaagcggagcattatatagtccatcaaaaagacaatttattgataaaatggaaggactttttggattaagtctccaaaaaaatattttggaattggttaaataa

SEQ ID NO: 11834 - protein, 159 aa, Unknown
  Obtained from environmental sample
  misc_feature (1)..(159): Xaa is any amino acid
MFNEKREIAGLSKTQFERLANIQRRSLDGILDKTSKQTDVVNLLKLGEFLDLSLEELMILHFKDRHVEEIKELQNSMEITFMNKHFDLKNISSLGFIEKDSSIEDLKNRICEFFQLKSIYDYENELSGALYSPSKRQFIDKMEGLFGLSLQKNILELVK

SEQ ID NO: 11835 - DNA, 549 bp, Unknown
  Obtained from environmental sample
  misc_feature (1)..(549): n is a, c, g, or t
ttgattggtatttctaataaagatttacttggtgcttttgatgaattaagtactggcttagtgagtatatttggtaaagaccttattcaaaaatttggtaaatatttaattaataaatctggaaaggatttatttggtgctttaggagaattagatacagacttagtaagtgtatttggtaaagaccttattcaaaaatttggtaatgatttaattaatatgtccggtaaagacttatttggtgattttaatcaaatgggagagatgtgggatctgtctcattatggtgttcatttagataatgatgttttatttaatgtaatgagtgttaaaaatggatttacagatgaattgtgggatgggatttcttatcgttcggataaagcagtaaaagataaattggcattattatctgtaaaaagttctatattttccaattatatttccgagattaaatttaaagggaatgataaaaaatttaatgagataactcgtgattttatttttaaagataattcaagcgaggaaataaaatatattggtttctaa

SEQ ID NO: 11836 - protein, 182 aa, Unknown
  Obtained from environmental sample
  misc_feature (1)..(182): Xaa is any amino acid
MIGISNKDLLGAFDELSTGLVSIFGKDLIQKFGKYLINKSGKDLFGALGELDTDLVSVFGKDLIQKFGNDLINMSGKDLFGDFNQMGEMWDLSHYGVHLDNDVLFNVMSVKNGFTDELWDGISYRSDKAVKDKLALLSVKSSIFSNYISEIKFKGNDKKFNEITRDFIFKDNSSEEIKYIGF

SEQ ID NO: 11837 - DNA, 387 bp, Unknown
  Obtained from environmental sample
  misc_feature (1)..(387): n is a, c, g, or t
atggataaaataaaaattataggcgcacgtgaacacaatttaaaaaatatatctttagagattccaaaaaactctcttgttgtctgtacggngctaagcggtagcggtaaatctacactagcttttgatacactctacgcagaagggcaacgtcgttacatggagtcactctcatcttatgctcgtcaattcctagatcgtgtaggaaaaccagacgttgataagatagaaggtcttactcctgctatcgccatagatcaaaaaacacctcaaaaaatcaccgctcaactgttggaacaattactgaaaattttagactattttccgcctttaaaaggctccgaaagggtgtacaaccactggtccataaagggtgggaaaaacaaa

SEQ ID NO: 11838 - protein, 129 aa, Unknown
  Obtained from environmental sample
  misc_feature (1)..(129): Xaa is any amino acid
MDKIKIIGAREHNLKNISLEIPKNSLVVCTXLSGSGKSTLAFDTLYAEGQRRYMESLSSYARQFLDRVGKPDVDKIEGLTPAIAIDQKTPQKITAQLLEQLLKILDYFPPLKGSERVYNHWSIKGGKNK

SEQ ID NO: 11839 - DNA, 933 bp, Unknown
  Obtained from environmental sample
  misc_feature (1)..(933): n is a, c, g, or t
atgaataattttagatcaaaatatcttatcagactgttaattatatccatatttctatccaaaatatacgttgacaacataactccaacaaaattaacacctactttagagaacaaaacagcccttgctcaactggagtataacaccatatacaataatctaaaagatcatgcacttataattttcagtgaaatcataaatacgaaaaatgtaataaatatatttacacaagccaataatggatcttctatagaacagagttatttaagagaaaaactctatacagagcttctagaatcttatcaacgtctcaataatttggtaaatttaaaacaacttcattttcatttaaaaaataatagaagttttttaagaatgcataaaccaaataaatttggtgatgatttaacagatattagagagtctgtaaaatatgcaaataaatataaaacaaacgtttacggttttgaggcaggaagattaaatgaaggatacagatttgtatttccactttttgatgaactaaaaaatcatataggcagtgttgaagtatcatttcccgcaaaagcactagttaaatctataaaaagtgatctttataatcctctttttattataaaagagagtgttgtccgcaaaagagcttggagtgaatacagtagtaaatttatgaacactgcaattagtgatgatttcgttatctcatcatcttcaaaaatgatatcacaagttattatgacacaagatataaaagatgaatttagcaaacactcaatggaagctaaagcatactccacatatataaaaatgaaacacagatctgtaatagcttcatttatacccgtaagaaatgctataaataaggagttagtagcctatggagtgcttctctcaacccagattcttttgaacatatttatgaccataaattag

SEQ ID NO: 11840 - protein, 310 aa, Unknown
  Obtained from environmental sample
  misc_feature (1)..(310): Xaa is any amino acid
MNNFRSKYLIRLLIISIFLSKIYVDNITPTKLTPTLENKTALAQLEYNTIYNNLKDHALIIFSEIINTKNVINIFTQANNGSSIEQSYLREKLYTELLESYQRLNNLVNLKQLHFHLKNNRSFLRMHKPNKFGDDLTDIRESVKYANKYKTNVYGFEAGRLNEGYRFVFPLFDELKNHIGSVEVSFPAKALVKSIKSDLYNPLFIIKESVVRKRAWSEYSSKFMNTAISDDFVISSSSKMISQVIMTQDIKDEFSKHSMEAKAYSTYIKMKHRSVIASFIPVRNAINKELVAYGVLLSTQILLNIFMTIN

SEQ ID NO: 11841 - DNA, 369 bp, Unknown
  Obtained from environmental sample
  misc_feature (1)..(369): n is a, c, g, or t
atgatgtataatccagatgagtccattagagtcttaaatgagattcatgatttaggtataaatttagcaattgacgattttggtaccggatactcatcactctcatatttgaaaaaactgcctattgataagctaaaaatagatcaatcatttataagagatattttaactgatgaagatgatatggcgatagtaaaatctaccatctctctagcaaaatcaatgaatttaaatatacttgcagaaggtgttgaagaggtagctcaaaaagagtttttactggaaaatggatgtaaaaatattcaaggttatctatactcaaaacctatgaacaaagatgatatgagagagtatttgaaaaatttctaa

SEQ ID NO: 11842 - protein, 122 aa, Unknown
  Obtained from environmental sample
  DOMAIN (1)...(109): EAL domain
  misc_feature (1)..(122): Xaa is any amino acid
MMYNPDESIRVLNEIHDLGINLAIDDFGTGYSSLSYLKKLPIDKLKIDQSFIRDILTDEDDMAIVKSTISLAKSMNLNILAEGVEEVAQKEFLLENGCKNIQGYLYSKPMNKDDMREYLKNF

SEQ ID NO: 11843 - DNA, 636 bp, Unknown
  Obtained from environmental sample
  misc_feature (1)..(636): n is a, c, g, or t
atgcatgctccagattataaaatagattggacacatgttaggaaattaatcaatcctaaaacaaaaatgattattataaatacacctcataatccaacagcaacagtattttctaaagatgattttttagctttagaaaaacttatcgccaataccgatattattgttttgagtgatgaagtatatgaacatattatttttgatgaatacaaacattatagtgcatctatgtttccaaagttagcagagcgttcatttatcgtttcttctttcggaaaaaccttccataatactggttggaaaatgggttattgtattgctcccgaaaccttaatgagcgagtttagaaaagtacatcaatatgttgttttttcagtaaatacgcctgctcaatttgccttagcagaataccttaaaaatgaaagtaattacttatccttaagtgctttttatcaacaaaaaagagacttctttacttctgtaatacgaaattctaaatttgaaattattccttcaaaaggcacttattttcagttattaagctataaaaatatttctgatgaaaaagatactgattttgcagtaagacttactatagagcacatgttagccaccatccctgtttctgttttttaa

SEQ ID NO: 11844 - protein, 211 aa, Unknown
  Obtained from environmental sample
  misc_feature (1)..(211): Xaa is any amino acid
MHAPDYKIDWTHVRKLINPKTKMIIINTPHNPTATVFSKDDFLALEKLIANTDIIVLSDEVYEHIIFDEYKHYSASMFPKLAERSFIVSSFGKTFHNTGWKMGYCIAPETLMSEFRKVHQYVVFSVNTPAQFALAEYLKNESNYLSLSAFYQQKRDFFTSVIRNSKFEIIPSKGTYFQLLSYKNISDEKDTDFAVRLTIEHMLATIPVSVF

SEQ ID NO: 11845 - DNA, 774 bp, Unknown
  Obtained from environmental sample
  misc_feature (1)..(774): n is a, c, g, or t
atgatacattttcaacaaaattttaaacaacagcttacaaaaaaagacaataaagtaattgatgagactttttctattttaaaagaggaaaaagactctaatagtattggttattataaactttatgaaacatctcaagatattcttaaaggtgtaaaaagatataaaaaagagaataaatacttaaaaaataaaaaaataaaaaacattgttgttataggtattggaggttctagtttgggtacaaaagccgtatatgagcttataaaactaaaacaaaaatcaactactaacttaatatttttggaaaatgtagatcctttggatattgcttcaaaaacacaaaatattaaaaaaacaaattcactgtttgttgtaatatcaaaatcgggttcaactattgaaacgatctctatttttaaatatgttttagaaaaatttaatttagatttaaaaaaagataatagtagattaattgcaattacagataaaggttcaaacctatcaaagttagcactaaaaaataatatacctcaatttaatataccacttaatgtgggtggaagattttctgtattaagtgctgtgggtgttgtacctttagttcttgctggatataaagttgaaaaacttttagaaggttctaaaaattttatagaatcattttttgataaaaaagaaaatcacttactccaaaaagcatattactatttttataataaagataaatactgtatcaatacactttttagctactctacttatttctcttaa

SEQ ID NO: 11846 - protein, 257 aa, Unknown
  Obtained from environmental sample
  misc_feature (1)..(257): Xaa is any amino acid
MIHFQQNFKQQLTKKDNKVIDETFSILKEEKDSNSIGYYKLYETSQDILKGVKRYKKENKYLKNKKIKNIVVIGIGGSSLGTKAVYELIKLKQKSTTNLIFLENVDPLDIASKTQNIKKTNSLFVVISKSGSTIETISIFKYVLEKFNLDLKKDNSRLIAITDKGSNLSKLALKNNIPQFNIPLNVGGRFSVLSAVGVVPLVLAGYKVEKLLEGSKNFIESFFDKKENHLLQKAYYYFYNKDKYCINTLFSYSTYFS

SEQ ID NO: 11847 - DNA, 372 bp, Unknown
  Obtained from environmental sample
  misc_feature (1)..(372): n is a, c, g, or t
atgaaagaagaaattcgagggatactagaagataaatcgattctattaacacagcagtattttaaacttcaagaattatttgaagcaaagtatggaaaagatactgttgttttgatggaggttggaactttttatgagacctatgaagtaaacaatgatgaggaaaaaatagggaaagctaaagagatagcggaacttttaaatatcccacttacacgaaaaaacaaatcactccttgaaaactcacaaacaaatcctttgatggctggtgttcctgcagtatcttttgaaaaacacctcactcgtataatctcaagagcaaaagtacacaatagctattatcaaacaagttggaacaccaccaaatgttag

SEQ ID NO: 11848 - protein, 123 aa, Unknown
  Obtained from environmental sample
  DOMAIN (16)...(117): MutS domain I
  misc_feature (1)..(123): Xaa is any amino acid
MKEEIRGILEDKSILLTQQYFKLQELFEAKYGKDTVVLMEVGTFYETYEVNNDEEKIGKAKEIAELLNIPLTRKNKSLLENSQTNPLMAGVPAVSFEKHLTRIISRAKVHNSYYQTSWNTTKC

SEQ ID NO: 11849 - DNA, 804 bp, Unknown
  Obtained from environmental sample
  misc_feature (1)..(804): n is a, c, g, or t
atggaaccagcaaatgaattagagaaaaagctgaaggagccgttgcataaaatcgacatctgcttcaacatagccggggtagataaatctaaccgtaaagcccgggttagtgttcaagtaaagccacaagcaattctagatcgacttgatgagctaatgggaattaatggttggactgttaattatattgttacaggcaatattgttgtatgtaaactctctttgagattagagaatgattggatatctaaagaagggaccgcgctttctgtagagccaatctgcaacctgtctgattctgcattagctaatgctgctatcaaattcggaatcggaagacagcttctaaatcaatcggatgtcattgtcgattttaaggataaaaagccagaacacccaaggaatgcggtacattactatgacgctcaagatatagtgggttggtgggaagaacctgatgtattgcatactgaacctatagagaaggataagctaacagaaactatcggtgagacagatttcaaaaaattaaatctggtgcagaaactggacaaattaattgagctggggatcatcaccgaggtgaaacatgttggctatcgtactaaaatcgaagataaaacttcccgcccgggattattgaggtatttcgaaaagcaattcaatcttctctatgatctgcattacatagctattaaccatgagaattccgcagataaccgggctaccttttacaaacgaataagggcctcccaaaaggaagggcttcccctaattaagaacgggaaatccaaccccctttag

SEQ ID NO: 11850 - protein, 267 aa, Unknown
  Obtained from environmental sample
  misc_feature (1)..(267): Xaa is any amino acid
MEPANELEKKLKEPLHKIDICFNIAGVDKSNRKARVSVQVKPQAILDRLDELMGINGWTVNYIVTGNIVVCKLSLRLENDWISKEGTALSVEPICNLSDSALANAAIKFGIGRQLLNQSDVIVDFKDKKPEHPRNAVHYYDAQDIVGWWEEPDVLHTEPIEKDKLTETIGETDFKKLNLVQKLDKLIELGIITEVKHVGYRTKIEDKTSRPGLLRYFEKQFNLLYDLHYIAINHENSADNRATFYKRIRASQKEGLPLIKNGKSNPL

SEQ ID NO: 11851 - DNA, 660 bp, Unknown
  Obtained from environmental sample
  misc_feature (1)..(660): n is a, c, g, or t
atggagagtaaaaagaaaaaaaattatctgaaggaaaaactgacctttaaatacagaattgttgtattaaatgaagatacttttgaagaacgattttcatttaaactcaatcgattaaatgtttttgtttttggtggactgttttccattttattgataggtcttactttccttatcattatgttaacacctttaaaagaatatattcagggttattcttccaccgaactacaaaaagaagcaagtaatttggtttataaggttgattctctaaatcaggctcttacagttaataatatctatatcgaaaatatccaaaaagtgctaaaaggagaaatccaaagaactacttttaacaaagattctgttttacaacagatgaaaattgaaaagatcgattttgctccgtctcatttagattctgtattcagacatgaagttgaattagaagaccggtatagtgtttttgaggaagccaccagaagtaatgatatcgttttttcttctccaataaagggtgaaattacgcaaacctacgattcaaaagaaaagcattttgctattgatattgcagttgataaagacactcctgttaaagctatagcagatggaaccgttatttttagaggatttacagcagatacaggatatgttatataa

SEQ ID NO: 11852 - protein, 219 aa, Unknown
  Obtained from environmental sample
  misc_feature (1)..(219): Xaa is any amino acid
MESKKKKNYLKEKLTFKYRIVVLNEDTFEERFSFKLNRLNVFVFGGLFSILLIGLTFLIIMLTPLKEYIQGYSSTELQKEASNLVYKVDSLNQALTVNNIYIENIQKVLKGEIQRTTFNKDSVLQQMKIEKIDFAPSHLDSVFRHEVELEDRYSVFEEATRSNDIVFSSPIKGEITQTYDSKEKHFAIDIAVDKDTPVKAIADGTVIFRGFTADTGYVI

SEQ ID NO: 11853 - DNA, 315 bp, Unknown
  Obtained from environmental sample
  misc_feature (1)..(315): n is a, c, g, or t
atgattaaaatagaaaagattatcgattattctttgattaaaaataaagatatttttactcaattaataaaacaaagagaaaagaaaatagatgttactattggatttgaacaatttaatattgaggatagtcataaagaagaatatattaaaaatttaaactatttacaagaactatatgaagatataaaagcccaaaagagaaataatgttgagaactttatatttatattaaaagagtatctatcagctagagaaatattagtagagaaaaaagatctaaaaccttcagaatattgttatagattattttag

SEQ ID NO: 11854 - protein, 104 aa, Unknown
  Obtained from environmental sample
  misc_feature (1)..(104): Xaa is any amino acid
MIKIEKIIDYSLIKNKDIFTQLIKQREKKIDVTIGFEQFNIEDSHKEEYIKNLNYLQELYEDIKAQKRNNVENFIFILKEYLSAREILVEKKDLKPSEYCYRLF

SEQ ID NO: 11855 - DNA, 429 bp, Unknown
  Obtained from environmental sample
  misc_feature (1)..(429): n is a, c, g, or t
gtggcccatcttataccatacctaaaaaataaaaatattttagatgaatttacggagatgtttaataggtattatttatatgcatttgaagaatctaaaatgaactactatatttcaaaaaacaattataatttcaaaaaactgctaaaaaaagatttgaattttaaagagatatatctatttgggaaaggtgaagtaggactacaactaaaaaaatttttaaccgataaaaacataccgataaaaggttttattgatgataacaaaaatggtaaaaatataataagccttgatactttaggtaatatacaaacaaaagatactatggttattatttgctcttacaaaagccaacatatacataatatatacaaaaaacttatatctattaataaaaaagatttttttatatacgaacttgtgaactaa

SEQ ID NO: 11856 - protein, 142 aa, Unknown
  Obtained from environmental sample
  misc_feature (1)..(142): Xaa is any amino acid
MAHLIPYLKNKNILDEFTEMFNRYYLYAFEESKMNYYISKNNYNFKKLLKKDLNFKEIYLFGKGEVGLQLKKFLTDKNIPIKGFIDDNKNGKNIISLDTLGNIQTKDTMVIICSYKSQHIHNIYKKLISINKKDFFIYELVN

SEQ ID NO: 11857 - DNA, 528 bp, Unknown
  Obtained from environmental sample
  misc_feature (1)..(528): n is a, c, g, or t
atgtatgatgcaaatgaatatccatcttttccaaagttagaaaatttacattcattagaaataaatacaattaatttaataaatagtattaaaaaaataacaccttcaatagataacaataaccctaaatttgaattaaatggtgcattaatagatataaaatcacaaaaaataaattttgttgcaacagatacacgtagattagcaatatctaatttagaaaatatatcaaataaagaatctcaaataataataccaaaaaaagctattattgaaatacaaaaactttttttagatgaagcaagtattaaatatgatgatacaaatttagtagtatcaaacaacaattatacattttttacaaaattaataaatggtaaatttcctgattatgaaagaattatccctaacaatttaaaatataaatttaaactttcaaaatctcttttaatagaagcaattaaactagtaacttcaatcgaatctaaaataaaaattacatttaatccagatagtattatattttga

SEQ ID NO: 11858 - protein, 175 aa, Unknown
  Obtained from environmental sample
  DOMAIN (20)...(130): DNA polymerase III beta subunit, central domain
  misc_feature (1)..(175): Xaa is any amino acid
MYDANEYPSFPKLENLHSLEINTINLINSIKKITPSIDNNNPKFELNGALIDIKSQKINFVATDTRRLAISNLENISNKESQIIIPKKAIIEIQKLFLDEASIKYDDTNLVVSNNNYTFFTKLINGKFPDYERIIPNNLKYKFKLSKSLLIEAIKLVTSIESKIKITFNPDSIIF

SEQ ID NO: 11859 - DNA, 540 bp, Unknown
  Obtained from environmental sample
  misc_feature (1)..(540): n is a, c, g, or t
gtgcaattattaggctatagctcgtggtgcacaaggggaatacttatagcttttttattgggaaaggaatctgtggaattacaaaccaaaaaaaccaaaaaacttatcactgtagatgcaatggtggaaaatatatttaactataaagttataggaaaaagagtcgattatacagctattactaatcaattgtttcaaaaaataagaacaaaatcaattatatttcttattggagatttttttaatacagaagatttaaatttaaagttgttagcaaaaaaacatgaagttatagctgtgataataagagatagatttgaagaacatccatctgctatgggtagcgttaactttacagacccacaaacatttcaaaaatatgatggggtattaaatagtacacttattaaaaaatatgaagcaaatatttataaaaacgatgaaaagctttacgaaaattttaaaagtagtggagtagagtttattaaaatatatactgatgagaatattttggtaaaaatgataaaactatttcaataa

SEQ ID NO: 11860 - protein, 179 aa, Unknown
  Obtained from environmental sample
  misc_feature (1)..(179): Xaa is any amino acid
MQLLGYSSWCTRGILIAFLLGKESVELQTKKTKKLITVDAMVENIFNYKVIGKRVDYTAITNQLFQKIRTKSIIFLIGDFFNTEDLNLKLLAKKHEVIAVIIRDRFEEHPSAMGSVNFTDPQTFQKYDGVLNSTLIKKYEANIYKNDEKLYENFKSSGVEFIKIYTDENILVKMIKLFQ

SEQ ID NO: 11861 - DNA, 798 bp, Unknown
  Obtained from environmental sample
  misc_feature (1)..(798): n is a, c, g, or t
gtgcctcataaaccgactctacgcctcggtattcctgtttatatagagaatgatttttcaggtatattaattgtaaatctattcatgaaacctttactatcttcactagaagatatatatttatacaacgtatatgtagtgtcacaagatacacactatgttattcatccaaataaagagttcaatttcagttcatctcttgatcataactatacgctacatgatgagttcccattacttgcaaaaaatattgataaaaatgagtttatggataatataacatatatgagtacactctttaagagcagcagtgatacactgaaaattattctaaaacctaaaaatgagttagttagtgagtttaaacaaaaaacatttttatatgcactgctgattgcactagcaggtgcatctactttgtttttgatactattttatccaatacgcctctatttgaataaaactagaaaaattctttctcttaaaaatagtgaatttcaaacaatattgaatgaaactgatatagcaattatatgtataaatgatgataaaaaaatagtctataccaataattccgcactttgcatgcttcagttatcgttaagtgaaataaaagatttttccattgagacactctttgcagataatagattagatgatatattacttcaagccgccacctctacagttgatattaatactgcgattaaaaacagtaaacaagaagtttttccagcaaatgtaaaaccacatcatgagggtgattcaaaaggatggatacaacctcttttttattaa

SEQ ID NO: 11862 - protein, 265 aa, Unknown
  Obtained from environmental sample
  misc_feature (1)..(265): Xaa is any amino acid
MPHKPTLRLGIPVYIENDFSGILIVNLFMKPLLSSLEDIYLYNVYVVSQDTHYVIHPNKEFNFSSSLDHNYTLHDEFPLLAKNIDKNEFMDNITYMSTLFKSSSDTLKIILKPKNELVSEFKQKTFLYALLIALAGASTLFLILFYPIRLYLNKTRKILSLKNSEFQTILNETDIAIICINDDKKIVYTNNSALCMLQLSLSEIKDFSIETLFADNRLDDILLQAATSTVDINTAIKNSKQEVFPANVKPHHEGDSKGWIQPLFY

SEQ ID NO: 11863 - DNA, 435 bp, Unknown
  Obtained from environmental sample
  misc_feature (1)..(435): n is a, c, g, or t
gtggatttgtttcacaaacattcatattttaataatggtgtaacttcaatgataaagataaataatttaaaagacttagatacttttatcgagatgataccggatatggtattttttaaaaatgttaattatgagtatatttacttcaataacacatatttaaactttattcaaaaaagtagagaagaggttattaataagactgtatttgatctatattcaattgagaacgccagtaaatttaatagagatgatcaaaatattttacatggagatcaagaccaatcttttgaggagatatttataaaagataatgatgagaatctatttttttatacaacaaaacagatcgtttatgatgaaaatagaaataaactgggtctattttgtatagtaaaagatattactacagaaagacaatatcaaacaatatag

SEQ ID NO: 11864 - protein, 144 aa, Unknown
  Obtained from environmental sample
  DOMAIN (24)...(86): PAS domain
  misc_feature (1)..(144): Xaa is any amino acid
MDLFHKHSYFNNGVTSMIKINNLKDLDTFIEMIPDMVFFKNVNYEYIYFNNTYLNFIQKSREEVINKTVFDLYSIENASKFNRDDQNILHGDQDQSFEEIFIKDNDENLFFYTTKQIVYDENRNKLGLFCIVKDITTERQYQTI

SEQ ID NO: 11865 - DNA, 459 bp, Unknown
  Obtained from environmental sample
  misc_feature (1)..(459): n is a, c, g, or t
atgagtaacgcaacttttgaagatacactgaactatgcaaaaaagttctccacatataaagatttttatatgaaatcaaatgatttggtcttctcaaaattaggattaggaacatttaataaagagccttataaagaggaaaactacctgtttcactatattgcatctgttaaagaggctgttaaaaatggaatgaacgtgatcgatagtgcgagtaactatagatatggtgagagcgaaaaagagataggcatagcacttaaagagatgctagatgagggttcagtgaaacttgaagagcttattatctgctcaaaaggcggatttattcagcttgattatccttttcctgaaaatccatatacatggattccagaaaatgtattagaaaaaaatttcgccaccaaagatgatatccgaactagacccaaccctggattgacctccagacttttttag

SEQ ID NO: 11866 - protein, 152 aa, Unknown
  Obtained from environmental sample
  misc_feature (1)..(152): Xaa is any amino acid
MSNATFEDTLNYAKKFSTYKDFYMKSNDLVFSKLGLGTFNKEPYKEENYLFHYIASVKEAVKNGMNVIDSASNYRYGESEKEIGIALKEMLDEGSVKLEELIICSKGGFIQLDYPFPENPYTWIPENVLEKNFATKDDIRTRPNPGLTSRLF

SEQ ID NO: 11867 - DNA, 738 bp, Unknown
  Obtained from environmental sample
  misc_feature (1)..(738): n is a, c, g, or t
ttgaaatatgattttgatactcctgatgcaaaaagtggtgtaaatcctatccaagatatagttggtggaaaatggtttaaatcaaatgtagatgcagtaaatattcaaccgttagctaaaagacatgaaaatgatttgttaaaagttgtaaatattcatttaaattctaatgataaagtgtttggaaggatagatggaaatcacagattaaccgctacaaataccggaaatatttataatgcagagatacctttttgtgtagtgttgtttgatagtgaaaatatacaaaaacaagaaaaaatgcttttttttaatataaattcaaaggcaattcctcttactacagaagaatctttaaagtcaatttttgaagatgaaataaatttttcaaatgaacttttaaaaaataatagctcttttggttgggagtattattttgcaaaacagattaaaaaagaagagcttaatagttattttcctaatcttcataacttatttaacaataattttttaactacatttttaaaattatttaaacttcttatcgttaaagatattattcaacaaaatgataatgagattagtaaaattcgtagtgcattaactgaaataaatacaaatatttatagtaatgagcaattgaaaaatagttcaaatagggctgtttttattgcatttatgttttatcagttaaaaagcccagaattaataaggttttttaaaaagttgggtggctga

SEQ ID NO: 11868 - protein, 245 aa, Unknown
  Obtained from environmental sample
  misc_feature (1)..(245): Xaa is any amino acid
MKYDFDTPDAKSGVNPIQDIVGGKWFKSNVDAVNIQPLAKRHENDLLKVVNIHLNSNDKVFGRIDGNHRLTATNTGNIYNAEIPFCVVLFDSENIQKQEKMLFFNINSKAIPLTTEESLKSIFEDEINFSNELLKNNSSFGWEYYFAKQIKKEELNSYFPNLHNLFNNNFLTTFLKLFKLLIVKDIIQQNDNEISKIRSALTEINTNIYSNEQLKNSSNRAVFIAFMFYQLKSPELIRFFKKLGG

SEQ ID NO: 11869 - DNA, 948 bp, Unknown
  Obtained from environmental sample
  misc_feature (1)..(948): n is a, c, g, or t
gtgggtttccccatctcaaatgggaaccagattccagaagcttttttgctttggcaactaaatttacgatttataccacttttggttcttccgataaaaagagtgaaaatagcttctaatgaatttgagataaaaagagtggagtggtgttcacaagaaaaagagcttcaccaacaaatactagaacgatatgtaagtgctcgtaaggcaagtattgaaaaagagtatcgccaagagatgctaaatcttcgtaaagaactctatgcaattaaagagcggctttataatgctggtaagtactctaaagttgatcttggcgatgaagccatatatatgattaccttggaaagggatattgaaaacctcacaatgggttatcaagaagatcttatacgtctctcgcaactaagctacatggagtttaacaaaccagtagttctacttcctctaaatacaaatgtgaaaaaagtatctcttagaaactatgatgagacaacagaaggaattattttaaagaaaagaatagaacaaaaaaaggatgaaatctctttagcctttcgtgaacaactcccttctgtgggtatttatagcaattactatatgtatggttctaatccaacagagtatgataatgcaattacagagattgaaaataaaagttggaatgttggaattgctttaagatttaatgtatttgaaggctttaaacactcatcaaatgatgctagattaaagttagaactgcaccgtttagaattagaattaagcgatgcgcaacacaactactcttacgaagtggattctaaaacaacaagactatcagaacttacgactttaaaagaacatgagcaacatctccttgaagaaaatcacaaaaagagagagatggtaaatagacttcgaaaactaaagagagtcgatagcataacccaaataaatacagagtag

SEQ ID NO: 11870 - protein, 315 aa, Unknown
  Obtained from environmental sample
  misc_feature (1)..(315): Xaa is any amino acid
MGFPISNGNQIPEAFLLWQLNLRFIPLLVLPIKRVKIASNEFEIKRVEWCSQEKELHQQILERYVSARKASIEKEYRQEMLNLRKELYAIKERLYNAGKYSKVDLGDEAIYMITLERDIENLTMGYQEDLIRLSQLSYMEFNKPVVLLPLNTNVKKVSLRNYDETTEGIILKKRIEQKKDEISLAFREQLPSVGIYSNYYMYGSNPTEYDNAITEIENKSWNVGIALRFNVFEGFKHSSNDARLKLELHRLELELSDAQHNYSYEVDSKTTRLSELTTLKEHEQHLLEENHKKREMVNRLRKLKRVDSITQINTE

SEQ ID NO: 11871 - DNA, 309 bp, Unknown
  Obtained from environmental sample
  misc_feature (1)..(309): n is a, c, g, or t
atgcagctggatcaaattgattgcctgagaaaaattggtactagacttaaagctactcatgtttcagatcaaatgggaatcaaggcaaatcacctactcccatattttggagtaacaaaatgggatgaaatacttcccattttaaatgaaataaattatcacggtgatttggtatttgaaagccatacaaacactcaaaatatacccgatgaattactaattaatacattgaagctaagtgttgatattggaaattatttaatttccataataaacaaaaataaaataaaggatatagataatgaataa

SEQ ID NO: 11872 - protein, 102 aa, Unknown
  Obtained from environmental sample
  misc_feature (1)..(102): Xaa is any amino acid
MQLDQIDCLRKIGTRLKATHVSDQMGIKANHLLPYFGVTKWDEILPILNEINYHGDLVFESHTNTQNIPDELLINTLKLSVDIGNYLISIINKNKIKDIDNE

SEQ ID NO: 11873 - DNA, 852 bp, Unknown
  Obtained from environmental sample
  misc_feature (1)..(852): n is a, c, g, or t
ttggctcaggtctcaacgctagctgatattactttccaaaactactttagaatgtatgataagttagctggtatgacaggaacagcccaaacagaagctacagagtttgcagagatttataatcttgatgttgtatcaataccaacaaatgtacctatccaaagattagataaaaatgatcttatttataaaacagagcgggaaaaatttgtagctgtttgtaatagaatcaaagagttaaatcaaaaagggcaacctgtcttagtagggactgcaagtattgaaaaatctgaaaagttacatgaattattaaaaaaagagaaaatcccacatacagttttaaatgctaaacagcatgaaaaagagggtaaaattgttgaagatgctggacttaaaggtgcagtaacaattgctacaaatatggctggtcgtggggttgatattaaattaccaaaagagtgtttagaacttggagggttggtgattcttggaactgaaagacacgaaagtagaagaattgacaaccaacttcgaggacgagcagggcgacagggtgatgttggtgagtcacaattttatctttctttagaagataatttattacgaatttttggaagtgataaaatcgctggagttatgagtagacttggacttgaagaaggtgagcatattgagtctggtatggttacaagagctgttgaaaacgcacagaaaaaagtagaaactatgcactttgagtcaagaaaacatctattagagtatgatgatgtagcaaatgaacaaagaaaagtaatctatagctttagaaataatcttttaagtgaagattatgatattacatcaaaaaattga

SEQ ID NO: 11874 - protein, 283 aa, Unknown
  Obtained from environmental sample
  DOMAIN (103)...(185): Helicase conserved C-terminal domain
  misc_feature (1)..(283): Xaa is any amino acid
MAQVSTLADITFQNYFRMYDKLAGMTGTAQTEATEFAEIYNLDVVSIPTNVPIQRLDKNDLIYKTEREKFVAVCNRIKELNQKGQPVLVGTASIEKSEKLHELLKKEKIPHTVLNAKQHEKEGKIVEDAGLKGAVTIATNMAGRGVDIKLPKECLELGGLVILGTERHESRRIDNQLRGRAGRQGDVGESQFYLSLEDNLLRIFGSDKIAGVMSRLGLEEGEHIESGMVTRAVENAQKKVETMHFESRKHLLEYDDVANEQRKVIYSFRNNLLSEDYDITSKN

SEQ ID NO: 11875 - DNA, 729 bp, Unknown
  Obtained from environmental sample
  misc_feature (1)..(729): n is a, c, g, or t
atgaatattctttttcgaactgattcctcttctcaaattggtacaggtcacataatgcgtgatcttgtccttgcaaaacaatatccaaatagcaatataacatttgcaactcgagaacttgatggaaatatcaatcataaaataaaagaagctggatataaaacagggatattaaaaacaaatgatttagaagagcttgatagtttagttaaagaattaaatattgatatgataataatagatcattatagtataggctttgattttgaaaaacaactctcaaccctcaattctcaaccttcaattatggtactagatgatacatatgaaaaacactattgtgatatattgttaaaccataatataagtgcagataaaaagagatataaaaatttagtaccaaaaaactgtgaactacgatgtggaagtaaatatacacttctaagggaagaattctataaagaaaaaaaaaaaatcaaaagaaaaaagcaattctcaaatccaaattctcaaatctcaatttttatagctatgggtggtgcagatacagcaaaactaaatattcctatcttaaaaattttaaaaaaacttgacaatataaaggtaactttagtaaccacatcatcaaacaataatttaaatatcctacaaaactattgtaaaaataaaaaaatggatcaatttacatatagattcaaacaaaattgcaaaacttatgaaaaaaagtga

SEQ ID NO: 11876 - protein, 242 aa, Unknown
  Obtained from environmental sample
  misc_feature (1)..(242): Xaa is any amino acid
MNILFRTDSSSQIGTGHIMRDLVLAKQYPNSNITFATRELDGNINHKIKEAGYKTGILKTNDLEELDSLVKELNIDMIIIDHYSIGFDFEKQLSTLNSQPSIMVLDDTYEKHYCDILLNHNISADKKRYKNLVPKNCELRCGSKYTLLREEFYKEKKKIKRKKQFSNPNSQISIFIAMGGADTAKLNIPILKILKKLDNIKVTLVTTSSNNNLNILQNYCKNKKMDQFTYRFKQNCKTYEKK

SEQ ID NO: 11877 - DNA, 480 bp, Unknown
  Obtained from environmental sample
  misc_feature (1)..(480): n is a, c, g, or t
atgaccaatcttactcttataaatttcatcgatttaactttagaagaaaaaaagctcgttttatcttggagaaataatcccaatataaaaaaatggatgtttaatacagaagatatatctttagaacaccatttaagatttatagaaacattaaaagattctaaagaaaaacagtattttttagttaaagataaagatacttatttaggtgttattgatttttgtaatatcacaaaaacaactttagaaatgggactttataaaaatccagagatttataatgttggtaaaaagttattagagataattgtagattactcttttaatattttaaaagtagatactattatatctaaagtgtttcagtcaaatgaaaaagcatatttactttatatatcaataggatttaaaccttttagtagtaagataatagatgataaaaaagtaatatgtatggagctaaaaagtgaaaataggtaa

SEQ ID NO: 11878 - protein, 159 aa, Unknown
  Obtained from environmental sample
  misc_feature (1)..(159): Xaa is any amino acid
MTNLTLINFIDLTLEEKKLVLSWRNNPNIKKWMFNTEDISLEHHLRFIETLKDSKEKQYFLVKDKDTYLGVIDFCNITKTTLEMGLYKNPEIYNVGKKLLEIIVDYSFNILKVDTIISKVFQSNEKAYLLYISIGFKPFSSKIIDDKKVICMELKSENR

SEQ ID NO: 11879 - DNA, 840 bp, Unknown
  Obtained from environmental sample
  misc_feature (1)..(840): n is a, c, g, or t
atgatctattttttcttctatatgatatatagaggatttgatgaacgtattactgacagtgtaacagatactctaaatcgtaagaatatattagaacttttttcacatgagcttaaaaaaagagaaaattatacagttgcactgatatctattgataatataaacagtataaatgaagagtatggatttataaatggtgataatattttaaaagatgtatcaaattatatctctaaattttttcttgataagttgtataagagagttccaatagggcatataaaaggcggagattttttagttggatttgatacaaaaaaagatgatgttaaagctttaatagatatgttgaatttaaaattagattcaattgaagtaaattcaatagagatatatacatctagcagtgtggttgattcaaactattcaaatgatataaaccatattttaaatagattgtatgaattaaagaaaaatagacgtatagacagtgtaaaagatgaagagttaatcaatccaaatgagttagagacacttgttataaaagcgataaaaagtagaaatatctctatcaaatttcaaaaaattgaaaataacggtgaaaatatattagaagcatctgtaacacttttagatgatagtggcaattacatacatcaaagagagtttataggtgtaatcaatagattaggtatgagtaaagattttgatatggttatacttgagctattagtgaatatattaaatagatatggtgatataacgctatctatcaaattttccacaatatctattcgtcacaaagagttttatgataagttaatatcctctggtatctga

SEQ ID NO: 11880 - protein, 279 aa, Unknown
  Obtained from environmental sample
  DOMAIN (14)...(163): GGDEF domain
  misc_feature (1)..(279): Xaa is any amino acid
MIYFFFYMIYRGFDERITDSVTDTLNRKNILELFSHELKKRENYTVALISIDNINSINEEYGFINGDNILKDVSNYISKFFLDKLYKRVPIGHIKGGDFLVGFDTKKDDVKALIDMLNLKLDSIEVNSIEIYTSSSVVDSNYSNDINHILNRLYELKKNRRIDSVKDEELINPNELETLVIKAIKSRNISIKFQKIENNGENILEASVTLLDDSGNYIHQREFIGVINRLGMSKDFDMVILELLVNILNRYGDITLSIKFSTISIRHKEFYDKLISSGI

SEQ ID NO: 11881 - DNA, 381 bp, Unknown
  Obtained from environmental sample
  misc_feature (1)..(381): n is a, c, g, or t
atgaaatatggtgaaaaaatagtaaatgagtttgatgtagagaaagatttagaaatctggccaaatgagcatgatcgtaactatttgattaagatgacgcttcctgagtttagctgtctatgtcctagaagcggttatcctgattatgcaacgatctacttagagtacacacctgataagctggtagtagagctaaaagctattaaactctatataaactcttttagagatcgtcacatttcacatgagaacagtgcaaatgagatttatgatgttttagataaaaagttaaagccaaaatatatgaaagttgtagcagattataaccctagaggaaatgttcatactgtcatagagatagatagtagtaaaattatttaa

SEQ ID NO: 11882 - protein, 126 aa, Unknown
  Obtained from environmental sample
  DOMAIN (28)...(124): GTP cyclohydrolase I
  misc_feature (1)..(126): Xaa is any amino acid
MKYGEKIVNEFDVEKDLEIWPNEHDRNYLIKMTLPEFSCLCPRSGYPDYATIYLEYTPDKLVVELKAIKLYINSFRDRHISHENSANEIYDVLDKKLKPKYMKVVADYNPRGNVHTVIEIDSSKII

SEQ ID NO: 11883 - DNA, 690 bp, Unknown
  Obtained from environmental sample
  misc_feature (1)..(690): n is a, c, g, or t
atgagtgaatatatggaaaaacatgctctctcacgcttagttggagcacctcctggatatgtaggttttgagcaaggtggacttcttaccgaggctataaagaaacatccatacactgttttacttcttgatgaaatagaaaaagcacatcctgacttagtaaatattttacttcagattatggatagtgctactcttacagataacaatgggtataaagcaaacttccagaatgtaatactcattatgacttcaaatattggagcaagtgctagaaatgttatgggattcaataaagatgaatctatttcaaaaaatgaagagttaaaatcattctttacacctgaatttagaaatcggctagatgctattgtagattttggacaacttagtctcaatacagttaaagatattgtaattaaatttatcaatgaattaaatacagacctaaaaaagaaaaaaattaatatttcaatctccgataaggctaaagactttatagcagagagtggttactcaaaagaaatgggtgcaagaccacttaagagatttattcaagataatattacaaataaactaagtgatgaaatactatttggaaaacttaaaaatggtggaattgttgaagttgattttaaaaaagagttgattttaaatttcaaaaaaatagatgattccacaactaaataa

SEQ ID NO: 11884 - protein, 229 aa, Unknown
  Obtained from environmental sample
  misc_feature (1)..(229): Xaa is any amino acid
MSEYMEKHALSRLVGAPPGYVGFEQGGLLTEAIKKHPYTVLLLDEIEKAHPDLVNILLQIMDSATLTDNNGYKANFQNVILIMTSNIGASARNVMGFNKDESISKNEELKSFFTPEFRNRLDAIVDFGQLSLNTVKDIVIKFINELNTDLKKKKINISISDKAKDFIAESGYSKEMGARPLKRFIQDNITNKLSDEILFGKLKNGGIVEVDFKKELILNFKKIDDSTTK

SEQ ID NO: 11885 - DNA, 495 bp, Unknown
  Obtained from environmental sample
  misc_feature (1)..(495): n is a, c, g, or t
ttggtttacgatggccaaaaagggccttggaacttgttgccacaagggggcggaaaaaaatattttcttcatagcgtttcatcaagaggatggcacttgaagaaaaaagcagatgaaaattgtgaagagaatgaagaagagatagagttccaactcgtggatgagagacaacttttctttatgattaagaaaaaacttgctcctgaatttggtgtgatactaaactatgaagaaagatactcagatatttctcacaaaattttagatgaactttatgaagaagatttaatacattttgatgttacagaaaatcgtattaaaaatattatttacggtgcgattacatctttcattgcagatgcatctgagctcgatgatgctgtgatggaaaaaatcagatcatacaaaaaaagatacattcccggaactgatgagtttgatattttatatgaaaaaatctatagagaagagttaatgaaaagaggtatggagtaa

SEQ ID NO: 11886 - protein, 164 aa, Unknown
  Obtained from environmental sample
  DOMAIN (1)...(164): Protein of unknown function (DUF507)
  misc_feature (1)..(164): Xaa is any amino acid
MVYDGQKGPWNLLPQGGGKKYFLHSVSSRGWHLKKKADENCEENEEEIEFQLVDERQLFFMIKKKLAPEFGVILNYEERYSDISHKILDELYEEDLIHFDVTENRIKNIIYGAITSFIADASELDDAVMEKIRSYKKRYIPGTDEFDILYEKIYREELMKRGME

SEQ ID NO: 11887 - DNA, 498 bp, Unknown
  Obtained from environmental sample
  misc_feature (1)..(498): n is a, c, g, or t
ttgaataagtatgaagaaggttgtcctattcctttcagaaatggggttgctttctcagtaaatggagcttccctgggtaattttaaaagtggtacggttttcgtttctggcgctgatggctcggtcaacccaattgaatcagaaaaaacttggttagataaatattctttcaaatcgggaacagaaaatgcttttgataatttgatcaatgttccaaaagactttctaaccaaattttcctcactccttttgggcgataagataacagctcagcaagatgaatatatagatggaacaattatttctctgggaagtaaattctatatttttgatgacggattagctaaaaatattacgctagaggttgccaaaatagtaaaactctatgtgaacgacgagtgggtagtccctgttgttgaggccgagctcgatgggtttatttttggagctcaaattaccgcagaagaaattagtactataattccatcttggaaataa

SEQ ID NO: 11888 - protein, 165 aa, Unknown
  Obtained from environmental sample
  misc_feature (1)..(165): Xaa is any amino acid
MNKYEEGCPIPFRNGVAFSVNGASLGNFKSGTVFVSGADGSVNPIESEKTWLDKYSFKSGTENAFDNLINVPKDFLTKFSSLLLGDKITAQQDEYIDGTIISLGSKFYIFDDGLAKNITLEVAKIVKLYVNDEWVVPVVEAELDGFIFGAQITAEEISTIIPSWK

SEQ ID NO: 11889 - DNA, 384 bp, Unknown
  Obtained from environmental sample
  misc_feature (1)..(384): n is a, c, g, or t
atggaaaaaaatataaaatttgatataaacagctctcaaaaaatgatggcaaatgagttgtttaatgagtacaatctatctcaatatgatcttgatgagagtgatattttaagagctataaaaattgaatctattttagagaagtatgactatgtcttcaaacactactacgctcttaaaatattttactctattgcaaaagcaggtatatttagagcagaacttctttttgagtttgtaaatagaacaaaagaggagtttgatctgatcatagaaaagatgatagagacaaaacttgtaattttaaactcagataatgagttggagttaactcttgaaggaaaaagtttggctgaaagacttggagttgatatatttatttaa

SEQ ID NO: 11890 - protein, 127 aa, Unknown
  Obtained from environmental sample
  misc_feature (1)..(127): Xaa is any amino acid
MEKNIKFDINSSQKMMANELFNEYNLSQYDLDESDILRAIKIESILEKYDYVFKHYYALKIFYSIAKAGIFRAELLFEFVNRTKEEFDLIIEKMIETKLVILNSDNELELTLEGKSLAERLGVDIFI

SEQ ID NO: 11891 - DNA, 372 bp, Unknown; identical to SEQ ID NO: 9165
  Obtained from environmental sample
  misc_feature (1)..(372): n is a, c, g, or t

SEQ ID NO: 11892 - protein, 123 aa, Unknown; identical to SEQ ID NO: 9166
  Obtained from environmental sample
  DOMAIN (19)...(121): Protein of unknown function, DUF485
  misc_feature (1)..(123): Xaa is any amino acid

SEQ ID NO: 11893 - DNA, 714 bp, Unknown
  Obtained from environmental sample
  misc_feature (1)..(714): n is a, c, g, or t
atgcactcacccactctctatatcgatgaacctgttatgcttcttgcaacgcctatcttcaaaaataaaaagatgatctcggttttaatgttaaaactgcctagcactcttataaactcaattctgcactatagagccagtgaagtaaaaagctgtgagacgtatgcagtgggaagagatcatctacttagaagtgacagttttttaaaaaaagagttaactgtaaaaaactcttttaatgatcataaaaactgctgtatactcactgaaaatatagacaaagcactcaagggtgaaagcggagtcagtgttagtaaagattacagaggtgtagatgtaatatctgcctactctccatttatttttgataacatcacttggggtgttatcacagagatggataagatagaggtcacaaaagagttagaagatatcgaaaaaagcttctatatctgggccgtagtaattgcacttattatatttattatcggcttctttgtaattagaaccgttataaaacgatctgttataaaccctttggtggcactctatcaaaaagcgaaaggatttgaagatattataaacaactctctaaatgagatctatattttctctaaagatgaactctattttatctttgcaaattatactgccattaacaacagtggctacacccttgaagagcttaaagcgttaaaggcatatgaaatctaa

SEQ ID NO: 11894 - protein, 237 aa, Unknown
  Obtained from environmental sample
  misc_feature (1)..(237): Xaa is any amino acid
MHSPTLYIDEPVMLLATPIFKNKKMISVLMLKLPSTLINSILHYRASEVKSCETYAVGRDHLLRSDSFLKKELTVKNSFNDHKNCCILTENIDKALKGESGVSVSKDYRGVDVISAYSPFIFDNITWGVITEMDKIEVTKELEDIEKSFYIWAVVIALIIFIIGFFVIRTVIKRSVINPLVALYQKAKGFEDIINNSLNEIYIFSKDELYFIFANYTAINNSGYTLEELKALKAYEI

SEQ ID NO: 11895 - DNA, 417 bp, Unknown
  Obtained from environmental sample
  misc_feature (1)..(417): n is a, c, g, or t
atgcatgatcgcctgtataacaacaaccagtggcagcttgatcccgctcattatttgaaacttatccaacaacgaccacaggcttttgacagtgcccgcccgataaaacaatggagaaaaaactggccgtcctgttatgaaaagcttcttgtgcgattttgcatcaagcaaggtaatacaaaagggactcgggattttatatccgtattgatgctgcacagtgaacacaaggctgagggtataaaagaatcaatcgagaaggctttaatggccggcgtcagtaccagtcatgcagttgtgcagatcctgcaaaatgcgtcggataataaaaaaatggcgattactccccttaaaaactggcagacgtttccacctccggacatctcgatatatggcaaaataggaggtgcggtatga

SEQ ID NO: 11896 - protein, 138 aa, Unknown
  Obtained from environmental sample
  misc_feature (1)..(138): Xaa is any amino acid
MHDRLYNNNQWQLDPAHYLKLIQQRPQAFDSARPIKQWRKNWPSCYEKLLVRFCIKQGNTKGTRDFISVLMLHSEHKAEGIKESIEKALMAGVSTSHAVVQILQNASDNKKMAITPLKNWQTFPPPDISIYGKIGGAV

SEQ ID NO: 11897 - DNA, 471 bp, Unknown
  Obtained from environmental sample
  misc_feature (1)..(471): n is a, c, g, or t
atgcgtggtatacaggtgatgatagataaagatttagcagaactttatggtgttgaaactaaaagacttaatgaacaagtgaaaagaaatattgttaaattcccttcagactttatgtatcaaataacagatacagaaaaaaatgaactggtcgcaaaatgcgaccggttcgaaaaacttaaacattcaacatccaatccacttgtatttactgaatatggagtatatatgttatctactattttaaaaagtacaatagctacagaagtaagtttggctatcatgagaacttttgtaaagatgaaaaaccaatcagtaccatattttgatatcatcaaacgacttgaaaagctagaaacagaagataaaaagacaaaagagttattaaaaaaagttgtacaagtagtaacttctatgcaagatattcaagatgaagcaaaagagggtactaaaaagattggatttatttaa

SEQ ID NO: 11898 - protein, 156 aa, Unknown
  Obtained from environmental sample
  misc_feature (1)..(156): Xaa is any amino acid
MRGIQVMIDKDLAELYGVETKRLNEQVKRNIVKFPSDFMYQITDTEKNELVAKCDRFEKLKHSTSNPLVFTEYGVYMLSTILKSTIATEVSLAIMRTFVKMKNQSVPYFDIIKRLEKLETEDKKTKELLKKVVQVVTSMQDIQDEAKEGTKKIGFI

SEQ ID NO: 11899 - DNA, 864 bp, Unknown
  Obtained from environmental sample
  misc_feature (1)..(864): n is a, c, g, or t
ttgggggaattactaggtgacagtttggatattgtggttgcattagatggcaagatgcccatagagatgcaaattcaagagttccctgatttaatatttcttgacattatgatgccacaaatggagggctatgaagtgtgcaaacaattaaaagaaaattctcaaacccagtcaattcccgtgatatttttgactgccaagagtgatgaaaatagtattgaaaaagcttatgaagttggtggaagtgactatgtttctaaacccttcaaacctaaagagctaatggctagagtaaagactcaattagatttacaaaatatgataaggaatctcgaatatatctcttcacatgatactatgacaggtattttaaatcgcagaaagttttttgaactagctcaagagaggtttgaatcgcaacaaaataacctatttgctgtaatgatagatattgacaaatttaaagatatcaatgatacatatggacatcatattggggatcttgtaataaaaaagatggctgaaataatacaaaacatgcttccaaaaaagagtatattcggaagaattggtggtgaagaattcgcaatagtttgtaattcagaaaatccaacaataatttttgaatatattgaaactatacgaaatattatcaaaaaagagactttaaatgtggaatctaaaaaaataaattttacttttagtagtggtattagtcaatataatgctaattttttaacaatagatgatctattaaaagaggcagataagatgctatatagagcaaaatctacaggacgagataaaacaatattagataatgaatatatgaaagcccggcaacaccnnnnnnnnngaatctaa

SEQ ID NO: 11900 - protein, 287 aa, Unknown
  Obtained from environmental sample
  DOMAIN (1)...(106): Response regulator receiver domain
  misc_feature (1)..(287): Xaa is any amino acid
MGELLGDSLDIVVALDGKMPIEMQIQEFPDLIFLDIMMPQMEGYEVCKQLKENSQTQSIPVIFLTAKSDENSIEKAYEVGGSDYVSKPFKPKELMARVKTQLDLQNMIRNLEYISSHDTMTGILNRRKFFELAQERFESQQNNLFAVMIDIDKFKDINDTYGHHIGDLVIKKMAEIIQNMLPKKSIFGRIGGEEFAIVCNSENPTIIFEYIETIRNIIKKETLNVESKKINFTFSSGISQYNANFLTIDDLLKEADKMLYRAKSTGRDKTILDNEYMKARQHXXXXI

SEQ ID NO: 11901 - DNA, 753 bp, Unknown
  Obtained from environmental sample
  misc_feature (1)..(753): n is a, c, g, or t
ttggatattgtaagttatggctcaaacataggaaaaaaattttcaggtgatcctttacgactatctcaagtcattataaatcttttaacaaatgcagtaaagtttacacaagatggtgagattggtatttatattgaaaagaaatcagatgacagatttcaatttatagttaaagatacaggtattggcttaacaaaagaggaacaaaataaactatttcactcattttcacaagcagatggaagtacgactagaaaatatggtggtacaggattaggactttctatttcaaaacaacttattgaacttatgggtggagatatatgggttgagagtgaaaaagatataggaagtagctttatatttgagatagacttagaagagctaaagaacaataaaaaagagtatcaacaattttataataaaagagcattagtagttgatgataataaaacatggcatgaaatattacacagtttactttctaattttggtttaagtgtagatgtagttttgagtggtaaagaagcgatagaaagagtagataaatgtaacaacagttatgacattatccttatggattggaatatgccaaatcttgatggtatcgagactacaaaacttatcaaacaagagtgtgactctagtattacaccacctactgttattatggtaagctcttttagacaagattcaataattggtttagcaaaggcagtgggtattgatatatttttaccaaaaacctattaa

SEQ ID NO: 11902 - protein, 250 aa, Unknown
  Obtained from environmental sample
  DOMAIN (142)...(249): Response regulator receiver domain
  misc_feature (1)..(250): Xaa is any amino acid
MDIVSYGSNIGKKFSGDPLRLSQVIINLLTNAVKFTQDGEIGIYIEKKSDDRFQFIVKDTGIGLTKEEQNKLFHSFSQADGSTTRKYGGTGLGLSISKQLIELMGGDIWVESEKDIGSSFIFEIDLEELKNNKKEYQQFYNKRALVVDDNKTWHEILHSLLSNFGLSVDVVLSGKEAIERVDKCNNSYDIILMDWNMPNLDGIETTKLIKQECDSSITPPTVIMVSSFRQDSIIGLAKAVGIDIFLPKTY

SEQ ID NO: 11903 - DNA, 870 bp, Unknown
  Obtained from environmental sample
  misc_feature (1)..(870): n is a, c, g, or t
ttgacagatcggctcggaacaaaacaaacaatcatagaaaatctgcttagtggaaaagtaaaaatcattgcaggtgctaggtctgcactttttttaccttatgataatttagggttaattatcgttgatgaggagcatgatgactcttataaatcagatcaaaaaccacgagttaatataaaagatttatcaatctatatggggaaaaaatttgatattcaagtgatacttggaagtgcgacacctagtttaagtagctttcataaaatcccatacataaggataaaaaaaactttttttgactcagagaaacaaatatcatttgtaaattcgaatttggaactctcagcttcaattatagaaaaaatttcacaaacattagaaaatcaaaaccaagtgatagtttttcttcctactcgtgcaaatttcaaataccagatatgtaaagattgtggaaaatctatcgagtgtcctttctgttcggttagtttaagtctacacaaaaacaataatgctttacaatgccattattgtaactacacacaaccaattgataagttttgtccacattgtaaaactggaaccattgagagttttcgtcttggaacagcacaagttgttgaagagttacaaaatatttttaaagataaaataatccaaaaatttgatagagatagtatcaaaacaaacaaagaactcaaacgagtaatcaaagattttaacgaaaataaaatagatatactagtaggtactcaaatgctctcaaaaggtcacgactaccataatgtaaaactagctgtggtgttgggaattgattctatgttaaatatgacaagttataaagtgagagaaaagccttgtcacttttga

SEQ ID NO: 11904 - protein, 289 aa, Unknown
  Obtained from environmental sample
  misc_feature (1)..(289): Xaa is any amino acid
MTDRLGTKQTIIENLLSGKVKIIAGARSALFLPYDNLGLIIVDEEHDDSYKSDQKPRVNIKDLSIYMGKKFDIQVILGSATPSLSSFHKIPYIRIKKTFFDSEKQISFVNSNLELSASIIEKISQTLENQNQVIVFLPTRANFKYQICKDCGKSIECPFCSVSLSLHKNNNALQCHYCNYTQPIDKFCPHCKTGTIESFRLGTAQVVEELQNIFKDKIIQKFDRDSIKTNKELKRVIKDFNENKIDILVGTQMLSKGHDYHNVKLAVVLGIDSMLNMTSYKVREKPCHF

SEQ ID NO: 11905 - DNA, 645 bp, Unknown
  Obtained from environmental sample
  misc_feature (1)..(645): n is a, c, g, or t
atgaaaaataataaaaaaatagcaatagtatttggtagtcagagttttgaacatgagataagtatcgttagtgcaataacaatgaaaaaggttttaaagtgtgaaattatttatatttttattgataagtatagagaattttatcttatccctacagatataataaaatcaaatcttttcagtagtggtgaatataaaaagtttgataaattagagttaaatcacaaggggtttactaagaaaaaactctttggaagagaaaaaatagagtttgatacggtattaaatttagttcatggtggagatggtgaagatggtgtactagctgggttatttaaattttacaatataccgtttataggtccacgaattgaagctagcgtagttagttgtaataaatatttaacaaaatcttacgctcatagttgtggagtaaagtctatagattttcaatatttcactaaaaatgaaataattacagtagaaaaatttccagttatcattaaaccagttcgattaggaagtagtataggtgtttctgttgtgaacaataaagaggagttggattatgctcttgatgttgcatttgaatttgacaacgaaattattattgaaccttttttgtgcagggataaaagaatataa

SEQ ID NO: 11906 - protein, 214 aa, Unknown
  Obtained from environmental sample
  DOMAIN (132)...(214): D-ala D-ala ligase C-terminus
  misc_feature (1)..(214): Xaa is any amino acid
MKNNKKIAIVFGSQSFEHEISIVSAITMKKVLKCEIIYIFIDKYREFYLIPTDIIKSNLFSSGEYKKFDKLELNHKGFTKKKLFGREKIEFDTVLNLVHGGDGEDGVLAGLFKFYNIPFIGPRIEASVVSCNKYLTKSYAHSCGVKSIDFQYFTKNEIITVEKFPVIIKPVRLGSSIGVSVVNNKEELDYALDVAFEFDNEIIIEPFLCRDKRI

SEQ ID NO: 11907 - DNA, 708 bp, Unknown
  Obtained from environmental sample
  misc_feature (1)..(708): n is a, c, g, or t
atgaaaaaagcttctgaattatccaatctgtaccttgagccatttaatattatcatgcaaaatcatagtgactcacttatgtctatcattgtagacataagtgaagaagcgaataggcaacgatttttaaatactgacactatcttacaaaagctatatacaaaagtttatacagctttttgtagagtagagcgtgaagttcaaaataataataggttgttgatcaacgaggttggaccacttttagaaagaataaaatctgagagtgtactcttgagcggttttagctcatttcttcgaaataataaaaaatttgaagtaccaaaactgttgcttaaaacaaataataaagtatattatagagatgctatctgggaagctaaagagatatgggatggatactacgaaatacaagaagatgttgtaatgcagagtattgaaacagtgaagaaagaatggatgtatgatgaaacaaaatatcttaagaagcttgagaaagtactacctgtaaataatttttataattggatatatatggagttaaggcaagagtcagagatagttgagtctaaaatgtttctacagctatctaagttgatacataatagaagtatagaagctatatatactgataatgaaagagaaaaaataattctagaagataaaataatggatgtgccaattgtaggcataaaaaaggtattgtaa

SEQ ID NO: 11908 - protein, 235 aa, Unknown
  Obtained from environmental sample
  misc_feature (1)..(235): Xaa is any amino acid
MKKASELSNLYLEPFNIIMQNHSDSLMSIIVDISEEANRQRFLNTDTILQKLYTKVYTAFCRVEREVQNNNRLLINEVGPLLERIKSESVLLSGFSSFLRNNKKFEVPKLLLKTNNKVYYRDAIWEAKEIWDGYYEIQEDVVMQSIETVKKEWMYDETKYLKKLEKVLPVNNFYNWIYMELRQESEIVESKMFLQLSKLIHNRSIEAIYTDNEREKIILEDKIMDVPIVGIKKVL

SEQ ID NO: 11909 - DNA, 780 bp, Unknown
  Obtained from environmental sample
  misc_feature (1)..(780): n is a, c, g, or t
ttggcatcagctgttgttggtttctatcaaacttttggtatagatgaaccaagtggttgttatgatgatatagaacttacagatacagttgtatcatggggttcaaatatggcagagatgcatcctattttatggtcaagggtaactgatagaaaattatcagatccagagagagtaaaagttgtaaatatttcaacttatagacatagaacatcagatttagctgatattgagattatcttcacacctaatactgatttagcactttggaactatattgcaagagagattgtatacaatcacccagaagctattgattgggactttgtaaataaacatatgattttctgttcacaacctgtaaatacagggtatggtatgagaagaagtgatgaaaaatctattgttgatggtaaatatacagataaagagatggaaactatctcaaaagagatgaaaaaagttgtttcagaagctgaagcaccagcattagagccttttggatataaagaaggtgatgtgatggagaataaaccagctgggctaaaacattgggaaatttcttttgaagagtataaaaaattcttagatccatatacagttgattatgtagcaaaaatctcaaaaggaaatcctgatgaagatattgaagagtttaagaaaaaacttcaaactttagcatcatattatattgaaaaaggtagaaaagtagtaagtttttggactatgggtatgaacccacatacaagagggaacttgggtaaataccctttcctataa

SEQ ID NO: 11910 - protein, 259 aa, Unknown
  Obtained from environmental sample
  misc_feature (1)..(259): Xaa is any amino acid
MASAVVGFYQTFGIDEPSGCYDDIELTDTVVSWGSNMAEMHPILWSRVTDRKLSDPERVKVVNISTYRHRTSDLADIEIIFTPNTDLALWNYIAREIVYNHPEAIDWDFVNKHMIFCSQPVNTGYGMRRSDEKSIVDGKYTDKEMETISKEMKKVVSEAEAPALEPFGYKEGDVMENKPAGLKHWEISFEEYKKFLDPYTVDYVAKISKGNPDEDIEEFKKKLQTLASYYIEKGRKVVSFWTMGMNPHTRGNLGKYPFL

SEQ ID NO: 11911 - DNA, 603 bp, Unknown
  Obtained from environmental sample
  misc_feature (1)..(603): n is a, c, g, or t
ttggcctcccataaggaactaattgatctcaaggaggctcaggaggtttttatggcttcctatgaaaatgaaactcctgaaaaaaggctgttcaaaatagtctccttttttgaagaactcattacaggctcacttaatccgcttaaaagaatttcagatataagtcatctctttatggagggcggtctatcttttagagataaaaaagatatttcagtggatcttttagagcatacagacaggcttgaacgccttttggcaatggtctatcatgtcacaagatttgtatgcggaaaaacacttctttcaaacattgatattcatgatataaaccgtatccttcttcttcagattgagagactgagtgaaattgcatcaagaaattcctgcacaataaaatatattccccaaagtgctaatcccatgatgtcccgtgtttcaataagagcaattgagcatctggttttcctcttaatagataattcagtaaaatatgccaaaaagggtaagcaaaatatatttgtaaaatcggaacaaataaacaaatcgattcacataacaataaaagatgaagccccttggaatagaaccgcgcttttatga

SEQ ID NO: 11912 - protein, 200 aa, Unknown
  Obtained from environmental sample
  misc_feature (1)..(200): Xaa is any amino acid
MASHKELIDLKEAQEVFMASYENETPEKRLFKIVSFFEELITGSLNPLKRISDISHLFMEGGLSFRDKKDISVDLLEHTDRLERLLAMVYHVTRFVCGKTLLSNIDIHDINRILLLQIERLSEIASRNSCTIKYIPQSANPMMSRVSIRAIEHLVFLLIDNSVKYAKKGKQNIFVKSEQINKSIHITIKDEAPWNRTALL

SEQ ID NO: 11913 - DNA, 732 bp, Unknown
  Obtained from environmental sample
  misc_feature (1)..(732): n is a, c, g, or t
ttgcaaaatatcgtcttaangttttttacaaaaaaatctagtaaattaaaatcaaaatacaaaacaataatcaatgattacagcactggaaagcaaactcaagtacaaatagctgttaacgttggtaaaactcgagaatgggtaaataagtacattaaaaacaactcatcttgtaataagaattacaattcagaaattaaacctcaaagtatagttttggttattgatacaacttatttcaaacaatttggcttgatggtttttcgtgctgtaaatcttaaaaaaaatttactttggtacatcattgatcatgaaacaaatgaaaaatatagagaaggaattcaatatttaatagatcaaaattggagtattgaaatgttaatagctgatggcaaaccaggcttagcaaagctatttcctgagataccatttcaactttgtaattttcatatttttcaaaatgtaacaagatcaacaactaaaaacccaaaacttgaagctgcaaaagaacttagaactattatgtttagattaaaagaaactgataaagttagttttaagttttgggtaaacaaatggaatgaaaaatgggatgattttctaaaagaaaaaacactaaatcaaataactggaaaatctttttatacgcatcgtagattaagaaaagcgttgcgttcaattaaggctgcaatgccatatttgtttacatatcaaaaaattaaaattacttaa

SEQ ID NO: 11914 - protein, 243 aa, Unknown
  Obtained from environmental sample
  misc_feature (1)..(243): Xaa is any amino acid
MQNIVLXFFTKKSSKLKSKYKTIINDYSTGKQTQVQIAVNVGKTREWVNKYIKNNSSCNKNYNSEIKPQSIVLVIDTTYFKQFGLMVFRAVNLKKNLLWYIIDHETNEKYREGIQYLIDQNWSIEMLIADGKPGLAKLFPEIPFQLCNFHIFQNVTRSTTKNPKLEAAKELRTIMFRLKETDKVSFKFWVNKWNEKWDDFLKEKTLNQITGKSFYTHRRLRKALRSIKAAMPYLFTYQKIKIT

SEQ ID NO: 11915 - DNA, 396 bp, Unknown
  Obtained from environmental sample
  misc_feature (1)..(396): n is a, c, g, or t
atgggtgatgaagctttagagataattaatgtttctcactcttatggggataatgaagttttaaaagatattgattttaaagttgaaccgggtgagagaattgcacttatcggtggaaacggtgttggtaagtcaactttagtaaaaatcatcatggaagagatcaaaccgacaattggagagatcaaatggggagctacagtagagagtagctattttccacaagatacggcagatattattaagggtgatggaactctttatgagtggctacgtgcttatgatccaaaacgtgatattgcagagattagaaactgtcttggaagaatgctattcaatggtgaacaacaagaaaaatctgtagagaagatctctggcccgaaaaacatcgtatga

SEQ ID NO: 11916 - protein, 131 aa, Unknown
  Obtained from environmental sample
  misc_feature (1)..(131): Xaa is any amino acid
MGDEALEIINVSHSYGDNEVLKDIDFKVEPGERIALIGGNGVGKSTLVKIIMEEIKPTIGEIKWGATVESSYFPQDTADIIKGDGTLYEWLRAYDPKRDIAEIRNCLGRMLFNGEQQEKSVEKISGPKNIV

SEQ ID NO: 11917 - DNA, 408 bp, Unknown; identical to SEQ ID NO: 8479
  Obtained from environmental sample
  misc_feature (1)..(408): n is a, c, g, or t

SEQ ID NO: 11918 - protein, 135 aa, Unknown; identical to SEQ ID NO: 8480
  Obtained from environmental sample
  misc_feature (1)..(135): Xaa is any amino acid

SEQ ID NO: 11919 - DNA, 426 bp, Unknown
  Obtained from environmental sample
  misc_feature (1)..(426): n is a, c, g, or t
atggtaactatgaaagacttattagaatgtggtgtacactttggtcaccaaactcgtcgttggaatccaaaaatgaaaaaacatatttttggtgttcgtaaaaatattcatattatagatcttcaaaagactctacgttatttccgtaacacataccaaatcgttgttgatgctgttgctgaagggcaaacagttctttttgttggtacaaaaaaacaagctcgtcaagctgttaaagaagctgcaattgcttgtggtatgccttatgttgataaccgttggttaggtggtatgcttactaactaccctacaattcaaaaatctattcgtaagcttgatgttattgagcagatgaaagagaatggtcaaattaatcttttaactaaaaaagaagcactgatgatgtctcgtcaagcagagaagtaa

SEQ ID NO: 11920 - protein, 141 aa, Unknown
  Obtained from environmental sample
  DOMAIN (7)...(141): Ribosomal protein S2
  misc_feature (1)..(141): Xaa is any amino acid
MVTMKDLLECGVHFGHQTRRWNPKMKKHIFGVRKNIHIIDLQKTLRYFRNTYQIVVDAVAEGQTVLFVGTKKQARQAVKEAAIACGMPYVDNRWLGGMLTNYPTIQKSIRKLDVIEQMKENGQINLLTKKEALMMSRQAEK

SEQ ID NO: 11921 - DNA, 621 bp, Unknown
  Obtained from environmental sample
  misc_feature (1)..(621): n is a, c, g, or t
atggtatatcaactttcaaatccgatcgtaaaatcactcataacatccttaagagatgtaaacacggatgctctgcgttttaaacacatcgtcatggaactctccagatttttagtttatgaagcactcaaggatatagagatgactccaaaagttatcactacatggaaaggtgaagatacatttgcatccataaaagaggaagatattgtatttgtgacagtgttacgtgcaggaatgcctatgatagaaggattaaacaacctatttgtctcttcaccatcaggttttttggctatgaaaagagatgaggttacacataaaagtaaattatattttgacagagttcctgattgtaaagggaaaagagtgattttagtagatcccatggtagcaacaggaggttccctctgtgatgccatagagctgttaaaaacaaaagatccacactccatcacaacactcaatattatagcttcacctgagggtttaagtgttgtgcaaaaagcttatggcgatgttgatatctatgtagcccaaatcgataaatctttaaacgatgataaattcatcttaccgggattaggtgacgcaggtgatagaagttataacactctctaa

SEQ ID NO: 11922 - protein, 206 aa, Unknown
  Obtained from environmental sample
  DOMAIN (16)...(177): Phosphoribosyl transferase domain
  misc_feature (1)..(206): Xaa is any amino acid
MVYQLSNPIVKSLITSLRDVNTDALRFKHIVMELSRFLVYEALKDIEMTPKVITTWKGEDTFASIKEEDIVFVTVLRAGMPMIEGLNNLFVSSPSGFLAMKRDEVTHKSKLYFDRVPDCKGKRVILVDPMVATGGSLCDAIELLKTKDPHSITTLNIIASPEGLSVVQKAYGDVDIYVAQIDKSLNDDKFILPGLGDAGDRSYNTL

SEQ ID NO: 11923 - DNA, 813 bp, Unknown
  Obtained from environmental sample
  misc_feature (1)..(813): n is a, c, g, or t
atgagctaccgctcaagcagaggttatgatcacttaaaagtcgctctttcagtcggtgttcagaagatggtcagaagcgataagagctgtagtggaaccatgttcagcattgatacagagagtggatcacgagatctgatcttaataaactcaggttggggtcttggtgaaaacattgtggggggtatgataaaccctgatgaatttttaatatttaaacctactttgaaaaataatgtttcaaccatactcaaaaaagagcttggaagtaaaaagcttaagatgatctactcgaaaaatggcggtagtgaaaatatcgagagtacaaaagaggagagagaaactttctcattaagtgatgaagatatttttacacttgcatccgccgcactaaagatagagacacactactctgagcttgcagatgaataccgtgccatggatatagagtgggcaaaagatggagagacgagtgaaatatttattttgcagtcacgaccagaaacaattcactcaaagaagagtactcaagaaaacaatattaaacaatataaactttcaactgaacaaaaaactcttatcaccaaaggtgtagccataggagataaaataggttctggaaaagtaagaatcatcaactctccatcagagtttcactttttttgtgatggtgaagtcttagtcgcagatattaccgatcctgattgggaacctatcatgaaacgcgcatctgcacttattacaaacagaggtgggaagaacttgtcctgctgccatagtagcacgagaaataggagttcctgcagtatttga

SEQ ID NO: 11924 - protein, 270 aa, Unknown
  Obtained from environmental sample
  DOMAIN (202)...(270): PEP-utilising enzyme, mobile domain
  misc_feature (1)..(270): Xaa is any amino acid
MSYRSSRGYDHLKVALSVGVQKMVRSDKSCSGTMFSIDTESGSRDLILINSGWGLGENIVGGMINPDEFLIFKPTLKNNVSTILKKELGSKKLKMIYSKNGGSENIESTKEERETFSLSDEDIFTLASAALKIETHYSELADEYRAMDIEWAKDGETSEIFILQSRPETIHSKKSTQENNIKQYKLSTEQKTLITKGVAIGDKIGSGKVRIINSPSEFHFFCDGEVLVADITDPDWEPIMKRASALITNRGGKNLSCCHSSTRNRSSCSI

SEQ ID NO: 11925 - DNA, 486 bp, Unknown
  Obtained from environmental sample
  misc_feature (1)..(486): n is a, c, g, or t
ttggcacgacacccaaaagatttagataagacaaagatatcccaatttatttcaaataaagttgttttagttacaggagctgggggaagtatagggagtgagattgtaagacaatgtttattttttaaagcttctaaaataatattactagaccatagtgaatttaatttgtaccaaatagaacaagagatacaacatttaacaacaattgatattatccctattatgcaatcagttgtaaacaaagaagatttggaaaaaacatttgaaaaatatacgccagatatagttatacacgcagcagcatataaacatgtgccattagtagaacataatatcaaagaatcaatagttaataatataataggaactaaaaatacaatagattgtgctattaagtataatgtggaaaaatttttattgatttcaaccgataaagcagttcgtcctacaaatgttatgggtactacaaagccgtatttgtga

SEQ ID NO: 11926 - protein, 161 aa, Unknown
  Obtained from environmental sample
  DOMAIN (1)...(160): Polysaccharide biosynthesis protein
  misc_feature (1)..(161): Xaa is any amino acid
MARHPKDLDKTKISQFISNKVVLVTGAGGSIGSEIVRQCLFFKASKIILLDHSEFNLYQIEQEIQHLTTIDIIPIMQSVVNKEDLEKTFEKYTPDIVIHAAAYKHVPLVEHNIKESIVNNIIGTKNTIDCAIKYNVEKFLLISTDKAVRPTNVMGTTKPYL

SEQ ID NO: 11927 - DNA, 822 bp, Unknown
  Obtained from environmental sample
  misc_feature (1)..(822): n is a, c, g, or t
ttgaaattgattccagatgttcctgtttattgtacagctaacggagttaaatccctgaaaggtcattaccatcaggattggaattttcgggttgtaaaaaccggagatacccttgatattggaaacgggaaatctttggttttcatcgaagctcctatgctgcactggccggatagtatgttcacttacctcactggggataatatactcttcagtaatgatgctttcggacagcattatgcttccgagttcatgtttaacgatttggtagatcaagctgaacttattcctgaagcgttgaaatattatgccaatattcttactcccttcagcaaatttgtaaccaaaaagatagagcagtttgtaggtttgaacttaccacttgatattatctgtcccagtcacggggtgatctggcgcgataacccgatgcaaattgcaggactatatcttaagtgggcggcagactatcaggaaaatcaggtaacaatactctacgataccatgtggggtgctaccagaaccatggctgaagaaatttctaaaggaattgttagcagtaacccaactgttaatgttaaattgtttaatacagctaaggctgataaaaatgacgttataactgaagtgtttaaagcaaaaatgattttagttggttcttccactataaatagagggtatctaaccagtattgctggtataatggaagagataaaaggtcttaaatttatgaataaaaaagctgctgctttcggctcttatggctggagtggtgaaatcgttaaacaaatatccaattttatgggatggggccgggtttga

SEQ ID NO: 11928 - protein, 273 aa, Unknown
  Obtained from environmental sample
  DOMAIN (164)...(270): Flavodoxin
  misc_feature (1)..(273): Xaa is any amino acid
MKLIPDVPVYCTANGVKSLKGHYHQDWNFRVVKTGDTLDIGNGKSLVFIEAPMLHWPDSMFTYLTGDNILFSNDAFGQHYASEFMFNDLVDQAELIPEALKYYANILTPFSKFVTKKIEQFVGLNLPLDIICPSHGVIWRDNPMQIAGLYLKWAADYQENQVTILYDTMWGATRTMAEEISKGIVSSNPTVNVKLFNTAKADKNDVITEVFKAKMILVGSSTINRGYLTSIAGIMEEIKGLKFMNKKAAAFGSYGWSGEIVKQISNFMGWGRV

SEQ ID NO: 11929 - DNA, 576 bp, Unknown
  Obtained from environmental sample
  misc_feature (1)..(576): n is a, c, g, or t
atggttaagtttcatggagattacttttctgaaaaattaaagaatactacgcctgaattaaagagtcaagacaaaaaacttcgaggaataatttcccaatcatgctttacaaagggtcttgggattatggggtatagtggacgagatcagtcaatcatggatacccttaatgccgcacttgagctagaaaacagttttccacatggaatattttggttcattagatcaggttcaaaaacattacctaacgtaaatgcgtttattgagaaagcacaaaacaaaggggtagaggcacatattattgaaattgaaacatttgatactggatgggctgaaattctaaaaggttttgactcaatacctgaagctgaacttggacagttaaatcgaaattactatagagtaaataatcgacctttgcctccaaaaggtaaaaggcttcctctacttaggtttaatgctattccgatagttaaatatccttcaatcgcaagattatataattgtgagataggaggaataaaagaggttagggaaaaaatttcaactaacaatagtagcattgttgttatatga

SEQ ID NO: 11930 - protein, 191 aa, Unknown
  Obtained from environmental sample
  misc_feature (1)..(191): Xaa is any amino acid
MVKFHGDYFSEKLKNTTPELKSQDKKLRGIISQSCFTKGLGIMGYSGRDQSIMDTLNAALELENSFPHGIFWFIRSGSKTLPNVNAFIEKAQNKGVEAHIIEIETFDTGWAEILKGFDSIPEAELGQLNRNYYRVNNRPLPPKGKRLPLLRFNAIPIVKYPSIARLYNCEIGGIKEVREKISTNNSSIVVI

SEQ ID NO: 11931 - DNA, 501 bp, Unknown
  Obtained from environmental sample
  misc_feature (1)..(501): n is a, c, g, or t
ttgagtattaactggcacaatatcagagcaattgaaggccaaagagaaggcttcgaggaattggtatgccagcttgctggacaagaaaaaatcgaaaagcaggtacaatttaccagaatcgggaaacctgatggaggaaaagaatgttattgggagttaagtaatggtcatattcattgttggcaagccaaatatttcataaacagtctatcggataaccagtggacacaggtagataaatctgttaaaacggctatcgataaccaccctaagctaaagaaatatcacatagccattcctgttgaccgaccagatggaaaaggacgcggtaaatctatgcttcaaaaatggaaggatcacgtggttgaatgggaaaagtatgcttcattaaagaaaatgaaagtatcctttgaatactggggtaaacacgaaatggaaatacgcctaagaaatcctgagaatgaagggttaatctattatttttttacngaagcagagtaa

SEQ ID NO: 11932 - protein, 166 aa, Unknown
  Obtained from environmental sample
  misc_feature (1)..(166): Xaa is any amino acid
MSINWHNIRAIEGQREGFEELVCQLAGQEKIEKQVQFTRIGKPDGGKECYWELSNGHIHCWQAKYFINSLSDNQWTQVDKSVKTAIDNHPKLKKYHIAIPVDRPDGKGRGKSMLQKWKDHVVEWEKYASLKKMKVSFEYWGKHEMEIRLRNPENEGLIYYFFTEAE

SEQ ID NO: 11933 - DNA, 495 bp, Unknown
  Obtained from environmental sample
  misc_feature (1)..(495): n is a, c, g, or t
ttgccacaggctttgaagattttgaacgacaaaggtataagcaatattgagaatgtttcaaataatttgtctgataaaaaaagacttatttataaacgaatgataaattcattagatctaatttctgataaaattaaacatttacgtagggtttatattttttattctgtccccgaaaaatcacttgtgcaacttgcagatatagttattcaacaaagagtaacagaaaatacagaaataaatttctttaataatagcgaagaagatattttaattttagttaagggggaattgacgtgtttggataaaaaacaacgattgtcatttaataaaaacagtattattattcttggtttgaatgcacctcagagtgtaattactcttaaatcaactacaaattctgtcgtgatgaaaataaatcgtttcaaatttttcaatttgcttgcttcaaataatgaacttgtgaaaaatttatttaaaacaatgaagttttaa

SEQ ID NO: 11934 - protein, 164 aa, Unknown
  Obtained from environmental sample
  misc_feature (1)..(164): Xaa is any amino acid
MPQALKILNDKGISNIENVSNNLSDKKRLIYKRMINSLDLISDKIKHLRRVYIFYSVPEKSLVQLADIVIQQRVTENTEINFFNNSEEDILILVKGELTCLDKKQRLSFNKNSIIILGLNAPQSVITLKSTTNSVVMKINRFKFFNLLASNNELVKNLFKTMKF

SEQ ID NO: 11935 - DNA, 753 bp, Unknown
  Obtained from environmental sample
  misc_feature (1)..(753): n is a, c, g, or t
atgaagaaaacaatcttaattattgcaagcctttttgtagctgcatttataggtcaggcacaggatatgacccttgaagaaattctagaaagccactttgaagccattggccaggaaaaaatgattgatgtaaaatcaataactatgacaggaaaacaaatggctcagggtatggagtttccatttaaagtaattatcaaaagaccagacaaagtaagaattgaagccacgatacaaggtaatattatggttcaggcttataatggagaagatggctggatgatagccccatggcttggtactatggatccgcaagatgttaatgaagaacaattgaaaggatataaagaacaagctgatatggatggtaaactctataactggaaagataaaggttatacggttgaactaattggtacagaagatatggaaggtactgaaatatataaaattaagcttactgaaaaacctgacaaagaaggcgaagatggggatgtgactttctattttattgattctgacagttttgtaattttaaaaacttctgccaaaagaataattcaaggaaatgaaatggaagcagaaacatttcaaagcaattataagcaaataaacggtattgccatggctttttccatggaaactaaaatgggtggtaattcaatgtcacaaattgttgttgaagaacttaaatttgacgaagaaattgacgacnagatttttgaccgtcctgagaaaaagaagaagaagtaa

SEQ ID NO: 11936 - protein, 250 aa, Unknown
  Obtained from environmental sample
  SIGNAL (1)...(20)
  misc_feature (1)..(250): Xaa is any amino acid
MKKTILIIASLFVAAFIGQAQDMTLEEILESHFEAIGQEKMIDVKSITMTGKQMAQGMEFPFKVIIKRPDKVRIEATIQGNIMVQAYNGEDGWMIAPWLGTMDPQDVNEEQLKGYKEQADMDGKLYNWKDKGYTVELIGTEDMEGTEIYKIKLTEKPDKEGEDGDVTFYFIDSDSFVILKTSAKRIIQGNEMEAETFQSNYKQINGIAMAFSMETKMGGNSMSQIVVEELKFDEEIDDXIFDRPEKKKKK

SEQ ID NO: 11937 - DNA, 861 bp, Unknown
  Obtained from environmental sample
  misc_feature (1)..(861): n is a, c, g, or t
atgggagattggagattgactttttcttnnncaagaacagaaccactggttatagtaatagatggattagaccacattgatagactattaaaaaattctaaacaattatctattgaaaaaactagaattatcgactttatttctaagataaagttacctagtaatgtttctataattttaggtagtcaacctataattgaattaaaagaacttactgataaacactcatataaaaaatataatattcttaaatggacaggagaagaaacattatcattaatgagtaaatattcattaaaagatagaataattgatcacataatgctttctcaacatattcttaataaaagtgaaggaaactctctttatacaacttatattttaaaagaactaattgataaggaaattacattagaattgctaaatacactcccttcttatgattttaatcttagtaaatattacgattatctaactaatcagataaagaataataatacatctgaagtgttatcatgcttggagtttagagtaaataaaaaagaattaaaggaattagtacactactcaggacatgttgaagataatttaaaaatattatctcctgttgtctcagaaaatagctcaataggtggacttagactctatcatgatagttttaggagatataatattgaaaagcttacaaaattagggcatatcaatgcgatttatttagatattgcagcatggttagaaaaaaaaagattttataaatttacaaagtcttactatcatttgtttaaatattacataaaagctgaacagtataaagaaatcaaaaagtatgcaaccacccatttttctatcaaaaagttttaa

SEQ ID NO: 11938 - protein, 286 aa, Unknown
  Obtained from environmental sample
  misc_feature (1)..(286): Xaa is any amino acid
MGDWRLTFSXXRTEPLVIVIDGLDHIDRLLKNSKQLSIEKTRIIDFISKIKLPSNVSIILGSQPIIELKELTDKHSYKKYNILKWTGEETLSLMSKYSLKDRIIDHIMLSQHILNKSEGNSLYTTYILKELIDKEITLELLNTLPSYDFNLSKYYDYLTNQIKNNNTSEVLSCLEFRVNKKELKELVHYSGHVEDNLKILSPVVSENSSIGGLRLYHDSFRRYNIEKLTKLGHINAIYLDIAAWLEKKRFYKFTKSYYHLFKYYIKAEQYKEIKKYATTHFSIKKF

SEQ ID NO: 11939 - DNA, 744 bp, Unknown
  Obtained from environmental sample
  misc_feature (1)..(744): n is a, c, g, or t
atgttaaaatgctatacaaattgtgaaaacttacatcatgaacatcaatatataatacaaagaccaatttttagaatgtttgaatatattgataatagatgggatgaagtgattgaaataattatttttttaaaagaatcttcccataggttaaattcatatttttatatggggatgttaaaaaattatgaatgtaaggagaatagagagtatttaataaatgaatatgagacaataataaaagaagatgaacaacaaagtgaagggtatagttttttaattgacactaccttttctttagcattgttatattcaaataatcgacaaaaaaagaaagctaagaagtattttaaaaaaggaatttcctatattactgcatacacatttagaaaagatacgactctagatgaattaataaatccattagattcaataaattatataaatcagaaaaaaactattaactattgtcaagaacttttagcattaaatttgacaattgaagctaacagtgaagatgggaaaggcattagatggctatatattgagtggtttgaaaagttatctttaattaataaaaaaatggcaattacttttttaataaataaattcttagaagatgaatattattggaagtatgaacatatgtttacaaatttagtcacttctatattaagtattgatcctatagttttgaattttcttcatagggtatctaacaaaaaattgatgaaaactaaatga

SEQ ID NO: 11940 - protein, 247 aa, Unknown
  Obtained from environmental sample
  misc_feature (1)..(247): Xaa is any amino acid
MLKCYTNCENLHHEHQYIIQRPIFRMFEYIDNRWDEVIEIIIFLKESSHRLNSYFYMGMLKNYECKENREYLINEYETIIKEDEQQSEGYSFLIDTTFSLALLYSNNRQKKKAKKYFKKGISYITAYTFRKDTTLDELINPLDSINYINQKKTINYCQELLALNLTIEANSEDGKGIRWLYIEWFEKLSLINKKMAITFLINKFLEDEYYWKYEHMFTNLVTSILSIDPIVLNFLHRVSNKKLMKTK

SEQ ID NO: 11941 - DNA, 630 bp, Unknown
  Obtained from environmental sample
  misc_feature (1)..(630): n is a, c, g, or t
ttgaaatttactataattatagaatataaacaaagggcaaaaagcatggaagataagtcgtctttgcaaaatacattgatacagattagagctttagaagatttcaatcgaactgtagataatccaaatgtaaaactaataaactatataaagactatggaagaatatgtatattctacaaaaacagataaacaaggcattattagtgatgtcagcgattctttttctagattgacaggctactcaagagatgaacttattggtaaaagtcataatctaataaaaagtccagagatgaaagatagtttttttacaaatatgtggcagacaatattaaaagaagaagtttgggaaggtaacattcaaaatatcaagaaggatggcactcttttttggatggctgtaattatttttcctatttatgctataaataaagaactattaggctactcagcattacgtcataatataactgatactaaagaacttgctcataaagcaatacatgatggactaactggtctatataatagacgctactatgatgaagtcattgagagagaactattacgtgctaaaagaaaaaaagtaaccttttcttttngtatgggggaatgtggatttttttaa

SEQ ID NO: 11942 - protein, 209 aa, Unknown
  Obtained from environmental sample
  DOMAIN (118)...(160): PAC motif
  misc_feature (1)..(209): Xaa is any amino acid
MKFTIIIEYKQRAKSMEDKSSLQNTLIQIRALEDFNRTVDNPNVKLINYIKTMEEYVYSTKTDKQGIISDVSDSFSRLTGYSRDELIGKSHNLIKSPEMKDSFFTNMWQTILKEEVWEGNIQNIKKDGTLFWMAVIIFPIYAINKELLGYSALRHNITDTKELAHKAIHDGLTGLYNRRYYDEVIERELLRAKRKKVTFSFXMGECGFF

SEQ ID NO: 11943 - DNA, 354 bp, Unknown
  Obtained from environmental sample
  misc_feature (1)..(354): n is a, c, g, or t
atggactccaaaagatgtattggatgtaaaacctgtattcttgcctgtccatacgatgctaggtactttgacgcaaatcgtcacgcaatagacaaatgcgatttctgctgggaaaagcgtttatccaaaggtgaaaaagaaaccggttgttcttcagcatgtccaacaggagccagaacattcggtaacctgacagaccctgacaatattgtcttcaaactggttcaccagatagaagagcaagtatgggttctccgtcctgcagatgacaccaagccaaacattttctacatgaaaggcaatatacgttcagtagataatatcttgaaaggacaaaaatttaaaaccacataa

SEQ ID NO: 11944 - protein, 117 aa, Unknown
  Obtained from environmental sample
  DOMAIN (2)...(22): 4Fe-4S binding domain
  misc_feature (1)..(117): Xaa is any amino acid
MDSKRCIGCKTCILACPYDARYFDANRHAIDKCDFCWEKRLSKGEKETGCSSACPTGARTFGNLTDPDNIVFKLVHQIEEQVWVLRPADDTKPNIFYMKGNIRSVDNILKGQKFKTT

SEQ ID NO: 11945 - DNA, 378 bp, Unknown
  Obtained from environmental sample
  misc_feature (1)..(378): n is a, c, g, or t
atgagggaaataattccagaaattgataaaacgtcaaagttggttcaagaaatatctgctgcgagtgttgagcaaagttcaggagctaatcaggttaatagtactttacaacaattaaatacaataacacagcaaaatgcttcttctagcgaggaattagcagcaagtgcagaggaacttactgctcaggcagaatcgttaaaaaatctcatatcattttttaaaattaagggcaaatctaagcgagaaagatataacaaacctttactaaaagaacctggaggaaaacaaaagaaagaaacttttactcagccaacaaatcaagggtttaatataaaattatcgaatgatttaaatgatgattataaagatttctaa

SEQ ID NO: 11946 - protein, 125 aa, Unknown
  Obtained from environmental sample
  misc_feature (1)..(125): Xaa is any amino acid
MREIIPEIDKTSKLVQEISAASVEQSSGANQVNSTLQQLNTITQQNASSSEELAASAEELTAQAESLKNLISFFKIKGKSKRERYNKPLLKEPGGKQKKETFTQPTNQGFNIKLSNDLNDDYKDF

SEQ ID NO: 11947 - DNA, 360 bp, Unknown
  Obtained from environmental sample
  misc_feature (1)..(360): n is a, c, g, or t
ttgaagaaattaaatgcctttgattgtgccaaatgctgcaaatcaataagtccaactttgtacgataaagatattgaaagactagcaaaacattttagaataaaaccttcaaaatttattgatgaatatttatatgtagataatgatggcgattatgtgtttaagcaaacaccttgtccttttttactccccgataattattgtatggtttatgaaagcagaccaaaagcttgtagagaatatccacataccgatcgtaaaaaaatttatcagattctagatttaacattaaagaacaccgagatttgtcctgctgttttcgatcttgttgaattattaaaaaacaaaaaaagtatctaa

SEQ ID NO: 11948 - protein, 119 aa, Unknown
  Obtained from environmental sample
  DOMAIN (7)...(108): Uncharacterised protein family (UPF0153)
  misc_feature (1)..(119): Xaa is any amino acid
MKKLNAFDCAKCCKSISPTLYDKDIERLAKHFRIKPSKFIDEYLYVDNDGDYVFKQTPCPFLLPDNYCMVYESRPKACREYPHTDRKKIYQILDLTLKNTEICPAVFDLVELLKNKKSI

SEQ ID NO: 11949 - DNA, 414 bp, Unknown
  Obtained from environmental sample
  misc_feature (1)..(414): n is a, c, g, or t
atgagcatcttaaatcaaatatctctttctgaacttcgagataaagccttaaaacttgctcctgaaacaaaatccttatttgcaaaactaaaaaagaagaagcctaaaaatctcgatacaactgttcatcaattacatgatcaggtttttgaagaaattaattgccttgattgtgccaattgctgcaaatcaataagtccaactttgtacgataaagatattgaaagactagcaaaacattttagaataaaaccttcaaaatttattgatgaatatttatatgtagataatgatggcgattatgtgtttaaagcaacaccttgtccttttttactccccgaaaatattgtatgggttatgaaagcaaaccaaaagcctggagaaaaaaatcacatacccatcgaaaaaaattaa

SEQ ID NO: 11950 - protein, 137 aa, Unknown
  Obtained from environmental sample
  misc_feature (1)..(137): Xaa is any amino acid
MSILNQISLSELRDKALKLAPETKSLFAKLKKKKPKNLDTTVHQLHDQVFEEINCLDCANCCKSISPTLYDKDIERLAKHFRIKPSKFIDEYLYVDNDGDYVFKATPCPFLLPENIVWVMKANQKPGEKNHIPIEKN

SEQ ID NO: 11951 - DNA, 318 bp, Unknown
  Obtained from environmental sample
  misc_feature (1)..(318): n is a, c, g, or t
atggaaccacgattcctaggtgtaaaagttgttcttgttagatcctttgctcgtatacacgaaacaaatcttaaaaaacaaggtgttttagcacttacttttgctaataaagatgactataacaaaattcaggaagatgatagttttgacataattggattaactgattttgcccctggaaaacaactaaaagttgttcttcatcacattaatggatcatctcaggaaattattgttaaccacacatataacagtaaccaaattgaatggtttaaagcaggtagtgctcttaatttaataaaaaagcaaaatgcctaa

SEQ ID NO: 11952 - protein, 105 aa, Unknown
  Obtained from environmental sample
  misc_feature (1)..(105): Xaa is any amino acid
MEPRFLGVKVVLVRSFARIHETNLKKQGVLALTFANKDDYNKIQEDDSFDIIGLTDFAPGKQLKVVLHHINGSSQEIIVNHTYNSNQIEWFKAGSALNLIKKQNA

SEQ ID NO: 11953 - DNA, 690 bp, Unknown
  Obtained from environmental sample
  misc_feature (1)..(690): n is a, c, g, or t
gtggagaattatgtgaaaccaaatataaatcttttgaaggctgttttaagagcccgatataagaaaaaaataagtacttttaaatcaaagattgatttagaaataaataaaaagaactacataatcaagactgctaatactccagacgagttagaacaggttttgacacttagacatcaagtctttttggaagaacttcttcaaaaaaaacgctttatagaggtggattttgataagtttgacttggtatgtgaccacttaatgattatcaataaaactgatgataatctgattggtacgtatagactaaactgcaccaaattcagtaattgcttctattctgcaacagagtttaatataaagtctattcttgaacttcctggagataaggtggaactgggacgagcttgtgttcaccctgattatagaaatggtatgactattgcccttctctggaaaggtcttagcgactatatgactgcgtctggaagtaggttcttctttggctgttctagtattaagaacttagatcatatggagattctcaagatatatagtacactagaaacttgcggtcatttggttcaccttcccgatgtaaaaccaatcggcaagtttaagtcacgttctttaaagaaactaataaagttttctccagaccttccccagttgaagaaaaggagctactag

SEQ ID NO: 11954 - protein, 229 aa, Unknown
  Obtained from environmental sample
  misc_feature (1)..(229): Xaa is any amino acid
MENYVKPNINLLKAVLRARYKKKISTFKSKIDLEINKKNYIIKTANTPDELEQVLTLRHQVFLEELLQKKRFIEVDFDKFDLVCDHLMIINKTDDNLIGTYRLNCTKFSNCFYSATEFNIKSILELPGDKVELGRACVHPDYRNGMTIALLWKGLSDYMTASGSRFFFGCSSIKNLDHMEILKIYSTLETCGHLVHLPDVKPIGKFKSRSLKKLIKFSPDLPQLKKRSY

SEQ ID NO: 11955 - DNA, 939 bp, Unknown
  Obtained from environmental sample
  misc_feature (1)..(939): n is a, c, g, or t
gtgctggggctgcggagcactagcaaaaaatctgctagtatctcccttataagaagaagtggtattgcaaatgatatagttcttagaggtcaaaaaagagataacatcaaagtaactatagatgatggtatggtttgtggtgcttgtccgaatagaatggatcctccaacttcacatgttattacaactatggttgatagtgtagagataaaagagggtccatttgatgtaacagagtttggaactctaagtggcggagtaaaaatcaaaactgtacaaccgcaagagggtttacatggtgaaattggtactactattggaagttatggatacaaaaaaggtattataagtgtaagtggtggaaatgataaaatcaaagcactatttacatactcaaaagaggaaagtgatcagtatgaagatggtgatggaaatacaatggctgaacaaactgcattagctcaagatcctactaaatacaatactggaactgacaatagatatttagatgcttataaggatatgaaagcttacgaaaaaagatctattatggcaaaagctattgcaaatatctcagatacacaagacctagaaataagtgctacacaaaatagaagtgatgatatactttatccatctagtgggatggatgcactttatgatgatagtaatttatataatgtaaaatatactgctagagagttaggaagtttttcaaagaaacttgaagtgaaagcttatagaacagatgtggaccatccaatgtcaattgattatagaataaaaaataattttgttccagcagcgatgaaaggattaacaaaccatcttactacagatgttacaggtgcaaaaattattaatacttttgatgccataagtagagaatttacaataggtcttgatagcagtaagagaaattgggatggaaattattat

SEQ ID NO: 11956 - protein, 313 aa, Unknown
  Obtained from environmental sample
  misc_feature (1)..(313): Xaa is any amino acid
MLGLRSTSKKSASISLIRRSGIANDIVLRGQKRDNIKVTIDDGMVCGACPNRMDPPTSHVITTMVDSVEIKEGPFDVTEFGTLSGGVKIKTVQPQEGLHGEIGTTIGSYGYKKGIISVSGGNDKIKALFTYSKEESDQYEDGDGNTMAEQTALAQDPTKYNTGTDNRYLDAYKDMKAYEKRSIMAKAIANISDTQDLEISATQNRSDDILYPSSGMDALYDDSNLYNVKYTARELGSFSKKLEVKAYRTDVDHPMSIDYRIKNNFVPAAMKGLTNHLTTDVTGAKIINTFDAISREFTIGLDSSKRNWDGNYY

SEQ ID NO: 11957 - DNA, 378 bp, Unknown
  Obtained from environmental sample
  misc_feature (1)..(378): n is a, c, g, or t
atgaaaacaacaattgaacaatggatagacacaaacctaaatccaattggttctatggagttcgctgaagtctgcaaacaaaaactggatgagacgggttgcctgttgttgcccggttttttgaaaaaagaagccctccagcaaatgatttctgaggcggaagcgcaagcggaccaggtctattatgcgtcacaaacccataacgcttacctcaccgcgcccgaatctaaactgccagacgcccacatctttaatcgtcagcttgaatctactaaaagctgcttgacgacagaacaagttcgcaaaattcgggtcttcacccctatatacagccctttttcaaaaatttggggcccatgcctggggaaaaccccttaa

SEQ ID NO: 11958 - protein, 125 aa, Unknown
  Obtained from environmental sample
  misc_feature (1)..(125): Xaa is any amino acid
MKTTIEQWIDTNLNPIGSMEFAEVCKQKLDETGCLLLPGFLKKEALQQMISEAEAQADQVYYASQTHNAYLTAPESKLPDAHIFNRQLESTKSCLTTEQVRKIRVFTPIYSPFSKIWGPCLGKTP

SEQ ID NO: 11959 - DNA, 396 bp, Unknown
  Obtained from environmental sample
  misc_feature (1)..(396): n is a, c, g, or t
ttgtataaaaatagtgatattaaagaagatatacaagataaactagaagttataatacttcaaagattaaaaaatgaggggattactcctacagcgccttataatatctatgatgaactagatattgacagaagacttggagatactattttcaaggcactcacaaagaaaaaacttgtaacaagaatacagcataacttatttatagaagctcaaatacttactaatttaatcactgaaatgaaaaatattattaaacaagaggggtatatagatattaaaaactttaaacaaaaatatactatgagtagaaaatatatgattgcatacttagactacttagataaaatgaataacatagaaaataaagatgggaaaagatacctactttcataa

SEQ ID NO: 11960 - protein, 131 aa, Unknown
  Obtained from environmental sample
  misc_feature (1)..(131): Xaa is any amino acid
MYKNSDIKEDIQDKLEVIILQRLKNEGITPTAPYNIYDELDIDRRLGDTIFKALTKKKLVTRIQHNLFIEAQILTNLITEMKNIIKQEGYIDIKNFKQKYTMSRKYMIAYLDYLDKMNNIENKDGKRYLLS

SEQ ID NO: 11961 - DNA, 351 bp, Unknown
  Obtained from environmental sample
  misc_feature (1)..(351): n is a, c, g, or t
atgaaagaaaaattttataaatacttaaaagagttttgtgagtatttattggatttaaaaaactattctcaacttacagtcaaaacatataatacccctatagcagaagctataaaaatcagtgaaatatatgaagaaaatggcaaaataatttttgatataacaaaatttagaatccaaattgcctctttaaatccaaaaacaatcaataaaaaaatatcaagtatcaatagttttataaaatatttagaatcaaaaaatatagctataaagcttgttggaaataatactattaaatcaccacaaactcttccaaaaccaatacaaacaaaaaatattttgaaagtttag

SEQ ID NO: 11962 - protein, 116 aa, Unknown
  Obtained from environmental sample
  misc_feature (1)..(116): Xaa is any amino acid
MKEKFYKYLKEFCEYLLDLKNYSQLTVKTYNTPIAEAIKISEIYEENGKIIFDITKFRIQIASLNPKTINKKISSINSFIKYLESKNIAIKLVGNNTIKSPQTLPKPIQTKNILKV

SEQ ID NO: 11963 - DNA, 540 bp, Unknown
  Obtained from environmental sample
  misc_feature (1)..(540): n is a, c, g, or t
atgacnnnnnnctgggtgctggtacattggtctagatttggtggtgcagtgaatggagcggcaaaacatttctcttggggactggaaaatgatttagaagctcgtgattttattactcaaatgaaaaagaaaaatatccgcgttcaagggataggtcatagaattcatagcattgataatccagatttacgttgtgaaatcatgatggactttgcaaaggaaaatttccctgatcattcattattggattacgcacttaaagttcaagatgttactacaatgaagaagaatacacttatcctaaatgttgatggttgtattggtgtattatttgttgatatgctcaaaagcttgaaatatacagataaagagattaaggaaatgatagagatgggattctttaatgcattctttattattggaagaacaatgggatttatggggcattattttgatcaaaaaaggttgaaaacacctctttatagacacccttgggatgatattctttatgctgtaccagataagccagaaaaggtttaa

SEQ ID NO: 11964 - protein, 179 aa, Unknown
  Obtained from environmental sample
  misc_feature (1)..(179): Xaa is any amino acid
MTXXWVLVHWSRFGGAVNGAAKHFSWGLENDLEARDFITQMKKKNIRVQGIGHRIHSIDNPDLRCEIMMDFAKENFPDHSLLDYALKVQDVTTMKKNTLILNVDGCIGVLFVDMLKSLKYTDKEIKEMIEMGFFNAFFIIGRTMGFMGHYFDQKRLKTPLYRHPWDDILYAVPDKPEKV

SEQ ID NO: 11965 - DNA, 405 bp, Unknown
  Obtained from environmental sample
  misc_feature (1)..(405): n is a, c, g, or t
atgaaaaaaatattagttttaagtgttttattgacagtatgtttgatatcatttgctcacccgcatgtgtatatagaaactggtgtaactgtgtgtatggatggaaaaggaataaaaaaactgaaaatcaagtttacatttgataaaatgtttagtttcgacttaaaagatggttttgatacaaatggagatggaaaatttgatcaaacagagattacaaatctcgaagaaaacgcattttgcaatcttgagaaatatgattatttcatacacatgaaactcgggagtgaggcgatagacacaaaaaatgtatcaaatttttatgcagaaattgatggagatgaagtgttttatacatttgacatttatcttgggtttgcctataaaaaactgaaaaaaaaataa

SEQ ID NO: 11966 - protein, 134 aa, Unknown
  Obtained from environmental sample
  SIGNAL (1)...(19)
  DOMAIN (3)...(134): Protein of unknown function (DUF1007)
  misc_feature (1)..(134): Xaa is any amino acid
MKKILVLSVLLTVCLISFAHPHVYIETGVTVCMDGKGIKKLKIKFTFDKMFSFDLKDGFDTNGDGKFDQTEITNLEENAFCNLEKYDYFIHMKLGSEAIDTKNVSNFYAEIDGDEVFYTFDIYLGFAYKKLKKK

SEQ ID NO: 11967 - DNA, 582 bp, Unknown
  Obtained from environmental sample
  misc_feature (1)..(582): n is a, c, g, or t
atggtcaacaataaaacttgttttataagtcttgtagcacttgttgcacttacttttttaacagtagatgcacccaaaaagatagaaaaagttgctataaatcttgaaaatttaccagatacagtggagttaataggttttgaagagcaaaaattcaatacaaatagtataataaaaccagaatctataatatttgtaggaaatcatgaatcaattatgttagcaaaaacacttgatgagatgttggatttggatgcaggggattttattattgtatcaagtgtttcagatgaaccttggtttataaaaagatggcaagcgcacactcaaaatacaaaacttaaaggggataaacagttagcgtggatttatgatagagatggaagtataagaaattttttgcaagtaccaacatctgatgcattaaaatattttgtttataatgtaaaaaaagatgggataatagaaaatatctatattggtaaaataaaagttggagcaagtaatggtactatgagtgaaaaagagataaaagaaaacctacaagaggttgtcaaaagagtaaaagaattagaatattaa

SEQ ID NO: 11968 - protein, 193 aa, Unknown
  Obtained from environmental sample
  misc_feature (1)..(193): Xaa is any amino acid
MVNNKTCFISLVALVALTFLTVDAPKKIEKVAINLENLPDTVELIGFEEQKFNTNSIIKPESIIFVGNHESIMLAKTLDEMLDLDAGDFIIVSSVSDEPWFIKRWQAHTQNTKLKGDKQLAWIYDRDGSIRNFLQVPTSDALKYFVYNVKKDGIIENIYIGKIKVGASNGTMSEKEIKENLQEVVKRVKELEY

SEQ ID NO: 11969 - DNA, 765 bp, Unknown
  Obtained from environmental sample
  misc_feature (1)..(765): n is a, c, g, or t
atgatgtttgggttttgtaaaccaagggcttatagctggaaatacatcatacagttgcctagttcaaagtggatggtgcaaactcatttggtccttatttggaaaccaccgtttataaaagagtttaaaagtggagatgcctgtcatctaaatggatgttgtacagatgaaaatcaagatattcgttatgtgagtgcttttggtcaaacgacagaacctggcggatggcgaatgaacaaacttagtggtggatttctatatgatataaaagaggagagatatctttgtgaaaatcttgctatgccacactccccaagactttataaaaatgagctttatgtacttttatcagctacagaagagctggtaaaagtagatagagttacaggagagttagaaagcatagtaaaagtagacggtttcataagaggtctcagtttctttgaaaactacgcttttataggtgtaagtaaactcagaaaatcacacactttcggtgacttaccaatagctagaaaaaaactctatgctggtgtagtagttgtaaatttagatacaaaagagagagtagcagagatattttatgaagataaactagaggagatatatgatgtacactttattccaaatgcttcaaggatcaacataatgaatcatcaaatgatacagacaaatccagccatcataacaccaaacttttcacactggatagtaaaaaatgaaaatgacacaaaagagaaatcacatgaaggagaacagatatga

SEQ ID NO: 11970 - protein, 254 aa, Unknown
  Obtained from environmental sample
  misc_feature (1)..(254): Xaa is any amino acid
MMFGFCKPRAYSWKYIIQLPSSKWMVQTHLVLIWKPPFIKEFKSGDACHLNGCCTDENQDIRYVSAFGQTTEPGGWRMNKLSGGFLYDIKEERYLCENLAMPHSPRLYKNELYVLLSATEELVKVDRVTGELESIVKVDGFIRGLSFFENYAFIGVSKLRKSHTFGDLPIARKKLYAGVVVVNLDTKERVAEIFYEDKLEEIYDVHFIPNASRINIMNHQMIQTNPAIITPNFSHWIVKNENDTKEKSHEGEQI

SEQ ID NO: 11971 - DNA, 645 bp, Unknown
  Obtained from environmental sample
  misc_feature (1)..(645): n is a, c, g, or t
gtggaagtttcaagtgtaacatttcattatgtattaaaagcattagagatgaaaacaaatatttcagttgatgaaatggcaaaatatgtagatcttgatatagaagatttagaacaaaatgaaagtgtaaaaagttataaattatctgcaatatttagatactgtatggaaaaaaccaataatccaaatttagcttttgatattgggcagtcaataccgtatcaatcattggggattttgggttatttacttatgaatgcaaaagatttaaaagagatgattgaaaagtttagtatttatcaaaaacttgtaagtagacacttaaaatttaatttttttgaagataaagagtattacaaatttgcaatttatatcaatgaaaatagatttattcctgttcctagttttcatgcagaggtacatttaagtgcaatattgaatatccttacacagatattagggaaaaaagttattccagaatatgtttatttttcttattctaagcaaaatgagttgatgaagtatgaagaaatctttggtaaaaaactttattttgaaaaagatgaaaatgcaattttctttaaaaaaacagaattaaatattcctgttaataatgctaatcccgggatgctcacatatttttga

SEQ ID NO: 11972 - protein, 214 aa, Unknown
  Obtained from environmental sample
  misc_feature (1)..(214): Xaa is any amino acid
MEVSSVTFHYVLKALEMKTNISVDEMAKYVDLDIEDLEQNESVKSYKLSAIFRYCMEKTNNPNLAFDIGQSIPYQSLGILGYLLMNAKDLKEMIEKFSIYQKLVSRHLKFNFFEDKEYYKFAIYINENRFIPVPSFHAEVHLSAILNILTQILGKKVIPEYVYFSYSKQNELMKYEEIFGKKLYFEKDENAIFFKKTELNIPVNNANPGMLTYF

SEQ ID NO: 11973 - DNA, 753 bp, Unknown
  Obtained from environmental sample
  misc_feature (1)..(753): n is a, c, g, or t
atgagtttgttctggctctttgatgttaaaaatggcaatcccaatggagatccagatggcggcaacatgccacgtattgatcctgaaactgggcatggaattacaacagatgtatgcttgaaacgtaaagttagaaactatattgatttagtgaaagagaatgtttctccttatgaaattcatgtgcgcgagggagcatatctttcagaacaccataaacgtgctcataaaagtttagattctgaaaaattatttatccatgttcctttggatttgcaaaaagaattaagtggttaccaggaatttcctgatggaatagggtttgaaaatgaaggcatttatcttcaacttgatgttgatttaaaaaagacagaaaaagctgttggtaaactaaaaaatatttcagatgcatcgaaagcaaagcttaaagaattatttgtagacacaaaagacgtgattgcaaaaaaatggatgtgtaaaaatttttttgatgtacgtacatttggagcggtgatgtcaacaggtgacaaaacttgtggtcaagttcgtggtccagttcaatttgcttttgcaagaagtatagaccccattatcggattggatattgccatgttcagaactgcggctgttaatgttgatgcgcctaaggataaaggacttggagccaggaaagctattgttccctatggattgtacagagtccatggctttatatcggcacctctggccaatcaanccggttttcgaagttga

SEQ ID NO: 11974 - protein, 250 aa, Unknown
  Obtained from environmental sample
  DOMAIN (1)...(249): Family of unknown function (DUF694)
  misc_feature (1)..(250): Xaa is any amino acid
MSLFWLFDVKNGNPNGDPDGGNMPRIDPETGHGITTDVCLKRKVRNYIDLVKENVSPYEIHVREGAYLSEHHKRAHKSLDSEKLFIHVPLDLQKELSGYQEFPDGIGFENEGIYLQLDVDLKKTEKAVGKLKNISDASKAKLKELFVDTKDVIAKKWMCKNFFDVRTFGAVMSTGDKTCGQVRGPVQFAFARSIDPIIGLDIAMFRTAAVNVDAPKDKGLGARKAIVPYGLYRVHGFISAPLANQXGFRS

SEQ ID NO: 11975 - DNA, 354 bp, Unknown
  Obtained from environmental sample
  misc_feature (1)..(354): n is a, c, g, or t
atgatagataaaaaaatagaacttacaatgaaaccacaaacttcaaaggtagatgaactctacaataaaagggaactactccttaatactatccaaactcaaacaaaatctttacaagagagaaatgagcttatagaaaatcttaaaaataaagttgtaatgtttaaaaaagaagacggtaaaaatatcttagatgagattgattacttcatcatcgaacaatttggtttctataatttttttgatgaaaacaaaaactatatgataaaagaggagatagaaagatatcttaaatcatatatgacaaatcaaatattgatacaaaaaaaacagaacgagctcttaacttcttag

SEQ ID NO: 11976 - protein, 117 aa, Unknown
  Obtained from environmental sample
  misc_feature (1)..(117): Xaa is any amino acid
MIDKKIELTMKPQTSKVDELYNKRELLLNTIQTQTKSLQERNELIENLKNKVVMFKKEDGKNILDEIDYFIIEQFGFYNFFDENKNYMIKEEIERYLKSYMTNQILIQKKQNELLTS

SEQ ID NO: 11977 - DNA, 384 bp, Unknown
  Obtained from environmental sample
  misc_feature (1)..(384): n is a, c, g, or t
atggtgaggtacctgctattgtacaaaataatgaatagtatgaaaaaaccaataatttttgctacactttttctagtaggattattgtttttagcatataataagtacgataccaaagagaagataactaattatttttatattagtgaaaaacttagcaaaatttatacacttaataataatcttgacctatttaaaagcaatattttagattataacaattatgaccatattgaggaaggtattaaacaaataagggaaaacttttcttttattggtttaaataactcaataaaaaatactatctttcaaaaagaacttcataaattacaaaaagattttgaaaataaaatttttattattcaaaaaaataaaatcttataa

SEQ ID NO: 11978 - protein, 127 aa, Unknown
  Obtained from environmental sample
  misc_feature (1)..(127): Xaa is any amino acid
MVRYLLLYKIMNSMKKPIIFATLFLVGLLFLAYNKYDTKEKITNYFYISEKLSKIYTLNNNLDLFKSNILDYNNYDHIEEGIKQIRENFSFIGLNNSIKNTIFQKELHKLQKDFENKIFIIQKNKIL

SEQ ID NO: 11979 - DNA, 726 bp, Unknown
  Obtained from environmental sample
  misc_feature (1)..(726): n is a, c, g, or t
gtgggggaatacacggctcttttttgttccggcatgttgggatttgaagatgccatgcgtcttatcatcaagcgatcggacctcatgtacgaatctaccttaaaaaaccccggtaaaattatggtggtctttaaaaatgaaagggaaaccgccggcctgatccgggaatcttttgtgtccggcatctatattaccaacaagaacagtgagaaacagacggccgtgtccggaaaggccgaggccattgaaaaattttgccggtatttgacgagacaggcagtggtctttaaaaaactcaatcttaccggtgcctttcacacccccatgctcaaggaagcctcggataaattgagaacctatctttcctctctgcagttgaacgatacaaggtatggaaagattatttccaacaccctggcccagccctacccggaacagccggaagaagtcaaagatttgttggcacgtcagatcgtttctccggttgagtttattgcctccattgaaaatgtctatgtctcgggtaaaacccatttcattgaaatcgggccctcaaggcttcttgtcaatttgctgaaaaatatcaatgtgggggagtatggcaccgccgtgtccgtggatgcaagggttggcgaggtcgtctcctttaagcctgccgccaatacctgttgtcctgcaacgctatatttgagcccaagaccattgtgcatccggagcccgaaatga

SEQ ID NO: 11980 - protein, 241 aa, Unknown
  Obtained from environmental sample
  misc_feature (1)..(241): Xaa is any amino acid
MGEYTALFCSGMLGFEDAMRLIIKRSDLMYESTLKNPGKIMVVFKNERETAGLIRESFVSGIYITNKNSEKQTAVSGKAEAIEKFCRYLTRQAVVFKKLNLTGAFHTPMLKEASDKLRTYLSSLQLNDTRYGKIISNTLAQPYPEQPEEVKDLLARQIVSPVEFIASIENVYVSGKTHFIEIGPSRLLVNLLKNINVGEYGTAVSVDARVGEVVSFKPAANTCCPATLYLSPRPLCIRSPK

SEQ ID NO: 11981 - DNA, 678 bp, Unknown; identical to SEQ ID NO: 10351
  Obtained from environmental sample
  misc_feature (1)..(678): n is a, c, g, or t

SEQ ID NO: 11982 - protein, 225 aa, Unknown; identical to SEQ ID NO: 10352
  Obtained from environmental sample
  misc_feature (1)..(225): Xaa is any amino acid

SEQ ID NO: 11983 - DNA, 483 bp, Unknown
  Obtained from environmental sample
  misc_feature (1)..(483): n is a, c, g, or t
atgtcttttttggatatggatgaaagattagtagagttgtctcaatatatggatgtagtgtatagcccttatgtggatgcaaaagagataccaagtgatattgatctatttattgttgaaggagctttaagtacagaccatgatattaaaatcataaaagagattagaaaaaactctaaattgattttagctttgggtgattgtgcagttactggaaatatatcggctatgaaaaatctttttggaacagaagctgttttagaaaaaggatattttgatttagcagatataaataaaggtaagtatccaagtgaagttgtaccaacacttttagataaagtaataccattaaatgaagctattgatgttgattattttgtccctggttgtccaactccagcagatgcgatttatgaagttataaaagcgattattgaaaacaaagagataaaaattagtgattatacaaggtttggcaagtaa

SEQ ID NO: 11984 - protein, 160 aa, Unknown
  Obtained from environmental sample
  DOMAIN (17)...(145): NADH ubiquinone oxidoreductase, 20 Kd subunit
  misc_feature (1)..(160): Xaa is any amino acid
MSFLDMDERLVELSQYMDVVYSPYVDAKEIPSDIDLFIVEGALSTDHDIKIIKEIRKNSKLILALGDCAVTGNISAMKNLFGTEAVLEKGYFDLADINKGKYPSEVVPTLLDKVIPLNEAIDVDYFVPGCPTPADAIYEVIKAIIENKEIKISDYTRFGK

SEQ ID NO: 11985 - DNA, 741 bp, Unknown
  Obtained from environmental sample
  misc_feature (1)..(741): n is a, c, g, or t
gtgagggaaaaaataacaaatgtagctggccaaatagcgggggcaaaaaatataaaaagtgatatctcaaatactttagaacaattaagaagtttcaatgttgctaaaacaccacagcaacaacagcttgtattacaaaatatatttaataacacacaagctatccagacaaaagtagatacacttccacaagcattatttgagaataatttaagtaaaacaacgaattttatgaatgatttgaaaataactgcttcaattatagaggagtatacaaaaaactcaaatgaaccaatttcaaaagagttaaaaactataattgataaaattaatacccaaatagacttttatcaactgttgtcttattcaacaaattcaacccatacttatctttcatttttacaagacgagatagaggactcagatataaggtttaataaaaataatgacaagagtttttcgtgtcaaatcaatttaagtttgaaaaaatatggggatttaaaaattttaatgatacttgataataaaagtaatattaatattaatataggactagaacaagaggagtttaaatccttggtacaagaaaatttacaaaaactaagagtaggaattaatagtattgatttattattacaaagcttaaatatatttagccttaatagtagtgaacagaaatctattagaaatagttatggaagttctactgacttaagttttggtttggatataaaggcttaa

SEQ ID NO: 11986 - protein, 246 aa, Unknown
  Obtained from environmental sample
  misc_feature (1)..(246): Xaa is any amino acid
MREKITNVAGQIAGAKNIKSDISNTLEQLRSFNVAKTPQQQQLVLQNIFNNTQAIQTKVDTLPQALFENNLSKTTNFMNDLKITASIIEEYTKNSNEPISKELKTIIDKINTQIDFYQLLSYSTNSTHTYLSFLQDEIEDSDIRFNKNNDKSFSCQINLSLKKYGDLKILMILDNKSNININIGLEQEEFKSLVQENLQKLRVGINSIDLLLQSLNIFSLNSSEQKSIRNSYGSSTDLSFGLDIKA

SEQ ID NO: 11987 - DNA, 549 bp, Unknown
  Obtained from environmental sample
  misc_feature (1)..(549): n is a, c, g, or t
ttgggaaaagtgttatctgggattcaaaaagccagtgaagttggactaaaagtaaaagtaaactgtgttcctatgaaagatatcaatgatggtgaacttatagatatattagaattttgtaaagaaaaagggtatgaggtacgatttatagaatttatggaaaactctcatgcttcagtaaaaaaaggtctcaattctgcccagatacaagagataatcaaatcaaaatacaactttactaaaaatgagagagaggggaatagcccatctcaaagttatgagctagaagatggttataaatttggaatcatagagccacatcttgatgatttttgtagtgattgtaatcgtttacgaataacagctgaggggtatttaatcccttgtttatattttgaagatgcattaagtattgcagatgctataaaagcaaaagatatagatggtgcaaaagagatattacgaaaagtattgaaagataaaccagaaaaaaacaaatggggaagtgaagatcaatctgatcgagcattttacgaaactggtggttga

SEQ ID NO: 11988 - protein, 182 aa, Unknown
  Obtained from environmental sample
  DOMAIN (45)...(167): Molybdenum Cofactor Synthesis C
  misc_feature (1)..(182): Xaa is any amino acid
MGKVLSGIQKASEVGLKVKVNCVPMKDINDGELIDILEFCKEKGYEVRFIEFMENSHASVKKGLNSAQIQEIIKSKYNFTKNEREGNSPSQSYELEDGYKFGIIEPHLDDFCSDCNRLRITAEGYLIPCLYFEDALSIADAIKAKDIDGAKEILRKVLKDKPEKNKWGSEDQSDRAFYETGG

SEQ ID NO: 11989 - DNA, 705 bp, Unknown
  Obtained from environmental sample
  misc_feature (1)..(705): n is a, c, g, or t
atgattacagaaagaacgaaagcaatattattattgacatcatacttcacaaagagttcagatagagatttgaagccattatcaacagcagaatggaataggcttgtgcgttggttgcaaacaaaatcgattaaccccgaagattttttaactcaggacattgactctttactacatgactggcaggacaagactactactattgagagagttagcgcattacttgagcggaaatatggattagcaatagctcttgacaaatggattaaagtaggtatttggataattaatagaggagatgtagcttatccgaaaaaacttaaagaaagattaaaagagaatactcctccaatattatttggtatcggtaatatagaattattaaatcaaaattacatcggtattgtaggtgcaaggaaaactagtgaaaaggaacttgaagacacaaaatatattgggaaaaatataagcaaaaataattatggcgttgtttctggtggagcaaaaggtgttgatgaatcaggaatgcttggtgcattagaggctggtggttatagtttaggttatgtagctgattcactaattagaaaatctacatctagtatttttagaaagcatattatcaataaacaactttgtttagtatcacctttcaatccgaagctggatttaatggttgggatgccatgtctaaaaaataattaa

SEQ ID NO: 11990 - protein, 234 aa, Unknown
  Obtained from environmental sample
  DOMAIN (88)...(234): SMF family
  misc_feature (1)..(234): Xaa is any amino acid
MITERTKAILLLTSYFTKSSDRDLKPLSTAEWNRLVRWLQTKSINPEDFLTQDIDSLLHDWQDKTTTIERVSALLERKYGLAIALDKWIKVGIWIINRGDVAYPKKLKERLKENTPPILFGIGNIELLNQNYIGIVGARKTSEKELEDTKYIGKNISKNNYGVVSGGAKGVDESGMLGALEAGGYSLGYVADSLIRKSTSSIFRKHIINKQLCLVSPFNPKLDLMVGMPCLKNN

SEQ ID NO: 11991 - DNA, 495 bp, Unknown
  Obtained from environmental sample
  misc_feature (1)..(495): n is a, c, g, or t
atggtccctatgaagggtgttaatgagagtgaaattttagatattttagagtattcaaaagagcgtggcatgactatacgctttattgagtatatggaaaatgtgcatgcggaagtaaatattaaaggtatgaaaagtgatgaactcttagctattatcggctctaaatatagctataaagatgaaggatttgacggtcattcaccatcgcattactactcacttgaagatggatataaatttggtattatcgaaccatataaagatgatttttgtaaaacttgcaatcgtataagagtctctgctgagggcgacatcataccttgtttgtattttgatgaggcacttagtattaaagagggtgtgaaaaatagagatgtgaaacagattaacgctgttttaaaagaggtagtaagaactaaacctgaaaaaaatagatggagcagtgaagatggagagatctctacacgcgctttttacgagacaggtggctga

SEQ ID NO: 11992 - protein, 164 aa, Unknown
  Obtained from environmental sample
  DOMAIN (24)...(147): Molybdenum Cofactor Synthesis C
  misc_feature (1)..(164): Xaa is any amino acid
MVPMKGVNESEILDILEYSKERGMTIRFIEYMENVHAEVNIKGMKSDELLAIIGSKYSYKDEGFDGHSPSHYYSLEDGYKFGIIEPYKDDFCKTCNRIRVSAEGDIIPCLYFDEALSIKEGVKNRDVKQINAVLKEVVRTKPEKNRWSSEDGEISTRAFYETGG

SEQ ID NO: 11993 - DNA, 627 bp, Unknown
  Obtained from environmental sample
  misc_feature (1)..(627): n is a, c, g, or t
atgctcggagtttatctgttgatgggacgtcacttacaacgctcatatgagataggtaaagagcaatcagttctaatgatgccaattttagaaggacttgatggtattcaaaagatgagtaaatctttgaataactatataggtgtagcagatgagccaaatgatatgtttggtaaagtgcttagcatctcagatgatcttatgtggcgatactatgagttacttagttcaaaatcattaaaagagatagaagagcttaaaaatggtgttgaaaatgagatttatcatcctaaaaaaattaaagagcagttggctgaagagataatagagcgttttcatggagcacaagctgcagttagtgcaaaaagcgagtttgaaaaagttttttcaagaagtcaacttccagataccatggatgtgtttgaatttagctctcctatctggatagcaaaagctttagttgatgcttcattatcctcatcaacatcacaagcacgtcgagacataaaacagggcgctgttaaaattgatcaactaaaaattgatgatgaacaactacaacttgaaaatggagagtatgttcttcaagtaggtaaacgcgaatttgcaagagtaaaagttaattaa

SEQ ID NO: 11994 - protein, 208 aa, Unknown
  Obtained from environmental sample
  DOMAIN (147)...(194): S4 domain
  misc_feature (1)..(208): Xaa is any amino acid
MLGVYLLMGRHLQRSYEIGKEQSVLMMPILEGLDGIQKMSKSLNNYIGVADEPNDMFGKVLSISDDLMWRYYELLSSKSLKEIEELKNGVENEIYHPKKIKEQLAEEIIERFHGAQAAVSAKSEFEKVFSRSQLPDTMDVFEFSSPIWIAKALVDASLSSSTSQARRDIKQGAVKIDQLKIDDEQLQLENGEYVLQVGKREFARVKVN

SEQ ID NO: 11995 - DNA, 441 bp, Unknown
  Obtained from environmental sample
  misc_feature (1)..(441): n is a, c, g, or t
ttggataataaaatgcaaaaaatagaagctttacaagtaaataaatacttaacacaaatggagatagaatctcaccttcttggtgtagaatacattattatggcagcaccttctgtaagagaaaatccaaaatatcccatacattttacaatctttttaaatacaaaagatatattaacccaagatattaaagatgcaatattagataaattttgtgagcagtataagataacatctattgtagatctattaagtgaattaagtgctgttgcatttgcgttaacatcaaatgagacaccaatgccacttcacctttttaaagaagatgatagaaaggtactgcaacacacatacatgcatgttatcgactttgagggcaactcttcagagtttaaagagccaaaagacggcttaactggctggagttatagttataactga

SEQ ID NO: 11996 - protein, 146 aa, Unknown
  Obtained from environmental sample
  misc_feature (1)..(146): Xaa is any amino acid
MDNKMQKIEALQVNKYLTQMEIESHLLGVEYIIMAAPSVRENPKYPIHFTIFLNTKDILTQDIKDAILDKFCEQYKITSIVDLLSELSAVAFALTSNETPMPLHLFKEDDRKVLQHTYMHVIDFEGNSSEFKEPKDGLTGWSYSYN

SEQ ID NO: 11997 - DNA, 537 bp, Unknown; identical to SEQ ID NO: 6933
  Obtained from environmental sample
  misc_feature (1)..(537): n is a, c, g, or t

SEQ ID NO: 11998 - protein, 178 aa, Unknown; identical to SEQ ID NO: 6934
  Obtained from environmental sample
  misc_feature (1)..(178): Xaa is any amino acid

SEQ ID NO: 11999 - DNA, 564 bp, Unknown
  Obtained from environmental sample
  misc_feature (1)..(564): n is a, c, g, or t
ttgcaaaaatataatatagctaaagatctacttttcataatagatggttttgagaaaataggaacttttgaatatagaaaaaaaatattgatagatgattcaaataagtttgtagagataaaaataaatatgattattgctctgcctattgatctgtttagttatgttaataattctagtaatttttctactccaatatcttttcctttgattgcattagataacaaaggaatagaaagatttaaagattttatatacagacgaatagatgaaaaattatttgatagtaaaaatactgttgaaaaaattattatatttggtgcaggatcaccaagagagactatgaaaattatcgcagaagcttatattatcgctgatgatgagatcataactttacaaagtgtcatagatgcaaaagataaaatgtccaatgacatagtaaattacctcccagaagatgatttaagagtattaaaagagcttagaagagaaaaagagtatctccttttagtgatacgcttgcctcactattgggtaaaaaaagtggtattacagtacgggtga

SEQ ID NO: 12000 - protein, 187 aa, Unknown
  Obtained from environmental sample
  misc_feature (1)..(187): Xaa is any amino acid
MQKYNIAKDLLFIIDGFEKIGTFEYRKKILIDDSNKFVEIKINMIIALPIDLFSYVNNSSNFSTPISFPLIALDNKGIERFKDFIYRRIDEKLFDSKNTVEKIIIFGAGSPRETMKIIAEAYIIADDEIITLQSVIDAKDKMSNDIVNYLPEDDLRVLKELRREKEYLLLVIRLPHYWVKKVVLQYG

SEQ ID NO: 12001 - DNA, 801 bp, Unknown
  Obtained from environmental sample
  misc_feature (1)..(801): n is a, c, g, or t
atggaaggccgtctgtatatgtggagtgtctctacggggaaaaaggtggacacgctatcgcatcattatgatgctgtctcggctatcagcagcaatgataacggtcattggatagcaacggcagggtatgacaaggtcatcaaggtctttaaccgttcctttcgtaaaaaccattataaacttatctcacatcagtctcctgtgacaacagtgaactttctttcaggccaaaggctcttatcaacagataaagacggcacaatactgatctgggatgtcgtgaagtccaatgtaattgcacgcttgccaaggttcggtgcgcatatcaccgctgtctgttttgacaaggatgaacagtttctttttgttgctgccctggggggaatggtaggattgtacaatatacaagaaaacagactgctcaagatcgactttctcaagcagctagccggcattacacagatgcagtattgtgatgagaaaaggttgcttatctttggtctgagcaacggacatatccctatttatgaactggacaaagaagaagagtcttttatccaacggatgaaagagaaagatttcaatgcctgttatatgatggccgaagacaatccgctgttggaatacagcgaaatgtacgccaaattggaagatctgtttgacaaagcctatgaaaatgcaaaaaacttgcttcgggcacaaaaaaatcaagaagcaagggatatactcnaacatttcaccagctcatcggcaaaacgtttgcatattcaaaaacttttcaaagacctctcccctgtttaa

SEQ ID NO: 12002 - protein, 266 aa, Unknown
  Obtained from environmental sample
  DOMAIN (56)...(92): WD domain, G-beta repeat
  misc_feature (1)..(266): Xaa is any amino acid
MEGRLYMWSVSTGKKVDTLSHHYDAVSAISSNDNGHWIATAGYDKVIKVFNRSFRKNHYKLISHQSPVTTVNFLSGQRLLSTDKDGTILIWDVVKSNVIARLPRFGAHITAVCFDKDEQFLFVAALGGMVGLYNIQENRLLKIDFLKQLAGITQMQYCDEKRLLIFGLSNGHIPIYELDKEEESFIQRMKEKDFNACYMMAEDNPLLEYSEMYAKLEDLFDKAYENAKNLLRAQKNQEARDILXHFTSSSAKRLHIQKLFKDLSPV

SEQ ID NO: 12003 - DNA, 531 bp, Unknown
  Obtained from environmental sample
  misc_feature (1)..(531): n is a, c, g, or t
atgtttaatacatatcatttgtttttcaagcataaaaagaatgaaaatgctaaaataaattggagtaaaatttttaatcctatcttaatagctactctaactgctgttattataaagcttacaaacacatatcaatatgtaccaaatgtatttttaacaattacaaaaatccttgggaatattgctttaccattaatattaattgttatcggtggaaatgtttatgtagattttaaaaataaaggtaaaattcaaattaaaccgatattgttatttattgcaataaaaaacttcatatttccacttactattcttggtttaataatattaattaagccaattttttctgtagcttttctttgtattcttctaagtgcagtgccaccaattactgctattcctattcttacaaataaagcaggaggagatagtgcaattgcaaatcagtttttaattgcaagttttatagtttcgataatatcaatacctttaataatgttattgttcgaaaacttttacaaaatcatttaa

SEQ ID NO: 12004 - protein, 176 aa, Unknown
  Obtained from environmental sample
  misc_feature (1)..(176): Xaa is any amino acid
MFNTYHLFFKHKKNENAKINWSKIFNPILIATLTAVIIKLTNTYQYVPNVFLTITKILGNIALPLILIVIGGNVYVDFKNKGKIQIKPILLFIAIKNFIFPLTILGLIILIKPIFSVAFLCILLSAVPPITAIPILTNKAGGDSAIANQFLIASFIVSIISIPLIMLLFENFYKII

SEQ ID NO: 12005 - DNA, 774 bp, Unknown
  Obtained from environmental sample
  misc_feature (1)..(774): n is a, c, g, or t
atggacaataaacagattgaaatatttaaaagtgatgatggtgtaactgaagttgaggttcgagtggacaatgacacagtttggcttaatcaatatcagatttcagatttgtttctaactgatagaacttctattggtcgtcatatctcgaacatatacaagagtaaagaactgaacgaaaaatcaactagtgcaaaaattacactagttcgggaagaaggaaaaagaacggtaaatcgacaagtagggatatataatttagatgtaattctttcaattggttatagagttaattcagatcgaggcagacagttccgcatttggacaaacaaaattctaagcgattatttattaaaaggctatgccttgaatgatcggaaattaaaggaacaaaacgaacaacttaatgaattaaagaaatccgtaaaaatattaggagaagtattaaactataagactttatcaaacgacgaaagtacgggattgcttaaaataatttctgattatgcatatgcattagacgttttagaccagtatgattatcaaaaacttgaaattacaaatacatctgggaaagaaacctatcagttaacctatgaggaagcaatgagccagattagaaatgcaaaaaaggctcatggaaatagtaatttgtttggacgtgagaaagatgattcatttagaaattccatatctaacatttatcaaacatttaaagggcaggacttaaatcctaacatccaaaaagaagccggaaatttatggaatttataa

SEQ ID NO: 12006 - protein, 257 aa, Unknown
  Obtained from environmental sample
  misc_feature (1)..(257): Xaa is any amino acid
MDNKQIEIFKSDDGVTEVEVRVDNDTVWLNQYQISDLFLTDRTSIGRHISNIYKSKELNEKSTSAKITLVREEGKRTVNRQVGIYNLDVILSIGYRVNSDRGRQFRIWTNKILSDYLLKGYALNDRKLKEQNEQLNELKKSVKILGEVLNYKTLSNDESTGLLKIISDYAYALDVLDQYDYQKLEITNTSGKETYQLTYEEAMSQIRNAKKAHGNSNLFGREKDDSFRNSISNIYQTFKGQDLNPNIQKEAGNLWNL

SEQ ID NO: 12007 - DNA, 690 bp, Unknown
  Obtained from environmental sample
  misc_feature (1)..(690): n is a, c, g, or t
ttgagcttatacaaaaaacttgtaggaaaagatcttaaaggaaatatttgtagaccaaatgtaaatgaaagttttttaccccctagcttagaagaagcaataaaagttggtgtaagaagaagctataaggttcaagaacaaatagaaaaaacaaaagaacaaaaagagaaaatcattcaagaaaaagcaggttttaaacccacaattaaagtacaactacaaaccttacttgacaatgatatagaattagcagaaaatggtagagaagatatatatagcgctagactttatctaagttggaatctttttgaaggtggtaaaacttactacatgacacaaaaagagaagctatttttacaagaagagcaaaaaaaacttgatgctgtaacaaatgaagttatcgatgagataaaagaatcctacaacactttttacaatcttcaaaaacgaatcgagaatatgacactctatgtggaagataattttaatattgtaaaagtttataaaaaacaactagcagatggtacgagaacttttattgatattcttaatgcagaagctgaactttatagatcanatattgataaaattcaacaagactttgattatatctctgcttattataacttgttattcaatatgtcaatattaagtgatgtaatccttatgcgagaagaaaaaaccctgtga

SEQ ID NO: 12008 - protein, 229 aa, Unknown
  Obtained from environmental sample
  DOMAIN (30)...(215): Outer membrane efflux protein
  misc_feature (1)..(229): Xaa is any amino acid
MSLYKKLVGKDLKGNICRPNVNESFLPPSLEEAIKVGVRRSYKVQEQIEKTKEQKEKIIQEKAGFKPTIKVQLQTLLDNDIELAENGREDIYSARLYLSWNLFEGGKTYYMTQKEKLFLQEEQKKLDAVTNEVIDEIKESYNTFYNLQKRIENMTLYVEDNFNIVKVYKKQLADGTRTFIDILNAEAELYRSXIDKIQQDFDYISAYYNLLFNMSILSDVILMREEKTL

SEQ ID NO: 12009 - DNA, 369 bp, Unknown
  Obtained from environmental sample
  misc_feature (1)..(369): n is a, c, g, or t
ttgccaggtggtatggaaattgaaatactaaagggatataagtttggtatatattttgaaaatactttttttgatgattatataacagaaaaaatatttaatgcgctggaaatgaatacaataccaatctattgtggagcacctaatctggatgattatataaattcaaggtgtgtgataaattatgatgattatggtcaatcctatcagaaaatgattgataaaattatagaattggataataacaaagaaatgtataattcagtctttaatttgcaattattcgatacaaaagaaaagaaagagcgaatagaaaatattgataacacattgatcaacttttataataaaatattggaaatagaatga

SEQ ID NO: 12010 - protein, 122 aa, Unknown
  Obtained from environmental sample
  misc_feature (1)..(122): Xaa is any amino acid
MPGGMEIEILKGYKFGIYFENTFFDDYITEKIFNALEMNTIPIYCGAPNLDDYINSRCVINYDDYGQSYQKMIDKIIELDNNKEMYNSVFNLQLFDTKEKKERIENIDNTLINFYNKILEIE

SEQ ID NO: 12011 - DNA, 603 bp, Unknown
  Obtained from environmental sample
  misc_feature (1)..(603): n is a, c, g, or t
atgaaaacttttctagatactaaaggtaaatcttttacttttagttcttgtgagggctgtcctgctcgatgttgtgatggaagagaagggagtgtcttttctcagcttttactagaagattttgaacctgtttcaaaaaatttccctatacttttcacttttggtgatttagggtatcttaaagcaaatgttttactttcaaatggaaaagatttttgtccttatattgtaaatcatcaatgtatcatttatgatgaacgaccaaatgtatgtagaaattatcccttaagtggaaatcttgataatcaaatctatattgatgatagttgtccagcaattcatagtgaagttggtcaagatattgtagtagatgggatagtgcaaaaaacatttgataatgagacactccatgactatcaaaataaatttttagatacacatcattatctagaacaattcaatcataaagaaaattttgataaagtaataacaattaataatatagagttttacatgtatacaaaggcttcaagtgataactatatgaacctacatataaagtcacttgataaacttaataaagtaataaaggaaaaatcatga

SEQ ID NO: 12012 - protein, 200 aa, Unknown
  Obtained from environmental sample
  DOMAIN (15)...(115): Uncharacterised protein family (UPF0153)
  misc_feature (1)..(200): Xaa is any amino acid
MKTFLDTKGKSFTFSSCEGCPARCCDGREGSVFSQLLLEDFEPVSKNFPILFTFGDLGYLKANVLLSNGKDFCPYIVNHQCIIYDERPNVCRNYPLSGNLDNQIYIDDSCPAIHSEVGQDIVVDGIVQKTFDNETLHDYQNKFLDTHHYLEQFNHKENFDKVITINNIEFYMYTKASSDNYMNLHIKSLDKLNKVIKEKS

SEQ ID NO: 12013 - DNA, 423 bp, Unknown
  Obtained from environmental sample
  misc_feature (1)..(423): n is a, c, g, or t
atgatacaatttcaacaaaattttaaacaacagcttacaaaaaaagagattaaagtaattgatgagactttttctattttaaaagaggaaaaagattctaatagtattggttattataaactttatgaaacatcacaagatattcttaaaggtgtaaaaagatataaaaaagagaataaatacttaaagaataaaaaaataaaaaatattgttgttgtaggtattggtggttctagtttgggtaccaaagctgtatatgagcttttaaaattaaaacaaaaatcaactataaatttaatatttttagaaaatgtagatcctttggatattgcttcaaaaacaaaagatattaaaaaaacaaattcactggttattgtaaaatcaaaatcgggttcacctattgaaaactatctctatttttaa

SEQ ID NO: 12014 - protein, 140 aa, Unknown
  Obtained from environmental sample
  misc_feature (1)..(140): Xaa is any amino acid
MIQFQQNFKQQLTKKEIKVIDETFSILKEEKDSNSIGYYKLYETSQDILKGVKRYKKENKYLKNKKIKNIVVVGIGGSSLGTKAVYELLKLKQKSTINLIFLENVDPLDIASKTKDIKKTNSLVIVKSKSGSPIENYLYF

SEQ ID NO: 12015 - DNA, 627 bp, Unknown
  Obtained from environmental sample
  misc_feature (1)..(627): n is a, c, g, or t
atgaatacagaacaaaatatggagctctttagagagaacttagcgatgaaaattgatgctcttttatctcctgaaatatgtaaagagttgatatcaaaatatgaaaacttttcaattgaaaatccaataaatatcaccagtgaaaaaattattaaagagtgttcggatatgatatttgtaaacgatcttgatgcttttttaacaaactattttcaatcaaaatacaaagttttctactcaacttttgatgtagttgattcatctacatctgtatccatatatcctagtaagctctggcaccttgatggtggtatacctaaaacactgaaactatttttatacttaactccagtctctgaacatggtggcaacacgatatatgttgatcaaaaaagaacaaaaatgctaataaaagcaggagaattacccattaatatggaagaacgtaaagaagatttaactcaggtttttgatcaaatgggagttgataatagttctcttgcctatgatcttaaagtaggagatggactcttatttagcccgcttttgctcgctcatagatgcctacctcctaaagaagataaaaaacgatacaccatctcttttactttaattccatggagttaa

SEQ ID NO: 12016 - protein, 208 aa, Unknown
  Obtained from environmental sample
  misc_feature (1)..(208): Xaa is any amino acid
MNTEQNMELFRENLAMKIDALLSPEICKELISKYENFSIENPINITSEKIIKECSDMIFVNDLDAFLTNYFQSKYKVFYSTFDVVDSSTSVSIYPSKLWHLDGGIPKTLKLFLYLTPVSEHGGNTIYVDQKRTKMLIKAGELPINMEERKEDLTQVFDQMGVDNSSLAYDLKVGDGLLFSPLLLAHRCLPPKEDKKRYTISFTLIPWS

SEQ ID NO: 12017 - DNA, 693 bp, Unknown
  Obtained from environmental sample
  misc_feature (1)..(693): n is a, c, g, or t
atgagtctgtggagaagatttttatcagttagagttgctcttattacagtactaatctactcagttttgggttttgttatcatacccttggttctgaagtatgctctgcctataattttaaaaaagaacctaaatgctgaatctaatatggagagtctctattttaatccatatagtttcgaacttgaactaaaaggctttaatcttctcgataattcaaatagattgctctttggctttggtagcttttatgtgaaccttgaaccttccgccctttttaataagttaatagttattaaaaaaatagacctgaatggactctactcaactgtaagagtcaacgataaaaaagtggcaaattttcagtacattttagactttttaaatcaaaaacctaaagtaaagagtgtaccttccaagctaaaaataccatatataacaattaacacttttaatatcaaagactcaacactctatttcaaagatgaatcaaaagttatcccatatgtagcagaatcanaatcttttaatctgagcgccacgaacatcagtacaacacccaacactaaagctacagttgagctaaatctggatttagaaaacactctctcactaaaatcatccaactctataactcccatccctttaaaagaaaaaagggacataaaacttttaaatccaacgaatagataa

SEQ ID NO: 12018 - protein, 230 aa, Unknown
  Obtained from environmental sample
  misc_feature (1)..(230): Xaa is any amino acid
MSLWRRFLSVRVALITVLIYSVLGFVIIPLVLKYALPIILKKNLNAESNMESLYFNPYSFELELKGFNLLDNSNRLLFGFGSFYVNLEPSALFNKLIVIKKIDLNGLYSTVRVNDKKVANFQYILDFLNQKPKVKSVPSKLKIPYITINTFNIKDSTLYFKDESKVIPYVAESXSFNLSATNISTTPNTKATVELNLDLENTLSLKSSNSITPIPLKEKRDIKLLNPTNR

SEQ ID NO: 12019 - DNA, 576 bp, Unknown
  Obtained from environmental sample
  misc_feature (1)..(576): n is a, c, g, or t
atggaaaatatagatttgaataaaattaaaaaaacatacaaccaacaaaaagcaaaaatcaaaaaaagagttgtgatttgtggtggaactggttgtattgctaacggttcgatggacgtttatcatgagtttgtaaatcaaataaaagaatcaggattagatgttattattgaacttaatgaacatacatgtgttgacgataaaaaagatagcatccttttaacagggagtggttgtcaggggttttgcgcacaaggtcctctggttaatatttatccagatgaagttttatatgtaaaagttcatcctgaaaatgtaaaagaaattgtacaaaatactcttataaatgatgacgtaatagatgaattattatatgtcaatactgttacaaaagaaaaaagtaagggatgtaacgaaattccattttataatcgacaagaacgaggcgttttagaggcgtgtggaaatttagatccagaaaatattgaaaagtatattagtagagatgggtaccaagctgctagaaaagcatttacagaaaaatcctccaaaagaattttgtccaatagttattga

SEQ ID NO: 12020 - protein, 191 aa, Unknown
  Obtained from environmental sample
  misc_feature (1)..(191): Xaa is any amino acid
MENIDLNKIKKTYNQQKAKIKKRVVICGGTGCIANGSMDVYHEFVNQIKESGLDVIIELNEHTCVDDKKDSILLTGSGCQGFCAQGPLVNIYPDEVLYVKVHPENVKEIVQNTLINDDVIDELLYVNTVTKEKSKGCNEIPFYNRQERGVLEACGNLDPENIEKYISRDGYQAARKAFTEKSSKRILSNSY

SEQ ID NO: 12021 - DNA, 708 bp, Unknown
  Obtained from environmental sample
  misc_feature (1)..(708): n is a, c, g, or t
atgccaaaacttggtggtgacaaaagtggttataattttgcgaaacaatttcatcattctactattgacccttttgcatctttagtacagcttgtaagtgacaataaaaatttagagatgattagtggagttaaagtagatggagttgtagaaaataaacaaggggatatattatttactaaatatggtctttctggttctgctattttagatataagcagagatatatcctataaactacaacatcaaaaaagtgtaaaagttaccgtagatattctcccaacattttctaaaaataaactagttgatatgctacttcaaagagctaaaacattagcctctagagatatttatgtttggcttgatggtattgtcaacaagaagctcagccgctatatcatcatagcatcaaagattccagagaatataaagtctgcaaaatttttaaatagaaaagatatcctaaaaatagtgcatactatgaaaaacttagaatttaatatcatagatacaaaaggttttgagacttgtgaagtgtgtgctgggggagtaataatagatgatattaacttacaaactatggaatcaaaactacaaaaaaatctctattttatcggtgaagttttggatgtagatggagattgtggtggatataatcttcactttgcttgggctagtggatatactttggcacaaaacctaagataa

SEQ ID NO: 12022 - protein, 235 aa, Unknown
  Obtained from environmental sample
  DOMAIN (1)...(228): HI0933-like protein
  misc_feature (1)..(235): Xaa is any amino acid
MPKLGGDKSGYNFAKQFHHSTIDPFASLVQLVSDNKNLEMISGVKVDGVVENKQGDILFTKYGLSGSAILDISRDISYKLQHQKSVKVTVDILPTFSKNKLVDMLLQRAKTLASRDIYVWLDGIVNKKLSRYIIIASKIPENIKSAKFLNRKDILKIVHTMKNLEFNIIDTKGFETCEVCAGGVIIDDINLQTMESKLQKNLYFIGEVLDVDGDCGGYNLHFAWASGYTLAQNLR

SEQ ID NO: 12023 - DNA, 801 bp, Unknown
  Obtained from environmental sample
  misc_feature (1)..(801): n is a, c, g, or t
ttgtctcatgaacttaaaacccttaaagaactcaatctaaagatgagtcaagatgcgcaaaacctcacaactgccctaaaaggggaaaataagacccaaggaagctggggcgaaatggtattagaaaaagtacttgaaagctctggtttacgactcaatgaagagtatataagagaaactacacttaaaaatgacgatggagaaaaatacagacccgatgtgatagtaaatctccctgctaatagacaagtaatcatcgatgcaaagacttctttgacaaattatgaacaatatacatcgacacaagatgtaatagagaaaaagggccatttgaatttacacataaaatcaataaatacccacatagattccctttcaaataaaaattatgaagagttaaagggggttaatactttagacttcatatttatgtttatccctattgagagtgcattaatgctagctatggaaagtgataaaggtctatttgataaagcctttaaaaagaagattgtactagtttccccaactacacttttagtagctttaaaagcagttgagaatagttggagatatgagaaacaagcacaaagtacaacagaggttatacgacttgcagagaagctttataataaggtaagaacttttgtagaagattttgaaaaagtaggaaaaaatctgagtcaagctcaaaaatcatatgatgatgcctacaaaaaactctcatctggaaaagataatatcgtaagacaaatagaggtttttcaagaaaaatcaaatataagcccttcaaacagataa

SEQ ID NO: 12024 - protein, 266 aa, Unknown
  Obtained from environmental sample
  DOMAIN (1)...(266): RmuC family
  misc_feature (1)..(266): Xaa is any amino acid
MSHELKTLKELNLKMSQDAQNLTTALKGENKTQGSWGEMVLEKVLESSGLRLNEEYIRETTLKNDDGEKYRPDVIVNLPANRQVIIDAKTSLTNYEQYTSTQDVIEKKGHLNLHIKSINTHIDSLSNKNYEELKGVNTLDFIFMFIPIESALMLAMESDKGLFDKAFKKKIVLVSPTTLLVALKAVENSWRYEKQAQSTTEVIRLAEKLYNKVRTFVEDFEKVGKNLSQAQKSYDDAYKKLSSGKDNIVRQIEVFQEKSNISPSNR

SEQ ID NO: 12025 - DNA, 609 bp, Unknown
  Obtained from environmental sample
  misc_feature (1)..(609): n is a, c, g, or t
atggaaaataattttaacgaaatatttgataaactagataaacaaaaaaagaccattaatgagcttacatccttatctaactcacttgcaacatctactagtatgtccgataaaacaattttagaaagtcaaataaattcacttactaattttttcaaaaaaagtaatgacgaaattaaagaaatcataaataatctaaatgttgctaaaaaaatagaaactaaggctccattaaaagatgaagtcactcctatcaaaaaagccattagccccccaaaaataaaaccaaatgtaattattgatgaaaattattttgatcccagtgaactagaggatttttcaattagcaagattagaaaaaaagaagttaaaaaagaagtaattaaaagagagaatgcaaattcttatatttctgcagcacacaaaatgttttcgaatttatctagaatgcttttaaaagaaggcgcttttgaaagtgtaaagaaaaatttagttaaagcaggtcttccgtttcttgctaaaagctatgtttcggtaatattttttaccacattnatttcagccggcgttggggttgctttaagatatttttcttattattcaacctaa

SEQ ID NO: 12026 - protein, 202 aa, Unknown
  Obtained from environmental sample
  misc_feature (1)..(202): Xaa is any amino acid
MENNFNEIFDKLDKQKKTINELTSLSNSLATSTSMSDKTILESQINSLTNFFKKSNDEIKEIINNLNVAKKIETKAPLKDEVTPIKKAISPPKIKPNVIIDENYFDPSELEDFSISKIRKKEVKKEVIKRENANSYISAAHKMFSNLSRMLLKEGAFESVKKNLVKAGLPFLAKSYVSVIFFTTXISAGVGVALRYFSYYST

SEQ ID NO: 12027 - DNA, 405 bp, Unknown
  Obtained from environmental sample
  misc_feature (1)..(405): n is a, c, g, or t
atgtattaccctaatattgaaaggcatattatcaacatcattaaaaataaaaatgctagaggttggtgtaaagtaatttcttttaatgacagggctctttttagaattaacaaactagacaacagtgttagattaggaaaattgtttgttggaaaacatgctcatcttccactttcttttgataaaggactaaatattagacctctaaaaaaatatgcttttgtagatgaagtaattgtaaaacacgactatgccacaaaagccattatagaaaaagtacatgatttcggtaaggaacttcatgtttggacagtaaacaacgaagaaactattcaaaaacttatagaaagaggtgttgatggtattatttcagattatcccaatctattgatgaagtataggtaa

SEQ ID NO: 12028 - protein, 134 aa, Unknown
  Obtained from environmental sample
  misc_feature (1)..(134): Xaa is any amino acid
MYYPNIERHIINIIKNKNARGWCKVISFNDRALFRINKLDNSVRLGKLFVGKHAHLPLSFDKGLNIRPLKKYAFVDEVIVKHDYATKAIIEKVHDFGKELHVWTVNNEETIQKLIERGVDGIISDYPNLLMKYR

SEQ ID NO: 12029 - DNA, 603 bp, Unknown
  Obtained from environmental sample
  misc_feature (1)..(603): n is a, c, g, or t
ttgaatcagaagaaattaactggtggaaattcaggtgttataattggtgtaaccgacatggataaatccataaaatattattcggaaatactgggttatgatactgttgcatatgatgttactgatgcttttgatgattttgggagtattccaggtggtaatgaaaattatcgacgagtactacttaaacatagtcagaagcgaaatggagcttttagtccaatgcttggaaatagttccattgaacttatccagtcagtttcgcgacaagcagtaaaaatttacaaggatcggttgtggggagatttaggatatattcatttatgtttcgatattattggaatgaatgaactccgtacaaagtgtgaaaaagcaggttatccttttactgttgatagtgccgatagcttcgacatgggagaagcagcaggccatttttcatatattgaagatcctgatggtactcttatagaatttgttgaaacccataaaataccaatattgaaaaaatttgggtggtatctaaacctattaaaacgaggacagaggacaccactttctaacttcttttttaaactactanatgctacacgaaagatttag

SEQ ID NO: 12030 - protein, 200 aa, Unknown
  Obtained from environmental sample
  misc_feature (1)..(200): Xaa is any amino acid
MNQKKLTGGNSGVIIGVTDMDKSIKYYSEILGYDTVAYDVTDAFDDFGSIPGGNENYRRVLLKHSQKRNGAFSPMLGNSSIELIQSVSRQAVKIYKDRLWGDLGYIHLCFDIIGMNELRTKCEKAGYPFTVDSADSFDMGEAAGHFSYIEDPDGTLIEFVETHKIPILKKFGWYLNLLKRGQRTPLSNFFFKLLXATRKI

SEQ ID NO: 12031 - DNA, 579 bp, Unknown
  Obtained from environmental sample
  misc_feature (1)..(579): n is a, c, g, or t
ttgttgaatttaaaatactactatatgcccgctgaacttcacgacgactctttaacaaccaatcagccagaaggccatccatatttcgatctaaaatctactttgcaagaatttataaaggaaaagcagtggtcaagtctagaaaaatccagtcgtaatatgattaacctttatcctgaaattgagtttggatggtttactttgggaatggcattggcaaaacaaaatgatcatattggagcagtacttaatttcaaaaaagcaatttatctaaatcctgattttgtaagttcatactaccaacttggtatttcatatttcaataaaaaagatttctctaattctatccattattatatggaagctataaaaaggggaatgaaaactcatactatctactataatattggtaatgcatggtttagtattggtgataatgacaaggcaattaaaaattatctgagaagtctgtcaatttgccccgattttactccagcagcctacagccttttccgtatttactttggaaatgaagattatcaaaatgcagtttcatcattacgcccgggggataagtga

SEQ ID NO: 12032 - protein, 192 aa, Unknown
  Obtained from environmental sample
  DOMAIN (62)...(95): TPR Domain
  misc_feature (1)..(192): Xaa is any amino acid
MLNLKYYYMPAELHDDSLTTNQPEGHPYFDLKSTLQEFIKEKQWSSLEKSSRNMINLYPEIEFGWFTLGMALAKQNDHIGAVLNFKKAIYLNPDFVSSYYQLGISYFNKKDFSNSIHYYMEAIKRGMKTHTIYYNIGNAWFSIGDNDKAIKNYLRSLSICPDFTPAAYSLFRIYFGNEDYQNAVSSLRPGDK

SEQ ID NO: 12033 - DNA, 336 bp, Unknown
  Obtained from environmental sample
  misc_feature (1)..(336): n is a, c, g, or t
atgaaagagttaaacttcatacttcaagatatagaagatttaaaagagaaaattgacgaaacaaaaaaacactcacctcaattgattcctgatatgaataaaaagatgttaaaactaaaaaagatggctaaaaaaattgaagagtctgcttttgatgccactcttgaaatcaaagaaaaagtacaaggtataaatcttattacgttctcttttccaaaagataaatttattgaattcaggactagacctcttatgagttatacaccatttagtattgaatacaataatgaagtagcaactttgaaccctgtaggagtaagtgtagaattagaataa

SEQ ID NO: 12034 - protein, 111 aa, Unknown
  Obtained from environmental sample
  misc_feature (1)..(111): Xaa is any amino acid
MKELNFILQDIEDLKEKIDETKKHSPQLIPDMNKKMLKLKKMAKKIEESAFDATLEIKEKVQGINLITFSFPKDKFIEFRTRPLMSYTPFSIEYNNEVATLNPVGVSVELE

SEQ ID NO: 12035 - DNA, 300 bp, Unknown
  Obtained from environmental sample
  misc_feature (1)..(300): n is a, c, g, or t
ttgggggattctccctcaaaagataaccaagttttcttctggaagaaaattacatggatagggcaagatgctttattgcatttaaaagttgagtattacgataaacttgggaaattacataggaaattaatactgtctgacattaaaaaagtagaaggattttggcaagcacataagttatatatgaataatgttcaatccatgcatcaaacagaaattactattgccaaccctagatttaatatcgatgtaaatgaagaatcctttacggtttctaatttggaaagaggtgatatttaa

SEQ ID NO: 12036 - protein, 99 aa, Unknown
  Obtained from environmental sample
  misc_feature (1)..(99): Xaa is any amino acid
MGDSPSKDNQVFFWKKITWIGQDALLHLKVEYYDKLGKLHRKLILSDIKKVEGFWQAHKLYMNNVQSMHQTEITIANPRFNIDVNEESFTVSNLERGDI

SEQ ID NO: 12037 - DNA, 480 bp, Unknown
  Obtained from environmental sample
  misc_feature (1)..(480): n is a, c, g, or t
atgagattaccagcagagtgggagcaacaagaatttgtacaactagtatttccacatgaaaatacagattggcgtgaatatcttgatgaagcaatagatacttttgtctctatagctaaagcaattcaaaaataccaaaaagtacttataatatctaaaaacttagagcagataagaaaaagatttccaaagaaaaataatcttacttttataactttggatagtgatgatacttggagtagagattttggtggtataactatagaacatgaagggaaatatcttatcgaagattttaccttcaatgcttggggaaaaaagtttgcatatgaaaaagacaatcaaatcacaagaaaactaaaactcagaggtattttcaaaggatattcccataaagcgattccacttgtactagaaggtggtgctattgagagtaatggtgcaaatattattatgaccacccactacctggcttattag

SEQ ID NO: 12038 - protein, 159 aa, Unknown
  Obtained from environmental sample
  DOMAIN (1)...(158): Porphyromonas-type peptidyl-arginine deiminase
  misc_feature (1)..(159): Xaa is any amino acid
MRLPAEWEQQEFVQLVFPHENTDWREYLDEAIDTFVSIAKAIQKYQKVLIISKNLEQIRKRFPKKNNLTFITLDSDDTWSRDFGGITIEHEGKYLIEDFTFNAWGKKFAYEKDNQITRKLKLRGIFKGYSHKAIPLVLEGGAIESNGANIIMTTHYLAY

SEQ ID NO: 12039 - DNA, 531 bp, Unknown
  Obtained from environmental sample
  misc_feature (1)..(531): n is a, c, g, or t
ttggagggggttgcatgtgacgctgaaaaagggcttctctatctagctgttgaagtggatgactctgtgttggttgttgatgcaaaaagtctaaaagtcataaaagaggttcctattaaaagagattttgagggagttaaagttcttaaaaaagataaagagtatggtttagaagccatcgagttagtaaatggtacactctacctatctaaccagtcatataaacagtggccacactctgatccttccgttgtctttactatagatacactcgagaataaagaggcaaaaatcacaaaagttttcaaacatggttatgtagatatcgcagcactcagctactacaaaaacaaactctacatgataagcgataaaaaaaatcttctcatcatctatgatcttgaaaaagagagaactgtaaaaactcacaaactgccaaaatattcacaagaggggctctgttttgatgacaaaggaaagatgtacattgccgatgataaaggaaaaatcataaaaatgaatgagccttaa

SEQ ID NO: 12040 - protein, 176 aa, Unknown
  Obtained from environmental sample
  misc_feature (1)..(176): Xaa is any amino acid
MEGVACDAEKGLLYLAVEVDDSVLVVDAKSLKVIKEVPIKRDFEGVKVLKKDKEYGLEAIELVNGTLYLSNQSYKQWPHSDPSVVFTIDTLENKEAKITKVFKHGYVDIAALSYYKNKLYMISDKKNLLIIYDLEKERTVKTHKLPKYSQEGLCFDDKGKMYIADDKGKIIKMNEP

SEQ ID NO: 12041 - DNA, 660 bp, Unknown
  Obtained from environmental sample
  misc_feature (1)..(660): n is a, c, g, or t
atgagagttttaggaaaagggaaaacagcacttgctgtacaagaagtatatagtgatgcaaaactttatgatgataatgataaagaggaatttgattttacaagtgaagaggaaactgtaataagtcctggtattcctcctcacaattttcttgtacaaaatacaaaaaatccaataagtgattatgacctttttttaaatgattcacaatacacaatatggataagtggtacaaatgggaaaacaacaactacctctatgttgtatcatctattaaaagatgatggtttttcatgtggtgggaatattggagttcccttagcaaaactacaggggaaagaaaaattaatattagaaacatcctcttttactttacattatacttcaaaagtaaaaccaaatatatacatactccttcctataagcgaggatcatatatattggcatggtagttttagtgagtatgaaaatacaaagctcaaaccattaacaatgatgggaaaaagtgatatagcaataattccaagtaaatataaagattttaaaacaaaagcaactctctatatttatgaagatacaacagatatagcccatcaatttaaaatagatttctcacagaatcattttaaagaaactttttttacaagaaggctggattaa

SEQ ID NO: 12042 - protein, 219 aa, Unknown
  Obtained from environmental sample
  DOMAIN (6)...(208): Mur ligase family, catalytic domain
  misc_feature (1)..(219): Xaa is any amino acid
MRVLGKGKTALAVQEVYSDAKLYDDNDKEEFDFTSEEETVISPGIPPHNFLVQNTKNPISDYDLFLNDSQYTIWISGTNGKTTTTSMLYHLLKDDGFSCGGNIGVPLAKLQGKEKLILETSSFTLHYTSKVKPNIYILLPISEDHIYWHGSFSEYENTKLKPLTMMGKSDIAIIPSKYKDFKTKATLYIYEDTTDIAHQFKIDFSQNHFKETFFTRRLD

SEQ ID NO: 12043 - DNA, 687 bp, Unknown
  Obtained from environmental sample
  misc_feature (1)..(687): n is a, c, g, or t
gtggtgtggtttaaatactatatcgttgaagaaggtgatggcgaaaaagttgaagtaggaaaagaagttactttacatggaataggaacttttgaaaatggagaagttttctgggaaacccgagatagcaattctccattttattttattacaggaacaaatagtgtgattaagggagttgaagaaggcgttagtaaaatgcgtgtaggagatcgatggatctttatcttgcctcctgaaattgcctatggtaatagaaaacgtgatcctattcctccaaattcgactcttatattcgattatgaaatattggatgtttccaatcctaagaaatcaattgcagatactctaagtaaagtaattaaaagcgatggaataaataaagctttagatctgtatactgaattaaaaaatcaagaagatatatttaattttagaatggatgagttaaatggattaggatacaaatttataaaagaagaaaagtacgagttaagtaaaatcgtattagagctaaacgcaaaagagcacccaaatgattataatgcttgggatagtttaggcgagatatacatgattctaggagaggatatgcttgcaattgaaagttacgaaagatcacttgaactgtatcctaagaacacgaatgcagaggaaatgatcaagaaaataagtgtaaaagaataa

SEQ ID NO: 12044 - protein, 228 aa, Unknown
  Obtained from environmental sample
  DOMAIN (181)...(214): TPR Domain
  misc_feature (1)..(228): Xaa is any amino acid
MVWFKYYIVEEGDGEKVEVGKEVTLHGIGTFENGEVFWETRDSNSPFYFITGTNSVIKGVEEGVSKMRVGDRWIFILPPEIAYGNRKRDPIPPNSTLIFDYEILDVSNPKKSIADTLSKVIKSDGINKALDLYTELKNQEDIFNFRMDELNGLGYKFIKEEKYELSKIVLELNAKEHPNDYNAWDSLGEIYMILGEDMLAIESYERSLELYPKNTNAEEMIKKISVKE

SEQ ID NO: 12045 - DNA, 417 bp, Unknown
  Obtained from environmental sample
  misc_feature (1)..(417): n is a, c, g, or t
atgaactacaaaataagtatctgtcatcccgataaaaaagaaatcgagattattccaaatagccttgatagtaaggaagctctagaattttttaatgattatccatggaaggaacaattagaacttttagataaaatgaaccaagagaaagttcaatacagtccttctgttcgttttactaacacgcgcaacaatatcagtttagagatgacagcagaatctcatggaggaaaaatatccttttcattatggtttgaaagacccgttcgtaccaaaattctatttggacttcttggagagaaagataagatgaaattaacagataagtggggatttgatcacatttcttcaaaacaacatttaactgcttttcttagagagaactacgatgaagttgaacgtataatgaaaaagtaa

SEQ ID NO: 12046 - protein, 138 aa, Unknown
  Obtained from environmental sample
  misc_feature (1)..(138): Xaa is any amino acid
MNYKISICHPDKKEIEIIPNSLDSKEALEFFNDYPWKEQLELLDKMNQEKVQYSPSVRFTNTRNNISLEMTAESHGGKISFSLWFERPVRTKILFGLLGEKDKMKLTDKWGFDHISSKQHLTAFLRENYDEVERIMKK

SEQ ID NO: 12047 - DNA, 423 bp, Unknown
  Obtained from environmental sample
  misc_feature (1)..(423): n is a, c, g, or t
gtggcagataagaatgagaacaaaagtcatttaacacataccatcaaagaatcagattcgagtaaaactttaaaagacagatggattagtgagaatttttatcccaatgttcagtttaccgaaaaaaatagcgttataatcgaatttaatggacaatgtcaataccagtacccaattagtgaaaaaactaataagggatggatagaatatcaaaaaactcctgattgcattacagacgtcccctttaataaaacatttgagctagagaagtatccaaaagtaggtgaccgattcgtaaagtatagaatctttggagatactttatactttgaatatttatacccagattggatagactctgtgaattcacagcaacaaaattatccttatttttctgagaaatatgtaagaataaatgagtag

SEQ ID NO: 12048 - protein, 140 aa, Unknown
  Obtained from environmental sample
  misc_feature (1)..(140): Xaa is any amino acid
MADKNENKSHLTHTIKESDSSKTLKDRWISENFYPNVQFTEKNSVIIEFNGQCQYQYPISEKTNKGWIEYQKTPDCITDVPFNKTFELEKYPKVGDRFVKYRIFGDTLYFEYLYPDWIDSVNSQQQNYPYFSEKYVRINE

SEQ ID NO: 12049 - DNA, 777 bp, Unknown
  Obtained from environmental sample
  misc_feature (1)..(777): n is a, c, g, or t
atgaaaaatggaagtataaatttagcctcaattttaaaacctcagaaaaaagatgtagaaaaagagtctagtgaaaaaacagatataccagcatttaaaatatcaaagactcaaattatagatgcaaattttatttttactcaagtttttgattctaaaaagactacaactaacataagtaatttcaactatactttttatgatataggaacatttgaaaattatcttgcctcacatagccttgttacaaacataaataaagatacaaagttatatatagatgggggatttagactaactccttttaaaatgtatggaaaagtaaaacttgaaaacctaaaatcaaatgaatatgttggatatacaaaagatttactaaactttcaaattggagagccaacattatctttatcttttggatatagagttgatacaactaaagaactagaagtatatattgacaatgcaaatcttagtttaaataacttaaaactaatcaaagacaataaagagattgcaggattaaatagttttgaaatagataatttaaagctagacttggcaaaacagaaaatagatatcaataatatatcacttaactctttatttgcaaatatagtgtcaaataaaaatgaaaagctaaatatagataatcttgtaaatataaaaaacaatactacaaatgaaaaaaaagatgaacccaaaaatgaaaaaccttggcttgtagatttaagctcttttgcaataaacaactcaaactttacttatgatgattaa

SEQ ID NO: 12050 - protein, 258 aa, Unknown
  Obtained from environmental sample
  misc_feature (1)..(258): Xaa is any amino acid
MKNGSINLASILKPQKKDVEKESSEKTDIPAFKISKTQIIDANFIFTQVFDSKKTTTNISNFNYTFYDIGTFENYLASHSLVTNINKDTKLYIDGGFRLTPFKMYGKVKLENLKSNEYVGYTKDLLNFQIGEPTLSLSFGYRVDTTKELEVYIDNANLSLNNLKLIKDNKEIAGLNSFEIDNLKLDLAKQKIDINNISLNSLFANIVSNKNEKLNIDNLVNIKNNTTNEKKDEPKNEKPWLVDLSSFAINNSNFTYDD

SEQ ID NO: 12051 - DNA, 627 bp, Unknown
  Obtained from environmental sample
  misc_feature (1)..(627): n is a, c, g, or t
atgcaacaaaagatggaggatattattgggtgtttgcaacagtatttctatttgagagttgtgatggttctaaaggatacttatcttgtagaagaaaaccttcaaaacttgaaatcaaagatgctgaagctttatataaagagtggtcaaatgaaaaatagcacaaaaacaaccctagaacttctttctaaaagaattatagaatatataaaagagcaccttaatatggaaaaaattgattctaattttactatagaggaagtaagcaaaatagagtatgacaatatctctacatttatctctttaagtggagatttaagtggaactattgggttgagcatatcaaataattttgcaaatttattagtcaatagttttatttttggagaggttgatgaggctactttaagagaattggcaactgaaaatgtagcagaaacacttaacataacacttggaaatattatcaaagacttagaagaagtaaaggcaggaggtaaagtagatatttcaacaccgtatacactacataatagtgtaagtattactaaaaaagaaaatggaacaatgtatttaagtcaaataaaatatttagacgaaattataattgtaagttactttatataa

SEQ ID NO: 12052 - protein, 208 aa, Unknown
  Obtained from environmental sample
  misc_feature (1)..(208): Xaa is any amino acid
MQQKMEDIIGCLQQYFYLRVVMVLKDTYLVEENLQNLKSKMLKLYIKSGQMKNSTKTTLELLSKRIIEYIKEHLNMEKIDSNFTIEEVSKIEYDNISTFISLSGDLSGTIGLSISNNFANLLVNSFIFGEVDEATLRELATENVAETLNITLGNIIKDLEEVKAGGKVDISTPYTLHNSVSITKKENGTMYLSQIKYLDEIIIVSYFI

SEQ ID NO: 12053 - DNA, 672 bp, Unknown
  Obtained from environmental sample
  misc_feature (1)..(672): n is a, c, g, or t
atgagcaacaaggaaagtcaagttagagatatcaatattgtagtcgtaaactcaaaaggtggatcatctaaatcaactgtatcgtatcaagtgtttggatcgtattttttatacaaacaattaggcacaataatttccgaatttgatgatgaaaaccaagattctgaagcatttattaagtctaatattgctactgagcagatacatataggcaccggtgatggaataaatgatacggtgagaaatatatttttaaatggcaaaaacaacgtttgtgatataggtggaaataaatcaactagcatttttttaaggtctttaggtgctactcaaatgtttaaaaaagtagatttatttgttatccctatgagtggtggtagcgttgatgtaaaaaatgctataaaaacgtacgaacttatcatcggttgggatccaaatgctaatatcatttttgctctgtcaagagtgcgaaatcttcgcagattgaggtggcaatacagtgattttttcaacaatcctgtaagtganaaaaaatattttattcttactgatagcgatgtagttgatttgagcagaaaggaagcaagatcagtttatgaaatcgcgcatgacgaaaaatataaacagagtcttcaaaaaaatttaacactgcgttggaaaaaaatgacctaa

SEQ ID NO: 12054 - protein, 223 aa, Unknown
  Obtained from environmental sample
  misc_feature (1)..(223): Xaa is any amino acid
MSNKESQVRDINIVVVNSKGGSSKSTVSYQVFGSYFLYKQLGTIISEFDDENQDSEAFIKSNIATEQIHIGTGDGINDTVRNIFLNGKNNVCDIGGNKSTSIFLRSLGATQMFKKVDLFVIPMSGGSVDVKNAIKTYELIIGWDPNANIIFALSRVRNLRRLRWQYSDFFNNPVSXKKYFILTDSDVVDLSRKEARSVYEIAHDEKYKQSLQKNLTLRWKKMT

SEQ ID NO: 12055 - DNA, 360 bp, Unknown
  Obtained from environmental sample
  misc_feature (1)..(360): n is a, c, g, or t
gtgttatgtatattatatttatattttgaaggaatgttagagatgaatattttattactaagtaatgactatactataaaaagttatttagaaattggacaaaacaagttgaactactcttttgtaaattctaatcaaccgatggtagactatgaaaaaaacaattttgatattgtaattgtcgatatttcaactcataaaaaaaaccttcttcaaatactagaactaacccctaaacaaaaaataatagttatctctgacaacttagattgtattaacgaaattggatgtgatatttgtccagtaaaatataataaacatagacttttaaaactattcaaattatactcttctgattaa

SEQ ID NO: 12056 - protein, 119 aa, Unknown
  Obtained from environmental sample
  misc_feature (1)..(119): Xaa is any amino acid
MLCILYLYFEGMLEMNILLLSNDYTIKSYLEIGQNKLNYSFVNSNQPMVDYEKNNFDIVIVDISTHKKNLLQILELTPKQKIIVISDNLDCINEIGCDICPVKYNKHRLLKLFKLYSSD

SEQ ID NO: 12057 - DNA, 438 bp, Unknown
  Obtained from environmental sample
  misc_feature (1)..(438): n is a, c, g, or t
gtgatagaagaggtaaaaaatatgatgcaagcaactttatctaattgtgatatagaactgagggaagattatagttttaataagaagataaaaacatataaaaaagagttagttcaagttttaataaattttattaaaaatgcaaaagagatgtttgaagagaaaaaaagtggtagtaaaataatatttatcaatgaatatattaagaataataatgttatcttacaaatatgtgataatgcaggtggaattgagcaagagaatattcataggatatttgagccttattttactacaaaagatgaaaaaaatggtactggacttggactttatatttcaaaagtgataattgaaaaacatttaaatggtactataaaagctttcaataaagatcaaggtgcatgctttgagattactttaaattttgaaaagggatag

SEQ ID NO: 12058 - protein, 145 aa, Unknown
  Obtained from environmental sample
  DOMAIN (32)...(143): Histidine kinase-, DNA gyrase B-, and HSP90-like ATPase
  misc_feature (1)..(145): Xaa is any amino acid
MIEEVKNMMQATLSNCDIELREDYSFNKKIKTYKKELVQVLINFIKNAKEMFEEKKSGSKIIFINEYIKNNNVILQICDNAGGIEQENIHRIFEPYFTTKDEKNGTGLGLYISKVIIEKHLNGTIKAFNKDQGACFEITLNFEKG

SEQ ID NO: 12059 - DNA, 306 bp, Unknown
  Obtained from environmental sample
  misc_feature (1)..(306): n is a, c, g, or t
ttgaaaagggatagtttggaaaatattatttcattaaaaaagcttggatgcgattataatttattggttgttgaagatagtaaacatgtcaatacaaaacttgtagaataccttagtaaattttttcttgagatagatagtgcagaagatggtcaagatgggctaacaaaatttaataacaaaagatatgatattgttataactgatataaatatgcctaaaatggatggcacaagttttatacaaaagcttatagaaaatgactccaatgtgcaaattattgttgcctctgcttttgggaaatga

SEQ ID NO: 12060 - protein, 101 aa, Unknown
  Obtained from environmental sample
  DOMAIN (19)...(101): Response regulator receiver domain
  misc_feature (1)..(101): Xaa is any amino acid
MKRDSLENIISLKKLGCDYNLLVVEDSKHVNTKLVEYLSKFFLEIDSAEDGQDGLTKFNNKRYDIVITDINMPKMDGTSFIQKLIENDSNVQIIVASAFGK

SEQ ID NO: 12061 - DNA, 507 bp, Unknown
  Obtained from environmental sample
  misc_feature (1)..(507): n is a, c, g, or t
atgaaattgtattttagtggattttctttaaaagaggaaaaagagctttttaaagattatattatagaaaatgattttaccgtatctggttttagttatggagcacaaaaagcttttgaatatgttttaaatacagataacagagtcgatttattgcaacttttttctccagcattttttcaggataaagatacaaaatataaacgccttcagttgatgttttttaaaaaagattcgcaaacatattgtgataactttttaacaaattgtggttttagtaaagaattagctagtaaatattttgaagagggaacatttgaagagctagaagaattactaacttatgaatggggtcaagaaaaattacaaaaattaattgataaaaatataaaaatagagatctacttaggaagtgatgataagattattgatgcaaatgttgcattagagttttttaaacagtttggtgaagtatattttataaaagaaaaggggcatatcttatga

SEQ ID NO: 12062 - protein, 168 aa, Unknown
  Obtained from environmental sample
  misc_feature (1)..(168): Xaa is any amino acid
MKLYFSGFSLKEEKELFKDYIIENDFTVSGFSYGAQKAFEYVLNTDNRVDLLQLFSPAFFQDKDTKYKRLQLMFFKKDSQTYCDNFLTNCGFSKELASKYFEEGTFEELEELLTYEWGQEKLQKLIDKNIKIEIYLGSDDKIIDANVALEFFKQFGEVYFIKEKGHIL

SEQ ID NO: 12063 - DNA, 711 bp, Unknown
  Obtained from environmental sample
  misc_feature (1)..(711): n is a, c, g, or t
gtggagtatggacaaaaggggaaaatctctttaatgaaaagtaaaatagatgcactctttggacatagtgaaaaagagaaaattaatacacttcttaaagatgatacacgattttttcaagcaggggatttaaaacatatagatgaaacaattattgaaaaaatggttgggaaaagtagagcatttgtaaaaattcaagaggggtgtaactttcgatgtagttattgtattatcccatttgttagaggtgattctagaagttatgatgaggctaaaatattagaacaaattaccactttggcttcaaatggttttggtgagtttatacttacaggaacaaatcttggttcttatggaaaaggtgttgaggggcgagatggtttagcaatacttcttaaaaaaatatctcaaataagaggggtaagacgaattcgtcttggaagtgttgaacctatacagattactgatcaatttaaagagatactaactgaaccttggatgggaaaacatctccatattgcattgcaacatacaaataaagagatgttaaagcttatgaatagacgaaaccaagttgataaagatttagaactttttgagtttttagcttcaaaaggatatgcaatagggacggattttatagttggacatccaggagagagtgaagaagtttgggaagatgctatgaaaaatcttcaaaatttccgctaa

SEQ ID NO: 12064 - protein, 236 aa, Unknown
  Obtained from environmental sample
  DOMAIN (63)...(232): Radical SAM superfamily
  misc_feature (1)..(236): Xaa is any amino acid
MEYGQKGKISLMKSKIDALFGHSEKEKINTLLKDDTRFFQAGDLKHIDETIIEKMVGKSRAFVKIQEGCNFRCSYCIIPFVRGDSRSYDEAKILEQITTLASNGFGEFILTGTNLGSYGKGVEGRDGLAILLKKISQIRGVRRIRLGSVEPIQITDQFKEILTEPWMGKHLHIALQHTNKEMLKLMNRRNQVDKDLELFEFLASKGYAIGTDFIVGHPGESEEVWEDAMKNLQNFR

SEQ ID NO: 12065 - DNA, 798 bp, Unknown
  Obtained from environmental sample
  misc_feature (1)..(798): n is a, c, g, or t
ttgtataaaaagaaaattggagataccgaatatggtattggttggttaccattaggtggttatgttaaaattgctggaatgattgacgaaagcatggacaaagaacaactaaaacaaccacctcaaccatgggaatttcgtgctaaaccgacttggcaacgtttaattattatgttgggaggtataattgtaaatgtaattgttggctttttaatttacagttttgtgttaatgggttatggagaaaaatttctgcctgccgatgaacttaaagatggtgtttggtgcttaaatgagtctattaccaatgaaatagggcttcaaaatggagataaaattataaccattaatggagaagctcctgaaacctttgagcaaatgcaagaagaggttttttattctaaaacgatgatggtagagcgaaatggagagcaaattagcttagacattcctaccgacttagttgataaactattaaaagaaagaagaggtcctttatttgcttatcgaattccttttacagtaggaggaacattaaaagattatcctgccgcaaaagcaggccttaaaccaaaagataaaattattggaataaatgatatctccattaattattatgatgaatttaaagacaaattaactcctttcattaatcaaacagttgaattaaaagtaatgagagagggggaattaatgtctttctcaacagaaattgtagattccgcttttattggcgtttctccttatccgtattccttaactgaattagaaaaagaaggcgttacaatacaaaactga

SEQ ID NO: 12066 - protein, 265 aa, Unknown
  Obtained from environmental sample
  misc_feature (1)..(265): Xaa is any amino acid
MYKKKIGDTEYGIGWLPLGGYVKIAGMIDESMDKEQLKQPPQPWEFRAKPTWQRLIIMLGGIIVNVIVGFLIYSFVLMGYGEKFLPADELKDGVWCLNESITNEIGLQNGDKIITINGEAPETFEQMQEEVFYSKTMMVERNGEQISLDIPTDLVDKLLKERRGPLFAYRIPFTVGGTLKDYPAAKAGLKPKDKIIGINDISINYYDEFKDKLTPFINQTVELKVMREGELMSFSTEIVDSAFIGVSPYPYSLTELEKEGVTIQN

SEQ ID NO: 12067 - DNA, 789 bp, Unknown
  Obtained from environmental sample
  misc_feature (1)..(789): n is a, c, g, or t
atgaaacccgaattagaaagttttgatttagtaataaaacatcaactaacaccaacaattntttcactaacgtcattaatagcttatgttaacactataaaagtattgcctgctgacaaaaactttaacattcatttaaagttagatacaggaatgcatcgtttggggttgaaaatggatgaattagatgaagtaataaaaactatacaacaatatcctaacataattatagaaagtgttttttctcagttaagttcttccgataatcctgatgaagacgattattcattaaatcaaataaaacaatttgaaaagatggctgagaaaatttcatcatcattcaactataaaattgataggcacatggcaaattctaatgccattgttcgtttttcagaaacacattacgatatggtaaggttgggaataggtttgttagggtttacagaagacgaaaccaccaacgcagtattaaaaaatgtagcggtattaaaaacaaaaattgctcaaattcatcatttacaagctggcgaaaccattggttatggaagaatggggaaagtaacaaaaccgtccaccattgcaacaatacctattggttatgcagatgggtttaaccgtcagttgggaaatgggaaatggtctttaatagtaaatggaaagccagctccaactataggaaatatatgtatggatattaccatggtagatgtaactgatatagagtgctctgaacaggatgtagcgttactttttaatactaaaaaaaagtgttctctctttgtctaa

SEQ ID NO: 12068 - protein, 262 aa, Unknown
  Obtained from environmental sample
  DOMAIN (1)...(151): Alanine racemase, N-terminal domain
  misc_feature (1)..(262): Xaa is any amino acid
MKPELESFDLVIKHQLTPTIXSLTSLIAYVNTIKVLPADKNFNIHLKLDTGMHRLGLKMDELDEVIKTIQQYPNIIIESVFSQLSSSDNPDEDDYSLNQIKQFEKMAEKISSSFNYKIDRHMANSNAIVRFSETHYDMVRLGIGLLGFTEDETTNAVLKNVAVLKTKIAQIHHLQAGETIGYGRMGKVTKPSTIATIPIGYADGFNRQLGNGKWSLIVNGKPAPTIGNICMDITMVDVTDIECSEQDVALLFNTKKKCSLFV

SEQ ID NO: 12069 - DNA, 849 bp, Unknown
  Obtained from environmental sample
  misc_feature (1)..(849): n is a, c, g, or t
ttgttttccaattggctaagcagcgaagccaacgaagccaaccacataaaacgtgatactcctgtaatgtgtgtaattggaaaccctccttatgctgttagtagtacaaataaaggagaatggattcaaaatctcataaaagactataaaaaggacttaaacgaacgaaacatccagccgctttctgacgattacatcaagtttatacgttacggacagcattttattgataaaaatggaagtggggttttggcttacatatcgaacaacagttttatagatggaattatccaccgccaaatgcgaaaaaatttgttggagagttttgataaaatatacattctcgatttgcatggaaattccaagaaaaaagaagtttgccccgatggttcggcagatcaaaatgtgttcgatattatgcaaggtgtatctataaatttatttgtaaaaacagggaaaaagaaaaaggatagccttggggaaatttttcatttcgatctccaaggtaaaagagatgtcaagtatgaatcccttcaaaaaaactcaatacttagtataaaatggaataaagtttctgcttcatctaacgattatttatttgtcaaaaataattttgataccataagaaatattccagctttttctattgataaattattcaatatatttagttctggtactcaaactaaacgagacaaactttttgttgatttaaaaaagaccgatttggaaaaaaagatgattaatttattgaatcaatcttatgatgaaacatttatccttgaatataaaataaaagactcttcctcatataatttattagagaagaataaaaaatcgaggttttaa

SEQ ID NO: 12070 - protein, 282 aa, Unknown
  Obtained from environmental sample
  misc_feature (1)..(282): Xaa is any amino acid
MFSNWLSSEANEANHIKRDTPVMCVIGNPPYAVSSTNKGEWIQNLIKDYKKDLNERNIQPLSDDYIKFIRYGQHFIDKNGSGVLAYISNNSFIDGIIHRQMRKNLLESFDKIYILDLHGNSKKKEVCPDGSADQNVFDIMQGVSINLFVKTGKKKKDSLGEIFHFDLQGKRDVKYESLQKNSILSIKWNKVSASSNDYLFVKNNFDTIRNIPAFSIDKLFNIFSSGTQTKRDKLFVDLKKTDLEKKMINLLNQSYDETFILEYKIKDSSSYNLLEKNKKSRF

SEQ ID NO: 12071 - DNA, 591 bp, Unknown
  Obtained from environmental sample
  misc_feature (1)..(591): n is a, c, g, or t
atgaataaagagctacttagcttcttttcaatttttattgcactctttgtgggtgcactttactatacaaacaatattcaagggccattaatttcagctcttaactacttaaaatcaaattatcataactctacagaattcatagaaaacaaaattgaccaacatacatttcaagcagactatattgtagaattaaaagaaaaactacaaaaatatgaaaataatcacctcgtaatgcaacaaatggcttcagaggtaaacgacctatttaaagccaataattctaaactaaaaactattccaaaagtagagcttgtaagagcaatttcttatgaaaaatttggagacttaaacagagtctggataaacgtccaggactataatgcatctagaatctatggtctaatatacaatgaactagttgcaggaatagtgataccacaaaatgaaaaacctttaggacttttaaatagagatattcaaagttcatatgcggtatatgttggaaaaaagaaagctccgggtatcgctcatggaaaattatgcaccaaacttagttgtaaagtttattccctgcttggtttaaaataa

SEQ ID NO: 12072 - protein, 196 aa, Unknown
  Obtained from environmental sample
  SIGNAL (1)...(19)
  misc_feature (1)..(196): Xaa is any amino acid
MNKELLSFFSIFIALFVGALYYTNNIQGPLISALNYLKSNYHNSTEFIENKIDQHTFQADYIVELKEKLQKYENNHLVMQQMASEVNDLFKANNSKLKTIPKVELVRAISYEKFGDLNRVWINVQDYNASRIYGLIYNELVAGIVIPQNEKPLGLLNRDIQSSYAVYVGKKKAPGIAHGKLCTKLSCKVYSLLGLK

SEQ ID NO: 12073 - DNA, 972 bp, Unknown
  Obtained from environmental sample
  misc_feature (1)..(972): n is a, c, g, or t
ttgtcttacattaatacgccaccacccaacagacaactggtgaaaactaaattggtactttttatgaaggaacttattcgtgatgctattatttatgagacatcagaagnaggtcaggttttatttgtnaacaatagagtggaaaatataaaagaagttgcaggtatggttcaacgactttgtccgaatgtaagtgttttaacagctcacggacaaatgaaaggcccagagttagagcaaaaaatggcagcttttgtagaaggtcaatatgatgtattgattgctaccactatcattgaatcaggtttggatattccaaatgctaacaccattattattttaaatgccaatcattttggaatgagtgatttgcatcaaatgagaggtagggtaggaaggtctaacaaaaaagcattttgttacttaatggcttctccgttacacaccttaacgatggaagcccgaaaaagattaaccgctttggagcagttttctgagttgggtagcggttttcaaattgctatgagagatttagacattagaggagctgggaatttattaggtgccgagcagagcggttttatttctgaaattggttttgatgtatatcaaaaaatattgcaagaagccatagacgagctgaaagaaaacgagtttaaagaattatatgctgaagaattaaaaaccaaaaattttgtaaaagattgccaaatagaaaccgattttgaaattttaattcctgatgattacattactaacattgcagaacgattagccatttataaggagttagatgagttagacaacttagaagaattagaaaaatataaaagtcaattgatagataggtttggaaaaattccttacgccactgaacaactttttaaagccattcagctaagatggatagctaaagaaattggttttgaaaaattagtgcttaagcagaagaaattgataggctatttataa

SEQ ID NO: 12074 - protein, 323 aa, Unknown
  Obtained from environmental sample
  DOMAIN (239)...(322): TRCF domain
  misc_feature (1)..(323): Xaa is any amino acid
MSYINTPPPNRQLVKTKLVLFMKELIRDAIIYETSEXGQVLFVNNRVENIKEVAGMVQRLCPNVSVLTAHGQMKGPELEQKMAAFVEGQYDVLIATTIIESGLDIPNANTIIILNANHFGMSDLHQMRGRVGRSNKKAFCYLMASPLHTLTMEARKRLTALEQFSELGSGFQIAMRDLDIRGAGNLLGAEQSGFISEIGFDVYQKILQEAIDELKENEFKELYAEELKTKNFVKDCQIETDFEILIPDDYITNIAERLAIYKELDELDNLEELEKYKSQLIDRFGKIPYATEQLFKAIQLRWIAKEIGFEKLVLKQKKLIGYL

SEQ ID NO: 12075 - DNA, 903 bp, Unknown
  Obtained from environmental sample
  misc_feature (1)..(903): n is a, c, g, or t
atggtcagaatcggctcgagggcagcttatttttttaatgatttagagcgagttgttggtgaagataaagtgctttttttccctaattcatacagaaatccttatcaagtagaacaaacggataatgctaatgtgttaatgcgtgctgaggtacttggtgccctaagcaaatcatcatctaccaaacttatagttacttatccggcagcactttctgaaaaagtaattacaaaaaaaatactcaaaaaaaatacgcttaaactaaaggtggaagaagaaattccattgagtaatttaatagaaaaattgaacgagtatcagtttgaacgtgtcgattttgtggtggaacctggacagttttctataagaggaggaattgtagatgtgttttctttctccaacgaaaatccttatagaattgagttttttggtgatgaaattgcttctgtaagaagttttgatcctgtttcgcaattgagcataaaaaattatcagaaggtaactattcttcctaacattcagaattcaatgttggaagaaatgagaatttctattttaaactatttgcctaaaaatactatagtttggactaaagatattgcacttattgcagctcaattagaaaaagattttactaatgcacaagaagcatataaaaaagtagaaaattctcctttggcacatttaattcccgaagaaatctattgtcaaaaaaataattttttagaagatattactgctaaaaacaccattgagtttggtaatcaatttaagttgcaagctaatttagaaattcaatttaatctgcaagtacaacctattttcaataaaaattttgacttattacatcaagatttattagaaaaaagagaaccagggtttaaaagtgtctgttttggctga

SEQ ID NO: 12076 - protein, 300 aa, Unknown
  Obtained from environmental sample
  misc_feature (1)..(300): Xaa is any amino acid
MVRIGSRAAYFFNDLERVVGEDKVLFFPNSYRNPYQVEQTDNANVLMRAEVLGALSKSSSTKLIVTYPAALSEKVITKKILKKNTLKLKVEEEIPLSNLIEKLNEYQFERVDFVVEPGQFSIRGGIVDVFSFSNENPYRIEFFGDEIASVRSFDPVSQLSIKNYQKVTILPNIQNSMLEEMRISILNYLPKNTIVWTKDIALIAAQLEKDFTNAQEAYKKVENSPLAHLIPEEIYCQKNNFLEDITAKNTIEFGNQFKLQANLEIQFNLQVQPIFNKNFDLLHQDLLEKREPGFKSVCFG

SEQ ID NO: 12077 - DNA, 705 bp, Unknown
  Obtained from environmental sample
  misc_feature (1)..(705): n is a, c, g, or t
ttgtcagattctatcttgccatcactctggatagcttcaatagttgaggtagatgatggttcatattggtatagtaattataacgaaggggtttattgcattaaaaatgaaaagataatcaatcaccttgatattaaggaaccccaggccatcattcaggaccaggatgggaatatctggattagctcgttaaataatagagtgtataagattagccctcactataatgcccatacgcatcatgacattactgagtttggaggctcagctatttctgccctgaataaatccctggcaggtgtgtggatgaccaatggtgaacgtgtttatttgtataggaatcaaagttttctgcctctggatttttgtaataatgaaagtaaactaaatatagttttttgtttggatgatgaaacattgattgttggtgagaaaagcagaaaccattatattatcactaatgtgaaaccaggccgattgacaaaacagctaagatatggtgaatgccataaaggacatcatggcagtggaatgaaatatcctgctgttgatcctggcacaggtgagctattttactttacacaatctaaactgtttgttaatccaaaacgaaaaaagatttggataagagggaagaaattccatataggtgaacccaattccataaaatcttttttaaaccctgaaagaaaatttggttgttaa

SEQ ID NO: 12078 - protein, 234 aa, Unknown
  Obtained from environmental sample
  misc_feature (1)..(234): Xaa is any amino acid
MSDSILPSLWIASIVEVDDGSYWYSNYNEGVYCIKNEKIINHLDIKEPQAIIQDQDGNIWISSLNNRVYKISPHYNAHTHHDITEFGGSAISALNKSLAGVWMTNGERVYLYRNQSFLPLDFCNNESKLNIVFCLDDETLIVGEKSRNHYIITNVKPGRLTKQLRYGECHKGHHGSGMKYPAVDPGTGELFYFTQSKLFVNPKRKKIWIRGKKFHIGEPNSIKSFLNPERKFGC

SEQ ID NO: 12079 - DNA, 540 bp, Unknown
  Obtained from environmental sample
  misc_feature (1)..(540): n is a, c, g, or t
atgttttcaaataatggtattgtagtaacaccataccttatctcaagtatcacaaatagatataatcaaaaaatagtatttgaaccagaagaagcatatttaacatcacctgaacaagcatatcttatgacaacaatattacatgatgttgtaaaaaaagggacaggacgaaatgccaatgttgctaatatagatattgttggtaaaacaggtacaacaaataacaatatagatgcttggttttgtggatactcaccaacattacaaacagtagtatggtatggtaatgatgataataaaccgatggggaaaagggaaactgggggaagaacagcggcacctgcgttcaaatacttttatgaacattggctaaaactacacccagaaatgccaagaaattttataaagccagaaaatgtttttatacaaaaatataatggtgaagatgagtattttacagaaacttcaaagatgccaaaagagcaaacagatatagagatacaaacagattatctaaaaaataaaaatgttattttttag

SEQ ID NO: 12080 - protein, 179 aa, Unknown
  Obtained from environmental sample
  misc_feature (1)..(179): Xaa is any amino acid
MFSNNGIVVTPYLISSITNRYNQKIVFEPEEAYLTSPEQAYLMTTILHDVVKKGTGRNANVANIDIVGKTGTTNNNIDAWFCGYSPTLQTVVWYGNDDNKPMGKRETGGRTAAPAFKYFYEHWLKLHPEMPRNFIKPENVFIQKYNGEDEYFTETSKMPKEQTDIEIQTDYLKNKNVIF

SEQ ID NO: 12081 - DNA, 630 bp, Unknown
  Obtained from environmental sample
  misc_feature (1)..(630): n is a, c, g, or t
atgtttaaccaaagagataaaaatgtcacaataaaagttggaaaacttatagcaaatgagcatatacttcatagcacctcagataaacttagtattgtagatcaatataaaaaacacctctatggtcttaaaaaagggaaaaaacaatattttgaaactatcaatactattgcccgtgaagaaaatagacaaagtctcaaaaaagaattaaaatcttcacagcttataggacaaacagctgatggtaaaaaaatttacctttatgattatgttgataacagtgcagtgatgaatgaaattggacgattaagagagataagttttagaaaagtaaatgaaggtgtcaataaaaaaagagaccttgaccaatatgaccaatactataaacatatagttttatgggatgatgaagatttagagatagttggggcttacagaattggtgagggaaaaagtattaatgcacagtatggaaaatatggtttttattcaaataccctttttagatttaaaaaaccttttgtaaaataccttgataactccatagaactcgggagaagttttgtacaaccaaaatattggggaactcgtgctttagattatctttggtatggaattggtgcatattaa

SEQ ID NO: 12082 - protein, 209 aa, Unknown
  Obtained from environmental sample
  misc_feature (1)..(209): Xaa is any amino acid
MFNQRDKNVTIKVGKLIANEHILHSTSDKLSIVDQYKKHLYGLKKGKKQYFETINTIAREENRQSLKKELKSSQLIGQTADGKKIYLYDYVDNSAVMNEIGRLREISFRKVNEGVNKKRDLDQYDQYYKHIVLWDDEDLEIVGAYRIGEGKSINAQYGKYGFYSNTLFRFKKPFVKYLDNSIELGRSFVQPKYWGTRALDYLWYGIGAY

SEQ ID NO: 12083 - DNA, 750 bp, Unknown
  Obtained from environmental sample
  misc_feature (1)..(750): n is a, c, g, or t
ttgggattttgtagctctattattaatatggcacatattatgagtatgaaagttatagcagaaggtgtagaaataaaagaggagtatctcacttgtaaagatattggtgtggatttagtacaaggatatcttatccaaaaacctaaaacagatatcacaaaaattaaagggaaatatcaccacataaatgaactttataaaaatgaccaaagaagttacacaacaaatattgttgataaaagtaaaatagaatttattgaacctcttaaacttgacactactttaaatgacctctttgaatattttaaaaatcatccaactaatacttttgtacctatagttgataaaattggtcaactctacggtgtgatttatgaaaaagatattaaagaactctcctactctcaatttggcgtatcgttggcaaaaaatgataaaactaataataaattaaaaaagtttatcaaagatactatctcttctgaaatcacatggggagtggataaaattttagagatatataatatggataaaaatagttcttatggtatttttataacaaaaaatagtcaatactatggctttatcgatgtgaataatcttctttctatctcttatcatagaaatatagagatagctaaagatcaaaatcctctcactaaacttccaggtaatagaacaattgaactttttattactgatgctttacaatgtgttgaagaaaaaacaaatcaaaaagtaaaattttga

SEQ ID NO: 12084 - protein, 249 aa, Unknown
  Obtained from environmental sample
  misc_feature (1)..(249): Xaa is any amino acid
MGFCSSIINMAHIMSMKVIAEGVEIKEEYLTCKDIGVDLVQGYLIQKPKTDITKIKGKYHHINELYKNDQRSYTTNIVDKSKIEFIEPLKLDTTLNDLFEYFKNHPTNTFVPIVDKIGQLYGVIYEKDIKELSYSQFGVSLAKNDKTNNKLKKFIKDTISSEITWGVDKILEIYNMDKNSSYGIFITKNSQYYGFIDVNNLLSISYHRNIEIAKDQNPLTKLPGNRTIELFITDALQCVEEKTNQKVKF

SEQ ID NO: 12085 - DNA, 369 bp, Unknown
  Obtained from environmental sample
  misc_feature (1)..(369): n is a, c, g, or t
ttgacccttagtaactttgcgcaaaaaatggtaggaagggaaaaaatttaccctgggacatgcaaaattattgttgggttaagtgaggatgagcaaaaattgatcattgattctatcatgggacaaaaattaagtgtaagagaaacagaaatactagttaaaaaaataaaagaaaatacagaatctacacaagaaactgtacaaaaaatagacaataaaataaatattgattataagcctctagatagcttaaaaaaagagcttagcaataaaaatttagaaataaaagtggataaaaactactttaaaataaaaatcaactcacaagatgatatagaaaatatactgaattattttcaaaatcaataa

SEQ ID NO: 12086 - protein, 122 aa, Unknown
  Obtained from environmental sample
  misc_feature (1)..(122): Xaa is any amino acid
MTLSNFAQKMVGREKIYPGTCKIIVGLSEDEQKLIIDSIMGQKLSVRETEILVKKIKENTESTQETVQKIDNKINIDYKPLDSLKKELSNKNLEIKVDKNYFKIKINSQDDIENILNYFQNQ

SEQ ID NO: 12087 - DNA, 474 bp, Unknown
  Obtained from environmental sample
  misc_feature (1)..(474): n is a, c, g, or t
atgattattactttagaaaaaaaagcaattatatttacacttaaagatgattctattaatttaaaacctctgttgcattttgtaaataataactttaaaagagtgagacactttactcactctactgttattttaaatgaaaatgacgaagagatattaaaaaaatatcttataaaatgggcatataaaatttatcaaaaatgctatccatatagtgatagtgaacttttttcaaatttaattcaattatatgaactcccaattcatataataatttccagtaaaaaatctattactcagatggcagttataacaatagaccagattgattcacatgagatctcagtagcttgtaatcaaaaccatgagaggataattcaatattttaaattaatctataaagatgctatggtacgcaccatgaaaaaagaattatcagaattacaattaaaacgaaaagtcaccgacgcttaa

SEQ ID NO: 12088 - protein, 157 aa, Unknown
  Obtained from environmental sample
  misc_feature (1)..(157): Xaa is any amino acid
MIITLEKKAIIFTLKDDSINLKPLLHFVNNNFKRVRHFTHSTVILNENDEEILKKYLIKWAYKIYQKCYPYSDSELFSNLIQLYELPIHIIISSKKSITQMAVITIDQIDSHEISVACNQNHERIIQYFKLIYKDAMVRTMKKELSELQLKRKVTDA

SEQ ID NO: 12089 - DNA, 435 bp, Unknown
  Obtained from environmental sample
  misc_feature (1)..(435): n is a, c, g, or t
atggttttttgtattacaaaattagcagacagtttagacttttatattgaaaataatgttttttctagtgcaaattataaaacatataatggggaaaattttttcatgctcacatgttctgaggaatatgaaaggttaaaagaatgtatagacttctctttattattagatgtagcacacctaaaagtaagtagtaggagtttgaatttaaattttgaagaggaatggtcttatttaataaagagtacggattatattcatattagtgataatgatagtttacatgatataaatagttcaatcaaagaaaaatcagatttagtggatttattaagaaaagaagatttaaaaaataaagattttactcttgaaatatatgatggtttagatgagttgaaaaatagttacaagttattacaaggattagtttcgtga

SEQ ID NO: 12090 - protein, 144 aa, Unknown
  Obtained from environmental sample
  misc_feature (1)..(144): Xaa is any amino acid
MVFCITKLADSLDFYIENNVFSSANYKTYNGENFFMLTCSEEYERLKECIDFSLLLDVAHLKVSSRSLNLNFEEEWSYLIKSTDYIHISDNDSLHDINSSIKEKSDLVDLLRKEDLKNKDFTLEIYDGLDELKNSYKLLQGLVS

SEQ ID NO: 12091 - DNA, 300 bp, Unknown
  Obtained from environmental sample
  misc_feature (1)..(300): n is a, c, g, or t
gtgatatatgtatcttcatcatgtgtaaaacataaaaagataaaagactctatcttagagttaatagattatggatttaaaaatattgaattatcaggtggaactgaatattatgatggttttgaagatgatttgttggtgttaaaaaagaaatatgatttaaattatatttgtcataactatttttctccaccaaaggagcattttgtactaaatttagcatcattagataatgaaattttatgtaaaacattagatcatttaaaacagaccattgttttatcacaaaaacttggtgct

SEQ ID NO: 12092 - protein, 100 aa, Unknown
  Obtained from environmental sample
  misc_feature (1)..(100): Xaa is any amino acid
MIYVSSSCVKHKKIKDSILELIDYGFKNIELSGGTEYYDGFEDDLLVLKKKYDLNYICHNYFSPPKEHFVLNLASLDNEILCKTLDHLKQTIVLSQKLGA

SEQ ID NO: 12093 - DNA, 510 bp, Unknown
  Obtained from environmental sample
  misc_feature (1)..(510): n is a, c, g, or t
gtgaaaagtatatttaaaagtcgtatatttgttatattattttttataattcttagttttacaatatatttcatcatcaattatttaaaaaacagtgaaatagatagatacaaaaaagacacatatagagagaaagttttagaatcaaaagtttatcttaatacacttatcaaagagaaagaaaatgccacatcaactatcgctttaggattatcacgaaatagtgatattattgctgctttaaaagatataaaaatcaatcctactttactcaaagattactcaaagcaactaaaaataaatactgattttaaaaatgtttggtttcaccttaatacaaaagatgggatatcagtacagaagaagttggaccggagtataaaaatggatagattaataactcccagagtagatttacaaaaagttctccaaagaaaaaaaaatattgaacaggaattggtgtgggaaaaatttgaaatgacctttaagtccaggggtccgggaattgaa

SEQ ID NO: 12094 - protein, 170 aa, Unknown
  Obtained from environmental sample
  misc_feature (1)..(170): Xaa is any amino acid
MKSIFKSRIFVILFFIILSFTIYFIINYLKNSEIDRYKKDTYREKVLESKVYLNTLIKEKENATSTIALGLSRNSDIIAALKDIKINPTLLKDYSKQLKINTDFKNVWFHLNTKDGISVQKKLDRSIKMDRLITPRVDLQKVLQRKKNIEQELVWEKFEMTFKSRGPGIE

SEQ ID NO: 12095 - DNA, 408 bp, Unknown
  Obtained from environmental sample
  misc_feature (1)..(408): n is a, c, g, or t
ttggctcaaattgtaaaaatcaatatccaaagtgagacacttgtcataattaatgttcatttagaagcgtttcatcaagaaactcgattaaagcaaaccaaaaaaataattgaactttataatagatatcgccatgagtttcctactattttattaggcgattttaatagcgatataaattatgatgatgccagtattaatttacttctaaaattatcaaaaacaggaaatgcagttttcaataaaaatgatattcaaaatactttcaactcaaaagatcctagcgaacgattagattatattttttataatactgattttatccaatttattgacggaaaagttttaaccgaatttaaacaagcatctgatcatttacctttattaatgaattttaaaattaaataa

SEQ ID NO: 12096 - protein, 135 aa, Unknown
  Obtained from environmental sample
  misc_feature (1)..(135): Xaa is any amino acid
MAQIVKINIQSETLVIINVHLEAFHQETRLKQTKKIIELYNRYRHEFPTILLGDFNSDINYDDASINLLLKLSKTGNAVFNKNDIQNTFNSKDPSERLDYIFYNTDFIQFIDGKVLTEFKQASDHLPLLMNFKIK

SEQ ID NO: 12097 - DNA, 597 bp, Unknown
  Obtained from environmental sample
  misc_feature (1)..(597): n is a, c, g, or t
ttggggcttttgtggacctgggggattgccaaaagaatcttttggtacctcgtaacaaacaaaaaaaatcccttcaatgtaggggattcacatatattaagagttgaatatgatgagcagagtcacaggctcatgggggttgaaagaatacaaaaatatctcaaaactcccactaaagatcttgtaacaaacctagaagtagatatcttggtatttgcatcaactcctatgggatttaaggtaattataaatcatgactatgaaggtatgatctataaaaatgagatatttgacaatgtaaaggtaggctatcaagctaaagcttacataaaggcagtgcgttcagataacaagatagatgtgtcacttcaaaaaattggcaataaaactctagaccaagagactcaaacagtaatggatcttttacatagcagtggcgaaagtctgccttacaattataaaagtgatgctgagttaattaaaaagatatttaaaatgagtaaaaaaagttttaaaaaatctttgacaactctcgttgagaacaaagagattgaagtaaaagatacagggatatatacagtaaaaaataatggctaa

SEQ ID NO: 12098 - protein, 198 aa, Unknown
  Obtained from environmental sample
  misc_feature (1)..(198): Xaa is any amino acid
MGLLWTWGIAKRIFWYLVTNKKNPFNVGDSHILRVEYDEQSHRLMGVERIQKYLKTPTKDLVTNLEVDILVFASTPMGFKVIINHDYEGMIYKNEIFDNVKVGYQAKAYIKAVRSDNKIDVSLQKIGNKTLDQETQTVMDLLHSSGESLPYNYKSDAELIKKIFKMSKKSFKKSLTTLVENKEIEVKDTGIYTVKNNG

SEQ ID NO: 12099 - DNA, 687 bp, Unknown
  Obtained from environmental sample
  misc_feature (1)..(687): n is a, c, g, or t
atgtcatttatgacaaaacttcttgaaaaacgtcaagaggagttgagaaattctccagaagcatccaaagtagcaataataataaaaaatcttacagaagatacaaaaaaattaaacaatattgttcataaacagttagaaaaagttaaagaagtacatacttcaacagcagagattatcaaaagtgtagatagcgaaacaatatttgatgcagaatatgacatgtataataagcgctatttaataaaaagattagaacaagaacttgttgcgattaaagagtttaaacataaaagtatttttatgcttattgagttaaacagagggatcgcttcagctcaatcaagtgataaaattagatatttgatgaatcgtactataggtagacttgtgctgaagacatcaagaagaaatgatattatcggctactatggtgcaggtgcatttggtatgatactgaagcactcagatgttaaaagttccgaaaaggccagtgaaagattggttgatcttgttaagagtacaaattttttcctagaagatgaagagatacaattgggcataaatattggtattaaagagttagatgattcgaaaagtgttgaagaaaatatagttgatgcgctcgattcacttgatagtgcattaaaagataataataaagattattatgtaagcggtaagtag

SEQ ID NO: 12100 - protein, 228 aa, Unknown
  Obtained from environmental sample
  misc_feature (1)..(228): Xaa is any amino acid
MSFMTKLLEKRQEELRNSPEASKVAIIIKNLTEDTKKLNNIVHKQLEKVKEVHTSTAEIIKSVDSETIFDAEYDMYNKRYLIKRLEQELVAIKEFKHKSIFMLIELNRGIASAQSSDKIRYLMNRTIGRLVLKTSRRNDIIGYYGAGAFGMILKHSDVKSSEKASERLVDLVKSTNFFLEDEEIQLGINIGIKELDDSKSVEENIVDALDSLDSALKDNNKDYYVSGK

SEQ ID NO: 12101 - DNA, 348 bp, Unknown
  Obtained from environmental sample
  misc_feature (1)..(348): n is a, c, g, or t
ttggaaaagaaaatgaatatacttatactagatgaagaggtttatttagcacaaaaagttgctattagacttcatgaagagggaaactattgtacccatgtatcaaatattaaagagataaaatttgatgaacaatatgatgtaattttactttcaacaaatattagtacaaatgatgtacataaaattatttcaaaatttaaagagagtattattattttacttgtttcctatataaaggagacaactgtaacccaacctttaaaaaatggtgccagggattacattgtaaaaccttttattatggatgagcctgtgcgaaaaatttttccccctgaaggaatttaa

SEQ ID NO: 12102 - protein, 115 aa, Unknown
  Obtained from environmental sample
  DOMAIN (5)...(114): Response regulator receiver domain
  misc_feature (1)..(115): Xaa is any amino acid
MEKKMNILILDEEVYLAQKVAIRLHEEGNYCTHVSNIKEIKFDEQYDVILLSTNISTNDVHKIISKFKESIIILLVSYIKETTVTQPLKNGARDYIVKPFIMDEPVRKIFPPEGI

SEQ ID NO: 12103 - DNA, 438 bp, Unknown
  Obtained from environmental sample
  misc_feature (1)..(438): n is a, c, g, or t
atgttcactatctctgaagatattttgttagagagtttaactaaaagtgataaaacagttatagaacttgaaaagatgaaagaatactcaagaatacccatatttaaaaaagatattgatgagattgttgggattgttttttcaaaagagtatttttatgaatttatagaaaatagattagaaaacaaacaagatattataaaatcagtatttaaagtacataagaatatccctatttctaaacttctagatctttttatctcaagaaaagagcatctatttattgtagttgataactatgaccaaacagcagggatagtaactcttgaagatgctatagaaactcttttaggtttggagattgttgatgaatttgacaataattctaatatgagagagttagcaaaaagcttaaagtttttaaaaaacaatatttaa

SEQ ID NO: 12104 - protein, 145 aa, Unknown
  Obtained from environmental sample
  DOMAIN (64)...(117): CBS domain
  misc_feature (1)..(145): Xaa is any amino acid
MFTISEDILLESLTKSDKTVIELEKMKEYSRIPIFKKDIDEIVGIVFSKEYFYEFIENRLENKQDIIKSVFKVHKNIPISKLLDLFISRKEHLFIVVDNYDQTAGIVTLEDAIETLLGLEIVDEFDNNSNMRELAKSLKFLKNNI

SEQ ID NO: 12105 - DNA, 639 bp, Unknown
  Obtained from environmental sample
  misc_feature (1)..(639): n is a, c, g, or t
atgnnnnnnccaanntcagattggctcgggttctgcttatggtgttgctccaaatctgcggctgattttgcatttttgcttcatgggtttaactatttagatgatgctggaactatggctattatcttgcctcacggtgttttgtttcgtggtggtgctgaagagagaatacgacgaggattattagaaaaaggatatattgatactgttataggtcttccctctaatctcttcttctctactggtattcctgtgtgtatcttggtacttaaaagatgtaaaaaatctgatgatgtattgtttataaacgcaagtgaacattttgccaaaggtaagcgtcaaaaccgtttacgtgtgggagaaaacggtgagcctaatgatattgagaagatagtaaacacttataaatacagaacagaagaagagagatattctaaacgaatatctctggaacgcatcgaagaagagggatataacctcaatatatcaagatacataagcacagccatagaagataaaaaaatagacttaaaaaaagagaatgataagctaatagatatagaaaaagatatagttaaatatacaaaagaacacaataaatttttagaagaattaaaacttgatttattaccaagttaa

SEQ ID NO: 12106 - protein, 212 aa, Unknown
  Obtained from environmental sample
  DOMAIN (6)...(159): N-6 DNA Methylase
  misc_feature (1)..(212): Xaa is any amino acid
MXXPXSDWLGFCLWCCSKSAADFAFLLHGFNYLDDAGTMAIILPHGVLFRGGAEERIRRGLLEKGYIDTVIGLPSNLFFSTGIPVCILVLKRCKKSDDVLFINASEHFAKGKRQNRLRVGENGEPNDIEKIVNTYKYRTEEERYSKRISLERIEEEGYNLNISRYISTAIEDKKIDLKKENDKLIDIEKDIVKYTKEHNKFLEELKLDLLPS

SEQ ID NO: 12107 - DNA, 699 bp, Unknown
  Obtained from environmental sample
  misc_feature (1)..(699): n is a, c, g, or t
gtgcaaataaaagatatctacaactatttaaatgatttaagcccttttgagcttcaagagaagtgggataatagtggtttaatagttggaaatatggaagataagtttgaaaatatctatatctctttagatttagatttagagatgattgaaaatattgaaccaaagagtttgattatcacacatcatccacttatttttagtccaattaaaacagtgaatgatgatagatatgcaacaaaacttctaaaaattttgataaaaaaagatattgcacttatatcaatgcatacaaatattgataaaacacatttaaatagttatgtaggaaatgatattttaggtttgaactttgaaaagagtgatgactttgtacttactacaaaagttgatatgagttttgaagaacttcaagagtacataaaaaagaagttaggaataacaactttaaaagtaacagattctacaaaaaagataaaaactttatctttaacaacaggttctggtatgagtttattgccatatataaaaacagattgttttttaactggtgatataaaatatcatgaagcaatggaggcaaaagccttaggtatcagtcttattgatattggacattttgagagtgagatacatttttgtacacttttagaaggtttaattcaagactatttgaaaaaaataataaaacagctataa

SEQ ID NO: 12108 - protein, 232 aa, Unknown
  Obtained from environmental sample
  DOMAIN (10)...(231): NIF3 (NGG1p interacting factor 3)
  misc_feature (1)..(232): Xaa is any amino acid
MQIKDIYNYLNDLSPFELQEKWDNSGLIVGNMEDKFENIYISLDLDLEMIENIEPKSLIITHHPLIFSPIKTVNDDRYATKLLKILIKKDIALISMHTNIDKTHLNSYVGNDILGLNFEKSDDFVLTTKVDMSFEELQEYIKKKLGITTLKVTDSTKKIKTLSLTTGSGMSLLPYIKTDCFLTGDIKYHEAMEAKALGISLIDIGHFESEIHFCTLLEGLIQDYLKKIIKQL

SEQ ID NO: 12109 - DNA, 822 bp, Unknown
  Obtained from environmental sample
  misc_feature (1)..(822): n is a, c, g, or t
ttgcctgccaaacaggaaaatcctgttgcaaaggaatctaaaaaaaatcacagccaaaccaaaccaattcattcaaaacagcgaaagtcagatcaatctgttcgcaataaacaaggtgataaagaggctttaaaaaatactcgcggagtaaaatcgcgcaatcagaaatatcaaaaacgaaagaagcaggtcaagtattttgatgataggtctccctctttggctgccattagggatgcatacggctcttcatcgaaagataattctgaaaataatagggttaagaatcaagcgcctgagagaacgcttttgaaagccagtgaaggttcccattttgagcagaaccctatttttagccaaaatggagattgttcgcataggacgaccatcgatgagcgaccgtgcgtaacgcagatttctccgggtagtgatattgaagtgcagttggttatcggtgtggatttgggtacctccgtgaccaaggtgataattggcgatcccgatcaaaagcgtttttatgctgtgcctctttctcctggatctgaaaacccctaccttatttccacctcaatccttaaagatgagctccataacatcattatcgatacgggagaatctcccaatgctcttcgcaatatcaaattggacttgatggaaagtaggagcaacgaagcaataatccacctggccggttacgttgctcagattgttcgtcatagcatacgttggtttttttcggcgcatgccgatgactatcgtggtatgcatctgttttggactatggcgatgggtttgcccgtagattctgctcgcccagcctga

SEQ ID NO: 12110 - protein, 273 aa, Unknown
  Obtained from environmental sample
  misc_feature (1)..(273): Xaa is any amino acid
MPAKQENPVAKESKKNHSQTKPIHSKQRKSDQSVRNKQGDKEALKNTRGVKSRNQKYQKRKKQVKYFDDRSPSLAAIRDAYGSSSKDNSENNRVKNQAPERTLLKASEGSHFEQNPIFSQNGDCSHRTTIDERPCVTQISPGSDIEVQLVIGVDLGTSVTKVIIGDPDQKRFYAVPLSPGSENPYLISTSILKDELHNIIIDTGESPNALRNIKLDLMESRSNEAIIHLAGYVAQIVRHSIRWFFSAHADDYRGMHLFWTMAMGLPVDSARPA

SEQ ID NO: 12111 - DNA, 495 bp, Unknown
  Obtained from environmental sample
  misc_feature (1)..(495): n is a, c, g, or t
ttgaaaaaagaaactgatagtagtttatgtttttcggaaccttcaaggtggatggaaaaattaataatcaataaaaatacagttaaatatcagtatgaaggagatattggttatgaagatatgaaatcatttagaaaagggacttgtaaaattgaatcagaaaaagtaattattaatattatgaaaggtttcataaatgctaaatttaaagatagaaatgacaagatttattcagaaaaaagattactaaagaccaagaaaataattttattatacatcaaagaaattgatgtttatattgagaaaaaatattataataaatattatggaaagaaagtttttataggaaaaaactatattacttctatcattgatgaagtttctaatagaatgaaatgtggagaaattggtttgcaattgaaatatatgagaaaaatcggattttatgtaagggatgatcaacgacaattaaaactgtcccccgacgacaattaa

SEQ ID NO: 12112 - protein, 164 aa, Unknown
  Obtained from environmental sample
  misc_feature (1)..(164): Xaa is any amino acid
MKKETDSSLCFSEPSRWMEKLIINKNTVKYQYEGDIGYEDMKSFRKGTCKIESEKVIINIMKGFINAKFKDRNDKIYSEKRLLKTKKIILLYIKEIDVYIEKKYYNKYYGKKVFIGKNYITSIIDEVSNRMKCGEIGLQLKYMRKIGFYVRDDQRQLKLSPDDN

SEQ ID NO: 12113 - DNA, 699 bp, Unknown
  Obtained from environmental sample
  misc_feature (1)..(699): n is a, c, g, or t
atgcttagaggaagtcgaaattttaactcaagaaatgattatgaaaaatttttgaaggataaatttaatcagatcaattcaaacagactggataaagtcaccgaagaaatgaaacatcttagagaattgccattaagaagaattgaagattatcgagaattttctattaaagtaagtcctggaagcacaataagaataaataacaatacctattcagtacacagtcgtttaatcaaagaacatgttaaggttcttttgtatgcagaccaccttaaagtttattatggccagagtcttattgaagaaataccaagacttgtaggtgatagcaaaaatcacatacaatatagacatattatagattccttgataaggaaaccaggagcatttgagaattataagtataaagatgatatgtttcctacaagtcattttaaaataacttttgacttgctcaaggaacaaaatccagtaaatgcaaacaaagaatatctcaaaattttaaatcttgccgcaaaagaatcagaagatcaggttgataaagccttaatgatatcaatagatgcagatgatgatatctcttttactggtattgaaaaaattgtgttatcagaatccgcttgtgatttttcatttcctatagagatatcgcctgttgatttaaaactctatgatgctttacttgaggaaccaatatga

SEQ ID NO: 12114 - protein, 232 aa, Unknown
  Obtained from environmental sample
  misc_feature (1)..(232): Xaa is any amino acid
MLRGSRNFNSRNDYEKFLKDKFNQINSNRLDKVTEEMKHLRELPLRRIEDYREFSIKVSPGSTIRINNNTYSVHSRLIKEHVKVLLYADHLKVYYGQSLIEEIPRLVGDSKNHIQYRHIIDSLIRKPGAFENYKYKDDMFPTSHFKITFDLLKEQNPVNANKEYLKILNLAAKESEDQVDKALMISIDADDDISFTGIEKIVLSESACDFSFPIEISPVDLKLYDALLEEPI

SEQ ID NO: 12115 - DNA, 537 bp, Unknown
  Obtained from environmental sample
  misc_feature (1)..(537): n is a, c, g, or t
atggatttagcggatggaactataaaagatttaatgtgcaatcataaaaaaaactataatagtaacttagaaacaagtgatttattaaatcagataaaacatatttctgagacaattaaaattttgcatcaagcaaacttcgctcatagggatataaaaccagaaaatattttattaaaagcaaattatcctgttttatctgattttggactttgtggcaagtgttctacaataaaaaagaaaaaaggtccaaaatactggccaaatccagaatttgtacaagcttgtgatgaagatcttaaaaaaattgatcatcaaagcgatatttttaatttaggttgtttatttttttacttttttacaggcaagtatcctattggacaaataaatctagaagaagaattatctaatttaagttccgagataagtgctataatagtaagaatgataagttatgaaaagaataatagattggatgatattactgaaatgatttcagttttagataataaaatagagaataatagtataagttaa

SEQ ID NO: 12116 - protein, 178 aa, Unknown
  Obtained from environmental sample
  DOMAIN (1)...(168): Protein kinase domain
  misc_feature (1)..(178): Xaa is any amino acid
MDLADGTIKDLMCNHKKNYNSNLETSDLLNQIKHISETIKILHQANFAHRDIKPENILLKANYPVLSDFGLCGKCSTIKKKKGPKYWPNPEFVQACDEDLKKIDHQSDIFNLGCLFFYFFTGKYPIGQINLEEELSNLSSEISAIIVRMISYEKNNRLDDITEMISVLDNKIENNSIS

SEQ ID NO: 12117 - DNA, 528 bp, Unknown
  Obtained from environmental sample
  misc_feature (1)..(528): n is a, c, g, or t
gtggaaaatcactattttgatagagatgatgatgcgggagaattaaatatctctatagtagatataacttcaaatgatactgaaggtggaaataaaacaggtgagccaaaagatataagtaaaaacttcaacgtatcaaaatctagtccagaaaatggaaaaataaaattatctcttgaacctacggaagatatggaaataggtgacaatatacaaatcaaagtagaacttacttctcctgaaaataactttgaagaacttattttaatagaaatagcagaacctcaaaaagaacaatcacaaaaaccagaagaggaagaaaatgaaaagtttggtttaccagaacttgtactaacatctgaaagttcagatgatgagaatataaaagcatgggaaaaacttgaagacaatgggatagatatggattataataaaatacttcatatttattcaagtgatggagagaaacttgaaaaaatctttataaatttagatagtactgtactaaaaaatcataaatctaaataa

SEQ ID NO: 12118 - protein, 175 aa, Unknown
  Obtained from environmental sample
  misc_feature (1)..(175): Xaa is any amino acid
MENHYFDRDDDAGELNISIVDITSNDTEGGNKTGEPKDISKNFNVSKSSPENGKIKLSLEPTEDMEIGDNIQIKVELTSPENNFEELILIEIAEPQKEQSQKPEEEENEKFGLPELVLTSESSDDENIKAWEKLEDNGIDMDYNKILHIYSSDGEKLEKIFINLDSTVLKNHKSK

SEQ ID NO: 12119 - DNA, 570 bp, Unknown
  Obtained from environmental sample
  misc_feature (1)..(570): n is a, c, g, or t
atgaaaaaactctctattataagtaatcagattaaaaacaatacttattcctatacagggaaaggttcttttgaagctgtggtaaatcaaaacaaagacataatattagaatggctagaggacttaatccctttacaaaagcaaatagagatgttaaaagatttaacaggtttagagtttcaaaaaagaaactatactagaattctcacaaaaatatttcctgatgagtatacggaatttgtatcacttaatattcttgtaagagatgctcatgctattgctcaacactatgatgatgagtacaatgtaacaatcctttataataacctcatagaacataaatatcttaaataccctggtaaatatgataaatatgtaagctacaatgttttccaaaaatttcttatgatgtatagagaagacttaatgaaaagtttagaaaatgatgatgcaaaagaagatactacagatacaacagaagagacctattttgatttagaagaacctacaatagaagaagttgaaactgaaactacaaaaagaaactcattctcaagaagaggaagatga

SEQ ID NO: 12120 - protein, 189 aa, Unknown
  Obtained from environmental sample
  misc_feature (1)..(189): Xaa is any amino acid
MKKLSIISNQIKNNTYSYTGKGSFEAVVNQNKDIILEWLEDLIPLQKQIEMLKDLTGLEFQKRNYTRILTKIFPDEYTEFVSLNILVRDAHAIAQHYDDEYNVTILYNNLIEHKYLKYPGKYDKYVSYNVFQKFLMMYREDLMKSLENDDAKEDTTDTTEETYFDLEEPTIEEVETETTKRNSFSRRGR

SEQ ID NO: 12121 - DNA, 906 bp, Unknown
  Obtained from environmental sample
  misc_feature (1)..(906): n is a, c, g, or t
gtggagtattttgttgacgcttactctaagaggtttttgtcggtagattttgctgatggtttttcgaagttaaagtcaaactctattttaactgatcgtgatcagtttttgtcttttaaatacccttacctttattatttctttgttgggaagaagattgcagagtcgtactccgaagttagtgaggtcaaacgttcggttgaagcgttattaaagaatctgcatagagaagattacgcaaatatcttaatatttatatctcatcatactaaagattcatgggttcttgatgaaataaaatccacgttgcgtgagcttttcgatactcatgtgcctacgtcacttgagcgcggacagttggcctttatgaatgatttcatgaagaaaatacctgagcttgtcatagagcaaagagagattcaaaaagagcgagatgatcataatgaaaaacttgataagctagaacgtagtgaagaggtggagcaaggcgaacctcatgatttactcgcgaatattaacaaggcatttaaaggtatcgagattgcgggtcagattattagaaatcgtcacgctacccttactaggtcatctttatttgagttggcagattgtggcgtaagtactgggcttaggtttttaaagtactttattgaaatttccgattctgcaaaaaaagaaattgttaaaatgattgctgcccatctttcagaatcgcctggtatctcggatcgtgaaattgaaaagcaggctgaaaatgcatatttacatttaacatacggagtaataaattcagtagttcggaaggtagccggatctattgggtcaaaaaaccgctggaaatttactttcttcttgagaaagaaaagcagacccccggctttacgcctcctaaggaaatcaaattga

SEQ ID NO: 12122 - protein, 301 aa, Unknown
  Obtained from environmental sample
  misc_feature (1)..(301): Xaa is any amino acid
MEYFVDAYSKRFLSVDFADGFSKLKSNSILTDRDQFLSFKYPYLYYFFVGKKIAESYSEVSEVKRSVEALLKNLHREDYANILIFISHHTKDSWVLDEIKSTLRELFDTHVPTSLERGQLAFMNDFMKKIPELVIEQREIQKERDDHNEKLDKLERSEEVEQGEPHDLLANINKAFKGIEIAGQIIRNRHATLTRSSLFELADCGVSTGLRFLKYFIEISDSAKKEIVKMIAAHLSESPGISDREIEKQAENAYLHLTYGVINSVVRKVAGSIGSKNRWKFTFFLRKKSRPPALRLLRKSN

SEQ ID NO: 12123 - DNA, 405 bp, Unknown
  Obtained from environmental sample
  misc_feature (1)..(405): n is a, c, g, or t
atgggaaaaatagaaaaaatatataaaacagcaacagctacttctccagaagtaattttggatattgagaacaatgtgttttcaataaaaggaaaatctgtggttacagaagtagatcaattttatcagccaattttaaattggttagatgagcttaaagccaattataatcaggaaattaactttgttttcgatttagaatatttcaatgttttttcatcaaaaagaatactttttttactgtataagttaaaagatataaaagaacaaggcgtaaatgttaaaatcgtttggcacttttctattgaagatgatgatatgaaagaagtaggagaagatttcgcctgtatggtaaacctaccttttgaatttattagtaaacaagtagaatcaccatttttctaa

SEQ ID NO: 12124 - protein, 134 aa, Unknown
  Obtained from environmental sample
  misc_feature (1)..(134): Xaa is any amino acid
MGKIEKIYKTATATSPEVILDIENNVFSIKGKSVVTEVDQFYQPILNWLDELKANYNQEINFVFDLEYFNVFSSKRILFLLYKLKDIKEQGVNVKIVWHFSIEDDDMKEVGEDFACMVNLPFEFISKQVESPFF

SEQ ID NO: 12125 - DNA, 618 bp, Unknown
  Obtained from environmental sample
  misc_feature (1)..(618): n is a, c, g, or t
atgaaaaatttaattgaattaaacgaagatgaaaaagattgtttacaagagcttatgaatatctcttatggtgctgcaacagcagcaatttctgaaataattgggaagtttgcaacattaagtataccgaatattgatactatttcatcttgtgatttaagaaaacatctcaacgaaaaacttttaagtaaaaataaatactatgtatcaaatcaattagttaatggataccttgcaggtgaaaatatttttatcatagatgaaatttcaagtataaaccttgcgcgggaatttgacctaagtgatgatgaaattgatgaaaatgaaataaaagatataatactagagattactaatattctttcttctgctacttctggaaaactagcttcattagtagatacaagtatctcatttagtgccccacatattacaaaaataaactctattgatgaatttgataaaagatttgaaggggaatatagtcatgtaattataatctcaacagaattaaattttaaagagcagaacattaagggtgagctgatgattttaacaaaaaaagaatcatctatttttctaaaaaaagcacttgataatgctttggaaaatctttaa

SEQ ID NO: 12126 - protein, 205 aa, Unknown
  Obtained from environmental sample
  misc_feature (1)..(205): Xaa is any amino acid
MKNLIELNEDEKDCLQELMNISYGAATAAISEIIGKFATLSIPNIDTISSCDLRKHLNEKLLSKNKYYVSNQLVNGYLAGENIFIIDEISSINLAREFDLSDDEIDENEIKDIILEITNILSSATSGKLASLVDTSISFSAPHITKINSIDEFDKRFEGEYSHVIIISTELNFKEQNIKGELMILTKKESSIFLKKALDNALENL

SEQ ID NO: 12127 - DNA, 741 bp, Unknown
  Obtained from environmental sample
  misc_feature (1)..(741): n is a, c, g, or t
ttgaaggtggaaaggggtgtccttggaaatacacactttaaaaattcaagaaaccaaacaccaacatatgcacaaccaggacttatgggtgaaaaaagacttgtaagattagagttaaaacttattgcggatgttggtgttgttggatatccaaatgttggaaaatcaacacttatctcaacaatatcaaatgcaaaacctcaagtggcaaattatgagtttacaacacttactccaaagcttggggttgttgaagttggagattataactcttttgtggcagctgatattcctggaattatagagggtgctgcagaagggcgaggtttagggattgagtttttaaaacatattgaaagaacaaaaacacttctttatatgatagatatggcaaatcatagagagatgttagatcaatataatgtattacaagaggaagttgagaagttctcaccggaattagctagtagaaaatttgcaattgcgttaacaaaaatagatgcaataccacaagaagaactcaatgaaaaagttgaaggttttataaaatcaataggcttagagacaacaaaagaaaatagttttgcttttgacaaagacaaaagttattttcttcaagatttgacatataatagatatgatgaaaatttaccatattttgtattaccaatatcatcggctactaaacaaaatattgaacctattaaatttgcattatatgatttaataagtagggactaa

SEQ ID NO: 12128 - protein, 246 aa, Unknown
  Obtained from environmental sample
  DOMAIN (1)...(169): GTP1/OBG family
  misc_feature (1)..(246): Xaa is any amino acid
MKVERGVLGNTHFKNSRNQTPTYAQPGLMGEKRLVRLELKLIADVGVVGYPNVGKSTLISTISNAKPQVANYEFTTLTPKLGVVEVGDYNSFVAADIPGIIEGAAEGRGLGIEFLKHIERTKTLLYMIDMANHREMLDQYNVLQEEVEKFSPELASRKFAIALTKIDAIPQEELNEKVEGFIKSIGLETTKENSFAFDKDKSYFLQDLTYNRYDENLPYFVLPISSATKQNIEPIKFALYDLISRD

SEQ ID NO: 12129 - DNA, 612 bp, Unknown
  Obtained from environmental sample
  misc_feature (1)..(612): n is a, c, g, or t
atgtttaacactaaatttattgcgatgaaaaaacttatccttttactgtttctggcttctattttggtacagcctatttttgcaaacacaaacaactctgacgaaaaaattgaattgactcctaaaattaaaaaaggggatagttggaatatggtaactaatgctcatgatttatctaaatattctgatatcccaaccagtaagaatgtgaagttagcttctccaagctcacatcaaacaaagacaaactggaaagttacttgtatggatgttgatgaaaatagtttgcttttaaagtttaaactggttagcctctctgaatatgatagacttgtgtttgagggtgaagacccaatatcctattacaataattcagactacccaattaatctcagtgaagatcatacagaacaaattaataagattcttggcaaatctttttcatttattattccatttgatgctaataagaaaatagaattaatcgagaatgaatttgaaagtaaaaaactagttctgccagtaatgacatttcaatcaaaggagaaaagctatttcagtataagttaccaaccaaatagttattttgcctggaggaccatttgtgattga

SEQ ID NO: 12130 - protein, 203 aa, Unknown
  Obtained from environmental sample
  misc_feature (1)..(203): Xaa is any amino acid
MFNTKFIAMKKLILLLFLASILVQPIFANTNNSDEKIELTPKIKKGDSWNMVTNAHDLSKYSDIPTSKNVKLASPSSHQTKTNWKVTCMDVDENSLLLKFKLVSLSEYDRLVFEGEDPISYYNNSDYPINLSEDHTEQINKILGKSFSFIIPFDANKKIELIENEFESKKLVLPVMTFQSKEKSYFSISYQPNSYFAWRTICD

SEQ ID NO: 12131 - DNA, 849 bp, Unknown
  Obtained from environmental sample
  misc_feature (1)..(849): n is a, c, g, or t
ttgctggtcctggtcgtcacgaaaattattttattgcagatatacaaagcatatggttgctggtatatattttttcaaaaagaaaagtttcatttggttttatctgttactcctaaagctggattggtttctagtatagcttcttttttggcaggcataaaaaatagaattcatttttttacaggacaagtatgggttacaaaaaaaggtatttttagatttatattaaaatctattgataagctaatagcaacacttaatacaaataacttaatagatagtcattctcaaaaagaatttttgattaaagaaaatgtcattttagaaaagaaagctaaaatccttttatctggatctatttcaggagtagatatagataaattttgtattaataatgaaatgaaaatacaactacaaaagaaatatcaattaaataataatgagattgtttttatgtttattggcagattcaatatagataaaggtattttagatttagttgcagtatttgaagatttatttaaagaatatagtaatattaagctttttttaattggtcctgatgaggggaatattgaaaatgaaatttctaattttttagagaatgaaaatgtaattcggattgattatgtatctaatccacaagagatattaaatattgcagatattcttgtcctccctagttatagagaaggttttggtacaatagtaattgaagctgctgcaatgggaatagcttgcataggtagtaatatttatggcttaaaagatgctattgtggataataaaacaggactacttcacgaagtaaaaaataaagaagatatgaagaaaaaaatttatcaataa

SEQ ID NO: 12132 - protein, 282 aa, Unknown
  Obtained from environmental sample
  DOMAIN (135)...(282): Glycosyl transferases group 1
  misc_feature (1)..(282): Xaa is any amino acid
MLVLVVTKIILLQIYKAYGCWYIFFQKEKFHLVLSVTPKAGLVSSIASFLAGIKNRIHFFTGQVWVTKKGIFRFILKSIDKLIATLNTNNLIDSHSQKEFLIKENVILEKKAKILLSGSISGVDIDKFCINNEMKIQLQKKYQLNNNEIVFMFIGRFNIDKGILDLVAVFEDLFKEYSNIKLFLIGPDEGNIENEISNFLENENVIRIDYVSNPQEILNIADILVLPSYREGFGTIVIEAAAMGIACIGSNIYGLKDAIVDNKTGLLHEVKNKEDMKKKIYQ

SEQ ID NO: 12133 - DNA, 636 bp, Unknown
  Obtained from environmental sample
  misc_feature (1)..(636): n is a, c, g, or t
atgataaatagatttagagttataagatattctatgcctaatgcgaatgcttgtgattttaaaatactgatagatattctagccgattttgttaaagagagctgtgagaactgtttttccataaaaaatacaatagaagaaacatttcctgtcactgagttttgcttgaatgaaagcaacgaatttcagatagagtttgagcatatggacggttctgttcatgttgaacgttttgagaaatcttctagcattgcagtttcggaacagatatctatttctaatttttatgacattatgaaaaatcatataaagcaaattgatcacactgggatagtgttttttgaaaatcatctgaaatatcaagaatggttggggtttattggtaaagtttctcaatattctaatttatataaatatccagaaaatcaagattggccatttgtacttccttcaacgagcgaagaatttttatcagatattaaagatttttctaatctgaggcagcccaaatttgagattgtgtatgttaaggataaaggtgaacttgtaatacaaatagatgttaaaacagaccttacaagaaaagagttagaaaggcttttccctcaccctgttggtaaacatttgatggcttag

SEQ ID NO: 12134 - protein, 211 aa, Unknown
  Obtained from environmental sample
  misc_feature (1)..(211): Xaa is any amino acid
MINRFRVIRYSMPNANACDFKILIDILADFVKESCENCFSIKNTIEETFPVTEFCLNESNEFQIEFEHMDGSVHVERFEKSSSIAVSEQISISNFYDIMKNHIKQIDHTGIVFFENHLKYQEWLGFIGKVSQYSNLYKYPENQDWPFVLPSTSEEFLSDIKDFSNLRQPKFEIVYVKDKGELVIQIDVKTDLTRKELERLFPHPVGKHLMA

SEQ ID NO: 12135 - DNA, 561 bp, Unknown
  Obtained from environmental sample
  misc_feature (1)..(561): n is a, c, g, or t
atgttagattcgaaagtagcatcaagatatgctaagtctttactagacttaggaaaagagcaaaatgctttagaaaccttgattaaagatatgactttaatcaaagaggtatgtaatgaaaatcctgaatttatgactttacttaaaagccctgttataagaggtgataagaaaagagcaattattaaagaggtgttctacaattcatttaactctgaagtaacaaaagctttcgtagaaatcattataagaaaaaaaagagaatcaattctttatgctattgctgtttcttttattagtttgtacaaaaagcatcacaatataaaaatagcaaaagtaactactgcacttccggggggtgccgagcaaaaacaaagtattattgctcaaatcgataaaacagaaaaagctacaatagaattagaagaagtagtaaataaagatataattggtggtttaattctaagaatagaagataaacaattggacgaaagcatcagaagaaaactcttaaatttagagatggaatttgatgacaacccttatgtaaaagaatattaa

SEQ ID NO: 12136 - protein, 186 aa, Unknown
  Obtained from environmental sample
  DOMAIN (6)...(177): ATP synthase delta (OSCP) subunit
  misc_feature (1)..(186): Xaa is any amino acid
MLDSKVASRYAKSLLDLGKEQNALETLIKDMTLIKEVCNENPEFMTLLKSPVIRGDKKRAIIKEVFYNSFNSEVTKAFVEIIIRKKRESILYAIAVSFISLYKKHHNIKIAKVTTALPGGAEQKQSIIAQIDKTEKATIELEEVVNKDIIGGLILRIEDKQLDESIRRKLLNLEMEFDDNPYVKEY

SEQ ID NO: 12137 - DNA, 480 bp, Unknown
  Obtained from environmental sample
  misc_feature (1)..(480): n is a, c, g, or t
atggcaatagaatcttatttttgttctatggaaacagacacattaacgttaaatgatattatttcagaaagtctaaataatagtatgacttattctgaatacagaaacttagttataaaattagttgaagaaaaatcaactactggtaacgacaaatcggaagcgttcgttgaatatactcagcttaatgacagacgcatgagacgttgggataaaaccggaaaagttgctgaagacatgaaaaccaagattgaaaactttgataaaaaagttacttggttagtaatttctgaaagttggtgtggtgatgctgctcatattatgcctattattaataaagtggctgagcttaatgataacattgattacaaaatagtcttaagagatgaaaatgaagctctcatgaaccaatttttaactaatggaggtcaatcaattcctaaattaattatgctcgattctgagacctttgagttctaa

SEQ ID NO: 12138 - protein, 159 aa, Unknown
  Obtained from environmental sample
  misc_feature (1)..(159): Xaa is any amino acid
MAIESYFCSMETDTLTLNDIISESLNNSMTYSEYRNLVIKLVEEKSTTGNDKSEAFVEYTQLNDRRMRRWDKTGKVAEDMKTKIENFDKKVTWLVISESWCGDAAHIMPIINKVAELNDNIDYKIVLRDENEALMNQFLTNGGQSIPKLIMLDSETFEF

SEQ ID NO: 12139 - DNA, 345 bp, Unknown
  Obtained from environmental sample
  misc_feature (1)..(345): n is a, c, g, or t
atgtttgaagttccgtatataaataaaaagctcttccttcaagatgcaagaaaaatcgttccttcacttagtgatgaagatatttcatatgcaaaaggttttggtggagtcagaccacaaatccttgataagaaaaacaaaaaacttatgcttggtgaggcttcaataaatacaggtgaaggaattatttttaatatgacaccttctcctggtgctacatcttgcttgggaaatgccgttcgtgatgttgaagcaatatgtgagtatttgggattaacatttgacaaagaacactttgaaaatgagttggtagaagaacagccaatgcaaggagataacatatga

SEQ ID NO: 12140 - protein, 114 aa, Unknown
  Obtained from environmental sample
  misc_feature (1)..(114): Xaa is any amino acid
MFEVPYINKKLFLQDARKIVPSLSDEDISYAKGFGGVRPQILDKKNKKLMLGEASINTGEGIIFNMTPSPGATSCLGNAVRDVEAICEYLGLTFDKEHFENELVEEQPMQGDNI

SEQ ID NO: 12141 - DNA, 717 bp, Unknown
  Obtained from environmental sample
  misc_feature (1)..(717): n is a, c, g, or t
ttggctagatatcaacatcaaagactacaatttttatcacaaaataatcttttgacaccgttttatcaagaagtgtttaaaggtgtttatggtgtgggtatagctatgtcaatatggcaatcatcttggacaaaacttattatcaatggagttaacaaagatttgcttgctaaatttgataatgatgatgaaaaagttatagagtttcttgaagaaaataatctctttgacaaagggcatgatggacttacagcagatagaagttactctatgcttgtaaaagaaaatggtagctataaaagtgctgcatatatcactgcttttaaaaaagaggtaactgctgttattgatgcgcttgaagagtttgttgatagtttaatagaacttgaagatgaagtatataatcaaaaatgggaatatatccactaccttcaagcaatcatcacagcatttagtgaaagaagaactgagatgttagtttcaaaatgggctgatgtggatagtgcttggatgaagattacaactcctatacaaattggtcatccactagagtattatgaagatcattttagaaaagctgtagcactagaatgggatataagacttgttaatccatccatacaaaataacaatcaaagggtagaaaaaatcaaagctatgtttagtgagctttttgaaactattaaacaaaacaatgatgaaaaaagtantttatga

SEQ ID NO: 12142 - protein, 238 aa, Unknown
  Obtained from environmental sample
  misc_feature (1)..(238): Xaa is any amino acid
MARYQHQRLQFLSQNNLLTPFYQEVFKGVYGVGIAMSIWQSSWTKLIINGVNKDLLAKFDNDDEKVIEFLEENNLFDKGHDGLTADRSYSMLVKENGSYKSAAYITAFKKEVTAVIDALEEFVDSLIELEDEVYNQKWEYIHYLQAIITAFSERRTEMLVSKWADVDSAWMKITTPIQIGHPLEYYEDHFRKAVALEWDIRLVNPSIQNNNQRVEKIKAMFSELFETIKQNNDEKSXL

SEQ ID NO: 12143 - DNA, 570 bp, Unknown
  Obtained from environmental sample
  misc_feature (1)..(570): n is a, c, g, or t
atgaaattaaaaatcgcacaattagaggatatagaggatgttttaaaacttcactataagtatcaagtagattctataaaagaggaagacaaaaaagatggttttgtgacaacaccatttacaaaagagcaactaacaaaattgatacaagaggagcaggggctatttatagcacttcaaggtgatgaagtggtagcttatgttatggctgcatcatggcagttttggtctgcttggccaatgtttgcacatatgataaaagatttaccaaatttagaatatcttggagaaactttgagtgtggagaactcctatcaatatggaccaatctgtatagataaaagtgtaagaggaacaactgctttaaaagagatatttaattttgctagagttgagatggcaaaacgctatccaatacttgtaacatttatcaataaaataaatccacgatcatatgaagcacatacaagaaaactaggactagaagtgatacaagagtttacttataacaacaatcactattatgagttggtttatgatacttctaaagaagttgaagagataaggtag

SEQ ID NO: 12144 - protein, 189 aa, Unknown
  Obtained from environmental sample
  misc_feature (1)..(189): Xaa is any amino acid
MKLKIAQLEDIEDVLKLHYKYQVDSIKEEDKKDGFVTTPFTKEQLTKLIQEEQGLFIALQGDEVVAYVMAASWQFWSAWPMFAHMIKDLPNLEYLGETLSVENSYQYGPICIDKSVRGTTALKEIFNFARVEMAKRYPILVTFINKINPRSYEAHTRKLGLEVIQEFTYNNNHYYELVYDTSKEVEEIR

SEQ ID NO: 12145 - DNA, 390 bp, Unknown
  Obtained from environmental sample
  misc_feature (1)..(390): n is a, c, g, or t
atgaaacaaatagagttttatgaaataaagttaaagtatgagattgactcttgggatttaaatgatgggttaaaaaatggtgaagatattattgtaattgacgcaagagcaaatgaagcctacgcttttgagcatattcaatcagccataaatattccccatcgaacaatgacagaagaaaatacaaaaacactcaataaagatactctttatgtaacttattgtgatggaatagggtgtaatgcttcaacaaaaggtgctttgaatcttgcaaagttaggctttaatgtaaaagagttacttggtggtttagattggtggaaaagagacggttatccaacagatggtaaacaatcattagaaactaaaagtaatatttgtggttgttag

SEQ ID NO: 12146 - protein, 129 aa, Unknown
  Obtained from environmental sample
  DOMAIN (20)...(110): Rhodanese-like domain
  misc_feature (1)..(129): Xaa is any amino acid
MKQIEFYEIKLKYEIDSWDLNDGLKNGEDIIVIDARANEAYAFEHIQSAINIPHRTMTEENTKTLNKDTLYVTYCDGIGCNASTKGALNLAKLGFNVKELLGGLDWWKRDGYPTDGKQSLETKSNICGC

SEQ ID NO: 12147 - DNA, 405 bp, Unknown
  Obtained from environmental sample
  misc_feature (1)..(405): n is a, c, g, or t
atggcctttttacttttcggtgaaaggtatgttttatttgagttttcctttgtctctattccgcataatgtagatcaattaatctttgactttaaaaaaaataattatactccaatcttagcacattacgaacgttatccttatttatttgaaaagggatctgagtatgttcagcatttaaaagataaaggattaaagattcagttgaatttaaattcacttacaggtcattatggaaaggctatccagaaacaagctgagatgctgattgataataaattggttgatttagttggaacagactgtcaccgaatcgaacaccttaatatcttggagtcaaacttgaaaggtgattattttcataaactatctgatttagatctattaaataggaagctttcttag

SEQ ID NO: 12148 - protein, 134 aa, Unknown
  Obtained from environmental sample
  misc_feature (1)..(134): Xaa is any amino acid
MAFLLFGERYVLFEFSFVSIPHNVDQLIFDFKKNNYTPILAHYERYPYLFEKGSEYVQHLKDKGLKIQLNLNSLTGHYGKAIQKQAEMLIDNKLVDLVGTDCHRIEHLNILESNLKGDYFHKLSDLDLLNRKLS

SEQ ID NO: 12149 - DNA, 621 bp, Unknown
  Obtained from environmental sample
  misc_feature (1)..(621): n is a, c, g, or t
atggttggttattctccagaaagaattaatccaggagataaggttcacacacttcaaagtgtagtgaaagttgtttctggatgttgtgatgaatcgctggataatattgctaagatttatgaattagttgttacagcaggtgtacatagagcaagtacaataaaagttgctgaagcggctaaaataatagagaatacgcagcgagatgtaaatatttcattgataaatgaattgtctattatatttaataaactaggaataaatacttatgacgtgcttgctgcagctggaactaagtggaatttcttgaagttcacacctggtttagtgggaggacactgtatcggtgttgatccctattacctcacacacaaagctaagcaagccggatatcatgccaaggtaattaatagtgggcgttatgtaaatgactcaatgggtttctatataggaaaacaatgtgttaaaaagatgatcgctcagggaaagaatatgaatgacgcanaagttcttgttatgggaactacattcaaggaaaatgttagtgacattagaaactcgaaagttattgacgttatcaatgaattaaaatcattctctggtacatgtagacgcggttga

SEQ ID NO: 12150 - protein, 206 aa, Unknown
  Obtained from environmental sample
  DOMAIN (54)...(148): UDP-glucose/GDP-mannose dehydrogenase family, central domain
  misc_feature (1)..(206): Xaa is any amino acid
MVGYSPERINPGDKVHTLQSVVKVVSGCCDESLDNIAKIYELVVTAGVHRASTIKVAEAAKIIENTQRDVNISLINELSIIFNKLGINTYDVLAAAGTKWNFLKFTPGLVGGHCIGVDPYYLTHKAKQAGYHAKVINSGRYVNDSMGFYIGKQCVKKMIAQGKNMNDAXVLVMGTTFKENVSDIRNSKVIDVINELKSFSGTCRRG

SEQ ID NO: 12151 - DNA, 642 bp, Unknown
  Obtained from environmental sample
  misc_feature (1)..(642): n is a, c, g, or t
atgaagatattaaaagtacgcttactaaatataaactccctaaaaggggagttcgagatagattttgaaaagtttctaaaagatgagtctttatttgctatcactggaccaacaggtgcaggaaaaagtacgatactagatgtcatcacttgtgctatgtatggaagaactgcaagactgacaaatccaaatgaacttatgagccgtcatactggtgagtgcttatgtgaagtggagtttgaagtaaaaggtaaatcgtataggtcatcttggagccaaaaaagagctagaaataaagctgatggaaactttcaaagtgcaaagatggagatagtagacctagaagaaaatgagattttagaatcatacctttcaaaagtgccaaaggtagttgaagagatatcaggactagactttgctaggtttatacaatcaatgatgttagctcaaggttcgtttgatgcctttttaaaagcaggtgaaaatgaacgctcaacattactagaaaagatgacgggtacatatatctataagcaaatatcacaagagatttacgaaacatattcattaaagaaaaaagatatagaacttgatgaaaactctttagggaggtatagagttactagaaacctgagatggtaa

SEQ ID NO: 12152 - protein, 213 aa, Unknown
  Obtained from environmental sample
  DOMAIN (1)...(174): RecF/RecN/SMC N terminal domain
  misc_feature (1)..(213): Xaa is any amino acid
MKILKVRLLNINSLKGEFEIDFEKFLKDESLFAITGPTGAGKSTILDVITCAMYGRTARLTNPNELMSRHTGECLCEVEFEVKGKSYRSSWSQKRARNKADGNFQSAKMEIVDLEENEILESYLSKVPKVVEEISGLDFARFIQSMMLAQGSFDAFLKAGENERSTLLEKMTGTYIYKQISQEIYETYSLKKKDIELDENSLGRYRVTRNLRW

SEQ ID NO: 12153 - DNA, 882 bp, Unknown
  Obtained from environmental sample
  misc_feature (1)..(882): n is a, c, g, or t
ttgttgcgatttattgagagattaaaaaagttaaataagttaaaagaattaggaattaatccttatcctcaaattgttattaaaaataagtgtaaaattagtgattttttaaaaaattatgataaattagaaaatgaaaaagaagatacgaatgttgaaaaattagctggaagattagttagtcttagatctatgggaaatattgcttttggaaatttacaagatgaatttggtaaagttcaagttatttttcaaaaaaataatttatctaattataaaacattaaaatatttggatgttggtgatttaatttatgttaaaggaaatccttttagaacaaaaagaggacaattaagtcttaattctaaagaattagttttaactagtaagtcacttagacctttacctgaaaaatttcatggattaaaagatgaagaaactagattaagaactagagaattagatgctataactaatccagaagttattttaaaatttaaaaaaaaatctttaattattaaaacaattagagaattttttgatcaaaatgattttttagaagttcaaactccagttttacaaaccatgtatggaggagcaagtgctgaaccttttgttactcaccataatgctcaagatttagatttatatttacgaatagctcctgaattacatcttaaaagaatgatagtagctggatttgaaaaaatatatgaattaggaaataaatataggaatgaaggaatggataaaagccatttgcaaganattttagatttagaattttattgggcttatcaagattatgaaggtttgatgaaatttactgaaaaattatttacttatttattaaaaaaaattaatgggttcattaaaagttaa

SEQ ID NO: 12154 - protein, 293 aa, Unknown
  Obtained from environmental sample
  DOMAIN (144)...(292): tRNA synthetases class II (D, K and N)
  misc_feature (1)..(293): Xaa is any amino acid
MLRFIERLKKLNKLKELGINPYPQIVIKNKCKISDFLKNYDKLENEKEDTNVEKLAGRLVSLRSMGNIAFGNLQDEFGKVQVIFQKNNLSNYKTLKYLDVGDLIYVKGNPFRTKRGQLSLNSKELVLTSKSLRPLPEKFHGLKDEETRLRTRELDAITNPEVILKFKKKSLIIKTIREFFDQNDFLEVQTPVLQTMYGGASAEPFVTHHNAQDLDLYLRIAPELHLKRMIVAGFEKIYELGNKYRNEGMDKSHLQXILDLEFYWAYQDYEGLMKFTEKLFTYLLKKINGFIKS

SEQ ID NO: 12155 - DNA, 696 bp, Unknown
  Obtained from environmental sample
  misc_feature (1)..(696): n is a, c, g, or t
atggccgagaattttagggagaatcacaataaatcacaagcaattcaagctataaaaaatgcaaaagagattggctttgagcatattaactgcgacataatatatgacacaaaattagacactcaacaattactagaaaatgatttagtgatcatcaaagatttacctatagaccatattagtgcttatagtcttactatagaggaggggactaaattttttaataaaagtaatgtacaagtagaaaatatagaattagctcaatacctctttgatcaattaaactctttgggattcaatcaatatgagatatctaattttgctttaaataataaagctagaagtaaacacaaccttggatattggcaatataaagagtatttaggagttggaagtggagctgttggttgtatcgatgcccaaagactatattcatcaaaagatattcaaaaatatatagataatccacttcaatacgaagaggtagaaaaattatcatcagaagatattgcaatagaaaaaactcttctgggatttcgcagtattgtaggtgttacaatatcattgttcaataatgaacaaaaaaagaaacttaatgatttagtaaaagaaaaaaagttaatacaaaaaggaaacagagtctattcaaataattttatgttagcagatgaactaacactttatttggatttttag

SEQ ID NO: 12156 - protein, 231 aa, Unknown
  Obtained from environmental sample
  DOMAIN (119)...(220): HemN C-terminal region
  misc_feature (1)..(231): Xaa is any amino acid
MAENFRENHNKSQAIQAIKNAKEIGFEHINCDIIYDTKLDTQQLLENDLVIIKDLPIDHISAYSLTIEEGTKFFNKSNVQVENIELAQYLFDQLNSLGFNQYEISNFALNNKARSKHNLGYWQYKEYLGVGSGAVGCIDAQRLYSSKDIQKYIDNPLQYEEVEKLSSEDIAIEKTLLGFRSIVGVTISLFNNEQKKKLNDLVKEKKLIQKGNRVYSNNFMLADELTLYLDF

SEQ ID NO: 12157 - DNA, 372 bp, Unknown
  Obtained from environmental sample
  misc_feature (1)..(372): n is a, c, g, or t
atgagattattattactactttctcttcttgtatatactgtttttgctgatagtgatgaagaaaaacatcatcactactatagtaaagatttaacatacttaaatttaaatcatgatcaaaagaaaagcctcaaacatattttaaaaagtatagaaaaaatattaaacattatagagaaaaaaaaagaagattttattgaacagaagcaagagatatttttagaaaatgattttaatattacaaaaattagaagattaaatccaaaaaatatcaaaaaatccacagatttagagatagaagttttaaaacaaatacctactcttttatctaaagaacaccgaaaaaaatttatcccaaatattgatggaagg

SEQ ID NO: 12158 - protein, 124 aa, Unknown
  Obtained from environmental sample
  SIGNAL (1)...(16)
  misc_feature (1)..(124): Xaa is any amino acid
MRLLLLLSLLVYTVFADSDEEKHHHYYSKDLTYLNLNHDQKKSLKHILKSIEKILNIIEKKKEDFIEQKQEIFLENDFNITKIRRLNPKNIKKSTDLEIEVLKQIPTLLSKEHRKKFIPNIDGR

SEQ ID NO: 12159 - DNA, 603 bp, Unknown
  Obtained from environmental sample
  misc_feature (1)..(603): n is a, c, g, or t
gtgattaataaaaatgcacagtatctctctacaacaatagatgattttagaaactatattaaaggggatagagagaaaaaagtttttaatctcaaaaaagatattaatagttttatccatcttgtagagggttcaattcataaatataatataaatatagttttggatttagatgaatctatagagattaatggatatgaaaatgaacttacccagtgttttatcaatattttcaataatgctaaagatgttttagtagagatagaaaatagttctgaacgatatttgtttatatctacaaatatagaaaatgatagagtgctaataaaaattaaagataatggtggtgggatacaagaagatataatgccaaaaatatttgaaccatatttcaccactaaacatcaatctcaaggtacaggacttggtcttcatatgacttatagtcttatagttgaggggatgaatggtactattgaggcaaaaatatttgttttgattatgaaagataaaaactataatggagtagagattaccatacccctttccatgctgagtaggtttaaaaaaaacagttcccttttgtggaccaatcgagcttaa

SEQ ID NO: 12160 - protein, 200 aa, Unknown
  Obtained from environmental sample
  DOMAIN (65)...(183): Histidine kinase-, DNA gyrase B-, and HSP90-like ATPase
  misc_feature (1)..(200): Xaa is any amino acid
MINKNAQYLSTTIDDFRNYIKGDREKKVFNLKKDINSFIHLVEGSIHKYNINIVLDLDESIEINGYENELTQCFINIFNNAKDVLVEIENSSERYLFISTNIENDRVLIKIKDNGGGIQEDIMPKIFEPYFTTKHQSQGTGLGLHMTYSLIVEGMNGTIEAKIFVLIMKDKNYNGVEITIPLSMLSRFKKNSSLLWTNRA

SEQ ID NO: 12161 - DNA, 648 bp, Unknown
  Obtained from environmental sample
  misc_feature (1)..(648): n is a, c, g, or t
atgttatcaaccaatatcccgagaaagttcgcgggggttgtttccgaatatgatagtggaatttatacagaagtgaataaaggattttttatctcaaaaggcgaaataattggtattctcaatgccgatgattattattttgaaaatactctgaaacaagttgttgaaatttttttaacttctcaatctgacattgtttacggtaacatggtaaagctgcggaccattcaaaataaagattacctgaaagaagttgctccaaacatttcacttatggaaagaacaatgcctattttccatcccgctacttttgtaaaaaaaacagtgtatgaaaaaataggcaacttcaacgaaaagtataagttgtctgccgattatgattttatataccgagcctacaaaaacaacataaattttgaatatactcctcaaccactaacggtttttagagtagatggtattagcagtattaattgccaatcttacaaagaaggctacaaaatacttgtttcgcacggatctccttacgataaagaaatgaagcgattagtgttgaaatggaaaattaaaaccctttttaggatgatagtttatttctttattcgcatatttggattaaccaaacggacacaagaaaagattgattaa

SEQ ID NO: 12162 - protein, 215 aa, Unknown
  Obtained from environmental sample
  misc_feature (1)..(215): Xaa is any amino acid
MLSTNIPRKFAGVVSEYDSGIYTEVNKGFFISKGEIIGILNADDYYFENTLKQVVEIFLTSQSDIVYGNMVKLRTIQNKDYLKEVAPNISLMERTMPIFHPATFVKKTVYEKIGNFNEKYKLSADYDFIYRAYKNNINFEYTPQPLTVFRVDGISSINCQSYKEGYKILVSHGSPYDKEMKRLVLKWKIKTLFRMIVYFFIRIFGLTKRTQEKID

SEQ ID NO: 12163 - DNA, 348 bp, Unknown
  Obtained from environmental sample
  misc_feature (1)..(348): n is a, c, g, or t
ttgcaacttgtattgatgaagagttttgtacaactggaaaaacccaaacaacaatggagttataagatggaatttgtcgtaatatttttagcaacactcgtagtagcctatatagttttaagaaaaacgaatcataaaatcaaacaaacagctgttaagaaaaatgagataattgaacagtatgaatcagaattaaaagcactaattgaacaatataaagatgataaaatcacacaactagaacaaaaaaaacgatttttaaaacagtgcaatgatgagctttctagaaatatattttttacaaatgaagaatcatcaataatcatcaaaaggttagctgaaatttga

SEQ ID NO: 12164 - protein, 115 aa, Unknown
  Obtained from environmental sample
  misc_feature (1)..(115): Xaa is any amino acid
MQLVLMKSFVQLEKPKQQWSYKMEFVVIFLATLVVAYIVLRKTNHKIKQTAVKKNEIIEQYESELKALIEQYKDDKITQLEQKKRFLKQCNDELSRNIFFTNEESSIIIKRLAEI

SEQ ID NO: 12165 - DNA, 741 bp, Unknown
  Obtained from environmental sample
  misc_feature (1)..(741): n is a, c, g, or t
ttgtggctcggtaaatgtgttgttggactaagcggaggtttagactctgctgttgtagcagttttggcaaaaaaagcatttggtgatggattgttgtgtgtaaagatgccatcacactactcatcgcaatctagtctgaatgatgcgaaagagttgtgtgaaacttttaagattaactcaattgtcaaagatatctcaccatatttaaaaatttatgaagatcaagaagagtcaaataatttacgtaaaggtaatttcagcgcacgtatcagaatggtaacactatatgatatttcagccatcagatcagcgttggtgctaggtaccagtaataaaagtgaactgatgcttggttatggtactatatttggggatttagcttcagcgctgaaccctattggagatctctataagagtgaagtttttgaacttgctgaatatctaggtgttcctaaaagtatcataaataaacctccttcagcagatttgtgggaaggtcaaagtgatgagaaagagataggttatacttatgcgcagatagactctatttttcaaaaatatattgaagagcgaataagtcgtgaagagttagttaaaaatggtgaagatgagaagttagttgatatgcttatatctaaaatatatgcaaatcactttaaacgtaaaatgcctgtaattgcaaaacttacatctagaactatagggcatgattttaattatcctagagatataacgaaatag

SEQ ID NO: 12166 - protein, 246 aa, Unknown
  Obtained from environmental sample
  DOMAIN (4)...(244): tRNA methyl transferase
  misc_feature (1)..(246): Xaa is any amino acid
MWLGKCVVGLSGGLDSAVVAVLAKKAFGDGLLCVKMPSHYSSQSSLNDAKELCETFKINSIVKDISPYLKIYEDQEESNNLRKGNFSARIRMVTLYDISAIRSALVLGTSNKSELMLGYGTIFGDLASALNPIGDLYKSEVFELAEYLGVPKSIINKPPSADLWEGQSDEKEIGYTYAQIDSIFQKYIEERISREELVKNGEDEKLVDMLISKIYANHFKRKMPVIAKLTSRTIGHDFNYPRDITK

SEQ ID NO: 12167 - DNA, 420 bp, Unknown
  Obtained from environmental sample
  misc_feature (1)..(420): n is a, c, g, or t
ttgaaaattataaaaaatattttcactattgtttttttaactttaacagtaatgtatgcaaataccaatagtggacaaattgaaactaagataaatagtttagaaaaacccttatacaacccatttgtggaaaactatatattgcatgaattaaaaactcttcgaaatgaaaatagagatttaaaagttgaacttcatgagacattagcaaaaaaagaggtagagatatctaacaatgctattagttatgcgacagcaactattaataatatgttttatattttagcagctgctacatcactacttgtaataattggatggacatctatacgagatatgaatgataaaataaaacatatagttgaccaaagagtatcaaaagttattgatgattatgaaacaaagaatgagtatagttga

SEQ ID NO: 12168 - protein, 139 aa, Unknown
  Obtained from environmental sample
  misc_feature (1)..(139): Xaa is any amino acid
MKIIKNIFTIVFLTLTVMYANTNSGQIETKINSLEKPLYNPFVENYILHELKTLRNENRDLKVELHETLAKKEVEISNNAISYATATINNMFYILAAATSLLVIIGWTSIRDMNDKIKHIVDQRVSKVIDDYETKNEYS

SEQ ID NO: 12169 - DNA, 738 bp, Unknown
  Obtained from environmental sample
  misc_feature (1)..(738): n is a, c, g, or t
atgctcagagcagatgaattagtttctatgggggagatgataggaaatattgctcatcaatggagacaacctttatccataattaccacaagtgctagtggattaaaaatgcaatcaacggtaaaagatataacaaaaaatgatatcgaaaaagtttctgatttaattgtccaacaagcacagtatctctcagaaacaattgataactttagaaacttcataaaaggtgatgatggttataaaccaacaagtattaaaaaaacaattgaagaaactttaaatttagtaaatgccacaattaaaaacaattatataaatctgattttaaatatagaggatgatataactatcaatggaaataaaaatgaacttattgaagcatttataaacatcataaataatgcaaaagatgtactcaaagaaaaagttcaagctcaagaggatagactattgtttattgagacaaataagatagatgataaaactataaagatcactattaaagatagtggtggaggtattaaagcaaacataattgatagaatctttgaaccatactttaccacaaaacatcaatcagtggggacaggactaggtctttcaatgaccgataaaatcatacgagaaagacacaaaggaaatatcactgtaaaaaatgtagaatatatctacaatgataaaaactataaaggttgttgttttactatagtttttacagcgcctcctacaaagaattga

SEQ ID NO: 12170 - protein, 245 aa, Unknown
  Obtained from environmental sample
  DOMAIN (9)...(79): His Kinase A (phosphoacceptor) domain
  misc_feature (1)..(245): Xaa is any amino acid
MLRADELVSMGEMIGNIAHQWRQPLSIITTSASGLKMQSTVKDITKNDIEKVSDLIVQQAQYLSETIDNFRNFIKGDDGYKPTSIKKTIEETLNLVNATIKNNYINLILNIEDDITINGNKNELIEAFINIINNAKDVLKEKVQAQEDRLLFIETNKIDDKTIKITIKDSGGGIKANIIDRIFEPYFTTKHQSVGTGLGLSMTDKIIRERHKGNITVKNVEYIYNDKNYKGCCFTIVFTAPPTKN

SEQ ID NO: 12171 - DNA, 333 bp, Unknown
  Obtained from environmental sample
  misc_feature (1)..(333): n is a, c, g, or t
gtgattgatgagagtgatgagataacttatatagttcaaagttcatttgatatgagtagagaagtaactcttaaaaaagcaaaaataaagagtagtgaagtagagttagattatgaccactctttgacatatgctcaactgaatatcaacacttcaaatcagcttggacttttggcttttattgtaagtgcgtttgataaagagaatataaatatagcaactgctaaaatacacaccactaaaaatagagctcgtgatcactttctaatagagaaagcacaaaactcacaagaagatttactaaaagttataaaagaacttacagaggattaa

SEQ ID NO: 12172 - protein, 110 aa, Unknown
  Obtained from environmental sample
  misc_feature (1)..(110): Xaa is any amino acid
MIDESDEITYIVQSSFDMSREVTLKKAKIKSSEVELDYDHSLTYAQLNINTSNQLGLLAFIVSAFDKENINIATAKIHTTKNRARDHFLIEKAQNSQEDLLKVIKELTED

SEQ ID NO: 12173 - DNA, 537 bp, Unknown
  Obtained from environmental sample
  misc_feature (1)..(537): n is a, c, g, or t
atgtgcggaatagtcggttacttaggtaataaaaatataaaaaatatacttctagatggcttaaaagagttagagtaccgcggatatgattctgcgggaatagcaattttagaaaatagtaacttctcactctataaagcagttggaaaactaaaaaatcttgaagagaagatgaaagagtatgagagccttgacttttgtattggtattggtcatacaagatgggcaacgcatggaaagccgacagaacttaatgcacatccccatatcggtgagagtacttatatcgttcataatggaattatagagaactatcaggagctaaaaaactcactgctgaatgatggagtaaaatttttatctcaaacagatactgaagttattgttcatctgtttgagagagaattaaaaagtataaaagatccttttgaagcttttcaatctacactaaaacaactccatggaacatacgcactgctgttaatcacaaaaagtgagagtgaaaaaatcttttatgccaaaacacgaatcacctaa

SEQ ID NO: 12174 - protein, 178 aa, Unknown
  Obtained from environmental sample
  DOMAIN (2)...(134): Glutamine amidotransferases class-II
  misc_feature (1)..(178): Xaa is any amino acid
MCGIVGYLGNKNIKNILLDGLKELEYRGYDSAGIAILENSNFSLYKAVGKLKNLEEKMKEYESLDFCIGIGHTRWATHGKPTELNAHPHIGESTYIVHNGIIENYQELKNSLLNDGVKFLSQTDTEVIVHLFERELKSIKDPFEAFQSTLKQLHGTYALLLITKSESEKIFYAKTRIT

SEQ ID NO: 12175 - DNA, 792 bp, Unknown
  Obtained from environmental sample
  misc_feature (1)..(792): n is a, c, g, or t
gtgattcaaatacttgagcgttcaaatcatagtattctttgttttgtaaaaaattcgaatctttatacagtaaaagaaaatgcttttatagattgtgaggttgtaaacaatagagatggggatattgttctttttgaaaaaggaaaaatcatcaaagtatttggaaatatcgctgatgcttcaattgatgaaaaaatatctttgtatctttataatgagttttatagactagacccaatggagtctttagagtttaataaacttgataattctaatagagttgacttaactcatcttgatttttgtactattgatccagtaagtgcaaaagattatgatgatgcaatctattatgatcaaaaggcacaagaactctatgtagcaatagcagatgtaagtgcctatgtacaagagggaagcgaactagacttggaagcttataaacgatcttttacagtgtatcttccaaataagatgcttccaatgcttccatttgaactaagtactgatttatgttctcttgtaccaaatgaagttagacccgcctatgtatttaaaatgaagttggatattaaaaatcaaacagtaatacaaagttctgtttttgaagcactcattgagtcaaaaaatagatacacttatgaatatatagatgaagttattgaggaaaataatccaaatcatccacaagtaaaactctatgagattacaaaaaaatttcgagaaaagagacttaaaaagggtatgacttttaaaagtgatgaaatttcctctcatcctaagatgaaggaa

SEQ ID NO: 12176 - protein, 264 aa, Unknown
  Obtained from environmental sample
  DOMAIN (24)...(264): RNB-like protein
  misc_feature (1)..(264): Xaa is any amino acid
MIQILERSNHSILCFVKNSNLYTVKENAFIDCEVVNNRDGDIVLFEKGKIIKVFGNIADASIDEKISLYLYNEFYRLDPMESLEFNKLDNSNRVDLTHLDFCTIDPVSAKDYDDAIYYDQKAQELYVAIADVSAYVQEGSELDLEAYKRSFTVYLPNKMLPMLPFELSTDLCSLVPNEVRPAYVFKMKLDIKNQTVIQSSVFEALIESKNRYTYEYIDEVIEENNPNHPQVKLYEITKKFREKRLKKGMTFKSDEISSHPKMKE

SEQ ID NO: 12177 - DNA, 852 bp, Unknown
  Obtained from environmental sample
  misc_feature (1)..(852): n is a, c, g, or t
ttgtcgctgagtaaagagaagagggagtgctacaatattgatatagaagttgaagatatagatagacaagagcttttagaaagtgatgatagggtagaaaagatagttgaatatatcttggcaaatcatggaagaaaaacacatagtaaagattttactggtatgatgtgtgtaagtagtgttgagatgcttatgaagtattatgaaacctttaagcaaaaagaacacaagctaaaaatagcaacaatcttttcatatagtgcaaacgaagaggataaagatgcaaatggtttgtatgaatcagacggcgctcatatagatgaaaatcatatcaacaaacacagccgtgaaaaacttgatgagtatatcgctgattataataagatgtttgggacaaaatacagcacaaaagatagcaagactttttataactactacaacgaactctcaaaaagggtaaaaaaaggtgaggttgatttacttcttgttgtaaatatgtttttaactggatttgatagtaaaaaactcaatactttatatgtggataaaagcttaaaatatcatggacttatacaagccttttcccgaacaaatagaatacttgatgagagaaaatcacaagggaatatagtctgctttagaaatatcaaaaaagccacagatgatgctatcgcacttttttcaaaaccagaagcaaaagatgtgatacttatgcaaccttatgaagagtatgttataaagttcaatgaggcttttataaatctgataaaaatagcaccaagtgttagtagtgtagatgctctaataagtgaagatgatagtttgagtttatcaaagcctttagagagctaa

SEQ ID NO: 12178 - protein, 283 aa, Unknown
  Obtained from environmental sample
  misc_feature (1)..(283): Xaa is any amino acid
MSLSKEKRECYNIDIEVEDIDRQELLESDDRVEKIVEYILANHGRKTHSKDFTGMMCVSSVEMLMKYYETFKQKEHKLKIATIFSYSANEEDKDANGLYESDGAHIDENHINKHSREKLDEYIADYNKMFGTKYSTKDSKTFYNYYNELSKRVKKGEVDLLLVVNMFLTGFDSKKLNTLYVDKSLKYHGLIQAFSRTNRILDERKSQGNIVCFRNIKKATDDAIALFSKPEAKDVILMQPYEEYVIKFNEAFINLIKIAPSVSSVDALISEDDSLSLSKPLES

SEQ ID NO: 12179 - DNA, 369 bp, Unknown
  Obtained from environmental sample
  misc_feature (1)..(369): n is a, c, g, or t
atgaacaaaataattactattatgatattaattatatcactattagtatttacaggatgtatatcaagtcattatcttcaagtaactacaaaaaataatcctttaaaaacaacatataatgctcaagatatatttgataaagtacaaaaatgttattacgaagaaaatagagagattctttttgaaaaacctaaaaatagcaactataaaaaaatacgaatttatgaagaatctaataacttttatcgattaattgcagtaattacaattttttcggataaagaaaaaacaattcatatcagtgaaaatttatctaaaaatctaaaaatttcagaatggatagaaaataatatggagtgtacactatga

SEQ ID NO: 12180 - protein, 122 aa, Unknown
  Obtained from environmental sample
  misc_feature (1)..(122): Xaa is any amino acid
MNKIITIMILIISLLVFTGCISSHYLQVTTKNNPLKTTYNAQDIFDKVQKCYYEENREILFEKPKNSNYKKIRIYEESNNFYRLIAVITIFSDKEKTIHISENLSKNLKISEWIENNMECTL

SEQ ID NO: 12181 - DNA, 399 bp, Unknown
  Obtained from environmental sample
  misc_feature (1)..(399): n is a, c, g, or t
atgataaattttgatttaataatatacatggagaaagttttagaaagagatggaacaagaccaatatcaataaataaagtacatgtaaataatactaactttggtttagaaaagtattcttatgtttcttcaaatacacaagactttttaatatcaacattaagttttatttgtatcttttcaaaaaaagatattataaaggacatggaggatttaagttattatcgtacttatctaaaccatacagactttataagtaatcctaataatatatattggatggatacttcttttaagcctaatattaaaactattaatagttttgaaaaaaagataaaaaaacttttttcattaaatattgaaaaatttgtacaagactatataaagtttaatgaataa

SEQ ID NO: 12182 - protein, 132 aa, Unknown
  Obtained from environmental sample
  misc_feature (1)..(132): Xaa is any amino acid
MINFDLIIYMEKVLERDGTRPISINKVHVNNTNFGLEKYSYVSSNTQDFLISTLSFICIFSKKDIIKDMEDLSYYRTYLNHTDFISNPNNIYWMDTSFKPNIKTINSFEKKIKKLFSLNIEKFVQDYIKFNE

SEQ ID NO: 12183 - DNA, 771 bp, Unknown
  Obtained from environmental sample
  misc_feature (1)..(771): n is a, c, g, or t
atgaaagatgctccaacaactcctgaagttctaaattcaaaagagtttttagagattgaagagactcctgcggttaatgaacaattatctacaacttattttataaaagctatatacctaatgacgttaagcacagcagataaagcggatataaacttaaaacatatagaacaaacttttaattatccatatttagatatatctaaaaattcatctggtacatttagcatagtaagacgtgtaaaaaatagtgaaaactcaagtagagtattatcagaggttaaaaaagattataaagatgcatggatggttgatacagcttctgtacctgccaataatagtcataatgaaactgaaaattcaactccatctaataaggtagatgagagtaaagagatgttagatataaatgaaacatacaaagatatcattaatgagtctaaagcgttgctagatgatttaaatatctcaatagaagatgagattgaacctattgttgatcaagctacacccaaccttaatgaatatgtgaataataaaattgatgatagtatagtaaatgaagagattatcataactgatgacataaatatatctgaaaaatcaccgacttatgaaggagataaagatattacatctatacaaagtgatgaaattttaccatcaaatgttcaagatgatatgtttataaaagctatctatatcatgactttaagtagtaaaaaatcagctcaaataatttttaaaaaatctgaaattatccacatttag

SEQ ID NO: 12184 - protein, 256 aa, Unknown
  Obtained from environmental sample
  misc_feature (1)..(256): Xaa is any amino acid
MKDAPTTPEVLNSKEFLEIEETPAVNEQLSTTYFIKAIYLMTLSTADKADINLKHIEQTFNYPYLDISKNSSGTFSIVRRVKNSENSSRVLSEVKKDYKDAWMVDTASVPANNSHNETENSTPSNKVDESKEMLDINETYKDIINESKALLDDLNISIEDEIEPIVDQATPNLNEYVNNKIDDSIVNEEIIITDDINISEKSPTYEGDKDITSIQSDEILPSNVQDDMFIKAIYIMTLSSKKSAQIIFKKSEIIHI

SEQ ID NO: 12185 - DNA, 897 bp, Unknown
  Obtained from environmental sample
  misc_feature (1)..(897): n is a, c, g, or t
atgatgggaaacaactttgcttatgtaaccaataagttagggcagtacaagatttatatttattataaggataatgataaaaagtataaaattttcaagaaagagttcaaattagacagagtaaatgatatttcttaccctgttttggcttggcacccagcaagtgaaatattatcttttgtaactgaagaaaaaggctttttaaaaatgtattatttcgacattaattctggtggactagaagtgaaagccttatttaacttagagaaagtaaccgcaatggattatcatgataatggcagagaaatggttttttcgggagttgctaaaggtcagtcagatttatatttatatacaataggttctaattctcagaaaaaaattaccaacgatttatttgatgatttggaacctcaatttatagaaaattcaacaaaaattattttcacatctaataggttaaccgattcattaggttatcagccagctaatttagagttgttttataataagagagatgtttggattttagattacctttcggaagacaaaaccctttcaagagttacagaatctactaaattctcagaaagtttaccttttggatatgattcagcagtatattacttaggagaagaaaatagagtgaacactcaatttagtgcagtaaaagatagttttattacacatattgatactactattcattatcatcatttttatgatgcaaagcctgcaaaaactatttttagtagaggaataaaagaacactttataaactctagaggtatttctactactgtgttagttgatgattttaaataccatttattatcaaacgacatcaatgaacctattattgatagtgttagtcaacagttacaaaatgactcataa

SEQ ID NO: 12186 - protein, 298 aa, Unknown
  Obtained from environmental sample
  misc_feature (1)..(298): Xaa is any amino acid
MMGNNFAYVTNKLGQYKIYIYYKDNDKKYKIFKKEFKLDRVNDISYPVLAWHPASEILSFVTEEKGFLKMYYFDINSGGLEVKALFNLEKVTAMDYHDNGREMVFSGVAKGQSDLYLYTIGSNSQKKITNDLFDDLEPQFIENSTKIIFTSNRLTDSLGYQPANLELFYNKRDVWILDYLSEDKTLSRVTESTKFSESLPFGYDSAVYYLGEENRVNTQFSAVKDSFITHIDTTIHYHHFYDAKPAKTIFSRGIKEHFINSRGISTTVLVDDFKYHLLSNDINEPIIDSVSQQLQNDS

SEQ ID NO: 12187 - DNA, 579 bp, Unknown
  Obtained from environmental sample
  misc_feature (1)..(579): n is a, c, g, or t
ttgaagaaaaacacagacatatcaacagaaaaagttgtaaaaaagtatcaacctaaaaaagataaaagcatgacggttattacaattgttattgctggtttttttattggaagtatgtggtgtgttgcttattatccttatactgtaattagtttttatgatttctctaaaatatttgcatttttagcagttattggttttttattaccattaaggctctatactaaatggtttcacttcactaagtacgaagccttcatctttaatttaatgggaatagctccttttatttgtgggagtttattgctaataaactattatttttacaccgctaagtttactcattattattttatagaagaatattttgtagaagagcaacgtaccattggaacacttggtattgaagctgaaagaaacctgattactggaaaatacaaaattaaagggcttacctaccctaatgaagatgattttatgaaacaaaattatttttatgaaattgaagtgcgagaaggaattttaggttttaaaacagtaaacagagatcttaatgtagctttacctgccgagcattaa

SEQ ID NO: 12188 - protein, 192 aa, Unknown
  Obtained from environmental sample
  misc_feature (1)..(192): Xaa is any amino acid
MKKNTDISTEKVVKKYQPKKDKSMTVITIVIAGFFIGSMWCVAYYPYTVISFYDFSKIFAFLAVIGFLLPLRLYTKWFHFTKYEAFIFNLMGIAPFICGSLLLINYYFYTAKFTHYYFIEEYFVEEQRTIGTLGIEAERNLITGKYKIKGLTYPNEDDFMKQNYFYEIEVREGILGFKTVNRDLNVALPAEH

SEQ ID NO: 12189 - DNA, 954 bp, Unknown
  Obtained from environmental sample
  misc_feature (1)..(954): n is a, c, g, or t
atggcagcctcagcccatgcaaatatctccgtactttatattcatcctgattccactcaagaagatcttaactacaaatttgaggttagcgaggaaaacggactattcaggattatgtttatgtttagaaaagcgaaatgttgtttgcgcctatttgcaaaattaattgacttcaatcgatatcttaaggctcatcacttaggcttagaacaaattaagaaatacagaggagagcccgatttaattcatgttcatgtgatgacccgactggccatactagcttatatttataagctttttaccggcactccttatctaattaccgaacattggactcggtatttacctatcaggaaagagttcaaaggtttttttagaaaatgcatgagtcgctgggtggctaaaaaagcaaaagcaattcttccggttagtgaagatcttaaacaggccatgctcagtcataaactttcaaataaaaattacatcattattccaaatgtggtagatacagatctattcacccctatcaataaaaaagaaaataacggaatcatacaatttgttcatctttcttgttttacagataatcataaaaatatctcagggatactccgagtgctgaaaaaactttccaaaaatcagaatgattttcattgtacatttattggagatggcccagattttgaaatactaaaaaactatgctgaagaattaggcattaaaaaacatcttacattcactggtttattagaagggaaagcagtagctgaacaaattaaaaaggcagatgccatgctactattcagcaatcacgaaaaccttcccgttgttatgctcgaaagctatgcttgcggggttcccattatttcaacaaatgtgggtggtattcatgagcatgtcaataaacatcttggcagactcgtgaaagaggcgatgaggaaggttcttagctaa

SEQ ID NO: 12190 - protein, 317 aa, Unknown
  Obtained from environmental sample
  DOMAIN (171)...(315): Glycosyl transferases group 1
  misc_feature (1)..(317): Xaa is any amino acid
MAASAHANISVLYIHPDSTQEDLNYKFEVSEENGLFRIMFMFRKAKCCLRLFAKLIDFNRYLKAHHLGLEQIKKYRGEPDLIHVHVMTRLAILAYIYKLFTGTPYLITEHWTRYLPIRKEFKGFFRKCMSRWVAKKAKAILPVSEDLKQAMLSHKLSNKNYIIIPNVVDTDLFTPINKKENNGIIQFVHLSCFTDNHKNISGILRVLKKLSKNQNDFHCTFIGDGPDFEILKNYAEELGIKKHLTFTGLLEGKAVAEQIKKADAMLLFSNHENLPVVMLESYACGVPIISTNVGGIHEHVNKHLGRLVKEAMRKVLS

SEQ ID NO: 12191 - DNA, 870 bp, Unknown
  Obtained from environmental sample
  misc_feature (1)..(870): n is a, c, g, or t
ttgtatataggtacggttattcctaaaaatgatttggttgaaatatctaatgacacaagatattatattattggtggctttgttattttggtaatacttttattatttgttttatattatacttttcaaaacaaaagaattaatttattactgaaaagaaaacatggtgagatatctaaaataaacaaaaatattgaagagaaaagtaaagaaattaaagatagtattcagtatgctaaaagaatacaatcagctattttaacttctaaagaagagtttaataccaacttaaataatagtttattagtgtatttacctaaagatattgttgctggagatttttattggcacaaacaaaaagataatttagttttttatgcagtagccgattgtaccggacatggtgttcctgcagcaatggtgtcggttatttgtaatcatgctttaaatacttgtgtaaatgatttagcattaactaatccaggtgaaatattagatagagcacgagaaattattattgatgcgtttaaccatcaagaaaattctattcaagatggaatggatatttcactttgtgtgttagataagaatgatttagaaaaagatggtttttactcttcattacaatgggcaggagccaatagtccgttatggttaataagaactataaaaaacaacgaagcagagttgtttgaatacaaacctaataaacaacctattggaaaaaccttaaacccaacaccatttacaaccaatactatttcattgcaaaaagaagatagtttatttattttttcagatggattttcagatcaatttggaggcgaaagaggaaagaaatttatgtctaaacaatttaaaaacttctaa

SEQ ID NO: 12192 - protein, 289 aa, Unknown
  Obtained from environmental sample
  DOMAIN (120)...(289): Stage II sporulation protein E (SpoIIE)
  misc_feature (1)..(289): Xaa is any amino acid
MYIGTVIPKNDLVEISNDTRYYIIGGFVILVILLLFVLYYTFQNKRINLLLKRKHGEISKINKNIEEKSKEIKDSIQYAKRIQSAILTSKEEFNTNLNNSLLVYLPKDIVAGDFYWHKQKDNLVFYAVADCTGHGVPAAMVSVICNHALNTCVNDLALTNPGEILDRAREIIIDAFNHQENSIQDGMDISLCVLDKNDLEKDGFYSSLQWAGANSPLWLIRTIKNNEAELFEYKPNKQPIGKTLNPTPFTTNTISLQKEDSLFIFSDGFSDQFGGERGKKFMSKQFKNF

SEQ ID NO: 12193 - DNA, 738 bp, Unknown
  Obtained from environmental sample
  misc_feature (1)..(738): n is a, c, g, or t
ttgaaggaagctcttggaaagcgggaatttgatgttaatggccagtttattacagggaggagggtaaaccgagctttttccagattcccttttgatatcttttatgaagttggaggcatcaaattaaaggggagtgttaaagaggagcttttaggagatatcagaaatatcatggataagtgtacttttacctatacaagacaaaatgagatgagaggtttaggagatgcaatttataaaggaaatgttcttgtaggctttcaaaatccatttgctgttatccttgcagatgatttatgtgtaaatcctgatggagatggtatcttaaaacagatggtagatctttatcacaaatataaatgttgtgttgtagcaactatggaagtacctaatgaagatgtacataaatatggagttattgaaggtaaagagatagaagatggagtatttatggtatcaaatatggtagaaaaaccagataatgataaagcaccgtcaaatttagctgtaattggaagatatattttaactccagatatttttgatatgattaaaaatacaaaacctggaaaaaatggggagttacaaattactgatgctttatgtgaacaagcaaaaaaagggatggtaatagcatataaatttaagggtaaaaggtttgattgtgggtcagttgatggatttgtagaagctacaaattatttttatgatcaagaaaaaaacaaaaataaaaagtag

SEQ ID NO: 12194 - protein, 245 aa, Unknown
  Obtained from environmental sample
  DOMAIN (14)...(239): Nucleotidyl transferase
  misc_feature (1)..(245): Xaa is any amino acid
MKEALGKREFDVNGQFITGRRVNRAFSRFPFDIFYEVGGIKLKGSVKEELLGDIRNIMDKCTFTYTRQNEMRGLGDAIYKGNVLVGFQNPFAVILADDLCVNPDGDGILKQMVDLYHKYKCCVVATMEVPNEDVHKYGVIEGKEIEDGVFMVSNMVEKPDNDKAPSNLAVIGRYILTPDIFDMIKNTKPGKNGELQITDALCEQAKKGMVIAYKFKGKRFDCGSVDGFVEATNYFYDQEKNKNKK

SEQ ID NO: 12195 - DNA, 783 bp, Unknown; identical to SEQ ID NO: 8115
  Obtained from environmental sample
  misc_feature (1)..(783): n is a, c, g, or t

SEQ ID NO: 12196 - protein, 260 aa, Unknown; identical to SEQ ID NO: 8116
  Obtained from environmental sample
  misc_feature (1)..(260): Xaa is any amino acid

SEQ ID NO: 12197 - DNA, 489 bp, Unknown
  Obtained from environmental sample
  misc_feature (1)..(489): n is a, c, g, or t
atgaaagagatcaactgggttaccatatacgagtatgctgagcttacgggattagatgagagttcaattatggagttaattgcacgtggaaaactgacatctaaagaagaagagggtattgtatttatagatcctgaaaaacatacaagctcggtaataccaatagaacttcaagatattaagagtggcaacatatctatgaatcctcaatttgtagagaaaacaatcggaactattattaaccttcatgaaaaagttttgggtgcaaaagatgagactattgagtcaattaaaaatgaaaatagctttctaaaagatggtctttcatcacttcaagagctatatgatgaagatagaaaaacaatagcaatcttaacagaacagttaaaacatgcccaacaagaagtagagtttatgagacgtaagtacaaacttatgtggggtaaagttgtagatgattactcagcaaaacctgaaataagtgcataa

SEQ ID NO: 12198 - protein, 162 aa, Unknown
  Obtained from environmental sample
  misc_feature (1)..(162): Xaa is any amino acid
MKEINWVTIYEYAELTGLDESSIMELIARGKLTSKEEEGIVFIDPEKHTSSVIPIELQDIKSGNISMNPQFVEKTIGTIINLHEKVLGAKDETIESIKNENSFLKDGLSSLQELYDEDRKTIAILTEQLKHAQQEVEFMRRKYKLMWGKVVDDYSAKPEISA

SEQ ID NO: 12199 - DNA, 723 bp, Unknown
  Obtained from environmental sample
  misc_feature (1)..(723): n is a, c, g, or t
gtgggtttaaatttaaaaagtgataagtttaaagatttgaaagtaagagaagcgattagtttagctattgatagacaacagatggcagatatcttgtattttggtcatgcttctgtttgtacgggaccttttttaaaagggagtattgcatataatgaaaatgtaaaacctattgtacaaaataaactaaaagcaaaacaactattagaagaagttggatatacaaaagaaaatcctttttcatttacagttatcacaagtgcaggtagttcaactggggttaatgtagctcaaataatgcaacatcaattaaaacagattggtgtagagatgaaaatacgagtgatggaatggcaagcttttttaaatacagtggttcatccaagaaattttgaagcagttattttggcttggaatttatctttaacacctgatgctagatctatttggcatagcaatagtaataaaaaaggtggatttaattttgtgggatatcaaaatagtgaagtagataaacttatagaacaagcagaaagaaccatagataaaaaagagtttggcaagatttataaaaaaatttataaatatataagtgatgatttaccatatctttttttatttgtacctaatagcattacaagtgttaatanaaatataaaaaatgtaacaccagcacttataggtattacacataatcaagaggagtggataaaaagtgaataa

SEQ ID NO: 12200 - protein, 240 aa, Unknown
  Obtained from environmental sample
  misc_feature (1)..(240): Xaa is any amino acid
MGLNLKSDKFKDLKVREAISLAIDRQQMADILYFGHASVCTGPFLKGSIAYNENVKPIVQNKLKAKQLLEEVGYTKENPFSFTVITSAGSSTGVNVAQIMQHQLKQIGVEMKIRVMEWQAFLNTVVHPRNFEAVILAWNLSLTPDARSIWHSNSNKKGGFNFVGYQNSEVDKLIEQAERTIDKKEFGKIYKKIYKYISDDLPYLFLFVPNSITSVNXNIKNVTPALIGITHNQEEWIKSE

SEQ ID NO: 12201 - DNA, 615 bp, Unknown
  Obtained from environmental sample
  misc_feature (1)..(615): n is a, c, g, or t
atggtacagaagcaatatttggaatcatttcattatgctttagaaaaacaagtttttaattttagtggagatgatggggagataaaaagtcatatagggtatccattggatattatgtttgctaatttaggagttgaacaaagtagagttatggattttgtagagagttataaagaaaattatagagaaatttcagaagagaagacaattttactagaatctgcaaaggaatcagtccaagaagcagcaaaatttgcaagacttggagtggttactacaaaaactacacaatatagtataccattgttaaaaaatttgggtgtttttgaatattttgagacaataattggtcgtcaagaggtgaaaaatccaaaacctgacccagaaccgattcaagttgcactaaaaaacatgggaataaagccttctagagaggttttcatgataggagatacaaaattggatttgattgcagcaaaccgcgctaatattagtagttgtggggtattgtgcggatatggttataagaaagagttatgttgctacacacctcttgtaaccaccaatgctttagaagcggtaaatttaattaaaagcaccatttctaaagcataa

SEQ ID NO: 12202 - protein, 204 aa, Unknown
  Obtained from environmental sample
  DOMAIN (6)...(172): haloacid dehalogenase-like hydrolase
  misc_feature (1)..(204): Xaa is any amino acid
MVQKQYLESFHYALEKQVFNFSGDDGEIKSHIGYPLDIMFANLGVEQSRVMDFVESYKENYREISEEKTILLESAKESVQEAAKFARLGVVTTKTTQYSIPLLKNLGVFEYFETIIGRQEVKNPKPDPEPIQVALKNMGIKPSREVFMIGDTKLDLIAANRANISSCGVLCGYGYKKELCCYTPLVTTNALEAVNLIKSTISKA

SEQ ID NO: 12203 - DNA, 750 bp, Unknown
  Obtained from environmental sample
  misc_feature (1)..(750): n is a, c, g, or t
atgaaaaataataaaaaaatagcaatagtatttggtagtcagagttttgaacatgagataagtatcgttagtgcaataacaatgaaaaaggttttaaagtgtgaaattatttatatttttattgataagtatagagaattttatcttatccctacagatataataaaatcaaatcttttcagtagtggtgaatataaaaagtttgataaattagagttaaatcacaaggggtttactaagaaaaaactctttggaagagaaaaaatagagtttgatacggtattaaatttagttcatggtggagatggtgaagatggtgtactagctgggttatttaaattttacaatataccgtttataggtccacgaattgaagctagcgtagttagttgtaataaatatttaacaaaatcttacgctcatagttgtggagtaaagtctatagattttcaatatttcactaaaaatgaaataattacagtagaaaaatttccagttatcattaaaccagttcgattaggaagtagtataggtgtttctgttgtgaacaataaagaggagttggattatgctcttgatgttgcatttgaatttgacaacgaaattattattgaacctttttgtgcagggataaaagagtataatcttgcaggaactaagatagaaaatgaatatncattatctataatcgaagagccacaaaaagagcagtttttagatttgataaaaatatttagatttttacagaac

SEQ ID NO: 12204 - protein, 250 aa, Unknown
  Obtained from environmental sample
  DOMAIN (132)...(243): D-ala D-ala ligase C-terminus
  misc_feature (1)..(250): Xaa is any amino acid
MKNNKKIAIVFGSQSFEHEISIVSAITMKKVLKCEIIYIFIDKYREFYLIPTDIIKSNLFSSGEYKKFDKLELNHKGFTKKKLFGREKIEFDTVLNLVHGGDGEDGVLAGLFKFYNIPFIGPRIEASVVSCNKYLTKSYAHSCGVKSIDFQYFTKNEIITVEKFPVIIKPVRLGSSIGVSVVNNKEELDYALDVAFEFDNEIIIEPFCAGIKEYNLAGTKIENEYXLSIIEEPQKEQFLDLIKIFRFLQN

SEQ ID NO: 12205 - DNA, 687 bp, Unknown
  Obtained from environmental sample
  misc_feature (1)..(687): n is a, c, g, or t
atgttacaactaaaagatattacttatggaatattaaatattgttgatattacagaactgaaaaaacaagaagagaaaaaattaaaaaaattaaaatcacatattataagtcaagcaactacacatgctcaaaaagcaagtgagataaaagggcaaaatactacagagctaattactcttcaagatgaacttgatcaagcaaaacatgaaatttttaaactcgaaagaaagttgactttatttgaaagagaaaaccatattttaaatggacaagcagaaaaaattcaagagaactctttcagttttgagcaagttttagatagagagatagctttagggaagagatatggtagaaaattttctttagctattgttggaattgatgattataaaacattttcagaacaagttaatagtgaagcaaaaaaagagttaattcttagagcctttaaaaaacactttagaagtactatacgaactactgatgtaatatattatgaaaatagtggattattttatatgattttacctaattcaaatgatgtaaacatcacagatttggtaaagagactattacatgctaaaaaaatagatacaagaatcattgtaaaattcaactgtggtattgctcacttttatgagcaagatacaagagatcacctcctttatagagcaagaaaaaattag

SEQ ID NO: 12206 - protein, 228 aa, Unknown
  Obtained from environmental sample
  DOMAIN (95)...(228): GGDEF domain
  misc_feature (1)..(228): Xaa is any amino acid
MLQLKDITYGILNIVDITELKKQEEKKLKKLKSHIISQATTHAQKASEIKGQNTTELITLQDELDQAKHEIFKLERKLTLFERENHILNGQAEKIQENSFSFEQVLDREIALGKRYGRKFSLAIVGIDDYKTFSEQVNSEAKKELILRAFKKHFRSTIRTTDVIYYENSGLFYMILPNSNDVNITDLVKRLLHAKKIDTRIIVKFNCGIAHFYEQDTRDHLLYRARKN

SEQ ID NO: 12207 - DNA, 468 bp, Unknown
  Obtained from environmental sample
  misc_feature (1)..(468): n is a, c, g, or t
gtggcttttgagtttgatacaaaagttattgtcgaaccgtttgtagtcggtgtaaaggagtacaaccttgcaggatatggaaaagataatagctttgtttattcagtagtagaagagccgcaaaaaaatgaatttttagattttgataaaaaatatatggatttttcccgttcatcaaaagttagtgaagctactcttgatgagctcatggttaaaaaacttcaaaatagtttttcaaaaatttatggaacaatttttaatggatcgttgattagatgcgacttctttattatagatgagactatatatttaaatgagataaaccctattcctggttctatggcaaactatctctttagtgattttgaagaggtaataaaagatttgctatcttctattcctagaaaaagttatccaaaagttgactaccaatatattcactccatctcacgtgcaaaaggtaaatag

SEQ ID NO: 12208 - protein, 155 aa, Unknown
  Obtained from environmental sample
  DOMAIN (1)...(131): D-ala D-ala ligase C-terminus
  misc_feature (1)..(155): Xaa is any amino acid
MAFEFDTKVIVEPFVVGVKEYNLAGYGKDNSFVYSVVEEPQKNEFLDFDKKYMDFSRSSKVSEATLDELMVKKLQNSFSKIYGTIFNGSLIRCDFFIIDETIYLNEINPIPGSMANYLFSDFEEVIKDLLSSIPRKSYPKVDYQYIHSISRAKGK

SEQ ID NO: 12209 - DNA, 426 bp, Unknown
  Obtained from environmental sample
  misc_feature (1)..(426): n is a, c, g, or t
atgagttttaaaaaatatagacaatatcctattgtcaaaaatatagttcgccaatggccaaataacagcataacaaaagcaccgatttattgttctgtggatttaagagatggaaatcaagctttaataaatccattgagtgtggagcagaagttagagtattttcactatttagtaaagatgggatttaaacatattgaggtgagttatcctagtgctagtgatacagattttgaatttacgagaaagattatagaggaggatttagttcctgatgatatttttatccaagtgttaattcctgcacgaaaagagttgatacaaagaagtgtggaagcattgagaggtgcaaaaaagcaatatttcatttgtacaatcctacaaatgagttttcaaagaaaagtagtaatttcaaaaaaccgatgg

SEQ ID NO: 12210 - protein, 142 aa, Unknown
  Obtained from environmental sample
  misc_feature (1)..(142): Xaa is any amino acid
MSFKKYRQYPIVKNIVRQWPNNSITKAPIYCSVDLRDGNQALINPLSVEQKLEYFHYLVKMGFKHIEVSYPSASDTDFEFTRKIIEEDLVPDDIFIQVLIPARKELIQRSVEALRGAKKQYFICTILQMSFQRKVVISKNRW

SEQ ID NO: 12211 - DNA, 732 bp, Unknown
  Obtained from environmental sample
  misc_feature (1)..(732): n is a, c, g, or t
atggacttaatagttgatgtaggaaatacttttgttaagatagctgtctttgaagatgataacattgtttttcaccagaaatatagtgaaattaattcctcaattatttttgaaataaaaaataaattccccataaaaagagcaattattagctccgtaaggaataatgaagccaaaatttcagctatttttaaaaaaattaacatttcattttactggttaaaccaccaaatgaaatttccatttaaaatggattataaaacaccagaaacattaggtttagatagaatttcggcagttgcaggagcaatggctttatttccaaatactaacttactggttgttgatatgggaacttgtgtaactttcgactttgttgatgaaagtttaacctatcatggcggaagtattgctcctggatttgaaatgagatttaaagctttgcctcattttacacacaaactaccattaataaaacttgaaaatcagccagtaaagttgattggagacagtactgaaaactccataatttcaggaatttataatggtttaaagtatgaaattttaggaatgatttcggcttacgaacaacaatataatgatctaaaaatagttcttaccggaggagattttaaactatttgatttagaagtaaaaaatcgcatctttgcagacgattttttagtccttcgtgggttacaacaaattttaatattaaatgagaaaaattag

SEQ ID NO: 12212 - protein, 243 aa, Unknown
  Obtained from environmental sample
  DOMAIN (2)...(194): Bordetella pertussis Bvg accessory factor family
  misc_feature (1)..(243): Xaa is any amino acid
MDLIVDVGNTFVKIAVFEDDNIVFHQKYSEINSSIIFEIKNKFPIKRAIISSVRNNEAKISAIFKKINISFYWLNHQMKFPFKMDYKTPETLGLDRISAVAGAMALFPNTNLLVVDMGTCVTFDFVDESLTYHGGSIAPGFEMRFKALPHFTHKLPLIKLENQPVKLIGDSTENSIISGIYNGLKYEILGMISAYEQQYNDLKIVLTGGDFKLFDLEVKNRIFADDFLVLRGLQQILILNEKN

SEQ ID NO: 12213 - DNA, 312 bp, Unknown
  Obtained from environmental sample
  misc_feature (1)..(312): n is a, c, g, or t
ttgaattgcaacaatttgttaaattcatttatgagaaaaagtgattttttggcaaggataggtggagaggaatttgtaataataattcaaaatccaaatattgataacagtgtgatagtatgtgaaaaaattagaaaaaaagttgaaaaaagttttatagaatataaagataagcgaatttatttttcagtaagtatcggtgttgttaaacttacaatagaaaatagtatagatgaacttcttgaaaaatcagataaggcactttatcaagcaaaagatacaggaaggaataaagtagtagagtataaataa

SEQ ID NO: 12214 - protein, 103 aa, Unknown
  Obtained from environmental sample
  DOMAIN (1)...(98): GGDEF domain
  misc_feature (1)..(103): Xaa is any amino acid
MNCNNLLNSFMRKSDFLARIGGEEFVIIIQNPNIDNSVIVCEKIRKKVEKSFIEYKDKRIYFSVSIGVVKLTIENSIDELLEKSDKALYQAKDTGRNKVVEYK

SEQ ID NO: 12215 - DNA, 663 bp, Unknown
  Obtained from environmental sample
  misc_feature (1)..(663): n is a, c, g, or t
atgactattaaagaaataattaccaaagacggttcagtaacataccataatgaaacttttgatgaatcttatcattcaagatctggcgcaattgaagaatcattcattaaatatgtagaaccatgtaatttagctagaataaataaagaatcagtaagtattctagatttttgttttggcctagggtataattcaattgttgctttagcagagtgtatgaaaaatcctaaaattaaaaaaataaaattaacaggtattgaacttgatccagagattgtttctaagatagaaaaattaaaattagattttgaagaattagatttaattaaagagttagttgtaaataaagaagtcaagaaaaaatacaaagacaaagagcttgaactctcacttttgataaacgatgctgctgctgcagtaaaagtatttgactctgattattttgatgttgtgctttttgatcctttttcaccaaaaaaacatcctgagctttggagtgaagaagttttcaaagatttatattcaaaaatgaaaaaagatggaatactaacaacttactcttgtgcacgtgttgttagagataatttgaaatcagcaaaatttaatgtttttgacggacctaaattacacagaagaggaccaagtactatagcaataaaataa

SEQ ID NO: 12216 - protein, 220 aa, Unknown
  Obtained from environmental sample
  DOMAIN (5)...(220): Protein of unknown function (DUF752)
  misc_feature (1)..(220): Xaa is any amino acid
MTIKEIITKDGSVTYHNETFDESYHSRSGAIEESFIKYVEPCNLARINKESVSILDFCFGLGYNSIVALAECMKNPKIKKIKLTGIELDPEIVSKIEKLKLDFEELDLIKELVVNKEVKKKYKDKELELSLLINDAAAAVKVFDSDYFDVVLFDPFSPKKHPELWSEEVFKDLYSKMKKDGILTTYSCARVVRDNLKSAKFNVFDGPKLHRRGPSTIAIK

SEQ ID NO: 12217 - DNA, 942 bp, Unknown
  Obtained from environmental sample
  misc_feature (1)..(942): n is a, c, g, or t
ttgatnnngggtatgatcggctnaggtaccttgntagccgttttagatatttacttaatctttctatctttatttacttatggtttaattttaaatattctatttccaattttaactattattatttcaagcataagtgctataacactaaattattttcttgaacaaaaacaaactaaagcaattaaaaataagtttgcttcaaaagtttctaaagaggttatggaatctcttcttgcaaacccagatgacacctctttttctgctatggaaaaagaggttacagtgttttttagtgatgtaagaggttttacaaatatttcagaatcaatgccaaatgcaaaagttttgattgaatttatgaatgaatatatggatcctatgactgatattattatcaatcagcacggtacagttgataaatttattggtgatgctattatggcgtattggaatgccccagggaatgttccagatcatgcagagcgtgcagttatagcaacgatggaacaacttcatatgctagatgaattaaataaaaaatttgaaaaagatgaacgatttgtagatgtagtaaaaatgtcaaaagaaaatggtgttccagtagttgatattgggattggtttaaactctggtgtggtaatagcgggggagatgggaagttctcaaagaagtgactataccgttattggagatccaattaacttaggagctagacttgaatctctttgtaaattttataattctaaatgtaatatttcanactttacaaaagaaagaatcaataatgaaaagtatatatttagattcttagaccttgtaactgtaaaagggaaaaaagaacctatagagatatggcagatacatgattacaatagagatgagtctctacataaactttataatgtaactaaaaaaagactttttgaaagagttaaaaag

SEQ ID NO: 12218 - protein, 314 aa, Unknown
  Obtained from environmental sample
  DOMAIN (87)...(290): Adenylate and Guanylate cyclase catalytic domain
  misc_feature (1)..(314): Xaa is any amino acid
MXXGMIGXGTLXAVLDIYLIFLSLFTYGLILNILFPILTIIISSISAITLNYFLEQKQTKAIKNKFASKVSKEVMESLLANPDDTSFSAMEKEVTVFFSDVRGFTNISESMPNAKVLIEFMNEYMDPMTDIIINQHGTVDKFIGDAIMAYWNAPGNVPDHAERAVIATMEQLHMLDELNKKFEKDERFVDVVKMSKENGVPVVDIGIGLNSGVVIAGEMGSSQRSDYTVIGDPINLGARLESLCKFYNSKCNISXFTKERINNEKYIFRFLDLVTVKGKKEPIEIWQIHDYNRDESLHKLYNVTKKRLFERVKK

SEQ ID NO: 12219 - DNA, 549 bp, Unknown
  Obtained from environmental sample
  misc_feature (1)..(549): n is a, c, g, or t
ttgtttaggtataataataaaatggacactaaagaaaataactacatacaccttttaaatgagataggatatcttctatcaacagagaagaacttacacataataatgcaaaaaatacttactgcagcaaaaaaaataacaaatgcagatgctggtactttttatcttgtgtgtgatgatgataaatctttaaaatttactgcagttcaaactgattcattagatattagcctttcgagtgccgaagggacaataccctggccaaatcttcctttatataaagatgatggaacacaaaatgatataaacatatctgtaaattgtgctttaaatgataaacttataaatgtagaagatgtatacaaatcaaaagagtttaactttgaaggtccaagagcttttgatatagcaactggatacagaacaaaatcaatgcttgttgttccaatgaaaaactatgaaaatgatatcattggagttgtgcaacttattaataaacaagataaaaatgaaaaaagtgttgcatttcaaaagatgatgaagatttaa

SEQ ID NO: 12220 - protein, 182 aa, Unknown
  Obtained from environmental sample
  misc_feature (1)..(182): Xaa is any amino acid
MFRYNNKMDTKENNYIHLLNEIGYLLSTEKNLHIIMQKILTAAKKITNADAGTFYLVCDDDKSLKFTAVQTDSLDISLSSAEGTIPWPNLPLYKDDGTQNDINISVNCALNDKLINVEDVYKSKEFNFEGPRAFDIATGYRTKSMLVVPMKNYENDIIGVVQLINKQDKNEKSVAFQKMMKI

SEQ ID NO: 12221 - DNA, 315 bp, Unknown
  Obtained from environmental sample
  misc_feature (1)..(315): n is a, c, g, or t
ttgatgcaagttattttaaatattctaaaaaactctcaaaataactttcaacaaaataaaataaaaaatccaaaaataacaattaccacagaaaatagaaaaatttctatttgtgataatggcggcggtattcaagaagatattatgaagagaatctatgacccttacttttcaactaaacatgaaaaaaatggagcaggattgggattatatatgtcaaaaatgattattgatgaacatcataatggaaaattgagagcagaaaatagagatggaggagtatgctttataatcgagttgggagtagtcccataa

SEQ ID NO: 12222 - protein, 104 aa, Unknown
  Obtained from environmental sample
  DOMAIN (1)...(103): Histidine kinase-, DNA gyrase B-, and HSP90-like ATPase
  misc_feature (1)..(104): Xaa is any amino acid
MMQVILNILKNSQNNFQQNKIKNPKITITTENRKISICDNGGGIQEDIMKRIYDPYFSTKHEKNGAGLGLYMSKMIIDEHHNGKLRAENRDGGVCFIIELGVVP

SEQ ID NO: 12223 - DNA, 360 bp, Unknown
  Obtained from environmental sample
  misc_feature (1)..(360): n is a, c, g, or t
atgtacacagaaatattagagaatcaaccttatggtattgcaaaatttacaagagatggacattatctctactttaatcaaaaagagttggattttagacaattgtcagaatctgatatcaacaaattatctattttcactctctatactccacaagaaacaaaaatattaaaacacatatntgaacaacttctctcttctacaggcaaagagctcttttttgagtatgaacaaaacgacnaatattatcaaatgagacttatcaaagattcggataacaatgtacttagtacgcttagcaacataacaaaacaacataacttagaagataaattattggaaaatgaaaaaaatatttaa

SEQ ID NO: 12224 - protein, 119 aa, Unknown
  Obtained from environmental sample
  misc_feature (1)..(119): Xaa is any amino acid
MYTEILENQPYGIAKFTRDGHYLYFNQKELDFRQLSESDINKLSIFTLYTPQETKILKHIXEQLLSSTGKELFFEYEQNDXYYQMRLIKDSDNNVLSTLSNITKQHNLEDKLLENEKNI

SEQ ID NO: 12225 - DNA, 522 bp, Unknown; identical to SEQ ID NO: 9955
  Obtained from environmental sample
  misc_feature (1)..(522): n is a, c, g, or t

SEQ ID NO: 12226 - protein, 173 aa, Unknown; identical to SEQ ID NO: 9956
  Obtained from environmental sample
  misc_feature (1)..(173): Xaa is any amino acid

SEQ ID NO: 12227 - DNA, 924 bp, Unknown
  Obtained from environmental sample
  misc_feature (1)..(924): n is a, c, g, or t
ttggatttttattncggattgattgctcaggatatggaggatgtatcgaagtatgttgctaattttgatagagaaggtttatatcaagtattaaagccaaaattcgattttctaaaaaaagaaaatcaatattttgcaactttgcatattattacaaaagatggaaaatcatttttaagggttcatgcaaaagatcactttggtgataatattatgcaattaagacctatggtacaagagataatgaaaaataaaactactctaataggctatgaaactggacttcatgctactgcatttagaataattatgcctttatataatgggaaagagtttttaggttctataggtattggtataaatccaaattattttattagtcagatatcagagttattaagtgaacaaggaatgttatttttagaagatcaacatttaaaacttttttctacaaatattgattttaaaataggaaactatagattacaaacaaaaataagtgaaaaaacaaaagagttgcttaatgctttacctaaagaatatgcatttgaagactctatccaaatcactttaaatgatagaatatattttatccattatgaaaatttaaaagattatgataatcatacattaggaaaatatcttttctttgaagatattactgataggataaatagtcacaatagtataagatggcagcttattgcagtagttattttgtttattattattgtttttattttggtaagtggttctattatgaaattttcaagacaactaaataggttttatcaagatattataaacactactgaagaatatgaatcttatttaaaagcagtagagaatggttcaaaaaatcttatttgtacaatattcaagggagagatttttacagtaaataacgcttttttagaatttatg

SEQ ID NO: 12228 - protein, 308 aa, Unknown
  Obtained from environmental sample
  misc_feature (1)..(308): Xaa is any amino acid
MDFYXGLIAQDMEDVSKYVANFDREGLYQVLKPKFDFLKKENQYFATLHIITKDGKSFLRVHAKDHFGDNIMQLRPMVQEIMKNKTTLIGYETGLHATAFRIIMPLYNGKEFLGSIGIGINPNYFISQISELLSEQGMLFLEDQHLKLFSTNIDFKIGNYRLQTKISEKTKELLNALPKEYAFEDSIQITLNDRIYFIHYENLKDYDNHTLGKYLFFEDITDRINSHNSIRWQLIAVVILFIIIVFILVSGSIMKFSRQLNRFYQDIINTTEEYESYLKAVENGSKNLICTIFKGEIFTVNNAFLEFM

SEQ ID NO: 12229 - DNA, 762 bp, Unknown
  Obtained from environmental sample
  misc_feature (1)..(762): n is a, c, g, or t
ttgaagttgccaggaattggtattgcaggaagagtgaatggaaagagaactcaacctaccgcctactttacttttagcagctacatttcaccttcaaaaatctatcaagtaaatttagatgaagtacaaacagatctctattttgaacctaaagttgattttaaaaccgaggaatatgttaccaaacaagtgttttatgaaagtaaagatggcataaaaatccctatgtttatttcgcataaaaaagatattgaattaaatggcaaaaacccttgtatgctttatgcttatgggggatttaacattagtgtaaaaccaacttttgatgtaagcaaagccgtatttatgcaaaacggaggcatttatgctgttgctaatattagaggtggtagcgagtatggcgaagaatggcacaaagcaggtatgctagaaaataaacaaaatgtttttgatgattttattgctgccgccaactttttaaagaataaagaatatacctcaacagaaaaattagccatacacggacgttccaatggcggattgctaattggtgctgtaatgactcaacaacctgatattgctaaagtagctattcctatggttggtgtgttggatatgcttcgttaccacgagttcactatcggttgggctttggcggtggaatatggtagcagtaaaaaccaagaacaattttcccaatttgtacaattactcccccattacaccacccttaaaaaaagccgaaataacccgcctactatt

SEQ ID NO: 12230 - protein, 254 aa, Unknown
  Obtained from environmental sample
  DOMAIN (106)...(253): Prolyl oligopeptidase family
  misc_feature (1)..(254): Xaa is any amino acid
MKLPGIGIAGRVNGKRTQPTAYFTFSSYISPSKIYQVNLDEVQTDLYFEPKVDFKTEEYVTKQVFYESKDGIKIPMFISHKKDIELNGKNPCMLYAYGGFNISVKPTFDVSKAVFMQNGGIYAVANIRGGSEYGEEWHKAGMLENKQNVFDDFIAAANFLKNKEYTSTEKLAIHGRSNGGLLIGAVMTQQPDIAKVAIPMVGVLDMLRYHEFTIGWALAVEYGSSKNQEQFSQFVQLLPHYTTLKKSRNNPPTI

SEQ ID NO: 12231 - DNA, 762 bp, Unknown
  Obtained from environmental sample
  misc_feature (1)..(762): n is a, c, g, or t
atgaaatcaaaagatataatggatcatcattatattatggaaattgcagatttcgaatggaaaaaagcacaaagacaaaagcaagacaaaggatatatgggaagaatgtcatttcctgaaaactttgaaaagccatcaagaacagtaatggcaactatgtcttgctcgtcaagagaatccatgatttatccttataaacaaaaagaagataggtacagactaccaacagtcagagagattgcttgtcttatgagttaccctttggattatagattttacgggaagagtaaaagtattaaatacaaacttgttggaaactctgtacctccaaaaatgtcttttgcaattgctaatgcaatatcaattgcaaataatttaaaaacacttaataaatatcaaccaattgagtttgacgatagccaggaagattttaaaaatttaaatggagatatttttcatattaatatagaaaaagaaaaaagacccatagcgaaatttaaatatcacattccgtatttaattataaatgcttttagagttgagttaactaataaatattctgattttgagaatttacagttcaaatggaatgttgagattcacaaaagtcaaggacaaaatgcaaaaacatatattccaaaaactgacttgaaaactattaaagaagagcacaaaactattgtaaaagattttattaatcagttaaagagaaaaataataaatgcaaacattttccaaaatatttattgtcaaacagattaa

SEQ ID NO: 12232 - protein, 253 aa, Unknown
  Obtained from environmental sample
  misc_feature (1)..(253): Xaa is any amino acid
MKSKDIMDHHYIMEIADFEWKKAQRQKQDKGYMGRMSFPENFEKPSRTVMATMSCSSRESMIYPYKQKEDRYRLPTVREIACLMSYPLDYRFYGKSKSIKYKLVGNSVPPKMSFAIANAISIANNLKTLNKYQPIEFDDSQEDFKNLNGDIFHINIEKEKRPIAKFKYHIPYLIINAFRVELTNKYSDFENLQFKWNVEIHKSQGQNAKTYIPKTDLKTIKEEHKTIVKDFINQLKRKIINANIFQNIYCQTD

SEQ ID NO: 12233 - DNA, 828 bp, Unknown
  Obtained from environmental sample
  misc_feature (1)..(828): n is a, c, g, or t
ttggacagatcggccgagagtctagatatttttaacactacaagtaaaaactatttaattgagtttttagattctcaagataagttttgtcctagtaatcatcatattaatatttttgacaaagatgccaatgcttttagctcacaattacttaacaaaccaaagcctgggaattggataccaatttataaaaaagaagatttaccagaatattttctcaataataatttgatgccaattcgttgtggtcaagcagagttttttttctttaaaggaaatatattttttgatttaacctctattgactttaatacaattgatataaacaatcttacgcaaattgatagttttctcccattgactttagaaaagtttcacaaaaatgaaaatgcttatttaaacaaagcattatctataggaattctaaatcattttatagatgatgatttaattaatcgtcgattattatatggtcaatttggtaagataaaaacaaattttgaattagagtttaaaacatctcatggtgttaaagagataaataaaggtttccaatttgaaatagattttgtattagaaaataaagatgagattattatttttgaagcaaaacaaggttctaagtcaagaacaacattttctttattgcaattatattatccattaatttatttaactaaaattacgaataatcaaaagaaaattagaaaaatttttatagatatagtttccaacaaaaataatgaaatttataaattaacagaattagaatttataaactgcgaatttgataatttgaatataattaaaagtattcaatacagttaa

SEQ ID NO: 12234 - protein, 275 aa, Unknown
  Obtained from environmental sample
  misc_feature (1)..(275): Xaa is any amino acid
MDRSAESLDIFNTTSKNYLIEFLDSQDKFCPSNHHINIFDKDANAFSSQLLNKPKPGNWIPIYKKEDLPEYFLNNNLMPIRCGQAEFFFFKGNIFFDLTSIDFNTIDINNLTQIDSFLPLTLEKFHKNENAYLNKALSIGILNHFIDDDLINRRLLYGQFGKIKTNFELEFKTSHGVKEINKGFQFEIDFVLENKDEIIIFEAKQGSKSRTTFSLLQLYYPLIYLTKITNNQKKIRKIFIDIVSNKNNEIYKLTELEFINCEFDNLNIIKSIQYS

SEQ ID NO: 12235 - DNA, 723 bp, Unknown
  Obtained from environmental sample
  misc_feature (1)..(723): n is a, c, g, or t
atgaagtcaattaaaaatcatctatctctaatactagctctttttactattatttttactgttcaaatatttagtattgttgatagaagcataaaatcttatgaagagaaactaaaaaatgactactctatgatagtcatagcaaatctctctctaaagaaagagactttactacatattgactccatgattgaagacatcgaagagttaactcctgatcatattttagataatataaaaagtgaaattaaagataaaaatttcaaactgctaaaaatatctcttccaaaattttatcgtgttcatctaaatagatttcctaacccttctgaaatagagaagctgacatctaaaataaaatctcttgagcaagttacaaaagttgaagatttttccgcaaaccacgatacaacatataaacttcttcttctctttaaaaagatcatagatattttctctattgctgtaattgcagtaacatcacttcttattttaaaagagatgagtatctggcaatatcagcataatgagagaatgagtattatggcacttttcggtgcacctgtctggcttcgctcagccgttctatttaggcttgctattgtagatgcagttgtctctacccctttagtagctggaaaattttttctaatcataaaaaatgaatggcttgaatccaccctaaaaaatattgatatcagtattgaaatatttaatttttgt

SEQ ID NO: 12236 - protein, 241 aa, Unknown
  Obtained from environmental sample
  misc_feature (1)..(241): Xaa is any amino acid
MKSIKNHLSLILALFTIIFTVQIFSIVDRSIKSYEEKLKNDYSMIVIANLSLKKETLLHIDSMIEDIEELTPDHILDNIKSEIKDKNFKLLKISLPKFYRVHLNRFPNPSEIEKLTSKIKSLEQVTKVEDFSANHDTTYKLLLLFKKIIDIFSIAVIAVTSLLILKEMSIWQYQHNERMSIMALFGAPVWLRSAVLFRLAIVDAVVSTPLVAGKFFLIIKNEWLESTLKNIDISIEIFNFC

SEQ ID NO: 12237 - DNA, 414 bp, Unknown; identical to SEQ ID NO: 10871
  Obtained from environmental sample
  misc_feature (1)..(414): n is a, c, g, or t

SEQ ID NO: 12238 - protein, 137 aa, Unknown; identical to SEQ ID NO: 10872
  Obtained from environmental sample
  misc_feature (1)..(137): Xaa is any amino acid

SEQ ID NO: 12239 - DNA, 744 bp, Unknown
  Obtained from environmental sample
  misc_feature (1)..(744): n is a, c, g, or t
ttgnnnnacatgtacagatcggctcaggcaaaaagacatgaaaatataaaaaccttgagaaaaagccttgaaactaaggaaaaagtgtttgaaaaagaaagacttcattctcttgagaaactaatgaatatcgaagaggctgaaatgaagaaaaaaataaaaacgatcgatgcttcaaaagcaacacaaagaatcgcacttataaaaaaggaaaaagaaactgttaaagatgctatcaacagacagaaagttcagcttgataacacaaaaggcgataaacttgcagatgtgatagataaagctcttgccggaaaaactctcctttatgataaacttcttaaacttgagggacttttccagagcgtaaaaggcaagaatattgaatattcatgtaaaggtaaaagacttattgctcctattgatagacttattgtaaaaaatctcaaccagaagaaaaaaactgtcacccagaaatctcagatggaaacaaagtttgtagaaaaatgtgatgtcagaggtcaatttacagaagatgccgctgaaaccatagaaaaagctcttgatacggcctatggcggcggtgcagtttcgctcactatcacgcatggattaggcccaggcaagcttaaaaaattcatcagagactttctttcgaaatatcagggaagatacaaatactcttttgacggcgganacaatgaagaaggtggagattctgttaccgttgtaagatttgagaagtga

SEQ ID NO: 12240 - protein, 247 aa, Unknown
  Obtained from environmental sample
  DOMAIN (169)...(246): Smr domain
  misc_feature (1)..(247): Xaa is any amino acid
MXXMYRSAQAKRHENIKTLRKSLETKEKVFEKERLHSLEKLMNIEEAEMKKKIKTIDASKATQRIALIKKEKETVKDAINRQKVQLDNTKGDKLADVIDKALAGKTLLYDKLLKLEGLFQSVKGKNIEYSCKGKRLIAPIDRLIVKNLNQKKKTVTQKSQMETKFVEKCDVRGQFTEDAAETIEKALDTAYGGGAVSLTITHGLGPGKLKKFIRDFLSKYQGRYKYSFDGGXNEEGGDSVTVVRFEK

SEQ ID NO: 12241 - DNA, 1008 bp, Unknown
  Obtained from environmental sample
  misc_feature (1)..(1008): n is a, c, g, or t
ttgatggctggcttcagacacagaagatggatttataataaaatgttcatagacaaacttattatcactggtcatacaggtgaaaaaattagagaagtttcatttaatcctaaaggcttaaatcttattgttggcattaatgataaaaatggttcaacaaacgatattgggaaaactacattgataagatgtattgatttttgtttaaatggtaaacttgaacaactctatattgataaagagtttagaagttcaattaatcaggaagtacatgattttttagcgaaacaacaacctactttttcaatcattttcaaagatgaatcaacagagtccaattatgtgatttctagaacagctaattttataaaagaaaaatttaaaatagatagcaaacttattattaatggaattaaaatagaaggtgattttgaaacagaattgaaaaaatatttttttaataatttagaaaaaaaaccaacttttaggcaattagttcctaaatttataagaaaagatgaacaacaaattagtaatgtactgagatatttgcatccaacaacatcacatggagaatatgaaaaaatacatttatttttattcggatttagtgcaaaaaaacttttacaagataaaagtgaattagaacataagtttaaaaatttaaaaaaatcaaaagaagctttggcttcaagatttaccacgacagatttaaagcagatattagaaattacaaaaaaagatttagaaaaactgtatgtagcaagagacacttttcaattagatgataaatatgaacttgaagaacaagaattgaaagatatacaacttgaattacttcaacttgaaaaattgatttctgattatcaactaaaaaaaactcttagtattaataagttgaaagagctagaagaaggtatttttgaaaatgatacaagagctttaaaattatatatgatgaagcaaagttctactcagctgatttgcataaaagttttgatgatgtag

SEQ ID NO: 12242 - protein, 335 aa, Unknown
  Obtained from environmental sample
  misc_feature (1)..(335): Xaa is any amino acid
MMAGFRHRRWIYNKMFIDKLIITGHTGEKIREVSFNPKGLNLIVGINDKNGSTNDIGKTTLIRCIDFCLNGKLEQLYIDKEFRSSINQEVHDFLAKQQPTFSIIFKDESTESNYVISRTANFIKEKFKIDSKLIINGIKIEGDFETELKKYFFNNLEKKPTFRQLVPKFIRKDEQQISNVLRYLHPTTSHGEYEKIHLFLFGFSAKKLLQDKSELEHKFKNLKKSKEALASRFTTTDLKQILEITKKDLEKLYVARDTFQLDDKYELEEQELKDIQLELLQLEKLISDYQLKKTLSINKLKELEEGIFENDTRALKLYMMKQSSTQLICIKVLMM

SEQ ID NO: 12243 - DNA, 612 bp, Unknown
  Obtained from environmental sample
  misc_feature (1)..(612): n is a, c, g, or t
atgaaaattttactcctagaagatgactatctgtacaaaatatctataaaagagttcttagaagaacttgattttgaagtggatgattttgataatggagatgaagcactcgatgcaatctatgaaaacagatacaatcttcttctactagatataagagtaccaggaattgacggctttacacttattgaagatatcagaaaagaagctatcaatacacctgtcattatccttacttcacttacagatatgtcaaatttaagcaaaggatatgaacttgggtgtaatgattatttaaaaaaaccttttgatctaatagagttacgatatagaattgaccaacttataaaaaataaatgttttacttctgatgaaaatataataattctcaacgataactttgcctttgatattcaaaaaaatatattatacaaagaacaaaagcctattgatttaacacaaaaagaaagtgaagtaataagctttttgaatcaaaatagaggtttttatatctccatagagtctttacatgaaaatatctgggataaccaaaaaatccaatacgcgggatatacgaatggttatcaaaaggataaaagggaaaccggataa

SEQ ID NO: 12244 - protein, 203 aa, Unknown
  Obtained from environmental sample
  DOMAIN (1)...(120): Response regulator receiver domain
  misc_feature (1)..(203): Xaa is any amino acid
MKILLLEDDYLYKISIKEFLEELDFEVDDFDNGDEALDAIYENRYNLLLLDIRVPGIDGFTLIEDIRKEAINTPVIILTSLTDMSNLSKGYELGCNDYLKKPFDLIELRYRIDQLIKNKCFTSDENIIILNDNFAFDIQKNILYKEQKPIDLTQKESEVISFLNQNRGFYISIESLHENIWDNQKIQYAGYTNGYQKDKRETG

SEQ ID NO: 12245 - DNA, 654 bp, Unknown
  Obtained from environmental sample
  misc_feature (1)..(654): n is a, c, g, or t
atgggtcacggaaaagaaacccccaggcaaaagatgatcggtatgatgtatttggtactaacagcattgttagcattgaatgtatcggcagaagtattggatgcttttggagctgttgacgaaggcttaattaaaacagctaaaatttatgcagaaaagaatcagattttatataatgaatttaatgaacaatatgttcaaaatgaagtgaaagttaagccttggaaagaaaaagctgatgaagttcaaagaagatccgaagagctatttgattatattcaggatttaaagattgagattattactgtagatggacagggtgatcttgagaaaggcgttataacggaagacggggaaataaataatcagaatatcgagggaaaagataagatggatgctgcaagtcaggttctaattggttctaatatggatggtaaagcgtttgatttgaaaaataagatattggaatatcgtgaatatttgattagtttagttgatgaagaggatgttagagttattacatctttagaaactaatcttgatacggaggatcctcatggaggcgaaagcgaacatcattcatgggaagtaaagaattttgctcatatgccattagctgctgttatgcccccttcttaccaaaaagcaacttga

SEQ ID NO: 12246 - protein, 217 aa, Unknown
  Obtained from environmental sample
  misc_feature (1)..(217): Xaa is any amino acid
MGHGKETPRQKMIGMMYLVLTALLALNVSAEVLDAFGAVDEGLIKTAKIYAEKNQILYNEFNEQYVQNEVKVKPWKEKADEVQRRSEELFDYIQDLKIEIITVDGQGDLEKGVITEDGEINNQNIEGKDKMDAASQVLIGSNMDGKAFDLKNKILEYREYLISLVDEEDVRVITSLETNLDTEDPHGGESEHHSWEVKNFAHMPLAAVMPPSYQKAT

SEQ ID NO: 12247 - DNA, 735 bp, Unknown
  Obtained from environmental sample
  misc_feature (1)..(735): n is a, c, g, or t
ttggtatctacaaatatttatccaaaatatgaatatggggataaattaaaaataaattgcgaattaataacaccggaaaaatttaatggtttttcatatgatagatatttagctaggtataacatctattctgtttgttattaccccagtctctcacgagagacggggcagggccttgattctaaagacttgatttataaaaagatatttagtttcaagcacctactccaagataagattaattctagtttaaatgagccagaggcaagcttggctagtgctatttttcttggttataaaaagaatttgccagccgacttacaagatggtttttctaaagttggtattagtcatattgtggcaatatcggggatgcatataggaattatttcagttattttgatgagcgtcttgattggatttggattcaaaagaaaatacgctttttatattgctacttttttattaattttatacatagttataattggtttcccggcttcagctatgagagcaggattaatggggtttctcgttctttgggccctgaatcttggtagattaaacaagattactaattcattatttttaacggcggcaattttattatttattaatccaaaattacttcgagatgatattggttttcaactttcttttttagcggttttgggaataatatatttttatcctagttattcagtaatttttttgaaaaaattcttaataaaataa

SEQ ID NO: 12248 - protein, 244 aa, Unknown
  Obtained from environmental sample
  DOMAIN (95)...(243): Competence protein
  misc_feature (1)..(244): Xaa is any amino acid
MVSTNIYPKYEYGDKLKINCELITPEKFNGFSYDRYLARYNIYSVCYYPSLSRETGQGLDSKDLIYKKIFSFKHLLQDKINSSLNEPEASLASAIFLGYKKNLPADLQDGFSKVGISHIVAISGMHIGIISVILMSVLIGFGFKRKYAFYIATFLLILYIVIIGFPASAMRAGLMGFLVLWALNLGRLNKITNSLFLTAAILLFINPKLLRDDIGFQLSFLAVLGIIYFYPSYSVIFLKKFLIK

SEQ ID NO: 12249 - DNA, 513 bp, Unknown
  Obtained from environmental sample
  misc_feature (1)..(513): n is a, c, g, or t
atgggattttgtgatcttgttgtctcggtaaatgtctccagttttcagcttaaacaagataattatattgaagtagtaaaaaatattttagatgagctctcttttaatcctgaatatttagagcttgaaattacagaatctacaatcatggtagacattgagagatcattagagaagttaaatgagttgaaagatttaggtattactatctctattgatgattttggtacgggttattcatctatcagctaccttaaaaaactgcctgcaaaggtacttaaaattgataaaagttttgtaatggattcacactttgacagtagcgataaatcgattatgacagctattatagccttagcaaaaagtttaggtttagagactattgctgagggtgcagagttacaagagcatatagatatattaaatgagttaggttgtgaaaaagttcaaggctactacttctctaaaccattaggtgtagagaagtttgaagagtatctacatagaaaatag

SEQ ID NO: 12250 - protein, 170 aa, Unknown
  Obtained from environmental sample
  DOMAIN (1)...(157): EAL domain
  misc_feature (1)..(170): Xaa is any amino acid
MGFCDLVVSVNVSSFQLKQDNYIEVVKNILDELSFNPEYLELEITESTIMVDIERSLEKLNELKDLGITISIDDFGTGYSSISYLKKLPAKVLKIDKSFVMDSHFDSSDKSIMTAIIALAKSLGLETIAEGAELQEHIDILNELGCEKVQGYYFSKPLGVEKFEEYLHRK

SEQ ID NO: 12251 - DNA, 453 bp, Unknown
  Obtained from environmental sample
  misc_feature (1)..(453): n is a, c, g, or t
atgatagccgcacacccttatgaggaagtagcttatgatatttatcatttagaaaataaagactcaaaaactggaagtggagttgttggcaaattacccactcctattaaaacaaaagattttttactacaattaaaaatggtaatgaaaaccaattgtattagacatactaacattattaaagaagaaattgaaactatagcactatgtggtggctctggaagttttttattgcctgatgctataaaaaccaaagcagatatttttattacaggcgattttaaataccatcagttttttgatgctgataatgaaattgttatagcagatattggacattatgaaagtgaacagtttacttctgaattaatttatgatattcttagaaaaaaaattcctaatttcgcacttcatttatctgaaaaaaatacaaaccccataaattacctgtaa

SEQ ID NO: 12252 - protein, 150 aa, Unknown
  Obtained from environmental sample
  DOMAIN (2)...(141): NIF3 (NGG1p interacting factor 3)
  misc_feature (1)..(150): Xaa is any amino acid
MIAAHPYEEVAYDIYHLENKDSKTGSGVVGKLPTPIKTKDFLLQLKMVMKTNCIRHTNIIKEEIETIALCGGSGSFLLPDAIKTKADIFITGDFKYHQFFDADNEIVIADIGHYESEQFTSELIYDILRKKIPNFALHLSEKNTNPINYL

SEQ ID NO: 12253 - DNA, 591 bp, Unknown
  Obtained from environmental sample
  misc_feature (1)..(591): n is a, c, g, or t
atgatatatatagagaaaattataattgaaaatattaaaagtataaaaaaattagagtttttaccaaatcaaaattttagtgttattgtaggtgaaaataatataggtaaaacaactatatttgacgctatattactttggaaaatggcttattccgagttgatattagccaatggcagaggtttttataaaaagtcatcttggaactcgttaaatgtgacatttagtaaattattaatatttagaatagtcaaagcaaaagatttatttaataatccaaaagaagattcatcaataacaattattataaaaacagaagaaaaaagtttcaacttaaaaattaaattgaatattcctgatattgaagactcgtatattagatttacaaatcaagattcgcatggagattttcttgagtttgccaaatattgtagtgataattcaattaaattgaaagatgcaatttccataggttttactaaaccaatatcatctatcataagagaagaaccctttttgaataaagctcanattcagaaaaaaatgttcacaggacatacttatgaaattttaagaaataaaatactttga

SEQ ID NO: 12254 - protein, 196 aa, Unknown
  Obtained from environmental sample
  misc_feature (1)..(196): Xaa is any amino acid
MIYIEKIIIENIKSIKKLEFLPNQNFSVIVGENNIGKTTIFDAILLWKMAYSELILANGRGFYKKSSWNSLNVTFSKLLIFRIVKAKDLFNNPKEDSSITIIIKTEEKSFNLKIKLNIPDIEDSYIRFTNQDSHGDFLEFAKYCSDNSIKLKDAISIGFTKPISSIIREEPFLNKAXIQKKMFTGHTYEILRNKIL

SEQ ID NO: 12255 - DNA, 864 bp, Unknown
  Obtained from environmental sample
  misc_feature (1)..(864): n is a, c, g, or t
atgatttttgacacaaatggtaaagttctagcacatacaaacaaaaaacacctcaataaatatcttggggatgagataagcctcttaccattaaaatcaaaacctatcacaactatactcattaataattcaaatatgatagatattgctgttcctattttgcgacaaacacaacatataggatgggcaagagttgctttatctttaaaaagcaatactcaaattctaaataaaatatctttaaatggtttgttttataccacattagcaattattttagggataataattgcttacatactctcaataagtttgacaaaaaatctttataaattaatctcgattgcaaaacaaataaccaatggaaagagagatattgaagttgacactaaaaggatagatgagattggctcactttctaaagaaattaactctatgttagaaaaaataaaagaaaatgaacaagaattaagattactcaataaaaaccttgaagagaaagtaacagaaaaaactataaaacttgaaaaacaaaacagagagttagaggaaagtgaccatgaactccaagttcttaatgcaaacctagaacaaagagtaaaagaggaagttgaaaaaaatatacaaacccaaaaacaactctttaaatctgaaaaaatggcatcaatgggtgaaatgataggaaatattgctcatcaatggagacaacccctttctataatatctactggtgctacagggatgaagatgaaaaaaactttcaataccctagatgataagttttttgaagaaacttgtgatcttataaatgataatgcacaatacctctccaaaactattgatgattttagaaattttatttaa

SEQ ID NO: 12256 - protein, 287 aa, Unknown
  Obtained from environmental sample
  DOMAIN (83)...(152): HAMP domain
  misc_feature (1)..(287): Xaa is any amino acid
MIFDTNGKVLAHTNKKHLNKYLGDEISLLPLKSKPITTILINNSNMIDIAVPILRQTQHIGWARVALSLKSNTQILNKISLNGLFYTTLAIILGIIIAYILSISLTKNLYKLISIAKQITNGKRDIEVDTKRIDEIGSLSKEINSMLEKIKENEQELRLLNKNLEEKVTEKTIKLEKQNRELEESDHELQVLNANLEQRVKEEVEKNIQTQKQLFKSEKMASMGEMIGNIAHQWRQPLSIISTGATGMKMKKTFNTLDDKFFEETCDLINDNAQYLSKTIDDFRNFI

SEQ ID NO: 12257 - DNA, 630 bp, Unknown
  Obtained from environmental sample
  misc_feature (1)..(630): n is a, c, g, or t
ttggagttatattttagaaataaaggttattatgattctgttgttgctgattcggtagtcttcaaaaaaaagaaagcaaaagtaatttatactgtacaaactaacgaaccctaccgaattcgaaacataaattactcctttgaagacacctccatgacggatctcattattaatgacaggtcacactgccttttacaaaatggagatttatttgatgttgatatactttccgatgaaagagaaagaatagcagaatttgcaaggactaaaggattttattatttctcaaaagagtatattttttatcaggctgactcaagtcttaacaataagctggttgacattgagataattatcaagaaatttaaacaatccactcaaaatggaggatatacagaacacaaacatcctctcaccaaaattagaaatgtctatatccacacaaactaccaaccaaaaattgcattgggaaattttgccgaatacgcttcagaacttgatacaatagtctccagtggcatttatctggtttatcgagatgaagaaaacattaaatcgacgattgttacggaatcaaatttcattcaacccggggacctttttaatatgacaaatgtctccagaagttaa

SEQ ID NO: 12258 - protein, 209 aa, Unknown
  Obtained from environmental sample
  misc_feature (1)..(209): Xaa is any amino acid
MELYFRNKGYYDSVVADSVVFKKKKAKVIYTVQTNEPYRIRNINYSFEDTSMTDLIINDRSHCLLQNGDLFDVDILSDERERIAEFARTKGFYYFSKEYIFYQADSSLNNKLVDIEIIIKKFKQSTQNGGYTEHKHPLTKIRNVYIHTNYQPKIALGNFAEYASELDTIVSSGIYLVYRDEENIKSTIVTESNFIQPGDLFNMTNVSRS

SEQ ID NO: 12259 - DNA, 489 bp, Unknown
  Obtained from environmental sample
  misc_feature (1)..(489): n is a, c, g, or t
atgccatcatttgatatagttagtaaagtagatattcagacattagacaatgctataaactctgtagcaagagaaattagcaatagatacgacttcaaaggaagtgattctacagttgaattggataagaaaacttattctttaaaaataatgactgaggatgaatttaggttagatcagatagagaaggtaattataggtcaatttgtaaagaataaattagatccttcgagtttggatgacggaaaagaacaatatgcttctggaaatagacttagaaaagatattatagtaaagcaaggtattgataaagaaacagctaagaaaattgtaaagagtatcaaggatactaaggcaaaagtacaagcggctattcaagatgatcaaataagagttactggaaaaaaaatagatgatttgcaaggagtgattgctcattgtagatcagccaactttgaaattccattgcaatacatcaattttaaataa

SEQ ID NO: 12260 - protein, 162 aa, Unknown
  Obtained from environmental sample
  DOMAIN (1)...(162): Protein of unknown function (DUF520)
  misc_feature (1)..(162): Xaa is any amino acid
MPSFDIVSKVDIQTLDNAINSVAREISNRYDFKGSDSTVELDKKTYSLKIMTEDEFRLDQIEKVIIGQFVKNKLDPSSLDDGKEQYASGNRLRKDIIVKQGIDKETAKKIVKSIKDTKAKVQAAIQDDQIRVTGKKIDDLQGVIAHCRSANFEIPLQYINFK

SEQ ID NO: 12261 - DNA, 846 bp, Unknown
  Obtained from environmental sample
  misc_feature (1)..(846): n is a, c, g, or t
ttgttggcttgtcgtccgccattaaatagaagattacactggttacctactgtttcagattttatgagtgttgatgaaaacggtgagatgaaagagaagaataaatcggtagaagaagttaccgaaaacttggtaattagcccagaagaaacggctaagaaacacgaaaaaatatatgctcaagaacctattttagaaatagaaaatttaaaaacatattttccgataagtaaaggtgtatttggtagagcaaaagaatatgtaaaagcagttaatgatgtttcttttaaggtttatcctggagaaactttaggtttggttggagaatcaggttgtggaaaaacaactttagggagaaccattttaaaattggtggagccaactgaaggaaagattatttttgaaggtaaagacatcactcatcttagtgtgaaagaaatgcgtgagtacagaaaagaaatgcaaattatttttcaagatccttactcatctttaaatcctagaattactattggagaagccattatggaaccaatgcgtgtacataatgtgtttagtagcgatgcagaaagaaaagaaagagtaatggaattattaaaacgtgttgatttacctgaacaacatttttatagatacccacatgagttttcgggcggacaaagacaacgtatttgtattgctcgttcattagcattaaatcctaaatttattatttgcgatgagtctgtatcggctttggatgtttctgttcaggcacaagtgttaaacttgttaaatgaaatgaaagaagaatttaagtttacttatatttttatttcgcatgattttgtcggttggttagtttaa

SEQ ID NO: 12262 - protein, 281 aa, Unknown
  Obtained from environmental sample
  DOMAIN (101)...(281): ABC transporter
  misc_feature (1)..(281): Xaa is any amino acid
MLACRPPLNRRLHWLPTVSDFMSVDENGEMKEKNKSVEEVTENLVISPEETAKKHEKIYAQEPILEIENLKTYFPISKGVFGRAKEYVKAVNDVSFKVYPGETLGLVGESGCGKTTLGRTILKLVEPTEGKIIFEGKDITHLSVKEMREYRKEMQIIFQDPYSSLNPRITIGEAIMEPMRVHNVFSSDAERKERVMELLKRVDLPEQHFYRYPHEFSGGQRQRICIARSLALNPKFIICDESVSALDVSVQAQVLNLLNEMKEEFKFTYIFISHDFVGWLV

SEQ ID NO: 12263 - DNA, 534 bp, Unknown
  Obtained from environmental sample
  misc_feature (1)..(534): n is a, c, g, or t
atgaactattataaaaaagaaaatgataggcttgtgtgtttgttgtgccaatactattgtaaattaaaaactgggcaaacgggagtttgtggagtcaatcaaaatgttggctctcatatagaaaatttagtttatggttatccaagtgcaattaatattgaccctatagaaaaaaaaccactatatcactttttaccctcgtctaaatccttttcagtaggaactgttggttgtaatttccactgtagtttttgtcaaaattggcaaatatcacaagaacataccatagataaaagcagatactttgaacctaaaacaatagcttctttagcactacaaaagggttgtcaatctatctcatatacctacaatgaacccactatcttttacccttacgcaaaagatattgcacttgaagctaaaaaacttggtcttaaaaatatatttgtaagtaatggatatgaatcaaaagaagtcatagatgatatggttggaataatagatgccataaatatagatttaaaatcattttga

SEQ ID NO: 12264 - protein, 177 aa, Unknown
  Obtained from environmental sample
  misc_feature (1)..(177): Xaa is any amino acid
MNYYKKENDRLVCLLCQYYCKLKTGQTGVCGVNQNVGSHIENLVYGYPSAINIDPIEKKPLYHFLPSSKSFSVGTVGCNFHCSFCQNWQISQEHTIDKSRYFEPKTIASLALQKGCQSISYTYNEPTIFYPYAKDIALEAKKLGLKNIFVSNGYESKEVIDDMVGIIDAINIDLKSF

SEQ ID NO: 12265 - DNA, 381 bp, Unknown
  Obtained from environmental sample
  misc_feature (1)..(381): n is a, c, g, or t
gtgaggaagccaaagttgcctactcagccatataatatgaaagtctctataagagagctttcatttagagctatcattgggatacttccaatagagagaaaagacacgcagagggttattatagatataaattgtgaatatgtttttcataacacatgtggtgaatttatagatcactcgtgtagagctaacactgctaaaaagattatgaagaaaacactgtttacacttattgaagatgctgttatttttttagaaaaaactctttataaaaaatataatatctctaatcttcacatacaaatcacaaaacctgatatttcgcccaattgtacagtatcaggagaaaaatgcttttgtagaataactctaagaattttt

SEQ ID NO: 12266 - protein, 127 aa, Unknown
  Obtained from environmental sample
  DOMAIN (15)...(121): Dihydroneopterin aldolase
  misc_feature (1)..(127): Xaa is any amino acid
MRKPKLPTQPYNMKVSIRELSFRAIIGILPIERKDTQRVIIDINCEYVFHNTCGEFIDHSCRANTAKKIMKKTLFTLIEDAVIFLEKTLYKKYNISNLHIQITKPDISPNCTVSGEKCFCRITLRIF

SEQ ID NO: 12267 - DNA, 621 bp, Unknown
  Obtained from environmental sample
  misc_feature (1)..(621): n is a, c, g, or t
ttgaaacaattagtatcaagtggtgaagcagcaaacattctaggtttatctttacaagggatacattatcgtataaaaaaagggcaattagagtctgtaaaacaagatggaaaaatctatgtatatatagatagttccagtataaaaaatcaacagcaaaatactaaacatacaactaacaatcaaaataacaatacatctcctaatgaacaagctatacatatgggtgagttagctttaaagtcaaaagatgagcagataactattttaaaaaaaacaattaaatttatgagaagacagtacacttctgaaatccaaagacttgataaaaaccaacaaaaaatacttgatgtatttcaaagtgaagttgatcttctaaaaagtgcttttaatgagatgaaaacattgtatcaagtagaacataaagagcatcaagaacaatcaaaagaggtatcccatcaagttggattaccatttatgaatcttaaagagttttttgttcttatgagaaactataataaaacagataatcaaataaaagctctcattttaaatagagtaaaaaatggggataaaagatttatctataaaaaagagactaaagaggttgattatatttaa

SEQ ID NO: 12268 - protein, 206 aa, Unknown
  Obtained from environmental sample
  misc_feature (1)..(206): Xaa is any amino acid
MKQLVSSGEAANILGLSLQGIHYRIKKGQLESVKQDGKIYVYIDSSSIKNQQQNTKHTTNNQNNNTSPNEQAIHMGELALKSKDEQITILKKTIKFMRRQYTSEIQRLDKNQQKILDVFQSEVDLLKSAFNEMKTLYQVEHKEHQEQSKEVSHQVGLPFMNLKEFFVLMRNYNKTDNQIKALILNRVKNGDKRFIYKKETKEVDYI

SEQ ID NO: 12269 - DNA, 888 bp, Unknown
  Obtained from environmental sample
  misc_feature (1)..(888): n is a, c, g, or t
atggatgctggggctttcctcaaatccactttttacgaagaagtagtacaacaagtaattgatgaagctacagtgaatgctaaattccttagttctaaaaaacaagatgaatttaaattacttcctgaatctaagggaacagatgcaaaagacttcgctaccataaaaccacgaatctcccagaaagagctgattgattttctacaagaattagatgaatatgttgtggcaaactgtccaaaactgaaatccagaaatgttattttcagtagtttggatatggaaaaaaatgttcttacttcgtctggtagtagttcctacagcaacaaacctcgtaccttagtaattatcagtttaacagtggaagaagatgatactccttataatttgtatgaagtttttggagatctggggcagtttgaggatatttttgaaaagccagctgatctttacccgggaatcaataaattatacaagcaactggttgataaatctatcggtatttacgctgatgccggtatcaaagatgtgatcatggatgctgatctggcaggtattctggctcatgaagctatcggtcatactaccgaagcagacctcgtcctgggtggatctgtggctgcggattatctgaataagaaagttggaaccgaactggttacacttatcgattacgctcatactgcgcatggtaaacagtgtcctgttcctatatatgtagatgatgaaggaactccggcagaagattgtgtgattattgagaacggaattcttaagaagtttatgtctaataaagaaactgcttccaaactggatattgaacttacggaaatgccagaacctacggattttatgatgaacctctggttaaatgagaaatacagcttt

SEQ ID NO: 12270 - protein, 296 aa, Unknown
  Obtained from environmental sample
  DOMAIN (1)...(261): Putative modulator of DNA gyrase
  misc_feature (1)..(296): Xaa is any amino acid
MDAGAFLKSTFYEEVVQQVIDEATVNAKFLSSKKQDEFKLLPESKGTDAKDFATIKPRISQKELIDFLQELDEYVVANCPKLKSRNVIFSSLDMEKNVLTSSGSSSYSNKPRTLVIISLTVEEDDTPYNLYEVFGDLGQFEDIFEKPADLYPGINKLYKQLVDKSIGIYADAGIKDVIMDADLAGILAHEAIGHTTEADLVLGGSVAADYLNKKVGTELVTLIDYAHTAHGKQCPVPIYVDDEGTPAEDCVIIENGILKKFMSNKETASKLDIELTEMPEPTDFMMNLWLNEKYSF

SEQ ID NO: 12271 - DNA, 561 bp, Unknown
  Obtained from environmental sample
  misc_feature (1)..(561): n is a, c, g, or t
ttgaaagagtatataaaaacagatctaatgaaaaaagatgacaagaagttacgcatttggtcttcagcatcttcaagtggtgaagaaccgtatagtttagctatttttttaatggaaaatctacctgaagtgagtagttgggatattaaaattttagctactgatatctctgaagatattttaaaaaaagctataacgggtgtatatagtgaaaaagatatggatgggttgtctcttaagattaaacagaaatattttagtgttaaaagagagaataattcaaaaatatatgaagttaatgactcaataaaaaagatgattacatttaggaagtataatttagtttacggagattattcaatgttctcaaatcccatagatataattttttgtagaaatgtaatgatctattttgataaagtagttcaaacgcagataaatgaaaaacttacagggcttttaagaagagatggattgttatttattggtcattcagaatcaatccctccgagtgttaaaaatataaaactagttaaatcatcaatatatgtgaaacaataa

SEQ ID NO: 12272 - protein, 186 aa, Unknown
  Obtained from environmental sample
  DOMAIN (2)...(185): CheR methyltransferase, SAM binding domain
  misc_feature (1)..(186): Xaa is any amino acid
MKEYIKTDLMKKDDKKLRIWSSASSSGEEPYSLAIFLMENLPEVSSWDIKILATDISEDILKKAITGVYSEKDMDGLSLKIKQKYFSVKRENNSKIYEVNDSIKKMITFRKYNLVYGDYSMFSNPIDIIFCRNVMIYFDKVVQTQINEKLTGLLRRDGLLFIGHSESIPPSVKNIKLVKSSIYVKQ

SEQ ID NO: 12273 - DNA, 810 bp, Unknown
  Obtained from environmental sample
  misc_feature (1)..(810): n is a, c, g, or t
atgtttcatttaaaatataattatttaaaagagaaagggatattacagttccattttcatcttgcaaatggtgatagttttttacgatttcacaaagttgataagtatggagataatttattttttagagatagtataaagcaagtagttgaaacaaaaaaaaaggtatatggatttgaagtaggaaaatattttgaaggctttcgatatgtatatcctttattttataataataattatgttggaagtgttgagtgttcaattggagtaaagtcaattattgagcaaatggaaaagactttaaaagctgatttttcgatgattttaaaagcagaaaatattaaagatattattacgaaggaacatctagcgaagtattttcataagtgtatgatagataataatttttatatgtcaaataaaattcacgataaaaaattatttaatccagaaatagcaaaatatttacaaaataatattcaatcagagttaaataataataaaagttttgcaaaagctatgcaccttaatggggagacaaaaatagctgtgtttttaccacttttagatataaaaaaaaataatgttggatatatattttcaattagagatgatagttctgtgcattcgcttttcattagtcaattagtaaagtttattatcgcatttattgttattcttattttagtttatttttactttttaaatagacaaaaaacaaatttaatagaacaactgcaagaagctattgatcaaacaacttggtttcaaaaacagatcaaaagggaatataactatgaaatgagctag

SEQ ID NO: 12274 - protein, 269 aa, Unknown
  Obtained from environmental sample
  misc_feature (1)..(269): Xaa is any amino acid
MFHLKYNYLKEKGILQFHFHLANGDSFLRFHKVDKYGDNLFFRDSIKQVVETKKKVYGFEVGKYFEGFRYVYPLFYNNNYVGSVECSIGVKSIIEQMEKTLKADFSMILKAENIKDIITKEHLAKYFHKCMIDNNFYMSNKIHDKKLFNPEIAKYLQNNIQSELNNNKSFAKAMHLNGETKIAVFLPLLDIKKNNVGYIFSIRDDSSVHSLFISQLVKFIIAFIVILILVYFYFLNRQKTNLIEQLQEAIDQTTWFQKQIKREYNYEMS

SEQ ID NO: 12275 - DNA, 732 bp, Unknown
  Obtained from environmental sample
  misc_feature (1)..(732): n is a, c, g, or t
ttggacccggtaaaaaatgtttggtacaaaaaggttttgaattctaaaatatctttacaagatatggggaaagaatattttgaccaggattctgatttaaaaataaaagaagctgaaaagaataaactcaaagctcaactaaatattactcaaaaagagttagaacaattcaaaaacaatacgctaaaagatatgataaaaagacagaatgaagtgtccagtgaattaaaaacagttacaccagaagttgataaaagtaattatattttagggagtaaatctatatatgcaactgtagatggaacaatatataatctcaaaaatagtaatggtggtaaagttgtacaatctggtgaagtaataatggaactaataccaaatgatgtaccactagaggtcgaagcaaaagtattaaatagagatattggatttattcaaataggacaaaaagttaaagttaaacttgatagttttaaattcacaaagtatgggtatatagaaggtgaagtaacgaatatagaaaaagcatctattttggatgaaaacttgggtgagatataccctataataatacaacttaatacagatattatgaaggttgataataaatatattaaattaatacctggtatgacttgttccgttgatataaaaatagggaaaagacaattaatagattatattatatctccaatgataagatatcaagatgaagctttacgtgaaaagtaa

SEQ ID NO: 12276 - protein, 243 aa, Unknown
  Obtained from environmental sample
  misc_feature (1)..(243): Xaa is any amino acid
MDPVKNVWYKKVLNSKISLQDMGKEYFDQDSDLKIKEAEKNKLKAQLNITQKELEQFKNNTLKDMIKRQNEVSSELKTVTPEVDKSNYILGSKSIYATVDGTIYNLKNSNGGKVVQSGEVIMELIPNDVPLEVEAKVLNRDIGFIQIGQKVKVKLDSFKFTKYGYIEGEVTNIEKASILDENLGEIYPIIIQLNTDIMKVDNKYIKLIPGMTCSVDIKIGKRQLIDYIISPMIRYQDEALREK

SEQ ID NO: 12277 - DNA, 459 bp, Unknown
  Obtained from environmental sample
  misc_feature (1)..(459): n is a, c, g, or t
atgaaaaaagaaaatatagattttttatcaggaatagaatcagttctatcacatagaccatctaaactattatggttaataccctctttaataggtgtattagttgttatcttaattttatggttaacatttagtcaaattgatgtcatagccccatcacaaggtaagactataccaaattcacgtatggtattaattcaagcaaaagatataagtattatagaaaggatatatgttaaaaatggacagatggtaaaaaaaggtgatcttttaattgaatttaaagataaaatagaaaattatgaaaatgatagtgtaaatgctaaatatacaaatctgttatctgaaaaactttttttagataattatatcaactatataaaaactaaaaaatataatgagctcatgaaagatgctagattgactgtagatactatagctatgataccatcaaattaa

SEQ ID NO: 12278 - protein, 152 aa, Unknown
  Obtained from environmental sample
  misc_feature (1)..(152): Xaa is any amino acid
MKKENIDFLSGIESVLSHRPSKLLWLIPSLIGVLVVILILWLTFSQIDVIAPSQGKTIPNSRMVLIQAKDISIIERIYVKNGQMVKKGDLLIEFKDKIENYENDSVNAKYTNLLSEKLFLDNYINYIKTKKYNELMKDARLTVDTIAMIPSN

SEQ ID NO: 12279 - DNA, 873 bp, Unknown
  Obtained from environmental sample
  misc_feature (1)..(873): n is a, c, g, or t
atgactaagttaaagacttatactgacaaaaatcttaaatcttctatgaactactactattacgttagagcagtttgtaaaataagaaatattaaatcagcatatgctcagatgataggtataagaacacaacctgcagaaaatatgttttcaaagattctatatcctatggcagataaagttggttatgctggagaaaaaactaaaaagaatgcagagcattttggaaataactcaatgtttgttggcgtttcagaggggaagggtgaatgttttggagtatgtggattttctctttctacaattcctaaaaatgcaattatcacaagtgcctcaatctctttttatccaatgaatagagtttccgtccaagtagagagttatggtgaatggagagttggacaaattgatgaaagaacaattgacagtatcagtagttttgatgacataaaaagtgcgaaatctcttagtttcattgatagaccaacaggttcggctcaattatctcagggtatatggagaaagtatgagtttgctgcacaggaaatagcagttttacaaaaatcattagctcgttcagaggctctttttaaatttgaaggaccaacatcattacctctagaccgcgcatctcaacttatgcagtgggatattggatatggaaaatttagtggtggacttacgtatagaccaaaattagatatttcttatactgttgatgaagctaagcttgagttgcagtcatcaagagaattaacagtgctagaaaatgagatgctagaaaataaacttattacaggatatgatgaaaatggtctaaaaaaatactcttggggagaatttgatttatctcaatgggccggaaatggataa

SEQ ID NO: 12280 - protein, 290 aa, Unknown
  Obtained from environmental sample
  misc_feature (1)..(290): Xaa is any amino acid
MTKLKTYTDKNLKSSMNYYYYVRAVCKIRNIKSAYAQMIGIRTQPAENMFSKILYPMADKVGYAGEKTKKNAEHFGNNSMFVGVSEGKGECFGVCGFSLSTIPKNAIITSASISFYPMNRVSVQVESYGEWRVGQIDERTIDSISSFDDIKSAKSLSFIDRPTGSAQLSQGIWRKYEFAAQEIAVLQKSLARSEALFKFEGPTSLPLDRASQLMQWDIGYGKFSGGLTYRPKLDISYTVDEAKLELQSSRELTVLENEMLENKLITGYDENGLKKYSWGEFDLSQWAGNG

SEQ ID NO: 12281 - DNA, 531 bp, Unknown
  Obtained from environmental sample
  misc_feature (1)..(531): n is a, c, g, or t
atgacaaaaatcatttatttaaatggagcctccagttcaggtaaaactactatagctaaagctcttcaagattcattttcagaaccttatcttcatcttggaattgataaaatcattggtttcatgcctaaaaagatcaacaattgggaaggagggaaatcttctcttggtttttcttggcagcctgatatagacccaacaggacaccccacctatcatattcatgctggcccttttgctaaacgaattattcattcccttaaagacatagcttttctcctagcttctcaaggttataatcttattattgatgatgtagcatttgaagtaatcgaaattgaaagatggaaagaagtcttgaaaaattataaagttctttatataggtgtaattgcccccttagacatacttgaaaaccgtgaacaatacagaggcaatcgctgtttaggatctgctcgttctcaacattttaaaattcataaaaatgttacctatgatcttgaaatagatacacataaaaccatcacttga

SEQ ID NO: 12282 - protein, 176 aa, Unknown
  Obtained from environmental sample
  misc_feature (1)..(176): Xaa is any amino acid
MTKIIYLNGASSSGKTTIAKALQDSFSEPYLHLGIDKIIGFMPKKINNWEGGKSSLGFSWQPDIDPTGHPTYHIHAGPFAKRIIHSLKDIAFLLASQGYNLIIDDVAFEVIEIERWKEVLKNYKVLYIGVIAPLDILENREQYRGNRCLGSARSQHFKIHKNVTYDLEIDTHKTIT

SEQ ID NO: 12283 - DNA, 363 bp, Unknown
  Obtained from environmental sample
  misc_feature (1)..(363): n is a, c, g, or t
atgaaaacaaaatccactttcacagatgctggttgggatttcgatactatctgggacatcaatcctgatgtaaatcacggctacccatttttagatgagcgacctcttgctatagaagatggcaaatatatttttgaagaaaatagcttgatatgttatccaaatcttgtctcaacaggagatattataaatattagtacacagagtaatgtcaaaaatgagatattctatatttatgatattcaggggcgtttaattgaaaaaaccatcaataggcagttgaaaatagatgaaaaaatctatagccgagggctgtattttatcaaatcaaatagtaattatactaagtttatagtggaatag

SEQ ID NO: 12284 - protein, 120 aa, Unknown
  Obtained from environmental sample
  misc_feature (1)..(120): Xaa is any amino acid
MKTKSTFTDAGWDFDTIWDINPDVNHGYPFLDERPLAIEDGKYIFEENSLICYPNLVSTGDIINISTQSNVKNEIFYIYDIQGRLIEKTINRQLKIDEKIYSRGLYFIKSNSNYTKFIVE

SEQ ID NO: 12285 - DNA, 441 bp, Unknown
  Obtained from environmental sample
  misc_feature (1)..(441): n is a, c, g, or t
ttggtaaaggatagtganatagccatacaaaagataaataaagctcttaaaaaagatgctagatttgtagctgaatttggtggttatggaaatattcagaatttaatgattgccatggaaaaagtttttaataataatccttcttggggagagtttaatagcccttggatatttccaaaagatacagaatataaagaactgttagagaaaaatggctttaaagtagactatattgaattaatacaaagaccaacacaaatagacgatatcacaaattggttggatgtgtttgcaaatggaattactgaaaatttaagtgcagaagaaaaaataaaatttaaagaagaagtaacaaagttactaaaaccaatacaatacaatgaaaaagatggttggagtgctgattatgttagacttcgagtaaaagctgttaaagtatag

SEQ ID NO: 12286 - protein, 146 aa, Unknown
  Obtained from environmental sample
  misc_feature (1)..(146): Xaa is any amino acid
MVKDSXIAIQKINKALKKDARFVAEFGGYGNIQNLMIAMEKVFNNNPSWGEFNSPWIFPKDTEYKELLEKNGFKVDYIELIQRPTQIDDITNWLDVFANGITENLSAEEKIKFKEEVTKLLKPIQYNEKDGWSADYVRLRVKAVKV

SEQ ID NO: 12287 - DNA, 645 bp, Unknown
  Obtained from environmental sample
  misc_feature (1)..(645): n is a, c, g, or t
atgagttttaaaaaatatagacaatatcctattgtcaaaaatatagttcgccaatggccaaataacagcataacaaaagcaccgatttattgttctgtggatttaagagatggaaatcaagctttaataaatccattgagtgtggagcagaagttagagtattttcactatttagtaaagatgggatttaaacatattgaggtgagttatcctagtgctagtgatacagattttgaatttacgagaaagattatagaggaggatttagttcctgatgatatttttatccaagtgttaattcctgcacgaaaagagttgatacaaagaagtgtggaagcattgagaggtgctaaaaaggcaatatttcatttgtacaatcctacaaatgagtttcaaagaaaagtagtatttcaaaaaactgatgatcagataattgccatggcagttgaaggtatgcaagagttgaaaagattaactgctgattttgagggggaagtgatgtatgaatatacacctgaaagtttttctcaaacagatttagaatttgcaagtcaaatttgtaatgcagtaatagatatagtagaacccacccaacaaaacaagatgataataaacttaccaaatacctttaaaagcttgtatgcc

SEQ ID NO: 12288 - protein, 215 aa, Unknown
  Obtained from environmental sample
  DOMAIN (36)...(215): HMGL-like
  misc_feature (1)..(215): Xaa is any amino acid
MSFKKYRQYPIVKNIVRQWPNNSITKAPIYCSVDLRDGNQALINPLSVEQKLEYFHYLVKMGFKHIEVSYPSASDTDFEFTRKIIEEDLVPDDIFIQVLIPARKELIQRSVEALRGAKKAIFHLYNPTNEFQRKVVFQKTDDQIIAMAVEGMQELKRLTADFEGEVMYEYTPESFSQTDLEFASQICNAVIDIVEPTQQNKMIINLPNTFKSLYA

SEQ ID NO: 12289 - DNA, 810 bp, Unknown
  Obtained from environmental sample
  misc_feature (1)..(810): n is a, c, g, or t
ttgaacaacttcttgatgctattgaaaaagctattgaaaagtttaaacttgaacatgaagcaaaaaatcaaaaatactaccgttgaacaatatctatctcttcttgataaaagtggtgttatctctaaaacagatacacaaggaactataacttatgtaaatgatagtttttgtaagataagtggatataaaagagatgaactcttagggcaaaaacatagtatcacaaaacatcatgaaaatacaaatgatatatatgaaaaaatgtggtacacaataaaaacaaaagagccaccttgggaaggggtagttaaaaacaaatctaaaagtgggagttcttattatgtgagaacaattattacacctattaaggatattgaaggtactgtggttgaatatgtagcagttcgagatagtttaaatgcagtggtggatgataaaaagtatctttttgagcaaatagaagaaaatgaactctctattttagttttattgcaaatggatgaatttgaaatgtttgaaaaattttataatgcggcaacggtcgatcaagtggaaaaaaactttgcgtttaatcttctctcatatcttccaaaagaatatagctttgaaaatgtttactccttaggtaatggaagttttgctttattgacagaatttaataactttaatactacaaaactcaatatagacgagtatctcaatacctttgtggataatgttaaaaattcaaatttagaatttgatgatatggaatttgatattaatatcacagtaagttactctattgggaaagtttatcctttatga

SEQ ID NO: 12290 - protein, 269 aa, Unknown
  Obtained from environmental sample
  DOMAIN (29)...(91): PAS domain
  misc_feature (1)..(269): Xaa is any amino acid
MNNFLMLLKKLLKSLNLNMKQKIKNTTVEQYLSLLDKSGVISKTDTQGTITYVNDSFCKISGYKRDELLGQKHSITKHHENTNDIYEKMWYTIKTKEPPWEGVVKNKSKSGSSYYVRTIITPIKDIEGTVVEYVAVRDSLNAVVDDKKYLFEQIEENELSILVLLQMDEFEMFEKFYNAATVDQVEKNFAFNLLSYLPKEYSFENVYSLGNGSFALLTEFNNFNTTKLNIDEYLNTFVDNVKNSNLEFDDMEFDINITVSYSIGKVYPL

SEQ ID NO: 12291 - DNA, 924 bp, Unknown
  Obtained from environmental sample
  misc_feature (1)..(924): n is a, c, g, or t
ttgaaaaattttataatgcggcaacggtcgatcaagtggaaaaaaactttgcgtttaatcttctctcatatctttccaaaagaatatagctttgaaaatgtttactccttaggtaatggaagttttgctttattgacagaatttaataactttaatactacaaaactcaatatagacgagtatctcaatacctttgtggataatgttaaaaattcaaatttagaatttgatgatatggaatttgatattaatatcacagtaagttactctattgggaagtttatgctttatgaagatgcaaaggaagggctagataatgccttaagagcaaaaagcaaagtgagtttttcaaatgattcttctattattgcttcaaaagaagcaaaagaaaatttagagatgattaaaacagtaaaaattgcccttgataatttcaatattgtttcatactttcaacctattattaataacaaaacaaaagaggtagaaaaatacgagtcactagtaagacttatagatgaaggtggcaatattctttccccttttcattttttaaatgtctctaaaaaaggaaattattatagtaaaataacccaaagagtattagaaaactctttcaaaattttacacacaataaatacaaaactttctataaatatttctgctaaagatatagaaaaagagcaaactagagtacaaatatttgcccttttagaacaatataaagaggatgcacatagaatagtgtttgaacttcttgaagatgaaaatgtagagaattttaatattataaaagagtttattcacaccgtaaaagccaaaggggttcaaatagctatcgatgattttggtgctggatattctaactttgaaagaattttagagtttgaacctgaatatctcagccattctgtctgcttttaa

SEQ ID NO: 12292 - protein, 307 aa, Unknown
  Obtained from environmental sample
  DOMAIN (130)...(305): EAL domain
  misc_feature (1)..(307): Xaa is any amino acid
MKNFIMRQRSIKWKKTLRLIFSHIFPKEYSFENVYSLGNGSFALLTEFNNFNTTKLNIDEYLNTFVDNVKNSNLEFDDMEFDINITVSYSIGKFMLYEDAKEGLDNALRAKSKVSFSNDSSIIASKEAKENLEMIKTVKIALDNFNIVSYFQPIINNKTKEVEKYESLVRLIDEGGNILSPFHFLNVSKKGNYYSKITQRVLENSFKILHTINTKLSINISAKDIEKEQTRVQIFALLEQYKEDAHRIVFELLEDENVENFNIIKEFIHTVKAKGVQIAIDDFGAGYSNFERILEFEPEYLSHSVCF

SEQ ID NO: 12293 - DNA, 867 bp, Unknown
  Obtained from environmental sample
  misc_feature (1)..(867): n is a, c, g, or t
atgaaattcagaagtctgtcaatggatttagttagaacccatgctttttttgctccaactatgttgttattaattgggctgagtaccatttttactatttatattggtggacaagaatatattgcaggtaacattaccaaaggaaatattttggagtttgtaatttatattaatatgttaacctggccagtaacagcaatagggtgggtgtcatctattattcaaagagcatcagcatctcaagagagaattaatgagtttttgaatacaaaatcaaaaattaaaaacccaacagataaaatagaggaagtaaaaggtgatattgaatttaataacgtttcatttacctatcctgaatcaggcataaatgccttgaaaaatatttcttttaaagtaaaacagggagaaaccttagcaattgttggaagaacaggttctggaaaatctactgtagtaaatctcttattaagaaattatgatttgaatgagggagagattttgatagacaataaaaacattaaagaaatcaatttaaatcattttagagaaaatgttggttatgttcctcaagatgtgtttttgttttctgataccattgaaaataatatagcatttggttacaaaaacaggatgccagaaaaagaggtggtagaacaagcggctaaagatgcagttatttattccagtataaaagaatttgataaaggttttaaaactagattaggagagagaggagtaaccttatctggcggacaaaaacaacgtatatcaatagctagggctattattaaatcgccaaaaattttaatttttgatgattgtttatcggcagttgacacagaaaccgaagacgctatttttaattaa

SEQ ID NO: 12294 - protein, 288 aa, Unknown
  Obtained from environmental sample
  DOMAIN (135)...(288): ABC transporter
  misc_feature (1)..(288): Xaa is any amino acid
MKFRSLSMDLVRTHAFFAPTMLLLIGLSTIFTIYIGGQEYIAGNITKGNILEFVIYINMLTWPVTAIGWVSSIIQRASASQERINEFLNTKSKIKNPTDKIEEVKGDIEFNNVSFTYPESGINALKNISFKVKQGETLAIVGRTGSGKSTVVNLLLRNYDLNEGEILIDNKNIKEINLNHFRENVGYVPQDVFLFSDTIENNIAFGYKNRMPEKEVVEQAAKDAVIYSSIKEFDKGFKTRLGERGVTLSGGQKQRISIARAIIKSPKILIFDDCLSAVDTETEDAIFN

SEQ ID NO: 12295 - DNA, 657 bp, Unknown
  Obtained from environmental sample
  misc_feature (1)..(657): n is a, c, g, or t
ttgttaaatgatacacttccaaaaatagaaagaggaattaataaagtaagtattccagcgtattattacaaagtggtaatggatttaactaaccaaaaagctattggatttatattgcccaaccaaaaaataaattacccattaaacaattatgccgtaagtattgatgaagttgaagctgcaacaggaattgattttttccatcaattaaaagacgagaaagaaaacactttagaaagccagaaaaacattacagattggttgcccgaaaagcaaaaaaatgatgttaaaccactttatcaaccagatttacctaaaggagtttacaataccatacaagctaaaagattaatgggtagtagtaaaaaagttaccattgcaggaactgtagtaagtgtgaaagaaactcgtaatgggcatttatttttaaacctagacatcaactatcctaatcatatttttactattgctatttggaagcaaagtattttaaactttagctataaccctcacgatatacttttgcaccaaaccatttatgtaacaggtaaaattgctgattttgatggaattcctaccatgattttagacaatgaaaaagccattgaaattcaagcaaaagaaaggtataaacttataattggtgatgaagattaa

SEQ ID NO: 12296 - protein, 218 aa, Unknown
  Obtained from environmental sample
  misc_feature (1)..(218): Xaa is any amino acid
MLNDTLPKIERGINKVSIPAYYYKVVMDLTNQKAIGFILPNQKINYPLNNYAVSIDEVEAATGIDFFHQLKDEKENTLESQKNITDWLPEKQKNDVKPLYQPDLPKGVYNTIQAKRLMGSSKKVTIAGTVVSVKETRNGHLFLNLDINYPNHIFTIAIWKQSILNFSYNPHDILLHQTIYVTGKIADFDGIPTMILDNEKAIEIQAKERYKLIIGDED

SEQ ID NO: 12297 - DNA, 312 bp, Unknown
  Obtained from environmental sample
  misc_feature (1)..(312): n is a, c, g, or t
atgactgacggtaaattattttatactattggtgaagtggctagcatgtttaatgtgaatacttcccttattcgtttttgggagaaggagtttgatattataaagcctcaaaaaaacaaaaaaggtaatcgactgtttactaaaaaagacattgataattttcatgttatctttcatttggtaaaagaaaagggctatactttagaaggagctaaaaacaaacttaaaagtggagcaactgcttttcaggaagaaaccaaagaaaacctcgaagtcatcaaatcattagaaaatgtaaaagctttcttntga

SEQ ID NO: 12298 - protein, 103 aa, Unknown
  Obtained from environmental sample
  DOMAIN (9)...(46): MerR family regulatory protein
  misc_feature (1)..(103): Xaa is any amino acid
MTDGKLFYTIGEVASMFNVNTSLIRFWEKEFDIIKPQKNKKGNRLFTKKDIDNFHVIFHLVKEKGYTLEGAKNKLKSGATAFQEETKENLEVIKSLENVKAFX

SEQ ID NO: 12299 - DNA, 762 bp, Unknown
  Obtained from environmental sample
  misc_feature (1)..(762): n is a, c, g, or t
atggagcagataatattttttagtataagtggtctaataattgcaattatcataacatttctgctaattaagtttgtaaatactccactaaaaaaactaaaaataggtttggacagtttttttctttttctacaaggcaaacaagactttacaaaacagatagagataccatcaaatgatgaattcggtcaaatggcatcctcactaaatgaaaatatatccgttagtgccagacttcatgaagaactaaacgcactatatacagatttagaacacaaagtagagataaggactcaagagctagctgagataaacagtgaacttcaagactccatagagtacgcctctacaatccaaaaatcatttttaaaagatcctgatttgataagagaaaaacttagtgaatcttttgtaatctggcaaccacgtgataaagttgggggtgatctatatatctatgaggagagtgccaaaggagttttatttggcgttgtagattgtactggacatagtgtaccaggaggtttcatgactatgttagcaggaagtattataaaaaaactatctacagatttttttgataaccctgcaaaactcttgcgtgagcttaacattgcaataaaacaccagcttagtcaagataaaaacagttcactctccgatgatgggcttgatatgggtctatgttttattaacaaagattgcaatctacttaaatttgccggagcaaaactcgatttgctctattttaaagagtggtga

SEQ ID NO: 12300 - protein, 253 aa, Unknown
  Obtained from environmental sample
  DOMAIN (4)...(78): HAMP domain
  misc_feature (1)..(253): Xaa is any amino acid
MEQIIFFSISGLIIAIIITFLLIKFVNTPLKKLKIGLDSFFLFLQGKQDFTKQIEIPSNDEFGQMASSLNENISVSARLHEELNALYTDLEHKVEIRTQELAEINSELQDSIEYASTIQKSFLKDPDLIREKLSESFVIWQPRDKVGGDLYIYEESAKGVLFGVVDCTGHSVPGGFMTMLAGSIIKKLSTDFFDNPAKLLRELNIAIKHQLSQDKNSSLSDDGLDMGLCFINKDCNLLKFAGAKLDLLYFKEW

SEQ ID NO: 12301 - DNA, 813 bp, Unknown
  Obtained from environmental sample
  misc_feature (1)..(813): n is a, c, g, or t
atgaatagaagtgaagtcatttctgatgttttgaattatatgtttggttatggcatcttacaacattatgtagaagatcaaaatattacggatattgatatatgtagatataattttatattaatcaagaaacatggttacaaggaaattgcacccattcagttttctgatgaacttgagtttacaaacttttgtaaattaatagtgatccgaaacggcggtgtaattaatgaacatgattgtcatgcaagaatttcagatcctaagtatagacttagaattaatgtaacaatagcaccgagaaatatccttggtacatccatgactattagaaaacatagattagatccctatgatttatcagatttagtgaaattaaatatgctagatgcaaagacgcgactccttcttaaaaatataatgaaagtatcgtctaggattttgattgtaggaaaaggtgcatctggtaaaacgacattattaagagccttacttaaggaaatacctattacagaaaggtttttagtttgtgaatcagatagtgagttgtaccctgagaatccaaattttattgttcaaaaggtggagcataagaaaaagaaacaaactcagcttcaggaattggttagagatggattaaccatgtcgttggatggctattgtgtcggtgagcttgtaggaaatgaagtgtatgaatttgtaaaagctggctacactgatcacagagtactcggcacaatgcacgccctaggtgttaaagaagcaatacctagaattatttcgatgatggaaaaccctaaggaacaaaattag

SEQ ID NO: 12302 - protein, 270 aa, Unknown
  Obtained from environmental sample
  DOMAIN (2)...(268): Type II/IV secretion system protein
  misc_feature (1)..(270): Xaa is any amino acid
MNRSEVISDVLNYMFGYGILQHYVEDQNITDIDICRYNFILIKKHGYKEIAPIQFSDELEFTNFCKLIVIRNGGVINEHDCHARISDPKYRLRINVTIAPRNILGTSMTIRKHRLDPYDLSDLVKLNMLDAKTRLLLKNIMKVSSRILIVGKGASGKTTLLRALLKEIPITERFLVCESDSELYPENPNFIVQKVEHKKKKQTQLQELVRDGLTMSLDGYCVGELVGNEVYEFVKAGYTDHRVLGTMHALGVKEAIPRIISMMENPKEQN

SEQ ID NO: 12303 - DNA, 300 bp, Unknown
  Obtained from environmental sample
  misc_feature (1)..(300): n is a, c, g, or t
atgtttatcatacacatcaattataaagtgagtctagacatcgttgagcaatatttaactgctcatgtcgactatttaaaacgacaatatgcccttggtaactttatagcttcgggaaaacaggtgcctcgtacaggtgggattatcctctctaatatggaaagcagagaggcaatggatcaggttttagaacaagatcctttcaaaaaaaataaattggctgattatgtgatcactgaatttgtgccaagtatgacttgcaaggaattggattttttaaaaatcagcccaaagctctaa

SEQ ID NO: 12304 - protein, 99 aa, Unknown
  Obtained from environmental sample
  DOMAIN (7)...(85): YCII-related domain
  misc_feature (1)..(99): Xaa is any amino acid
MFIIHINYKVSLDIVEQYLTAHVDYLKRQYALGNFIASGKQVPRTGGIILSNMESREAMDQVLEQDPFKKNKLADYVITEFVPSMTCKELDFLKISPKL

SEQ ID NO: 12305 - DNA, 534 bp, Unknown
  Obtained from environmental sample
  misc_feature (1)..(534): n is a, c, g, or t
atgaaaccaactacacatgcaactataacaagagtagcgattcagcactctaaagggatgctctcaaatgagatatgtaagaatactcatgagatagttcaaggtagtatagatgaagatgaagcgattttaagtattgtaaaaagagttaaaaattggcatttttatcgcagtgagaaaagtactattcctaaaaaaatctttaagttttttaagacaacatctgaggatattttagatgataggataggaactttctttaaaaaggagaaaggtagtaaaaagtactttaactaccttggtcgaattttacatcatattcaagacatgagtacaccctctcatgtcatgcccatatatcatggtccgaaatttcctcttncattatcactaggcatgatcgaagatcattttgagacatttatgcaaaagaatgattgcataatttcatcaaaaaatatcacgcaagagatatctatagcggtagttaaagctatcgtgatatttacaagcatgcagctgaagatatgttga

SEQ ID NO: 12306 - protein, 177 aa, Unknown
  Obtained from environmental sample
  misc_feature (1)..(177): Xaa is any amino acid
MKPTTHATITRVAIQHSKGMLSNEICKNTHEIVQGSIDEDEAILSIVKRVKNWHFYRSEKSTIPKKIFKFFKTTSEDILDDRIGTFFKKEKGSKKYFNYLGRILHHIQDMSTPSHVMPIYHGPKFPLXLSLGMIEDHFETFMQKNDCIISSKNITQEISIAVVKAIVIFTSMQLKIC

SEQ ID NO: 12307 - DNA, 597 bp, Unknown
  Obtained from environmental sample
  misc_feature (1)..(597): n is a, c, g, or t
ttggatttatggttaatttatgaattaatatgtgaagatattgctcataaaacttttattgacaaatttcttgatagtttttcagaaaaagaatcatttattagtaatgaaaatttttataaaagatttagagcaagtacaaaaagagatgttttaaagacagccccaactatatcttataatgcttttgataaataccaattagatttattgtttattgggattgattacgatgatttagataaaaacaatttttctgtagaattagaaaatcgttacaacgaagttgataaatccgtaaaagataaaacacttattttttatcctgttcaagcaattgaacattggttatggtatataaaatatcatattgaaaatcctaaattgacaaagaatattccttttgaaaataaaaaaagaaaagaagcaaaatttgaaatttataaaagtagaagggcttctgaatcaaaaacaataaaaataatttcagaactattgaaagatgcagattttaaatggttaatatcccgttctgaaagttttaaatatttttttaatgcttttagtaaatatttatcaagtttaaagaaaggataa

SEQ ID NO: 12308 - protein, 198 aa, Unknown
  Obtained from environmental sample
  misc_feature (1)..(198): Xaa is any amino acid
MDLWLIYELICEDIAHKTFIDKFLDSFSEKESFISNENFYKRFRASTKRDVLKTAPTISYNAFDKYQLDLLFIGIDYDDLDKNNFSVELENRYNEVDKSVKDKTLIFYPVQAIEHWLWYIKYHIENPKLTKNIPFENKKRKEAKFEIYKSRRASESKTIKIISELLKDADFKWLISRSESFKYFFNAFSKYLSSLKKG

SEQ ID NO: 12309 - DNA, 438 bp, Unknown; identical to SEQ ID NO: 11411
  Obtained from environmental sample
  misc_feature (1)..(438): n is a, c, g, or t

SEQ ID NO: 12310 - protein, 145 aa, Unknown; identical to SEQ ID NO: 11412
  Obtained from environmental sample
  DOMAIN (14)...(139): Glyoxalase/Bleomycin resistance protein/Dioxygenase superfamily
  misc_feature (1)..(145): Xaa is any amino acid

SEQ ID NO: 12311 - DNA, 303 bp, Unknown
  Obtained from environmental sample
  misc_feature (1)..(303): n is a, c, g, or t
atgtttttaataatccctgcaatcataatttttcttgcattttcatatctctatgtaaatgatgatgtgagtttaattgtacaaggaattatatgtttttcaatacttattatcatcttattctctttttatatatacaaatctatacaaaaaaaccttcgacaacaagaacataacaaaattttacttgagataaaacagcttcatataaaacttaacaatattcaaaatgaagaggaaaggaaaattatttaccaaaaaattagaaaattagaaaaggaagctaaaaataataatttctag

SEQ ID NO: 12312 - protein, 100 aa, Unknown
  Obtained from environmental sample
  misc_feature (1)..(100): Xaa is any amino acid
MFLIIPAIIIFLAFSYLYVNDDVSLIVQGIICFSILIIILFSFYIYKSIQKNLRQQEHNKILLEIKQLHIKLNNIQNEEERKIIYQKIRKLEKEAKNNNF

SEQ ID NO: 12313 - DNA, 561 bp, Unknown
  Obtained from environmental sample
  misc_feature (1)..(561): n is a, c, g, or t
atggaagaaaatactctaaaatacacagttttagttatagaagataaccttggtgattttatacttattcaagattatttagaagaacatcagccagtacctacaattttaagagctacaactttttcagaagcagctgatgtcttagataaaacttctcataaaatagatgcaatattattagatttatcactaccagataaaaatggagcaaaccttatagaagaaattcttattcgtgctaaagatatacctgttatagtacttacaggttattctgatgagaattttgctgtaaaatcactttctttaggtgttgcagattatattcttaaagatgaattaaccgcagtaaacattcataaaagtataatatatggtattgaacgtcagaaaagtttagcaaaaattaaaacttcagaaaaacgttatagcgatttgtttcaattcactccttttccaatatttatatgcgaaaaaggtacttttaaaattgttcaagctaatgataaagctataaaacaatatggttattctgaaaatgaattgcttgacatgccc

SEQ ID NO: 12314 - protein, 187 aa, Unknown
  Obtained from environmental sample
  DOMAIN (8)...(132): Response regulator receiver domain
  misc_feature (1)..(187): Xaa is any amino acid
MEENTLKYTVLVIEDNLGDFILIQDYLEEHQPVPTILRATTFSEAADVLDKTSHKIDAILLDLSLPDKNGANLIEEILIRAKDIPVIVLTGYSDENFAVKSLSLGVADYILKDELTAVNIHKSIIYGIERQKSLAKIKTSEKRYSDLFQFTPFPIFICEKGTFKIVQANDKAIKQYGYSENELLDMP

SEQ ID NO: 12315 - DNA, 432 bp, Unknown
  Obtained from environmental sample
  misc_feature (1)..(432): n is a, c, g, or t
atgttaaaaaaatcattgataattgtttttattgggtttatctctctatacggaactgtatttagtaaaaaagcaacggttacaccaaagttgttacagcaagaaaatggtaaccaatggtgtccagtttcaggggagaaaattgaggatttttataaaacatcatatacagcaaaactccaaatgaatgggaataataggcaatactgtagtatacgatgtttagttatggatatggatgagtatggtatagatttaaatagtgttcaagttttagatgtgatttctcaaaaatatattcaagcacaagatgcctattttgttgtaggaagtgaagtagatggttcattgtcccaaaaaagtaaacttgcatttaaatcaaaaaaagatgctctagagtttataaaaaatataaaggacccagccatctga

SEQ ID NO: 12316 - protein, 143 aa, Unknown
  Obtained from environmental sample
  misc_feature (1)..(143): Xaa is any amino acid
MLKKSLIIVFIGFISLYGTVFSKKATVTPKLLQQENGNQWCPVSGEKIEDFYKTSYTAKLQMNGNNRQYCSIRCLVMDMDEYGIDLNSVQVLDVISQKYIQAQDAYFVVGSEVDGSLSQKSKLAFKSKKDALEFIKNIKDPAI

SEQ ID NO: 12317 - DNA, 561 bp, Unknown
  Obtained from environmental sample
  misc_feature (1)..(561): n is a, c, g, or t
gtggcaatagaggtaagggtaaatttcttaagaacatttattaatatgagaaaacttatctcttcaaactctatgctatttcaaaaatttgaatacatggaccaaaaactaatacaatacgatgaaaaatttgcaaaagtatttgaagctatagaacacaaagagataaaaccntcnttcggtatattttatgatggtcagatgtttgatgcatatatttttatatctgatttaataagaggtgcaaaatcaaagattgtacttatagataattatattgatgatagtgtgctaacattttttagtaaaaatcaagatgtcgatgtaacgatttatactcatactgtatctaaacagctgaaattagatatagaaaaatacaactctcaatacaaagctatcacaatcaaaagttttaaagattctcacgataggtttatgataatagatgacaatgaagtttatcatatcggggcaagtttgaaagacttgggcaaaaagtggtttgctttttctaagataggtatagaaccacttgatattttagataaattgaaataa

SEQ ID NO: 12318 - protein, 186 aa, Unknown
  Obtained from environmental sample
  misc_feature (1)..(186): Xaa is any amino acid
MAIEVRVNFLRTFINMRKLISSNSMLFQKFEYMDQKLIQYDEKFAKVFEAIEHKEIKPSFGIFYDGQMFDAYIFISDLIRGAKSKIVLIDNYIDDSVLTFFSKNQDVDVTIYTHTVSKQLKLDIEKYNSQYKAITIKSFKDSHDRFMIIDDNEVYHIGASLKDLGKKWFAFSKIGIEPLDILDKLK

SEQ ID NO: 12319 - DNA, 393 bp, Unknown
  Obtained from environmental sample
  misc_feature (1)..(393): n is a, c, g, or t
gtgctcgcaaaccgtaaagcgacttatttcatgaaaaagatattggcactggataattttcttgtagtcggatctgaagattgtatcgacgttatggattatgagcataatactctttttaaaatagagaatttaaactcagttcatgacatgagttatggaattataggcgatggatgcggtggaggaagactctttattttagaactatacgcagtgaaagtatttgattttgagaccaaagagattatggaaatttatactcaagctgagaagatgtactcttttagtaaaaaaggttgtgacctttttataacaacagatgagagaatattaaaattcaatctctctatgatgagagcagagatttctttaattaaaccaattttttag

SEQ ID NO: 12320 - protein, 130 aa, Unknown
  Obtained from environmental sample
  misc_feature (1)..(130): Xaa is any amino acid
MLANRKATYFMKKILALDNFLVVGSEDCIDVMDYEHNTLFKIENLNSVHDMSYGIIGDGCGGGRLFILELYAVKVFDFETKEIMEIYTQAEKMYSFSKKGCDLFITTDERILKFNLSMMRAEISLIKPIF

SEQ ID NO: 12321 - DNA, 849 bp, Unknown
  Obtained from environmental sample
  misc_feature (1)..(849): n is a, c, g, or t
ttgtataacaatttaggtagtgtttatatttcattaaacaaaaatgatagtgcggtttattttttcaaaaaaagtaatgagtttactaccttaattggttataaagaagctactagagacaattacttaggattagcaacagcttatgataaattagggaaatataaagaagcatttgaagcacataaaaatcaccttgtctataaagactccttatttaatgaagaatcaaataaacaaattgaggaaattagaacgcaatatgaaacagagaagaaagaaaaacagctaatagaacaagaagttattattacaaaagaacaattacgggtacgacaaaggaattacactcttgtaggtttggctttagtgctaatatttattgttatccttagcgtttatatctacaaacaacaaaaatttaagcagcaaaaactaattgaagaaaataggttgaaagatgaaatagctaaaatcacacttcaaaatgaattacatgaagaacgaataagaatatcaagggatttacatgacaacataggttctcaactaacttttatcatttcttcggtagataatatgggttatttatttaaaacagcagacgaaaaacttagagaaaaactacacggcattgctgattttagtagaacaaccattacccaactaagagatactatttgggcattaaataaagatgaaataagttttgaagatttaaaatcgagattatataattacattgaaacagctaanattgttaaagaaaacattacttttaattttgaggtggatgtgcaacaaaaaattagctttaatgcaattgagggagttatatttacagaatag

SEQ ID NO: 12322 - protein, 282 aa, Unknown
  Obtained from environmental sample
  misc_feature (1)..(282): Xaa is any amino acid
MYNNLGSVYISLNKNDSAVYFFKKSNEFTTLIGYKEATRDNYLGLATAYDKLGKYKEAFEAHKNHLVYKDSLFNEESNKQIEEIRTQYETEKKEKQLIEQEVIITKEQLRVRQRNYTLVGLALVLIFIVILSVYIYKQQKFKQQKLIEENRLKDEIAKITLQNELHEERIRISRDLHDNIGSQLTFIISSVDNMGYLFKTADEKLREKLHGIADFSRTTITQLRDTIWALNKDEISFEDLKSRLYNYIETAXIVKENITFNFEVDVQQKISFNAIEGVIFTE

SEQ ID NO: 12323 - DNA, 657 bp, Unknown
  Obtained from environmental sample
  misc_feature (1)..(657): n is a, c, g, or t
gtgttttatcaaccaaaagatattgtttcgggcgatttttattggatagaacaagttggttctaaaactttcttttctgttatagactgtaccggacatggagtgcctggagcctttgtaagtcttattgcttttaacttattaaataaagtaatcctagaaaaaaaatacactcaaccatcagaaattttaacccaattagatgaattattaattaggttgtttaaaaaatcggatgagaatattagagatggttttgatatgggtttatgttgttgggacagtgaaaataacacattaaattttgctggtgctaatcattctctttttagaataattaataacgaactacaagaaattaaaggcaccaaggcatctataggttattcattatatgaaaataaacacacttttgaaaaccatacttttaatttagaaaaagaggaaactatttatttatgttctgatgggttaccagatcaatttgggggagaaaaaggcaaaaaactaaagtggaaaggttttaaaagttggctaatggaagttcaacctatagcaatagataaacaaaaaaatcagctccaacaattttttaaagattggaaaaaagaccaagaacaaattgatgatgtttgcatgttaggagttaggttttag

SEQ ID NO: 12324 - protein, 218 aa, Unknown
  Obtained from environmental sample
  DOMAIN (19)...(218): Stage II sporulation protein E (SpoIIE)
  misc_feature (1)..(218): Xaa is any amino acid
MFYQPKDIVSGDFYWIEQVGSKTFFSVIDCTGHGVPGAFVSLIAFNLLNKVILEKKYTQPSEILTQLDELLIRLFKKSDENIRDGFDMGLCCWDSENNTLNFAGANHSLFRIINNELQEIKGTKASIGYSLYENKHTFENHTFNLEKEETIYLCSDGLPDQFGGEKGKKLKWKGFKSWLMEVQPIAIDKQKNQLQQFFKDWKKDQEQIDDVCMLGVRF

SEQ ID NO: 12325 - DNA, 738 bp, Unknown
  Obtained from environmental sample
  misc_feature (1)..(738): n is a, c, g, or t
atgttaaagagttctttaaaaatttattataagcatttaaccattgaactgacaaacaagatctattatgatcacttaagactcttggcaatcacaatgtttgacaggttcatcacaaaagtagacaaagagagttacacatttttgtatgatgataaagatactcctcttgagatattcactaaaggaacaatcttgttattctctcattttggaggatgggcagcatcttcaaatgtttcccgctcaagcaacaagatgaacattgttatgcaggaatctttaatggatgaaattaaagagattgaagactcgattgagtctaaaacaaatctatctatcattgatttgaaaactggctccctcagcgtttctatccagatagcaaatgctttaataaatgaagagatagtggcgataatgggtgacagagcttctaatcaaaaaggtgtgatagaggttgattttttaaatgaaaaagcctatttcaataaaaatccatttcaaattgcatataaaatggataagccgatattgatatattttgttatattagttggcatgcaaacatataaaatagaatatttaagagtggacgtggacaagactaaatctgaaggtgaagcactcatggaagccgtgaaaatctatgtaaacgagtatgagagtatcataaaaagatacccaaatcagtggcttaacttttatgatttttgggataaagagtttaagggttaa

SEQ ID NO: 12326 - protein, 245 aa, Unknown
  Obtained from environmental sample
  misc_feature (1)..(245): Xaa is any amino acid
MLKSSLKIYYKHLTIELTNKIYYDHLRLLAITMFDRFITKVDKESYTFLYDDKDTPLEIFTKGTILLFSHFGGWAASSNVSRSSNKMNIVMQESLMDEIKEIEDSIESKTNLSIIDLKTGSLSVSIQIANALINEEIVAIMGDRASNQKGVIEVDFLNEKAYFNKNPFQIAYKMDKPILIYFVILVGMQTYKIEYLRVDVDKTKSEGEALMEAVKIYVNEYESIIKRYPNQWLNFYDFWDKEFKG

SEQ ID NO: 12327 - DNA, 447 bp, Unknown
  Obtained from environmental sample
  misc_feature (1)..(447): n is a, c, g, or t
atgtttggaatgataggcgatcctccggaatatgaagctgtttacggaaagttttcaatacttggtgagaaagcatttaaggataaagtgatcaggcagaattataacggatatcttgaaaagcttgatatggttgagattccggagcttaaatttttgaccataaaatcccctgacagaattaaagaaattgttttgaagcattttaatataaaagaaaaagagttgctgagatcttcaagaaacaatattcctaggaagttatttctgcatcttttgaaaaagtattcgcgattaaaactttcagaaatagcagttttttcagaaatattgccaaattcatgtggaagtttgataataaaattcagaaatgatataaaacagtcaaaagaattgaaaaaattggtggatggtattgaggagcagttaagaaatgaaacaagttaa

SEQ ID NO: 12328 - protein, 148 aa, Unknown
  Obtained from environmental sample
  misc_feature (1)..(148): Xaa is any amino acid
MFGMIGDPPEYEAVYGKFSILGEKAFKDKVIRQNYNGYLEKLDMVEIPELKFLTIKSPDRIKEIVLKHFNIKEKELLRSSRNNIPRKLFLHLLKKYSRLKLSEIAVFSEILPNSCGSLIIKFRNDIKQSKELKKLVDGIEEQLRNETS

SEQ ID NO: 12329 - DNA, 795 bp, Unknown
  Obtained from environmental sample
  misc_feature (1)..(795): n is a, c, g, or t
gtgttttcaagagttttaggagtgttagaaagtaaacatttcactgagggtcaaaaagtaaaccaaggtgatttattatataaaatagaagatgatatttataaagcaagagttgctgaggcaactgcatctgtacaaatgaatgaagcttcaatgaataatgcttcaagaaactgggaaagaataaaaagactttataaaacaaaatcagtaagtgttgaaaaaagagatgatgcattatcagaatatgaacaagcaactgcatcatatgctttagctaaggcaaaattaactcaagcaaaaattgatttaaattttacaaatgtaaaagcaccaattagtggtattgttggtttaaaaaaagttgatattggagatttagttacgaataatccaccacaagaactaacttctataactcaaaatgagcaagtttatatagatttttctatgccattaagtgattataaaaatattaagaataatttatggtcattaccagaggataaaaaagtaaaagtaaatatagaaatcaatgaaaaacctactacttatacaggtataatagactttattgatgtaaatataaatcaaaatacatcaacagtaaaaatgagagcaatagttaataatagtgatagctttttaatgccaggaaattttataagagtagtacttaatgatattgtacaaaaagatgttatcactataccccaaaaagctgttttacaaaatcctatgggaaccattgtatttatagaaaatggggggaaaatttggagtgaaacctggtaa

SEQ ID NO: 12330 - protein, 264 aa, Unknown
  Obtained from environmental sample
  DOMAIN (3)...(263): HlyD family secretion protein
  misc_feature (1)..(264): Xaa is any amino acid
MFSRVLGVLESKHFTEGQKVNQGDLLYKIEDDIYKARVAEATASVQMNEASMNNASRNWERIKRLYKTKSVSVEKRDDALSEYEQATASYALAKAKLTQAKIDLNFTNVKAPISGIVGLKKVDIGDLVTNNPPQELTSITQNEQVYIDFSMPLSDYKNIKNNLWSLPEDKKVKVNIEINEKPTTYTGIIDFIDVNINQNTSTVKMRAIVNNSDSFLMPGNFIRVVLNDIVQKDVITIPQKAVLQNPMGTIVFIENGGKIWSETW

SEQ ID NO: 12331 - DNA, 357 bp, Unknown
  Obtained from environmental sample
  misc_feature (1)..(357): n is a, c, g, or t
atgataggtttagaactgatacatattgtaaatatttctaagcaagttggtgctttagaagtttatgaatcagtaaatcaatttttgaaaaatagagatttgagaatttacaatactaaagagtttttttcattggtgttgagatttaattatgatgaagagaccattgaaaagtttttaaaaggaactatttttgacaacatcgaaaatagtatatattttgacaccattgttcccgaaggatacattgggatttgtcatgattgtgtaataaatagcaaagagtctaagcttttggtagttggagaactatcaaaagattatgaattcttttataataaaataagtatgaattag

SEQ ID NO: 12332 - protein, 118 aa, Unknown
  Obtained from environmental sample
  misc_feature (1)..(118): Xaa is any amino acid
MIGLELIHIVNISKQVGALEVYESVNQFLKNRDLRIYNTKEFFSLVLRFNYDEETIEKFLKGTIFDNIENSIYFDTIVPEGYIGICHDCVINSKESKLLVVGELSKDYEFFYNKISMN

SEQ ID NO: 12333 - DNA, 705 bp, Unknown
  Obtained from environmental sample
  misc_feature (1)..(705): n is a, c, g, or t
atggttgggaaaagtagagcatttgtaaaaattcaagaggggtgtaactttcgaggtagttattgtattatcccatttgttagaggtgattctagaagttatgatgaggctaaaatattagaacaaattaccactttggcttcaaatggttttggtgagtttatacttacaggaacaaatcttggttcttatggaaaaggtgttgaggggcgagatggtttagcaatacttcttaaaaaaatatctcaaataagaggggtaagacgaattcgtcttggaagtgttgaacctatacagattactgatcaatttaaagagatactaactgaaccttggatgggaaaacatctccatattgcattgcaacatacaaataaagagatgttaaagcttatgaatagacgaaaccaagttgataaagatttagaactttttgagtttttagcttcaaaaggatatgcaatagggacggattttatagttggacatccaggagagagtgaagaagtttgggaagatgctatgaaaaatcttcaaaaatttccgctaacccattgtcatagttttacttatagtaaaagggatggaacaccaagtgctacaatgaaaccacaagtcaatggagcgattgcaaaacagcgtctaaaacaattagatgatataataaaacaaaaaaacctgagtttgaaaacacaaaaaagttag

SEQ ID NO: 12334 - protein, 234 aa, Unknown
  Obtained from environmental sample
  DOMAIN (9)...(178): Radical SAM superfamily
  misc_feature (1)..(234): Xaa is any amino acid
MVGKSRAFVKIQEGCNFRGSYCIIPFVRGDSRSYDEAKILEQITTLASNGFGEFILTGTNLGSYGKGVEGRDGLAILLKKISQIRGVRRIRLGSVEPIQITDQFKEILTEPWMGKHLHIALQHTNKEMLKLMNRRNQVDKDLELFEFLASKGYAIGTDFIVGHPGESEEVWEDAMKNLQKFPLTHCHSFTYSKRDGTPSATMKPQVNGAIAKQRLKQLDDIIKQKNLSLKTQKS

SEQ ID NO: 12335 - DNA, 465 bp, Unknown
  Obtained from environmental sample
  misc_feature (1)..(465): n is a, c, g, or t
atgcacaagttgaagcagaaaacttactcccaggtggaagtgcgaatggactatttgatggtcccatttcaaactaaaaatatgaaaaaagttttttttaaaacctttgggtgtcgtaccaatatttttgacactcaaataatgatgagtaatctaaaagattttcaaactacccaagatgaaaaagaagcagatatggtggtaataaactcctgtacagtaacaaatagtgcagatagtacagctagaaactatataagctctttacaaaaacttcctaaaaaaccaagagtaatatttacaggatgtggagtatggacaaaaggggaaaatctctttaatgaaaataaaatagatgcactctttggacatagtgaaaaagagaaaattaatacacttcttaaagatgatacacgattttttccagcaggggatttaaaacatatagatgaaacaattattgaa

SEQ ID NO: 12336 - protein, 155 aa, Unknown
  Obtained from environmental sample
  DOMAIN (30)...(123): Uncharacterized protein family UPF0004
  misc_feature (1)..(155): Xaa is any amino acid
MHKLKQKTYSQVEVRMDYLMVPFQTKNMKKVFFKTFGCRTNIFDTQIMMSNLKDFQTTQDEKEADMVVINSCTVTNSADSTARNYISSLQKLPKKPRVIFTGCGVWTKGENLFNENKIDALFGHSEKEKINTLLKDDTRFFPAGDLKHIDETIIE

SEQ ID NO: 12337 - DNA, 726 bp, Unknown
  Obtained from environmental sample
  misc_feature (1)..(726): n is a, c, g, or t
atgaatgattttttatttagtatgaaaaataaaaatttagaacattttaaatctaaatatagacaatgtgatctattgcttattgatgatgttcagtttttaagtggaaaagaaacaacacaagaagagttttttcataccttcaatgaacttcataatgctaataaacaaatcgttttaacaagtgataaacttccatcacaaattgctggtcttgaagagagactaaaaagtagatttgaacatggattaaaatcacatattcaacttcctgaacttgaaacaaaaattgctattatagagaaaaaaagtgaattaaatggtattcatcttactaaagatatagttcaatacatagctacaaatcttggtaactctatacgagaaatagaaggtgtacttatccaaataaatgcaaatgcaaatttaattggtggggatatcaatattgatttagtaaaaagagttttaaaagatcaaatcaaagagacaaaagaaaatattaaattactagatattatcaatgttgtttctaatgaattaaatataaaaccaagtgatcttaaatcatcaaaaagaacaaaaaatatagtagatgcaagaagaactgttatctatcttgcacgtgaacttacacataactctatgccagatattgcaaagtttttggggatgaaagatcactcatcagtttcaaaaatatatctaaagccaatgagcttatag

SEQ ID NO: 12338 - protein, 241 aa, Unknown
  Obtained from environmental sample
  DOMAIN (1)...(234): Bacterial  dnaA  protein
  misc_feature (1)..(241): Xaa is any amino acid
MNDFLFSMKNKNLEHFKSKYRQCDLLLIDDVQFLSGKETTQEEFFHTFNELHNANKQIVLTSDKLPSQIAGLEERLKSRFEHGLKSHIQLPELETKIAIIEKKSELNGIHLTKDIVQYIATNLGNSIREIEGVLIQINANANLIGGDINIDLVKRVLKDQIKETKENIKLLDIINVVSNELNIKPSDLKSSKRTKNIVDARRTVIYLARELTHNSMPDIAKFLGMKDHSSVSKIYLKPMSL

SEQ ID NO: 12339 - DNA, 591 bp, Unknown
  Obtained from environmental sample
  misc_feature (1)..(591): n is a, c, g, or t
ttgggtgaagatagagtaattccatattttcaaggcatctataataacaaaactaaaaagataataaaatatgaggcattagtaagaattatcgataacggaaaaatcatcttaccatctaaatttttagaaccggcacacctttcaggtatgttaccagagataacaaaggtgatgatagataaaagttttgaaataatggcagataatgattactctttttcgattaatatcagtgaagatgacttgagtagaaactatttagttgattatttagcgagtaaagcattggagtattgtattgatcctaagcgtgttattttggagatattagagggtgtaagttcatctggtaaacagagtcatatgaagcagttaaataagttaaaaagagcagggtactctctggctatagatgattttggagcggagtactctaattttgagagaatactagatctagacattgactttttgaagattgatgctaaatatattaaagatattgacacaaatactaaaagttatgagattgcaaaggcaatctcattttttgctaaaaattcaaatataccatgtattgctaggtaa

SEQ ID NO: 12340 - protein, 196 aa, Unknown
  Obtained from environmental sample
  DOMAIN (1)...(195): EAL domain
  misc_feature (1)..(196): Xaa is any amino acid
MGEDRVIPYFQGIYNNKTKKIIKYEALVRIIDNGKIILPSKFLEPAHLSGMLPEITKVMIDKSFEIMADNDYSFSINISEDDLSRNYLVDYLASKALEYCIDPKRVILEILEGVSSSGKQSHMKQLNKLKRAGYSLAIDDFGAEYSNFERILDLDIDFLKIDAKYIKDIDTNTKSYEIAKAISFFAKNSNIPCIAR

SEQ ID NO: 12341 - DNA, 528 bp, Unknown
  Obtained from environmental sample
  misc_feature (1)..(528): n is a, c, g, or t
atgggaaaacatctccatattgcattgcaacatacaaataaagagatgttaaagcttatgaatagacgaaaccaagttgataaagatttagaactttttgagtttttagcttcaaaaggatatgcaatagggacggattttatagttggacatccaggagagagtgaagaagtttgggaagatgctatgaaaaatcttcaaaaatttccgctaacccattgtcatagttttacttatagtaaaagggatggaacaccaagtgctacaatgaaaccacaagtcaatggagcgattgcaaaacagcgtctaaaacaattagatgatataataaaacaaaaaaaccttgagtttagaaaacaacaaaaaagtttagatatacttatagaatcttctaaagatgatatttatacaggctatgatcaattttttaatcctattgaagtatcatcaagtagtgatattgttggggattggatagtatgtgatcagtttgaggtaaaggagaattataatgtttccaaattttaa

SEQ ID NO: 12342 - protein, 175 aa, Unknown
  Obtained from environmental sample
  misc_feature (1)..(175): Xaa is any amino acid
MGKHLHIALQHTNKEMLKLMNRRNQVDKDLELFEFLASKGYAIGTDFIVGHPGESEEVWEDAMKNLQKFPLTHCHSFTYSKRDGTPSATMKPQVNGAIAKQRLKQLDDIIKQKNLEFRKQQKSLDILIESSKDDIYTGYDQFFNPIEVSSSSDIVGDWIVCDQFEVKENYNVSKF

SEQ ID NO: 12343 - DNA, 387 bp, Unknown
  Obtained from environmental sample
  misc_feature (1)..(387): n is a, c, g, or t
atgtttccaaattttaataaaaaaaatgagaaagaaactcaatcaaatgtagataaaaatttaaagatgatgagtatttcagctattgtgttaatagtattatttttatatacacttacaaaagcagataatgtgatacatggctcaagttattatgtaggggttggctttttatttatacttttaattttaacatttgcattacaaaaatataaagataaaattcgtaaaaaattagggacaagtagattttcaaatgaattggaaaaagcacaagaggaaacacctacaaatgaaaagagcaaagtgaaacaaaaagaggagataacttctccaataatgccaataagctcaaaccattacttttcaagatgtagccggggatag

SEQ ID NO: 12344 - protein, 128 aa, Unknown
  Obtained from environmental sample
  misc_feature (1)..(128): Xaa is any amino acid
MFPNFNKKNEKETQSNVDKNLKMMSISAIVLIVLFLYTLTKADNVIHGSSYYVGVGFLFILLILTFALQKYKDKIRKKLGTSRFSNELEKAQEETPTNEKSKVKQKEEITSPIMPISSNHYFSRCSRG

SEQ ID NO: 12345 - DNA, 507 bp, Unknown
  Obtained from environmental sample
  misc_feature (1)..(507): n is a, c, g, or t
atgaaattgtattttagtggattttctttaaaaggggaaaaagagctttttaaagattatattatagaaaatgattttaccgtatctggtnttagttatggagcacaaaaagcttttgaatatgttttaaatacagataacagagtcgatttattgcaacttttttctccagcattttttcaggataaagatacaaaatataaacgccttcagttgatgttttttaaaaaagattcgcaaacatattgtgataactttttaacaaattgtggttttagtaaagaattagctagtaaatattttgaagagggaacatttgaagagctagaagaattactaacttatgaatggggtcaagaaaaattacaaaaattaattgataaaaatataaaaatagagatctacttaggaagtgatgataagattattgatgcaaatgttgcattagagttttttaaacagtttggtgaagtatattttataaaagaaaaggggcatatcttatga

SEQ ID NO: 12346 - protein, 168 aa, Unknown
  Obtained from environmental sample
  misc_feature (1)..(168): Xaa is any amino acid
MKLYFSGFSLKGEKELFKDYIIENDFTVSGXSYGAQKAFEYVLNTDNRVDLLQLFSPAFFQDKDTKYKRLQLMFFKKDSQTYCDNFLTNCGFSKELASKYFEEGTFEELEELLTYEWGQEKLQKLIDKNIKIEIYLGSDDKIIDANVALEFFKQFGEVYFIKEKGHIL

SEQ ID NO: 12347 - DNA, 783 bp, Unknown
  Obtained from environmental sample
  misc_feature (1)..(783): n is a, c, g, or t
ttgaatatcatcaagatcctaaatttttattatttatctggattaagagaacctcatgcagtactgattatttttaaagaagaacaaagatttggtaatggtgtaactactgatgaaattctatttcttcaaaaaagagatgaatctaatgaagtatggacaggtaaaagattaggtataaaaggagctaccgaatttttaaaaatgagaaccgcttacgaaggatcagatttttcaagctttgaagccgaatttgaaacattcgaacatattttagcttttcccttaccacaagatgtaagaaataccaaagaaacggatgatttagcttctcttattcagcaatttgaactgaaaacacaaaaagcaagcgataaaattgaccacatgaagttagttaccattatggcttcgttaagacaaataaaatcggaagaagaaattgttttgttgcgaaaagccattgacattacttgcgatgctcaaattgaattgatgaaaaacctaaaacccggcatgaaagaatacgaatctgaagcgataattgaatacttttttaagaaaaatggagccgaacatcctgggtttccttctattttaggaagtggcgaaaactcttgtgtgctgcattatactaccaaccgaaaaacattgggagataatgatttattagttagtgatgttggtgctgaatacagaggttacacagcagatgttaccagaactattcctgcaaaaggaaagttttctgaagaacaaaaaattatttataacaccgtttag

SEQ ID NO: 12348 - protein, 260 aa, Unknown
  Obtained from environmental sample
  DOMAIN (149)...(260): metallopeptidase family M24
  misc_feature (1)..(260): Xaa is any amino acid
MNIIKILNFYYLSGLREPHAVLIIFKEEQRFGNGVTTDEILFLQKRDESNEVWTGKRLGIKGATEFLKMRTAYEGSDFSSFEAEFETFEHILAFPLPQDVRNTKETDDLASLIQQFELKTQKASDKIDHMKLVTIMASLRQIKSEEEIVLLRKAIDITCDAQIELMKNLKPGMKEYESEAIIEYFFKKNGAEHPGFPSILGSGENSCVLHYTTNRKTLGDNDLLVSDVGAEYRGYTADVTRTIPAKGKFSEEQKIIYNTV

SEQ ID NO: 12349 - DNA, 759 bp, Unknown
  Obtained from environmental sample
  misc_feature (1)..(759): n is a, c, g, or t
atgaaaaaaaacgctatgaaaaacgacatcccatctataattcctgaaaatcacgagcatctgtcagatcttgaattttttcttgtgaaagaatctttaaacaacaaagcttttgaaacctttttatctgaaagacccgacctctttgctgttggagccataaagatcctcatacgtaagaaggactttgcaactgcaaaagacatgctttctaaaaagcatatgggccgtcatgacagcaaaacaaagggcgaactcttaatgctttcaggaaagattgattacaatgaaaaaaaatataaagaagcttttaggaaatacacacaaggagcagataacacaaaaagtttctcacattatctgattgccgcacactgctctttgaaacttggaaaaaatgagattaagctcgcagaaaagaatttaatgaaaggcactctccactccaccagaaatctttcttcattctacctttggaaatatagaaaagaacttatgggaaatgacatcgcaagagctttaagatcactagaaaaagctgctgagatctcaaaaaagcccaacgtgaaaaatcagcttgcacttttttattacagaaacagaatgtattttcaggcacagcaggaaatatctgaaataattcacaaataccccaactacagaaaaacagaaatgaaaaaactaataaagaagattactaatcagatatcaaaacatgaactggacacaattaaggattcacttctaaataaaacttaa

SEQ ID NO: 12350 - protein, 252 aa, Unknown
  Obtained from environmental sample
  misc_feature (1)..(252): Xaa is any amino acid
MKKNAMKNDIPSIIPENHEHLSDLEFFLVKESLNNKAFETFLSERPDLFAVGAIKILIRKKDFATAKDMLSKKHMGRHDSKTKGELLMLSGKIDYNEKKYKEAFRKYTQGADNTKSFSHYLIAAHCSLKLGKNEIKLAEKNLMKGTLHSTRNLSSFYLWKYRKELMGNDIARALRSLEKAAEISKKPNVKNQLALFYYRNRMYFQAQQEISEIIHKYPNYRKTEMKKLIKKITNQISKHELDTIKDSLLNKT

SEQ ID NO: 12351 - DNA, 384 bp, Unknown
  Obtained from environmental sample
  misc_feature (1)..(384): n is a, c, g, or t
gtgttttataagatgatagaacttattatacttgatgttgatggtacattaacagatggttctattatctattcaaataatggagaagagttaaaaaactttgatgtaaaagatggactagcagttgcctcttggacaaaaaagctgggaaaaaaagctgcaattataacaggaagaaaatcacaactagtagaaagaagagcaaaagaacttggtattacacatctttatcaagggttcgataataaagatgagatattagaaaagatattacaagaggaaaacttaacatgggagcaaactgctgctattggtgatgatttaaatgattacaaaatgttaaaaaaggtagctttatcgttttgcgttggtgaaggctgttga

SEQ ID NO: 12352 - protein, 127 aa, Unknown
  Obtained from environmental sample
  misc_feature (1)..(127): Xaa is any amino acid
MFYKMIELIILDVDGTLTDGSIIYSNNGEELKNFDVKDGLAVASWTKKLGKKAAIITGRKSQLVERRAKELGITHLYQGFDNKDEILEKILQEENLTWEQTAAIGDDLNDYKMLKKVALSFCVGEGC

SEQ ID NO: 12353 - DNA, 468 bp, Unknown
  Obtained from environmental sample
  misc_feature (1)..(468): n is a, c, g, or t
atggaacataatctaacacttgctaaacacccatctgaaaatgatttacgattaatggtaagaattattgcatttattttaaatgctagtgaagatttggttttttgtaaagggatagcagaaaacgatgagccagatttatggcaaaaaactttaggtggagatattgagttatggatagatttaggtcaacctgatgagaagcgtataaaaaaagcttgtggacgttcaaaaaatgtaattatatatacatatcaagaggggatggctactgcttggtataaacagataaaaaaatcacttaagcgttttgataatttaaaagtaatttatcttgatattgatggagagattgatgcaatggtagagcgttcaatgaccttacaagctaatattagtgattttgaactaactataattaatggtgaaaatagtatattaattaaagaagatatatttaactcataa

SEQ ID NO: 12354 - protein, 155 aa, Unknown
  Obtained from environmental sample
  DOMAIN (1)...(155): YaeQ protein
  misc_feature (1)..(155): Xaa is any amino acid
MEHNLTLAKHPSENDLRLMVRIIAFILNASEDLVFCKGIAENDEPDLWQKTLGGDIELWIDLGQPDEKRIKKACGRSKNVIIYTYQEGMATAWYKQIKKSLKRFDNLKVIYLDIDGEIDAMVERSMTLQANISDFELTIINGENSILIKEDIFNS

SEQ ID NO: 12355 - DNA, 345 bp, Unknown
  Obtained from environmental sample
  misc_feature (1)..(345): n is a, c, g, or t
atgaaatattgtgttggcagaggaggaggttttacaggcgattttgaagagtacattttgcttgaaaacggtaaggtgtataaaagagattttgtttacgaaagagatgttttctacaaagaactttctgaattagatacagagtatctactaaacaagattgatgagctaagtttgtatggtgaagatattaataagcccgggaacatgtcttattacttagaaatccgacaaggaaacaataccattaataaaattatttggggagcacattcttactatccaccaaaggaattagaagcttttcataaagagttttttgagaaattaaaacaaagagactaa

SEQ ID NO: 12356 - protein, 114 aa, Unknown
  Obtained from environmental sample
  misc_feature (1)..(114): Xaa is any amino acid
MKYCVGRGGGFTGDFEEYILLENGKVYKRDFVYERDVFYKELSELDTEYLLNKIDELSLYGEDINKPGNMSYYLEIRQGNNTINKIIWGAHSYYPPKELEAFHKEFFEKLKQRD

SEQ ID NO: 12357 - DNA, 756 bp, Unknown
  Obtained from environmental sample
  misc_feature (1)..(756): n is a, c, g, or t
ttggaaataaaaaaatgtcgaatttgtaaaagtaatgatcttgaagtaatattagatttaggaaaacagtcttatacaggaagatttttagatgaaaatgaagaagatccaagttttgaacaattaagtattgttcagtgtaatgaatgtggtttaatacaactgaaagatattttccctccatcagaaatgtatggagaaacatatggctatagatcttcaattactaaaacaatgagagatcatttattaggaatatcagaatatgctttttcttttttaaagaaaaatactaatttaaatataattgatataggtagtaatgatggaacacttattggtcattttaataaaaataaaaataatataataggtattgatccgtgtattaataaacataaagaaaactatgataataatattttattagtaaatgattttttttctaagaaatcaattttagctaacacgactacaaaaagttttgatataattacttcaatagcaatgttctatgaccttgatgatccaataaaatttgcaacagatataagtgaattattacgcgataaaggtatatggattacagaacaaacatatagtcatactcttatagaaagtaagtgttatgactctatatgtcatgaacatgtaacatatttagcattagcagatattgaaaaaatttgtgaacaaacaaatttaaagatattagatatctctacaaatatattaagggggggagttttagattaa

SEQ ID NO: 12358 - protein, 251 aa, Unknown
  Obtained from environmental sample
  misc_feature (1)..(251): Xaa is any amino acid
MEIKKCRICKSNDLEVILDLGKQSYTGRFLDENEEDPSFEQLSIVQCNECGLIQLKDIFPPSEMYGETYGYRSSITKTMRDHLLGISEYAFSFLKKNTNLNIIDIGSNDGTLIGHFNKNKNNIIGIDPCINKHKENYDNNILLVNDFFSKKSILANTTTKSFDIITSIAMFYDLDDPIKFATDISELLRDKGIWITEQTYSHTLIESKCYDSICHEHVTYLALADIEKICEQTNLKILDISTNILRGGVLD

SEQ ID NO: 12359 - DNA, 375 bp, Unknown
  Obtained from environmental sample
  misc_feature (1)..(375): n is a, c, g, or t
gtgaaagaccataagttagaactaagtgagtatttagaagatcaatattcaaaaggtaaaaaaattctaggatatggtgcttctacaaaaggtaatgttttaatacaatattgtaatattactaataaaattatgcatgctattttagaaagagatgaaagaaaatttggtaaacttactcctgcttcaagaattccaataatatcggaagaagaaggtagagctatgaagccagatatcttagttgtttttccatggcactttaaagaggaaattcttaaaagagaagaagtatttttaaaagaaggtggaacattagttttccctttacctaaaatagaaatttatacaaaagatactatttgtaatgactaa

SEQ ID NO: 12360 - protein, 124 aa, Unknown
  Obtained from environmental sample
  misc_feature (1)..(124): Xaa is any amino acid
MKDHKLELSEYLEDQYSKGKKILGYGASTKGNVLIQYCNITNKIMHAILERDERKFGKLTPASRIPIISEEEGRAMKPDILVVFPWHFKEEILKREEVFLKEGGTLVFPLPKIEIYTKDTICND

SEQ ID NO: 12361 - DNA, 861 bp, Unknown
  Obtained from environmental sample
  misc_feature (1)..(861): n is a, c, g, or t
atgatcgctgagagctttacaattagtagaagtaattcaacattatctcgaagaacctatgtaagagaattgaaaaaatattttttacaagaaaaacatattgaagataaattatttgctaattttttaaaagaagacgagataaacaaatgggaaaatttttatgactcaattatacaatctcgagaagcaaaaaacctaaaagttgcatacttatctggaccaaatcctgaaaatgatttaagagaaatgtttaaacatgggatattgccagagaatgtatgggcttttgaatctaataataacgtctataacaatgcaattatgtctgcaataaattcagaatttccatttattaaaataattaatgggactattgatagttttttagatttttctcctcagaaatttgacattatatatttggacttttgtcaacccataataaataaaggaaaaaacaataaaacattaaaagtgataaccaaaattttagataaacatagtttaaattctccaggtattttgattacaaatgtttctttacctacagaagatcaagataaagaatcaagaaatgctataagtaaactagtggctacttatttatacccaaaagcttttcaagaaagtgatacatccccatctggatttatagatagtgctatggcatatggtgatgaatttgatgattttttgaataaagtaagtagaaatttagatactttttatggtacttttgtatctagactgttaatagatcatgcaagtataatttgtccttacaatagattaatgagaagtaagataattggaaaaatttttagttttaatgaaaaaattcaaaagaaatcaatataa

SEQ ID NO: 12362 - protein, 286 aa, Unknown
  Obtained from environmental sample
  misc_feature (1)..(286): Xaa is any amino acid
MIAESFTISRSNSTLSRRTYVRELKKYFLQEKHIEDKLFANFLKEDEINKWENFYDSIIQSREAKNLKVAYLSGPNPENDLREMFKHGILPENVWAFESNNNVYNNAIMSAINSEFPFIKIINGTIDSFLDFSPQKFDIIYLDFCQPIINKGKNNKTLKVITKILDKHSLNSPGILITNVSLPTEDQDKESRNAISKLVATYLYPKAFQESDTSPSGFIDSAMAYGDEFDDFLNKVSRNLDTFYGTFVSRLLIDHASIICPYNRLMRSKIIGKIFSFNEKIQKKSI

SEQ ID NO: 12363 - DNA, 495 bp, Unknown
  Obtained from environmental sample
  misc_feature (1)..(495): n is a, c, g, or t
atggtttgtaaggtacgaaagcagatacctgagtactctatttttaatattttcaatctgggaagtaaaaaacaaagggagttatgcaagcaaggtatcatagatatagaagatatcccagaagattttgatttgactgcaatccaaaaacaagcagtagaaaacttcaaatcaaaaccaacctatatagataaaaatagtatcgaaacctttttacaaaatctaacttacccaatatatcatcttgactttgaatcctaccaacaagccataccacaatacaaaggactcaaaccctttgaacaaattcccttccaatactcacttcatattgagtatgctgatggaactttggagcataaagagtatttgtcacaagatggagttgatagcagatatgagttagctcaaaagctgtgtgatgatataccaaacgatgtgacagtattagcttataatatgagctttgaaaaaaggtgtgataaaaagacttag

SEQ ID NO: 12364 - protein, 164 aa, Unknown
  Obtained from environmental sample
  misc_feature (1)..(164): Xaa is any amino acid
MVCKVRKQIPEYSIFNIFNLGSKKQRELCKQGIIDIEDIPEDFDLTAIQKQAVENFKSKPTYIDKNSIETFLQNLTYPIYHLDFESYQQAIPQYKGLKPFEQIPFQYSLHIEYADGTLEHKEYLSQDGVDSRYELAQKLCDDIPNDVTVLAYNMSFEKRCDKKT

SEQ ID NO: 12365 - DNA, 342 bp, Unknown
  Obtained from environmental sample
  misc_feature (1)..(342): n is a, c, g, or t
atgttaaaaaaaaagttagaatatttttttcttggcatgattttcagtgcaatttcttatctactttacaactactataaaacagcttcttttgaaaatagtgagataccgcaaagttataaagagagaatttttaacaaagaacaagaagtcttggaaaatatgcaaaaaaactttggttacgtttttcaagtccctctcattgtgacagacgagtttaaaggcagactctacggactaacgtcttacaaaaacggtgagataaaaatttaccttaacaaaaaagtgatgcaagagagcatggactataggcaaacacctgtaagttttttattagtgtaa

SEQ ID NO: 12366 - protein, 113 aa, Unknown
  Obtained from environmental sample
  misc_feature (1)..(113): Xaa is any amino acid
MLKKKLEYFFLGMIFSAISYLLYNYYKTASFENSEIPQSYKERIFNKEQEVLENMQKNFGYVFQVPLIVTDEFKGRLYGLTSYKNGEIKIYLNKKVMQESMDYRQTPVSFLLV

SEQ ID NO: 12367 - DNA, 354 bp, Unknown
  Obtained from environmental sample
  misc_feature (1)..(354): n is a, c, g, or t
atgagtattactggacgacgtcaattgaatgagattgtttttagtctaacaaaaaatttacttactaaaaaaaacaaagcaaagtacttcaaagaagtcattaaaaacgaagtaaaagtttttgttttttattcgtcagatgcaatgaatgattataaacttttaaaaaaagcaggtttttataaaatatatagcttaaaactatttagtaaggattattttgtgtgctttattactaggttgagtcttatggacgatattgcattaagaatcttaaagagttctaagcaaatggatatattttttaagattgctagaaaattaagagaatacaggaaaaaaacgaatgtatga

SEQ ID NO: 12368 - protein, 117 aa, Unknown
  Obtained from environmental sample
  misc_feature (1)..(117): Xaa is any amino acid
MSITGRRQLNEIVFSLTKNLLTKKNKAKYFKEVIKNEVKVFVFYSSDAMNDYKLLKKAGFYKIYSLKLFSKDYFVCFITRLSLMDDIALRILKSSKQMDIFFKIARKLREYRKKTNV

SEQ ID NO: 12369 - DNA, 597 bp, Unknown
  Obtained from environmental sample
  misc_feature (1)..(597): n is a, c, g, or t
ttgatcttaaatggtatctttacacatttttgttgttcagatgaggaaaatggtatcacaaaagagcaagaggagaattttcaacaagcttttcaagagacaaaaaaatatatagattataactttagagtacattgtgcaaacagtacaggtgtttttaaagttaatatgaatttatatgatatagcaagggtaggtataggtatttatggttacttagatactaaagaggaacaatatttacaaccagtgctttcacttcatgctcaaaaattagcaactaaaaatattaaaaaggggaaccatatagggtatggaagtgattcttttataacaccgtcagatatggttgtatcaaattataatattggatatggagatggattatttagagccaattctcataaacaaagaaaaatagctaatggattagagatacttggtcgagtttctatggatagtttttctgtagaatctaaagacgatgaagtatgtgtttttgataatgtaacccatctagcacaagtgcacaatacaatcaaatatgagatactcacaagtttaaaaccatcaataaaaaggctgattgttgagtaa

SEQ ID NO: 12370 - protein, 198 aa, Unknown
  Obtained from environmental sample
  DOMAIN (84)...(197): Alanine racemase, C-terminal domain
  misc_feature (1)..(198): Xaa is any amino acid
MILNGIFTHFCCSDEENGITKEQEENFQQAFQETKKYIDYNFRVHCANSTGVFKVNMNLYDIARVGIGIYGYLDTKEEQYLQPVLSLHAQKLATKNIKKGNHIGYGSDSFITPSDMVVSNYNIGYGDGLFRANSHKQRKIANGLEILGRVSMDSFSVESKDDEVCVFDNVTHLAQVHNTIKYEILTSLKPSIKRLIVE

SEQ ID NO: 12371 - DNA, 756 bp, Unknown
  Obtained from environmental sample
  misc_feature (1)..(756): n is a, c, g, or t
ttgtcaaaatggaataaaaaaagagcgaagataattgaccaagaaaataaattaaaaaaagaatattcacaaatagtgaccgatatcttaacatcaattgagaaatcaactgacagtgtctctttagagctcgacaaggtatttcttttatcaaagactccatctagtatcgagatagaatctgcaagaatcagaaaggaattaggtaatccacccggaaaatctgccgaccccttgggggaccaactgacatgggaacaattattgccaacaattgagaacaaggaagtctggattataaccaatgatagtgattttttttcaaaatatagaaatcgtcattatctgaatccttttctctacaatgaattgaaaaaaaataacaataacaaacccccaacagttaatttgttcagatcgttacctgaaggtatagaagatttttgtaaaaaaactagttttcaattgaaaaccttgccttcagatgaagaaatgaagctaataataattgaagaagctgaagtacatctacaccccgatatagccagacaaattgtaagttcctccaatttaatttcaattggctacgacaaagagacatctaccctagaagtagagtttcaaggaggcgctgtatatcaatatagtaaagttccagaagatatttatatggaactcatgaacacagaatcacacggagttatttttgaccaacacattaaaaaagcagggtttccatacaataaaattaaatga

SEQ ID NO: 12372 - protein, 251 aa, Unknown
  Obtained from environmental sample
  misc_feature (1)..(251): Xaa is any amino acid
MSKWNKKRAKIIDQENKLKKEYSQIVTDILTSIEKSTDSVSLELDKVFLLSKTPSSIEIESARIRKELGNPPGKSADPLGDQLTWEQLLPTIENKEVWIITNDSDFFSKYRNRHYLNPFLYNELKKNNNNKPPTVNLFRSLPEGIEDFCKKTSFQLKTLPSDEEMKLIIIEEAEVHLHPDIARQIVSSSNLISIGYDKETSTLEVEFQGGAVYQYSKVPEDIYMELMNTESHGVIFDQHIKKAGFPYNKIK

SEQ ID NO: 12373 - DNA, 705 bp, Unknown
  Obtained from environmental sample
  misc_feature (1)..(705): n is a, c, g, or t
atggaaacttcactttctagttcagatggatttgaagtagaattaaaaagactagaatataaacttccgctatttaatgatacacttcttgaaaatcaccagaagcttttagataaaattttaacactttcaaaaatagatattataggtatggttccggaagcgaccatggttagtacatatatggaaattaaaaaactttatcaaacagcacaagctagtgaaggtggatttgatttagaagaggatgaacttaaagaggttcttgaacagattaaattaggtaaaaagattactgatgaagctaaaaatagaatggcaaaatcaaacttaagactagtggtttcaatcgcaaaaagatacacaaatagaggattaccatttctagaccttattcaagagggtaatattggtttaatgaaagctgttgataaatttgaatacaaaaaaggttacaagttctcaacttatgcaacatggtggattagacaagcaatctctagagccattgcagatcaagctagaactattagaatccctatccatatgattgaaactattaatagaatcaataaaatcatcagaaaaggtatccaagaaaatggaagagaaccggatgtagatgagattgcaaaagaggtaggacttactgttgataaagtaaaaccagttattaaaatcacaaaagaaccagtatcactttga

SEQ ID NO: 12374 - protein, 234 aa, Unknown
  Obtained from environmental sample
  DOMAIN (106)...(176): Sigma-70 region 2
  misc_feature (1)..(234): Xaa is any amino acid
METSLSSSDGFEVELKRLEYKLPLFNDTLLENHQKLLDKILTLSKIDIIGMVPEATMVSTYMEIKKLYQTAQASEGGFDLEEDELKEVLEQIKLGKKITDEAKNRMAKSNLRLVVSIAKRYTNRGLPFLDLIQEGNIGLMKAVDKFEYKKGYKFSTYATWWIRQAISRAIADQARTIRIPIHMIETINRINKIIRKGIQENGREPDVDEIAKEVGLTVDKVKPVIKITKEPVSL

SEQ ID NO: 12375 - DNA, 453 bp, Unknown
  Obtained from environmental sample
  misc_feature (1)..(453): n is a, c, g, or t
atgaacaacaacggaaatccttttgtaattgagtacaatgttagaatgggcgaccccgaaacagaagtagtaattccaagaattgagtctgatttactagattatttccacggagtagctactcaacccctccacgaaaaagaaataaaaataaatccgcaaacagcaacaacagtaatgttagtatccggtggttatcccgaagcttatgaaaaaggaaaagtgataactggattagaaaatattgaagaaagcaccatttttcatgctggaacaactactaaagacaaccaagtagtaaccaatggcggaagagttattgcggttacttcttttggcaactcactagaagaagccttggaaaaatcttttaaaaatgcggaaaaaattcagtttgaaaagaagtactacagaaaagatatcggacaagacttactagcctataaaaattaa

SEQ ID NO: 12376 - protein, 150 aa, Unknown
  Obtained from environmental sample
  DOMAIN (55)...(146): Phosphoribosylglycinamide synthetase, C domain
  misc_feature (1)..(150): Xaa is any amino acid
MNNNGNPFVIEYNVRMGDPETEVVIPRIESDLLDYFHGVATQPLHEKEIKINPQTATTVMLVSGGYPEAYEKGKVITGLENIEESTIFHAGTTTKDNQVVTNGGRVIAVTSFGNSLEEALEKSFKNAEKIQFEKKYYRKDIGQDLLAYKN

SEQ ID NO: 12377 - DNA, 522 bp, Unknown
  Obtained from environmental sample
  misc_feature (1)..(522): n is a, c, g, or t
atggctagtacaactatgatagtatctctaattgtagctgttgccgaaaataatgttatcggtaaggacaacacccttatatggcacttgcctaaagacatgcaattttttaaacaaactaccctgaaccatcatattattacaggtagaaaaaattacatttctattcccgaaaaatttcgaccgttggctagtagaactaacattgtgcttacccgacaaaatgattttacagaacaaggttgtgtagttctaaactcgttggaagctgctattgaatttgccaaaaataataatgaaagtgaagtttttattattggtggcggacaaatttataaagaagctttagataaagatttagtagataaaatgtacattacacatgttcatcatgcttttgaaggagacacattttttccagagattgacagttcaaaatggaaaaaaacaagtgaagaacatcacagcaaagacgaaaaacatgcttatgattttagtttttgtatttattctagaatttaa

SEQ ID NO: 12378 - protein, 173 aa, Unknown
  Obtained from environmental sample
  SIGNAL (1)...(15)
  DOMAIN (7)...(172): Dihydrofolate reductase
  misc_feature (1)..(173): Xaa is any amino acid
MASTTMIVSLIVAVAENNVIGKDNTLIWHLPKDMQFFKQTTLNHHIITGRKNYISIPEKFRPLASRTNIVLTRQNDFTEQGCVVLNSLEAAIEFAKNNNESEVFIIGGGQIYKEALDKDLVDKMYITHVHHAFEGDTFFPEIDSSKWKKTSEEHHSKDEKHAYDFSFCIYSRI

SEQ ID NO: 12379 - DNA, 441 bp, Unknown
  Obtained from environmental sample
  misc_feature (1)..(441): n is a, c, g, or t
ttgaaaatactagtaacaggtacagctggttttataggttatcatcttgctttgaaattattacaaagaggtgatgaggttataggacttgataatatcaatgactattatgatgttaacttaaaatatgcaagattatctaaattgggtatattaaaagagaatattaaagaaaatattcttatatctagtcataagtatccaaatcataagtttatcaaaattgatttatcagataaaaagtttattgataaattatttaaggctgagaagtttgattctgtatgcaacttagcagctcaagcaggagttcgttatagtcttgaaaatccaaatgcgtatattcaaaataatgtggtggggtttatgaatatattagaggcttgtcgttattttggtgtaaaaaacttatcttatgcttcatcactcagccgaatctga

SEQ ID NO: 12380 - protein, 146 aa, Unknown
  Obtained from environmental sample
  DOMAIN (3)...(145): NAD dependent epimerase/dehydratase family
  misc_feature (1)..(146): Xaa is any amino acid
MKILVTGTAGFIGYHLALKLLQRGDEVIGLDNINDYYDVNLKYARLSKLGILKENIKENILISSHKYPNHKFIKIDLSDKKFIDKLFKAEKFDSVCNLAAQAGVRYSLENPNAYIQNNVVGFMNILEACRYFGVKNLSYASSLSRI

SEQ ID NO: 12381 - DNA, 627 bp, Unknown
  Obtained from environmental sample
  misc_feature (1)..(627): n is a, c, g, or t
ttgaaaattaggcatatatattattttgccaatcataatctttcaggtataagtgttaggtatagaggtgtttatgttttaaattttctttttgaatcttatggtatttctaatactatagtttaccctggttataaagctgtagaaattttaaattttttcaaagtctattttgaaattttatttttcagaaaaaataactcattaattatatttcaaaaactttatactaaaggcatatacactaatttacttaagttattattgatattgagacctagtatgactgtgtatgatattgatgatgctgattacttgagatttgataaaaagaacattgttttttttatgaaaaacaccaaaatctgtatagttgggagtaaagcactatttaattatgtaaaagaaatcaataaaaatgttttagtattaactactcctataatacatcaccaacatattaaaactaacagaaattctgttatacatattggttgggtaggggattatggatttaataaaggttcacaagctttgtttagtcacaaaatgagtttagagcaattatttttacctgctttaaatgaattgaactttccttttaaactgacattgttaggaaattaa

SEQ ID NO: 12382 - protein, 208 aa, Unknown
  Obtained from environmental sample
  misc_feature (1)..(208): Xaa is any amino acid
MKIRHIYYFANHNLSGISVRYRGVYVLNFLFESYGISNTIVYPGYKAVEILNFFKVYFEILFFRKNNSLIIFQKLYTKGIYTNLLKLLLILRPSMTVYDIDDADYLRFDKKNIVFFMKNTKICIVGSKALFNYVKEINKNVLVLTTPIIHHQHIKTNRNSVIHIGWVGDYGFNKGSQALFSHKMSLEQLFLPALNELNFPFKLTLLGN

SEQ ID NO: 12383 - DNA, 558 bp, Unknown
  Obtained from environmental sample
  misc_feature (1)..(558): n is a, c, g, or t
atggaattaggtaaaaatttatctcccaaagctcaaatagattacgaattggttgtgaaagcaagagaccatcaggatgaaaaagcttatgctattctgttagaaaaatacaaggattctattttttatatgatgcttaaaatggttaagaatcaagatgatgctgatgatttaaccattgaagcttttggtaaagcttttaatcgtttgcaccaatatactcccgattatgcgtttagtacttggctttttaaaattgctactaacaactgcatagattttatccgtaagaaaaaaatggtaactttttctatagataaaggttttgaagatagtgaaggcaataattctactttcgatattaaggagaataacttaaacccggaagaaaaatttatgcgaaagcaaaagattagaattatgcgtgaaatggtagatcatttaaaaccacgctataaacaattaattgttttaagatattttagagaattatcttacgatgaaattgctgaagctacagaacttcttttgggaactgtaaaagccccaattatttag

SEQ ID NO: 12384 - protein, 185 aa, Unknown
  Obtained from environmental sample
  DOMAIN (33)...(100): Sigma-70 region 2
  misc_feature (1)..(185): Xaa is any amino acid
MELGKNLSPKAQIDYELVVKARDHQDEKAYAILLEKYKDSIFYMMLKMVKNQDDADDLTIEAFGKAFNRLHQYTPDYAFSTWLFKIATNNCIDFIRKKKMVTFSIDKGFEDSEGNNSTFDIKENNLNPEEKFMRKQKIRIMREMVDHLKPRYKQLIVLRYFRELSYDEIAEATELLLGTVKAPII

SEQ ID NO: 12385 - DNA, 708 bp, Unknown
  Obtained from environmental sample
  misc_feature (1)..(708): n is a, c, g, or t
gtgttggtaaagcaaattgcagatattaaaaccataattgttgagactgaaattgaggccttgttgttggaaaacaacctcataaaaaaatatcaaccgaagtataatgtaatgcttaaggatgataaaacctacccatggatttgcattaaaaacgaacgatttccacgagtgttttctaccagaaacatagttaaagatggttctgagtattttggaccttacgcttctgtaagaatgatgaataccattttggaacttatccgaaagttatatccattaagaacatgtaactataatttatcgcaagaaaatattgataatgacaagtttaaggtgtgtttagaataccacattggtaattgtagagctccttgtgtgggaaatcaaacagaagatgattatgcagaagctattcagaatataaaagccattattaaaggaaatattcatggagtaattaagtacttaaaacaactcatgaagcaatatgctgatgaattggcatttgaaaaagcccaattgataaaagaaaaaattcagttgctggaaaattaccaaagtaaatcagtagtggttagtcctaccattaatgatgtggatgttttctctattatttccgatgaaaaatatgcctatgtaaactacctaaaagtgattaatggagctattattcagggacataccattgagttgaaaaagaattag

SEQ ID NO: 12386 - protein, 235 aa, Unknown
  Obtained from environmental sample
  DOMAIN (151)...(186): UvrB/uvrC motif
  misc_feature (1)..(235): Xaa is any amino acid
MLVKQIADIKTIIVETEIEALLLENNLIKKYQPKYNVMLKDDKTYPWICIKNERFPRVFSTRNIVKDGSEYFGPYASVRMMNTILELIRKLYPLRTCNYNLSQENIDNDKFKVCLEYHIGNCRAPCVGNQTEDDYAEAIQNIKAIIKGNIHGVIKYLKQLMKQYADELAFEKAQLIKEKIQLLENYQSKSVVVSPTINDVDVFSIISDEKYAYVNYLKVINGAIIQGHTIELKKN

SEQ ID NO: 12387 - DNA, 357 bp, Unknown; identical to SEQ ID NO: 12331
  Obtained from environmental sample
  misc_feature (1)..(357): n is a, c, g, or t

SEQ ID NO: 12388 - protein, 118 aa, Unknown; identical to SEQ ID NO: 12332
  Obtained from environmental sample
  misc_feature (1)..(118): Xaa is any amino acid

SEQ ID NO: 12389 - DNA, 795 bp, Unknown
  Obtained from environmental sample
  misc_feature (1)..(795): n is a, c, g, or t
atggatagcacagagtactttagcaataatagtattaagctagatgctctaatagacttagatttagatcaacagaaatatacatttaaagaaaacaaggcttacattaacgctttacctttagagttcgatgggtttatacaattggttgaagctggccaaaacattgatattacatttaaaaacccaggagctacttttaaagatttcttggctgtgattcctaaagcttacaccaaggatattgaaaatgtaagtaccacagggaactttactgttaatggagtggttaaaggtttggtttcagaagaaacgattccaacactagacatccgtttaaattctaacaatgcctcatttaaatatccagacctccctaagagtgtaaaaaatatagctatcgatgcttctgtaaaaaataccacaggaaatgttgacgacacctatgtaaatattgataaattgaattttcaggttgatgaagatgtttttaaatctgaagcttcaattaaaaatctcactcaaaatatgctcatttcggcaaaattggatggtgtattaaatttagctaacattacaaaagcctatcctgttgagcttgatagcgaactcagtggtatcctaaaaggtaacgtaagtacttcttttgatatgaatgctcttgaaactaatgcctaccaacgtattaaaaatgttggaagtgtatctatttcggactttatcttttcttctgaagatatggcaaatcctgtgcaaattaacgaagctagcttagcctttaaaccggaactgtga

SEQ ID NO: 12390 - protein, 264 aa, Unknown
  Obtained from environmental sample
  misc_feature (1)..(264): Xaa is any amino acid
MDSTEYFSNNSIKLDALIDLDLDQQKYTFKENKAYINALPLEFDGFIQLVEAGQNIDITFKNPGATFKDFLAVIPKAYTKDIENVSTTGNFTVNGVVKGLVSEETIPTLDIRLNSNNASFKYPDLPKSVKNIAIDASVKNTTGNVDDTYVNIDKLNFQVDEDVFKSEASIKNLTQNMLISAKLDGVLNLANITKAYPVELDSELSGILKGNVSTSFDMNALETNAYQRIKNVGSVSISDFIFSSEDMANPVQINEASLAFKPEL

SEQ ID NO: 12391 - DNA, 690 bp, Unknown
  Obtained from environmental sample
  misc_feature (1)..(690): n is a, c, g, or t
atggcaagtatgggtgaaatgattggaaatatcgctcatcaatggaggcaacctctcaatgctttagggttaacaatacaaaaaataaaaatgtattatgaagaagatatgttatctcaagaagaactggataaggcagtagataaaagtaaagttctgattactaaaatgtcaacaactatagatgattttagaaatttttttagaatagataaaacaaaacaacaatttaatataaaagatgccatacaagatacaatgggtttagtagatgctagtctaaaaaatcatcatatttttattgatataactaaaacaaataatgatattgattttttagggtataaaaatgaattagaacaggtattattaaatcttattaataatgccaaagatgctttagtggaaaataatattgaaaatccaaaaatatctatagaaagttttctacaaaataactatatatttatagaaatacaagataatgcaggtggaatttctaatgaaattattgcaaatatatttgatccatattttactacaaaagagcaaggaaaaggtacgggaataggtttatatatgtcaaanatgataatacaaaataatatgagtggaaatatcacagtagaaaataaactagatggtgcttgttttagtataaagttaaatcaggaaaaaataaatgaataa

SEQ ID NO: 12392 - protein, 229 aa, Unknown
  Obtained from environmental sample
  DOMAIN (3)...(73): His Kinase A (phosphoacceptor) domain
  misc_feature (1)..(229): Xaa is any amino acid
MASMGEMIGNIAHQWRQPLNALGLTIQKIKMYYEEDMLSQEELDKAVDKSKVLITKMSTTIDDFRNFFRIDKTKQQFNIKDAIQDTMGLVDASLKNHHIFIDITKTNNDIDFLGYKNELEQVLLNLINNAKDALVENNIENPKISIESFLQNNYIFIEIQDNAGGISNEIIANIFDPYFTTKEQGKGTGIGLYMSXMIIQNNMSGNITVENKLDGACFSIKLNQEKINE

SEQ ID NO: 12393 - DNA, 702 bp, Unknown
  Obtained from environmental sample
  misc_feature (1)..(702): n is a, c, g, or t
atgaaaatatttagtgagctaggaaaggaaaaaaattatcaattttgcttaaagctaaaatctatctatatggaaattgctacaatgcactactatttagacaaaggatttatatataattattctaatcatttaggtgataaaacagacttaatattagaaaaaaataaaaaagtttacgatatacaagttaaacataaacaatcactagatgactttaaagatatttttattacatatttgattgggattgctatgctcaagaaatatgagtatctaaaaaataaatattattattttaattttaatcaagaatttttagattataaagaaagaaaacaagcatggaatgaattagagaaattcacagcaaataaagagaatatttacaatggtaaatatattacaattaatagtaaagtaacaaattcaacacaaattaatgctactgaaataaccgatgaacttataaatgaaaaaaaagcagaagccttaatcaataatataatacctagcatagttgataaactcacagatcagtataatgcacagttaaataatgaacatatttttatcggtgttataatatggagtgtgccatttaaatgtgaagcagattttgataatataaaaaagaaaatgcaaagtatattcaatcctttattcgaattaaatattacactccatgcttttgaaaaaaaa

SEQ ID NO: 12394 - protein, 234 aa, Unknown
  Obtained from environmental sample
  misc_feature (1)..(234): Xaa is any amino acid
MKIFSELGKEKNYQFCLKLKSIYMEIATMHYYLDKGFIYNYSNHLGDKTDLILEKNKKVYDIQVKHKQSLDDFKDIFITYLIGIAMLKKYEYLKNKYYYFNFNQEFLDYKERKQAWNELEKFTANKENIYNGKYITINSKVTNSTQINATEITDELINEKKAEALINNIIPSIVDKLTDQYNAQLNNEHIFIGVIIWSVPFKCEADFDNIKKKMQSIFNPLFELNITLHAFEKK

SEQ ID NO: 12395 - DNA, 537 bp, Unknown
  Obtained from environmental sample
  misc_feature (1)..(537): n is a, c, g, or t
gtgaaagaaaagcaacgtcgtatcgatttgtcgttgttagaggataaccaaatggaaaataaattgggtattacaatacatatcccttcagtgtatagaattagtaaagctgacgaagattttttctgggttcgtaaaaacctttctaattctaagacgatggagttaatgttttatgaagtaccattagaaactatttctaaaggagacagcactattgtagatatcgtgaagatgagagatgagattacaaaatctaaaattccaggtgaagatggtatttatatggctgtagaagatgcttatgctccatctatgtttaaaactataatagacaacaaacctgcatacgaaataagaggtatgtgggaaatgaaaggttataccatggcaggtccatttataacgtatgcaatagaagataaaataaacaatcgttacttaattgcagatgggtatgtatatgcaccttctttagaaaaacgagattatatttttgaattagaatctattattaaatctattactataaagtag

SEQ ID NO: 12396 - protein, 178 aa, Unknown
  Obtained from environmental sample
  misc_feature (1)..(178): Xaa is any amino acid
MKEKQRRIDLSLLEDNQMENKLGITIHIPSVYRISKADEDFFWVRKNLSNSKTMELMFYEVPLETISKGDSTIVDIVKMRDEITKSKIPGEDGIYMAVEDAYAPSMFKTIIDNKPAYEIRGMWEMKGYTMAGPFITYAIEDKINNRYLIADGYVYAPSLEKRDYIFELESIIKSITIK

SEQ ID NO: 12397 - DNA, 843 bp, Unknown
  Obtained from environmental sample
  misc_feature (1)..(843): n is a, c, g, or t
ttgaaaaagtctggaaaaccagtaggagaactgtttaaaaatttcaacttatttatttttggtggtgttaattacgagccttaccgggctaagttcgaaaacttaattgggagaaaagtagatagtatagaattgtatccggctagtgaaggcttttttgcatatcaagataaacagcaagagcgagggatgttacttcagttaaattcgggtatattttacgagtttattgaagccgaacatttttttgatgagaaccctaaacggatcaccattgcagatgtaaagttaaacgtaaattacgtaatgattatttctacaactgctggtctttgggcatacaatattggagatactgtagagtttacatcattaaaaccctatagagtgattgtaagcggacgcattaaacattttatttcagcctttggagagcacgttatcggaaaagaagtagagcaagccctaaaggatgctacggctaaaacatcaatttctgtaaatgagtttacggtggctcctcaaataagtccggaagaaggcttaccgtatcacgaatggttaattgaatttgaaaacgaacctgaggatgaagccgctcttattgaagctttagatcagtctttacagcaacaaaatagttattatttagatttaattgaaggaaaagtactgagacctttaaaagttacaaaaattaagaaagatggatttcaaacctatatgaaatctatagggaaattgggtggtcaaaataaaattccacgactttctaatgatagaaaaattgcagatagtatgcaccaacttcngagccgatctgatacatggtnnttaaaataa

SEQ ID NO: 12398 - protein, 280 aa, Unknown
  Obtained from environmental sample
  misc_feature (1)..(280): Xaa is any amino acid
MKKSGKPVGELFKNFNLFIFGGVNYEPYRAKFENLIGRKVDSIELYPASEGFFAYQDKQQERGMLLQLNSGIFYEFIEAEHFFDENPKRITIADVKLNVNYVMIISTTAGLWAYNIGDTVEFTSLKPYRVIVSGRIKHFISAFGEHVIGKEVEQALKDATAKTSISVNEFTVAPQISPEEGLPYHEWLIEFENEPEDEAALIEALDQSLQQQNSYYLDLIEGKVLRPLKVTKIKKDGFQTYMKSIGKLGGQNKIPRLSNDRKIADSMHQLXSRSDTWXLK

SEQ ID NO: 12399 - DNA, 618 bp, Unknown
  Obtained from environmental sample
  misc_feature (1)..(618): n is a, c, g, or t
ttgaaaactaaacatcaaaaactaatcaagcttttatatgataatgatgagttaatagataagatttataaaaatccaaactctgttcactcttcaaatattcctcctaatcttctagaacaaggtataatattaaaacttggagaagctgttgatttaaatcctttttataggcaatttgtaaatactatattattaaaagcagactattcaattctttttggaaattttgatgaacattcaaaagagattatctctttaaaaaaacgttatttagaaacaaatgattatggtttaataataaaaataaaaaacctaatacatagtctatatatgtcagttgaattacaaaataaacaaatagaagctttactttatagtatggaaaatcaaataaatatagaattagaccaattaatacatgaagctagttcactacatgataaagtggaaagctatttaacctctatcaaaaatatattaagagatttagatgatgatttagcttccattaattcggagattgaagagagcgtagatactaccaattacactttagaaccttatttatctaaaatagaatcttattgtgatagattttctgatttaatagaattt

SEQ ID NO: 12400 - protein, 206 aa, Unknown
  Obtained from environmental sample
  misc_feature (1)..(206): Xaa is any amino acid
MKTKHQKLIKLLYDNDELIDKIYKNPNSVHSSNIPPNLLEQGIILKLGEAVDLNPFYRQFVNTILLKADYSILFGNFDEHSKEIISLKKRYLETNDYGLIIKIKNLIHSLYMSVELQNKQIEALLYSMENQINIELDQLIHEASSLHDKVESYLTSIKNILRDLDDDLASINSEIEESVDTTNYTLEPYLSKIESYCDRFSDLIEF

SEQ ID NO: 12401 - DNA, 552 bp, Unknown
  Obtained from environmental sample
  misc_feature (1)..(552): n is a, c, g, or t
ttggcattgacagcaatagtttttgaaatactaaaagatgggagtattatatcttcaaattctaaagatgaacaaataagaagtatattttatagcctaagtgatgataatgtatttgaagaaacacaaaaggtatttcaacaaataggatttaaacttatctatgaagataattgtttttatttgtctaaacaaagctatttcaatgataaagaacaagataaattcattaaaaaatatagagatagttttctagcactctctatattaaagtatttttttcaaggtatatccagtggaagagaattttcaaaaagttctttaatagcaaaagcaaataataatttggatgttcaagtaaaagagactttagaatatctaacaaaaaaagaggatgatttatctggttcaatggaagtggtattaaaaatattaagggaaaataaaattattgaaagaatagataaaaaaaatgaagataaatatttcgtgttagatgctataggatattttaatagtattttaaaacaactggagaatgtcgatgcttaa

SEQ ID NO: 12402 - protein, 183 aa, Unknown
  Obtained from environmental sample
  misc_feature (1)..(183): Xaa is any amino acid
MALTAIVFEILKDGSIISSNSKDEQIRSIFYSLSDDNVFEETQKVFQQIGFKLIYEDNCFYLSKQSYFNDKEQDKFIKKYRDSFLALSILKYFFQGISSGREFSKSSLIAKANNNLDVQVKETLEYLTKKEDDLSGSMEVVLKILRENKIIERIDKKNEDKYFVLDAIGYFNSILKQLENVDA

SEQ ID NO: 12403 - DNA, 792 bp, Unknown
  Obtained from environmental sample
  misc_feature (1)..(792): n is a, c, g, or t
ttgcaagagtcaatctctgtaaatatcatgaaacactcgatcaaatatctgaaaaagttttttgtaaagaaaaaccacattctatttttagcaccggactttgtagacaataatattaaagatctctatatctacatatctactcaaacagactatagagctgtgatagcaactaataatctttctcatgaagagcttttaaaaaatagtggctttcatgtaataaaatacccctctttagcatttgtatacaatagcttaaaatcaaacataacaattcttgatcacactccaaactcaaaactcttaaaagagtccataaaaaactcatttactgttcagatttggcatgggatagctcttaaaaagatcggtggggctgattataaagatatcgattatgatctatttatatctacctctgattatgtaagcgaaaagaatttcaaagatgtcttcaaatataaagagatcatcaacagcggataccctcgtaatgatattttcacaaatcaaaatattacacaaatgcacaaagtttttttgagtgatgagatatatgaatttgtaagaggcagctcgctgaaaaccatagtctatatgccaacatacagagagaacagcttcgcttcaaatccactaaattttgagatgttaaataagtttgcaaaagagaacaaccttttcatcatcataaaactgccccccattttcaactcctggggatgtttggataccctcttcttcagagaggttttgaattcaaaaagaactattgatgaaaaaatcctc

SEQ ID NO: 12404 - protein, 264 aa, Unknown
  Obtained from environmental sample
  misc_feature (1)..(264): Xaa is any amino acid
MQESISVNIMKHSIKYLKKFFVKKNHILFLAPDFVDNNIKDLYIYISTQTDYRAVIATNNLSHEELLKNSGFHVIKYPSLAFVYNSLKSNITILDHTPNSKLLKESIKNSFTVQIWHGIALKKIGGADYKDIDYDLFISTSDYVSEKNFKDVFKYKEIINSGYPRNDIFTNQNITQMHKVFLSDEIYEFVRGSSLKTIVYMPTYRENSFASNPLNFEMLNKFAKENNLFIIIKLPPIFNSWGCLDTLFFREVLNSKRTIDEKIL

SEQ ID NO: 12405 - DNA, 609 bp, Unknown
  Obtained from environmental sample
  misc_feature (1)..(609): n is a, c, g, or t
atgcacaaagtttttttgagtgatgagatatatgaatttgtaagaggcagctcgctgaaaaccatagtctatatgccaacatacagagagaacagcttcgcttcaaatccactaaattttgagatgttaaataagtttgcaaaagagaacaaccttttcatcatcataaaactgcacccattttcaactctagggatgtttgatacactctcttcagagaggtttgaattcagaaagaactatgatgaaaatatactcttctatcccaatggtaaagatatctaccctattttaaaatttagtgatatgctcataacagactactcctctatctattttgattatcttcttttaaataagccgatactcttttttgtttatgacatggatgagtatattgggtcgcgtggtgactttatgctggattttgagagagttaccccaggtaaaaaatgttacgattttgacgatctaagagaaggaattctcgatcagcttcaaaataacacttttgcacttgatcgagaaaaattaaaagataaactatttgaagaaagttctaaaagtgccagtgaagagattttcaaaaaattaaaggattttagttga

SEQ ID NO: 12406 - protein, 202 aa, Unknown
  Obtained from environmental sample
  DOMAIN (7)...(200): CDP-Glycerol:Poly(glycerophosphate) glycerophosphotransferase
  misc_feature (1)..(202): Xaa is any amino acid
MHKVFLSDEIYEFVRGSSLKTIVYMPTYRENSFASNPLNFEMLNKFAKENNLFIIIKLHPFSTLGMFDTLSSERFEFRKNYDENILFYPNGKDIYPILKFSDMLITDYSSIYFDYLLLNKPILFFVYDMDEYIGSRGDFMLDFERVTPGKKCYDFDDLREGILDQLQNNTFALDREKLKDKLFEESSKSASEEIFKKLKDFS

SEQ ID NO: 12407 - DNA, 705 bp, Unknown
  Obtained from environmental sample
  misc_feature (1)..(705): n is a, c, g, or t
atgatagaagatcctcaaattatgtgtacaatcagtacaggtaaatttgatatgacttttaaatcgatggttccaatttatgataaaagtacttttataggaatgtttgagattattacccattttaattctatatcaaatcaacttcttgatagtgatatagattctattatagttgtagataagaagtataaagctcagctttctaaagcattaacaagaatatttattgatgattattatgttgcaaatgaaaatgtaaaagaggagataattgattatataaaaagtaaggatataaaaaactatatacatagtgacaaaaaatatatcattgaccaaaaagagaataaatttattgtagtttataatattccagatatctataataatcctatgggaagtatcattgcttttaaagatttagattctttaaatatggatgatattgaatatgtaaaaacaaacatgatattttatatagtattatttatcttagtggttattttaataggatattattttctagcaagaaagcatacaaaagaactagacatcaaggttattaaaagaacaaaagaattatacaacgaaaaacgatatatacagacaatattagatacgaatcccagtattattattgttactcaaaactctaaaataacaaatgcaaacaaaaggttttttgaatttttttccctataa

SEQ ID NO: 12408 - protein, 234 aa, Unknown
  Obtained from environmental sample
  misc_feature (1)..(234): Xaa is any amino acid
MIEDPQIMCTISTGKFDMTFKSMVPIYDKSTFIGMFEIITHFNSISNQLLDSDIDSIIVVDKKYKAQLSKALTRIFIDDYYVANENVKEEIIDYIKSKDIKNYIHSDKKYIIDQKENKFIVVYNIPDIYNNPMGSIIAFKDLDSLNMDDIEYVKTNMIFYIVLFILVVILIGYYFLARKHTKELDIKVIKRTKELYNEKRYIQTILDTNPSIIIVTQNSKITNANKRFFEFFSL

SEQ ID NO: 12409 - DNA, 327 bp, Unknown
  Obtained from environmental sample
  misc_feature (1)..(327): n is a, c, g, or t
gtgattcgtgtttcagggaacaacctgataatagagaaatatttattgggagaaccaatgatgaaaacttatgatttaatgaggattgagaaattgaaatacgaaaaaaaagtaaaatcagatttttactcttcacatggaagtgttaaagtaatgggactaaatgtaactcctgaaagcatgaaaacatattattatcacaatgaaattatatcttttaaatttaaaaataagttagttgaacttggtaaatggaaaaaggaatttggtggagaaaaattattcaaaattttaagtgaaaaaattatcaaactaaatattaattga

SEQ ID NO: 12410 - protein, 108 aa, Unknown
  Obtained from environmental sample
  misc_feature (1)..(108): Xaa is any amino acid
MIRVSGNNLIIEKYLLGEPMMKTYDLMRIEKLKYEKKVKSDFYSSHGSVKVMGLNVTPESMKTYYYHNEIISFKFKNKLVELGKWKKEFGGEKLFKILSEKIIKLNIN

SEQ ID NO: 12411 - DNA, 795 bp, Unknown
  Obtained from environmental sample
  misc_feature (1)..(795): n is a, c, g, or t
ttgttacttgttataattacaggtcagtgtgtctattggtttgttccgaatctattttcaaatacaagtttcgactttacccaaaatcaaaatcaattagaagcttttaaaaaagaattagactcacttcgtttaattaaaatagcacaaagtaaacctaacatttatccgtttaatccaaattatattacagattataaaggttatactttaggaatgaccaatgaagaaatagatagacttcatgcatttagagctactgatcaatgggtgaattctgtaagccaatttcaaaaagtgacgaaagtatctgattcgttattaaaaataatttctccatattttaaatttcctagttgggtaaaccaatctcaatctcaaaccaaggcatattcaaacgcatatgccaactttacaaaaccgaaaagttttaaacaaaaaatagatttaaatattgcaacggctgctcagctaaaaaaagtgtatggtgttggggaaaaactttctcaacgtattgtagcctatcgaaacaagtttaaaggaggttttattgcggatattgaactcagtgaagtctatggtttgtcgcccgaagtcataacacgtattcaaaatgactttacagtaaaaacacctagagtcataaagaagattcatctcaacacggcgacaagagatcaacttgtaaatattcagtatatagactatgaaattgcccaccatattatagaagaacgtacccttagagatggatttaattccttggaagaattattaaaagtgaagtttccgtaa

SEQ ID NO: 12412 - protein, 264 aa, Unknown
  Obtained from environmental sample
  misc_feature (1)..(264): Xaa is any amino acid
MLLVIITGQCVYWFVPNLFSNTSFDFTQNQNQLEAFKKELDSLRLIKIAQSKPNIYPFNPNYITDYKGYTLGMTNEEIDRLHAFRATDQWVNSVSQFQKVTKVSDSLLKIISPYFKFPSWVNQSQSQTKAYSNAYANFTKPKSFKQKIDLNIATAAQLKKVYGVGEKLSQRIVAYRNKFKGGFIADIELSEVYGLSPEVITRIQNDFTVKTPRVIKKIHLNTATRDQLVNIQYIDYEIAHHIIEERTLRDGFNSLEELLKVKFP

SEQ ID NO: 12413 - DNA, 597 bp, Unknown
  Obtained from environmental sample
  misc_feature (1)..(597): n is a, c, g, or t
ttgcatttagttgatttagaaggtgctaagaatcagaaaataatgaacattaaaactttagaaagaatagcctctaatactagtttgactattgattttggtggtggagttaagtctgagcagagtcttttagatgcttataatgctggtgctacacgagtaacttgtggaagtatagcagtaaaaaataaagatttagtattacaatggcttgccaaatattcaagcgataaattaattttaggggctgactgtataaacaatatggttgctacatcaggctggcttgaagttagtcaattaatagtagatgaattcattaatagttatctgaataaaggtttcaaacgagttatttgtactgatatttctaaagatgggatgatgagtggtccttcttttgatttatataaacttctgatagctaattgttcttcttccctagagctagtagcttcaggtggtgttagttcaattgaagatattaaaaaattacatgaagacaagttacatagtgtaattgttggtaaagcatatttagaaggtaaaattagcataaaagagttaggcaaattgcaggagaattttagatgttag

SEQ ID NO: 12414 - protein, 198 aa, Unknown
  Obtained from environmental sample
  DOMAIN (1)...(185): Histidine biosynthesis protein
  misc_feature (1)..(198): Xaa is any amino acid
MHLVDLEGAKNQKIMNIKTLERIASNTSLTIDFGGGVKSEQSLLDAYNAGATRVTCGSIAVKNKDLVLQWLAKYSSDKLILGADCINNMVATSGWLEVSQLIVDEFINSYLNKGFKRVICTDISKDGMMSGPSFDLYKLLIANCSSSLELVASGGVSSIEDIKKLHEDKLHSVIVGKAYLEGKISIKELGKLQENFRC

SEQ ID NO: 12415 - DNA, 687 bp, Unknown
  Obtained from environmental sample
  misc_feature (1)..(687): n is a, c, g, or t
ttgttggaacttcttgccaaaacagataattatgaaagagctgataattacataatggctaacgagaatcttttagagtcaaatccatataaaaaaagtagtaaatcttggcaatttttagagatctgtgagttagattatgacaatggctactcaaagcttgtacctgtagaaattttagaagagtatggtcttaaaactacaaatggcggagattggtgcagaagtgatggcaacttaggtaaatactttaatgttaacagagttaaagataaaggtagaattactggtgttcaactgatgggatacaaaaaaaacagcttctctgctaaaataaaccctcagataagagatttttacaaagagtctgattgtcatgtattggcaattggcggtaagtttatagagatcgatcataaagatggcagaaaagatgactttgccatgcccgaagatcagacgactagtgattttcaaccacttcatagaaacgtaaacatagcaaaaagagagcactgcagagtctgtaaagatacaaatataagatttgatgccctaaaacttggttacatagtttcacaatggatcggtaacaaagagtataatggaagctgtgtcggatgttactggtatgaccctttagagttcaatagaaaaatttcgcaaaacttcctcaaccccagataa

SEQ ID NO: 12416 - protein, 228 aa, Unknown
  Obtained from environmental sample
  DOMAIN (32)...(227): ICEA Protein
  misc_feature (1)..(228): Xaa is any amino acid
MLELLAKTDNYERADNYIMANENLLESNPYKKSSKSWQFLEICELDYDNGYSKLVPVEILEEYGLKTTNGGDWCRSDGNLGKYFNVNRVKDKGRITGVQLMGYKKNSFSAKINPQIRDFYKESDCHVLAIGGKFIEIDHKDGRKDDFAMPEDQTTSDFQPLHRNVNIAKREHCRVCKDTNIRFDALKLGYIVSQWIGNKEYNGSCVGCYWYDPLEFNRKISQNFLNPR

SEQ ID NO: 12417 - DNA, 483 bp, Unknown
  Obtained from environmental sample
  misc_feature (1)..(483): n is a, c, g, or t
gtgtcgccgagattcagaaccgataaattgaaaggtaaaaaaagagcattaaaatatattacggtattattagaccaatatgagaattataagagttttacattgttagaattttcacaatttgtaaaagaaaatattgattcaaatatttcaaaagtaagtggtggtaaaataaaatctttttatgacacatacagctttaatcaattattactttgtgtatcaatacctgaagatttaagccttcataaaactattcataaagcaaaaggtgatgaatttaataatgttttattagttttaaaagaagaaaacgatataaactttttgataaactctgatttaaacaataatgaagaacaccgtattaattatgttgcactaagtagagcaaaaaatagactgtttatttctatacctattttagatgatgtgaaaaaaaacacattaaatggtgtctttgaaatagaaaacattcaataa

SEQ ID NO: 12418 - protein, 160 aa, Unknown
  Obtained from environmental sample
  misc_feature (1)..(160): Xaa is any amino acid
MSPRFRTDKLKGKKRALKYITVLLDQYENYKSFTLLEFSQFVKENIDSNISKVSGGKIKSFYDTYSFNQLLLCVSIPEDLSLHKTIHKAKGDEFNNVLLVLKEENDINFLINSDLNNNEEHRINYVALSRAKNRLFISIPILDDVKKNTLNGVFEIENIQ

SEQ ID NO: 12419 - DNA, 816 bp, Unknown
  Obtained from environmental sample
  misc_feature (1)..(816): n is a, c, g, or t
ttgttaatggacaatatacacaagagtcccattaaagccatacttaatattttagataaagatatcaaaatggtttttgcacataaatttttagataaaaataaaaagagtgagataagagcacttcaagagatacttgatgataaactttttagtggtgagggtcaaatcttctcatttgatgcactattaacacaatcaaacattctcaatactatcaattcccaaggaaatagatatattgctaaactcaaagataatcaagataacctaaaacaaaaagctgttgagacagttgaagcgtttgaaactccaaatgatagttatgatgacaaagatgggtatcttaatgaaaacaataaaagagttactagaacagtagaggtatatcaaaataaaaattgtaacttagtgatgcatcatgagagatttgataatattcaatcgctaattaaagtcactaagcaattaacgaatcctatcactggagaacatacacaaacagtgcaatacttaatggctaatttcaaaactacagcagaagatttctaccaaaagatactgcaacattggcggatagaaacttaccactatcatttggatatgttagtagaagaagatcaacatattgcatacaaagagcctttctctatggcaatactcagaagttttgcaattaatctttatcagttatttttgaatgctaacaaagataaaaaaattctaccaactggaaaaacaacaatggcagagattaaaagaaattgcctatatcgcgatgattttactgctgatctgttgagcaggaaggtgtaa

SEQ ID NO: 12420 - protein, 271 aa, Unknown
  Obtained from environmental sample
  misc_feature (1)..(271): Xaa is any amino acid
MLMDNIHKSPIKAILNILDKDIKMVFAHKFLDKNKKSEIRALQEILDDKLFSGEGQIFSFDALLTQSNILNTINSQGNRYIAKLKDNQDNLKQKAVETVEAFETPNDSYDDKDGYLNENNKRVTRTVEVYQNKNCNLVMHHERFDNIQSLIKVTKQLTNPITGEHTQTVQYLMANFKTTAEDFYQKILQHWRIETYHYHLDMLVEEDQHIAYKEPFSMAILRSFAINLYQLFLNANKDKKILPTGKTTMAEIKRNCLYRDDFTADLLSRKV

SEQ ID NO: 12421 - DNA, 420 bp, Unknown
  Obtained from environmental sample
  misc_feature (1)..(420): n is a, c, g, or t
atgtgggaaaagattcttaaaagttttaatcatagtaatattgttaattcgtttaatagtatgaagataataaatattttatccaatgttaatattaatgaaaaaataaagataaaaggtgaaaaagaaactttatatattagtcaagcacgattaaattatgaatttaaaaattataagcaaactattgaaatatgtatggaagctatttctgaaaaaatacatgacgatgatatctttttatatttaggtaaagcatataaaaaaaccgatagattaaaagaagcaattgtttatttagaaaaagctattgatataaatccctttttatatgaagctcatgaaaatttaagcccatcttttatgacattttctttaacgggaaaaaaatatattttaaaaatcaaaaatggcttttaa

SEQ ID NO: 12422 - protein, 139 aa, Unknown
  Obtained from environmental sample
  DOMAIN (77)...(110): TPR Domain
  misc_feature (1)..(139): Xaa is any amino acid
MWEKILKSFNHSNIVNSFNSMKIINILSNVNINEKIKIKGEKETLYISQARLNYEFKNYKQTIEICMEAISEKIHDDDIFLYLGKAYKKTDRLKEAIVYLEKAIDINPFLYEAHENLSPSFMTFSLTGKKYILKIKNGF

SEQ ID NO: 12423 - DNA, 366 bp, Unknown
  Obtained from environmental sample
  misc_feature (1)..(366): n is a, c, g, or t
atgaactctgttgatcatattcgtctgagatgtatcgctatcaagatcaataaaaagaatattcagatctggatacagctctttcatctttttttccacgcccttagctacgacctgatttgcaatacatccaaacggctgcagacagagaatgtttttaataccattttctgcaaagaaagcaatttcagcggctataagccatccttctccaaactgatttaccagagaaagtatccgggaagctttaccggaaagatctctcaactcaggatagggaaaaccaaatctgaatctctgcatttcctttgccacctttttatgaaaatttgcgaaatatttttccaggagaggaagaaaaagtga

SEQ ID NO: 12424 - protein, 121 aa, Unknown
  Obtained from environmental sample
  misc_feature (1)..(121): Xaa is any amino acid
MNSVDHIRLRCIAIKINKKNIQIWIQLFHLFFHALSYDLICNTSKRLQTENVFNTIFCKESNFSGYKPSFSKLIYQRKYPGSFTGKISQLRIGKTKSESLHFLCHLFMKICEIFFQERKKK

SEQ ID NO: 12425 - DNA, 858 bp, Unknown
  Obtained from environmental sample
  misc_feature (1)..(858): n is a, c, g, or t
gtggagtattttgttgacgcttactctaagaggtttttgtcggtagattttgctgatgctttttcgaagttaaagtcaaactctattttaactgatcgtgatcagtttttgtcttttaaatacccttacctttattatttctttgttgggaagaagattgcagagtcgtactccgaagttagtgaggtcaaacgttcggttgaagcgttattaaagaatctgcatagagaagattacgcaaatatcttaatatttatatctcatcatactaaagattcatgggttcttgatgaaataaaatccacgttgcgtgagcttttcgatactcatgtgcctacgtcacttgagcgcggacagttggcctttatgaatgatttcatgaagaaaatacctgagcttgtcatagagcaaagagagattcaaaaagagcgagatgatcataatgaaaaacttgataagctagaacgtagtgaagaggtggagcaaggcgaacctcatgatttactcgcgaatattaacaaggcatttaaaggtatcgagattgcgggtcagattattagaaatcgtcacgctacccttactaggtcatctttatttgagttggcagattgtggcgtaagtactgggcttaggtttttaaagtactttattgaaatttccgattctgcaaaaaaagaaattgttaaaatgattgctgcccatctttcagaatcgcctggtatctcggatcgtgaaattgaaaagcaggctgaaaatgcatatttacatttaacatacggagtaaataattcagtagttcggaaagtagcccgatctattgggtcaaaagaagcgctggaaaattacttttcttcttga

SEQ ID NO: 12426 - protein, 285 aa, Unknown
  Obtained from environmental sample
  misc_feature (1)..(285): Xaa is any amino acid
MEYFVDAYSKRFLSVDFADAFSKLKSNSILTDRDQFLSFKYPYLYYFFVGKKIAESYSEVSEVKRSVEALLKNLHREDYANILIFISHHTKDSWVLDEIKSTLRELFDTHVPTSLERGQLAFMNDFMKKIPELVIEQREIQKERDDHNEKLDKLERSEEVEQGEPHDLLANINKAFKGIEIAGQIIRNRHATLTRSSLFELADCGVSTGLRFLKYFIEISDSAKKEIVKMIAAHLSESPGISDREIEKQAENAYLHLTYGVNNSVVRKVARSIGSKEALENYFSS

SEQ ID NO: 12427 - DNA, 972 bp, Unknown
  Obtained from environmental sample
  misc_feature (1)..(972): n is a, c, g, or t
ttggagccaaaaagagctagaaataaagctgatggaaactttcaaagtgcaaagatggagatagtagacctagaagaaaatgagattttagaatcatacctttcaaaagtgccaaaggtagttgaagagatatcaggactagactttgctaggtttatacaatcaatgatgttagctcaaggttcgtttgatgcctttttaaaagcaggtgaaaatgaacgctcaacattactagaaaagatgacgggtacatatatctataagcaaatatcacaagagatttacgaaacatattcattaaagaaaaaagatatagaacttgatgaaaactctttaggaagtatagagttactagaacctgagatagtaaaagaaaaaatagaacaactcaaacaaagtcaaaaacaaaaaaaacagcttgatacacaagagggtgaattaaaaaagatagccacatggcttgaaaacttagctaaactagaagctgatgataaaagatatactttagaatttgaacaaataagtaaagaaaaagaggataaaaaagagcagtttacaaaactagctttagcaaacaaagctttaaatgtacagccaagttatcaagaaaaaaactcacttcttaagataattgaatcagataaacaaaagtgtgagactttaaaaaaagagcttgaagagttaaaaaaacttctagaaactaaaacaagtgaatcaaataaattaaaagataagtttgcaaaagaaaaagtctcatatgagcaaaatatcaaaaaaatccaagagggtagaactttacaaaaagtgatagagaccaaaactcaaaataaaactaaactagaaatagatatccacccaaatactaaaccactagaaatttttaaaaaagaacctggagagaaaaaaagttttggagggaaagattcaaaaagaatttaccacctatccaaaatttttctagcctccaaataa

SEQ ID NO: 12428 - protein, 323 aa, Unknown
  Obtained from environmental sample
  misc_feature (1)..(323): Xaa is any amino acid
MEPKRARNKADGNFQSAKMEIVDLEENEILESYLSKVPKVVEEISGLDFARFIQSMMLAQGSFDAFLKAGENERSTLLEKMTGTYIYKQISQEIYETYSLKKKDIELDENSLGSIELLEPEIVKEKIEQLKQSQKQKKQLDTQEGELKKIATWLENLAKLEADDKRYTLEFEQISKEKEDKKEQFTKLALANKALNVQPSYQEKNSLLKIIESDKQKCETLKKELEELKKLLETKTSESNKLKDKFAKEKVSYEQNIKKIQEGRTLQKVIETKTQNKTKLEIDIHPNTKPLEIFKKEPGEKKSFGGKDSKRIYHLSKIFLASK

SEQ ID NO: 12429 - DNA, 465 bp, Unknown
  Obtained from environmental sample
  misc_feature (1)..(465): n is a, c, g, or t
gtgaataaatcatactataacgtgaaggaagacaaaacaatccgggttattattgttgacgatgaagagaactctagaaatcttctggataaatttttgtttgcattccctgatgtacaagttatgggtttggcagaatgcgttgatgatgctgtttctttagtagttgaaactgatccggaattagtatttcttgatatctcaatgccgggaaaagacggatttgattttattaaagaacttaataatcttaatagaattcctgaaattatttttgttactgctttcgatcagttcgctattcaggcatttaaagtttctgctttcgattatctgcttaaacccatcgatatctcctctctggaggaaaccttatcacggtatcggcaacgaaggaataaatgctgtcattgcaggaaagatgtctgtgttgctcgatcatcttggaaagaaaaatggctttag

SEQ ID NO: 12430 - protein, 154 aa, Unknown
  Obtained from environmental sample
  DOMAIN (14)...(133): Response regulator receiver domain
  misc_feature (1)..(154): Xaa is any amino acid
MNKSYYNVKEDKTIRVIIVDDEENSRNLLDKFLFAFPDVQVMGLAECVDDAVSLVVETDPELVFLDISMPGKDGFDFIKELNNLNRIPEIIFVTAFDQFAIQAFKVSAFDYLLKPIDISSLEETLSRYRQRRNKCCHCRKDVCVARSSWKEKWL

SEQ ID NO: 12431 - DNA, 402 bp, Unknown
  Obtained from environmental sample
  misc_feature (1)..(402): n is a, c, g, or t
ttgatatctcaatgccgggaaaagacggatttgattttattaaagaacttaataatcttaatagaattcctgaaattatttttgttactgctttcgatcagttcgctattcaggcatttaaagtttctgctttcgattatctgcttaaacccatcgatatctcctctctggaggaaaccttatcacggtatcggcaacgaaggaataaatgctgtcattgcaggaaagatgtctgtgttgctcgatcatcttggaaagaaaaatggctttagcagggtaaagattcctactcgtaccggaactatttttcttgaatccaacaaaataccctactgtgaacccgatggtaattatacaaaattagtaaccagaagatttgggaggaatactcccctcccctaa

SEQ ID NO: 12432 - protein, 133 aa, Unknown
  Obtained from environmental sample
  misc_feature (1)..(133): Xaa is any amino acid
MISQCREKTDLILLKNLIILIEFLKLFLLLLSISSLFRHLKFLLSIICLNPSISPLWRKPYHGIGNEGINAVIAGKMSVLLDHLGKKNGFSRVKIPTRTGTIFLESNKIPYCEPDGNYTKLVTRRFGRNTPLP

SEQ ID NO: 12433 - DNA, 783 bp, Unknown
  Obtained from environmental sample
  misc_feature (1)..(783): n is a, c, g, or t
ttgcnnntaggcatggacaggatcggcncgagtacaggagcagcagatgtggattttgttgagtcatcaactgccatttacaatatcacaaaatcgggacaggccaaaaaatcatctaatgaggaaaagaaaatctttgaatttggagaagacgatgaatcaataaatattaatgttggagacattgaagtagatgttaaagatggcgaatcgactcgcgtgcgggtaggaggaaaagaggttactatagatgaagatggaaatgtagacgttaaaagagttaagaagacaaaatttaacggacactggggcggcctacaaataggaattaacgggtacctcaatagtgctaacgaacttgcacttccaaccggatcagaatatttagagctgaaatatcaacgctcttatcaattcaacctgaatatttgggaacagaacatcaatttaatcaacaatcacttcggacttatcacaggtattggatttcagtggaacaactattttttccaaaacaatgtatttctacataacgactccacaatgctctatggcacatatggagatgacgaaagcagaacttatgagaagtctaaactggttgtaagctatttatcaatacccttaatgctcgaatatcagactaataaatattccagattggatagttttcatgctacagcaggaatgataatgggcatccgcctaaattctcacagtaaaaatattttatatggtaacggtaaaaaaaaggtcaagggatgggaaaaactatcattttag

SEQ ID NO: 12434 - protein, 260 aa, Unknown
  Obtained from environmental sample
  misc_feature (1)..(260): Xaa is any amino acid
MXXGMDRIGXSTGAADVDFVESSTAIYNITKSGQAKKSSNEEKKIFEFGEDDESININVGDIEVDVKDGESTRVRVGGKEVTIDEDGNVDVKRVKKTKFNGHWGGLQIGINGYLNSANELALPTGSEYLELKYQRSYQFNLNIWEQNINLINNHFGLITGIGFQWNNYFFQNNVFLHNDSTMLYGTYGDDESRTYEKSKLVVSYLSIPLMLEYQTNKYSRLDSFHATAGMIMGIRLNSHSKNILYGNGKKKVKGWEKLSF

SEQ ID NO: 12435 - DNA, 669 bp, Unknown
  Obtained from environmental sample
  misc_feature (1)..(669): n is a, c, g, or t
ttgaatggagattggataaaatataaaattgagatgaaagacggcagtagtttaattgaccgttttttgactgactcttcatacgtcaattacacttttagaaaattggaaatgtgtactaatggaaatccaacgcatagagtaaatgaggtttgttttcctttctcattaaatcaaaactttatcaaaacatcttcaacttctggcttcgaaattgaaaaagtaaaaaatgacacgctaattctctgtgaaagaataaacggaatggaaaacgacaaattaaagagattctattttgttagagaacaaaaattattcaatgaaattaaaaagggaaaaggggaaagtaaaaatcaagttgcaaatgaattctatacaccaactttaaagtcgagtttaatgcttgaactgaacaaagcatttaagaaaaaacacagcaactttaaagctaagggaattataacaattgatttaaaaaataaaaatataagtaccttaataaatttctctaacacaaatgactcaagtaaaattgagagaattaaaaaagtaattaacaagtcatataaactttggaagttagataaattcgaacaccttgaaaagcttgaaatgccatttgtcttaaaagacgaaaaaaaccaaaacctttcgtggaaatatcaatga

SEQ ID NO: 12436 - protein, 222 aa, Unknown
  Obtained from environmental sample
  misc_feature (1)..(222): Xaa is any amino acid
MNGDWIKYKIEMKDGSSLIDRFLTDSSYVNYTFRKLEMCTNGNPTHRVNEVCFPFSLNQNFIKTSSTSGFEIEKVKNDTLILCERINGMENDKLKRFYFVREQKLFNEIKKGKGESKNQVANEFYTPTLKSSLMLELNKAFKKKHSNFKAKGIITIDLKNKNISTLINFSNTNDSSKIERIKKVINKSYKLWKLDKFEHLEKLEMPFVLKDEKNQNLSWKYQ

SEQ ID NO: 12437 - DNA, 309 bp, Unknown
  Obtained from environmental sample
  misc_feature (1)..(309): n is a, c, g, or t
gtgagcggccggcggccatgtgtcggcattgcaaaactaattgaaaataaagattttcaaaatcataacattattaatttaggaactggaaaaggagtgagtgtattagaagcagtaaaagcgtttgaaaaagttagtggtaaaaaattaaattatgttataggacaaagaagagaaggagatgttcaggctatttttgctaacaaccaaaaagctcaacaattattaggttggaaaccaatttataatatcgaagatatgatgctttctgcttggaaatgggagcaaaatctacatactaatttataa

SEQ ID NO: 12438 - protein, 102 aa, Unknown
  Obtained from environmental sample
  misc_feature (1)..(102): Xaa is any amino acid
MSGRRPCVGIAKLIENKDFQNHNIINLGTGKGVSVLEAVKAFEKVSGKKLNYVIGQRREGDVQAIFANNQKAQQLLGWKPIYNIEDMMLSAWKWEQNLHTNL

SEQ ID NO: 12439 - DNA, 450 bp, Unknown
  Obtained from environmental sample
  misc_feature (1)..(450): n is a, c, g, or t
atgcatgcattaagtaaaatgaagtgttatttgttgttgtttggtataatattgagtaattttttagttgctcaggattatattgttataaatggcgatgatactgtttattgtaagatagaaagtgttggaactcaaaaaatatttttttctgttccaaccgatagtgttccttataattcatcgttattattatcaaaagtaaattcatattatttcaatcattctagtgaactacaagatactatagcaacagtagaaaaatcaaaaaaagttaggataaaaattgcaaggaaatcggcacctctttttaggttttcagctagttgtggcttaggttattttgattatcaaaacacaaaagagaatgcctacacaaaagaacttaagagtggttataatgctgcttttgaagcacactattttcccgaaggtttaattatggattag

SEQ ID NO: 12440 - protein, 149 aa, Unknown
  Obtained from environmental sample
  misc_feature (1)..(149): Xaa is any amino acid
MHALSKMKCYLLLFGIILSNFLVAQDYIVINGDDTVYCKIESVGTQKIFFSVPTDSVPYNSSLLLSKVNSYYFNHSSELQDTIATVEKSKKVRIKIARKSAPLFRFSASCGLGYFDYQNTKENAYTKELKSGYNAAFEAHYFPEGLIMD

SEQ ID NO: 12441 - DNA, 522 bp, Unknown
  Obtained from environmental sample
  misc_feature (1)..(522): n is a, c, g, or t
ttgaaagaagaaaaagccaaagctctttcagcggaaataatggtaaggtattccaatggagcggaaataaaaaagttgtctgattatactttccatgggacaaatgtacttttttgggaagctcataatcctagaaatattacccttaaagaattagttaattctggaaatgtatccataattaagaatgccaatattagaaactcacttcttgaaattaatgcttcatacgatgaattatttgaggtcagacggcatatgtatgacgattacacgctttatttatatagtccttattctggaataatcaattacgatgagggcattaaggtttggactaatcctaatgtagaaatagatttatctgaagaagatgttgaagttgctctgaaaaataaggcaataaaaaatggatttaccctagcatcatttaacaataatttacttaaagaccaactcgttcaaatattgaaaaatgttgaattaacgatagatttaattaaaaaagaaataaaaaaataa

SEQ ID NO: 12442 - protein, 173 aa, Unknown
  Obtained from environmental sample
  misc_feature (1)..(173): Xaa is any amino acid
MKEEKAKALSAEIMVRYSNGAEIKKLSDYTFHGTNVLFWEAHNPRNITLKELVNSGNVSIIKNANIRNSLLEINASYDELFEVRRHMYDDYTLYLYSPYSGIINYDEGIKVWTNPNVEIDLSEEDVEVALKNKAIKNGFTLASFNNNLLKDQLVQILKNVELTIDLIKKEIKK

SEQ ID NO: 12443 - DNA, 861 bp, Unknown
  Obtained from environmental sample
  misc_feature (1)..(861): n is a, c, g, or t
ttgacaagaatcggctcgagaccaaaattaaaaggctctaaaaatggtatttctggcgaagttacacagtttattccgttaggtttttggggtgaagttttaaaattgaggcttaaaaatgaatcttcagaagtaaaaaaaataaaattattctcttttattgagtggtgtctttggaatgccgaagatgatatgaccaacttccaaagaaacttctctacaggtgaagttgaaatagaagactcggttatttaccacaaaacagaatttaaagaacgtcgtaatcactatgcattctactcatcgaacacaccgatgcaaggctacgatacagatagagaatcgttcttaggattatacaacgattttgacaaaccagacgctgtgtttgaaggcaagcctcgcaacaccgaagcacatggttggtcgcccattgcatcgcattatttcgaaattgaattacaacccagcgaacaaaaagacatgatttttatgttaggttatgttgaagttgcgcctgaagacaaatgggaaagcaaaggcattatcaacaaaaaaccagcgaaagacatgatcgctaagtttgataccgttgagaaagttgaagctgctcttgcagaattacgtacgttctgggacaatcttttaagtaaggtttctattaaatctggagacgataaacttgatcgtatggttaatatctggaaccaataccaatgtatggtgacctttaacatgagtcgttcggcgtcattcttcgaatcgggaattggccgcggtatgggattccgtngattctaccaagatttaatttgggtttgtgcatcaaattccagacagagctcgggaacgaattcttga

SEQ ID NO: 12444 - protein, 286 aa, Unknown
  Obtained from environmental sample
  DOMAIN (2)...(77): Glycosyltransferase family 36
  misc_feature (1)..(286): Xaa is any amino acid
MTRIGSRPKLKGSKNGISGEVTQFIPLGFWGEVLKLRLKNESSEVKKIKLFSFIEWCLWNAEDDMTNFQRNFSTGEVEIEDSVIYHKTEFKERRNHYAFYSSNTPMQGYDTDRESFLGLYNDFDKPDAVFEGKPRNTEAHGWSPIASHYFEIELQPSEQKDMIFMLGYVEVAPEDKWESKGIINKKPAKDMIAKFDTVEKVEAALAELRTFWDNLLSKVSIKSGDDKLDRMVNIWNQYQCMVTFNMSRSASFFESGIGRGMGFRXFYQDLIWVCASNSRQSSGTNS

SEQ ID NO: 12445 - DNA, 372 bp, Unknown
  Obtained from environmental sample
  misc_feature (1)..(372): n is a, c, g, or t
gtgttatcgtatctaaaaaagcaatttaataaaaaacataagcctgtgggcggtgttaaggtaatattacagcatagcttaatattaaaaaaattaggttataatgttaaattaattaaactcggaaaatatgaaggggatttttttaactttgaggttgatttctgcgattttaatagttcttctttatatcttccagaggactcaatcgtggtaataccagaatgtggtcctggttataaacactattttgataggttttgtaaaattttatatgcgcagaataccaggatatattcaggcgttacgcactcatattttaacttgaataaaaatttctccgaaaatgggtttgtaaaaactattgcatga

SEQ ID NO: 12446 - protein, 123 aa, Unknown
  Obtained from environmental sample
  misc_feature (1)..(123): Xaa is any amino acid
MLSYLKKQFNKKHKPVGGVKVILQHSLILKKLGYNVKLIKLGKYEGDFFNFEVDFCDFNSSSLYLPEDSIVVIPECGPGYKHYFDRFCKILYAQNTRIYSGVTHSYFNLNKNFSENGFVKTIA

SEQ ID NO: 12447 - DNA, 915 bp, Unknown
  Obtained from environmental sample
  misc_feature (1)..(915): n is a, c, g, or t
atgggtgtatcacatacatacagatctttgtgcagagatgatctaaaaaatatccgctatgtaaatattgttccaagctcagaaggatatgctagacgcagtaatttcatagaagctgttccaaaaaaaataggctggccaatatataaacttaatcttgaaaaatgggtaaacgaaaaaagatttattagagagctgagtgctctagatgctgcatatatatggccagaaataagcttaagttctttagaaaaaataaaagataaagttccaattgtcattgaaagaataaattgtttcacaggtaaagctaaaaaaatattagatgaagaatataagcggattggaatcaggccttcgcataaaataacggatgaaatggtgcgttatgaacaaagtgtaatagaaaaggctgattatattttttgtccgagtgctgaggtggagaaatcattcatagaggctggagtcccagcaacaaaaatactccgttcatcttatggctggagtaatgaaagatttgatttaaatcgtatatttttaaattcaacaaatagagaatatgattttgtatttgtaggaaggatttgtgttaggaaaggatctcatcttttaattaaatattttgccgagtctggagtggataaaaagctgctcttatgcggtaaaatagaacaagatgtaatagatatctgtggtgaatatttaaaatccgaaaacatacatcatattgatttttacgaaaaacatttccgaaaatatataaaaaactcaaaggttttttgtatttccctacccctggaagaaaggccgaacccgtttagttacataccaaagcaatggctacccgggccctaccagttgctaaccaacgccccatggggaagcagggactcagccagtaaaggggaataa

SEQ ID NO: 12448 - protein, 304 aa, Unknown
  Obtained from environmental sample
  misc_feature (1)..(304): Xaa is any amino acid
MGVSHTYRSLCRDDLKNIRYVNIVPSSEGYARRSNFIEAVPKKIGWPIYKLNLEKWVNEKRFIRELSALDAAYIWPEISLSSLEKIKDKVPIVIERINCFTGKAKKILDEEYKRIGIRPSHKITDEMVRYEQSVIEKADYIFCPSAEVEKSFIEAGVPATKILRSSYGWSNERFDLNRIFLNSTNREYDFVFVGRICVRKGSHLLIKYFAESGVDKKLLLCGKIEQDVIDICGEYLKSENIHHIDFYEKHFRKYIKNSKVFCISLPLEERPNPFSYIPKQWLPGPYQLLTNAPWGSRDSASKGE

SEQ ID NO: 12449 - DNA, 639 bp, Unknown
  Obtained from environmental sample
  misc_feature (1)..(639): n is a, c, g, or t
atgagaaaagaatgtaaatttaaatgtgagaaagaagaagaatgtaatattaaaaaagatagtccaaagtatactggattgttaggctcaaatgagaccgacataatgattatagctgaagcaccaagttcttcagctggtaagaaagcatacttcggaggtgatttaaagaaatttttagatgaagagcaaaaaaatgaagggctttctaacatcattaaattcattgaagagaacaatccaacaccttattttactgatgtgattaaatgtggtgtcctaaatcaaaacaataaaaagggacttaatgcaaaaagaagaaaaaattgtgtagagaaattcttattgaaagagattgagattctcaaacctaaagtaatattctgtgtaggtaacatggcttttgataccatcataaaacaaaaaaaagaaaagaaaatatcagaagaaattaaaattataaaattaatccattatagtagacaggcaaatttacctttaaaagatcctgataaaattaaaatctgggaaatccaagccggcaagataaattcagaagattttgacaaaactattttagatcttgaaatagtaaaaaaacttaaaaccgatttgcagaacatgttggatagtaattga

SEQ ID NO: 12450 - protein, 212 aa, Unknown
  Obtained from environmental sample
  DOMAIN (28)...(181): Uracil DNA glycosylase superfamily
  misc_feature (1)..(212): Xaa is any amino acid
MRKECKFKCEKEEECNIKKDSPKYTGLLGSNETDIMIIAEAPSSSAGKKAYFGGDLKKFLDEEQKNEGLSNIIKFIEENNPTPYFTDVIKCGVLNQNNKKGLNAKRRKNCVEKFLLKEIEILKPKVIFCVGNMAFDTIIKQKKEKKISEEIKIIKLIHYSRQANLPLKDPDKIKIWEIQAGKINSEDFDKTILDLEIVKKLKTDLQNMLDSN

SEQ ID NO: 12451 - DNA, 795 bp, Unknown
  Obtained from environmental sample
  misc_feature (1)..(795): n is a, c, g, or t
atgaatagagagaaagttgttattgttggtggtggtactgctggtgtagctatagcaaatcgtttacaaagtcactttgatgtaacagtgatagaaaaaagtgaatataaaaaatacccttggatatatagagtacctttaatggttgggattttgtttagaaaaatggtactgactcaagtcacaaaaagagaatttaaactagcagatgggcgtaaaatccctttctatgaatcaaatttatttggtggtgcatctgtaatgaatggtgctgtacatgtttttggatttaagtctgtttgggaaaaagcactacaaaaatttaatataagttatgatgaattaatcaagagtaatgatgaattgtattcttttgatttgaaacaagttaataaaatatctttaatgcttgcacctcaaaatattattgatgattcatttataacaacactcaataaacgaaatatagcacttggtgatatgggatattctgaagatgcagtttgtggaccaatccaaaatacggtaagaaaatattttagaacttcagttttgtcactattaaaaaaaaccaattttaatattcttttagcagaaaaagttgaaagtatactttttgatgaaagcaatcaagttcaaggtgttaaaaccaataagggtgtaataaaagcaaattacgttatcctatctgcaggtgtcataagaagttgtgatcttatgttaggagaaagagataaaaaaaatatctctcaagaactagatatggggagaaatccaagatcataccaatattag

SEQ ID NO: 12452 - protein, 264 aa, Unknown
  Obtained from environmental sample
  DOMAIN (6)...(256): GMC oxidoreductase
  misc_feature (1)..(264): Xaa is any amino acid
MNREKVVIVGGGTAGVAIANRLQSHFDVTVIEKSEYKKYPWIYRVPLMVGILFRKMVLTQVTKREFKLADGRKIPFYESNLFGGASVMNGAVHVFGFKSVWEKALQKFNISYDELIKSNDELYSFDLKQVNKISLMLAPQNIIDDSFITTLNKRNIALGDMGYSEDAVCGPIQNTVRKYFRTSVLSLLKKTNFNILLAEKVESILFDESNQVQGVKTNKGVIKANYVILSAGVIRSCDLMLGERDKKNISQELDMGRNPRSYQY

SEQ ID NO: 12453 - DNA, 522 bp, Unknown
  Obtained from environmental sample
  misc_feature (1)..(522): n is a, c, g, or t
ttgttatttgaagcaggatctccaaaaaaaattagtaaaataatccaagagaaagaagaagaattaaatcaagttaaaaaaattattcccgaactaatgctagactttcaaatggaaaaagaaaaacaagagattcatagtttcaaaggaaaagcaggaataaaaaccatattgcaagaaatgttaaactccaaaacagaaatattagattttggtgcagaatataaaattaaagaaaatttaccttacgaatatccaaaatggaacaaagaaagaattaagaaaaaaattaatatgcgaatagttgccaatataaaaattaaaccaacaaaaatttctttaacaaaaataaaatatgttccttcagaattcaattccaatgtttcaacatatatttttgataataaagttgcattaatcatgtgggtagaaaatcccatgggaattcttatagaacataaagcagtttatgaatcttacaaaaattatttcaaatatctgtggaagaattcaaacgaataa

SEQ ID NO: 12454 - protein, 173 aa, Unknown
  Obtained from environmental sample
  misc_feature (1)..(173): Xaa is any amino acid
MLFEAGSPKKISKIIQEKEEELNQVKKIIPELMLDFQMEKEKQEIHSFKGKAGIKTILQEMLNSKTEILDFGAEYKIKENLPYEYPKWNKERIKKKINMRIVANIKIKPTKISLTKIKYVPSEFNSNVSTYIFDNKVALIMWVENPMGILIEHKAVYESYKNYFKYLWKNSNE

SEQ ID NO: 12455 - DNA, 744 bp, Unknown
  Obtained from environmental sample
  misc_feature (1)..(744): n is a, c, g, or t
gtgaaatacagaattcacaatttagaaaaaaagaacgtaataacagaatatagaacactgataaattatggaaaattaggtttaaacttatttagagtgggaataaatttaattgatataactgatgaaacaataaatgaaattcagggatttctaaaagatgtacctaacttacattcattacatcagtgtgatacaaactgggatttagtatttacaattttagtaaatgataaaagagatttttataaattctatgaaattttcaaaggaaaattcaaaaaatatgttgaaagacaacaattatcaatattaactgatgaacaagttttcactagatctttagctccaacggcaaaaaagaaaaacgcagtactagattattgtgaagaaaaagtatcattcgataaaacggatatagacatactacaagtaatcgctcatgacgcaaaatgtcctttaatagatatagcaaaaaaacttgatttagacagtatgactgtaaaaagaagaatagaaggaatggtaaaaaaaggaataattgcaggatttaaaacagaaataaatccaaaagttctaggaataaaaagatattacgttaaactaggattatttgatacatcaactttatcatcattttcaaaacatttagcaacactaaaagaaacagttgcaataactgaatctattgaagactatgattttgaatgtgaatttaaaagttgcagattatttcgaacttga

SEQ ID NO: 12456 - protein, 247 aa, Unknown
  Obtained from environmental sample
  misc_feature (1)..(247): Xaa is any amino acid
MKYRIHNLEKKNVITEYRTLINYGKLGLNLFRVGINLIDITDETINEIQGFLKDVPNLHSLHQCDTNWDLVFTILVNDKRDFYKFYEIFKGKFKKYVERQQLSILTDEQVFTRSLAPTAKKKNAVLDYCEEKVSFDKTDIDILQVIAHDAKCPLIDIAKKLDLDSMTVKRRIEGMVKKGIIAGFKTEINPKVLGIKRYYVKLGLFDTSTLSSFSKHLATLKETVAITESIEDYDFECEFKSCRLFRT

SEQ ID NO: 12457 - DNA, 507 bp, Unknown
  Obtained from environmental sample
  misc_feature (1)..(507): n is a, c, g, or t
atgagattaaaagggttcatatacctcgtttttgccttattaatttatggttgtgctcaggtagttccgcttactggcggagataaagatgaaacacctcctaaagaactaaaaagtactcccgaaaataaaagtatcaactttacagcaaaaaccattactattgaatttgatgaatttattagactagaaaacctgctgcaacaattaattgtttctccagtaatggaaaaaaagccagaaataagcgtaaaaggcaaaaagctttttattcagctaaaagaagagctacttcctaatactacttacagcattaattttggtaacgctattatagacattaccgaaaacaatcctatacctaattataaatatgttttttctacgggcgactatttagattctttatcgtttgctggtaatgttctttttgctcaagatcttaaaccaaaagaaaaagtatatgtaatgctttacgaacagttagaagattctgtgccttattaa

SEQ ID NO: 12458 - protein, 168 aa, Unknown
  Obtained from environmental sample
  misc_feature (1)..(168): Xaa is any amino acid
MRLKGFIYLVFALLIYGCAQVVPLTGGDKDETPPKELKSTPENKSINFTAKTITIEFDEFIRLENLLQQLIVSPVMEKKPEISVKGKKLFIQLKEELLPNTTYSINFGNAIIDITENNPIPNYKYVFSTGDYLDSLSFAGNVLFAQDLKPKEKVYVMLYEQLEDSVPY

SEQ ID NO: 12459 - DNA, 330 bp, Unknown
  Obtained from environmental sample
  misc_feature (1)..(330): n is a, c, g, or t
ttggtaaaaaaatcgaaggaattggggttttggggtcttttttcaggggacccaatttgcttgtccaaggaattaaaaaaaggcaaagggggtttgtggtaccagcatggcaacaagccaacccctttaatggttcccaatgtagatgaatttcctggacatatagcttgtagtagcgagtcaaaatctgaaatagtagtgcctgtttttaataagaataatgaagtaattatgattattgatgtagatagcgaagcacttaattcttttgataaaactgatgctacttacctcgaaaaagtagctcaactaattagcaattttgcatga

SEQ ID NO: 12460 - protein, 109 aa, Unknown
  Obtained from environmental sample
  misc_feature (1)..(109): Xaa is any amino acid
MVKKSKELGFWGLFSGDPICLSKELKKGKGGLWYQHGNKPTPLMVPNVDEFPGHIACSSESKSEIVVPVFNKNNEVIMIIDVDSEALNSFDKTDATYLEKVAQLISNFA

SEQ ID NO: 12461 - DNA, 696 bp, Unknown
  Obtained from environmental sample
  misc_feature (1)..(696): n is a, c, g, or t
atgtttcaaaaacaaatttacatagacagacgtaataatttacgtaaacaaatgaacagcggagtgttgttatttcttggaaatcaagatgttgcattcaattatcctgcaaatatttatcctttcagacaagatagtgcttttttgtattttttcggaatagaccaacctatgatggcggcagttattgatttagaaagcggtgaagacattatttttggtgatgagttagaaattgatgacattatttggatgggaaaacttccaactataaaatatttgtctgaaaaagttggcattaacaaggtattgccctctgctgatttgaaaaaagcactcgaaggtaaaaaagttcactttttacctccttatcgtggcgaaactaaacatcaattagaatctttacttggcataaaatacgattctgtaagagaaaaagcgtcagttgaacttattgaagctgttgtaaaacttcgttcaataaaagacgaatttgaaattgcagaaattgaaaaaatggtgaatgttgcttacgatatgcatactactgctatggcaatggcgaaagttggcgtaaaagaacagcaaattgcaggtgccattcaaggtgttacattatataacgagggtcccgtttccttttcctggattgtaactataaagggtcaaacgttgcaaaaaaattattacggttaa

SEQ ID NO: 12462 - protein, 231 aa, Unknown
  Obtained from environmental sample
  DOMAIN (2)...(127): Aminopeptidase P, N-terminal domain
  misc_feature (1)..(231): Xaa is any amino acid
MFQKQIYIDRRNNLRKQMNSGVLLFLGNQDVAFNYPANIYPFRQDSAFLYFFGIDQPMMAAVIDLESGEDIIFGDELEIDDIIWMGKLPTIKYLSEKVGINKVLPSADLKKALEGKKVHFLPPYRGETKHQLESLLGIKYDSVREKASVELIEAVVKLRSIKDEFEIAEIEKMVNVAYDMHTTAMAMAKVGVKEQQIAGAIQGVTLYNEGPVSFSWIVTIKGQTLQKNYYG

SEQ ID NO: 12463 - DNA, 672 bp, Unknown
  Obtained from environmental sample
  misc_feature (1)..(672): n is a, c, g, or t
atgcatctacgctgtatgatgctggttacaactcatgaaaacagttcaatggttcgcaaggttgatggtattctgaaaataaaatcatattatcattttatcaaagctgttaactattatctgatagcaaataatttccataatgaattatttatcaaggataactgcgattccttcgaagaatacaaagaaactattcttaaggaagactttggcgaattagtaaggctgtcgggtgctccaactatggacactgttgttgagtttgcaaaatcatacaacaatgaaatgaatgcaataattgtattttccgagaaagaaatttcaggaaatgccagttatgaacttttcaacttgagtatgattacaggcaagcttggtaaaactgcaaacggactaatatcactaaaggaaaagaacatctcacagggactatttgatatgggtattaaccctaaacttggtgtgggaactcaatgcattgacaatcctaagcttggaaaacttatgatggaaaaatggaaagtatatgagttaccattggtagaacacaaaagtcagtttgagcaactggaagatggtgatattaaaaaccttttcatttttggcgaatatccagtgggaacagccataaaatcagatagtatagcccgaggggatttcaaattctga

SEQ ID NO: 12464 - protein, 223 aa, Unknown
  Obtained from environmental sample
  misc_feature (1)..(223): Xaa is any amino acid
MHLRCMMLVTTHENSSMVRKVDGILKIKSYYHFIKAVNYYLIANNFHNELFIKDNCDSFEEYKETILKEDFGELVRLSGAPTMDTVVEFAKSYNNEMNAIIVFSEKEISGNASYELFNLSMITGKLGKTANGLISLKEKNISQGLFDMGINPKLGVGTQCIDNPKLGKLMMEKWKVYELPLVEHKSQFEQLEDGDIKNLFIFGEYPVGTAIKSDSIARGDFKF

SEQ ID NO: 12465 - DNA, 675 bp, Unknown
  Obtained from environmental sample
  misc_feature (1)..(675): n is a, c, g, or t
atgtccttctcattacgtcattgtcgaaattcaatagtatttggcgcaggccatggcataggactggcctttgttgaatatatgctcacaaaccatcccactctcactgtcatggctacatatagaagtgaagacaaggcaagtgagctatttaaatgccaagaacgctatcccaagcgcctcattatcaaaaaccttgacccaactcttgaaagtgatatcaaacgagcatacgaagaatgtatagaaagcggcatttcttttgacctaattatcaatagcgttggtcttttacataagaatcaaatacagccggagaaatcattacgtacttttgaagaagatcactttatggaaatcatgaaggtcaattgtatcgtcactcctcttatcgcaaaatatttcgaaaaactgatcaataaagaatctcaaagcgcattcatttctttatccgcaaaagtaggaagtatcagcgataatagaatgggaggttggtatagttatcgagcttcaaaagcagcactaaatatgctgatcaaaacgatatccattgaatatagtcggaagaaaatcaaatggaatggttttagctattcatccaggaacgacaaagaacttattatcagcccccattcatttgaaagaacaaactatatattacccgaagcccattga

SEQ ID NO: 12466 - protein, 224 aa, Unknown
  Obtained from environmental sample
  misc_feature (1)..(224): Xaa is any amino acid
MSFSLRHCRNSIVFGAGHGIGLAFVEYMLTNHPTLTVMATYRSEDKASELFKCQERYPKRLIIKNLDPTLESDIKRAYEECIESGISFDLIINSVGLLHKNQIQPEKSLRTFEEDHFMEIMKVNCIVTPLIAKYFEKLINKESQSAFISLSAKVGSISDNRMGGWYSYRASKAALNMLIKTISIEYSRKKIKWNGFSYSSRNDKELIISPHSFERTNYILPEAH

SEQ ID NO: 12467 - DNA, 843 bp, Unknown
  Obtained from environmental sample
  misc_feature (1)..(843): n is a, c, g, or t
atgggccttattcatgttccaaaggtacataggtcactcatgaacttatcgcaagagacacttttaaaactcctttctagagatacgttttcatcttttaaactagagtcagatgatattgatttcttaaagccaagtgaagtggcatctctttatatatatgttgctcttctcgttaccatcatgggttatattaaagaacaattatggttatataagaatggaaatttagatgataagagagtgactagctataaagactttataactcccttattcgtcaatgaactgacctcaatatcttttttaaaggacttgttactagagaaggacgaaaaaggaataaaggaattattagttctctcacaaaagatagaatgtcagataattgaattaatgatctctcggcctaaagaagatcaaaaagaatttttagagttctctctaaaagaaatgaatcgatattttattatagaagaaaataaccaaaaaggaagagctcaagagcttggtcataatggcctgaggctttatcgaacctttgatcgaattgatgaactttttggacttaactataacttagaccaagctatgttggtcgaccatgactcaaaggaacgtttgtaccaaagaactgggggtggagtacagtcgggttattccaccatccttctttctttggaacaatacaatgtttcctataggggggaaaaaaacctaaatctgggttccgggctttggaaaaaattaggactccttttattcctttgttggaaaaccggatattcgaattttattggggattatgaaatagtgttccccccactcggggtgggaaagggg

SEQ ID NO: 12468 - protein, 281 aa, Unknown
  Obtained from environmental sample
  misc_feature (1)..(281): Xaa is any amino acid
MGLIHVPKVHRSLMNLSQETLLKLLSRDTFSSFKLESDDIDFLKPSEVASLYIYVALLVTIMGYIKEQLWLYKNGNLDDKRVTSYKDFITPLFVNELTSISFLKDLLLEKDEKGIKELLVLSQKIECQIIELMISRPKEDQKEFLEFSLKEMNRYFIIEENNQKGRAQELGHNGLRLYRTFDRIDELFGLNYNLDQAMLVDHDSKERLYQRTGGGVQSGYSTILLSLEQYNVSYRGEKNLNLGSGLWKKLGLLLFLCWKTGYSNFIGDYEIVFPPLGVGKG

SEQ ID NO: 12469 - DNA, 390 bp, Unknown
  Obtained from environmental sample
  misc_feature (1)..(390): n is a, c, g, or t
atgggaaaaaaacgttcaccccccaaccaattcaaaacaaagggggctggttattcgggtgccagggtgctaaaattcccttgggttattattacctattcgggggatacgccaaaaaattggaagctaatttctgtagttgtaaaaagaatttcccggattgctcaactggctatagaaattcctgctcatgttatagaaaagggaagatgtaaagatccatttatgcataacatgcttccagatatcaacaaagagatgtttgaataccttcttaaaagggttgcagttctagaacatattcttgttgaagacaacaaaaatgtacttgaagaggacttagagctagagaatatttacgaatctttcattagagctatgaagagttaa

SEQ ID NO: 12470 - protein, 129 aa, Unknown
  Obtained from environmental sample
  misc_feature (1)..(129): Xaa is any amino acid
MGKKRSPPNQFKTKGAGYSGARVLKFPWVIITYSGDTPKNWKLISVVVKRISRIAQLAIEIPAHVIEKGRCKDPFMHNMLPDINKEMFEYLLKRVAVLEHILVEDNKNVLEEDLELENIYESFIRAMKS

SEQ ID NO: 12471 - DNA, 726 bp, Unknown
  Obtained from environmental sample
  misc_feature (1)..(726): n is a, c, g, or t
ttggaatattctgatgactggaaaaaatatatcaaaaaacttggtcgttgggtggatatggaggatagttacaagactatggatttgtcttacatggaatctgtttggtgggtatttaaggaattgtgggataaggatttgatatacaaaggatatcgctctatgcatgtttgtccgagatgtgaaactactttgtcacaatcagaggttaccgaaggctataaggatataaaagatttatcagcgattgccaaatttgaattagtagacgagcctggaacttttgttctcgcctggacgactacaccttggacattaattggtaatgttgctttggccgttggagaagatattaattatgtattaattgatatgaacgaacaagcaaaggaattgaaaggaaaatatattgttgctgaagatagaatgatagttttggaagaaaaaattgaaaaaatagacccaaataagccttttaaaattaataaattatataaaggaaaagaattaattggaaaaaaatataaacctttgtttgattattattcaagtaatgaaaagttggaaaatagagagaatggttggcagatttatgctggtgattttgtgactactgaagaaggaactggaatagtacatattgctccggcttttggcgatgatgatatgaagttgggacaaaaacatgacttgccttttgtgcaacatgttaaaaatggatggtga

SEQ ID NO: 12472 - protein, 241 aa, Unknown
  Obtained from environmental sample
  misc_feature (1)..(241): Xaa is any amino acid
MEYSDDWKKYIKKLGRWVDMEDSYKTMDLSYMESVWWVFKELWDKDLIYKGYRSMHVCPRCETTLSQSEVTEGYKDIKDLSAIAKFELVDEPGTFVLAWTTTPWTLIGNVALAVGEDINYVLIDMNEQAKELKGKYIVAEDRMIVLEEKIEKIDPNKPFKINKLYKGKELIGKKYKPLFDYYSSNEKLENRENGWQIYAGDFVTTEEGTGIVHIAPAFGDDDMKLGQKHDLPFVQHVKNGW

SEQ ID NO: 12473 - DNA, 837 bp, Unknown
  Obtained from environmental sample
  misc_feature (1)..(837): n is a, c, g, or t
atgtaccaaaaagctaatatttacgaaagtaatattgatgtttttggaaaagcatttgttagtccattctctccattttggaaagtgtattacaaattttatttactagatagcgcgatagtaaataatcattggagctatcaaatatcgttcagacctcgatctaaaacagagcctactttttcgggcgatttctgggtaactgataaaacatgggcattacaagaggttaacattaaaattacgaaagatgcaaatatcaaccttattcaagacatggttgttcatcaaaaatatattgaagttgagccaaatttatggatgctaaaacgagaaaaattagtagttgattttaacctcgctaaaaaaacaataggcttttttggcagaaaaactactgtttacgacaagttcattgtcaataaacctaaacaaaaagatttcttcgctaacggaactcttcaaacaattgaaattttagatagtgctagagacaaaacaaaagatttttgggaagatgcacgtaaagagcaactaaccaagcaggaagaaggtatttacgcaatggttgacactattcaagctattcctctttttagaacttacattgatgttataacaatgtttatgacaggctattatgatgcaggagcaatagaatacggtccatactcaaaaatatttagctataatacagtagaaggatatagacttagatttggtgcaagaacagggatagagttcagcgagaaattattcttagaagcctatgtagcctacggaacaaaagatttaacttataaatttggtgccgatgcaaaatacttttttaattag

SEQ ID NO: 12474 - protein, 278 aa, Unknown
  Obtained from environmental sample
  misc_feature (1)..(278): Xaa is any amino acid
MYQKANIYESNIDVFGKAFVSPFSPFWKVYYKFYLLDSAIVNNHWSYQISFRPRSKTEPTFSGDFWVTDKTWALQEVNIKITKDANINLIQDMVVHQKYIEVEPNLWMLKREKLVVDFNLAKKTIGFFGRKTTVYDKFIVNKPKQKDFFANGTLQTIEILDSARDKTKDFWEDARKEQLTKQEEGIYAMVDTIQAIPLFRTYIDVITMFMTGYYDAGAIEYGPYSKIFSYNTVEGYRLRFGARTGIEFSEKLFLEAYVAYGTKDLTYKFGADAKYFFN

SEQ ID NO: 12475 - DNA, 429 bp, Unknown
  Obtained from environmental sample
  misc_feature (1)..(429): n is a, c, g, or t
gtgactttagaatacatcaacaaagactcttcaagagaaattataaatatagacagtaatcaaaagattacagatgagtggataaatatagattcatcaagcaaaaaagaatttatacaaaaatttgtaccggcttttttaagtggtcaaaaaatagttctctttgacaaaaaacatcaacaacttctaaacttttatgaacaaaataatctaaatgactttaaaggcatcgaggaagtaaacaaaactactcaacttctgtttttcacatcaggtagtagtggatttcctgttggagcatttaaaagtagagacaatcttttaaaagaaatcgaaatacataaaagagttactccaggagttagtaaaattaaaccgcggttgttggaaagtgtccccttttattccaaatatatgggcattgtttaa

SEQ ID NO: 12476 - protein, 142 aa, Unknown
  Obtained from environmental sample
  misc_feature (1)..(142): Xaa is any amino acid
MTLEYINKDSSREIINIDSNQKITDEWINIDSSSKKEFIQKFVPAFLSGQKIVLFDKKHQQLLNFYEQNNLNDFKGIEEVNKTTQLLFFTSGSSGFPVGAFKSRDNLLKEIEIHKRVTPGVSKIKPRLLESVPFYSKYMGIV

SEQ ID NO: 12477 - DNA, 585 bp, Unknown
  Obtained from environmental sample
  misc_feature (1)..(585): n is a, c, g, or t
ttgctttttttttgctcggggagggcaggcctacgcacattattaaactgcgttgggaatgaaaggaaaaaaatacccctggaccctgcagaaggattacatactttacccaggatcgggattaactcaggacctcttattgctgggaatattggcagtaatcaacgtatggactatactgcaattggggatacagtaaatcttgcatcaaggttggagggtgttaataaaatctacaaaaccaacataattatctctgattatacttaccagcttgtcaaagatcattatctttgccgtgaaattgatttcttaagagttaaaggtaaactgaaaccaacaagaatctatgaattaattgacttgaaaaaaagcgatctcaaacctgcctggattcttgattatgaatatgctttgactctttacagaaaagctgaatgggaaagagcgatggatatttttgaaaaactttcttaccaccccgtcaatgatggcgcaagtcatgtgatgctggaaagatgtaggtacttgctcgaaaataatccaaagaattgggatggtatcttgactctggaggttaaatga

SEQ ID NO: 12478 - protein, 194 aa, Unknown
  Obtained from environmental sample
  DOMAIN (1)...(121): Adenylate and Guanylate cyclase catalytic domain
  misc_feature (1)..(194): Xaa is any amino acid
MLFFCSGRAGLRTLLNCVGNERKKIPLDPAEGLHTLPRIGINSGPLIAGNIGSNQRMDYTAIGDTVNLASRLEGVNKIYKTNIIISDYTYQLVKDHYLCREIDFLRVKGKLKPTRIYELIDLKKSDLKPAWILDYEYALTLYRKAEWERAMDIFEKLSYHPVNDGASHVMLERCRYLLENNPKNWDGILTLEVK

SEQ ID NO: 12479 - DNA, 321 bp, Unknown
  Obtained from environmental sample
  misc_feature (1)..(321): n is a, c, g, or t
gtgataattctaaaaaaaaacatgaaactaattgaaaataaaccaaatacaaaacgactaataaaatttggaatagtaataatattatggcttttatggatgatatggcttaaaagtttatggatgttaataggtttcccaattatcttcgatatttacatttccagaaaagtaaagtggaatgtttttaagcaaaaagaaggcgaacctaaaaagaagtggaaagaatgggcggatgctttagtttttgccttggttgtttctacaatcattaaaatttttataattcaaattatatgctatccccaacaggttccttaa

SEQ ID NO: 12480 - protein, 106 aa, Unknown
  Obtained from environmental sample
  misc_feature (1)..(106): Xaa is any amino acid
MIILKKNMKLIENKPNTKRLIKFGIVIILWLLWMIWLKSLWMLIGFPIIFDIYISRKVKWNVFKQKEGEPKKKWKEWADALVFALVVSTIIKIFIIQIICYPQQVP

SEQ ID NO: 12481 - DNA, 414 bp, Unknown
  Obtained from environmental sample
  misc_feature (1)..(414): n is a, c, g, or t
atgctcgacaaaaactttattgatagaaagcaagctaaagtaatttaccgtactattcgtagacacttaatttcatcacctaatttaatacctgattttgaagctgttcagcatattattcatctttttggaaaaccagctttttatgaaattagtcataaatgtaatttaacatgtgagggttgttattattttgattcatcagtatttaaaatagaacctttagaagagaaaatattctcaaataattgggatacattgcttgctaatgaatctaaacgtggtgttacgatgccatatttcctaggtgcagaaccagctttggaggaaaaacgtttaattagtgcagctaaatattttcaaagaaggaaatgtaggaaaccaaatggtacagttttttttaaaggctcctga

SEQ ID NO: 12482 - protein, 137 aa, Unknown
  Obtained from environmental sample
  misc_feature (1)..(137): Xaa is any amino acid
MLDKNFIDRKQAKVIYRTIRRHLISSPNLIPDFEAVQHIIHLFGKPAFYEISHKCNLTCEGCYYFDSSVFKIEPLEEKIFSNNWDTLLANESKRGVTMPYFLGAEPALEEKRLISAAKYFQRRKCRKPNGTVFFKGS

SEQ ID NO: 12483 - DNA, 642 bp, Unknown
  Obtained from environmental sample
  misc_feature (1)..(642): n is a, c, g, or t
atgattatttttgtactatttcaaaccacttcaatgaataaaagttctttatacgaaagagttattaacgataaaaatatttacaactctatatattcaattgaatcctatgtttttgaaaaagagcttttatctcataaagatattaagcttttcaatgagctttcggacaaatataatcacaaagcaataaaaaaagttattactaaatgtaagactaagattaaaagtcttttaaacacagaagaattatttgatgtatccgtcttttttaagccaaagaaatttgataaagaaacaaatgtagttgagtatagacctatacatagtgccgatctcattactcaaatttgtatagtatcattgcttaatcaaataatgtttgatgacagttcagggaaaagaaatttatcagatattagtaaacttttaccatcaaacttttatggtaatattcctagtacttctgtagaatcattatttgaaccttggaataggaaatatcaagagtattcagaagaaggaattgaagcacacaatccaatatttcaacgactaagaaaatttgtggaatggaaatccaatttagaatctcaaaaaagcttcttttccaaacaaatagatccccctcatttgatttag

SEQ ID NO: 12484 - protein, 213 aa, Unknown
  Obtained from environmental sample
  misc_feature (1)..(213): Xaa is any amino acid
MIIFVLFQTTSMNKSSLYERVINDKNIYNSIYSIESYVFEKELLSHKDIKLFNELSDKYNHKAIKKVITKCKTKIKSLLNTEELFDVSVFFKPKKFDKETNVVEYRPIHSADLITQICIVSLLNQIMFDDSSGKRNLSDISKLLPSNFYGNIPSTSVESLFEPWNRKYQEYSEEGIEAHNPIFQRLRKFVEWKSNLESQKSFFSKQIDPPHLI

SEQ ID NO: 12485 - DNA, 843 bp, Unknown
  Obtained from environmental sample
  misc_feature (1)..(843): n is a, c, g, or t
atgattgattttagtaagtttgaaaaatattcacgaccaggacctagatatactagttatccaacagcacctgagtttcacacaaattttacacaaaatgatttaatagaaaaattcaaatctcaaagtgatgatagaccattgtccctttatatacatatccctttttgtcgaagtgcttgttatttttgtggttgtaatgtaatttttacaagtaaagaggataaaaaagttacctatattgagtatcttaaaaaagagctagcaatattagcaaaacacttaaatacaaatagaacagtgactcaaatgcactttggtggtggaacccctacttttctaagtgctcctcaactaaaagaggttcttgatgctattagaggaactttcccaaattttagtgatgatgctgaaatttcttgtgaaattgatccaagatactttacaaaagagcatatggatgtactaaaagaagctggaacaaatcgtgtaagctttggagtacaagatttagacccaaaagtgcaagaaacaatccatagaatacagccatttgaaactacacaaaatgtagttaaaatagcaagagatgctggaattaagtctattaacattgatttaatctatggactaccataccaaacaaaagagacttttgctaaaacaatacgagatatagttaaactaaatccagatagattagctgtatttaactatgcccatgtaccttggatgatgaaaacacaaagaaagtttgatgaaacaacatttgcaccaccatcaacaaaactagagatactaaaaagatggtatagagtttttttgaaatcacctgggatataa

SEQ ID NO: 12486 - protein, 280 aa, Unknown
  Obtained from environmental sample
  DOMAIN (51)...(226): Radical SAM superfamily
  misc_feature (1)..(280): Xaa is any amino acid
MIDFSKFEKYSRPGPRYTSYPTAPEFHTNFTQNDLIEKFKSQSDDRPLSLYIHIPFCRSACYFCGCNVIFTSKEDKKVTYIEYLKKELAILAKHLNTNRTVTQMHFGGGTPTFLSAPQLKEVLDAIRGTFPNFSDDAEISCEIDPRYFTKEHMDVLKEAGTNRVSFGVQDLDPKVQETIHRIQPFETTQNVVKIARDAGIKSINIDLIYGLPYQTKETFAKTIRDIVKLNPDRLAVFNYAHVPWMMKTQRKFDETTFAPPSTKLEILKRWYRVFLKSPGI

SEQ ID NO: 12487 - DNA, 414 bp, Unknown
  Obtained from environmental sample
  misc_feature (1)..(414): n is a, c, g, or t
atgctttatctaaaaaacgaagatgtaaaacgtaatgttaccaatattgataacttcattattcttctaaaaaaaattattgagaatcaatttaagccgggagagataataaatattgtagatccgaaaccagttaaaaccctcgatataataaatttaatctacagaatgttagatgatcaagaacctccttcatatatatttaaaaataatttcatgatagaactttggagaaaaagcagtagttattttaacaaacacctcctggcaacaaacataagttttttaaccaggagtaaatacctggatatcgattatatctgtgaagaggttgtaagcaaatctattgacactttgaatcagatgaaaattctactgcaaaattatctaaaaagcgaaggaagaaaaaattga

SEQ ID NO: 12488 - protein, 137 aa, Unknown
  Obtained from environmental sample
  misc_feature (1)..(137): Xaa is any amino acid
MLYLKNEDVKRNVTNIDNFIILLKKIIENQFKPGEIINIVDPKPVKTLDIINLIYRMLDDQEPPSYIFKNNFMIELWRKSSSYFNKHLLATNISFLTRSKYLDIDYICEEVVSKSIDTLNQMKILLQNYLKSEGRKN

SEQ ID NO: 12489 - DNA, 702 bp, Unknown
  Obtained from environmental sample
  misc_feature (1)..(702): n is a, c, g, or t
atgatacaacagaatgttggtgcttctgagaatctattcaaaattgttactaaaaaatcgaataatctccagaaatttattttcttcagcagtttagctgcgatgggttttcaaagaggattatcagttggtaatgatacaaaaccagagcctgatacaatctatggagaatcaaaatacatcgctgaacaaaagctcgaacagcttgcatctgaaaatgatacaccattggttattattagaccaagtttggtttatggtcctggagaccgcacctctgattttctaaattcatgccgacttatcaacaaaggattctttccaatttttggtacaggcaagaacattatgtcaccagtcatttttattgatgatctgattgaaatctgtcatcgattttctgtcactaaatcagtaggaaaatacatctgttgtaatgatgagaaattcactataatggattttgttaaaattattgcatccaattttaataaaaaaaatggctctcttaaaatacccgttgtacttggtcaaatacttatcactccaatagagttactttgcaaagttttaaacaaacctgccccgttaaatcgcagaagagtcatggatttaagtgtagatagaaagctgcattcaattcattcagccttgaaagatgcaatcgattatgagcctgaaaccaatctgcaaatgggctaa

SEQ ID NO: 12490 - protein, 233 aa, Unknown
  Obtained from environmental sample
  misc_feature (1)..(233): Xaa is any amino acid
MIQQNVGASENLFKIVTKKSNNLQKFIFFSSLAAMGFQRGLSVGNDTKPEPDTIYGESKYIAEQKLEQLASENDTPLVIIRPSLVYGPGDRTSDFLNSCRLINKGFFPIFGTGKNIMSPVIFIDDLIEICHRFSVTKSVGKYICCNDEKFTIMDFVKIIASNFNKKNGSLKIPVVLGQILITPIELLCKVLNKPAPLNRRRVMDLSVDRKLHSIHSALKDAIDYEPETNLQMG

SEQ ID NO: 12491 - DNA, 726 bp, Unknown
  Obtained from environmental sample
  misc_feature (1)..(726): n is a, c, g, or t
gtgggacgtagtggtcataaaatggttaagaaggttatagataaatatcctgaaattgtattagacagcaccaaagtagacctgggtgtgcgtttcgaacttcctgatcacatagtggaagatctgaaccgtgaaatgtatgaattcaaaattaaatataagagtaaaaccggatatatggttagaacattctgtaataaccccagtggttacgtagttacagaaaattacgatgatttcagcacagtgaatggtcacagtaaaatgcgggaaaaaagtaagaataccaacttcgctattttggtaacggttcagcttaccgaacctttcaacgatccgattgggtttggttcctacgtggcaaaactcaccaatattctggcaggtcaggataaggtaattctgcaaacctacggtaattttaaacaaagtaagcgtactaaacacctctaccgtgtacaaccaactttggaagcagacaagtacattctgggtgatatcaatctggccttcccgcgtcgtattgcggaaagcattatcgatttcattgaaaacctgaatgaagtagttcccggtgtagcaaacgatgataacctgctccatgctccggagatcaaattctacagtaataaattgagtaatgatgaattcagtaacctgaagtttgtaggcgattgtagtggtcatactcgttcgattatctacgccacagcccatggtggatga

SEQ ID NO: 12492 - protein, 241 aa, Unknown
  Obtained from environmental sample
  misc_feature (1)..(241): Xaa is any amino acid
MGRSGHKMVKKVIDKYPEIVLDSTKVDLGVRFELPDHIVEDLNREMYEFKIKYKSKTGYMVRTFCNNPSGYVVTENYDDFSTVNGHSKMREKSKNTNFAILVTVQLTEPFNDPIGFGSYVAKLTNILAGQDKVILQTYGNFKQSKRTKHLYRVQPTLEADKYILGDINLAFPRRIAESIIDFIENLNEVVPGVANDDNLLHAPEIKFYSNKLSNDEFSNLKFVGDCSGHTRSIIYATAHGG

SEQ ID NO: 12493 - DNA, 687 bp, Unknown
  Obtained from environmental sample
  misc_feature (1)..(687): n is a, c, g, or t
ttgaataaagttttaaaaaaaatattaatcaaaacaaaaaaagcaattttttcacaaaaaatagggaataacacctcaaagtttaaaggtgagggatatgactttgttgagctgagagaatatgaagatggtgaagatattcgaaaaatagattgggtaataagtgcaaagatgcaaaagccttttgtgaaagtttttttagcccaaagagagttggatataaatatagttccaatattagggggaagtgttcattttggaacatcacgacttaaacaagaggttatctctgaggtgtgtgcaattataggctatagctcgtgtgcacaaggggatacttatagctcttttataggaaatgaatctgtagaattacaaaccaaaaaaaccaaaaaacttatcactgtagatgcaatggtggaaaatatatttaactataaagttataggaaaaagagtcgattatacagctattactaatcaattgtttcaaaaaataagaacaaaatcaattatatttcttattggagatttttttaatacagaagatttaaatttaaagttgttagcaaaaaaacatgaagttatagctgtgataataagagatagatttgaagaacatccatctgctatgggtagcgttaactttacagacccacaaacatttcaaaatatgatggggtattaa

SEQ ID NO: 12494 - protein, 228 aa, Unknown
  Obtained from environmental sample
  misc_feature (1)..(228): Xaa is any amino acid
MNKVLKKILIKTKKAIFSQKIGNNTSKFKGEGYDFVELREYEDGEDIRKIDWVISAKMQKPFVKVFLAQRELDINIVPILGGSVHFGTSRLKQEVISEVCAIIGYSSCAQGDTYSSFIGNESVELQTKKTKKLITVDAMVENIFNYKVIGKRVDYTAITNQLFQKIRTKSIIFLIGDFFNTEDLNLKLLAKKHEVIAVIIRDRFEEHPSAMGSVNFTDPQTFQNMMGY

SEQ ID NO: 12495 - DNA, 780 bp, Unknown
  Obtained from environmental sample
  misc_feature (1)..(780): n is a, c, g, or t
gtggatatccctgtgattttcttaacagcaaaagctgaaacagatgatatcttagaagcctttgaagttggagctgttgattatattacgaaacctttttttcaaaaagaactcatttctcgagtctcttcccatcttgaattaactttaaaaaaagagaaactgcaatcttatgtagatattgtggataaatatgtacttacctctattactgatagtgagggggttataaaatatgcaagtgaagcatttttaaaaagaactggatatacaaaagaggaactatatggaaatacacatagggttcttaaaaataataaatttgataaaaaagtctataaagagttaaaagaatcactcctaaaaaacaattattgggagggtgagattcttaatattgataaggatggaaatgactattgggtttctgtagtgattgatgctcaacgctctaaaacaggtgagttaaaagggtatcaagcaataatggaagatataacagataaaaaaatggttgagtatctttcaataactgataatcttacaaaaatatacaatagaagaaaaatagagtatcttttagattattctataaaacagttacctagagataataatagtttatcagtcttattaattgatattgatgattttaagttggtaaatgatactcatggacatgaagttggagatgatgttttagaaaaattttcaaaaattatcaaagactcagtgagacaaaatgatcttttggaagatggggtggtgaagaatttgtag

SEQ ID NO: 12496 - protein, 259 aa, Unknown
  Obtained from environmental sample
  DOMAIN (127)...(169): PAC motif
  misc_feature (1)..(259): Xaa is any amino acid
MDIPVIFLTAKAETDDILEAFEVGAVDYITKPFFQKELISRVSSHLELTLKKEKLQSYVDIVDKYVLTSITDSEGVIKYASEAFLKRTGYTKEELYGNTHRVLKNNKFDKKVYKELKESLLKNNYWEGEILNIDKDGNDYWVSVVIDAQRSKTGELKGYQAIMEDITDKKMVEYLSITDNLTKIYNRRKIEYLLDYSIKQLPRDNNSLSVLLIDIDDFKLVNDTHGHEVGDDVLEKFSKIIKDSVRQNDLLEDGVVKNL

SEQ ID NO: 12497 - DNA, 867 bp, Unknown
  Obtained from environmental sample
  misc_feature (1)..(867): n is a, c, g, or t
atgccaataagtgctataaatacaggtaatattgatcttatattaccacctgaaaagattggagatgagctctatgatatcacacaatatccaataagaatgatctcatcagatgaaaaaactgctcagcaagattattcaaatatttataaaaatattttaacaaaattacaaaaagagacaaaagtagatttttcacaatataaaagtactactattattagaagaatagagcgtagaatgactactttaaaacttacttctgttatagaatacaataattatcttcaaaaacacaaagatgaagttgtcgagctttttaaagatattcttattggtgtaacatcattttttagagatattgacccttttgaatccttgaaagaaaagattacagaatatctaaaaacaaaagaagataaaatatttagagcttggaccacagggtgtagtactggtgaagaaccatacaccatagctatgatacttttagatattttaggacctaaaatagttgagtataagattcagatttttgctagtgatttagacgatagagcaatagacacagcaagaaaagggatatatcctgaaagtgctattttagatatacctaaaaactatagaaataaatattttactgttaaaggggatcaatttgaggttataaaaccaataaaagagttagtgatattttcaaaacatgatattactagagatcccccatttttaagaactagatcttttaaagtggtaagaaacttacctgaatattattttacgaactggatttaccaaaaaaaaggaatattttccaaatcctttttatttaaggcctttaaaaaggccaaaaggggattttttttg

SEQ ID NO: 12498 - protein, 289 aa, Unknown
  Obtained from environmental sample
  DOMAIN (46)...(102): CheR methyltransferase, all-alpha domain
  misc_feature (1)..(289): Xaa is any amino acid
MPISAINTGNIDLILPPEKIGDELYDITQYPIRMISSDEKTAQQDYSNIYKNILTKLQKETKVDFSQYKSTTIIRRIERRMTTLKLTSVIEYNNYLQKHKDEVVELFKDILIGVTSFFRDIDPFESLKEKITEYLKTKEDKIFRAWTTGCSTGEEPYTIAMILLDILGPKIVEYKIQIFASDLDDRAIDTARKGIYPESAILDIPKNYRNKYFTVKGDQFEVIKPIKELVIFSKHDITRDPPFLRTRSFKVVRNLPEYYFTNWIYQKKGIFSKSFLFKAFKKAKRGFFL

SEQ ID NO: 12499 - DNA, 525 bp, Unknown
  Obtained from environmental sample
  misc_feature (1)..(525): n is a, c, g, or t
atggctgttattaaaccgccatctatgaatgagatattagtagcacagatacaaaaactgatacttccatcaagtgttattatcaatgagatgatggatatagtatatgtaaaagggaaaaatagttatcttattcgtccagagggagattctacagataatatatttaaaaatgtacatagtgttttatctgttgaattgcgtagtttaataaatactgcaaaaatagctaaaaatacacaaaaatcaaaatatcaaaaaatcgtcatagatgatagcttgacaaagtttgtaagagttattgttattccagtaatagatgagattcatgtacctccattatttataatattttttcaagatgaagagcttgaacatatacaacaaatagatttagaatatctcggtggtgatgatgagaaaataaaacaagtagagcttgaactcttaaaaacaagagagcaactacaaacagtaattgaagagcttgaaacctcaaatgaagagatgcaacactatgaatga

SEQ ID NO: 12500 - protein, 174 aa, Unknown
  Obtained from environmental sample
  misc_feature (1)..(174): Xaa is any amino acid
MAVIKPPSMNEILVAQIQKLILPSSVIINEMMDIVYVKGKNSYLIRPEGDSTDNIFKNVHSVLSVELRSLINTAKIAKNTQKSKYQKIVIDDSLTKFVRVIVIPVIDEIHVPPLFIIFFQDEELEHIQQIDLEYLGGDDEKIKQVELELLKTREQLQTVIEELETSNEEMQHYE

SEQ ID NO: 12501 - DNA, 546 bp, Unknown
  Obtained from environmental sample
  misc_feature (1)..(546): n is a, c, g, or t
atgcttgatgcgctcaatcgaatgaataaaatgattactagaattcttgatgtcaagatgatcgaatcgaaaagcattaatttacagctcgaaaaaattaatctttctaaactatttgatatcgttaataacaacttcaaagagaaacttgaacaaaagcacatcaaattacattttgacccagcagatacgtatgtgaatgttgatcctgaatatatgactcaggtttatgaaaatttgatctctaatgctattaaattctctccttcaaataaggagatatgggtgaaagtttgggaagatggggataaggtaaaaaccatggttaaagatgaaggtcctggaatctcaactgaagatcaaaaaagaatgtttggcaaattccaaattttaagtgctaaaccaactgccggagaacgttccacaggcttagggctttctattgtaaagaaatatgtagaagcaatggaaggtaaagtttggtgcgaaagtgaaattggacaaggcagtaactttataatagaaatggacaaagctcttgtttaa

SEQ ID NO: 12502 - protein, 181 aa, Unknown
  Obtained from environmental sample
  DOMAIN (68)...(179): Histidine kinase-, DNA gyrase B-, and HSP90-like ATPase
  misc_feature (1)..(181): Xaa is any amino acid
MLDALNRMNKMITRILDVKMIESKSINLQLEKINLSKLFDIVNNNFKEKLEQKHIKLHFDPADTYVNVDPEYMTQVYENLISNAIKFSPSNKEIWVKVWEDGDKVKTMVKDEGPGISTEDQKRMFGKFQILSAKPTAGERSTGLGLSIVKKYVEAMEGKVWCESEIGQGSNFIIEMDKALV

SEQ ID NO: 12503 - DNA, 396 bp, Unknown
  Obtained from environmental sample
  misc_feature (1)..(396): n is a, c, g, or t
gtgaaagaaaatataaacaaagaagctgagagtaatgcatacaatgaactattttttgaagaactcgttgagaaagagatcctgagggctgagcgttatggttataaatttgtcattgtcctatttaaatatgaagataaaaaagagctatcagaatatatgaaaaagattttaagaacaactgacaattttggtaaattcaactcagatacatatgcaatattggctattcaaacagatgtacaaaaggctcttattctagcagatagagtaaaagagcttcttcatgtgcatgtaggtctctcttcatactccatgggagatactcttggcataatgtatgagaagtgtgagagtgctattaaaagtaaaaaagatatagatttagaactgtga

SEQ ID NO: 12504 - protein, 131 aa, Unknown
  Obtained from environmental sample
  misc_feature (1)..(131): Xaa is any amino acid
MKENINKEAESNAYNELFFEELVEKEILRAERYGYKFVIVLFKYEDKKELSEYMKKILRTTDNFGKFNSDTYAILAIQTDVQKALILADRVKELLHVHVGLSSYSMGDTLGIMYEKCESAIKSKKDIDLEL

SEQ ID NO: 12505 - DNA, 354 bp, Unknown
  Obtained from environmental sample
  misc_feature (1)..(354): n is a, c, g, or t
atgaaaattctagcgatagatgataaacaagataatttaacttcgataaaagcgttaattaaaaactatatgcctgatctagatgtgattacctctctatctggaaaagaaggattgtcttttgctaagcttgagaaacctgatgttattcttctggatattattatgcctgaaatggatggttatgctgtttgccgtgaactgaaaaataatgtagagacaaaacatatacccataattatgcttacggctataaaagctaatatggaaaccagagttaaagggatggatctcggggctgaggcatttataacaaaacccgatgatccccttggaaacttctgccccaaataa

SEQ ID NO: 12506 - protein, 117 aa, Unknown
  Obtained from environmental sample
  DOMAIN (1)...(115): Response regulator receiver domain
  misc_feature (1)..(117): Xaa is any amino acid
MKILAIDDKQDNLTSIKALIKNYMPDLDVITSLSGKEGLSFAKLEKPDVILLDIIMPEMDGYAVCRELKNNVETKHIPIIMLTAIKANMETRVKGMDLGAEAFITKPDDPLGNFCPK

SEQ ID NO: 12507 - DNA, 393 bp, Unknown
  Obtained from environmental sample
  misc_feature (1)..(393): n is a, c, g, or t
atgaaaccaaccgtcaataaagccgaccttctctaccctgaactcagttatcaaatcatgggttgcgctttcgatgttcataatgaactcggtggcggcctacttgaaaaagtttatcaaaaagcattggctgttgcattcaaaaacagaaatatcaactttcaggaacaagcacattttccgattgtatttgaaggagaaaaagtgggtgcaggatattttgactttctgattgaagaaaaaattgtggtcgagttaaaacgaacacagcatttctcaagaaagcagatagatcaggtcgtttcttatttgaatcaatcaggtctgaaacttggaattctgatacatttcggacaagaacaagttcgatataaacgtattatcaatgaatga

SEQ ID NO: 12508 - protein, 130 aa, Unknown
  Obtained from environmental sample
  misc_feature (1)..(130): Xaa is any amino acid
MKPTVNKADLLYPELSYQIMGCAFDVHNELGGGLLEKVYQKALAVAFKNRNINFQEQAHFPIVFEGEKVGAGYFDFLIEEKIVVELKRTQHFSRKQIDQVVSYLNQSGLKLGILIHFGQEQVRYKRIINE

SEQ ID NO: 12509 - DNA, 711 bp, Unknown
  Obtained from environmental sample
  misc_feature (1)..(711): n is a, c, g, or t
ttgatttctcttttttctgttggagcaaacctaaaaccaatttacgctaagctttatcaatattcatcttttgcaatggcaatggacttgtctgcaacttaccataatgccaaaaaacaatttaccaccgcattgttagttaaaaatattggcagacaattttctacctactttgaaggaagagaaaaagaaccgcttccttttgaagtacaattaggaatttctaaaaaactagcacatactcctattcgttttaatgtcgatttaattcatttaaataattggaatttagcatataatgattcttcttcagtaactaatagagataataccttagatgaagaagccagaaaagaattaaataaaacaggaatggttagcgagctttttagacatgttgttgttgggacagagtttgtactttctcctaactttatgataagatttggctataatttccaacgaagatctgaattagcttttgataacaaaggaggattaattgggtttagttggggcttagggtttagaattaaaaagatacatgttagctatggtggagcaagttatcatttggcaggaacttccaatcattttaccattaccacaaccatttcggattattataaaaagaatcagatagtgattccagaagaaaaagcttcaaaaaaatcccgaaaaagaaaaaaagacaaacaaagcgaagaatga

SEQ ID NO: 12510 - protein, 236 aa, Unknown
  Obtained from environmental sample
  misc_feature (1)..(236): Xaa is any amino acid
MISLFSVGANLKPIYAKLYQYSSFAMAMDLSATYHNAKKQFTTALLVKNIGRQFSTYFEGREKEPLPFEVQLGISKKLAHTPIRFNVDLIHLNNWNLAYNDSSSVTNRDNTLDEEARKELNKTGMVSELFRHVVVGTEFVLSPNFMIRFGYNFQRRSELAFDNKGGLIGFSWGLGFRIKKIHVSYGGASYHLAGTSNHFTITTTISDYYKKNQIVIPEEKASKKSRKRKKDKQSEE

SEQ ID NO: 12511 - DNA, 657 bp, Unknown
  Obtained from environmental sample
  misc_feature (1)..(657): n is a, c, g, or t
ttggcaaaagactcattaaacatgtcgatgattacaatgaatggaagaacaacactatggaaaaactttaaaattcaatatggttcaatttgggatccgtatgcaaaggattcggcaggagttagatataatgaatatgaatgggatgtaaatcgccgaatcctccgactcgatcaaacaacatggaggctaagttttggattcaaacttggagatactgactttgggggaaaagataaacccgacaatgttagcgatgatcaaatggaacaaattgaagccaatcctgatgaatttgtagactggaacattccttggtcaataaatatgaattacaatttctcatattcaaataatatggactatattaattttgtaaaagtcccgacaaaaacaattgtccaaaccctgtcattttcaggacaggtaaatattacgccaaagtggaaattcacctttaactccggatgggatttcacgagcaataaactatcatatacaaatgttaatatttatcgtgatcttcattgttgggaaatgcgatttagttggacacctcttggaattcgacaaagttggaacttttccatcaatgtaaaagcgtcgatcttacaagatttaaaactcaataagaaaaaggattttagagattattag

SEQ ID NO: 12512 - protein, 218 aa, Unknown
  Obtained from environmental sample
  misc_feature (1)..(218): Xaa is any amino acid
MAKDSLNMSMITMNGRTTLWKNFKIQYGSIWDPYAKDSAGVRYNEYEWDVNRRILRLDQTTWRLSFGFKLGDTDFGGKDKPDNVSDDQMEQIEANPDEFVDWNIPWSINMNYNFSYSNNMDYINFVKVPTKTIVQTLSFSGQVNITPKWKFTFNSGWDFTSNKLSYTNVNIYRDLHCWEMRFSWTPLGIRQSWNFSINVKASILQDLKLNKKKDFRDY

SEQ ID NO: 12513 - DNA, 840 bp, Unknown
  Obtained from environmental sample
  misc_feature (1)..(840): n is a, c, g, or t
atgatattactagatcagcgatttaatgcatctgatatagatatctcttccagagtattaatacattggaaagagaatgatttattacctgagcctgtattaatggatacaaatgctcaaaagagggatgaggaagatttagatgccaacaagataactcgagaaaggaataagtttgatttctttggactcctatacatgtacatattgcaagatctaagagggtttggtctttcgcttaagaaattgaaacgggtcaagaaatttctttattcaaaagtcgatttactagaaatcatcagtgaaattacagaatctaaaatagatatcatcgaagaaaatgggtttgacacaaagaatttgtatcattctcttgaattaataaaagggattggtaaagatgcagagggaataccaaccgagctattaagagcccccttaattatgtatattatcctaaatattatagtaagtaaatcagaccttaaattggtaatattaattgatggtgatacggcacttaatgttacaaatttggtaggtcaaactttagagactaagtacaatcgacaaccgcatattgttttacctctgtataattatttatatcactttgtaagtatgaaaaagtataaaaagtattatacaatgtataatttattaaatgataaggaattatttattcttgaacaagtaagatgtggtttgtatactaagattgtgataaagaagagtactggaactattgtgtctatgggattaacagaagagcttaaagcggataatgcagctagattgcaagatatattattgaaggggggggtatcaggaaataaatag

SEQ ID NO: 12514 - protein, 279 aa, Unknown
  Obtained from environmental sample
  misc_feature (1)..(279): Xaa is any amino acid
MILLDQRFNASDIDISSRVLIHWKENDLLPEPVLMDTNAQKRDEEDLDANKITRERNKFDFFGLLYMYILQDLRGFGLSLKKLKRVKKFLYSKVDLLEIISEITESKIDIIEENGFDTKNLYHSLELIKGIGKDAEGIPTELLRAPLIMYIILNIIVSKSDLKLVILIDGDTALNVTNLVGQTLETKYNRQPHIVLPLYNYLYHFVSMKKYKKYYTMYNLLNDKELFILEQVRCGLYTKIVIKKSTGTIVSMGLTEELKADNAARLQDILLKGGVSGNK

SEQ ID NO: 12515 - DNA, 621 bp, Unknown
  Obtained from environmental sample
  misc_feature (1)..(621): n is a, c, g, or t
atgaaaaaatactatttaggctgcgatgtctcaaaaggttatgctgattttgttatgcttgattctgataaaaatattatcgaaaacaactttcaactcgatgatacttttaatggtcacaaccaactctattcaattcttacagatttttataaggcacatccaatttctagtattctctctgccgttgaatcaactggaggttacgaaaacaactggtttaacactctgtctaaactcagtgagatattaaacatcaatgttgttagacttaatccactcggggttagccatagtcaaaaagctaagatgaatagagcaattactgatgagataagtgcgtacaatattgctgaatatttaatcaatcatcagaacaaaattcagactaatactaaaagctattattcatctttgagaaaacaatggatctttgttaaattacttgttaaacaaagagttcaacttcttaaccaactagaagctattgtctatactgcaaatacagaagtacttacttactgtaaacattcaacaccaaactggctacttttaattctaaaacaaaatccctactggcaaacgccctggcacgagcaaaaagtatcctctcctttttaa

SEQ ID NO: 12516 - protein, 206 aa, Unknown
  Obtained from environmental sample
  misc_feature (1)..(206): Xaa is any amino acid
MKKYYLGCDVSKGYADFVMLDSDKNIIENNFQLDDTFNGHNQLYSILTDFYKAHPISSILSAVESTGGYENNWFNTLSKLSEILNINVVRLNPLGVSHSQKAKMNRAITDEISAYNIAEYLINHQNKIQTNTKSYYSSLRKQWIFVKLLVKQRVQLLNQLEAIVYTANTEVLTYCKHSTPNWLLLILKQNPYWQTPWHEQKVSSPF

SEQ ID NO: 12517 - DNA, 588 bp, Unknown
  Obtained from environmental sample
  misc_feature (1)..(588): n is a, c, g, or t
atgattcaagttgtttttcagggtggtgacgaatacgaattggatgaagtccaatcacaaatgagttgcaaaattgactttgttaattcgcaaataagtaatgagcttaaaagtgtagtttctgattggtatgaaactttaccaaacaatagtgaagagcataaacttataaaatttatattaagacacgaagttaaacttcaaaattttattgaattgtcatttttaacatctggaatcatattagttaattacttgttcttttctttttcatcatctgaaattagatttcggttattaggtacaaatcatatcctttttgcatcgttaacactctcagttgcatttttatatttattttttcaatttggtcaattatatgctgacagaatgatgcggaaacaaattagtaaacttaaaagaaacccaatgtttgattttacaaaaggtgataaaaatttatttaatgaaatcaagaaagataataaagtatatctaaaaggtatacttaaatcaattctgataggcttatcaattaatggtctctcaattttaattggctatttattcaatataataataaggtga

SEQ ID NO: 12518 - protein, 195 aa, Unknown
  Obtained from environmental sample
  misc_feature (1)..(195): Xaa is any amino acid
MIQVVFQGGDEYELDEVQSQMSCKIDFVNSQISNELKSVVSDWYETLPNNSEEHKLIKFILRHEVKLQNFIELSFLTSGIILVNYLFFSFSSSEIRFRLLGTNHILFASLTLSVAFLYLFFQFGQLYADRMMRKQISKLKRNPMFDFTKGDKNLFNEIKKDNKVYLKGILKSILIGLSINGLSILIGYLFNIIIR

SEQ ID NO: 12519 - DNA, 816 bp, Unknown
  Obtained from environmental sample
  misc_feature (1)..(816): n is a, c, g, or t
ttgttgggtgtaaataataataaaaaaattataggtacaaatatttcagacactcaattaaatgagtacaagcaagaaattgcaaaacatacgtcacccacaaccaattttataaacacacatagggtaactaaaaatggtttagaggtaataatgttacaaatacctatcgcacccaaaggaattcctttatcttggaaagggcattgttatggtagagacggtgaaagtttaggagcattatcatctgacgaatatgatagaattaaaaatcaaaataaaacagaagattggagtgctcaaataattaaagaagcttcaattttagatttgtctcaagaagctattacccaagctcgtttaagatatactcaaaagaaccctaatttagaagaagatattaaacattggtcagatactgttttcttaaataaagcaaaacttactataaaaggtgcaattacaaatgctacaataattttactgggtaaacctgaatcagaacattttataaatcctgcaacttctaaaattacttggatacttaaaggcagtgataatattgaaaaagattacgaacattttacttgtcctttacttttaaatattcaacaagtttatggtaaaatacgaaacctaaagtatcgttatcttacagatggcactttgtttccagaagaagtagaccaatacgattcttacatcattcgcgaaggtttaaacaattctattgtgcatcaagattatacattgggaggcaaaatattggtggtagaaaacgaaaatgcaaccttaaacttttgctatttctggtag

SEQ ID NO: 12520 - protein, 271 aa, Unknown
  Obtained from environmental sample
  misc_feature (1)..(271): Xaa is any amino acid
MLGVNNNKKIIGTNISDTQLNEYKQEIAKHTSPTTNFINTHRVTKNGLEVIMLQIPIAPKGIPLSWKGHCYGRDGESLGALSSDEYDRIKNQNKTEDWSAQIIKEASILDLSQEAITQARLRYTQKNPNLEEDIKHWSDTVFLNKAKLTIKGAITNATIILLGKPESEHFINPATSKITWILKGSDNIEKDYEHFTCPLLLNIQQVYGKIRNLKYRYLTDGTLFPEEVDQYDSYIIREGLNNSIVHQDYTLGGKILVVENENATLNFCYFW

SEQ ID NO: 12521 - DNA, 903 bp, Unknown
  Obtained from environmental sample
  misc_feature (1)..(903): n is a, c, g, or t
ttggataaattaataaatcaggatttaaagaaagtaattgtagcagttccagaacggtctattggtagttcatttgctaaaacagaattaaagaagtttggtttttttgcagattgggaacctaatccaagatataatttatgtacgcctggtatagaaaaaagcaaagtaactgcatttctgaattttttagaaagtgacgaaaaaatactaatttgtacacacgctacattgcgttttgcttttgatgcaatagatgaaaaacaactcaatgattgtttattggcaatagatgaatttcatcacgtatccgtagatggtgataataaattaggattggttttaagtagtgtaatggaaaaatctactgcacacgtagtagcaatgacaggttctttctttagaggagattctgtacctattttattaccagaagatgaggcgaaatttactaaggtgaagtatgattattaccaacaactaaatggctataattatttaaaatcattaggtattgggtatcacttctatcaagggaaatatacttctgctattcacgagatattagatgaaaacaaaaaaacaataattcatataccaagtgtaaattctggagagtctgaaaaagataaatatgaagaagtgaatagaattgttgacggtttaggtgagttagattatcaagacccagatacaggtgttttatatgtaataagtaaggctacaggtaaaacgttaaagattgcagatttagtccacgataatcaaaaagatagagataaaatacaagaatatttacgtaatgtaacaagtgtagatgatatagatattatcatagcattaggtatggcaaaagaaggttttgattggccctattgcgaacacgctttaacggtggtatag

SEQ ID NO: 12522 - protein, 300 aa, Unknown
  Obtained from environmental sample
  misc_feature (1)..(300): Xaa is any amino acid
MDKLINQDLKKVIVAVPERSIGSSFAKTELKKFGFFADWEPNPRYNLCTPGIEKSKVTAFLNFLESDEKILICTHATLRFAFDAIDEKQLNDCLLAIDEFHHVSVDGDNKLGLVLSSVMEKSTAHVVAMTGSFFRGDSVPILLPEDEAKFTKVKYDYYQQLNGYNYLKSLGIGYHFYQGKYTSAIHEILDENKKTIIHIPSVNSGESEKDKYEEVNRIVDGLGELDYQDPDTGVLYVISKATGKTLKIADLVHDNQKDRDKIQEYLRNVTSVDDIDIIIALGMAKEGFDWPYCEHALTVV

SEQ ID NO: 12523 - DNA, 426 bp, Unknown
  Obtained from environmental sample
  misc_feature (1)..(426): n is a, c, g, or t
ttgtttttcgggtggaagaaaaatgggcgactggtattaacaacctgggcaaatttggaacaccctaaaattataaaacattttcccgtttcctttcgaaaagatgacagtggatattatgtattccaggaaagtgatgagtgtatagaaaaagtatattttccttttaaagatacagcgatttttgtttttgatataaaagaagataaagagattcttcttaaactcaataatggtgaaacaataacattggttccagaccaattgtttgaaaaaggcgataaactttttcttaaaactcctgaccatctagtcaagttctcagaccgtgcccttttaaaaatttcaaagtttcttgaagaaaaagatgatcaactgttttttaaattaaaagataatctttatcctgttgacagcatacaatag

SEQ ID NO: 12524 - protein, 141 aa, Unknown
  Obtained from environmental sample
  misc_feature (1)..(141): Xaa is any amino acid
MFFGWKKNGRLVLTTWANLEHPKIIKHFPVSFRKDDSGYYVFQESDECIEKVYFPFKDTAIFVFDIKEDKEILLKLNNGETITLVPDQLFEKGDKLFLKTPDHLVKFSDRALLKISKFLEEKDDQLFFKLKDNLYPVDSIQ

SEQ ID NO: 12525 - DNA, 543 bp, Unknown
  Obtained from environmental sample
  misc_feature (1)..(543): n is a, c, g, or t
gtgaatgttggctatgttggtaatttacagatgcaattaattgactgggataatttaattcaaactgttaaaaaaaatccagaattaaattttatttttattggacctgataaaaaatcaaatatagggggtaaagtaaaacaacctaaaataaatcttttaaaaatgcttccaaataccaattttacaggtagcttaacaaaggaagaactaattaaattattatcttttttagaaattttttggttatgttacgataataaaaaatttcctattgaagtttctaacagtcataaaattctagaatatttaagcacaggaaaagtaatagtatctaattttatttcaacttacgaaaattctactttgttagaaatgacaaacagtaatgatgaactaaaatcaaaaataaaagaaattacatcaaacctatcaaattataataacgctaatctccaacaagaaagaattaacttcgcaaaagaaaacacctataaaaaacagatagaacgtatagaaaagtttattactgttaccatatga

SEQ ID NO: 12526 - protein, 180 aa, Unknown
  Obtained from environmental sample
  misc_feature (1)..(180): Xaa is any amino acid
MNVGYVGNLQMQLIDWDNLIQTVKKNPELNFIFIGPDKKSNIGGKVKQPKINLLKMLPNTNFTGSLTKEELIKLLSFLEIFWLCYDNKKFPIEVSNSHKILEYLSTGKVIVSNFISTYENSTLLEMTNSNDELKSKIKEITSNLSNYNNANLQQERINFAKENTYKKQIERIEKFITVTI

SEQ ID NO: 12527 - DNA, 435 bp, Unknown
  Obtained from environmental sample
  misc_feature (1)..(435): n is a, c, g, or t
atggccataaaagaaaaagaagtagtcaataccacatatcttggaaacatgtccttcgaaacagagatcaacgggcataaaattatcatagatgcagatcntgattcaggaggtgaaaaccttggacccagacctaaacctttcatgcttgcggcccttggaggttgtacaggaatggacgtggtctccatcctgaaaaagatgagggttgaattcaagagcttgaatgtaaaggttgaaggaggacttacagtagagcatccacgtaagtttcataaaatgcacgtagtttacgagatagagggtgataacttacctctggataagatcaaaaaggctgtgtcactctccgaagaacaatactgtggtgtaagcgctgtctataaagaggtgatggagatcacatccgaaattgtgctcaaaaaagctgactaa

SEQ ID NO: 12528 - protein, 144 aa, Unknown
  Obtained from environmental sample
  DOMAIN (9)...(139): OsmC-like protein
  misc_feature (1)..(144): Xaa is any amino acid
MAIKEKEVVNTTYLGNMSFETEINGHKIIIDADXDSGGENLGPRPKPFMLAALGGCTGMDVVSILKKMRVEFKSLNVKVEGGLTVEHPRKFHKMHVVYEIEGDNLPLDKIKKAVSLSEEQYCGVSAVYKEVMEITSEIVLKKAD

SEQ ID NO: 12529 - DNA, 480 bp, Unknown
  Obtained from environmental sample
  misc_feature (1)..(480): n is a, c, g, or t
atgggtaaaaaattattagatattatgaaagataaaattagatttaaacactatagcataaaaacagagcaaagttatatcggatgggcaaaaagatatatactttatcataataaaaggcaccctaaagatatgggaaaaattgagatcgaacaatttctcacccaccttgcttcaaaattaaatgtatctccaaccactcaaaatcaagcgttcaatgcaatattatttttatatgagcaagttttaaatatatcattaaaagatcagaatatacaagctttaagagcacaagaaaggaagcatattcctatagtgcttacaatggatgaagttaaaaatataaatcataatatgaaaggtatctatcagcttatgataaagctaatgtacggatgtggtcttagaatgaaagaggtgcaaaatattcgcataaaagacatcgattttggatttgacaaaatttatatttggggatag

SEQ ID NO: 12530 - protein, 159 aa, Unknown
  Obtained from environmental sample
  misc_feature (1)..(159): Xaa is any amino acid
MGKKLLDIMKDKIRFKHYSIKTEQSYIGWAKRYILYHNKRHPKDMGKIEIEQFLTHLASKLNVSPTTQNQAFNAILFLYEQVLNISLKDQNIQALRAQERKHIPIVLTMDEVKNINHNMKGIYQLMIKLMYGCGLRMKEVQNIRIKDIDFGFDKIYIWG

SEQ ID NO: 12531 - DNA, 759 bp, Unknown
  Obtained from environmental sample
  misc_feature (1)..(759): n is a, c, g, or t
ttgttgaatgcaaaggatattccttccgtactggatattgtccaaaaggggttgaaaattgtgttcaatgtgccccgggtttttttctttcttttagatggggaaaaaacgatgctgaccggagactgcaaccctggggataaaaattataagatcgtcagccgtattgctcttcccatgtccaacccatccagcatgctggttaaatcactgaaaaccggcaccatccagacccagttccagtcggcaagggatgcacaatcagcgatttcagatatccggattattcgtttgctggaaacaaaggggggctattgtattcccatagcttgtgggggaaggggaatgggggttatggtcctgggggttgacccggaccttgccaggaacctggattgcaacagggggcttttaaaacttttttccaaacaggcaggaatgtgtcttcagaatatcgggtttaaccaggaatatgcccgggacatgaatgaaaaaaaaatggaagcctatgccaccctcaccgataaagtgatccatgaaatcaataatcccatttccatcattaaaagttacctggaaaccctgagcctgaaattgccggacaaacatccggcccaggatgaattatccgttgtgggagaagagatcagtccggtctctgttttacttgaggggttgtcaagcttttcaaaccaaaaattgggggaattgaagccattggtatcattccacttttgtcggggaattttgggaatttaa

SEQ ID NO: 12532 - protein, 252 aa, Unknown
  Obtained from environmental sample
  misc_feature (1)..(252): Xaa is any amino acid
MLNAKDIPSVLDIVQKGLKIVFNVPRVFFFLLDGEKTMLTGDCNPGDKNYKIVSRIALPMSNPSSMLVKSLKTGTIQTQFQSARDAQSAISDIRIIRLLETKGGYCIPIACGGRGMGVMVLGVDPDLARNLDCNRGLLKLFSKQAGMCLQNIGFNQEYARDMNEKKMEAYATLTDKVIHEINNPISIIKSYLETLSLKLPDKHPAQDELSVVGEEISPVSVLLEGLSSFSNQKLGELKPLVSFHFCRGILGI

SEQ ID NO: 12533 - DNA, 465 bp, Unknown
  Obtained from environmental sample
  misc_feature (1)..(465): n is a, c, g, or t
ttgagagaaacaaataaatttgaactcgacaaaataaagaagcgatattccgacagcttaagtttcaagattcaaccgatttgggatttgccagatccaaaactttattccccatataaaaattcatgggattcagaggataagcttcgattcaaactgatcttatcagtttctatagaccgtttattcacatctctagatgattcatatttagaaatctttaaaactccaggcttatttcacaatcgtgtaaatgaaaataaggtgtgtggaatactaaatagatgggaacaaggtttaccagttgaccctccaataatgttgtggaactcgaactctgataaaataatgattgacaacggaatacaccggttgaatacagcaattaaactgggagcactacatgtcccaattattgttacaactcaaaactatttagaaattcattctcaacttaaagaataa

SEQ ID NO: 12534 - protein, 154 aa, Unknown
  Obtained from environmental sample
  misc_feature (1)..(154): Xaa is any amino acid
MRETNKFELDKIKKRYSDSLSFKIQPIWDLPDPKLYSPYKNSWDSEDKLRFKLILSVSIDRLFTSLDDSYLEIFKTPGLFHNRVNENKVCGILNRWEQGLPVDPPIMLWNSNSDKIMIDNGIHRLNTAIKLGALHVPIIVTTQNYLEIHSQLKE

SEQ ID NO: 12535 - DNA, 837 bp, Unknown
  Obtained from environmental sample
  misc_feature (1)..(837): n is a, c, g, or t
ttgccaacctacaagatgctacgggccgtgttcaggtgtatttcaatcgtggatgtaatttgtcccggagaagataaatcgatgtacaatgatgttttcaaaaagcttctggacatcggtgattttattggtatcaaaggaaaagtatttaccacccaagttggcgaaactactattgaagtagagtcttttaccgtattgagcaaggcgctaaaaccacttcccgttgtaaaaacggatgatcagggaaatgtgcacgatagtttttctgacccagaaatgcgctaccgcatgcgatatgtagatttggtggtaaatgatggtgtgaaagaaacttttgtgaagcgcaccaaaataatgaacgccatgcgtgagtttttcaacgccaaagattatttggaagttgaaactccaatcctgcaacccattcctgggggtgctgctgcacgtccttttattacgcatcacaatgcgctggacatgccactttacctgcgtattgcaaatgagctttacctaaaaagattaattgttggtggatttgatggagtgtatgaatttgccaaagacttccgtaacgaaggaatggaccgcacccacaatccggagtttaccgtgatggaaatttatgtggcctacaaggactacttctggatgatggactttacagagaagatgctggagcatgtggtgaaagccgtaaatggtggaactaccgtaaaaattggagataaagaaattgatttcaaagcaccattcaagcgcatcagcatgattgatgccattatggagcatactggaatcgacattaatggaatgggctcagccgaattctga

SEQ ID NO: 12536 - protein, 278 aa, Unknown
  Obtained from environmental sample
  DOMAIN (91)...(276): tRNA synthetases class II (D, K and N)
  misc_feature (1)..(278): Xaa is any amino acid
MPTYKMLRAVFRCISIVDVICPGEDKSMYNDVFKKLLDIGDFIGIKGKVFTTQVGETTIEVESFTVLSKALKPLPVVKTDDQGNVHDSFSDPEMRYRMRYVDLVVNDGVKETFVKRTKIMNAMREFFNAKDYLEVETPILQPIPGGAAARPFITHHNALDMPLYLRIANELYLKRLIVGGFDGVYEFAKDFRNEGMDRTHNPEFTVMEIYVAYKDYFWMMDFTEKMLEHVVKAVNGGTTVKIGDKEIDFKAPFKRISMIDAIMEHTGIDINGMGSAEF

SEQ ID NO: 12537 - DNA, 762 bp, Unknown
  Obtained from environmental sample
  misc_feature (1)..(762): n is a, c, g, or t
ttgttcattgaaagaggattagaactattaaaaccaagtggatattttggttacattgtgccaagtaaatttacaaaagttggtgcagggaaaaaattgagagaattgcttgcttccaataaatcagttgaacaaattatatcgtttggagcaaatcaagtgtttcacgataaaacaacttacacttgtttattgattcttaaaaatgaagagcaagaagaattaagctatttagaagttaattcattaaagaattggaaaacaagaaaaattgaagcagagcattttgatactgttaaatttgatgagttagaaaaaaatgattgggttcttgttcctggtttactaaagccagtttataattccattattgaaaaatcagaaactttagaaaatttaataggttctgacaatatttataatggcattcagacaagtgcaaataacatttacatccattcaaaaaccaaagaagacaggaaatatgtctatttttctaaggatggtattgattggaaaatagagaaaaaactcacaaatccatattacaaaacttccactggcaatgataacttaaacacatatcgtccatttagtccaaacacgtttgttatttacccttatttaaaaaacgaaaaaagggaattcagtttgtcaaaatcgaaaaacttaaatcttcatatccttatttacacccttacccaaaccatttatagagataaattagataatccaaaaagagatattaaacccaattcctga

SEQ ID NO: 12538 - protein, 253 aa, Unknown
  Obtained from environmental sample
  misc_feature (1)..(253): Xaa is any amino acid
MFIERGLELLKPSGYFGYIVPSKFTKVGAGKKLRELLASNKSVEQIISFGANQVFHDKTTYTCLLILKNEEQEELSYLEVNSLKNWKTRKIEAEHFDTVKFDELEKNDWVLVPGLLKPVYNSIIEKSETLENLIGSDNIYNGIQTSANNIYIHSKTKEDRKYVYFSKDGIDWKIEKKLTNPYYKTSTGNDNLNTYRPFSPNTFVIYPYLKNEKREFSLSKSKNLNLHILIYTLTQTIYRDKLDNPKRDIKPNS

SEQ ID NO: 12539 - DNA, 378 bp, Unknown
  Obtained from environmental sample
  misc_feature (1)..(378): n is a, c, g, or t
atgacactttatgctcacatgaaatcatttcgtaaaggtattaaaagaggcaaaaaagttaaaaaaggtcaagttatcggatatgtcggctcaacaggactctcaacaggacctcatctgcactttggactttacaaaaataacagtgccataaatcctgcaaatgtcatcaggttaacagtgaaaaaattaaaaggctctaagaaaaaagagtttgaaaaaattaaagacaacttgaatcagatggttgctatgcacttagaggtgaatacaaaacctactagatgtaaagattttgagaactgtttagagatagatattaacagctttgaagccattgcttcaaaagagcctgagaaaaaatccgctaaaatataa

SEQ ID NO: 12540 - protein, 125 aa, Unknown
  Obtained from environmental sample
  DOMAIN (1)...(53): Peptidase family M23
  misc_feature (1)..(125): Xaa is any amino acid
MTLYAHMKSFRKGIKRGKKVKKGQVIGYVGSTGLSTGPHLHFGLYKNNSAINPANVIRLTVKKLKGSKKKEFEKIKDNLNQMVAMHLEVNTKPTRCKDFENCLEIDINSFEAIASKEPEKKSAKI

SEQ ID NO: 12541 - DNA, 828 bp, Unknown
  Obtained from environmental sample
  misc_feature (1)..(828): n is a, c, g, or t
atggcaatttattttttaatgtgttcagaaagatctggtagtaactttattacgaaactattaaatggacataaggacatttgtggaccatctactaaacatataattaatccaatagcgagaaatatttttagatacagagatttaaaaaatgaaaataattggaatgaattgttaactgatatatttaatttaatgaacgttgcattctcaatatggaaaaaaaaatttactttaaaagagctacagcaaatagcacctatcggtgatataaaagccttaatagaaaatatatttatggcagaagcaattgcaaatggaaagcaaaatgtttttattaaagagaaccaagtttatgaatttttaccatttttacttctaaactttcctgaatctaaatatatatatcaaacaagagatccaagagatatggcactttcgtggaaaaaaaacttagatcatccaggtggtgtggttagtgcagccaagcaatggcagaaagatcaacaaagtacattgaaaaattttacggagttagaaaaagtaggaaaagcttattttgttagatatgaagatttaatcactgattcagatagatataccaaagagatagtagagttttttggtttacagcatgatactaatatagaaaatttttatcaagatgaaatgactcaaaaaaattctaaaatgcaagaggcatggaataatttatctaaaggtgggatgaaagataataagaaaaaatatcttccagagctgagtatagatgagataaagtctatagaaaagatatgctattatgaaatgaaatatttaggttatgac

SEQ ID NO: 12542 - protein, 276 aa, Unknown
  Obtained from environmental sample
  DOMAIN (82)...(274): Sulfotransferase domain
  misc_feature (1)..(276): Xaa is any amino acid
MAIYFLMCSERSGSNFITKLLNGHKDICGPSTKHIINPIARNIFRYRDLKNENNWNELLTDIFNLMNVAFSIWKKKFTLKELQQIAPIGDIKALIENIFMAEAIANGKQNVFIKENQVYEFLPFLLLNFPESKYIYQTRDPRDMALSWKKNLDHPGGVVSAAKQWQKDQQSTLKNFTELEKVGKAYFVRYEDLITDSDRYTKEIVEFFGLQHDTNIENFYQDEMTQKNSKMQEAWNNLSKGGMKDNKKKYLPELSIDEIKSIEKICYYEMKYLGYD

SEQ ID NO: 12543 - DNA, 306 bp, Unknown
  Obtained from environmental sample
  misc_feature (1)..(306): n is a, c, g, or t
atggatgggtataaaataatgttaggacgagacgaaagggaaaatatatatcttttagagaatagcaaagcaagtgatttttggtttcatcttcaaggtatgccatcttctcatgtaattgtatcttgtactaaaaaaacattaccacaaaatattattgaagaagcggcaaaaatatgtgcaagattttctattgatagtggaggtagatttagtgtagactatactcaaaggagaaatgtaaaaatacaaaataaggcaaatgtactttataatccttatagtacagttgaagtaaaagtataa

SEQ ID NO: 12544 - protein, 101 aa, Unknown
  Obtained from environmental sample
  DOMAIN (1)...(83): Domain of unknown function (DUF814)
  misc_feature (1)..(101): Xaa is any amino acid
MDGYKIMLGRDERENIYLLENSKASDFWFHLQGMPSSHVIVSCTKKTLPQNIIEEAAKICARFSIDSGGRFSVDYTQRRNVKIQNKANVLYNPYSTVEVKV

SEQ ID NO: 12545 - DNA, 798 bp, Unknown
  Obtained from environmental sample
  misc_feature (1)..(798): n is a, c, g, or t
ttgttaggtaacatttttttgtcgtttaaatattatttagaagcctcaatctgcttaatagactgtgaacctgttaaaattaaagagcatatttttgagtgtgcacgcattctttatcataaaggacatttagcattaactaagaaatttttagaagttgctactcaactttatgataattataaacagcaatttgaacttggttattcatattatcatttgagtaatgtatgtagagatttaggcaatcttatagaatctgggaggtttattgattatgctatccaaatatttaaagacattgatgaaaagatttttttgctttcttcatattcatctaaagtactaaatttagctgaagaaggccagaaaagtaaatcacttgaattaattaagactattatatcagagttacctgaagataataggactaaagcattggcatatgcgaatatatctaaaacttacttatactttaaccaatatatgttatgtagcaaatattctaaaatggctattgatattttcaaaacacttaaagataattatggtatacaaatttcaatattaaattatacaagcggcttagctaacatgaatgaggagaatcttgcaactcagtatttagaagagcttttaactgatgatgaaattgatataacaccaggagtgagagcggcagtattgggcaacttatcatcatgttatagaaaaagtggtgattgtgaaaatgctaaggatgcaagtaatagaagtcttgagattttgaacccgtttaggattaaaagaaacagatag

SEQ ID NO: 12546 - protein, 265 aa, Unknown
  Obtained from environmental sample
  misc_feature (1)..(265): Xaa is any amino acid
MLGNIFLSFKYYLEASICLIDCEPVKIKEHIFECARILYHKGHLALTKKFLEVATQLYDNYKQQFELGYSYYHLSNVCRDLGNLIESGRFIDYAIQIFKDIDEKIFLLSSYSSKVLNLAEEGQKSKSLELIKTIISELPEDNRTKALAYANISKTYLYFNQYMLCSKYSKMAIDIFKTLKDNYGIQISILNYTSGLANMNEENLATQYLEELLTDDEIDITPGVRAAVLGNLSSCYRKSGDCENAKDASNRSLEILNPFRIKRNR

SEQ ID NO: 12547 - DNA, 447 bp, Unknown
  Obtained from environmental sample
  misc_feature (1)..(447): n is a, c, g, or t
atggaaaataaaccttttatagtatatgtggtagaagacaacgaatggtataataaattgttggtgcataacctatctttaaaccccgattttgttgttaaatcatttctaaatggaaaagatttaatggcagcattgataaaaaagcctgatgttgttactttagattatcgtctaccagatataaatggagaaagtttattgtctaaaataaaagattttgaccaaaatattgaagtcattgttatttctgaacaagaagaaattgaaactgctgtagatttattaaaagctggagcttacgattatattgtaaaatctaaagacattaaagataggttaaataacacagtaaatcctattaagaaaaacgctaagctaaaaaaacaatttggtaccactacaaaaagaagttcaggggaaatatgccttttaaaaaatctataa

SEQ ID NO: 12548 - protein, 148 aa, Unknown
  Obtained from environmental sample
  DOMAIN (6)...(122): Response regulator receiver domain
  misc_feature (1)..(148): Xaa is any amino acid
MENKPFIVYVVEDNEWYNKLLVHNLSLNPDFVVKSFLNGKDLMAALIKKPDVVTLDYRLPDINGESLLSKIKDFDQNIEVIVISEQEEIETAVDLLKAGAYDYIVKSKDIKDRLNNTVNPIKKNAKLKKQFGTTTKRSSGEICLLKNL

SEQ ID NO: 12549 - DNA, 420 bp, Unknown
  Obtained from environmental sample
  misc_feature (1)..(420): n is a, c, g, or t
atgaaaacacaagaaaaattaatctacatcgttgaagacagtaaaattattgctgatatacttgctaaagttataagctctgttcctaatacaaaaacaaaagatttttgtaatggagaatccatgcttaatgaattaaactacgaaatgcccgatatgattttcttagattactacctctatgaaaatggcagaaaaattaataacaactctaccaccatgaatggcgagcaagtttttaatgaaataatgaaagttaatccagatgttcctgtagtacttcttactggtcttgatgattacaatgtaattgaaaaaatgaaaactaatggaatctgctgcgttatccataaagaagttgatgatatctataattctgtattagactgtgttcaaaaatacctaccacaagctgtatag

SEQ ID NO: 12550 - protein, 139 aa, Unknown
  Obtained from environmental sample
  DOMAIN (6)...(135): Response regulator receiver domain
  misc_feature (1)..(139): Xaa is any amino acid
MKTQEKLIYIVEDSKIIADILAKVISSVPNTKTKDFCNGESMLNELNYEMPDMIFLDYYLYENGRKINNNSTTMNGEQVFNEIMKVNPDVPVVLLTGLDDYNVIEKMKTNGICCVIHKEVDDIYNSVLDCVQKYLPQAV

SEQ ID NO: 12551 - DNA, 738 bp, Unknown
  Obtained from environmental sample
  misc_feature (1)..(738): n is a, c, g, or t
ttggttttaaaaaaagaatccaatatggaaagaaagcaaataaagtttagtaatgaagaaaataatagaaatttaatcaaaaatgattttgcaaatgatagcaaaagattagcattatatgaattatatagaagttggagtgaattaaaagataatacaaaagaatttcgactatgtttagcatggaataatccagttgatgaagatattgcgtctatattaaaaaaagttgatgaaacttcttcttttattgaatttcaaactaccatctataaaattgatattaataaactctgggaaaaagattctttaccttctccgaattggagtaattttagaaaatttattgaagattatcgaatcgaaagaaaagaattctctgatttttgtgataacttaattattgaattagaatttccaaaggcaagtttaaattttgaaaaaccaaataatttggaagtgattttaattagccaagctaaaagactaggaattggtatttatccaaatgataatcgaacaattacagattttttgaatacgttagcttatactgtcaataaattgaaaagcaatgaaattaatattgagaccttacttcaaaaacttgaagtagtaactgactttggaagtattgaacaaaaatttgaaatagatcaatcaaaaaatatcaagaaagatcttaatttttattctttttataatttaatacttgaaaatcaaaaaactttatattag

SEQ ID NO: 12552 - protein, 245 aa, Unknown
  Obtained from environmental sample
  misc_feature (1)..(245): Xaa is any amino acid
MVLKKESNMERKQIKFSNEENNRNLIKNDFANDSKRLALYELYRSWSELKDNTKEFRLCLAWNNPVDEDIASILKKVDETSSFIEFQTTIYKIDINKLWEKDSLPSPNWSNFRKFIEDYRIERKEFSDFCDNLIIELEFPKASLNFEKPNNLEVILISQAKRLGIGIYPNDNRTITDFLNTLAYTVNKLKSNEINIETLLQKLEVVTDFGSIEQKFEIDQSKNIKKDLNFYSFYNLILENQKTLY

SEQ ID NO: 12553 - DNA, 519 bp, Unknown
  Obtained from environmental sample
  misc_feature (1)..(519): n is a, c, g, or t
ttgaaacaattagtatcaagtggtgaagcagcaaacattctaggtttatctttacaagggatacattatcgtataaaaaaagggcaattagagtctgtaaaacaagatggaaaaatctatgtatatatagatagttccagtataaaaaatcaacagcaaaatactaaacatacaactaacaatcaaaataacaatacatctcctaatgaacaagctatacatatgggtgagttagctttaaagtcaaaagatgagcagataactattttaaaaaaaacaattaaatttatgagaagacagtacacttctgaaatccaaagacttgataaaaaccaacaaaaaatacttgatgtatttcaaagtgaagttgatcttctaaaaagtgcttttaatgagatgaaaacattgtatcaagtagaacataaagagcatcaagaacaatcaaaagaggtatcccatcaagttggattaccatttatgaatcttaaaagagttttttgttcttatgagaaactataa

SEQ ID NO: 12554 - protein, 172 aa, Unknown
  Obtained from environmental sample
  misc_feature (1)..(172): Xaa is any amino acid
MKQLVSSGEAANILGLSLQGIHYRIKKGQLESVKQDGKIYVYIDSSSIKNQQQNTKHTTNNQNNNTSPNEQAIHMGELALKSKDEQITILKKTIKFMRRQYTSEIQRLDKNQQKILDVFQSEVDLLKSAFNEMKTLYQVEHKEHQEQSKEVSHQVGLPFMNLKRVFCSYEKL

SEQ ID NO: 12555 - DNA, 534 bp, Unknown
  Obtained from environmental sample
  misc_feature (1)..(534): n is a, c, g, or t
atgcatggtgtacagaattttccaacaagtattaaaaatgctaatattagtagattacaattactcaaagaaaattttaacttaccagcaggttatgatgaccatacagatgcagaagaccctttttctagaatgattgatcttattgcacttggtgctggagctaatgtattagaaaaacatatcacacttagtagagcagaaaaagggatagattaccaatctgcattagaagcagatgaatttaaaagttttgtaaaaaatattcatcaagcatcaagggctttaggaaataaaaaacctaaaatatttgatgaaagtgatttaaaatatagaaaattccaaaagaaaagtgttgtagcgattcgagatatacaacaaggtgaaatcttagacaaaaaagactttaaatttttaagaaataagtttgttggtttatcaccttatgaaagcttaaatttaattggcaaaaaagtgattacaaatattaaaaaatacgataatatacttaaaagtaatgtagatgaattttaa

SEQ ID NO: 12556 - protein, 177 aa, Unknown
  Obtained from environmental sample
  DOMAIN (118)...(175): Antifreeze-like domain
  misc_feature (1)..(177): Xaa is any amino acid
MHGVQNFPTSIKNANISRLQLLKENFNLPAGYDDHTDAEDPFSRMIDLIALGAGANVLEKHITLSRAEKGIDYQSALEADEFKSFVKNIHQASRALGNKKPKIFDESDLKYRKFQKKSVVAIRDIQQGEILDKKDFKFLRNKFVGLSPYESLNLIGKKVITNIKKYDNILKSNVDEF

SEQ ID NO: 12557 - DNA, 810 bp, Unknown
  Obtained from environmental sample
  misc_feature (1)..(810): n is a, c, g, or t
gtgatatatgtatcttcatcatgtgtaaaacataaaaagataaaagactctatcttagagttaatagattatggatttaaaaatattgaattatcaggtggaactgaatattatgatggttttgaagatgatttgttggtgttaaaaaagaaatatgatttaaattatatttgtcataactattttcctccaccaaaggagcattttgtactaaatttagcatcattagataatgaaatttatgtaaaaacattagatcatttaaaacagaccattgttttatcacaaaaacttggtgctacaaagtttggatttcacgctggcttttttatagatattaaagtaagtgaaataggtcaaaaaattacaaaagaaaatttatatgataaacaagaagcaattaaaagattttgtgatggttttttagtattacaaaagttagcagacagtttagaactttatattgaaaataatgttttttctagtacaaattataaaacatataatggagaaaattttttcatgctcacatgttctgatgaatatgaaaggttaaaagaatgtatagacttctctttattattagatgtagcacacctaaaagtaagtagtaggagtttgaatttaaattttgaagaggaatggtcttatttaataaagagtacggattatattcatattagtgataatgatagtttacatgatataaatagttcaatcaaagaaaaatcagatttagtggatttattaagaaaagaagatttaaaaaataaagattttactctgaaatatatatctcagccgatctga

SEQ ID NO: 12558 - protein, 269 aa, Unknown
  Obtained from environmental sample
  DOMAIN (1)...(255): AP endonuclease family 2
  misc_feature (1)..(269): Xaa is any amino acid
MIYVSSSCVKHKKIKDSILELIDYGFKNIELSGGTEYYDGFEDDLLVLKKKYDLNYICHNYFPPPKEHFVLNLASLDNEIYVKTLDHLKQTIVLSQKLGATKFGFHAGFFIDIKVSEIGQKITKENLYDKQEAIKRFCDGFLVLQKLADSLELYIENNVFSSTNYKTYNGENFFMLTCSDEYERLKECIDFSLLLDVAHLKVSSRSLNLNFEEEWSYLIKSTDYIHISDNDSLHDINSSIKEKSDLVDLLRKEDLKNKDFTLKYISQPI

SEQ ID NO: 12559 - DNA, 378 bp, Unknown
  Obtained from environmental sample
  misc_feature (1)..(378): n is a, c, g, or t
ttggattgcaccacttccaggatttttcttcctatttgcatttggtatattacaagctttcattttcatgatgcttacttatgtatatatctctggttcagttatgatggcagaggaagaccactagtagagatacaagtgctcacagaaaaaaaattagaaaaggaggcttttaaaaagcctcctttttttatctcttatcttattactgaccctaaagaatatgggaatacagtaaaaaatttcgaaaaaaattttatacaagctcttacttctcataaagttgatatggtatgttttagagacaaaacaacaccaaacactcaagagctaatacactctttaaaaccatgcaaaagagtctcagccgaattctga

SEQ ID NO: 12560 - protein, 125 aa, Unknown
  Obtained from environmental sample
  misc_feature (1)..(125): Xaa is any amino acid
MDCTTSRIFLPICIWYITSFHFHDAYLCIYLWFSYDGRGRPLVEIQVLTEKKLEKEAFKKPPFFISYLITDPKEYGNTVKNFEKNFIQALTSHKVDMVCFRDKTTPNTQELIHSLKPCKRVSAEF

SEQ ID NO: 12561 - DNA, 429 bp, Unknown
  Obtained from environmental sample
  misc_feature (1)..(429): n is a, c, g, or t
atgtatgcagtagcgttacttataatagtaggtatgctttttgttatgggtggtaaaaaagagtatatgcttttaaatatcaataaaacaactgaactttataaaataagagataatggtgaggtagcaaataactttgtattactattccaaaatactcaaagagaaaactatacatataatttagaagtaataggtgaatatgcaggaaaaattgagataaaaaggtttacaccttttaaattaagtcataataagatggcaaaaaaagttatccaacttgctactacagaaaggttagttgacagtgttgaaaaagatacaccaatcactgttacacttaaatcatatgcaattgaaaatcctgaagagatttttgttataagaaaagctgtatttatctatccaagagcagataaactaaaataa

SEQ ID NO: 12562 - protein, 142 aa, Unknown
  Obtained from environmental sample
  misc_feature (1)..(142): Xaa is any amino acid
MYAVALLIIVGMLFVMGGKKEYMLLNINKTTELYKIRDNGEVANNFVLLFQNTQRENYTYNLEVIGEYAGKIEIKRFTPFKLSHNKMAKKVIQLATTERLVDSVEKDTPITVTLKSYAIENPEEIFVIRKAVFIYPRADKLK

SEQ ID NO: 12563 - DNA, 699 bp, Unknown
  Obtained from environmental sample
  misc_feature (1)..(699): n is a, c, g, or t
ttgggtatgtgggaatgttgcattatgaattatgaagtaaataatcacgattcaacaccaattttagaagcaaaaaatataacccataattttgattatcctctttttgaggatatcaatcttactctacatccacaagaaactattgcaataattggcgttagtggtagtggaaaatcaactttacttaatatattttcttccctattgattccaaataaaggtgaagtatactacaataataagaatatttttaaattatctaaaaatgagttattagagatacgacgaaatgattttggtatcatttttcaagcacattatctctttcgtggatttagtgcattagaaaatttgcaaatatccgagtttttaagtggcgaggctataaatgaaaatttactgaaatctttaaaaatagattatgtaatgaaacaagggattggtgaactaagtggaggacaacagcaacgactatcgtgtgcaagagttcttacaaaaaaaccaaaaataatttttgctgatgaacctacaggaaacttagaccatgaaacagcaaatgaagttataaatgttttgtttgattatattgaaaaacaaagtgcaggcttaataatagttacacatgaagaagagatagcatttaagtgtgataaagtttacaaattaaatgattataaattggagcaattaaaatga

SEQ ID NO: 12564 - protein, 232 aa, Unknown
  Obtained from environmental sample
  DOMAIN (46)...(226): ABC transporter
  misc_feature (1)..(232): Xaa is any amino acid
MGMWECCIMNYEVNNHDSTPILEAKNITHNFDYPLFEDINLTLHPQETIAIIGVSGSGKSTLLNIFSSLLIPNKGEVYYNNKNIFKLSKNELLEIRRNDFGIIFQAHYLFRGFSALENLQISEFLSGEAINENLLKSLKIDYVMKQGIGELSGGQQQRLSCARVLTKKPKIIFADEPTGNLDHETANEVINVLFDYIEKQSAGLIIVTHEEEIAFKCDKVYKLNDYKLEQLK

SEQ ID NO: 12565 - DNA, 633 bp, Unknown
  Obtained from environmental sample
  misc_feature (1)..(633): n is a, c, g, or t
atgatagaaaaaatgaaaaaactaatgctttttatgcccgacactgccgttaatattgatgctgaacttactgttttgggacaacttggggtaatgcacattacacctttgcaggccgcaaaacacgattcgattgaacgggttgatgcacgaataaaacaattggaaaaggccatttcggttttgagcaggtacgataacgagcaaaactctgattctgaaaagagtgaaattatcaactattcaaaattggagagaggcgaggtttttctcatggaaaaagtactggatgctgaaaattatcggattgaacttgaaaatacaaagctcaatttaatgcacgacctggagtggtttgcaaattggggaagcataaggcaaaaagatataaaagaactcagtgataagggaatttacataaaactttatttacttaacgataaggagttaaagcgaattgccgaccgtgaagatattcaggtagttggaaaattggatggattaaaccaggtagttttactttccaacgatgcggatgaaaaactagatttccaggagattccgtttcctccgtcggagtttgaaaattcgaggaagttattaaacacgacgaaacaaagatctggagagtaa

SEQ ID NO: 12566 - protein, 210 aa, Unknown
  Obtained from environmental sample
  misc_feature (1)..(210): Xaa is any amino acid
MIEKMKKLMLFMPDTAVNIDAELTVLGQLGVMHITPLQAAKHDSIERVDARIKQLEKAISVLSRYDNEQNSDSEKSEIINYSKLERGEVFLMEKVLDAENYRIELENTKLNLMHDLEWFANWGSIRQKDIKELSDKGIYIKLYLLNDKELKRIADREDIQVVGKLDGLNQVVLLSNDADEKLDFQEIPFPPSEFENSRKLLNTTKQRSGE

SEQ ID NO: 12567 - DNA, 429 bp, Unknown
  Obtained from environmental sample
  misc_feature (1)..(429): n is a, c, g, or t
ttgttgctaaaaataaacactttttttcctacaataggaaactcaatttcattattcaacttcttaaaaattatacttatgagcaaaattattgtattaggtgccggaatggtaggcagtactatggctatcgacttagcaaaaaaacatgaagtaacccttaccgatttaaacacatccactttacaacatgtaaaaaataaatgtaatcaattgaacattttgcagctggatgttactcaaacagcaacattaaaaacaacacttcaaccttttgatttggtaatttgtgctgtgcccggtttcttaggtttcaataccctaaaaaatattattgaagcagagaaaaatgtaatcgatatttctttctttcctgaaaatgcgttagaactgcatgaacttgcccaacaaaaaaatgtactgctatag

SEQ ID NO: 12568 - protein, 142 aa, Unknown
  Obtained from environmental sample
  misc_feature (1)..(142): Xaa is any amino acid
MLLKINTFFPTIGNSISLFNFLKIILMSKIIVLGAGMVGSTMAIDLAKKHEVTLTDLNTSTLQHVKNKCNQLNILQLDVTQTATLKTTLQPFDLVICAVPGFLGFNTLKNIIEAEKNVIDISFFPENALELHELAQQKNVLL

SEQ ID NO: 12569 - DNA, 360 bp, Unknown
  Obtained from environmental sample
  misc_feature (1)..(360): n is a, c, g, or t
atgataggtaatgagttgttttttggtaaaagtgtactatgtggcagtaaagatggagtcgatgctcctgctagcattaacagtgatgaactagaagctttaatatcatatgagataagtgatttttatagagatgtactttcacaattaaagagagatagtttgaatataaaagagacttttatgattacacataacaatcagagtattccattaaattacgagtgggttttatatacatttaacatagcagataatgcaacaaaagattattttttaaatggactgaagagtgaaaatgatcacaaaggttattttcaaaaaatggctgatttagcttttaaagcaggtaataaataa

SEQ ID NO: 12570 - protein, 119 aa, Unknown
  Obtained from environmental sample
  misc_feature (1)..(119): Xaa is any amino acid
MIGNELFFGKSVLCGSKDGVDAPASINSDELEALISYEISDFYRDVLSQLKRDSLNIKETFMITHNNQSIPLNYEWVLYTFNIADNATKDYFLNGLKSENDHKGYFQKMADLAFKAGNK

SEQ ID NO: 12571 - DNA, 741 bp, Unknown
  Obtained from environmental sample
  misc_feature (1)..(741): n is a, c, g, or t
ttggataaaataaaaaagctcaactgctcatattcagagcagagtgtaatcgaagatctaaacttagagatagatgagcacatctgtatcttaggagcaaatggaagcggaaaaagtacactggcaaaagcactatctaatctcataagttttgagggtaatatcttcataggtggcaaaaatatatctgaactaaaacgctctgagatatcaaaacttataacttatgttccttcaaaaatggagttctttgatgcatacataagtgtttttgagtatgttcttcaaggaagatatgttcataaaaacaactttgctccctatagtgcacaagacatagagaaagttgcagatattttagagcagatgagcataacacacttaaaagataaagccatcagtgagctaagttccggggaatcacaacttgttcttatcgctcaaaatatcgttcaagagagcaaagttatcatctttgatgaaccaactgctaatctagatccgactcactcttatgagcttttaaaagagattaaaaaacttaaatcatcacatctgatcatactcataacccatgatgtaaatctagcatttgccatggagagctccattctttttatctcaggaaaagagcacaaatattttaaagagcgtgaaaagttttttacaaaagagaatctctttgagtgttataagacaaaatttagcgtagataaaacagtggcaatagattatgattaa

SEQ ID NO: 12572 - protein, 246 aa, Unknown
  Obtained from environmental sample
  DOMAIN (25)...(210): ABC transporter
  misc_feature (1)..(246): Xaa is any amino acid
MDKIKKLNCSYSEQSVIEDLNLEIDEHICILGANGSGKSTLAKALSNLISFEGNIFIGGKNISELKRSEISKLITYVPSKMEFFDAYISVFEYVLQGRYVHKNNFAPYSAQDIEKVADILEQMSITHLKDKAISELSSGESQLVLIAQNIVQESKVIIFDEPTANLDPTHSYELLKEIKKLKSSHLIILITHDVNLAFAMESSILFISGKEHKYFKEREKFFTKENLFECYKTKFSVDKTVAIDYD

SEQ ID NO: 12573 - DNA, 420 bp, Unknown
  Obtained from environmental sample
  misc_feature (1)..(420): n is a, c, g, or t
ttgattaaaaatatagatcatgaactagaaaatacaaaaaaactcccacaaaagcagagagttttagtagtttttggagcgccaagttctatcgtaaatggtctatatgttgcaggaaaacagatattttataatgatattttagactcttgcggagctattaatgcctactctgatttaactatcgaacagccaaaaatctcttatgaacagatcatctctcttgatcccgatcaggtactcatacttgatcctcaacacctaaattctaaggagagttatatcgctcagtttaaagagttaaacatggattcaaagataaaagtcatctatgacggttatatctcaattccaagtcacagagtagcacagagtataaaaaagatgtgtgacacactctactatgataaaaataaataa

SEQ ID NO: 12574 - protein, 139 aa, Unknown
  Obtained from environmental sample
  misc_feature (1)..(139): Xaa is any amino acid
MIKNIDHELENTKKLPQKQRVLVVFGAPSSIVNGLYVAGKQIFYNDILDSCGAINAYSDLTIEQPKISYEQIISLDPDQVLILDPQHLNSKESYIAQFKELNMDSKIKVIYDGYISIPSHRVAQSIKKMCDTLYYDKNK

SEQ ID NO: 12575 - DNA, 330 bp, Unknown
  Obtained from environmental sample
  misc_feature (1)..(330): n is a, c, g, or t
gtgacacactctactatgataaaaataaataagctcaactgctcatattcagagcagagtgtaatcgaagatcttaacttagagatagatgagcacatctgtatcttaggagcaaatggaagcggaaaaagtacactggcaaaagcactatctaatctcataagttttgagggtaatatcttcataggtggcaaaaatatatctgaactaaaacgctttgagatatcaaaacttataacttatgttccctcaaaaatggagttctttgatgcatacataaatggttttgagtatgttctccaggaagaatatgtcataaaacaactttgc

SEQ ID NO: 12576 - protein, 110 aa, Unknown
  Obtained from environmental sample
  misc_feature (1)..(110): Xaa is any amino acid
MTHSTMIKINKLNCSYSEQSVIEDLNLEIDEHICILGANGSGKSTLAKALSNLISFEGNIFIGGKNISELKRFEISKLITYVPSKMEFFDAYINGFEYVLQEEYVIKQLC

SEQ ID NO: 12577 - DNA, 738 bp, Unknown
  Obtained from environmental sample
  misc_feature (1)..(738): n is a, c, g, or t
atgacagaatggctgaggccgatttctgtttcccaccatgaaaatgaggcaagtcaaacaagatgttgtacctctcaagagttagcaaaatattggatgcataatggttttgtaaatatagatggggaaaagatgtctaaatcacttggaaatagtttttttctcaaagatgctttagataaatatgatggtgaagttatccgattttatatgttaagtactcattatagatctgatttgagttttaatgaagaagatttattaacaagtaaaaaaaggcttgataaactctatagagtaaaaaaaagagtttatggaacaactgcgagtattgtcaataaagatatacaaaaacaacttttagaatctttaaatgatgatatgaataccgcaaaagcgatggcttttttagatgaatatatctcaagtgttaatgactcgttaaataataatccaaaagacaaagctcttaaaaaagagtttatagcaactattgattttatctcatctcttttaggaattggagctcaagattgttttgagtattttcaatttgggattactgaagaggaaaaaagtagcattgaaaaacttataagtgatagaacaatagcaaaacaaaataaaaactttgaggaatcagataagataagagaaaaattaacagatatgggaatatctcttatggataccccaaatgggaacaatgtggggaagaaaactaaactatttcattag

SEQ ID NO: 12578 - protein, 245 aa, Unknown
  Obtained from environmental sample
  DOMAIN (1)...(92): tRNA synthetases class I (C) catalytic domain
  misc_feature (1)..(245): Xaa is any amino acid
MTEWLRPISVSHHENEASQTRCCTSQELAKYWMHNGFVNIDGEKMSKSLGNSFFLKDALDKYDGEVIRFYMLSTHYRSDLSFNEEDLLTSKKRLDKLYRVKKRVYGTTASIVNKDIQKQLLESLNDDMNTAKAMAFLDEYISSVNDSLNNNPKDKALKKEFIATIDFISSLLGIGAQDCFEYFQFGITEEEKSSIEKLISDRTIAKQNKNFEESDKIREKLTDMGISLMDTPNGNNVGKKTKLFH

SEQ ID NO: 12579 - DNA, 717 bp, Unknown
  Obtained from environmental sample
  misc_feature (1)..(717): n is a, c, g, or t
atgtatggtctgcctgaggatctaattgatcatgtgcatatcatggataagaaatatccctcagacaaatcaaaaagtacaagctttttttccagagtaaaacaggcaagagagcttcctgaacaagatataatatttgatttaacagatagctctttaactctgctattgatatttttttcagaagcaaaacttaaaataggttactcatatagaactatcagacgtatgttttatgacatctcaatactcagaagtgatttcgttatagaggcagaatctgtactgcatatgttaaatatgttaggtgcaaaaaccacaagagctttacaatatggatatgataaaaaatatccaaaaaatgatcgtaaacagatactctattttgccggagctgctatggagagtaaatgctgggaaaaagagaagtttaaagacttaatctctaaaacatcagaagtttatagagattatgatcacatcatcttacaaggcattaaagagaatgagaagtttttagagatatataatcctctaaaagagcataaaaatgtcaaactccaagaggctatggatttagataaaactatgcaacttctatctgattggaaatgtgtagtctcaaatgatacaggtgtcagaaacatggctattgcggtaaacacaccaacgaaaggtatatttttggcacctggggctttcaaaataggggcctaa

SEQ ID NO: 12580 - protein, 238 aa, Unknown
  Obtained from environmental sample
  misc_feature (1)..(238): Xaa is any amino acid
MYGLPEDLIDHVHIMDKKYPSDKSKSTSFFSRVKQARELPEQDIIFDLTDSSLTLLLIFFSEAKLKIGYSYRTIRRMFYDISILRSDFVIEAESVLHMLNMLGAKTTRALQYGYDKKYPKNDRKQILYFAGAAMESKCWEKEKFKDLISKTSEVYRDYDHIILQGIKENEKFLEIYNPLKEHKNVKLQEAMDLDKTMQLLSDWKCVVSNDTGVRNMAIAVNTPTKGIFLAPGAFKIGA

SEQ ID NO: 12581 - DNA, 642 bp, Unknown
  Obtained from environmental sample
  misc_feature (1)..(642): n is a, c, g, or t
atgaaaaataaaaatattttagagatctgtctttctcctgatcttggtggacttgaaatctttatgacaaactgttttaaatattttaagacaaaaactaattgtaaagttatagtgcaacaaaatcaaaaattagatgcctatttagaagatgaaaaagtttcttacataaaaagagagaaatattttccaatcaaaccagctttagaacttgctcattttattgataaccacgacatagatatagttcattttcactggacaaaagatattctcacagttgtacttgctaaattttttagttctaaaaaaccaaaaatagtccaaacaagaaatatgaacatgacaagatttaaaagcgatttctatcataaatggctatacaaaaatataaccttaatccatgcagtaacttatcaggtaaaaagtcagctagagaaatttatacctcaagctattagacctaaaatagaagttgtatatatgggtacaaaagagcaagaagttgataataaaaaagttgaagagttaaaaaacagatataacttacaagataactttgttgttgggattgtcggtaggattgaagaggttaagggtcaatatttggttatagaagctatcgagaaactaaaagattaa

SEQ ID NO: 12582 - protein, 213 aa, Unknown
  Obtained from environmental sample
  misc_feature (1)..(213): Xaa is any amino acid
MKNKNILEICLSPDLGGLEIFMTNCFKYFKTKTNCKVIVQQNQKLDAYLEDEKVSYIKREKYFPIKPALELAHFIDNHDIDIVHFHWTKDILTVVLAKFFSSKKPKIVQTRNMNMTRFKSDFYHKWLYKNITLIHAVTYQVKSQLEKFIPQAIRPKIEVVYMGTKEQEVDNKKVEELKNRYNLQDNFVVGIVGRIEEVKGQYLVIEAIEKLKD

SEQ ID NO: 12583 - DNA, 732 bp, Unknown
  Obtained from environmental sample
  misc_feature (1)..(732): n is a, c, g, or t
atgtttaacagcacatatgccatgatagatcacattaatgtaatgatcaatgtaaataacaacaaaacagaagagaagtttaaacttcaagagtatctgatctattttgtatttattttttctgtaattgttctattttggtactcaaatagattaagtgtaatatataaagatatacagtatctattttcaattaaagatagctcagaatatactatatccacaaatgaagtaaactctatttcacgaagaatgtcatcaaaaccgactacaaaaaaagatgatcctttaatgatcgactctgtaactgatatgaaaaatatgcaaggcgttttaagcagtcatgcagacattaaaatgtcaaaaagtcatacagcacaagagatagcactgttcgctattgatgatataaaattattacgtaaaaagtacccttcaaaagtcataaatagtatattcaaaaaagtagcatttgttatctctttacatgaacagcataatgatgttgttggttttgtgtctgataatacatttgtatttatcttctcacaaaaaaataaaaatgagtcactagaagtttgcgaagagattagagatacgatatcaaaaagtcattttaaaatagatcaagacagagagatttcactcactattagctccatagtcgttacaaaacttgccgggcaaaagtttggaaaaatatgccttactccagtcaaaaagaaaagttaa

SEQ ID NO: 12584 - protein, 243 aa, Unknown
  Obtained from environmental sample
  misc_feature (1)..(243): Xaa is any amino acid
MFNSTYAMIDHINVMINVNNNKTEEKFKLQEYLIYFVFIFSVIVLFWYSNRLSVIYKDIQYLFSIKDSSEYTISTNEVNSISRRMSSKPTTKKDDPLMIDSVTDMKNMQGVLSSHADIKMSKSHTAQEIALFAIDDIKLLRKKYPSKVINSIFKKVAFVISLHEQHNDVVGFVSDNTFVFIFSQKNKNESLEVCEEIRDTISKSHFKIDQDREISLTISSIVVTKLAGQKFGKICLTPVKKKS

SEQ ID NO: 12585 - DNA, 795 bp, Unknown
  Obtained from environmental sample
  misc_feature (1)..(795): n is a, c, g, or t
ttgaaaaacatatttgaggagggcgagttagaagaaaaagcaactattaaggatttcttaatagttcaaaaagagggagaacgagaggtaaagagaaaacaagtattttataatctagatgcaattatttctgttggttaccgaataaaatcgcacgtggcaacaaagtttaggcaatgggcaacaaagcacataaaggaatttattgtaaaaggttttgtgttagatgatgagcgattaaaaaatccagatttgccttttgattattttgaagaattagaaaaacgaatacaagatattcgcacatctgaaaagagattttatagaaaaattactgacatttacgctacaagtgttgattatgacccaacattggatataagtactagttttttcaaaacgattcaaaacaaattgcattgggctatcacaggaaaaacagcagcggaaataattacatcaagagctgatagccaaaaacaaaatatgggtttaaccaattggcgaggggaaaaagttagaaaaactgatgtttcaattgctaaaaactacttgcaggaaaatgaattaatggcattgaataatttagttgaacaatatcttatttttgcacaaggtcaggcaatgcaacgtattccaatgaatatgagagattggattgaaaaacttgaagcatttttaataattaacaatcgggatataataacagatgttggcaaagtttctcacgaattagcaaaagataatgcagagttggagtacgaaaagtttaaacaacccaacaaaaagtattga

SEQ ID NO: 12586 - protein, 264 aa, Unknown
  Obtained from environmental sample
  misc_feature (1)..(264): Xaa is any amino acid
MKNIFEEGELEEKATIKDFLIVQKEGEREVKRKQVFYNLDAIISVGYRIKSHVATKFRQWATKHIKEFIVKGFVLDDERLKNPDLPFDYFEELEKRIQDIRTSEKRFYRKITDIYATSVDYDPTLDISTSFFKTIQNKLHWAITGKTAAEIITSRADSQKQNMGLTNWRGEKVRKTDVSIAKNYLQENELMALNNLVEQYLIFAQGQAMQRIPMNMRDWIEKLEAFLIINNRDIITDVGKVSHELAKDNAELEYEKFKQPNKKY

SEQ ID NO: 12587 - DNA, 441 bp, Unknown
  Obtained from environmental sample
  misc_feature (1)..(441): n is a, c, g, or t
atgtttttaggaagttttaattattcaatagatacaaaaggcagaatctctattcctgcaaggatgaggaagttcgtttcatcagaatcaaatgatacatttgttctgacgagaggctcctcaaaatgtataaatatttatccgatggattattggaaagaattagttacaaacaaattggataaactgaatacatttgacccacaagatgcaaaatttatgagaatgtttttacgagaggcagcagaagatagattcgattctcaatcacgattacttgtacctaaaaaattgatcgattttgctgaaattgagaaagacgtacttatactaggaatgaataaatatatagaagtttggaatcctcaactgtatgaagagtatttgcaaagcattgaagactcatacgaggaaattgcaaaagaagttatggatatgtaa

SEQ ID NO: 12588 - protein, 146 aa, Unknown
  Obtained from environmental sample
  DOMAIN (77)...(146): Domain of unknown function UPF0040 family
  misc_feature (1)..(146): Xaa is any amino acid
MFLGSFNYSIDTKGRISIPARMRKFVSSESNDTFVLTRGSSKCINIYPMDYWKELVTNKLDKLNTFDPQDAKFMRMFLREAAEDRFDSQSRLLVPKKLIDFAEIEKDVLILGMNKYIEVWNPQLYEEYLQSIEDSYEEIAKEVMDM

SEQ ID NO: 12589 - DNA, 621 bp, Unknown
  Obtained from environmental sample
  misc_feature (1)..(621): n is a, c, g, or t
atgggtcagaatcggctcgaggccatagataaagaatcattatcctggaataaaacttcaaaagagttctacttaccaatatttcagttatctgaaatgtgcagagacaaattcaaaaagataattgaaaagaaagatctacttaatacaattcctccagaagtgtgggaaaaaggttggaatgttaatattcaatctgtgggctccggcaggaacacaataaagtatttatccaggtatgtgtttaaagttgcaatatctgatcaccgtattatcaaagttcataaccggcgagtatattttaaatacaccaaccgggagaccggaaggattattgtaacttctttggacgtactggattttattcaaaagtaccttctgcatgtcctgccatcaggttttatgaaggttcgatattatggatttatgcatacttcattttctctggattatgataagctcaagttaatcgttgaaggttttaattctgttatgaataaagcagcgatagagattcctaagaaaatatatttgacctgttcttcatgtggaaaaaccatgaagtttatgttttccattctcccaaataatgcaagaataagaggctcaggtttcacttaa

SEQ ID NO: 12590 - protein, 206 aa, Unknown
  Obtained from environmental sample
  DOMAIN (13)...(149): Putative transposase
  misc_feature (1)..(206): Xaa is any amino acid
MGQNRLEAIDKESLSWNKTSKEFYLPIFQLSEMCRDKFKKIIEKKDLLNTIPPEVWEKGWNVNIQSVGSGRNTIKYLSRYVFKVAISDHRIIKVHNRRVYFKYTNRETGRIIVTSLDVLDFIQKYLLHVLPSGFMKVRYYGFMHTSFSLDYDKLKLIVEGFNSVMNKAAIEIPKKIYLTCSSCGKTMKFMFSILPNNARIRGSGFT

SEQ ID NO: 12591 - DNA, 303 bp, Unknown
  Obtained from environmental sample
  misc_feature (1)..(303): n is a, c, g, or t
atggcagattttgttggttcaacttcacaattaattacttatataaaagagttaccaattgaacaaaagatagcagttggaactgagtataatatggtaaatagattaagagaaaaaaatacatatatattaagctcaactaaacctgagtgtcctactatgaatgaaacaaccttagaagatgtatataagtgtttaaaagatattaaagatggtaaagaagtttttgaaacagagatttttgtaaatgaaaatgtaactaaatgggcacaagtagcactacaaaggatgtttgaagtatga

SEQ ID NO: 12592 - protein, 100 aa, Unknown
  Obtained from environmental sample
  misc_feature (1)..(100): Xaa is any amino acid
MADFVGSTSQLITYIKELPIEQKIAVGTEYNMVNRLREKNTYILSSTKPECPTMNETTLEDVYKCLKDIKDGKEVFETEIFVNENVTKWAQVALQRMFEV

SEQ ID NO: 12593 - DNA, 780 bp, Unknown
  Obtained from environmental sample
  misc_feature (1)..(780): n is a, c, g, or t
gtgccggggtcaggagtttcanggagtggcaaatcgacgttaataaatgaaacactttaccctatacttaatgcacactatttcaatggcgtaaagaaaccaatgccttataaaagcattacaggcttagagcatttagataaagttattgatattaatcaatctccaattggtagaactccacgaagtaacccggcaacctacactaaaacttttgatgaaattagaagtctctttgccaagattcctgaagctatgattcgcggttataagccaggacgatttagttttaatgttaaaggcggacgttgtgaaacttgccaaggaggtggcttacgtgttattgagatgaatttcttaccagacgtatatgtggaatgcgaaacttgccaaggtaaacgttttaatcgtgaaactttagagattagatataaaggaaaatctataagtgatgttttagacatgactattgaagaagctgtagatttctttgaaaacataccaaaaatccacagaaaactcaaaacaattaaggatgttggcttaggctatattacacttgggcaacaaagtactaccctttctggtggtgaagcacagcgtataaaattagccacagaattaagtaaacgcgatacaggaaacaccttctatattttagatgaacctaccacagggcttcattttgaagacatcagagtccttatgaaagtcctaaataaattagccgataaagggaatactgttctaatcatagaacataatctcgatggttattaa

SEQ ID NO: 12594 - protein, 259 aa, Unknown
  Obtained from environmental sample
  DOMAIN (5)...(258): ABC transporter
  misc_feature (1)..(259): Xaa is any amino acid
MPGSGVSXSGKSTLINETLYPILNAHYFNGVKKPMPYKSITGLEHLDKVIDINQSPIGRTPRSNPATYTKTFDEIRSLFAKIPEAMIRGYKPGRFSFNVKGGRCETCQGGGLRVIEMNFLPDVYVECETCQGKRFNRETLEIRYKGKSISDVLDMTIEEAVDFFENIPKIHRKLKTIKDVGLGYITLGQQSTTLSGGEAQRIKLATELSKRDTGNTFYILDEPTTGLHFEDIRVLMKVLNKLADKGNTVLIIEHNLDGY

SEQ ID NO: 12595 - DNA, 633 bp, Unknown
  Obtained from environmental sample
  misc_feature (1)..(633): n is a, c, g, or t
atgagtaatggatatgaagaactcaatgaaaaagtaaaatcaacaacacaaattattcaagatgtttcagttgcaagtacaagacaacatgagagtattaaacagattaatgattctattgctgatttagataaaaatactcaagtcaatgcacaaaactctcaatatatagcacagcttgccaactccatctctaatctctcagaagatttaatcaatgcttcatcaaaagctacttttaaagatgaagttagacaacaagtatgtgatatagatttagtttataaaacagctgaactaaaaaatcaacatattttattaaaatcaaaaaactttgaaaaactaggaacttatgaacaatgggatattgtaacagatcaagattgcaatatgggtaaatggttagaggaacaagaaaaacttgataaaaaattcactaaaactgaacaatggattcaattaaagaaaatacatagcgatgtacataattctattcaacattatataaatagtaatgcaaagcgtgtttcaaataaagagttaagagagattgcagncacaattgaaagtaatactttaatgatatttgataaatttaatgagattaagatattaaattgtaatatggaataa

SEQ ID NO: 12596 - protein, 210 aa, Unknown
  Obtained from environmental sample
  misc_feature (1)..(210): Xaa is any amino acid
MSNGYEELNEKVKSTTQIIQDVSVASTRQHESIKQINDSIADLDKNTQVNAQNSQYIAQLANSISNLSEDLINASSKATFKDEVRQQVCDIDLVYKTAELKNQHILLKSKNFEKLGTYEQWDIVTDQDCNMGKWLEEQEKLDKKFTKTEQWIQLKKIHSDVHNSIQHYINSNAKRVSNKELREIAXTIESNTLMIFDKFNEIKILNCNME

SEQ ID NO: 12597 - DNA, 465 bp, Unknown
  Obtained from environmental sample
  misc_feature (1)..(465): n is a, c, g, or t
ttgaggaagaaacaggtgtgtgatttattttcagagcaatcacttctgtgttcagtatttccacacgctgctggcttatcttttgatactttaattgcaaaaggccatgatccaaaaattgcttatatcgaatgctggcacgaagtaaagctcattgcagatgctatgattaaacacggcccaagcgcattccttggccttatttctccaaatgcattcataggtggagaaaaggctaagtcactgatttttgatagtgactaccagaacaagctcaataaattatatgacgagataaaatcatctcaatttgctgatgaaattattcatactgatttccaaaagcagctctctcaggttataagtgacactgaaaaacttgaaattaccaaggtttatcaaagctttgggaagaaattggttaaaggtgaatcctgtgaagatgctaacaaccagaaaaattaa

SEQ ID NO: 12598 - protein, 154 aa, Unknown
  Obtained from environmental sample
  DOMAIN (1)...(148): Acetohydroxy acid isomeroreductase, catalytic domain
  misc_feature (1)..(154): Xaa is any amino acid
MRKKQVCDLFSEQSLLCSVFPHAAGLSFDTLIAKGHDPKIAYIECWHEVKLIADAMIKHGPSAFLGLISPNAFIGGEKAKSLIFDSDYQNKLNKLYDEIKSSQFADEIIHTDFQKQLSQVISDTEKLEITKVYQSFGKKLVKGESCEDANNQKN

SEQ ID NO: 12599 - DNA, 654 bp, Unknown
  Obtained from environmental sample
  misc_feature (1)..(654): n is a, c, g, or t
ttgcttaatatcaccagtggctattcaacaaaggaatttgattccaggaaagcagccctgctttacaatgatttttttgttaaggaaaagttctatcggaattatcagatgtcggaaaaaggaacccccacccttagaacaatccctgttaaaaaaagcattgccccggaagaaaaaatcctgaagagcgaagaagcccatgaaatgattaataaccttaaccatgaggatctattgcttgttccttgtccatgcagatcccgcatggaagagacaggagatagggaatgccgggaaaaatttcccattggattctgcattatgctgggtgcaagcgccctccattttgagagcattggggtgggaaaaagggttagtaaaaatcaagccattgattattttgacaaaatgcaggacctgggactggtgggaaataccgacaacacggcatcgggtaatgcggtaatttgcctgtgctgcggctgctgctgttcccatctaaggggaagaaccctttggggtacgaaaccgatcctgccttccaactttctccctgcaccagcagatgagtgccgatattgcggcaaatgcgccaaagcctgttttttcggagcaatcaccattgacaaaaaccaacaaacccgttctggttga

SEQ ID NO: 12600 - protein, 217 aa, Unknown
  Obtained from environmental sample
  DOMAIN (184)...(207): 4Fe-4S binding domain
  misc_feature (1)..(217): Xaa is any amino acid
MLNITSGYSTKEFDSRKAALLYNDFFVKEKFYRNYQMSEKGTPTLRTIPVKKSIAPEEKILKSEEAHEMINNLNHEDLLLVPCPCRSRMEETGDRECREKFPIGFCIMLGASALHFESIGVGKRVSKNQAIDYFDKMQDLGLVGNTDNTASGNAVICLCCGCCCSHLRGRTLWGTKPILPSNFLPAPADECRYCGKCAKACFFGAITIDKNQQTRSG

SEQ ID NO: 12601 - DNA, 471 bp, Unknown
  Obtained from environmental sample
  misc_feature (1)..(471): n is a, c, g, or t
atgagagatctggaagttttaatgaatccgaataagatggtaagacatcttcagaagccggcccgtgagtttacaaaatacgacatcattaagtttattggggatcatcatattgaaatgatcaatttcagatatgtgggtgaagatggaaaattgaaaacactcaattttgttattaccagcaaagattatctggagtcaatcttatcaactggagagcgcgttgacggatccagtttgttctcttatatcgatgcccaatccagcgatttgtatgttatacccaggtttccgacagcctttgttaatccttttactgaacagcccacacgggatattctatgctcattttacacgaaggaggggaaacctcttgaaagtgcccctgagtatacccccaaaaaagccaccagggtgtttaccgaacaaaccggctatatcttcaaaccgaggggcgaaatggaaaattaa

SEQ ID NO: 12602 - protein, 156 aa, Unknown
  Obtained from environmental sample
  misc_feature (1)..(156): Xaa is any amino acid
MRDLEVLMNPNKMVRHLQKPAREFTKYDIIKFIGDHHIEMINFRYVGEDGKLKTLNFVITSKDYLESILSTGERVDGSSLFSYIDAQSSDLYVIPRFPTAFVNPFTEQPTRDILCSFYTKEGKPLESAPEYTPKKATRVFTEQTGYIFKPRGEMEN

SEQ ID NO: 12603 - DNA, 621 bp, Unknown
  Obtained from environmental sample
  misc_feature (1)..(621): n is a, c, g, or t
atgaagggtagggtcagacattttgttcgattcaatttggaattgaaaagaactgggagtttacaaaagaaatctccggatttagatacggttttcgatgatagagtgatctgttttaaaaactttgtggatgcaaacatgagtttatctgatgccgacaaagtggaaaaagccactaaaatatgggctaagattcaggctaagaacccttacatgtataagttgggatacgaagagcaaatgactcaggccttatcgcttttttctgatctcgataccgaagcgtaccagggtataatgacgggtttatttggtgttagcgaaagctatgtgctaaccaaaacagcatacaccaatcttcaaagcatgtaccgaaaagggcaggagataaaagctttaaaagagaatgtaattccttcgaacgtattaagaaaagaagtagtagaagttattaataccaagctgattccttacttgtatataatgagcgacacgcagcctgaactttatggagaaacctacaccaaaattattcattatatagagctggttaatacaaaaataagaacacgaagaagccgcgctgctaacgaagaagaagtagttagcgaagtggaataa

SEQ ID NO: 12604 - protein, 206 aa, Unknown
  Obtained from environmental sample
  misc_feature (1)..(206): Xaa is any amino acid
MKGRVRHFVRFNLELKRTGSLQKKSPDLDTVFDDRVICFKNFVDANMSLSDADKVEKATKIWAKIQAKNPYMYKLGYEEQMTQALSLFSDLDTEAYQGIMTGLFGVSESYVLTKTAYTNLQSMYRKGQEIKALKENVIPSNVLRKEVVEVINTKLIPYLYIMSDTQPELYGETYTKIIHYIELVNTKIRTRRSRAANEEEVVSEVE

SEQ ID NO: 12605 - DNA, 342 bp, Unknown
  Obtained from environmental sample
  misc_feature (1)..(342): n is a, c, g, or t
ttggttattaagagaagaattttgatgggtattattggggggagttgttatggcggatgttaccttaggctaaaagatttgaaaaacttgggagcggactatgttgcttttggttcattttacgctagccctacaaaacctgattcaaatatagttccactggaaactttaaaaatagcaaaagataaacttaatatccctatatgtgcaattggtggaataaatagtaaaaatatagatgagataataaagtttcaacctcatatggtaagtgtgataagtgatatttggaatagtgataatattacagaacaatcaaagatatataaagataaattttaa

SEQ ID NO: 12606 - protein, 113 aa, Unknown
  Obtained from environmental sample
  misc_feature (1)..(113): Xaa is any amino acid
MVIKRRILMGIIGGSCYGGCYLRLKDLKNLGADYVAFGSFYASPTKPDSNIVPLETLKIAKDKLNIPICAIGGINSKNIDEIIKFQPHMVSVISDIWNSDNITEQSKIYKDKF

SEQ ID NO: 12607 - DNA, 366 bp, Unknown
  Obtained from environmental sample
  misc_feature (1)..(366): n is a, c, g, or t
atggtagattattattatacaaatgcaataatgggggaacgaccaaaagttgtaaatccaaataaagaatttttagagcagttaacagcagatggatttcaaaaaatggtagatgctttttatgagatagtagtggagagtgatatagcccattattttcctgatgatgcagaggaattggcacttataaaaaaaagaaatggttcttattttataatgatatgtggaggagatgagagatatatttcaaaatatggtggtgactttgatcaaatcaaaacacatgagatgttctcaatcccaaacaaagcaagaatcgaatggctaggttgttgggaaggaggttttaagaccaatagaagataa

SEQ ID NO: 12608 - protein, 121 aa, Unknown
  Obtained from environmental sample
  misc_feature (1)..(121): Xaa is any amino acid
MVDYYYTNAIMGERPKVVNPNKEFLEQLTADGFQKMVDAFYEIVVESDIAHYFPDDAEELALIKKRNGSYFIMICGGDERYISKYGGDFDQIKTHEMFSIPNKARIEWLGCWEGGFKTNRR

SEQ ID NO: 12609 - DNA, 486 bp, Unknown
  Obtained from environmental sample
  misc_feature (1)..(486): n is a, c, g, or t
ttgatattagctttttttgagaatcaaaaattgctacaaagttacgatacgttcaagtcaagatttaatacaatcattgaggataaacaagatttattaaaagaggaacaatttcatccagatacagaaggagagctaaagatagttcatgacttttctaatcatttaaatgcatttcctgaattctctcttggcaatcaaataaatgatgagatattaaaagttcatagtattttaaagaatactaatcatatacttaaaaaactaaatattaaggttgatggtgaagctgatatttataaagctgttaaatggattattgatttgtattttcctaaaactcgtttaaaaaataaagcttcctttatacaagaatttaaaacgtatcaccctaacattttgatacctgaactaaaaactgccatagaatataaatatattaaaacggaagatgatgaaagcaaaattggaaacttatatcgatga

SEQ ID NO: 12610 - protein, 161 aa, Unknown
  Obtained from environmental sample
  misc_feature (1)..(161): Xaa is any amino acid
MILAFFENQKLLQSYDTFKSRFNTIIEDKQDLLKEEQFHPDTEGELKIVHDFSNHLNAFPEFSLGNQINDEILKVHSILKNTNHILKKLNIKVDGEADIYKAVKWIIDLYFPKTRLKNKASFIQEFKTYHPNILIPELKTAIEYKYIKTEDDESKIGNLYR

SEQ ID NO: 12611 - DNA, 588 bp, Unknown
  Obtained from environmental sample
  misc_feature (1)..(588): n is a, c, g, or t
ttgtgtgaagaactattaacccggaagaaacaattatttgctagaatgatatctgatgaatactattttatgaatctattaggaagattattacaagatgaaaagaataatggtgaagttactgcatttgataaaagtcgcacctttggagataaagagttagattgtaaatctagagatgctctaacactatttttgtttgaagagagttataaagagtatgaacttatccttttatattcttattttcaaaattatacacaagatattttacaatataatatatatcaagatatgatagatgaatctcaatttcatcttaagagttttggaaacatgatggctaaaatgggaatacttgcaattccgagaacagttatagaacaactttatatcaataaagatattaagcagttcttgattgatggtgttgatgaagagattaaggcaaaagaggagtgtgcaaatcttgctgctgctattaaagatgaagagataagtaagtttttaacttgtgttatgtatcaagaagattatcatatagtattgatgaaaaaagctattaaaaaaatagaacttactaaatag

SEQ ID NO: 12612 - protein, 195 aa, Unknown
  Obtained from environmental sample
  misc_feature (1)..(195): Xaa is any amino acid
MCEELLTRKKQLFARMISDEYYFMNLLGRLLQDEKNNGEVTAFDKSRTFGDKELDCKSRDALTLFLFEESYKEYELILLYSYFQNYTQDILQYNIYQDMIDESQFHLKSFGNMMAKMGILAIPRTVIEQLYINKDIKQFLIDGVDEEIKAKEECANLAAAIKDEEISKFLTCVMYQEDYHIVLMKKAIKKIELTK

SEQ ID NO: 12613 - DNA, 585 bp, Unknown
  Obtained from environmental sample
  misc_feature (1)..(585): n is a, c, g, or t
ttgtcaggattcggctcgaggcacattaaaatggggaactacatgaaagccattaaacaaactatccctaaaattattgaagggctacaacattttgatggtaaaataaacaaagaagaagaaatgttattttattacaatatttctagggtttacttctttactgatgatttaaaaagtgcgttgaaatacattaatttggtattaaatgaaaataaacccggactaagagatgatgtatatacttttgctaggttagtaaacctcattattcattttgagctaaataacattgatttactagaatataacataaaatctaccaaacgttttcttacggttaataaaagagattttaagctagaaactgttttcttaaacgaaatgagaaaattggtaaaggcaaaaaatgaggaaaaacaaaaagaacaattcattacttttaaagaaaacttaatgaaagtttttgaagatccatatgaaaaaatagctctagattattttgatttcatattatggttagatagcaaaataaccaaccaatcttttgcgaaattggctatagaaaaaagtgaatcgaaatag

SEQ ID NO: 12614 - protein, 194 aa, Unknown
  Obtained from environmental sample
  misc_feature (1)..(194): Xaa is any amino acid
MSGFGSRHIKMGNYMKAIKQTIPKIIEGLQHFDGKINKEEEMLFYYNISRVYFFTDDLKSALKYINLVLNENKPGLRDDVYTFARLVNLIIHFELNNIDLLEYNIKSTKRFLTVNKRDFKLETVFLNEMRKLVKAKNEEKQKEQFITFKENLMKVFEDPYEKIALDYFDFILWLDSKITNQSFAKLAIEKSESK

SEQ ID NO: 12615 - DNA, 660 bp, Unknown
  Obtained from environmental sample
  misc_feature (1)..(660): n is a, c, g, or t
atgagatatttattttttataataatctcgttttcatatctttgggcgaacgctcacatttttgtttaccatagatttgtagatgatagatacccaagtgcaaatacctcaaaagaggaattgattaaacaatttgagtattttaaacaaaataattaccaagtagttcctttagaaaaaattgtcgaaaaattgaaaaaaaatgaagatataccatcaaaatgggttgctctaactattgatgatgcttacaaaagcttttatgaacatggtttagaaattttcaaacaatacaattatccatttagtttgtatgtttatgtggaagcaacaaataaacattatggggattatatgagttgggagcaaattaaagaagcttcaaaatatggttctattgggttacactcttattctcacccaagattgcaaaacctcagtgaagaagagatattagaagatacaaaaaaagcatacagtacttttgtaaaaaaacttgatattaagccaatttcatatgcgtatccttatggtgaatataacgaaaaagttactaaaactttacgaaataattttaactttgacgcaatatttaatcaaaataccggttcagtaaataaaaatactgatcgttttgatatccctagaattgccctgtag

SEQ ID NO: 12616 - protein, 219 aa, Unknown
  Obtained from environmental sample
  DOMAIN (69)...(197): Polysaccharide deacetylase
  misc_feature (1)..(219): Xaa is any amino acid
MRYLFFIIISFSYLWANAHIFVYHRFVDDRYPSANTSKEELIKQFEYFKQNNYQVVPLEKIVEKLKKNEDIPSKWVALTIDDAYKSFYEHGLEIFKQYNYPFSLYVYVEATNKHYGDYMSWEQIKEASKYGSIGLHSYSHPRLQNLSEEEILEDTKKAYSTFVKKLDIKPISYAYPYGEYNEKVTKTLRNNFNFDAIFNQNTGSVNKNTDRFDIPRIAL

SEQ ID NO: 12617 - DNA, 750 bp, Unknown
  Obtained from environmental sample
  misc_feature (1)..(750): n is a, c, g, or t
atgcaattcgaacaacctataactaagaatttagatagaaaaaacattaaggttattgtcgttggtggtggatggtctggactttcaattgcaaaaaatttaaaagcattttcacccactactgatgttatcttagtggagcaaaaggatcaatttgtctcatgtcctatgagcaacttatggctcgttgatagagtagatttagaatttctaacccatgattatctccaagctgcaagaaataataattatactttttttcaagcaactgcaactggtatggataagagtaaaaaaatattatttacaactaatggtaatcttcattacgactatattgttttcgctccaggaattgattatgattattcttttataacagacaatcctgaattagaaaagagattacgacaggaatatcctgctggatttaaacctggaagtgagcatctcactttaaaaaagaagattcatgactttaaaggtggtaattttatcatgaccgttcctgcaggtaactacagatgtctccctgcaccttatgaaagagcttgtttagttgcagatttcttcaaatcaaagaaattggatgctaaagtattattacttgatgaaaataatgatatcacaataaaagagcatggttttcacaccgcatttgatgaactctattcagattatttagaataccatccaaattctacaatagaaaatattgatttagatgagaaaatagtgaaacagaattaa

SEQ ID NO: 12618 - protein, 249 aa, Unknown
  Obtained from environmental sample
  misc_feature (1)..(249): Xaa is any amino acid
MQFEQPITKNLDRKNIKVIVVGGGWSGLSIAKNLKAFSPTTDVILVEQKDQFVSCPMSNLWLVDRVDLEFLTHDYLQAARNNNYTFFQATATGMDKSKKILFTTNGNLHYDYIVFAPGIDYDYSFITDNPELEKRLRQEYPAGFKPGSEHLTLKKKIHDFKGGNFIMTVPAGNYRCLPAPYERACLVADFFKSKKLDAKVLLLDENNDITIKEHGFHTAFDELYSDYLEYHPNSTIENIDLDEKIVKQN

SEQ ID NO: 12619 - DNA, 723 bp, Unknown
  Obtained from environmental sample
  misc_feature (1)..(723): n is a, c, g, or t
atggaaaagaaatggatttatttattagcagtattgatatcgttttcatttataagtgataaacctgcttaccaactatttaatgaaaaaggtaaaaaaaccaactataaaaagcttttaaaagctactgaagaagctgatattattcttttcggagaattacataataatccaattaatcactggcttcaattagaattaactaaagatgttcatcagcaaattaaccaagatattgttctaggagcagaaatgtttgaagcagatgaccaaatgattattaatgaatacttgtctggtaagtatgattataaaacttttgctaaagaaatgaaactttggccaaataacaagactgattatcagccattaatggactatgccttaaaatatcaattgagttttattgccaccaatattcctagaagatatgccaatatggtttataaagatggttttggaccattaaatagcctaacagataagggaagacagtttattgccccactaccaattgcttatgataaagatttgccgggttaccaaaaaatggtagaaatggcaggaggacacggaggtgaaaatttaccaaaagctcaagccataaaagatgcgactatggctcattttattttaaaaaattggaaaaaaggtcaaacatttattcattataatggtacttatcactctaataattttgaggggaataagttnggtatttaa

SEQ ID NO: 12620 - protein, 240 aa, Unknown
  Obtained from environmental sample
  DOMAIN (6)...(228): Protein of unknown function, DUF399
  misc_feature (1)..(240): Xaa is any amino acid
MEKKWIYLLAVLISFSFISDKPAYQLFNEKGKKTNYKKLLKATEEADIILFGELHNNPINHWLQLELTKDVHQQINQDIVLGAEMFEADDQMIINEYLSGKYDYKTFAKEMKLWPNNKTDYQPLMDYALKYQLSFIATNIPRRYANMVYKDGFGPLNSLTDKGRQFIAPLPIAYDKDLPGYQKMVEMAGGHGGENLPKAQAIKDATMAHFILKNWKKGQTFIHYNGTYHSNNFEGNKXGI

SEQ ID NO: 12621 - DNA, 324 bp, Unknown
  Obtained from environmental sample
  misc_feature (1)..(324): n is a, c, g, or t
atgttcatgaccgagccaaatgcattaaggactgaatatgaaatgggtcatacatttatccaaatcccgtggttattttttgtaaagaaatatgaatgtgaaacagtttatcattatattcaggtacaattatttggacatattaatagtttaattcgtaattataaagaaaaatttaaagatcatgaagataaaattgatatgatctttaaagaggttattgatgagacagaaaatgaatatttccagaaagatgcatttcaacttataatcaataatttagaatctatatataaaaaattaggggtttccaaatttcaatag

SEQ ID NO: 12622 - protein, 107 aa, Unknown
  Obtained from environmental sample
  misc_feature (1)..(107): Xaa is any amino acid
MFMTEPNALRTEYEMGHTFIQIPWLFFVKKYECETVYHYIQVQLFGHINSLIRNYKEKFKDHEDKIDMIFKEVIDETENEYFQKDAFQLIINNLESIYKKLGVSKFQ

SEQ ID NO: 12623 - DNA, 609 bp, Unknown
  Obtained from environmental sample
  misc_feature (1)..(609): n is a, c, g, or t
atgacatataaagatcattacaattttcttatgaaaatagaaaacattgaaacaaaaattttcaaactaatggaagagcaggaaatactaaaacaatttaaaataaaaagtataattcaaaaggaaaatgacggttttaaatatcttcttgctaaaactgaatatgatcaggatttaggttttgaatatgcagcagtctatataagttgtcttatggatctctcgtctcttagttctgaaattgaagaattttattttccttttatatgtgttcctgaaaataatccgtctagagcttcggaatattatgatgaaaagatattaattgctcatgaattatgccatattaaagatttattggagtatgttgaattacaccctgaatattattcaaatgtgcaaaaatatggattcggtaatgtcagtgatttttcagatataaaaaatagtataaaatttgagatagataaaatgctcatgaccgagccaaatgcattaaggactgaatatganatgggtcatacatttattccaatcccgttgttattttttgtaaagaaatatgaatgtgaaacagtttatcattatattcaggtacaatttatttga

SEQ ID NO: 12624 - protein, 202 aa, Unknown
  Obtained from environmental sample
  misc_feature (1)..(202): Xaa is any amino acid
MTYKDHYNFLMKIENIETKIFKLMEEQEILKQFKIKSIIQKENDGFKYLLAKTEYDQDLGFEYAAVYISCLMDLSSLSSEIEEFYFPFICVPENNPSRASEYYDEKILIAHELCHIKDLLEYVELHPEYYSNVQKYGFGNVSDFSDIKNSIKFEIDKMLMTEPNALRTEYXMGHTFIPIPLLFFVKKYECETVYHYIQVQFI

SEQ ID NO: 12625 - DNA, 792 bp, Unknown
  Obtained from environmental sample
  misc_feature (1)..(792): n is a, c, g, or t
ttgattttatcacttttgatgacaaatattttatttgcaaatacacaagaggtgaatatatactcacatcgacactacgatactgataagcaactttacaaaatgtttgagaaaaaaacaggtattaaagtaaatattgtaaaagcaacagcaaatgaacttatcaaaagacttgaaagtgaagggaaaaattcaccagctgatatactaatcacatctgatgtagcccgactttatttagctcaaagtaaaggtttactgcaaaaagtagattctaaaatattagaaaagattgtaccaaaaaacttacgacacaaagatggatattggtttgctttaacaaaaagagcaagagttattgtttataatattgataatgtagacccctcaactattacaacttacgatagccttactaagcctgaatttaaaggtaaggtattgatgagaaattcaagtaatatatacaatcaatctctcttagcttccatgattgcaaacttcgggaaagaaaaagcaaaacaatgggcacaaggtatggttgataattttgcacgaaatccaagaggaaatgatatagaccaaatgaaagctgtagctgctggtttgggtgatgtggctgttgtgaatacttattatttagggaaactattaagttcaagaaaatttagtgaagttgccgttgggaaaaagatgggtatagtttttccaaatcaaaaaacgaatggaacacatgtaaatatttcaggtgcaggggttgtaaaatatagtcaaaacaaaaaaatgctgtaa

SEQ ID NO: 12626 - protein, 263 aa, Unknown
  Obtained from environmental sample
  misc_feature (1)..(263): Xaa is any amino acid
MILSLLMTNILFANTQEVNIYSHRHYDTDKQLYKMFEKKTGIKVNIVKATANELIKRLESEGKNSPADILITSDVARLYLAQSKGLLQKVDSKILEKIVPKNLRHKDGYWFALTKRARVIVYNIDNVDPSTITTYDSLTKPEFKGKVLMRNSSNIYNQSLLASMIANFGKEKAKQWAQGMVDNFARNPRGNDIDQMKAVAAGLGDVAVVNTYYLGKLLSSRKFSEVAVGKKMGIVFPNQKTNGTHVNISGAGVVKYSQNKKML

SEQ ID NO: 12627 - DNA, 312 bp, Unknown
  Obtained from environmental sample
  misc_feature (1)..(312): n is a, c, g, or t
atgacattaaaccaacttccaaagaatataacattatatctttatggtagtggatatatgggtgaaacttattttcaattaatacaaatattaagagatgatattcaagttaagtttatcgatgataatgataacaatgaggatgctattaattttcatacatttcatgatttagaaaaaaacaacttttttattgttaactgtataatcactgcaaatgtaaaagaatctattaatatcaaattaatcaataatgggtataaggactatttaattgaaaataagggaattgatggtttttttaaaaagtga

SEQ ID NO: 12628 - protein, 103 aa, Unknown
  Obtained from environmental sample
  misc_feature (1)..(103): Xaa is any amino acid
MTLNQLPKNITLYLYGSGYMGETYFQLIQILRDDIQVKFIDDNDNNEDAINFHTFHDLEKNNFFIVNCIITANVKESINIKLINNGYKDYLIENKGIDGFFKK

SEQ ID NO: 12629 - DNA, 681 bp, Unknown
  Obtained from environmental sample
  misc_feature (1)..(681): n is a, c, g, or t
atggggcttgcaagttatggaaaacctatatataaagataagatttatgaacttttaatgatagaaaatgatgacttttttatcaaagatggcttttttgactttaattctgtggatacactttatacaagtaaatttatagaaaagtttggaacagaaaaaatcggtagtgattatgatctcaacactgataaatattatgtagatatagcttcttcaatacaaagtgttactgaagacttagtactaatgtatatcaaaaaagctatagaaatgagtggtattaataacgtttgcttatgtggtggggttgctttaaactcagttgcaaatgaaaaagtaaaacaacagtataaaaatataaacttatttgttccacctgatccaggtgatggaggttcttctttattttgtgctttatattatgctaaatatataaaaaaagtgtcaacaaaatataaactagaaagtccatttttaggtaaacgatattctttagaagcattaaaaaaagatattgacaacaattttaccggtgaatttatacaaatagatgataaagaaaaattctttgactatgtttctgatttattaatagacaataatgtaattggttggttttatggtgagtttgagtggggtccaagagctttggacatagaagtctcgagccgattctga

SEQ ID NO: 12630 - protein, 226 aa, Unknown
  Obtained from environmental sample
  DOMAIN (1)...(226): Carbamoyltransferase
  misc_feature (1)..(226): Xaa is any amino acid
MGLASYGKPIYKDKIYELLMIENDDFFIKDGFFDFNSVDTLYTSKFIEKFGTEKIGSDYDLNTDKYYVDIASSIQSVTEDLVLMYIKKAIEMSGINNVCLCGGVALNSVANEKVKQQYKNINLFVPPDPGDGGSSLFCALYYAKYIKKVSTKYKLESPFLGKRYSLEALKKDIDNNFTGEFIQIDDKEKFFDYVSDLLIDNNVIGWFYGEFEWGPRALDIEVSSRF

SEQ ID NO: 12631 - DNA, 693 bp, Unknown
  Obtained from environmental sample
  misc_feature (1)..(693): n is a, c, g, or t
gtggtattattagtaaagccagaaggtggagagatcgtaagaaccaaaagatatgaagccgatgaaagtgtacaaaacactattgccaatattattatggatgacacaggaggctttacagcagatgtgaatgttaaaactacaggttttcaatacagtctccatgagggtattgaaaataaaacagaacgcgaccagcataattattacaaaaactactgggacaatattaacaatattaccattgaaaatatagatattgttaatgataaagacacagttatacttagcgaaaatgtaaaattatcggcaactaattacgcttcaaaaagtggagatagactcatttttcaacctaatatgtttaatcgtgtaactacaattccttcaagatatattgatcgtaaattagaatttaaaatagaccgttccttcaaagataccgatgagtttatcatacaattacctcaaggtttaaaggttgaagctatgacggatgctaaagaaattaaatcgcaatttggtacctatagttttaagatagaaaccttagagaataataagttaaaatacactcgcacgtatatattgcttaagggtaactacccaaaggaagattataaagcatttagagactttagaaagcaaattgtaaagaacgataagagtaaaattgtattaattaaagcctaa

SEQ ID NO: 12632 - protein, 230 aa, Unknown
  Obtained from environmental sample
  misc_feature (1)..(230): Xaa is any amino acid
MVLLVKPEGGEIVRTKRYEADESVQNTIANIIMDDTGGFTADVNVKTTGFQYSLHEGIENKTERDQHNYYKNYWDNINNITIENIDIVNDKDTVILSENVKLSATNYASKSGDRLIFQPNMFNRVTTIPSRYIDRKLEFKIDRSFKDTDEFIIQLPQGLKVEAMTDAKEIKSQFGTYSFKIETLENNKLKYTRTYILLKGNYPKEDYKAFRDFRKQIVKNDKSKIVLIKA

SEQ ID NO: 12633 - DNA, 912 bp, Unknown
  Obtained from environmental sample
  misc_feature (1)..(912): n is a, c, g, or t
atgttggggcttatcgatcctgaatctatctcaaacatctttagtgccatttttgcaaaagatacggctcgtgtcatgggttatgtaaaagagttggaagattatgaagctgagatggtggtagatgagtttatcgcttttttaagagagagactttatgagaatgatcctagattttccaccattattttagatagattttttagaatcgtcagtgaatctaagatgctttttgccattaatgctgatggctcatttgtactctcactcatattttttaagatgatcgaggctctgaaaatcaaagagatagatcagatgatagagtcgctagaggctcaaatagagcgtccaaaatcgatcaaactcccttcacaaaacactcaaatagatcctaaaaaagaggaagtagcagagcaaaagagtgaagctgttacacaaaacatacatgcagaacctactcctgagccgatagctgaagtagtagtgccggttgatccaaattttgagaagtttgaagagctacaagttatgataagtgatagaaatgcagatcttggtgagtgttttaaaaagagtgtagagtatctatcttttgaaaacggtgttttgatgtgggagagttgtgcaaatgagagttgtaaaaacactcttaaacacggctacagtgtaatcagacaatttgtaagagagctttacggttttgagaccccaataaaacatcaagcctgcacaaaagagattgccccaatcgacgaaaaaaaaagtggtgtaacaaagccagagagtcaatcgggctcacccatagaagatataaaaactggtggtggaaagttgtgctcggccgttgtaaaagaaaaagaaaaatgcccccgcccgaaattaaacgggaaacggacctttttaaaatga

SEQ ID NO: 12634 - protein, 303 aa, Unknown
  Obtained from environmental sample
  misc_feature (1)..(303): Xaa is any amino acid
MLGLIDPESISNIFSAIFAKDTARVMGYVKELEDYEAEMVVDEFIAFLRERLYENDPRFSTIILDRFFRIVSESKMLFAINADGSFVLSLIFFKMIEALKIKEIDQMIESLEAQIERPKSIKLPSQNTQIDPKKEEVAEQKSEAVTQNIHAEPTPEPIAEVVVPVDPNFEKFEELQVMISDRNADLGECFKKSVEYLSFENGVLMWESCANESCKNTLKHGYSVIRQFVRELYGFETPIKHQACTKEIAPIDEKKSGVTKPESQSGSPIEDIKTGGGKLCSAVVKEKEKCPRPKLNGKRTFLK

SEQ ID NO: 12635 - DNA, 720 bp, Unknown
  Obtained from environmental sample
  misc_feature (1)..(720): n is a, c, g, or t
gtggaatttgtaagtatagagggtttttcggactggttttatcaactggtgaaacaagtgatacatcttcatggactagggatttgtctcaatgacatcaagcccgataatatcattatcagaaagggaaaaccttatctgatagattttggtttggcgactcctaacaactataatgacggcatatttcggggcagcgtggcttattccagtcccgaaaaatatctatttaagagctgtaactttcgtggagatatatttgccctgggcattgtgttcataacactggtgaaaaaacagcatccatctgaggaattaaaagatgagaactggcaggacgtattggcagatgaaaagcggtggaacaggtggctcaaagattatggaataacttcagatatggaaggaatgctttcatggtcggcagataagcgttttgatgatctggaaatgggaaaacttgccgcatcatctgcaaaacaggaagtgacaccagaaatgtcgttgatggaaaattacaagttccgttttcagaaaaaggctgccaaggatatctggacaaagaagcgattagtagtacatcctgatgatgaaccggagcgcatcgcggaatttgctcatttgggtcgggaagcccaaggtgaaagggtgatcctgataaatgaaaaagacctggattccggaagcggatgccctgttagacagattacacccatttga

SEQ ID NO: 12636 - protein, 239 aa, Unknown
  Obtained from environmental sample
  misc_feature (1)..(239): Xaa is any amino acid
MEFVSIEGFSDWFYQLVKQVIHLHGLGICLNDIKPDNIIIRKGKPYLIDFGLATPNNYNDGIFRGSVAYSSPEKYLFKSCNFRGDIFALGIVFITLVKKQHPSEELKDENWQDVLADEKRWNRWLKDYGITSDMEGMLSWSADKRFDDLEMGKLAASSAKQEVTPEMSLMENYKFRFQKKAAKDIWTKKRLVVHPDDEPERIAEFAHLGREAQGERVILINEKDLDSGSGCPVRQITPI

SEQ ID NO: 12637 - DNA, 723 bp, Unknown
  Obtained from environmental sample
  misc_feature (1)..(723): n is a, c, g, or t
atgttacgagatgaaggtgctatgatgatgatagcatcaacagaagtttcatcaaaagaggaactaaaatcaaaacttgaacaaagtccaagaattgaagatataaattatatagagcaggtaagtacacaagaatcatatattcataaatatggtgcatggaatatggatacaatgtcatataataaagcaatgatgagtgataaaaaagtagtagttatagattttggtgtaaagcgaaatattttaaacgaactagtagaatcaggactagaagttgaagttgtaccaagtgattttaatgcagatgatttaattcaaagatttgagaataaagagataggtggagtttttttaagtaatggaccaggtgatccacttacactaacaaaagaaaaagctcaggtgcaaaaactaatagataaagatatcccaatgtttgctatatgtttaggacatcaaatgttaagtatagcacatggacatgacacatataagttaccatttggacaacatggtggtaaccacccagttcaaaatagtactagtgtagttgagataactgcccaaaatcataactataatgtacccacaagtataaaagagattgcagatgtaacacatataaatctttttgataatacaattgagggtgtaaagtataaaaataaaccaatattttcagtacaacatcccccccaaagcaagtctggccccacatga

SEQ ID NO: 12638 - protein, 240 aa, Unknown
  Obtained from environmental sample
  DOMAIN (72)...(240): Glutamine amidotransferase class-I
  misc_feature (1)..(240): Xaa is any amino acid
MLRDEGAMMMIASTEVSSKEELKSKLEQSPRIEDINYIEQVSTQESYIHKYGAWNMDTMSYNKAMMSDKKVVVIDFGVKRNILNELVESGLEVEVVPSDFNADDLIQRFENKEIGGVFLSNGPGDPLTLTKEKAQVQKLIDKDIPMFAICLGHQMLSIAHGHDTYKLPFGQHGGNHPVQNSTSVVEITAQNHNYNVPTSIKEIADVTHINLFDNTIEGVKYKNKPIFSVQHPPQSKSGPT

SEQ ID NO: 12639 - DNA, 654 bp, Unknown
  Obtained from environmental sample
  misc_feature (1)..(654): n is a, c, g, or t
atggcattagagatggagttaaaagagaaagaatttttgctgttagaacagtcaaaattagcacaaatgggtgagatgttaaatatgatagctcatcaatggagacaacctttaaatacaatatctgcttctgctatgaacctatcttttcaaaatgaacttgatatgcttgataaaaatagtatagaagagacaagtgcttttattcaaaatgagacacaacggatgtctggaatcattaatgattttatggagtttaataaaacagaatcaaacaaagagttttttatatataaggctactgatgaggttcgtaaaatgatctctcctcaacttaaaaacagatctatactgttagagattgatattgataaaaggttaaaagtttttcataatatgaaaagcattgagcatgtgttattaaatattataaataatgccagagatgcttttgaaggtaaaaaatatataactaataaaaaaataagtattttcacaacagctgatgaaaaatcgataactctaaatatagaagataatgctggaggaatatcgaaaaatattatgaacaaaatatttaatccgtactttactacaaaagagcagggtaagggtactggaaataggtttatatatgtcaaaacagatggttga

SEQ ID NO: 12640 - protein, 217 aa, Unknown
  Obtained from environmental sample
  DOMAIN (131)...(217): Histidine kinase-, DNA gyrase B-, and HSP90-like ATPase
  misc_feature (1)..(217): Xaa is any amino acid
MALEMELKEKEFLLLEQSKLAQMGEMLNMIAHQWRQPLNTISASAMNLSFQNELDMLDKNSIEETSAFIQNETQRMSGIINDFMEFNKTESNKEFFIYKATDEVRKMISPQLKNRSILLEIDIDKRLKVFHNMKSIEHVLLNIINNARDAFEGKKYITNKKISIFTTADEKSITLNIEDNAGGISKNIMNKIFNPYFTTKEQGKGTGNRFIYVKTDG

SEQ ID NO: 12641 - DNA, 699 bp, Unknown
  Obtained from environmental sample
  misc_feature (1)..(699): n is a, c, g, or t
ttgccattttatcaacctatttatgatcttgaaagttctaaaatatttgcatatgaagttttagccagaataaaatataaagatagatttatacctccttcattttttatagacctcagtaaaaaagccggaattttaaacaagttgtctaaaatactatttgaaaaaagttttttagtttttataaataataattacagtattactatcaatattgatgaatctttatgggatgatgatgcttttgaagagtatttgatatacatatgtaagcataataaaatttcaaatgacagagtaatcataaatataaataattatggaaatttttctgctactagcgagatagcaaaacggttaaaaatattaaaatcatttggatttaaaattgctattacaaatttaaataataaaagtatagatatagaactatttagtattttaaagcccgatatatttagggtagataaaattcttctagatagatcactgatagatgaagattataaaaatcttttgaaatctgtagtatcttttattaactcactaaatttgacaacaatcgctgtaggagttgagagtaaagatgtttttgaactttcaaaagagattaattttaatatgattcagggctactatgtaaaagagccaattagtaatctgctaagtgaggaagagataaactcgttgaatatttag

SEQ ID NO: 12642 - protein, 232 aa, Unknown
  Obtained from environmental sample
  DOMAIN (2)...(217): EAL domain
  misc_feature (1)..(232): Xaa is any amino acid
MPFYQPIYDLESSKIFAYEVLARIKYKDRFIPPSFFIDLSKKAGILNKLSKILFEKSFLVFINNNYSITINIDESLWDDDAFEEYLIYICKHNKISNDRVIININNYGNFSATSEIAKRLKILKSFGFKIAITNLNNKSIDIELFSILKPDIFRVDKILLDRSLIDEDYKNLLKSVVSFINSLNLTTIAVGVESKDVFELSKEINFNMIQGYYVKEPISNLLSEEEINSLNI

SEQ ID NO: 12643 - DNA, 861 bp, Unknown
  Obtained from environmental sample
  misc_feature (1)..(861): n is a, c, g, or t
atgttttttaaagaaaaaatgcaaaaccccaaaataaccaaaatatttaaaaggaatttttttccggatggaatctccccctggataaaaaaaaacaattttaatgagcatgtatttatttcaccaatacaaaaggttgattggataagaaaaaataataatcctctatatgatagtttagtaaataaaattgatttagtaatttttgatgagggacattatgagcctgcgttctcttggagtcaaactattagagggtttaaatcaaaaaaacttctttttacagcaaccccatttagaaatgatttgaaaccatttgatatttctgaagaatatatctatccatatagatatatagacggcgtaaaggataaatatcttcgaaaagttgaatttaagtcggaaccaaaggaaaaagatgacgattcttttttaaaaaaaatatttacatattataaattcaaatttggttcatttacaaaaaaatcgcctaagttaattattagatgctctcagagatctacaatcattagattaacaaataagataaaaaaagagtataaatcgattgaagttttatcaattcatgagaattttaaatcatccaaaaagccatatttaaaaagtgctgttcccaaaacacccactactcacactgctaaagtatggatccatcaaaataaattattagaaggtatagatgataaccaatttaaaatgcttgctatttatgatgatttcaaaaatgacagagcacttatccagcaaattggaagattagttagagttgcggaaacaaatgaaaactttaaggcttatgtaatcgatttagcaatggacgtcagaaagttagaactctga

SEQ ID NO: 12644 - protein, 286 aa, Unknown
  Obtained from environmental sample
  misc_feature (1)..(286): Xaa is any amino acid
MFFKEKMQNPKITKIFKRNFFPDGISPWIKKNNFNEHVFISPIQKVDWIRKNNNPLYDSLVNKIDLVIFDEGHYEPAFSWSQTIRGFKSKKLLFTATPFRNDLKPFDISEEYIYPYRYIDGVKDKYLRKVEFKSEPKEKDDDSFLKKIFTYYKFKFGSFTKKSPKLIIRCSQRSTIIRLTNKIKKEYKSIEVLSIHENFKSSKKPYLKSAVPKTPTTHTAKVWIHQNKLLEGIDDNQFKMLAIYDDFKNDRALIQQIGRLVRVAETNENFKAYVIDLAMDVRKLEL

SEQ ID NO: 12645 - DNA, 354 bp, Unknown
  Obtained from environmental sample
  misc_feature (1)..(354): n is a, c, g, or t
ttgtttnttcacccatggatcagaattcggctgaggatttctaatatagattcaattagtaaaagtcatgacctcgaatataaagctgacctttttgcctttgaaaatttatttggtgatataaaagaggatattcaaaagtggtcaactttttattctatctattacttctttatatggctaaacctaattgaatataaaaatggtaaagaactttctaaaattcatccatcacctttagatagagcaaacagattaaaaaatgaaatgataaagattactaaggatgatttaggatttttagatttattagatgaattagataaaaaaattcaaacttatgtggagagttaa

SEQ ID NO: 12646 - protein, 117 aa, Unknown
  Obtained from environmental sample
  misc_feature (1)..(117): Xaa is any amino acid
MFXHPWIRIRLRISNIDSISKSHDLEYKADLFAFENLFGDIKEDIQKWSTFYSIYYFFIWLNLIEYKNGKELSKIHPSPLDRANRLKNEMIKITKDDLGFLDLLDELDKKIQTYVES

SEQ ID NO: 12647 - DNA, 375 bp, Unknown
  Obtained from environmental sample
  misc_feature (1)..(375): n is a, c, g, or t
atgtggagagttaatatgtatacaaagatttttaaagatataacaattatcacagaagaggctgattttttggaaaatttatttgactctataccaaaggaagaagaaagtattttattgaaaaataacatagatgttaaatatttatttaaaaatgaatctgatgaaaaagcatttggtaaaaaagatttagttattggtttatcaataggattattaagtggagtaccagcaggtataattgcaaatacaatttatgataaattgatgaataatgggaagaataaattaattgtaaaaaaagataaggttactattattgatgagaaagacttattaatttatattagagaaacagtattaaaagaaaaataa

SEQ ID NO: 12648 - protein, 124 aa, Unknown
  Obtained from environmental sample
  misc_feature (1)..(124): Xaa is any amino acid
MWRVNMYTKIFKDITIITEEADFLENLFDSIPKEEESILLKNNIDVKYLFKNESDEKAFGKKDLVIGLSIGLLSGVPAGIIANTIYDKLMNNGKNKLIVKKDKVTIIDEKDLLIYIRETVLKEK

SEQ ID NO: 12649 - DNA, 444 bp, Unknown
  Obtained from environmental sample
  misc_feature (1)..(444): n is a, c, g, or t
atgataaacaaatcgacactctttattgtaaatgatattgataaatctagcgaagatataagtagtagtttacctaaacactctgttagagttataagaaacgagactgaggggaaaaatgagtttttaatagatgaagcaaaaaaagctatcaaagaagcatatatcgctacaagtgaaacaaagtatatacttctttgtggtaattcttttggaatacccgctcaaaattcacttttaaaagtacttgaagaaccacctaaaaatattatttttataattataactatctcaaaaagttcaattctccctacaattttatcccgagtagaggtaaagtatcaaaaaactaaaaaaactgtacaagagttttctcttgatttaaagaggcttgaacttaaagatttatataaatatctcaaaagaacctcaacgaatccataa

SEQ ID NO: 12650 - protein, 147 aa, Unknown
  Obtained from environmental sample
  misc_feature (1)..(147): Xaa is any amino acid
MINKSTLFIVNDIDKSSEDISSSLPKHSVRVIRNETEGKNEFLIDEAKKAIKEAYIATSETKYILLCGNSFGIPAQNSLLKVLEEPPKNIIFIIITISKSSILPTILSRVEVKYQKTKKTVQEFSLDLKRLELKDLYKYLKRTSTNP

SEQ ID NO: 12651 - DNA, 354 bp, Unknown
  Obtained from environmental sample
  misc_feature (1)..(354): n is a, c, g, or t
atgaaaaaaataacattaaacataacagggatgcactgcgcaagttgttcagctttaatagataaaggattttcaaaatcagatggcattacatcgtctaatgttaattattcaacatcaaaagcgacagtggaatatgatgaaactaaactttctgaaaaagatcttattaaaattgtagtaggaagaggttatggagcatctttgtttagtaaaaaagcgaaagatactgaaaaaaaagaaatcagaaatcttaaacgtaaattcacattaagtcttatttttacaatacctgcttttgttataggtatggtatttatgtggttaaatattatgatcccattccaagattaa

SEQ ID NO: 12652 - protein, 117 aa, Unknown
  Obtained from environmental sample
  DOMAIN (5)...(69): Heavy-metal-associated domain
  misc_feature (1)..(117): Xaa is any amino acid
MKKITLNITGMHCASCSALIDKGFSKSDGITSSNVNYSTSKATVEYDETKLSEKDLIKIVVGRGYGASLFSKKAKDTEKKEIRNLKRKFTLSLIFTIPAFVIGMVFMWLNIMIPFQD

SEQ ID NO: 12653 - DNA, 756 bp, Unknown
  Obtained from environmental sample
  misc_feature (1)..(756): n is a, c, g, or t
atgataagaattgcctggagagacttaaatctgaaagcacaactgagcgaagtgctctcggatctttccatgcttgcagacgcctgtattgaaatagtttcaacgtatatatacaatgggctatcctcaacatatgggtttccctgtgatgaaaaaggaaacaaacaaaaaattataatccttggcatgggaaagctgggcgccatggaacttaacttttcatcagatattgatctaatttttgtatacccttgtaacgggtttacagataaaaaacccaacatttccaatggggatttcttcactaaattgtgcagaaaatttataaaattattgggttccaatgttgatggtgtaaatttttatcgtgtggatactcggctaagaccgtttggtgccacaggtccccttgtgatgacctgccatgaattcgaagaatactaccaggcccagggcagagagtgggaaagatatgcctttattaagacaaggcccgtggcaggcaatatcaaagcagggtataaacttttaaaagatttaaattcttttatttatcgacgatattttgattatggcacctttgattcttttaaagatatgaaaaaaagaatctccctgcaggttaaaagtgcaaagatgcaagataatgtaaagttaggccctgcgaggcataagggaaatcgaatttttcggacaaatttttcagctcataagaggtggggtgaaccgaactcagactcaggactcacccaataa

SEQ ID NO: 12654 - protein, 251 aa, Unknown
  Obtained from environmental sample
  DOMAIN (1)...(203): Glutamate-ammonia ligase adenylyltransferase
  misc_feature (1)..(251): Xaa is any amino acid
MIRIAWRDLNLKAQLSEVLSDLSMLADACIEIVSTYIYNGLSSTYGFPCDEKGNKQKIIILGMGKLGAMELNFSSDIDLIFVYPCNGFTDKKPNISNGDFFTKLCRKFIKLLGSNVDGVNFYRVDTRLRPFGATGPLVMTCHEFEEYYQAQGREWERYAFIKTRPVAGNIKAGYKLLKDLNSFIYRRYFDYGTFDSFKDMKKRISLQVKSAKMQDNVKLGPARHKGNRIFRTNFSAHKRWGEPNSDSGLTQ

SEQ ID NO: 12655 - DNA, 735 bp, Unknown
  Obtained from environmental sample
  misc_feature (1)..(735): n is a, c, g, or t
ttgggaataattggaaaaataacacaaacctgggcaaaaacctatgaatcaaaaccaagagatatcttctatctaaaaacagaaaaagagattatccacctagtaaagtattgtaacaaatatcaaactccacttaaaattgtaggtggggcagatagttacaatgatatattttgccctggggagtatgggtttttagtaagcttagaaaagttcaataagcttttagatgtggataaagagaatcataccgctacctttgaagcgggtatgatgatgcctgatttaataaaacaactcaaaagatataatctagctatctcaaatttaggtacaaatatcttcgattgtgttgctggaagctgtagtaccggttatcatggaagtggtattaactataagatatttagctcttttgtaaaaacttttgaacttatcactccaactggggagaaaaaagtagttcactctgatgatgaagaatttgacatctatgcagttggactaggagttttaggagttattactaaaatcactttacagtgtgaaccatcttttaaccttgaggtagttgagaaaaagatgagtttagaagagattgagaaaaattttgatcaacttctaaacaacaatgagcattttaaatttatttgggttccccatacggatcattttatggtttggcttggcaatagaacaaaccaagaagaatcaactaattttaaaaagttttga

SEQ ID NO: 12656 - protein, 244 aa, Unknown
  Obtained from environmental sample
  DOMAIN (19)...(174): FAD binding domain
  misc_feature (1)..(244): Xaa is any amino acid
MGIIGKITQTWAKTYESKPRDIFYLKTEKEIIHLVKYCNKYQTPLKIVGGADSYNDIFCPGEYGFLVSLEKFNKLLDVDKENHTATFEAGMMMPDLIKQLKRYNLAISNLGTNIFDCVAGSCSTGYHGSGINYKIFSSFVKTFELITPTGEKKVVHSDDEEFDIYAVGLGVLGVITKITLQCEPSFNLEVVEKKMSLEEIEKNFDQLLNNNEHFKFIWVPHTDHFMVWLGNRTNQEESTNFKKF

SEQ ID NO: 12657 - DNA, 765 bp, Unknown
  Obtained from environmental sample
  misc_feature (1)..(765): n is a, c, g, or t
ttgaaaatttccaaagcaaactctacacttactacaggtatgaagagtgttggtgaagttatgtctatggggagaacatttaaagagtctttccaaaaagcattatgttcacttgaaactggactttgtggatttgatccaatcaaaggtgatattgaattaatcaaaaaagagattcgaagaccaaattgtgatagatatatctacttaatgcaaggtatgcgagaaggtttaagtgataaagatatctttgagttatcaaaaattgatccatggtttttaaatcagtttagagaaattcacgatatggaagtaaaaattaaaagtgaagcatcagcagttctacaaaatgaagaacttttaagaagagcgaaaacttttggatttagtgataaaatgatctctttacttattggttgtaaagaaactgaagtatatgatgcaagaaaagcacttagtataaactttgaatacaatgaagttgatacttgtgcagctgagttcaaagcattgacaccatatctttattctacaacaaatatctcttcattgccacaaaaagcaaaagagaaatctgataagaaaaaagttatgattattggtggtggacctaatagaataggtcaggggattgagtttgattattgttgttgtcatggctcatttgctttaaatgagatgggtgttgaaaacattatcgataactggaatcccggaaactgtatcaccagattagtgatccacctgataatccttaaattttga

SEQ ID NO: 12658 - protein, 254 aa, Unknown
  Obtained from environmental sample
  DOMAIN (55)...(179): Carbamoyl-phosphate synthetase large chain, oligomerisation domain
  misc_feature (1)..(254): Xaa is any amino acid
MKISKANSTLTTGMKSVGEVMSMGRTFKESFQKALCSLETGLCGFDPIKGDIELIKKEIRRPNCDRYIYLMQGMREGLSDKDIFELSKIDPWFLNQFREIHDMEVKIKSEASAVLQNEELLRRAKTFGFSDKMISLLIGCKETEVYDARKALSINFEYNEVDTCAAEFKALTPYLYSTTNISSLPQKAKEKSDKKKVMIIGGGPNRIGQGIEFDYCCCHGSFALNEMGVENIIDNWNPGNCITRLVIHLIILKF

SEQ ID NO: 12659 - DNA, 687 bp, Unknown
  Obtained from environmental sample
  misc_feature (1)..(687): n is a, c, g, or t
gtgcgccgaggcaatactattgcgatgaagttaactaaagatgatcatttcacagtagatgaaaaagataaagttgttcttatcacagaagatggtattactaaggctgaagagctttttggcgtagaaaacctttacagtgtagaaaatgcttctcttcctcactcgcttgaccaagcacttaaagcaaactatctttttgaaaaagatgttgattatgttataaatgatggtgaagttgtaattgttgatgagtttacaggtagacttagtgaaggtcgtcgttttagtgaaggtcttcaccaagctcttgaagcaaaagaaaaagtagagataaaagaagaaacacaaactcttgctgatattacatttcaaaattattttagaatgtatgacaaattagcaggtatgactggtactgcagagactgaagctactgagtttgctcaaatttactcacttgatgttgtatctattcctacaaatattcctattacaagaaaagacttaaatgaccttatctataaaacagaagacgaaaagtttgatgcagttatagaaactattaaaaaactatccaaaacaggtcagcctgttcttataggtactgcatctattgaaaaatctgaactattacatgaagttcttaaaaaaagaaaaaattgctcatactgttttaaatgctaa

SEQ ID NO: 12660 - protein, 228 aa, Unknown
  Obtained from environmental sample
  DOMAIN (2)...(105): SecA preprotein cross-linking domain
  misc_feature (1)..(228): Xaa is any amino acid
MRRGNTIAMKLTKDDHFTVDEKDKVVLITEDGITKAEELFGVENLYSVENASLPHSLDQALKANYLFEKDVDYVINDGEVVIVDEFTGRLSEGRRFSEGLHQALEAKEKVEIKEETQTLADITFQNYFRMYDKLAGMTGTAETEATEFAQIYSLDVVSIPTNIPITRKDLNDLIYKTEDEKFDAVIETIKKLSKTGQPVLIGTASIEKSELLHEVLKKRKNCSYCFKC

SEQ ID NO: 12661 - DNA, 792 bp, Unknown
  Obtained from environmental sample
  misc_feature (1)..(792): n is a, c, g, or t
ttgtttgggctttttgggcgggaagtagaattaaaagtaaaaaaaatcaataatctaattctaaatgagaaattaaaagaaaaaaagtttgaaaattatcattttaatctagatattcttataaaagatgataatgtaatagatgcaatctttattgctaaagtattagacggtatttctaagtctgttgtagaactatctttagagatttttggagaatattattttaaaggtaaatttgagataatggtagatatatggaactattctgtattgcgtttttgtgatattgataagtataaaataattcagaagagcttagagagtgttggttttaactctaactttttagataaggcttatagacttaaacaggagcatgcaaaatgggatataagattaatacatagttttgattatgaatttaatgatgaaactatgaaaataaaatcatttacaacagaaaacattttagataagttcattccacatttagaaaatatagatataaaaaataatagtataaaaaatatcttaaaaaactattatgagtcaattaaaaactttaatcaattagaactttatggaaccgataatagatctctttctgattttttcgaaagacttgatcctattgtaaaaaatgatactatttatagtattttatctgaagttgaatacgcttttggagattttgaagatgtttttcatgaatttgttagtataaatgaaatatctgatttagatgaggaaaatgttacaaatatatggaaactattgtgtttatgttga

SEQ ID NO: 12662 - protein, 263 aa, Unknown
  Obtained from environmental sample
  misc_feature (1)..(263): Xaa is any amino acid
MFGLFGREVELKVKKINNLILNEKLKEKKFENYHFNLDILIKDDNVIDAIFIAKVLDGISKSVVELSLEIFGEYYFKGKFEIMVDIWNYSVLRFCDIDKYKIIQKSLESVGFNSNFLDKAYRLKQEHAKWDIRLIHSFDYEFNDETMKIKSFTTENILDKFIPHLENIDIKNNSIKNILKNYYESIKNFNQLELYGTDNRSLSDFFERLDPIVKNDTIYSILSEVEYAFGDFEDVFHEFVSINEISDLDEENVTNIWKLLCLC

SEQ ID NO: 12663 - DNA, 465 bp, Unknown
  Obtained from environmental sample
  misc_feature (1)..(465): n is a, c, g, or t
atgcgtataaaaatagagttaatctctaaaaaaaagaatatatatttaaaaacaggttacaattcctcattgcaagcattaatttacaataatatttctgaaaaacttgcagataagcttcataatgaaggttttagttatgaaaacaggaaattcaaactttttacatattcatctgttttagaaagaggaaactttgacaaagagaagaagatttttacatttccccagcagataagtttttacatctcctctcctgtggaatttttattagaagatattgcaagaacgatgataaaccgagatgagattcgtttagggaataatagtttattaatttcttcaataaatgttatcaaaaagattttaccaaagaagaatagtttaaaagttacagcagtaacccccatagagatgcattctacatttaagaaacctgatggaagaaattccgagccgatctga

SEQ ID NO: 12664 - protein, 154 aa, Unknown
  Obtained from environmental sample
  misc_feature (1)..(154): Xaa is any amino acid
MRIKIELISKKKNIYLKTGYNSSLQALIYNNISEKLADKLHNEGFSYENRKFKLFTYSSVLERGNFDKEKKIFTFPQQISFYISSPVEFLLEDIARTMINRDEIRLGNNSLLISSINVIKKILPKKNSLKVTAVTPIEMHSTFKKPDGRNSEPI

SEQ ID NO: 12665 - DNA, 576 bp, Unknown
  Obtained from environmental sample
  misc_feature (1)..(576): n is a, c, g, or t
atgtggtccccgggggattttttattccctagggttaaggaggcttttttcggagaggttttcggggggggtgctaagaccagagggcgtttttttaggtattattggaaaaaaaaaatgtttggatattttttcaacccgctacataatctggaatcaaaatacaggtcataccctgtaatggcttcaaagttacacttgataggtcaatcactgaggttttataaaacacaagagaactcttttgggtttatcttaaaaggcttaaactatggattttcccatgaagaaaaagtgttaatctcaatagtggcaaagtgcagtggaaaagcacttccaaaagttgatgatataaatcaatttgggaacttattaccatctattgaaacaatacattggttaaattttatgatgactttaaatttaactttaaatacagaatacggaaaaataaaatatgattttatacttgaagataatattttaagagtaagttcccaagatgaaaatcatttagtaaaaagtgatctttttaagatagaagtaccgcacgatatagtggtggagctcgaataa

SEQ ID NO: 12666 - protein, 191 aa, Unknown
  Obtained from environmental sample
  misc_feature (1)..(191): Xaa is any amino acid
MWSPGDFLFPRVKEAFFGEVFGGGAKTRGRFFRYYWKKKMFGYFFNPLHNLESKYRSYPVMASKLHLIGQSLRFYKTQENSFGFILKGLNYGFSHEEKVLISIVAKCSGKALPKVDDINQFGNLLPSIETIHWLNFMMTLNLTLNTEYGKIKYDFILEDNILRVSSQDENHLVKSDLFKIEVPHDIVVELE

SEQ ID NO: 12667 - DNA, 660 bp, Unknown
  Obtained from environmental sample
  misc_feature (1)..(660): n is a, c, g, or t
atgctaccttccaataataaagtaaaaattcactttaccatatctcttgaacatcaagagctgttttctaaattacttgaaggtcttagaaaagatcttgagaagcaatatctagtagagttagaaatttcattttctccgcaaaaatcatcaactgatataattgctgttgatttaaataatgaactttttagaaatagtgatggttcattgttgttcagacctggtggccatggtgcattaattgaaaatcttaatgatctggattctgatattatttttataaaaaacattgataatattgttcctgataaaataaaaaatattacagttcaatataaaaaagcattagctggagttttactttcttataaagaaaaaatctccatatatcttgaaaaaatagacactaaagattacaacaaagatttccttaatgagattaaacaatttattgcagatgaactatgtgttaaattaaaatttgataataatttaagtttagatcaatatgcagatatattgagagagaaattgaatcgacccattcgagtttgcggaatggttaaaaatgaaggccaacctggaggaggtccattttgggttaaacattccgatggaactgttgatttaccaatagtgggaatcatctccaattaa

SEQ ID NO: 12668 - protein, 219 aa, Unknown
  Obtained from environmental sample
  misc_feature (1)..(219): Xaa is any amino acid
MLPSNNKVKIHFTISLEHQELFSKLLEGLRKDLEKQYLVELEISFSPQKSSTDIIAVDLNNELFRNSDGSLLFRPGGHGALIENLNDLDSDIIFIKNIDNIVPDKIKNITVQYKKALAGVLLSYKEKISIYLEKIDTKDYNKDFLNEIKQFIADELCVKLKFDNNLSLDQYADILREKLNRPIRVCGMVKNEGQPGGGPFWVKHSDGTVDLPIVGIISN

SEQ ID NO: 12669 - DNA, 561 bp, Unknown
  Obtained from environmental sample
  misc_feature (1)..(561): n is a, c, g, or t
atgatagtcggaattgaaggaaaaatagaaaaaaaagaccccacttttgtacatataaatgttggtggtttgatatatgaggtattcgtgtcggtaaattgtagttcggcaattgttggtgatagtgtgaaactctatactactcaaataattaaagaagagagcaataatctttatggttttttagattttgatgaaaaacggttatttgacacagtgataaagataaatggtgttggtccaaaagttgcaatggcaatctgtagtacatttacaccaacaagctttgctcagatagtacaaactaatgatataggtatgctaaaaagagttcccggaattggtcctaaaggggcgagtagaatattggttgagcttagtggttttgttgtctcaagcacaagtgaaggtggtaactttggtcaaagtgcctctgaagcagtgatggcattggagtcattaggttttaaaaaagagcagataaacaaggcgttagttaatgcagtatcgacagatactgctggtttagttaaagaagcattaaaaaaattacaaaaatag

SEQ ID NO: 12670 - protein, 186 aa, Unknown
  Obtained from environmental sample
  DOMAIN (142)...(185): RuvA, C-terminal domain
  misc_feature (1)..(186): Xaa is any amino acid
MIVGIEGKIEKKDPTFVHINVGGLIYEVFVSVNCSSAIVGDSVKLYTTQIIKEESNNLYGFLDFDEKRLFDTVIKINGVGPKVAMAICSTFTPTSFAQIVQTNDIGMLKRVPGIGPKGASRILVELSGFVVSSTSEGGNFGQSASEAVMALESLGFKKEQINKALVNAVSTDTAGLVKEALKKLQK

SEQ ID NO: 12671 - DNA, 333 bp, Unknown
  Obtained from environmental sample
  misc_feature (1)..(333): n is a, c, g, or t
atgtcattaaatctaagtaaaaaaataagtaaacttgtagggcaaacaaatgcaaactatgagttaataaaagagggtgacaagattttagttggttttagtggaggaaaagattcccttacacttatccacactctaaaaagaatgcaaagtgtggcaccttttaaattggaatttaaagcggttactataacttatggtatgggtgaacaagtagagtttttagctaatcatggtaaaaaatatgagatggaacatgagatggtggatacagaaattttggatatttcaaaggaaaggatagaaaaaacagctctttctgagccaatctga

SEQ ID NO: 12672 - protein, 110 aa, Unknown
  Obtained from environmental sample
  misc_feature (1)..(110): Xaa is any amino acid
MSLNLSKKISKLVGQTNANYELIKEGDKILVGFSGGKDSLTLIHTLKRMQSVAPFKLEFKAVTITYGMGEQVEFLANHGKKYEMEHEMVDTEILDISKERIEKTALSEPI

SEQ ID NO: 12673 - DNA, 759 bp, Unknown
  Obtained from environmental sample
  misc_feature (1)..(759): n is a, c, g, or t
ttgttcaatgaaaaaagtggacccaaaggggtggtcataccgggagatagtatcacggtaggtcctgctcttccacttccagataaagaataccaaaatatgagaaatgcttcttttgcaattttaagagagattggagttgatacaggtggaagtaatgttcagttctcaatagacccaaaaactggaagaatgatagttattgagatgaatccaagagtttcaagaagttctgcacttgcttcaaaagctacaggatatcctatagcaaaagttgcaactctacttgcagttggttttacacttgatgagattgaaaatgatatcacaggaactacagcatcatttgaaccagtgattgattatgttgtaacaaaaattccaagatttacatttgaaaaatttccaaaagcaaactctacacttactacaggtatgaagagtgttggtgaagttatgtctatggggagaacatttaaagagtctttccaaaaagcattatgttcacttgaaactggactttgtggatttgatccaatcaaaggtgatattgaattaatcaaaaaagagattcgaagaccaaattgtgatagatatatctacttaatgcaaggtatgcgagaaggtttaagtgataaagatatctttgagttatcaaaaattgatccatggtttttaaatcagtttagagaaattcacgatatggaagtaaaaattaaaagtgaagcatcagcagttctacaaaatgaagaactttaa

SEQ ID NO: 12674 - protein, 252 aa, Unknown
  Obtained from environmental sample
  DOMAIN (187)...(251): Carbamoyl-phosphate synthetase large chain, oligomerisation domain
  misc_feature (1)..(252): Xaa is any amino acid
MFNEKSGPKGVVIPGDSITVGPALPLPDKEYQNMRNASFAILREIGVDTGGSNVQFSIDPKTGRMIVIEMNPRVSRSSALASKATGYPIAKVATLLAVGFTLDEIENDITGTTASFEPVIDYVVTKIPRFTFEKFPKANSTLTTGMKSVGEVMSMGRTFKESFQKALCSLETGLCGFDPIKGDIELIKKEIRRPNCDRYIYLMQGMREGLSDKDIFELSKIDPWFLNQFREIHDMEVKIKSEASAVLQNEEL

SEQ ID NO: 12675 - DNA, 480 bp, Unknown
  Obtained from environmental sample
  misc_feature (1)..(480): n is a, c, g, or t
atggaacattttaattatgatgtaaaagataaaaatatagcaatagtgggtgatgtatttaattcacgagttgcatcttcaaatcttgaattattacctagatttggtttaaaaccaattcttgtaacacctaaagagtttagagtagtatcacaatacaaaacagtaaaaaatattaataaagtgatagataaacttgatatcataatgagtttacgagtgcagcatgaaagacacacttttactctctctgataatgaattagaggagaatacaaaaaaatatagcaaaaaatattgtatcacaaaaaaaatgatgggtagtagagatatcttacttatgcatccaggaccagtgaataggaatatcgatataagtgatgagatgttagaagatcctcgttcaaaagttctagaacaagtgagaaatggtgtagcagtaagaatggcttgtttaaaaaaactaatactaaatcaataa

SEQ ID NO: 12676 - protein, 159 aa, Unknown
  Obtained from environmental sample
  DOMAIN (8)...(156): Aspartate/ornithine carbamoyltransferase, Asp/Orn binding domain
  misc_feature (1)..(159): Xaa is any amino acid
MEHFNYDVKDKNIAIVGDVFNSRVASSNLELLPRFGLKPILVTPKEFRVVSQYKTVKNINKVIDKLDIIMSLRVQHERHTFTLSDNELEENTKKYSKKYCITKKMMGSRDILLMHPGPVNRNIDISDEMLEDPRSKVLEQVRNGVAVRMACLKKLILNQ

SEQ ID NO: 12677 - DNA, 315 bp, Unknown
  Obtained from environmental sample
  misc_feature (1)..(315): n is a, c, g, or t
gtgaacttaaaaaagatactcaataattatggctccaaaaaagagccatttttttttatgattagttatgatttaaaaaactatgaagtgattccattaaaagatattccaaaagatattcaatataaaataaattcaaaagagctattttcaaaaaaaaatcaaaccataaccaaaaacccaataagttatgaaaactatttaacaaaatataactccataccaaatgagataaaaaatggaaatacctatcttatccatctaacaccccccacaaaagtgaacggaaaattagatttaaaaaatatcctttaa

SEQ ID NO: 12678 - protein, 104 aa, Unknown
  Obtained from environmental sample
  misc_feature (1)..(104): Xaa is any amino acid
MNLKKILNNYGSKKEPFFFMISYDLKNYEVIPLKDIPKDIQYKINSKELFSKKNQTITKNPISYENYLTKYNSIPNEIKNGNTYLIHLTPPTKVNGKLDLKNIL

SEQ ID NO: 12679 - DNA, 474 bp, Unknown
  Obtained from environmental sample
  misc_feature (1)..(474): n is a, c, g, or t
ttggctttacattttattgagcaaattagggttgataataaagaggttcccattgttgtgttaagtgcacataaagatgaagaatttttgctaaaagccatccctttagggctcacctcttatgaagttaagcctattaattttactgattttaaaagtttacttaataaatgtgctcaagctattaacagtaaaaatttattacttataaaagatgatattttttatgattatgacacaaagtctatttataaaaatcaagaggagatacttttgagtaaaaaagaatctctatttgttgagttactcataaaaaataaaaatagtattacaagtaaagatgatatcaataattttatttgggaaaatgaaattatgagtgaatcggcattgaaaaactttttgttaagagtaagaaaaaaagttggaaaagattttttttatacaattcagaatataggatatagattataa

SEQ ID NO: 12680 - protein, 157 aa, Unknown
  Obtained from environmental sample
  DOMAIN (87)...(157): Transcriptional regulatory protein, C terminal
  misc_feature (1)..(157): Xaa is any amino acid
MALHFIEQIRVDNKEVPIVVLSAHKDEEFLLKAIPLGLTSYEVKPINFTDFKSLLNKCAQAINSKNLLLIKDDIFYDYDTKSIYKNQEEILLSKKESLFVELLIKNKNSITSKDDINNFIWENEIMSESALKNFLLRVRKKVGKDFFYTIQNIGYRL

SEQ ID NO: 12681 - DNA, 339 bp, Unknown
  Obtained from environmental sample
  misc_feature (1)..(339): n is a, c, g, or t
ttggaaggtggtaaaatggaatataattataaatatcttatagaggaatctatagataatctatattcaaaaaaaagtatagctgatgagatatttatagtaaaaaacaagctagttacagatacctctatagcaaatattgcaatatataaagaaaataggtggttaacaccaaagcaacccttactaaaaggaaccactagagcaagattattagaagaagaaatagtatatgaatcagagctaagtgtagaggatctaaaagatgcttctaaaattgctcttttgaatgcgatgattggatttaaagagattgagaattttacaattttagattaa

SEQ ID NO: 12682 - protein, 112 aa, Unknown
  Obtained from environmental sample
  misc_feature (1)..(112): Xaa is any amino acid
MEGGKMEYNYKYLIEESIDNLYSKKSIADEIFIVKNKLVTDTSIANIAIYKENRWLTPKQPLLKGTTRARLLEEEIVYESELSVEDLKDASKIALLNAMIGFKEIENFTILD

SEQ ID NO: 12683 - DNA, 741 bp, Unknown
  Obtained from environmental sample
  misc_feature (1)..(741): n is a, c, g, or t
atgtgtggaatagtgggatatataggtaaaaataatattaaggatatcttgctggatggactcggcgaacttgaatatcgcggctatgactcagcagggatcgccgtacttcaagatgagaacttttcgatctacaaggcagtcggtaaactggaaaacctcagagaaaagacaaaagagtttcatcccaaaggtttttctatcgggatcggccacacccgctgggcaacacacggaaaacctaccgaactcaatgcccatccgcacatcggtgaaagttcttatgtcgtacataacggtatcatcgaaaactatcaagtgcttaaaaaacgtcttcttggcgagggtgctgtctttgtatcacaaaccgataccgaagtcatcgttcatctgtttgaatcacacctcaaagacctaaatgaccctctcaaagccttcagggctactctggatgaactcgaaggtgcttatgccgtcttgctcattaccaagtgggctccggggaccatattcttcgccaaacacggttctccaatgctcatcggtctcgcgggagacgacaaacatttcgcctcatcagatacgccgcttatcggtcggtgcacggatgtcatctatctgcatgatggtgaaaacggctatttaactgccgacactgtcgaactttttaaggaaaactacgagaagacagaccccgttttaaaatcccttccaagctcaaaactctcgcagccaatctga

SEQ ID NO: 12684 - protein, 246 aa, Unknown
  Obtained from environmental sample
  DOMAIN (2)...(134): Glutamine amidotransferases class-II
  misc_feature (1)..(246): Xaa is any amino acid
MCGIVGYIGKNNIKDILLDGLGELEYRGYDSAGIAVLQDENFSIYKAVGKLENLREKTKEFHPKGFSIGIGHTRWATHGKPTELNAHPHIGESSYVVHNGIIENYQVLKKRLLGEGAVFVSQTDTEVIVHLFESHLKDLNDPLKAFRATLDELEGAYAVLLITKWAPGTIFFAKHGSPMLIGLAGDDKHFASSDTPLIGRCTDVIYLHDGENGYLTADTVELFKENYEKTDPVLKSLPSSKLSQPI

SEQ ID NO: 12685 - DNA, 831 bp, Unknown
  Obtained from environmental sample
  misc_feature (1)..(831): n is a, c, g, or t
atgtcaactatcgtagagattactgaagaaaaaaagttagaggtaaaagattttagttttacatatgctggagctgatgaaccgagtttgaaaaaaattactatgcctatagctaaaaactcggtaacagcactaatcggtcctagtggatgtggtaaaacaacacttttaagagcatttaacagaatgcatgatctatatcctggaaatagctatgaaggtgatattatatttgaaaatagaaatatattaaacccaaatgaagatctaatcaaactacgttcacgtattggtatgatttttcaaaaaccaactgcttttcctatgagtatctatgataatgttgcatatggcatgaaacttcaaggcatcaaagcaaaaagcgaattagatgacagagtagaaaaagctctaaaagatgcagccatctggggtgaagtaaacgacagacttaaaaatgatgctaacggtctctcaggcggtcaacaacaacgtctctgtattgcacgtgccattgcagtagaaccagatgttcttctttttgatgagcctacttctgcactagatccaatttcaactcagggaattgaaaaacttgtaattgagttaaaagatagagtatcaataatcatagtaactcataacatgcagcaagccgctcgtgttagtgattatactggttttatgtatcttggtgatcttgttgagttaggccgtacaaaagaactgtttgttactcctcgtgagagacttacagaagagtatattacaggtaaaatttgggtgatttttattaaaatatcctacgtatttccctcaaagaacaattaa

SEQ ID NO: 12686 - protein, 276 aa, Unknown
  Obtained from environmental sample
  DOMAIN (40)...(232): ABC transporter
  misc_feature (1)..(276): Xaa is any amino acid
MSTIVEITEEKKLEVKDFSFTYAGADEPSLKKITMPIAKNSVTALIGPSGCGKTTLLRAFNRMHDLYPGNSYEGDIIFENRNILNPNEDLIKLRSRIGMIFQKPTAFPMSIYDNVAYGMKLQGIKAKSELDDRVEKALKDAAIWGEVNDRLKNDANGLSGGQQQRLCIARAIAVEPDVLLFDEPTSALDPISTQGIEKLVIELKDRVSIIIVTHNMQQAARVSDYTGFMYLGDLVELGRTKELFVTPRERLTEEYITGKIWVIFIKISYVFPSKNN

SEQ ID NO: 12687 - DNA, 327 bp, Unknown
  Obtained from environmental sample
  misc_feature (1)..(327): n is a, c, g, or t
atggctcaggatttattccacctcaataattaccgaagattgggcctaaaaatagtacctgataattttggtaatgaccccatatcccttgcctattttaaaaacctagatatagaccttgttagatttgatggtagtttccccaaaaatattacctcgtttaacagtagaaacttattatttggtttaataactgcagcagaaaaaattgggtataaatcgtggattaaaatggttgagaatgaagagagttacaaaattgcaaaagagatgaatatagattatattcagggtaattttgtagctaaaataaataacataaattaa

SEQ ID NO: 12688 - protein, 108 aa, Unknown
  Obtained from environmental sample
  misc_feature (1)..(108): Xaa is any amino acid
MAQDLFHLNNYRRLGLKIVPDNFGNDPISLAYFKNLDIDLVRFDGSFPKNITSFNSRNLLFGLITAAEKIGYKSWIKMVENEESYKIAKEMNIDYIQGNFVAKINNIN

SEQ ID NO: 12689 - DNA, 381 bp, Unknown
  Obtained from environmental sample
  misc_feature (1)..(381): n is a, c, g, or t
atgaaatatggtgaaaaaatagtaaatgagtttgatgtagagaaagatttagaaatctggccaaatgagcatgatcgtaactatttgattaagatgacgcttcctgagtttagctgtctatgtcctagaagcggttatcctgattatgcaacgatctacttagagtacacacctgataagctggtagtagagctaaaagctattaaactctatataaactcttttagagatcgtcacatttcacatgagaacagtgcaaatgagatttatgatgttttagataanaagttaaagccaaaatatatgaaagttgtagcagattataaccctagaggaaatgttcatactgtcatagagatagatagtagtaaaattatttaa

SEQ ID NO: 12690 - protein, 126 aa, Unknown
  Obtained from environmental sample
  DOMAIN (28)...(124): GTP cyclohydrolase I
  misc_feature (1)..(126): Xaa is any amino acid
MKYGEKIVNEFDVEKDLEIWPNEHDRNYLIKMTLPEFSCLCPRSGYPDYATIYLEYTPDKLVVELKAIKLYINSFRDRHISHENSANEIYDVLDXKLKPKYMKVVADYNPRGNVHTVIEIDSSKII

SEQ ID NO: 12691 - DNA, 615 bp, Unknown
  Obtained from environmental sample
  misc_feature (1)..(615): n is a, c, g, or t
atgagtgtacaagaccattcagtatgtcctcattttactaataatgaaaaactctattattgtacctcaattgatattggtgaccaatctattttaattattaattttatcttagatacaaaggcagaattagatgaactagtaagaaatataccacttattaaaaattattttatggaagcaacgccatcattaattgtaaaacttctacttgaagctcttaaatcatctgcatttagagatgggttaacaaacctctataatagaaaatttcttgatgaacatttaacgaaacttgttccacaagcattaagagaaaatattaaaattggtgtattaatgcttgatatggatcattttaaatctgtaaatgatgaatatggtcatgatattggtgacttagtattaaaagaactaggaaaaattttaagtgaaaatgtaagagaatcagatattgttgtaagatatggaggagaagagtttattatacttcttattggggtagataatgaagaatctgtacttgaagtaccaaataaatacgaaccaaagtcaggtaaaaatgaaatccaatgtctaatgccggaaaataaaataagaaacaagcgcaaataa

SEQ ID NO: 12692 - protein, 204 aa, Unknown
  Obtained from environmental sample
  DOMAIN (74)...(202): GGDEF domain
  misc_feature (1)..(204): Xaa is any amino acid
MSVQDHSVCPHFTNNEKLYYCTSIDIGDQSILIINFILDTKAELDELVRNIPLIKNYFMEATPSLIVKLLLEALKSSAFRDGLTNLYNRKFLDEHLTKLVPQALRENIKIGVLMLDMDHFKSVNDEYGHDIGDLVLKELGKILSENVRESDIVVRYGGEEFIILLIGVDNEESVLEVPNKYEPKSGKNEIQCLMPENKIRNKRK

SEQ ID NO: 12693 - DNA, 843 bp, Unknown
  Obtained from environmental sample
  misc_feature (1)..(843): n is a, c, g, or t
gtgggcgtggaattacccactctaatcagcaaattgcttgctgttaaaagagtttctcaaaataaaggcagcaaaacaccaggaattgacggcatcatttggaacagtgatgctcgttgtatgactgcggtcaatcaactgagccgaaaaggctatcatgcccaaccgctcagacgtatctacatccccaagaaaaacggcaaactcagacctttaggcattccctgcatgatagacagagcgcagcaagcgctgcatcttctcgccttggagcctatttcagaaacggtagccgacctcaatagctatggctttcgacctaaccgaagcacagcagatgccattgcacagtgcttcaaatgcttgtgtcagaaaagctctagccaatgggttcttgagggtgacattaaagcctgtttcgataagataggtcatcaatggctcatcgacaacattcaattagataaacgaatgctgaaacaatggcttggatgtggttatgttgataaaggattgttctacaaaacagcagaaggaacaccgcaaggcgggataatttccccaacgctgatgttgctcacgctggcagggttagagcagttggttaagactattgcctgtaaaacagggaatagagtcaactttatcggatatgcagatgattttgttatcacaggttcttcgaaggaagtgctcgttaatgacatcaagccgcagctaattggttttctacaggaaagaggcttaacactctctgatgagaaaacgcacataactcatatcgatgatggttttgactttctgggattcaatatcccaaagtacaaagcaaactgctcataa

SEQ ID NO: 12694 - protein, 280 aa, Unknown
  Obtained from environmental sample
  DOMAIN (53)...(272): Reverse transcriptase (RNA-dependent DNA polymerase)
  misc_feature (1)..(280): Xaa is any amino acid
MGVELPTLISKLLAVKRVSQNKGSKTPGIDGIIWNSDARCMTAVNQLSRKGYHAQPLRRIYIPKKNGKLRPLGIPCMIDRAQQALHLLALEPISETVADLNSYGFRPNRSTADAIAQCFKCLCQKSSSQWVLEGDIKACFDKIGHQWLIDNIQLDKRMLKQWLGCGYVDKGLFYKTAEGTPQGGIISPTLMLLTLAGLEQLVKTIACKTGNRVNFIGYADDFVITGSSKEVLVNDIKPQLIGFLQERGLTLSDEKTHITHIDDGFDFLGFNIPKYKANCS

SEQ ID NO: 12695 - DNA, 849 bp, Unknown
  Obtained from environmental sample
  misc_feature (1)..(849): n is a, c, g, or t
ttgtggtgggaattgctacaaaaatcaatgattttttggggattaggaattactgaaaatattgatggtagttatgcagttatgtctatagtaaatctagctcttatgactggaaatattggaaaaataggcgctggacttatgcctttaagaggtcaaaataatgttcaaggaacctgtgatatgggatgtcttccttactatggtcctgattatacaaagccaaaagaggatggacttaaaactccagaccttatggatgatatgcttgaagataaaataaaagcaatggtagttatgggagaagatacagctcatatacatccaaatttaaataaagtcaacaaagctttagaaaacttagaacttcttatcactcaagatttatttatgaacgaaatagcaaaaaagtcagatatagtctttggtgtaaaatcagcttatgaaaaaactggtgtatatgtaaatgctatgagaagattacatttatctcaaccactagttgaaaataacttaccagatgattggcaagttttaagagatattgaaaataaaatcaaaggtgagttcctctttaaatcaagcgaagatgtgtgggagcaagtaagagttgaagctccatatagatatggaggtgcaagttatcacaaactaatgaaacatagaagtaaagggatgcaatggccagtcgctaaagatgatacacctattttacatcttgaaaaattcaatacaccagatggtcttggaacttttaaatacaatggttaccaacttcgtggtcaaataaaaaagttaatagagggtgaaaagttcgatacattttatctaacaccagtagaaatctaa

SEQ ID NO: 12696 - protein, 282 aa, Unknown
  Obtained from environmental sample
  misc_feature (1)..(282): Xaa is any amino acid
MWWELLQKSMIFWGLGITENIDGSYAVMSIVNLALMTGNIGKIGAGLMPLRGQNNVQGTCDMGCLPYYGPDYTKPKEDGLKTPDLMDDMLEDKIKAMVVMGEDTAHIHPNLNKVNKALENLELLITQDLFMNEIAKKSDIVFGVKSAYEKTGVYVNAMRRLHLSQPLVENNLPDDWQVLRDIENKIKGEFLFKSSEDVWEQVRVEAPYRYGGASYHKLMKHRSKGMQWPVAKDDTPILHLEKFNTPDGLGTFKYNGYQLRGQIKKLIEGEKFDTFYLTPVEI

SEQ ID NO: 12697 - DNA, 879 bp, Unknown
  Obtained from environmental sample
  misc_feature (1)..(879): n is a, c, g, or t
ttgggtaattggttcccaaaacaacctattcctaaatgcattgggtggaaattatttggggagggattaatttcaaaggaactaaggccaaacggagcgggagaaaccaatcaaactctaaaaaatgatgtgtattatattgtagcaagtgctaaaggttatggctctagcgaacaagctgttgaagtgcatcaagatagtttaagagaaatttttttctatttaggagagccatctgaagaacctataattgttgaacagattgatactattgttgagccagaaattattcctgaacctgaagatactatttcaacagcagcaatgccagttggattatatgccgaaaacaatattgtttttttaatagatgcttctgtttcgatgaagttagaaggtagaatggatttgcttaaagctgctatgatagaattgttaaacggattacgttctattgacaggttggcaattgtaacttacgcctcttctgttgatgttgttttaacttctcaatttgtaaaagacaaagcccaaattacccaaattatacaagatttatctgctggagggagaacagaaggagctcaaggtcttgaaaaagcctatgaaatagcatatcaaaacaaacttaccgaaggaaataaccttattattatagcaacagacggtgtatttaacctaagtaaagaagataaagcaaatgttgaacaaaacacaagcaatggaattaatgtttcggttgttggtgtgaaaaatgaaaaatggactgaaaaatcaatgttaactatcgctgaacttggtaatggaagttaccttaacataaaatcttatagacaagcaaaagaaacattacttaaggaaatcaagcaaaaatcgtaa

SEQ ID NO: 12698 - protein, 292 aa, Unknown
  Obtained from environmental sample
  DOMAIN (118)...(288): von Willebrand factor type A domain
  misc_feature (1)..(292): Xaa is any amino acid
MGNWFPKQPIPKCIGWKLFGEGLISKELRPNGAGETNQTLKNDVYYIVASAKGYGSSEQAVEVHQDSLREIFFYLGEPSEEPIIVEQIDTIVEPEIIPEPEDTISTAAMPVGLYAENNIVFLIDASVSMKLEGRMDLLKAAMIELLNGLRSIDRLAIVTYASSVDVVLTSQFVKDKAQITQIIQDLSAGGRTEGAQGLEKAYEIAYQNKLTEGNNLIIIATDGVFNLSKEDKANVEQNTSNGINVSVVGVKNEKWTEKSMLTIAELGNGSYLNIKSYRQAKETLLKEIKQKS

SEQ ID NO: 12699 - DNA, 810 bp, Unknown
  Obtained from environmental sample
  misc_feature (1)..(810): n is a, c, g, or t
gtgatcgatattattggaataaatcagtctcaatctaaaacatcaatatatccaatacactcagaactccatagtgaaaaaattggtttagatacgttaaaaagcaagatctttgatagagtcttagatatcattattcactcaaataattcaggaatatttgtaatggatagaggatttgatgataaaaaagtaattcaagaattatataagcataacgcttcttttataattcgtatgaaaaaaaatcggcatgttttctataaaggagatctattaaatatttccaaagtagcagaccaaataagtaagagacataaatttgaaattgatcataaaagaactattagagcgggtattagtgagattagtatacctttaagtaggcataaagttaaagatcccgaaaaggcaaaagtatatcttgtctctgctgaaataacatctaagaaatctaatgacagaaactttacagggaaatttatgattttaatctcaatgcctggttctaaaaaatcttctaaagagatgtgtgagcttgcactaaaatcatatagattacgttggaaaatcgaagaagtgcatcggcaaataaaaacagactttgggtgggaaaaaatgcaattattaaagtttgatcgtttacaagcgttgaatacattgctctggttagctttaggctttatttatgaactagatgattggaaatataaatttgcaaaagcttttactagcttgattttagacaaaaaaaatgatctaaaaatacttaaccaatttcatctattatcgaataacaaaagttattaa

SEQ ID NO: 12700 - protein, 269 aa, Unknown
  Obtained from environmental sample
  DOMAIN (2)...(228): Transposase DDE domain
  misc_feature (1)..(269): Xaa is any amino acid
MIDIIGINQSQSKTSIYPIHSELHSEKIGLDTLKSKIFDRVLDIIIHSNNSGIFVMDRGFDDKKVIQELYKHNASFIIRMKKNRHVFYKGDLLNISKVADQISKRHKFEIDHKRTIRAGISEISIPLSRHKVKDPEKAKVYLVSAEITSKKSNDRNFTGKFMILISMPGSKKSSKEMCELALKSYRLRWKIEEVHRQIKTDFGWEKMQLLKFDRLQALNTLLWLALGFIYELDDWKYKFAKAFTSLILDKKNDLKILNQFHLLSNNKSY

SEQ ID NO: 12701 - DNA, 732 bp, Unknown
  Obtained from environmental sample
  misc_feature (1)..(732): n is a, c, g, or t
atggaaaatatcccaaccaggtactttacaatattttctaaaaccgcatctaatatagaatctttggaggaatggtataaaattatccataatgagttaaacccaattttggatgctacaaatttttatatagctttttgtaacgaaaaaacgggagagataatttcaccttattattatgatgaaaagcacgagattaaaacacctttaaagatgagaactaatggtattacaaattacattatcaacacaaaaaggtcgctatatctagataatgatgttcgggaatttcttattacaactggaaaaattgcagattatactagtaagagcaaaatgatgttgggtgttcctcttatgttaggaaaaaaaataatgggaactttggctattagatcttataacgagaaggtaaattacacacatcaccatttagaaattttggaatttgtagcggatcaaattacagctgttatagctcaaaaaagatcggagcataaattggaaaaatctttaaaagagaaagagacaatattgcaagagctacaccaccgtacaaaaaacaatatgcaagtgatcatttctatgctctctattcaatctaaaagtgcaaatagcgactttattaaagataaatttcaggaagtatcaaataggataagcaccaggtctttagctcaggaaaaacggcataattctcacgatatctctggaataaatctacgggaatag

SEQ ID NO: 12702 - protein, 243 aa, Unknown
  Obtained from environmental sample
  DOMAIN (21)...(159): GAF domain
  misc_feature (1)..(243): Xaa is any amino acid
MENIPTRYFTIFSKTASNIESLEEWYKIIHNELNPILDATNFYIAFCNEKTGEIISPYYYDEKHEIKTPLKMRTNGITNYIINTKRSLYLDNDVREFLITTGKIADYTSKSKMMLGVPLMLGKKIMGTLAIRSYNEKVNYTHHHLEILEFVADQITAVIAQKRSEHKLEKSLKEKETILQELHHRTKNNMQVIISMLSIQSKSANSDFIKDKFQEVSNRISTRSLAQEKRHNSHDISGINLRE

SEQ ID NO: 12703 - DNA, 720 bp, Unknown
  Obtained from environmental sample
  misc_feature (1)..(720): n is a, c, g, or t
ttgtcgaaaaaactatttatagaaactttagggtgtgctatgaatgttcgagatacagaacatatcatagcagagctcaataaacatcaatcatactcacaaacgcaaaacttagaagatgccgatctcattattatcaatacttgttctgtaagagaaaaacctgttgcaaaactattttcagaacttggtgtatttaataaaaagaaaaaaactggtgcaaaaataggtgtgtgtggatgtactgcaagtcacttgggtgatgagattatcaaaaaagcgccctatgtggattttgttgttggggcgagaaatgtttctaaaatcgccgatgcagttctaaaaaaaggaactgttgagattgatataaataatgatgagacgaactatgattttgcagattatagaaactcactttatagagcaagtatcaatatctctttaggatgtgacaaaagctgtactttttgtattgttcctgcaacaagaggtgatgagataagtattcctagtgaacttatcttaaaagagatacaaaagtctgttgactctggggctgttgaagtatttcttttgggacaaaatgtccacaactatgggaaacactttagcgataaaactgaaaaaacaaactttacacactttttacaaatgattagtaaaattgaggggctaaaaaggattcgatttacctcaccacatcctttacatatgggatga

SEQ ID NO: 12704 - protein, 239 aa, Unknown
  Obtained from environmental sample
  DOMAIN (4)...(102): Uncharacterized protein family UPF0004
  misc_feature (1)..(239): Xaa is any amino acid
MSKKLFIETLGCAMNVRDTEHIIAELNKHQSYSQTQNLEDADLIIINTCSVREKPVAKLFSELGVFNKKKKTGAKIGVCGCTASHLGDEIIKKAPYVDFVVGARNVSKIADAVLKKGTVEIDINNDETNYDFADYRNSLYRASINISLGCDKSCTFCIVPATRGDEISIPSELILKEIQKSVDSGAVEVFLLGQNVHNYGKHFSDKTEKTNFTHFLQMISKIEGLKRIRFTSPHPLHMG

SEQ ID NO: 12705 - DNA, 510 bp, Unknown
  Obtained from environmental sample
  misc_feature (1)..(510): n is a, c, g, or t
ttgggacaaaatgtcaacaactatgggaaacactttagcgataaaactgaaaaaacaaactttacacaacttttacaaatgattagtaaaattgaggggctaaaaaggattcgatttacctcaccacatcctttacatatggatgatgagtttattgaagagtttgcttcaaatcctaaaatctctaaacagattcatgttccacttcaagctggtaatacaagagttctaaaagagatgaaaagaggatacacaaaagagtggttcttaaatcgttgtgaaaaaatacgaacacttgtaccagatgtaagaatctctacagatattattgtcgcatttccaggggaaagtgatgaggagtttttagatactcttgatgtgatggagaaggtaaaatttgatgctgtttttaacttcaaatattccccaagaccattaacaccagcgcaaaatatgccaaatcaaatagatgatgcaactgctacaaaaaggttacaaaggagtgattga

SEQ ID NO: 12706 - protein, 169 aa, Unknown
  Obtained from environmental sample
  misc_feature (1)..(169): Xaa is any amino acid
MGQNVNNYGKHFSDKTEKTNFTQLLQMISKIEGLKRIRFTSPHPLHMDDEFIEEFASNPKISKQIHVPLQAGNTRVLKEMKRGYTKEWFLNRCEKIRTLVPDVRISTDIIVAFPGESDEEFLDTLDVMEKVKFDAVFNFKYSPRPLTPAQNMPNQIDDATATKRLQRSD

SEQ ID NO: 12707 - DNA, 507 bp, Unknown
  Obtained from environmental sample
  misc_feature (1)..(507): n is a, c, g, or t
atgttagtgaaaataatttttcaaaaccaattaaattccctagcaaaacaaattttcgatattacacataagcatctagacatgatggagtgttcccgtcaagatttggcagtagctgcaaaactatatcctagcggaagtaatatacacttttactctaaaaataagcatagctactacttattacaaagtgcattggagtatggatttacacatcagcaaataatgcttatttcaactctatgtaaatatgctaaaagaaaacaaccttcagttagacatacacagaagtattatcagttacttcctgaaatggaaaccgttaatgcgctgagctacatactttctcttagtatttctcttcttgcacataaacctagaaatattgattttgaattaatgtttaaagagggagtgttaacaatagattctgatgaaactatgcgcctcgcgaaagaggctgtgaataagctagaaacagtagagaatttaaaagttaaattttaa

SEQ ID NO: 12708 - protein, 168 aa, Unknown
  Obtained from environmental sample
  misc_feature (1)..(168): Xaa is any amino acid
MLVKIIFQNQLNSLAKQIFDITHKHLDMMECSRQDLAVAAKLYPSGSNIHFYSKNKHSYYLLQSALEYGFTHQQIMLISTLCKYAKRKQPSVRHTQKYYQLLPEMETVNALSYILSLSISLLAHKPRNIDFELMFKEGVLTIDSDETMRLAKEAVNKLETVENLKVKF

SEQ ID NO: 12709 - DNA, 654 bp, Unknown
  Obtained from environmental sample
  misc_feature (1)..(654): n is a, c, g, or t
atgaacaatttaaaacagattttagcgattgtaatgttattaagtgtaacagcagtaacagctcaacaaacggcatatgttgccgcagaaagtggattatctcttagagaccaaccagacattagtgcaaaactattgagtaaattatcctatggtgaagccattggagttatagagaacacaaataaagaactcgttgtagtagatggtggtaaaaaggtcagtggcgaatgggtaaaagttgaaacccgaaaccatattggctatgtgtttaatggctatttatcgtcaacaaaaatttctaaaacgattagattggatttagacaaattgaatattgaaattaagaatttagcgactagcgactataaaagaacgcacaatttaaaacaacaagattccattacaattaatgtggatcttggagcttcaccggaaaaaaaacaaattgttcttgtggataatgattataagcatgtgagtatttttcaacgttacgaaaacagcatttcatttatgagtgcagatgcgcaatgcgactctaaggattggaaacattttgatttgggatggaaaccactaaaacaaactagatctaatacgtgtgaaactttagcctatacagaaaacgagcggaagaattttatgatctga

SEQ ID NO: 12710 - protein, 217 aa, Unknown
  Obtained from environmental sample
  SIGNAL (1)...(18)
  misc_feature (1)..(217): Xaa is any amino acid
MNNLKQILAIVMLLSVTAVTAQQTAYVAAESGLSLRDQPDISAKLLSKLSYGEAIGVIENTNKELVVVDGGKKVSGEWVKVETRNHIGYVFNGYLSSTKISKTIRLDLDKLNIEIKNLATSDYKRTHNLKQQDSITINVDLGASPEKKQIVLVDNDYKHVSIFQRYENSISFMSADAQCDSKDWKHFDLGWKPLKQTRSNTCETLAYTENERKNFMI

SEQ ID NO: 12711 - DNA, 816 bp, Unknown
  Obtained from environmental sample
  misc_feature (1)..(816): n is a, c, g, or t
atggaaatagtgcagaaatacactaacaacttccacgatgttactaaactgttcaacttaatttctccaagcatagaacctaccgctacaggacatatcatagagcaaattgaaatgattcaagacattataaaaaatggctatgcttatgaaataaatggttctgtatattttgatgtaaaaaaatatgctgaaaaatataattacggagaactttctggcagaaaattagacgaacttattgaaaatacccgggaagaactggaaggcggtacagataaaaagttctttgctgattttgctctttggaaaaaagcttctgaaaataccattatgaaatggccttctccttggggagttggagtgccgggttggcacttagaatgttctgtaatgagcaccaaatatttaggcaaatctttcgatatacatggtggtggtatggatttaaaatttccacaccacgaatgtgaaatcgctcaatcagttggtagtgggaacgaacatcctgtaaaatattggatgcacggaaatatgcttactgtaaatggaaccaaaatgagtaaatcattgggtaattctttcttacctttagaactaattactggtagccacccattattagaaaaaggctactcaccaatggtggttaaatttttcttcttacaagccaattacagaagtaccgtagatttttctaacgaagctttacaggctgccgaaaaaggatatgcaagaatgatagctgctgttgaaacattggacgaaattataccctcagctactacgtcatttgatattgatgcgtttgattaa

SEQ ID NO: 12712 - protein, 271 aa, Unknown
  Obtained from environmental sample
  DOMAIN (1)...(242): tRNA synthetases class I (C) catalytic domain
  misc_feature (1)..(271): Xaa is any amino acid
MEIVQKYTNNFHDVTKLFNLISPSIEPTATGHIIEQIEMIQDIIKNGYAYEINGSVYFDVKKYAEKYNYGELSGRKLDELIENTREELEGGTDKKFFADFALWKKASENTIMKWPSPWGVGVPGWHLECSVMSTKYLGKSFDIHGGGMDLKFPHHECEIAQSVGSGNEHPVKYWMHGNMLTVNGTKMSKSLGNSFLPLELITGSHPLLEKGYSPMVVKFFFLQANYRSTVDFSNEALQAAEKGYARMIAAVETLDEIIPSATTSFDIDAFD

SEQ ID NO: 12713 - DNA, 432 bp, Unknown
  Obtained from environmental sample
  misc_feature (1)..(432): n is a, c, g, or t
ttggacgttgcgcatgagcaaagttcaaaaaaatcattatataagcataatattattggttctgatattttatcaaataatttaaaaattgctcaagcaaatattgataatatttaccttggaaataaaattcagttaatacacaaacaatttcaggaatttattcctcctgaagaaaatggaattcttattgtaaatccaccttatggtgagcgcttgaaaaaaaaagaaatgaacaatttttacgctatgatcggagaaaggctaaaacacaagtttgcaggttatcaagtttggttgctaagcggtaatagtgaagctataaaatatattggacttaaaccttcgcggcgaattgctcttttaaatggttcaatcgaatgtacatatttaaacttttcaatgtatgaaggaagcaagaagaataaataa

SEQ ID NO: 12714 - protein, 143 aa, Unknown
  Obtained from environmental sample
  DOMAIN (5)...(132): Putative RNA methylase family UPF0020
  misc_feature (1)..(143): Xaa is any amino acid
MDVAHEQSSKKSLYKHNIIGSDILSNNLKIAQANIDNIYLGNKIQLIHKQFQEFIPPEENGILIVNPPYGERLKKKEMNNFYAMIGERLKHKFAGYQVWLLSGNSEAIKYIGLKPSRRIALLNGSIECTYLNFSMYEGSKKNK

SEQ ID NO: 12715 - DNA, 471 bp, Unknown
  Obtained from environmental sample
  misc_feature (1)..(471): n is a, c, g, or t
gtgacaaaaaaaatagattttttagctaaaacactttatggacttgaagaggttctttcaaaggaattagaacaacttggtgcacaagaaatacaaatacaaaaacgagctgtaagtttttctggcaataaggaattaatgtataaatcgaacttatatttacgaacagctttaaaaatactagtaccaatatataagtgcaaagtgaaaaacgaggatgaattatattcaaatgtaagaaatattgactggtcggagtatattgaagtaaatgacactattgctgttgatgctgttttgtattcacctaattttaatcattctcattatgcagcattaaaagtaaaagatgcaataattgaccagtttcgcgacaaaaccggcattagaccatcagtaaacattaaatcaccaaccttaaagaataaacccttcatatttcaaacaataactgccccaatttccccttga

SEQ ID NO: 12716 - protein, 156 aa, Unknown
  Obtained from environmental sample
  misc_feature (1)..(156): Xaa is any amino acid
MTKKIDFLAKTLYGLEEVLSKELEQLGAQEIQIQKRAVSFSGNKELMYKSNLYLRTALKILVPIYKCKVKNEDELYSNVRNIDWSEYIEVNDTIAVDAVLYSPNFNHSHYAALKVKDAIIDQFRDKTGIRPSVNIKSPTLKNKPFIFQTITAPISP

SEQ ID NO: 12717 - DNA, 369 bp, Unknown
  Obtained from environmental sample
  misc_feature (1)..(369): n is a, c, g, or t
gtggttatggctcgaatcaaatctgcttgggaaatagctttagaaaaaactgaaaacttgaatgttgaccttgataaaatcaaaaaagataaagaaataaaattaggaagaaaaatctgtggtttatatattaacgacattgattattctatggacaaatttaaaaatgtctatgaaaaagaagtagataaaactaatattaaagaagggattattaataatcttctattaaatttatctctccccaaagatttgttctttgatgacacaataaataaaattatcgacattataacttatttaaaaaaagatagtgaggatttagttatactcttaccccaattaaagaattctttaagccatacctaa

SEQ ID NO: 12718 - protein, 122 aa, Unknown
  Obtained from environmental sample
  misc_feature (1)..(122): Xaa is any amino acid
MVMARIKSAWEIALEKTENLNVDLDKIKKDKEIKLGRKICGLYINDIDYSMDKFKNVYEKEVDKTNIKEGIINNLLLNLSLPKDLFFDDTINKIIDIITYLKKDSEDLVILLPQLKNSLSHT

SEQ ID NO: 12719 - DNA, 789 bp, Unknown
  Obtained from environmental sample
  misc_feature (1)..(789): n is a, c, g, or t
gtgagggcaacatttctaaataaaaccaagacccttaacatcaatatcccattaggaaaaaccggacttgatcttaggttttatcccgaaggtggtaatttggtacaaggtattgcaaataaaattgcttttaattcaacagacaattatggaaacccaataaatatttgcgggactttaattaaccaaaatggtgatcacctaaaaaagctcaagagtaagcatgatggaatgggcatatttaatttagttcctcaacccaacgaaacatattatgtttcagtccaggatccaattttaaaaaatgcaatttatcaacttcctaaagcaactaaaagtggatatatattaagtgtggatagttgcataaacgaccaactatacgtagttattaatttaaccgatgatctgaagggaaaagaagtagagttaacgctttcaaatggaattgcaatagaatcattatttaatgcgagcttaaaaaagaaaactcaaatacgtatttcaacaaaggagtatccaattggaatatcaaccctgacacttcactcaaatggacttcctgttgccgagcgtctggtttttctaaacaagcataaaaaaattaaactggccgttgagactgacaaagaaatttatgctcctcgcgaaaaagttgaaattaccattaaagcaacagattttaatggtaagcccacttcggtgaatttatcattagccgtggcagatgagaatagaatcggcaatcaacaaaatatcctagctaatatgcttgtgagtagtcaatga

SEQ ID NO: 12720 - protein, 262 aa, Unknown
  Obtained from environmental sample
  misc_feature (1)..(262): Xaa is any amino acid
MRATFLNKTKTLNINIPLGKTGLDLRFYPEGGNLVQGIANKIAFNSTDNYGNPINICGTLINQNGDHLKKLKSKHDGMGIFNLVPQPNETYYVSVQDPILKNAIYQLPKATKSGYILSVDSCINDQLYVVINLTDDLKGKEVELTLSNGIAIESLFNASLKKKTQIRISTKEYPIGISTLTLHSNGLPVAERLVFLNKHKKIKLAVETDKEIYAPREKVEITIKATDFNGKPTSVNLSLAVADENRIGNQQNILANMLVSSQ

SEQ ID NO: 12721 - DNA, 504 bp, Unknown
  Obtained from environmental sample
  misc_feature (1)..(504): n is a, c, g, or t
atgaaaacaattactaaaattattatccgagaaattcaaagactaaaaagtcgggcttctgcttggattcttatttttataattccaactcttctctttttttatttaggttacatttatacgcaaggtacaattgaacatgtaaatattgctgtaaaaaacgaagatcactccaaattaagtagaaccatcctccagaatattgaagcttctcctaaactcaacatcatcaaattcttaaattcaagcgatgatcttgaatctgtttttattgataatccggaaatcaaaggagtctatctgatcccaaaagattttgaaaaaaatatttatcatggtgaacaaagtaaattactcgtttataccaattcatccaatattgtttatggcaatttattatataaagaagccgccacttttatcaatacagtttctgccggaatcaatttaaaaatgtttcaggcaaagggtattccttacaaaagagcaataaaaaatgggtaa

SEQ ID NO: 12722 - protein, 167 aa, Unknown
  Obtained from environmental sample
  misc_feature (1)..(167): Xaa is any amino acid
MKTITKIIIREIQRLKSRASAWILIFIIPTLLFFYLGYIYTQGTIEHVNIAVKNEDHSKLSRTILQNIEASPKLNIIKFLNSSDDLESVFIDNPEIKGVYLIPKDFEKNIYHGEQSKLLVYTNSSNIVYGNLLYKEAATFINTVSAGINLKMFQAKGIPYKRAIKNG

SEQ ID NO: 12723 - DNA, 348 bp, Unknown
  Obtained from environmental sample
  misc_feature (1)..(348): n is a, c, g, or t
atgatccaagaattagagttaaatgattttgatgtgattttttcctccatgactattcctcatattcatgatccacataaaataatgaagatatttaactttagtttaaaaatgggtggctatatatgtattgcagaccttgttactgaggatggaacctttcattctgagcatcctgattttgatggacataaaggttttgataaagaggtatttagtttggttttagaagagaatggttttcaagtaggatattataaaatagtttttactattgaaaaagaggtaaatggagaaaataaaaagtacccactttttttaacgattgctaaaaaaataaaagattaa

SEQ ID NO: 12724 - protein, 115 aa, Unknown
  Obtained from environmental sample
  misc_feature (1)..(115): Xaa is any amino acid
MIQELELNDFDVIFSSMTIPHIHDPHKIMKIFNFSLKMGGYICIADLVTEDGTFHSEHPDFDGHKGFDKEVFSLVLEENGFQVGYYKIVFTIEKEVNGENKKYPLFLTIAKKIKD

SEQ ID NO: 12725 - DNA, 543 bp, Unknown
  Obtained from environmental sample
  misc_feature (1)..(543): n is a, c, g, or t
atgacaactgatagagacgtcttagaagcattgcttagcgcctctacgttgaaagttcttcgcctattcatcaacaatgatgagcaaacctactatttgagagaggtggcaaaacttactcgagtccctcctgcgtccaccttccggatcattaatttactagttaagatagatatcatccgaatgcagcctattaagcgctttaaactctattctcttaatacagaaacccgctccttcctatatgacatattacaggataggaaatcggctgttgttgaatttgttaactctattaaggaattcgacggcgtagacatggtagttttgcatgggaaggaagataaagaccgtgctaacgttttagtgataggaaacaacttggatgtcgattctatgaagcgaaatgccctctatatctctgataagttccattttaacattattttacttactttaacccctgatcagtataatcaaatgtcctctatgggtctatatccgggtaagaaaaagatactttttgaagcggaaagtagctga

SEQ ID NO: 12726 - protein, 180 aa, Unknown
  Obtained from environmental sample
  misc_feature (1)..(180): Xaa is any amino acid
MTTDRDVLEALLSASTLKVLRLFINNDEQTYYLREVAKLTRVPPASTFRIINLLVKIDIIRMQPIKRFKLYSLNTETRSFLYDILQDRKSAVVEFVNSIKEFDGVDMVVLHGKEDKDRANVLVIGNNLDVDSMKRNALYISDKFHFNIILLTLTPDQYNQMSSMGLYPGKKKILFEAESS

SEQ ID NO: 12727 - DNA, 363 bp, Unknown
  Obtained from environmental sample
  misc_feature (1)..(363): n is a, c, g, or t
atggattttaagtttgatatagaagggggtaatttttcaaaagcgggtacagcttcaagtgacgttaagaaagtcttgaaaaagctaaatgttgacccaaagctgattaagagaattgttgtttcaatatacgaggcggaggtaaatgtagttgctcatgcctacgaaggtgagatgaatgtctcaatatttccagaaaagataattgttcgtattgttgataaaggacctgggattcctgatatagatcttgcaatgcaaaaaggatactcaacagcttcaccagaagttagagagatgggctttggagcaggaatgggtttgccaaatataaagaagaataccaacgaattgaatatttaa

SEQ ID NO: 12728 - protein, 120 aa, Unknown
  Obtained from environmental sample
  misc_feature (1)..(120): Xaa is any amino acid
MDFKFDIEGGNFSKAGTASSDVKKVLKKLNVDPKLIKRIVVSIYEAEVNVVAHAYEGEMNVSIFPEKIIVRIVDKGPGIPDIDLAMQKGYSTASPEVREMGFGAGMGLPNIKKNTNELNI

SEQ ID NO: 12729 - DNA, 867 bp, Unknown
  Obtained from environmental sample
  misc_feature (1)..(867): n is a, c, g, or t
atgccagtatatttagattttgaagaaccgatacagattttagaagaacaattagaggagcatttaaagcttcaagaagaaaaaggtgttgatacaactaagattgttaaagaaattcaaaagaaaataaaagatactcgtaaagagttatactccaacctaacaccttggcaaagagttcaggtttcaagacatccagaaagaccttatactttagcttatataaaacatattactgaaggaaattttgttgagttacatggtgatagaactgttaaagatgataaagcaatggttggtggttttgggatgatagatgggcaatctgttatgttaataggtcagcaaaaaggagttaatactaaaatgagacaatacagaaattttgggatgcctaatccagaaggatatagaaaggctctaagattaatgaagttggctgaaaaatttaataagcctgtaatttgttttgtagacactccaggtgcttttccaggccttgaagcagaagaaagaggacaaggggaagctatagcaagaaatttgtttgatatggctcaattaactgtaccaattatagtagttattattggagaaggcgcttctggtggagctttaggtattggggtaggagataaggtattaatgatggaaaatacatggtattctgttatttctccagagtcttgttcttctattttatggagaagctgggattttaaagagcaagctgctgctgcacttaaacttacatctactgatatgttagaaaacaaattagtggatggtgttaataaaaaacctggtgggtggtgcacatgctgctccaaaagaggctttttgattggaaaaaaaagaattccttaa

SEQ ID NO: 12730 - protein, 288 aa, Unknown
  Obtained from environmental sample
  DOMAIN (3)...(148): Acetyl co-enzyme A carboxylase carboxyltransferase alpha subunit
  misc_feature (1)..(288): Xaa is any amino acid
MPVYLDFEEPIQILEEQLEEHLKLQEEKGVDTTKIVKEIQKKIKDTRKELYSNLTPWQRVQVSRHPERPYTLAYIKHITEGNFVELHGDRTVKDDKAMVGGFGMIDGQSVMLIGQQKGVNTKMRQYRNFGMPNPEGYRKALRLMKLAEKFNKPVICFVDTPGAFPGLEAEERGQGEAIARNLFDMAQLTVPIIVVIIGEGASGGALGIGVGDKVLMMENTWYSVISPESCSSILWRSWDFKEQAAAALKLTSTDMLENKLVDGVNKKPGGWCTCCSKRGFLIGKKRIP

SEQ ID NO: 12731 - DNA, 522 bp, Unknown
  Obtained from environmental sample
  misc_feature (1)..(522): n is a, c, g, or t
atgagtgatttaatgtcaaaatttataccaatctgggagattgaaacccatttcaggtgtccggttatcggggcggtgttgtcggtggaaaaacacagacaaatcttaaaaaaatgcggatacaacgtcaaggaaatgaagccctacgaataccaccaacaggtgatgagcaagctttttgaagaaaacaacgtctccataaaagtgaacaactatttaagaagcaaagcccgaaaatatatggtggcggttcagggcaagtctgagcaagggatgcgaacactttggaaagaacaatcccttatagggaatgtcggtccgttaatgtatgccttggtttcctttgaggacagcagtgttgaactcctacatgaggtatacggtgaagttcacatgcaggcccatgccaacatgacacaaattcatgatatccggcaaaaactagcaactgcggatgagatcatattgagagaaaaaaataaggctgcccggaaaagagaagagatctcgagccgatcctga

SEQ ID NO: 12732 - protein, 173 aa, Unknown
  Obtained from environmental sample
  misc_feature (1)..(173): Xaa is any amino acid
MSDLMSKFIPIWEIETHFRCPVIGAVLSVEKHRQILKKCGYNVKEMKPYEYHQQVMSKLFEENNVSIKVNNYLRSKARKYMVAVQGKSEQGMRTLWKEQSLIGNVGPLMYALVSFEDSSVELLHEVYGEVHMQAHANMTQIHDIRQKLATADEIILREKNKAARKREEISSRS

SEQ ID NO: 12733 - DNA, 468 bp, Unknown
  Obtained from environmental sample
  misc_feature (1)..(468): n is a, c, g, or t
ttgaaaggagagtctttttctgatgttttattaggtgcagatgcagatgaattgggaagattaatagctagtaatgaaaaaatactagtaaaacttcatgggaaagcaactagtggaaaaaatagaattttaacggaagatgagtataatgaacattactttgatacagatagtttaaaaaaagctattgatactatttgttctaattcattactttttttaggatgtagtttaagttcagatagaactataaaaactatggttgaaattgtaaaagaaaaaggacacgaaaaggttccaagacattatgcttttataggtttgtatagtgaagatgagagagtatctagaacaaaggaattagcaaaggcaaatatatttcctatttggtatgatgcaaacggtaatcaagatgatagtattgaagctttaattttaaaattggctgatggaataatggagttataa

SEQ ID NO: 12734 - protein, 155 aa, Unknown
  Obtained from environmental sample
  misc_feature (1)..(155): Xaa is any amino acid
MKGESFSDVLLGADADELGRLIASNEKILVKLHGKATSGKNRILTEDEYNEHYFDTDSLKKAIDTICSNSLLFLGCSLSSDRTIKTMVEIVKEKGHEKVPRHYAFIGLYSEDERVSRTKELAKANIFPIWYDANGNQDDSIEALILKLADGIMEL

SEQ ID NO: 12735 - DNA, 363 bp, Unknown
  Obtained from environmental sample
  misc_feature (1)..(363): n is a, c, g, or t
ttgatttcattagttgtaaggcaaaaaagagaagggaaagggataacatggagaggaacatactatggcgataatatacaagaaagaggcatcaacattcttttaaatggtgcagagatcactttttatatgcaagatgacgattttaaagaaaaaattgaaaaacatgaaattacattttcaagtgatgataatatgcgagttctatttgatatcaaaggtacgttagatgcagataaatttcaaaattcaagtatctatataaaagaggtaaagaaattcaatgaagatataattgagcataagattaaaccctcaaaaataacgctagaaacaccagaagatcaaatgcgattattttaa

SEQ ID NO: 12736 - protein, 120 aa, Unknown
  Obtained from environmental sample
  misc_feature (1)..(120): Xaa is any amino acid
MISLVVRQKREGKGITWRGTYYGDNIQERGINILLNGAEITFYMQDDDFKEKIEKHEITFSSDDNMRVLFDIKGTLDADKFQNSSIYIKEVKKFNEDIIEHKIKPSKITLETPEDQMRLF

SEQ ID NO: 12737 - DNA, 750 bp, Unknown
  Obtained from environmental sample
  misc_feature (1)..(750): n is a, c, g, or t
ttgaaaataaccaatagggatagagtatttacagacaattcaaatgaggctacaagtgaagttacttttgtaacttcaaaacaaaataaaaactttgttcaaagtgcaaaagaaaacggatgtacacagtttataaaaagtagtgagttaaaaaactattttgatttttctactataaaagttgttggtattacaggtactaatggaaaaactacaacagcagctgctatttattctattcttttagatttgggatataaagttgctttacaaggtactcgtggcttttttatcaatgatgaaaaaattgaagattatagtttaactacacctgttcaaatatcaaattttctccatattcaaaaagctttagaaagagattgtgatttttttattatggaagtgagctcccatgctatagagcaaaatagaattgaaggtcttgattttgctttgaaaatccatacaaatatcactcaagatcatcttgattatcataaaacaattgaagaatatatcaaggtaaaaaatagctttttttctgatgaaagtatgaaacttatcaataaagatgataaaaatatcaagtttaatataaaaaacacttttgcctatggagctgaaaatccagcaacttataaagttactgcctatagtttaaagaatggacttcatgtagcgttacaacatttttctaatatgggtcattttagttctcctatgaagggattatttatggttataatttaa

SEQ ID NO: 12738 - protein, 249 aa, Unknown
  Obtained from environmental sample
  DOMAIN (1)...(249): Mur ligase family, catalytic domain
  misc_feature (1)..(249): Xaa is any amino acid
MKITNRDRVFTDNSNEATSEVTFVTSKQNKNFVQSAKENGCTQFIKSSELKNYFDFSTIKVVGITGTNGKTTTAAAIYSILLDLGYKVALQGTRGFFINDEKIEDYSLTTPVQISNFLHIQKALERDCDFFIMEVSSHAIEQNRIEGLDFALKIHTNITQDHLDYHKTIEEYIKVKNSFFSDESMKLINKDDKNIKFNIKNTFAYGAENPATYKVTAYSLKNGLHVALQHFSNMGHFSSPMKGLFMVII

SEQ ID NO: 12739 - DNA, 690 bp, Unknown
  Obtained from environmental sample
  misc_feature (1)..(690): n is a, c, g, or t
atgtctgaacttatgcaaagttctttacagccctcaatatcattgagtatcaatgatgatttaaaatctttttgtattaaaataggtgattctccatctttaatatttgaagaatcaatacaacaagagatggaaaaatttattgaaaagagatttgaagttgataaaaaaattgtagcacaaaaaactgcagatatcgcacgacttattagtcttatgaacaaatatcttagtgatgcaattgatagtagtaaatcaggttcaagtaatgtatcagatattaaagatgaaattcaatcaattaaaatatctggctcaacaaaagatgaacttaaccaacttcaaacaaaacttgttcaagcagctattactatagaaaatgagatgagtagtgttagtaaaaatttagaaactggaaaaaatgaagttattgttttagaaaataaggttaaaactctagaaagagaattagcagaggcaaaacttacaagtacaaaagattttttaactggtacacttaacagaaaaacatatgaagaagagattaaaaaatttgaaaatgaatttattagaaaaaatcaaaactatgcaattatcttttttgatattgaccattttaaaagtgttaatgacaactatggacacgaatgtggagatattattcttaaaacattctcctctttattataa

SEQ ID NO: 12740 - protein, 229 aa, Unknown
  Obtained from environmental sample
  misc_feature (1)..(229): Xaa is any amino acid
MSELMQSSLQPSISLSINDDLKSFCIKIGDSPSLIFEESIQQEMEKFIEKRFEVDKKIVAQKTADIARLISLMNKYLSDAIDSSKSGSSNVSDIKDEIQSIKISGSTKDELNQLQTKLVQAAITIENEMSSVSKNLETGKNEVIVLENKVKTLERELAEAKLTSTKDFLTGTLNRKTYEEEIKKFENEFIRKNQNYAIIFFDIDHFKSVNDNYGHECGDIILKTFSSLL

SEQ ID NO: 12741 - DNA, 495 bp, Unknown
  Obtained from environmental sample
  misc_feature (1)..(495): n is a, c, g, or t
gtggtggctggggtatattttgtatttataaatcaaaaaatggctgtcattaaaagaaaaaatgatagagctattatgatttttaatcctccatcaaacttacaattgggttttggttacaatatagttgtaaatagtattgatttatataatggattaaaagagattaaaaaaatatcagatattcaaaagttaaactctatagagaattattctaactattatatagatgctaatactattaatctttttgatataaaaaatcaaaataatattataaaaaatctaactggggtatatcaaaaaggttatttgtattttaaaaaaggaactaaagaggaaaaaataaaactctacttttacaaagagttacaaagaccaaaggacggtgaaaaaatcaccataacctccggtcacttaagtatatataaatcaaaaattcaaattgttttatatagtaaaaaagactttattaagcatgtccaagaaatttaa

SEQ ID NO: 12742 - protein, 164 aa, Unknown
  Obtained from environmental sample
  misc_feature (1)..(164): Xaa is any amino acid
MVAGVYFVFINQKMAVIKRKNDRAIMIFNPPSNLQLGFGYNIVVNSIDLYNGLKEIKKISDIQKLNSIENYSNYYIDANTINLFDIKNQNNIIKNLTGVYQKGYLYFKKGTKEEKIKLYFYKELQRPKDGEKITITSGHLSIYKSKIQIVLYSKKDFIKHVQEI

SEQ ID NO: 12743 - DNA, 729 bp, Unknown
  Obtained from environmental sample
  misc_feature (1)..(729): n is a, c, g, or t
atgcaatttgatgctacaaaagagagactagaaaataaatatggtgcaaaaaaatttattgtttattttcaatcatttacaaatacctatgctcccctagatactttaaagtcactttatgaaaaagctttgagctttgataatgtggtaggtttaagtataggtacacgaacagatagtatcacagaagaaactttagattatctacaaagtttatcaaaagataaagagatctgggttgagtacggaatacaatcaatttatgatgaaactctagaaaaaataaatcgtggacacacttttgcaaatattcaagagtggatacttaaaacaaaagatagaaatttgttagtttgtggtcatatgatatttggacttcctaacgaaacacaagagatgatgcttaaaggtgttaaagaatcactaaagctaggtatagattctattaaatttcatcctttgtatgtaacgaaaaatacactcttggcaaatgaatataagcagggagagtttaccccaataagtgaagaactttatgtaaatacccttgtgaagtctataaaaatgttacctgataatgtatcaatatcaagggtaacagcggggataaatgatagtaagttacttgatccctctgggtgtaataataagcctaaacaaatttataaaataaaacaagctttatttaaaagaggggttggatataccaaatggaaaattcctttaaga

SEQ ID NO: 12744 - protein, 243 aa, Unknown
  Obtained from environmental sample
  misc_feature (1)..(243): Xaa is any amino acid
MQFDATKERLENKYGAKKFIVYFQSFTNTYAPLDTLKSLYEKALSFDNVVGLSIGTRTDSITEETLDYLQSLSKDKEIWVEYGIQSIYDETLEKINRGHTFANIQEWILKTKDRNLLVCGHMIFGLPNETQEMMLKGVKESLKLGIDSIKFHPLYVTKNTLLANEYKQGEFTPISEELYVNTLVKSIKMLPDNVSISRVTAGINDSKLLDPSGCNNKPKQIYKIKQALFKRGVGYTKWKIPLR

SEQ ID NO: 12745 - DNA, 753 bp, Unknown
  Obtained from environmental sample
  misc_feature (1)..(753): n is a, c, g, or t
atggcaaaagagttaaaaccatattttaataaagataacctttttataataagcagtgatctatctcacttctgtgactacaaagatgcaaaaaagatagatactatgacaattaactcaatattaaaaaataactcaaatgagtttataaaacaaatagaagataataaaaatacacaaataaaaaatctcataacatccgcatgtggttcaagtgctatcttaacacttctgtttatgagtgaaaatgataaaagtttaatctataaactaataaaatacaaaaattcaggtgacagcatctatggcgatcaaaacagagttgttggatacagtgccatagcagttactaaaaaaagtgaggacaagtttatgctaaacagtgacgagaaaaagtttttgttaaacctagccagagagagtgttgagaactatattaaatttaataagatatcggtattaacagatttaagtctatcagataacttaagagtaaagtctggtgcctttgtaactttacataaagatggaaggttaagaggctgtatcggcacatttagagcagatactccgctatataatacaattcaacagatggcaatatcatcctcaactaaagatacaagatttaatcctgttactattgatgaattaagcactcttaattatgagatatcagttttaactcctatgaaaaagattaattctattgatgagattgtgttgggaaaaccatggaatatatatagttaa

SEQ ID NO: 12746 - protein, 250 aa, Unknown
  Obtained from environmental sample
  DOMAIN (129)...(245): AMMECR1
  misc_feature (1)..(250): Xaa is any amino acid
MAKELKPYFNKDNLFIISSDLSHFCDYKDAKKIDTMTINSILKNNSNEFIKQIEDNKNTQIKNLITSACGSSAILTLLFMSENDKSLIYKLIKYKNSGDSIYGDQNRVVGYSAIAVTKKSEDKFMLNSDEKKFLLNLARESVENYIKFNKISVLTDLSLSDNLRVKSGAFVTLHKDGRLRGCIGTFRADTPLYNTIQQMAISSSTKDTRFNPVTIDELSTLNYEISVLTPMKKINSIDEIVLGKPWNIYS

SEQ ID NO: 12747 - DNA, 726 bp, Unknown
  Obtained from environmental sample
  misc_feature (1)..(726): n is a, c, g, or t
ttgatgaaaaatgaggtttggttaatgaataagaaaaaagttcttgtggttgatgacgaaagtcgatttatttttttactcagtgctaatttgaaaaccgttggctatgaagttttcaaagccaataatggtgaagaagctatcaaagttttgatagataaacaacctgatattattcttttagatgcaatgatgccaattatggatggatttcaagctcttgaaaaaatcaggaaattttcctctgttccagttattatggtcacagcgatgggagaggaacatcaacgaatcgatggattaaatatgggcgctgatgattatattacaaaaccattttcagctgatgaattattagcccgtgtcaatgctgttttgcggagatctgagattcaacaatctaaccttggaaataaaattttcaaacatggtgatttgacaataaatatggagcgcgctgaagtttggcggggggaagaacaaaaactattatcgtctactgaatatcgtttgttattgatgtttataaacaatcttgggaaagtgctttcttctgaacaactgttgacatcggtttggggaaatgaatatcaaaatgatcgcgaaattttatgggtgtgtatatctcggttgaggcaaaaactagaggtaaatccaaaatctccaaaacatattacaactcgttctgggatggggtatatgatgcccaatgaagcccgagaatag

SEQ ID NO: 12748 - protein, 241 aa, Unknown
  Obtained from environmental sample
  DOMAIN (159)...(235): Transcriptional regulatory protein, C terminal
  misc_feature (1)..(241): Xaa is any amino acid
MMKNEVWLMNKKKVLVVDDESRFIFLLSANLKTVGYEVFKANNGEEAIKVLIDKQPDIILLDAMMPIMDGFQALEKIRKFSSVPVIMVTAMGEEHQRIDGLNMGADDYITKPFSADELLARVNAVLRRSEIQQSNLGNKIFKHGDLTINMERAEVWRGEEQKLLSSTEYRLLLMFINNLGKVLSSEQLLTSVWGNEYQNDREILWVCISRLRQKLEVNPKSPKHITTRSGMGYMMPNEARE

SEQ ID NO: 12749 - DNA, 543 bp, Unknown
  Obtained from environmental sample
  misc_feature (1)..(543): n is a, c, g, or t
gtgataatacaaaaaaccagacacaatattggatttagagttttggactcgctaataaaaaattcttcttcaccgtcaatagatctttttgccttcaataagaaaatagatggggaacttggcacaatttcagacaaagaaaaaatctaccttctaaaaccatcttcttttatgaatctttcgggcaaaccaatcgctactgctataaaatatttaggcatagatttagctaatatactaattgttcatgatgatattgatttaccatttggccaaattcgcttgtctaaaaattctggtcctggaggacacaatggcattaaatctgcaatcgaatacttacactcaaaagattttgcaagattaaaaatcggaatctcaacagcactctctagacaaaaaattccaactgaaaaatttgttcttggtaagttctcctcggaagaagaagatgaattagaaaaaattgtgctttcctcatgtgaatgtacaaaaagttttctaaaagacgggctagaaaaaacaatgaacaattttaattaa

SEQ ID NO: 12750 - protein, 180 aa, Unknown
  Obtained from environmental sample
  DOMAIN (1)...(180): Peptidyl-tRNA hydrolase
  misc_feature (1)..(180): Xaa is any amino acid
MIIQKTRHNIGFRVLDSLIKNSSSPSIDLFAFNKKIDGELGTISDKEKIYLLKPSSFMNLSGKPIATAIKYLGIDLANILIVHDDIDLPFGQIRLSKNSGPGGHNGIKSAIEYLHSKDFARLKIGISTALSRQKIPTEKFVLGKFSSEEEDELEKIVLSSCECTKSFLKDGLEKTMNNFN

SEQ ID NO: 12751 - DNA, 525 bp, Unknown
  Obtained from environmental sample
  misc_feature (1)..(525): n is a, c, g, or t
atggaaaaaatttatgtagcgaaacttggtaaaacagttggcttaaaagggcaacaaaaacttcacattgattcagactttcctgaacaattcaaaaaagatgcaaaatttataacagataaaaaacaagaactaactatagagtcatataatgatacaaatagtgtagtcaagtttatcggtatcgatactatagaagatgcaaaaaaattaacaaatagacaactttttacctcaatggaagatacaaaagagctttgtcaactaaaagacaaagagtatttttggtttgatatgatgaattgtgaaattatagaagaggatgtagttttagggaaagttgtggatatacaaagaatgcctttatcagattatcttttaattgatactgcaaaagagcttattgacaaaaaactttcaaatcaatttttaataccatatcttgatgattatataattaatgttgatataaataacaaaaaaataactacaaaaaatagttacctcatattagaaaatagctag

SEQ ID NO: 12752 - protein, 174 aa, Unknown
  Obtained from environmental sample
  DOMAIN (91)...(171): PRC-barrel domain
  misc_feature (1)..(174): Xaa is any amino acid
MEKIYVAKLGKTVGLKGQQKLHIDSDFPEQFKKDAKFITDKKQELTIESYNDTNSVVKFIGIDTIEDAKKLTNRQLFTSMEDTKELCQLKDKEYFWFDMMNCEIIEEDVVLGKVVDIQRMPLSDYLLIDTAKELIDKKLSNQFLIPYLDDYIINVDINNKKITTKNSYLILENS

SEQ ID NO: 12753 - DNA, 693 bp, Unknown
  Obtained from environmental sample
  misc_feature (1)..(693): n is a, c, g, or t
atgaccatattgccattacttgatatggaaagctttatagcaaataaactacatattaacagagataaagtctttaccactaatcaccacctttcacatatctcttctcatttgatatctaattttgatgaatcagttatactaagtattgatggcgtaggagaatatgaaactttaactatttacaaatctcaaaacaataacttatcaaaactcttttcaaaagaacttcctcactctgtaggtttattatatagtgcctttactgcttttttaggatttgaagtaaatgaaggtgaatataaagttatggggcttgcaagttatggaaaacctatatataaagataagatttatgaacttttaatgatagaaaatgatgacttttttatcaaagatggcttttttgactttaattctgtggatacactttatacaagtaaatttatagaaaagtttggaacagaaaaaatcggtagtgattatgatctcaacactgataaatattatgtagatatagcttcttcaatacaaagtgttactgaagacttagtactaatgtatatcaaaaaagctatagaaatgagtggtattaataacgtttgcttatgtggtggggttgctttaaactcagttgcaaatgaaaaagtaaaacaacagtataaaaatataaacttatttgttccaccctga

SEQ ID NO: 12754 - protein, 230 aa, Unknown
  Obtained from environmental sample
  misc_feature (1)..(230): Xaa is any amino acid
MTILPLLDMESFIANKLHINRDKVFTTNHHLSHISSHLISNFDESVILSIDGVGEYETLTIYKSQNNNLSKLFSKELPHSVGLLYSAFTAFLGFEVNEGEYKVMGLASYGKPIYKDKIYELLMIENDDFFIKDGFFDFNSVDTLYTSKFIEKFGTEKIGSDYDLNTDKYYVDIASSIQSVTEDLVLMYIKKAIEMSGINNVCLCGGVALNSVANEKVKQQYKNINLFVPP

SEQ ID NO: 12755 - DNA, 696 bp, Unknown
  Obtained from environmental sample
  misc_feature (1)..(696): n is a, c, g, or t
atgcatttttttccatataactattttcaaaatgtagatgatatttcaaaagttgatcaatttggttttagaattaatcaaaaaattgacaaaactaaaaagctaattattattttaggtggttcaggtagtcatgacttaaactcaatagataatgaaacaatcactactcaattaaataatttacttgatcccaaatatcaagttttaaactacagtttaccaggatatgtattgttaaatgagatgatactatatattcttatgataaaaaagctaaaaccatatatggtaataacatatgatggagttaatgatttcttaaatgggatacaaaatgataaaaagctagttacaaattataatttaaactatactcattacctagagaaagttgcatcaaaaatttatgaaaaaaacgtatcttctaatctctgtgcaactatagaagatgtagtcatctcgtatatagaaagaaaaaaacaattcgaagagttattaaacaatgatggtgtaaaatttatttctattttacaaccacttgtttatagtaaatcatcattatcacaacaagagattgatactcaaacaaatacttttttagatatatacaaaaaaattccagatgcttatcaattactaaataatttagatattgaaaatcatttagatttacacaaaatattagtcagttga

SEQ ID NO: 12756 - protein, 231 aa, Unknown
  Obtained from environmental sample
  misc_feature (1)..(231): Xaa is any amino acid
MHFFPYNYFQNVDDISKVDQFGFRINQKIDKTKKLIIILGGSGSHDLNSIDNETITTQLNNLLDPKYQVLNYSLPGYVLLNEMILYILMIKKLKPYMVITYDGVNDFLNGIQNDKKLVTNYNLNYTHYLEKVASKIYEKNVSSNLCATIEDVVISYIERKKQFEELLNNDGVKFISILQPLVYSKSSLSQQEIDTQTNTFLDIYKKIPDAYQLLNNLDIENHLDLHKILVS

SEQ ID NO: 12757 - DNA, 567 bp, Unknown
  Obtained from environmental sample
  misc_feature (1)..(567): n is a, c, g, or t
atgggaagtttggcaaggagaacagcactatttacataccatcccgtgactttgggacaaagtaatctatatcatgatattgaaaaggtacttctagtgttagaagagttagacatgaatgtattatttgtgtatgcaaatgctgacagtaatgggagagtgattaaccaaaagattgagtcattgtgccaaactgatccgcttaaatataaagtcgtcaagaatctcggacaatttaaatatttatatgcgatgaagtatgctgacttattgattggtaatacttcaagtggcatcattgaagcagctagttttaacaagccagttgttaatattggtgatagacaaaagggtagattacaaagtggaaatgtggttgggtgtactttagacacgcttaaagactcgatatcagtagcattgagtagtgagttcttggataaatgtaaagatattgaaaatatttatggaaatggctgtgccgcagatgtaattgtaaagacacttgaggaaaaagagatcttaatcaataaaacatttatagattcaaataaatacgttgtataa

SEQ ID NO: 12758 - protein, 188 aa, Unknown
  Obtained from environmental sample
  DOMAIN (1)...(170): UDP-N-acetylglucosamine 2-epimerase
  misc_feature (1)..(188): Xaa is any amino acid
MGSLARRTALFTYHPVTLGQSNLYHDIEKVLLVLEELDMNVLFVYANADSNGRVINQKIESLCQTDPLKYKVVKNLGQFKYLYAMKYADLLIGNTSSGIIEAASFNKPVVNIGDRQKGRLQSGNVVGCTLDTLKDSISVALSSEFLDKCKDIENIYGNGCAADVIVKTLEEKEILINKTFIDSNKYVV

SEQ ID NO: 12759 - DNA, 882 bp, Unknown
  Obtained from environmental sample
  misc_feature (1)..(882): n is a, c, g, or t
atgaactttttgccagatgtaaaaattggtggagaaattactttgccggaagcactgcaatgcgatggcaaaactgaaagtatgaaacttgaatcaatgataacacttaatggtaacggtagtattagtggtgcaattgaagatgtagttctaaaatgccctataaacattgggcttgcatcattctatatgaaaaaatctaaacttgaatttaaaaatgaagatggacaaaaaatttatttagatggaaatgctggagttaaatttactaatgacccaagacaaaaagaagttggtgagatatcagtaatttatgaagttctaaataacgaaattgttaaagttgaaggaaagattaaagaaaaatttacttgggatttatcaggagagaatccaacattttcatttgaagttgaagaagctatgatttctgatggcaaattagaaattgatggtcgtgcagaatttgttctagacgatggtgaaaagatgggtgtcactttcgataagtttacaatagatttggatgaatacacaattgaagatggaagagtaatttttgatgaattatttgcaatggtagtggaagaattagataatgacgaaattgcttttaaagcagtaagtaaagggaatataccccaaacggatacttttatttattatgaattacccgataagattgctctcgataaagatggatttactgtctcgggcaaaagcaaagcaattatgagatatcagggtaaaaagttagatgatttaacaacggattttagtgatgaatttgcattctccgctaaaacgtttcaaattttcaaaaggcaaaatgccaatatattttctaaaaaaaaaaccagtttgcatatttttaatgccgga

SEQ ID NO: 12760 - protein, 294 aa, Unknown
  Obtained from environmental sample
  misc_feature (1)..(294): Xaa is any amino acid
MNFLPDVKIGGEITLPEALQCDGKTESMKLESMITLNGNGSISGAIEDVVLKCPINIGLASFYMKKSKLEFKNEDGQKIYLDGNAGVKFTNDPRQKEVGEISVIYEVLNNEIVKVEGKIKEKFTWDLSGENPTFSFEVEEAMISDGKLEIDGRAEFVLDDGEKMGVTFDKFTIDLDEYTIEDGRVIFDELFAMVVEELDNDEIAFKAVSKGNIPQTDTFIYYELPDKIALDKDGFTVSGKSKAIMRYQGKKLDDLTTDFSDEFAFSAKTFQIFKRQNANIFSKKKTSLHIFNAG

SEQ ID NO: 12761 - DNA, 726 bp, Unknown
  Obtained from environmental sample
  misc_feature (1)..(726): n is a, c, g, or t
ttggaaaacaatgaacttataggaatctttgaagttataacacacttcaactcaatatcaagagccttagaacagacaaaaagtgatactatcgtttttgcccataaaagatttttcaaaactgtgatttatccttttacaaataactttatagaagaatattatattgcaaatgtaaatgcaaaggagtatttaatagatttaattaaaaattatggtattgatgatattttagaaaataaagatgattttttaattttaaataatcattttatactaaattataaaatatatgattttgagaataaaaatataggatatattgttctttcaaaaaaacttcaagacatagatatttctgaaataaaaaagtttaaaactaattttatgtttaatataatttttacgcttgttattttattttttattttaacacttattttttattacttcttttcaaacaaaattatacttgaaaagaaaaaagctcaaaaaatacttgactcacaacaaaatattataatcttaacagatggtgaaaatctaaataatgcaaataaacaatttttaatcttttttgatcaatataaaaccatagaagattttaaattagatcataaatgtatttgtgagatgtttatagatttaaatgatgaaagttatctaatagaaaaagattatgtggcaaaaacgggcgagtcccagccaatcttttcttggtgntaa

SEQ ID NO: 12762 - protein, 241 aa, Unknown
  Obtained from environmental sample
  misc_feature (1)..(241): Xaa is any amino acid
MENNELIGIFEVITHFNSISRALEQTKSDTIVFAHKRFFKTVIYPFTNNFIEEYYIANVNAKEYLIDLIKNYGIDDILENKDDFLILNNHFILNYKIYDFENKNIGYIVLSKKLQDIDISEIKKFKTNFMFNIIFTLVILFFILTLIFYYFFSNKIILEKKKAQKILDSQQNIIILTDGENLNNANKQFLIFFDQYKTIEDFKLDHKCICEMFIDLNDESYLIEKDYVAKTGESQPIFSWX

SEQ ID NO: 12763 - DNA, 576 bp, Unknown
  Obtained from environmental sample
  misc_feature (1)..(576): n is a, c, g, or t
ttgctcccaagggcaattttttcttatattttggggaaggggccagggaactgtttaaataattcacaaagcatttattcagagaatgcttaccaaggatatcaaaaggggcttatcatacagaagcgattatgcaatccatcactggtggtggttggaggtattatgggaaggctggaaataaaggtggcaaaaatatcagtagggcttaatataaaacttcctgctgaacaaaaaataaataaatttgtaaaactatctttacaatttcgttactttttcacaagaaaagttacttttttaaaatactctgtaggatttgtagtaatgcctggtggctttggaactttagatgaactttcagaagctttatgtttagtacaaacaaaaaggatgggagctttccctattgtattatttggaaaagatttttttaaaccactagaagctttttttcaaacaatgttagaacacaactatattagtaaaaaagatttatcactttatctcattacagatgatattgatgaagcagttgaatatatcaaaaaaaactctataacaaatggacattaa

SEQ ID NO: 12764 - protein, 191 aa, Unknown
  Obtained from environmental sample
  DOMAIN (52)...(185): Possible lysine decarboxylase
  misc_feature (1)..(191): Xaa is any amino acid
MLPRAIFSYILGKGPGNCLNNSQSIYSENAYQGYQKGLIIQKRLCNPSLVVVGGIMGRLEIKVAKISVGLNIKLPAEQKINKFVKLSLQFRYFFTRKVTFLKYSVGFVVMPGGFGTLDELSEALCLVQTKRMGAFPIVLFGKDFFKPLEAFFQTMLEHNYISKKDLSLYLITDDIDEAVEYIKKNSITNGH

SEQ ID NO: 12765 - DNA, 849 bp, Unknown
  Obtained from environmental sample
  misc_feature (1)..(849): n is a, c, g, or t
atgggattgaagcttattattttatataattcgatatggaaaacttccgagatattatatccaaataaacactgtttagaaaaattgggtcccatcatgggaaaaacttgctatagtgccttacaaaaagacagaaaacaaccttgtgattactgtgatcttttagataataaataccctaaagagataggttcaacttataaatgggaacatcacaatactttaaacaataaacactatatttttagtgataaaataactctcataaatgatagaaaagtcaaagttcaaattggaataaatatcacgaaacaaaaagagttagaaacaaaaattcttgaacaaaaaactaaaaacatagaaacatttgaagctttatcaaactctacaatagagggattaatcatttatgatgaaaataaaaaatgtattagcacaaatagtgtagcccctgaactatttggctacgaagctcaagaaatgattggaaaaagtgcttttgaatttatagcatacgaatcagtaaatcatataaaaaatgtaataaataatcaaaaccaagaaccttatgaagctattatgttgagaaaagatggttcaaaatttcctgcaatattaagaggaagagatattcaacttgaaggtaaaaacataagagtttctgcagtaatggatataactaaaataaaagagaaagaggaagagatattacaacttgcttattttgattctttaacaactcttcccaatagaactttattagaagatagagcaagtaggcttatcaataaaaacaatagaaataaaaactacgcgtgctttaatgtttatagatttagacaattttaa

SEQ ID NO: 12766 - protein, 282 aa, Unknown
  Obtained from environmental sample
  DOMAIN (189)...(229): PAC motif
  misc_feature (1)..(282): Xaa is any amino acid
MGLKLIILYNSIWKTSEILYPNKHCLEKLGPIMGKTCYSALQKDRKQPCDYCDLLDNKYPKEIGSTYKWEHHNTLNNKHYIFSDKITLINDRKVKVQIGINITKQKELETKILEQKTKNIETFEALSNSTIEGLIIYDENKKCISTNSVAPELFGYEAQEMIGKSAFEFIAYESVNHIKNVINNQNQEPYEAIMLRKDGSKFPAILRGRDIQLEGKNIRVSAVMDITKIKEKEEEILQLAYFDSLTTLPNRTLLEDRASRLINKNNRNKNYACFNVYRFRQF

SEQ ID NO: 12767 - DNA, 372 bp, Unknown
  Obtained from environmental sample
  misc_feature (1)..(372): n is a, c, g, or t
ttgtatggtattgataaaatgaaaggttttatgcgttatgatgatgcttttaaaatatacaaagattttgaaaacaataggttaagcatatttaatttatgggaaggcaaaaaatacaaatctaatatattaaaatataaaaaagattatgacggacaccaccccacgcaaaagcctgtattattattagaagatttaataaagacttttagtaacgagaatgatttagtagttgatttaacaatgggtagtggttcaacaggtgtggcttgtaagaataccaatagagattttataggtattgaaatgaatgaagcatactttaaaatagctgaacaaaggataaataatattaaatacgaattgttttag

SEQ ID NO: 12768 - protein, 123 aa, Unknown
  Obtained from environmental sample
  DOMAIN (1)...(115): DNA methylase
  misc_feature (1)..(123): Xaa is any amino acid
MYGIDKMKGFMRYDDAFKIYKDFENNRLSIFNLWEGKKYKSNILKYKKDYDGHHPTQKPVLLLEDLIKTFSNENDLVVDLTMGSGSTGVACKNTNRDFIGIEMNEAYFKIAEQRINNIKYELF

SEQ ID NO: 12769 - DNA, 579 bp, Unknown
  Obtained from environmental sample
  misc_feature (1)..(579): n is a, c, g, or t
gtgaggagatgtagtttaattgctttctgttattttatggcaaaacttgaagatgttgagacaaaggggcaaaaaccaatcatatggattgatgatccaatttctagtctggatgggaatcatatattttttttatacagccttattaattcagagatcgtatctaaagaagtttatgaacagctatttatttcaactcataacttagattttcttaaatatctaaagcgattacctggtgcacataatgacaatcagaaaaaggaagagaagaaaaaatataggtttttaattatacaaagaaataatattaattcaaatatttatttaatgccagattttcttagagagtatatcactgaatttaattatttatttaatcagatttatcaatgttcaacaatttctagaatagatgattcaaatcatagttttttttataattttggaaataatgcacggaaattcttggaagtttttctgtactacaaatatcctgataatagttctcaatataaaaagatacaaacattttttggaggtgaaaagatacctgcaatacttacagatagggattaa

SEQ ID NO: 12770 - protein, 192 aa, Unknown
  Obtained from environmental sample
  misc_feature (1)..(192): Xaa is any amino acid
MRRCSLIAFCYFMAKLEDVETKGQKPIIWIDDPISSLDGNHIFFLYSLINSEIVSKEVYEQLFISTHNLDFLKYLKRLPGAHNDNQKKEEKKKYRFLIIQRNNINSNIYLMPDFLREYITEFNYLFNQIYQCSTISRIDDSNHSFFYNFGNNARKFLEVFLYYKYPDNSSQYKKIQTFFGGEKIPAILTDRD

SEQ ID NO: 12771 - DNA, 453 bp, Unknown
  Obtained from environmental sample
  misc_feature (1)..(453): n is a, c, g, or t
atgattcaaatcatagttttttttataattttggaaataatgcacggaaattcttggaagtttttctgtactacaaatatcctgataatagttctcaatataaaaagatacaaacattttttggaggtgaaaagatacctgcaatacttacagatagggattaataatgaatattctcatctttgtggtggtttagagcggggaggtttgccaataaaagttcctgaaatgaattcggctgcaaaattgattctggaaagaattgaatacttagatcgggcccaaaaaaaaaccttattgaaaaggattggggaaacaacaaagggaccaggaaccccccacaggcagccggcgaaagaagcggagacaccccccgggaccgaccaagacggatgcggctcgaagagaacgcggaaaaccggggttagcaaagacaccccacacgcggaataa

SEQ ID NO: 12772 - protein, 150 aa, Unknown
  Obtained from environmental sample
  misc_feature (1)..(150): Xaa is any amino acid
MIQIIVFFIILEIMHGNSWKFFCTTNILIIVLNIKRYKHFLEVKRYLQYLQIGINNEYSHLCGGLERGGLPIKVPEMNSAAKLILERIEYLDRAQKKTLLKRIGETTKGPGTPHRQPAKEAETPPGTDQDGCGSKRTRKTGVSKDTPHAE

SEQ ID NO: 12773 - DNA, 321 bp, Unknown
  Obtained from environmental sample
  misc_feature (1)..(321): n is a, c, g, or t
atgaatgcatttgaaaataaaaaacaatatatatttaaatttgaattagcaggtattgaaaaaaaagatatcaaagtttcaatttcaaatcaaaatatactagcaatcagtggtaagaaaaaatctcttacaaaagaggagcaaaaagatatgatacgacaagagcatttttatggttcatttagtagaaatatctctttaccagatgatattgatagagataatataaaagtgacttataaagatggtgtattaagtgtaactattaacaaagatttgaaaaaaactaaaaataaaacaaaaattcttactatagagtaa

SEQ ID NO: 12774 - protein, 106 aa, Unknown
  Obtained from environmental sample
  DOMAIN (2)...(106): Hsp20/alpha crystallin family
  misc_feature (1)..(106): Xaa is any amino acid
MNAFENKKQYIFKFELAGIEKKDIKVSISNQNILAISGKKKSLTKEEQKDMIRQEHFYGSFSRNISLPDDIDRDNIKVTYKDGVLSVTINKDLKKTKNKTKILTIE

SEQ ID NO: 12775 - DNA, 648 bp, Unknown
  Obtained from environmental sample
  misc_feature (1)..(648): n is a, c, g, or t
gtgaaggatcttcaatcgcttcatggtaaagctgataatatcaagcaagtatgttgcgatatgtccccagcttttattaaaggcgttaaggagaatctaagccaagccgaactaacatttgataaatttcatataattaagataatcaatgaagcagttgaccaggttcgcagagaagaagttaaaagtgaaattatcttaaaaaagagccgttatctgtttttaaagaatagagttaacctgactcaaaatgagagtacacgctttaccgctatatcattatctaagaagaaacttaaaacatttagagcttatatgattagagagagttttcaggagatttatgcttccagagatattgatgattttaaaattaatcttaaaaaatggtatttttgggcaacacatagtcagttaaagccaatgataaaagctgctaaaacaattaagtcgcactgggatggtgtggtaaactggatgaaatctaaaattagcaatggaatattagagggatttaattcaatggtacaagctgcaaaagcaaaagcaagaggatttaagaaattcgaatatttcagaacaattatctatctgcttttagggaaattagattttaagaaattgaataactattactcacccatttaa

SEQ ID NO: 12776 - protein, 215 aa, Unknown
  Obtained from environmental sample
  misc_feature (1)..(215): Xaa is any amino acid
MKDLQSLHGKADNIKQVCCDMSPAFIKGVKENLSQAELTFDKFHIIKIINEAVDQVRREEVKSEIILKKSRYLFLKNRVNLTQNESTRFTAISLSKKKLKTFRAYMIRESFQEIYASRDIDDFKINLKKWYFWATHSQLKPMIKAAKTIKSHWDGVVNWMKSKISNGILEGFNSMVQAAKAKARGFKKFEYFRTIIYLLLGKLDFKKLNNYYSPI

SEQ ID NO: 12777 - DNA, 351 bp, Unknown
  Obtained from environmental sample
  misc_feature (1)..(351): n is a, c, g, or t
atgttagaagagaatgaattaaaagagaagtgggaaaatattttaaaaatggtagaacatcgttttgatgaacaaatagatgaacaaaccatactttatattattggtttacaagaactcaataaaccccatagagttttccagaaagaagaaaaagtagatattatacatattggtatttgtactgttttaagccaatatggatattataggtttactggtagagatgatgatggttggccacattttaaaaatgtaaaaaaaataccatctaacaccaaaggacgaaagcaacttttattaatgcgaaaaggaattattgattattttgagaccctgaaaaaattgtaa

SEQ ID NO: 12778 - protein, 116 aa, Unknown
  Obtained from environmental sample
  misc_feature (1)..(116): Xaa is any amino acid
MLEENELKEKWENILKMVEHRFDEQIDEQTILYIIGLQELNKPHRVFQKEEKVDIIHIGICTVLSQYGYYRFTGRDDDGWPHFKNVKKIPSNTKGRKQLLLMRKGIIDYFETLKKL

SEQ ID NO: 12779 - DNA, 627 bp, Unknown
  Obtained from environmental sample
  misc_feature (1)..(627): n is a, c, g, or t
atgcttgattttcagtgggtattattgctttgggaaaagagtttttcaagcaaaaaggcaaacgggtttattgatgggtttacattcagcgatgaaagtatagacgggaaaagtaaaataaaggcatatgcgctgtttgaaagttcttttatcaacagcatagaggttgggactgccagaggattgcagcagatacatgcctatttgtttggcggtttgtatgattttgcaggacaaatcagacaaaaaaacatttcaaagggcggttttcaatttgcgatgtctctttatcttgatggcacacttaagaaaatagatgcaatgcccgaaaatacatttgatgaaatagtagaaaaatatgttgaaatgaatattgcacacccatttatggaaggcaatggcagaagcactcgtatctggttggatctgcaactgaaaaagtgcctgaaaaaatgcgttgattggagcaaaataggaaagacaaattatataaatgcgatggtggaaagcccgataaatagcagcgccttaaaaaaacttcttaaaaatgcgttaacctctaaaattgatagtagagaaatgtttatgaaaggaattgactattcatattactacgaagaaatctag

SEQ ID NO: 12780 - protein, 208 aa, Unknown
  Obtained from environmental sample
  DOMAIN (62)...(173): Fic protein family
  misc_feature (1)..(208): Xaa is any amino acid
MLDFQWVLLLWEKSFSSKKANGFIDGFTFSDESIDGKSKIKAYALFESSFINSIEVGTARGLQQIHAYLFGGLYDFAGQIRQKNISKGGFQFAMSLYLDGTLKKIDAMPENTFDEIVEKYVEMNIAHPFMEGNGRSTRIWLDLQLKKCLKKCVDWSKIGKTNYINAMVESPINSSALKKLLKNALTSKIDSREMFMKGIDYSYYYEEI

SEQ ID NO: 12781 - DNA, 402 bp, Unknown
  Obtained from environmental sample
  misc_feature (1)..(402): n is a, c, g, or t
gtgaagggcagcacctggggggataaacaaagatcgagcaaaatgacagatatgacacaggtacaaatagcagaagcattttcaaacggaaattttgaattgactttcccatatttatctaaaagcatagtttggaatgtagtcggagaaaatttgtttaatggaaaaattgaagtaattgagaattgcaaacaaacttcggagtatttcaaatctattgagacggactttaaaacagaagatgtaatagtagctaaagataaggtaataataaggggaacaggcgaatttataagagacggaaaaagagtaaatttaattactgcctgtgatgtttatgagttcaatagaaagggtgaattggagaatatttattcctattgtattcctgaaaataaataa

SEQ ID NO: 12782 - protein, 133 aa, Unknown
  Obtained from environmental sample
  misc_feature (1)..(133): Xaa is any amino acid
MKGSTWGDKQRSSKMTDMTQVQIAEAFSNGNFELTFPYLSKSIVWNVVGENLFNGKIEVIENCKQTSEYFKSIETDFKTEDVIVAKDKVIIRGTGEFIRDGKRVNLITACDVYEFNRKGELENIYSYCIPENK

SEQ ID NO: 12783 - DNA, 360 bp, Unknown
  Obtained from environmental sample
  misc_feature (1)..(360): n is a, c, g, or t
atgacagatatgacacaggtacaaatagcagaagcattttcaaacggaaattttgaattgactttcccatatttatctaaaagcatagtttggaatgtagtcggagaaaatttgtttaatggaaaaattgaagtaattgagaattgcaaacaaacttcggagtatttcaaatctattgagacggactttaaaacagaagatgtaatagtagctaaagataaggtaataataaggggaacaggcgaatttataagagacggaaaaagagtaaatttaattactgcctgtgatgtttatgagttcaatagaaagggtgaattggagaatatttattcctattgtattcctgaaaataaataa

SEQ ID NO: 12784 - protein, 119 aa, Unknown
  Obtained from environmental sample
  misc_feature (1)..(119): Xaa is any amino acid
MTDMTQVQIAEAFSNGNFELTFPYLSKSIVWNVVGENLFNGKIEVIENCKQTSEYFKSIETDFKTEDVIVAKDKVIIRGTGEFIRDGKRVNLITACDVYEFNRKGELENIYSYCIPENK

SEQ ID NO: 12785 - DNA, 714 bp, Unknown
  Obtained from environmental sample
  misc_feature (1)..(714): n is a, c, g, or t
ttgagtataacactcacttttgtacttgaaactcgtattgtagatgtatataaaataatgcaagaaaaaatctcaaaacgaatgtttatgaaactaggtagtacaccaacagctatgatggaacgttcagtagcaccacaggcaagagctatgctatcaacaactgctcagccaacttctactgagttgattaagcagatgtatgcacagggaacttgtacaaatgggtgggatgttgtttttaatatgggtcttgctcaaattaacagtgctttgaaagatcagtatgaagcacttaaaaaagatacaaaatataaaaataaaatagatgtagatactcaacaggagtatccaggtgtaacggtcattaataaatttacaataaattatggatatccacttttaacgtttagtgttaataatactaatagtgcaaccttgaatatggaaattataagcggtagtgtacagaggtgttcaaaaattggagataatgacgtagtttgtgccgatcctacagatattagcggtgaaaagttcactgctattattgatcttggcaaagtagctggaaaaacaaagatagatggttcagtacatgatgtactaagagtagagctagatatggctaaaggagcttttagtatcagtaatattgatctagatgatgaaacaaaagtagagtttaatcaagctgtaaaagcatacttgtaa

SEQ ID NO: 12786 - protein, 237 aa, Unknown
  Obtained from environmental sample
  misc_feature (1)..(237): Xaa is any amino acid
MSITLTFVLETRIVDVYKIMQEKISKRMFMKLGSTPTAMMERSVAPQARAMLSTTAQPTSTELIKQMYAQGTCTNGWDVVFNMGLAQINSALKDQYEALKKDTKYKNKIDVDTQQEYPGVTVINKFTINYGYPLLTFSVNNTNSATLNMEIISGSVQRCSKIGDNDVVCADPTDISGEKFTAIIDLGKVAGKTKIDGSVHDVLRVELDMAKGAFSISNIDLDDETKVEFNQAVKAYL

SEQ ID NO: 12787 - DNA, 684 bp, Unknown
  Obtained from environmental sample
  misc_feature (1)..(684): n is a, c, g, or t
gtgatttatactagtgaagtagctatttttaacgatacgatttattttactcgattaaaagaacctttcatagcaaaagatgctgaaggaaacataatcaatgtttctatgatgggagtggaacaattacctgttaatatgaaagtaggaactactcttgttccttatcatgattatggtgttagcactccaaaacattctacttatactgcagaaagaaaagaacatgtaggtaccacttatagtttaccctatttagattacttaggtagaacttgtagaaccgttacacaccgttataaaactatttctgctgaagtaaaaaaagaagaaacaccctatatgcattctattcataatgttgaaagtgaaataactaaaatagaagaaatagaatttaatggcaaaaagtataatgcttacttaatagaatcaatgacttggtcaaaatttggaacagacatacagtttgaatctgcagatgctaaaattcaaaaacaacaaattaaaaacaatgaaaaagttgaaaaactactcaataaagccatgggcacaaacgatttaggctatttgcaaatgtttgttcaaaaatggtatgttccagaacttggtgttgtaaaacaaattaattatgaccataacggagctattttaacaacaactcagttaatctcaattcaataa

SEQ ID NO: 12788 - protein, 227 aa, Unknown
  Obtained from environmental sample
  misc_feature (1)..(227): Xaa is any amino acid
MIYTSEVAIFNDTIYFTRLKEPFIAKDAEGNIINVSMMGVEQLPVNMKVGTTLVPYHDYGVSTPKHSTYTAERKEHVGTTYSLPYLDYLGRTCRTVTHRYKTISAEVKKEETPYMHSIHNVESEITKIEEIEFNGKKYNAYLIESMTWSKFGTDIQFESADAKIQKQQIKNNEKVEKLLNKAMGTNDLGYLQMFVQKWYVPELGVVKQINYDHNGAILTTTQLISIQ

SEQ ID NO: 12789 - DNA, 867 bp, Unknown
  Obtained from environmental sample
  misc_feature (1)..(867): n is a, c, g, or t
ttgaaagcgggaagcgctccatttttggggacttttagactcctacatagacggtaccatattcagagttttttttggtattttagtaaaacaataaaaaaaagtatttttttctcttctttttggaatagctgtagtactttaaatgataagacgcaaattattaatcaatatgaaactatgtttacttccttggtgaaagataaaggctttagcgtaggttcatttgtagaaaccaaaaaagttagaaactctttactatttgatggaatttacgtacctgaagatgaaattcttttttactcattgtggcactatgtaattgttaagtttaaagccccgtgcataaaaaaaaatatactttgcaactcacataaagattacaatcctttaacgtctaattggcatagcatcttaagtaatcatagtatctataggagcgcatatattgtaaaatatttaaaaaactgtaaaaaaaagaaattggagtctagctttaattggctaggagttttcaagcaactgattggagaaattagatcattaaggagtcagaattataaaattgttatttatggctattcctatgttggaaagttaattcattcgatcttaaaagaaaacgtggaatcaattattgacgctaattatgaatatttaaatgagattaattctttcaaaatacttcctccagataaaattttagatatagagtttgataaagttatgatttgtgcttttggccgagagagagacgttgtaaatcaattcagacaatatcgaattggtagggataagtttttaagcgtaaataattttatagatatagactctttagctttttcaattttattaccaacttgctga

SEQ ID NO: 12790 - protein, 288 aa, Unknown
  Obtained from environmental sample
  misc_feature (1)..(288): Xaa is any amino acid
MKAGSAPFLGTFRLLHRRYHIQSFFWYFSKTIKKSIFFSSFWNSCSTLNDKTQIINQYETMFTSLVKDKGFSVGSFVETKKVRNSLLFDGIYVPEDEILFYSLWHYVIVKFKAPCIKKNILCNSHKDYNPLTSNWHSILSNHSIYRSAYIVKYLKNCKKKKLESSFNWLGVFKQLIGEIRSLRSQNYKIVIYGYSYVGKLIHSILKENVESIIDANYEYLNEINSFKILPPDKILDIEFDKVMICAFGRERDVVNQFRQYRIGRDKFLSVNNFIDIDSLAFSILLPTC

SEQ ID NO: 12791 - DNA, 618 bp, Unknown
  Obtained from environmental sample
  misc_feature (1)..(618): n is a, c, g, or t
atggggacttacttccctactagatttgaccatttaaaactttntgataaatggttaaaaaaatatgagggttcaaaacagcaggtcatagaaattggagtaggaagtggtgttttgtcatttcaattaatccaaaatggttttgaaaatatctttgcaacagatacaaacaaaaatgcaatcattggtgttgcccaagaaagtaaaagattaggttatgaagagaatattagacttaatcatggtgatttatttgaaaattgtgatatcaaagctgatttgattgtttttaatcctccatggttacttgcaaaacacaaattagaagagggcatagacaaagccatatattttgaagaagaactttttccaagattttttgaagaagcattaaaacatcttaatcctgaggggaaaatagttttgatattttcaaatttagcacaagtagtagatgaagagagtactcatcctataatagaagaactacgtaataataatcgttttagaaaagagttacatcttagacgtgatgtgagagcttcatctaaaagaacaaagcgtactgattcaagagagaatgaaaaagttgaattatgggttttagcacctaaataa

SEQ ID NO: 12792 - protein, 205 aa, Unknown
  Obtained from environmental sample
  misc_feature (1)..(205): Xaa is any amino acid
MGTYFPTRFDHLKLXDKWLKKYEGSKQQVIEIGVGSGVLSFQLIQNGFENIFATDTNKNAIIGVAQESKRLGYEENIRLNHGDLFENCDIKADLIVFNPPWLLAKHKLEEGIDKAIYFEEELFPRFFEEALKHLNPEGKIVLIFSNLAQVVDEESTHPIIEELRNNNRFRKELHLRRDVRASSKRTKRTDSRENEKVELWVLAPK

SEQ ID NO: 12793 - DNA, 843 bp, Unknown
  Obtained from environmental sample
  misc_feature (1)..(843): n is a, c, g, or t
ttgaatgttaagtttaagaattatttacatgagctacttttaagatttaaaaaaaataagggactttggtttactacaattacaactctcgctgtatttggtatagttatagcgatgtatatcattatgattatgacaagtaatgtatctgaaaaagtatatcaaagtatggcaaaagattatcgtataaaagttacaactttatttgatagtaaagaattagagtttaaaaaaatgatttcagttatagaggaaaataaacctttattagctcaaattgagcaaaaccaagaacaagagattttggtatctcaaaaagctatcaatgattcttttggcaaaaaaggtattaataactataaagtatcattttattctgttgctaataataaagagatatttcgttcaagtattatctctgtaattaaatctaaaaatacaatatatgggttagaggttatgtcagatggagtttttaatacttatttacaacctttaataaaagatggtaatgtatatggtgtgattgaggtaaaagagtctatccataattatagaaagatttttgaaagtttaaatgatgagtatgtttttttacttgataaaaaaatgttatcactaatttctatagatgcaaaaaatggaagatatagagatatgataaatgactatacagttgaacaaacattttatgatacaaaatttactgctatgattaaagatatagagaaagatgaatttaaacaaatgatccatgaaaattatgttatatctgggatttattatcgtacatataaaatgatcactgatattaatggtgctactataggtatgggatgctag

SEQ ID NO: 12794 - protein, 280 aa, Unknown
  Obtained from environmental sample
  misc_feature (1)..(280): Xaa is any amino acid
MNVKFKNYLHELLLRFKKNKGLWFTTITTLAVFGIVIAMYIIMIMTSNVSEKVYQSMAKDYRIKVTTLFDSKELEFKKMISVIEENKPLLAQIEQNQEQEILVSQKAINDSFGKKGINNYKVSFYSVANNKEIFRSSIISVIKSKNTIYGLEVMSDGVFNTYLQPLIKDGNVYGVIEVKESIHNYRKIFESLNDEYVFLLDKKMLSLISIDAKNGRYRDMINDYTVEQTFYDTKFTAMIKDIEKDEFKQMIHENYVISGIYYRTYKMITDINGATIGMGC

SEQ ID NO: 12795 - DNA, 459 bp, Unknown
  Obtained from environmental sample
  misc_feature (1)..(459): n is a, c, g, or t
ttggcgggaggtcggcgaaccggcaactggcggtgggaggacagcacgctgggaaacggagctgagcgttttgagagcgaggtgttaattcataggggggatgtgttatttattgactatgcattaaatgaccgtcaagtaggattagaaaaagcttatgaagcatggaatcaaatgattacagaggcaaaagaaaagggtattaaagtaatcttgttaactccctcgcctgatcaaaaggtggattactatttaccaaagaatgtattaaagaaacatactgaacaaattataaagctggcaaaagaaaatcaggtgggacttgttgatagttataaagcatttgaatttttatatgctgataaagaagaacttgccaaatatatgtcggaggtgaatcaccccaacgaaaaggggcgtgaattaattgcaaatgaaatagtaaagtgttttaaataa

SEQ ID NO: 12796 - protein, 152 aa, Unknown
  Obtained from environmental sample
  misc_feature (1)..(152): Xaa is any amino acid
MAGGRRTGNWRWEDSTLGNGAERFESEVLIHRGDVLFIDYALNDRQVGLEKAYEAWNQMITEAKEKGIKVILLTPSPDQKVDYYLPKNVLKKHTEQIIKLAKENQVGLVDSYKAFEFLYADKEELAKYMSEVNHPNEKGRELIANEIVKCFK

SEQ ID NO: 12797 - DNA, 441 bp, Unknown
  Obtained from environmental sample
  misc_feature (1)..(441): n is a, c, g, or t
atgagcactgaggagtttgagggaatagttttaatcgatgagattgaacttcatcttcatccaaaatggaaatataattttatgaaaaaactgagagatatatttccaaaaattcagtttattgtaactacacacagccctacagtcattttaggtgcaagtgaagaagcggtattttataaggtctataaagaggatggaaaagtagaaattacagatcaaatcatcaacaaaggctacacaaacaacactcttatctcttcacctctatttgatctggagacaatggcttcaagaaattatgatgataaaaactttagtgatgatgattttatctatgaaaaaattcatcaagtagtagcagcaaaaatcaaagaagatagagatatgagtgaagaggaaatatcaaaattaattgaagaagaactgaaaaacttatga

SEQ ID NO: 12798 - protein, 146 aa, Unknown
  Obtained from environmental sample
  misc_feature (1)..(146): Xaa is any amino acid
MSTEEFEGIVLIDEIELHLHPKWKYNFMKKLRDIFPKIQFIVTTHSPTVILGASEEAVFYKVYKEDGKVEITDQIINKGYTNNTLISSPLFDLETMASRNYDDKNFSDDDFIYEKIHQVVAAKIKEDRDMSEEEISKLIEEELKNL

SEQ ID NO: 12799 - DNA, 390 bp, Unknown
  Obtained from environmental sample
  misc_feature (1)..(390): n is a, c, g, or t
atgattaaaatagataaagatcttgaaaatattccctctattttaaaaagtgaaagaagaaaagaggcttttcttaaaaacatttcagcatctaaatacgatgatggttcaaatctctataaagtaggttctgtagataaagtactatgggaactctataacaataaatgtgcatattgtgaaaaagatatttcagatgaagataaacatttagaacactatcgacctagagatatctactactggcttgcttatagttgggacaatttactactaagttgtggcaagtgtaacaagaaaaaaggcacagattttgaactaaatggagatagagtctcttaccgtggagagttatttgagaatattcatacttttagggaaagagtatga

SEQ ID NO: 12800 - protein, 129 aa, Unknown
  Obtained from environmental sample
  misc_feature (1)..(129): Xaa is any amino acid
MIKIDKDLENIPSILKSERRKEAFLKNISASKYDDGSNLYKVGSVDKVLWELYNNKCAYCEKDISDEDKHLEHYRPRDIYYWLAYSWDNLLLSCGKCNKKKGTDFELNGDRVSYRGELFENIHTFRERV

SEQ ID NO: 12801 - DNA, 642 bp, Unknown
  Obtained from environmental sample
  misc_feature (1)..(642): n is a, c, g, or t
ttggagattataaaaaagcctttggattttcaactaaaagagttagaaataagagaaaaagtattaggagataaaaatcctgatttagcaaaaaactataataatatctctacgatttaccgagttattggagagttagacagagccttagaatttcaacttaaatcattaaaaataggagaagaggtcttaggagataaagatcctactttaatgaaaagctataacaatatttccatgatttacatggataagggagagttagagaaagccttagaattcggacttaaatctttaaaaataggggaagaggttttagaaaataaacatcctgatttagctacaagctataacaatatctctatgatttatcaagatatgggagagttagagaaagccttagagtttcaactgaaatcattaaaaataaaagaagagctcttaggaggtaaacatcctgatttagctacaaattataacaatatctctgcaatttattatgaaattggagagttggaaaaagcaaaagaatttatagacagagctttaggtatattgcaagaagtttttccagatgggcatctaaatttagatactactatgaaaaatagagatctaatatatttcactaaacaaaattga

SEQ ID NO: 12802 - protein, 213 aa, Unknown
  Obtained from environmental sample
  misc_feature (1)..(213): Xaa is any amino acid
MEIIKKPLDFQLKELEIREKVLGDKNPDLAKNYNNISTIYRVIGELDRALEFQLKSLKIGEEVLGDKDPTLMKSYNNISMIYMDKGELEKALEFGLKSLKIGEEVLENKHPDLATSYNNISMIYQDMGELEKALEFQLKSLKIKEELLGGKHPDLATNYNNISAIYYEIGELEKAKEFIDRALGILQEVFPDGHLNLDTTMKNRDLIYFTKQN

SEQ ID NO: 12803 - DNA, 648 bp, Unknown
  Obtained from environmental sample
  misc_feature (1)..(648): n is a, c, g, or t
atggaaattaaaatgagagactcaaaaaagcatattcaaaatattcttattgcaacaagtgcggctattccaatagttggtggtcctttagctgtattagtagataaatatttaccagatgaactagaaaatagaaaaactcaactacttgagtctattgctaaagatcttgatcaatataaaattaatattactaaaatagaaagccctgaatttataactacttttttaaatgtttttcaaaaaagtattagtgaacatcgtaaagaaaaacttattgcctttagaaatattctaataaatgaagttatatctgactctaaggaatttgatgaattaacattttatatgagacttgttaatgatctaacagttgatcaaattagaatattacattatatttatcaatcggaattaacaggacactgtagtattaattgtaatactaacatttatcaagatattagtgataaatggcctgatatagataaatattatctacaagcttgtgtaacagaacttattaggttttttataatcagttctgctaaagatgttatttacaataatataaactctggtcatgctttaacagagtttggtaaaaggtttgttaactatatatttacaccaaatagtatggaatga

SEQ ID NO: 12804 - protein, 215 aa, Unknown
  Obtained from environmental sample
  misc_feature (1)..(215): Xaa is any amino acid
MEIKMRDSKKHIQNILIATSAAIPIVGGPLAVLVDKYLPDELENRKTQLLESIAKDLDQYKINITKIESPEFITTFLNVFQKSISEHRKEKLIAFRNILINEVISDSKEFDELTFYMRLVNDLTVDQIRILHYIYQSELTGHCSINCNTNIYQDISDKWPDIDKYYLQACVTELIRFFIISSAKDVIYNNINSGHALTEFGKRFVNYIFTPNSME

SEQ ID NO: 12805 - DNA, 642 bp, Unknown
  Obtained from environmental sample
  misc_feature (1)..(642): n is a, c, g, or t
atgttaaataagctaacacaaatgatattcggagatcgagacgagcgtgaagcaaaaaaaatgcaacccagaatctctgagataaatataatctacgatactctgaaagatctttcagatgatgcgatacgaggtcgagtaaaagagattaagcaagatattcagaatatacttctacctcttgaaaatgagttagatgaattgagcgagaaataccagaccgaacctgatgaagataaaaaaataagtttaggaaacaatatagatagtcttgcggttaatctaaaaaataaaactcaaactatacttgatgaacaattaccggaagtttatgcaatagttaaggatacgtgccgtcgtctggttggatatgaatatgaaatccgtggagataaagaaacctggttcatgatcccatttgatgtgcagcttattggtgctattgttctgcatgaagggaaaattacagaaatggcaactggagaaggtaaaacactggttgcaacaatgccactctttttaaacgccttattaggaaaaggtgtgcaccttattactgttaatgattatctggcacagcgtgatgctgaatggatgactccaatatttgaatttcatgggtttaactattggttggaataa

SEQ ID NO: 12806 - protein, 213 aa, Unknown
  Obtained from environmental sample
  DOMAIN (2)...(213): SecA DEAD-like domain
  misc_feature (1)..(213): Xaa is any amino acid
MLNKLTQMIFGDRDEREAKKMQPRISEINIIYDTLKDLSDDAIRGRVKEIKQDIQNILLPLENELDELSEKYQTEPDEDKKISLGNNIDSLAVNLKNKTQTILDEQLPEVYAIVKDTCRRLVGYEYEIRGDKETWFMIPFDVQLIGAIVLHEGKITEMATGEGKTLVATMPLFLNALLGKGVHLITVNDYLAQRDAEWMTPIFEFHGFNYWLE

SEQ ID NO: 12807 - DNA, 702 bp, Unknown
  Obtained from environmental sample
  misc_feature (1)..(702): n is a, c, g, or t
ttggctatagtagctaatgattacatattgtgtgtcattagtttgaaatcaaaaaacgatgcaatagaatcctttgcttcagaacttgctcaaaaagaccaagagatgagcgatatagttaaacattttataggaactatacatgatattaaaaatgtagtttcttctgtaaaaagttttgcagatattatccctgatgctgatacagaagaggagaaaaatgaatacctcgggtatatagattcttctgcaatgaaaggaatagatatgacttcacaaatcatgaacatgcttaaattagaatttttcgaggataagccagttataaaagagtttaatttgagaactctgatttccaagatagtgaagacaaatcaactttctgccaaaagagaaggagttctattaacggacacctacataaatatagatgtagatctcactattttaagcgatagcttaaaattagatcagattataacatatctggttacaaatggtataaagttctctaaatcgaatgtgagaattggtgttgaaatgagtaatgaaactacagacactatcggagtaatgtttaatatttatgatgatggaatcggtataccggaagaaaagatttcggagatatttaaacctttttatcanactgatttaaccataaaaaaaatgggagtggagtgggttaaatatagtctctaa

SEQ ID NO: 12808 - protein, 233 aa, Unknown
  Obtained from environmental sample
  DOMAIN (151)...(232): Histidine kinase-, DNA gyrase B-, and HSP90-like ATPase
  misc_feature (1)..(233): Xaa is any amino acid
MAIVANDYILCVISLKSKNDAIESFASELAQKDQEMSDIVKHFIGTIHDIKNVVSSVKSFADIIPDADTEEEKNEYLGYIDSSAMKGIDMTSQIMNMLKLEFFEDKPVIKEFNLRTLISKIVKTNQLSAKREGVLLTDTYINIDVDLTILSDSLKLDQIITYLVTNGIKFSKSNVRIGVEMSNETTDTIGVMFNIYDDGIGIPEEKISEIFKPFYXTDLTIKKMGVEWVKYSL

SEQ ID NO: 12809 - DNA, 774 bp, Unknown
  Obtained from environmental sample
  misc_feature (1)..(774): n is a, c, g, or t
atgggttttttattttttggggggagctttggtaaaattaatgttccggctatgtttttaaaaaatccaaaccaaaatgatttttgtatttttcccggaaaaaaccggagccgaatattttttttcaatagcattctccccttctcaaaatcaattataattcctaatacttgttcagtagtaaatcatcccgaagaaataaacaaaaccgttattgattttattcctgaagattattttaaaattttacatgttggtagtgttggtgctgacggtcatttctttacaacttttttaaacgctactaataaatttacagcaaatgataaaactgcttttatttttattggtagaaaaacgaatgaaattgacgattttctatcccaaaacaatttttcaaatgtacattttatagaaaccattccacacgaagagcttttgaaaatttatcctaaaattgatctaggaattatattatataagggtactaacttaaattttgaattttgtgctccaaacaagctttatgagttttggtctaatggaatccctgttttagctcatcaattaaaggggttaataccactatttacaaccgattttttaggagaacttactgattttaatgatgaagaaaaaattgtactttcgataactaaattgagaaatttgcccaaagaaaataaattgaccttaactaattattttaaaaaaaaacttgatgttgaaatttatatttctctactagaaaaacacatatataaactacaataa

SEQ ID NO: 12810 - protein, 257 aa, Unknown
  Obtained from environmental sample
  DOMAIN (66)...(239): Glycosyl transferases group 1
  misc_feature (1)..(257): Xaa is any amino acid
MGFLFFGGSFGKINVPAMFLKNPNQNDFCIFPGKNRSRIFFFNSILPFSKSIIIPNTCSVVNHPEEINKTVIDFIPEDYFKILHVGSVGADGHFFTTFLNATNKFTANDKTAFIFIGRKTNEIDDFLSQNNFSNVHFIETIPHEELLKIYPKIDLGIILYKGTNLNFEFCAPNKLYEFWSNGIPVLAHQLKGLIPLFTTDFLGELTDFNDEEKIVLSITKLRNLPKENKLTLTNYFKKKLDVEIYISLLEKHIYKLQ

SEQ ID NO: 12811 - DNA, 525 bp, Unknown
  Obtained from environmental sample
  misc_feature (1)..(525): n is a, c, g, or t
atgtataaagacaaaataaaaaatcaaatagcgttagctgaaaaatatggtgatgactacatttactcatcccaatggattccttttacaaatgatatcccaacaacttttccactaaaaactagtattgataaagattttgatagccctattgattggttaaccacttcttggttaaataaatcagggcaaacaggtatttggttaacccctaaaaaactaattgaacaagccggaaaatgggatgaaacattaaaggtaaatcaagatggcgaatatttttttagagtcttattaaaaagcaaaggagtaaagtttgttgataatgcctatctattttatcgaagagaaattagaacaagtattagcaataaacatatccctgaaagagctagttcaatgttacaatcatacattagttacgaaaaaatacttgacctaaaagataacgctgaagttagaaaagcattggcttttaactatgttaagtttatttatatatatcagaagaaagaaaaaaattga

SEQ ID NO: 12812 - protein, 174 aa, Unknown
  Obtained from environmental sample
  misc_feature (1)..(174): Xaa is any amino acid
MYKDKIKNQIALAEKYGDDYIYSSQWIPFTNDIPTTFPLKTSIDKDFDSPIDWLTTSWLNKSGQTGIWLTPKKLIEQAGKWDETLKVNQDGEYFFRVLLKSKGVKFVDNAYLFYRREIRTSISNKHIPERASSMLQSYISYEKILDLKDNAEVRKALAFNYVKFIYIYQKKEKN

SEQ ID NO: 12813 - DNA, 870 bp, Unknown
  Obtained from environmental sample
  misc_feature (1)..(870): n is a, c, g, or t
atggggcaaaaaatctctaaaggtcaggttatcgcagatggtccatctatggacaacggtgagttagcaattggagtaaatgcaacagtggcatttatgccatggaatggttataactacgaagatgctattatcctttctcaaaaacttattaaagaagatgcttttacttctgttcatatctatgaaaaagaggttgaggcaagagaattaaaacatggtaatgaagagattactagagatttaccaggtgttaagtctgaaaatcttgatcatttagatgagtcaggtattgttaaaatagggactcacttaaagccaggtatgattatggttggtaaagttacaccaaaaggtgaaattaaaccaactcctgaagagagactattaagagcaatttttggtgaaaaagcaggacatgttataaataaatctatgtactgttcagcttctatggaaggtgttgttgtagatgttaaagtattcactaaaaaagggtacgaaaaagatgagagagcagttgctacaattgaagctgaaaaaacaggtttagatattgaacatcatgataagttgatgatgttagatagagaagaaaacttaaaaatcaatgatattatctctaanagtgttttagaaaaagatgtagagattaatgataaagtttttaaaanaggtgaaaaaattacactagaagatttagaaaatgttaatagatttgcaatgaaaaaaagttatcccatccttttgggaaaagaaggttgcaaaaaccataataatggatgtaaaaagatccccttttatttaaagaaaaaaaaccaatttttaagaaagaaaaattcattggaaggaagaaaatttattccttaa

SEQ ID NO: 12814 - protein, 289 aa, Unknown
  Obtained from environmental sample
  DOMAIN (1)...(257): RNA polymerase Rpb2, domain 6
  misc_feature (1)..(289): Xaa is any amino acid
MGQKISKGQVIADGPSMDNGELAIGVNATVAFMPWNGYNYEDAIILSQKLIKEDAFTSVHIYEKEVEARELKHGNEEITRDLPGVKSENLDHLDESGIVKIGTHLKPGMIMVGKVTPKGEIKPTPEERLLRAIFGEKAGHVINKSMYCSASMEGVVVDVKVFTKKGYEKDERAVATIEAEKTGLDIEHHDKLMMLDREENLKINDIISXSVLEKDVEINDKVFKXGEKITLEDLENVNRFAMKKSYPILLGKEGCKNHNNGCKKIPFYLKKKNQFLRKKNSLEGRKFIP

SEQ ID NO: 12815 - DNA, 549 bp, Unknown
  Obtained from environmental sample
  misc_feature (1)..(549): n is a, c, g, or t
atgccaaatatgaatggggtatcacttttaaaagaaatcagaaaactcaatgaagatatccctttttattttacaactgcatattcagacgaaacttatttgatggaatcaataaaattaaatgttacatcatattttataaagcctgtagaaattgaaagtttattagaaaaagttagcaaagattgtcaaaaatataatcaaaaccaaattattcaaaatcaaaaaaatgaattagagagatatttacatgctatagataatgtagcaattgtttctaaaactgatttaaaaggtaatatcacatttgcaaatgacttcttttgtgaattagcaaaatattcaagagatgaacttctaggtcaacctcataatataattagacatccagattctccaaaagaggtttttaaaaatctttgggaaacaattcaaaaaggtaaaacctggaatggtaaaattaaaaatcttgcaaaagatggctctgtatattatgtaaatagtacagtaattcctatttttgatgatttgggaaaaagagattattga

SEQ ID NO: 12816 - protein, 182 aa, Unknown
  Obtained from environmental sample
  DOMAIN (80)...(142): PAS domain
  misc_feature (1)..(182): Xaa is any amino acid
MPNMNGVSLLKEIRKLNEDIPFYFTTAYSDETYLMESIKLNVTSYFIKPVEIESLLEKVSKDCQKYNQNQIIQNQKNELERYLHAIDNVAIVSKTDLKGNITFANDFFCELAKYSRDELLGQPHNIIRHPDSPKEVFKNLWETIQKGKTWNGKIKNLAKDGSVYYVNSTVIPIFDDLGKRDY

SEQ ID NO: 12817 - DNA, 669 bp, Unknown
  Obtained from environmental sample
  misc_feature (1)..(669): n is a, c, g, or t
atgcttgtaataggagctttaactcttttatcatttattataattagtgctatttttttgatggcacaaaaaaacatgatgcttttggaaaaaaaatcaaagttaactaatattgtcgaactttcatatggtttagttgaacatgaatataatgaattcaaagcaggtattatcgatgaacaaactgcaaaaacaaatgcaataaatgctattaaaaatctaagatatgatctgacaaattacatttggattaacgatgacacagaaccttttccaagaatgattatgcatcctatttctgaatctttaaatggtaaagttcttgatgataatatgtttgatagtgcttatagtttagagcatggcaatgtaattgaagagacaaataataaaaatatatttcaagcatttgcagaaatttcaaataaaagcggaaaaggctttgtaaaatatagctggactaaagcttcagaagatggaacagtctcaaaaacaaaatatccaaaactatcatttgtacaaaagtttgatgagtggggttgggttttaggtactggaatttatatcgatgatatagatacagagtttaataacagtattataaaagnttgtaataattatggcaataatattggctgttttaatgatttcattctcaatggtaagtaa

SEQ ID NO: 12818 - protein, 222 aa, Unknown
  Obtained from environmental sample
  misc_feature (1)..(222): Xaa is any amino acid
MLVIGALTLLSFIIISAIFLMAQKNMMLLEKKSKLTNIVELSYGLVEHEYNEFKAGIIDEQTAKTNAINAIKNLRYDLTNYIWINDDTEPFPRMIMHPISESLNGKVLDDNMFDSAYSLEHGNVIEETNNKNIFQAFAEISNKSGKGFVKYSWTKASEDGTVSKTKYPKLSFVQKFDEWGWVLGTGIYIDDIDTEFNNSIIKXCNNYGNNIGCFNDFILNGK

SEQ ID NO: 12819 - DNA, 858 bp, Unknown
  Obtained from environmental sample
  misc_feature (1)..(858): n is a, c, g, or t
ttggnntgggggtatattgatgacataaggcttaagtatattcttactgccctattttctgcaagtatggtatcatcgaatggagatgatgttactatcaaaataaatcctctctctaatgacaaacttcaatttattattcaaaatagagactctattttcaataaagaattactaagtacaatgtttgatccgtttgtgctatccaaaaaatttgaagcttctgagaatggtttaactggtttaagccttactcttgctcatagatatatcactttcctaaatggtgaaattaatgttaaacacaattcaaatgaaggggtaacttttaattttactataaaagcagatatgcataaatcaccactgaaagtagacttttcgaaattgccaaaaccaacaaaagagagaaataatatacttgttgtggaagatgattatgcaacttctaagttgttaagtaattatttaaataagtggggttacactccaactattgtaaatactggagatcagacaatgtctcaaattgcaaaagaaaaatttcttgcagttattttagacattgaaattccttcaatgaatggcttagagttactgaaaaaaataagagagcacgagaatgccaagaatgttcctgtaattgtctgttcggttgaacccgatgaacaaaaagcatatttgatgggagccgttgagtactttgtaaaaccaattaactataattatttagtagaagttttaacaagttataaactcagaaagaactccaatattctttgtgttgatgatgatgttccaactcctaaacttagtaaacaagctattgagaccgcaggttttatttgcataacctga

SEQ ID NO: 12820 - protein, 285 aa, Unknown
  Obtained from environmental sample
  DOMAIN (6)...(117): Histidine kinase-, DNA gyrase B-, and HSP90-like ATPase
  misc_feature (1)..(285): Xaa is any amino acid
MXWGYIDDIRLKYILTALFSASMVSSNGDDVTIKINPLSNDKLQFIIQNRDSIFNKELLSTMFDPFVLSKKFEASENGLTGLSLTLAHRYITFLNGEINVKHNSNEGVTFNFTIKADMHKSPLKVDFSKLPKPTKERNNILVVEDDYATSKLLSNYLNKWGYTPTIVNTGDQTMSQIAKEKFLAVILDIEIPSMNGLELLKKIREHENAKNVPVIVCSVEPDEQKAYLMGAVEYFVKPINYNYLVEVLTSYKLRKNSNILCVDDDVPTPKLSKQAIETAGFICIT

SEQ ID NO: 12821 - DNA, 876 bp, Unknown
  Obtained from environmental sample
  misc_feature (1)..(876): n is a, c, g, or t
ttgatcaagaaggcatcgnctttaaagatccataccgagcttttcagcgaacacctcaaaggcatacagccaaaatttgagatatttgtccaccatcctgagttcagcggccttcatctgcgcatgagcaagatcagccgcgggggtctgcgctggagcgaacggcatgaagactatcgaaccgagatcaaatcacttatgatcactcaagaaggtaaaaactccattatcgtacccgacggtgcaaagggcggatttatcatccataaagacaagtctgagataacaaaagagtattttcaagagatctacacggcttttatcaacaaccttttggatatggtcgacaatgtagtcgacggcaaagtcgtcacgcatgagaatatcatttcctatgatgaggatgatacctattttgtcgttgcagccgacaaaggaaccgccaatatgagcgatgtcgccaacggcatatccttgcaacgcaacttctggctcagagatgcctttgccagcggcggatcgaacggttttggacacaaagacctggggatcacggccaaaggtgccattatctcaacacagcgcttttttattgaaaaaggcgttgatttctacaaagaacctatctccgttgtcggattgggttccatgaacggagatgtctttggaaatggaatgatcgagtccaaagcctttaagcttcttgccgctatcagccacaaagagatctttgtcgaccccgatcccgaccctcagacttcatacgaagagagacagcgactctttagctccaaagacggctcatggagttcgtatgatcagaaacttatctccaaaggcggcggcgtctttttgcgctccgacaagtccatttga

SEQ ID NO: 12822 - protein, 291 aa, Unknown
  Obtained from environmental sample
  misc_feature (1)..(291): Xaa is any amino acid
MIKKASXLKIHTELFSEHLKGIQPKFEIFVHHPEFSGLHLRMSKISRGGLRWSERHEDYRTEIKSLMITQEGKNSIIVPDGAKGGFIIHKDKSEITKEYFQEIYTAFINNLLDMVDNVVDGKVVTHENIISYDEDDTYFVVAADKGTANMSDVANGISLQRNFWLRDAFASGGSNGFGHKDLGITAKGAIISTQRFFIEKGVDFYKEPISVVGLGSMNGDVFGNGMIESKAFKLLAAISHKEIFVDPDPDPQTSYEERQRLFSSKDGSWSSYDQKLISKGGGVFLRSDKSI

SEQ ID NO: 12823 - DNA, 849 bp, Unknown
  Obtained from environmental sample
  misc_feature (1)..(849): n is a, c, g, or t
ttgatttctacaaagaaccctatctccgttgtcgattggggttccatgaacggagatgtctttggaaatggaatgatcgagtccaaagcctttaagcttcttgccgctatcagccacaaagagatctttgtcgaccccgatcccgaccctcagacttcatacgaagagagacagcgactctttagctccaaagacggctcatggagttcgtatgatcagaaacttatctccaaaggcggcggcgtctttttgcgctccgacaagtccattgaactctccaaagagatcaagaagatgataggaacaaccaagcagcaactcagtggagaagagctggcgaaaaaactcctgtgtatgaaggtcgatatgctctttaacgggggtgtcgggacctatgtaaaaggctcggatgaaagtgatctggatcttggagacaaacaaaacgagagtgtccgtatcgatgcgaatgagctcaaagccttttgtgtctgtgaaggggggaacctgggtctgacccaacgtgcccgcatcgagtatgcactcggtggcggacgcatcaacctcgacgggatagacaactccgcaggtgtgaacatctcagaccatgaggtcaacctgaagatccttctcaacactatacaggccaaaggtcttataaacgaggaggagaggaataagacacttgccagcctgactgaacaagtcgtcaaacttgtcttatgggacaattataatcagagccttgccctctcaagagacgagaagctcagcagtatctatacgaaagattttacagaggcgatcaagatccttgaacagcatgtaagcgccttaaacgcaaagatttga

SEQ ID NO: 12824 - protein, 282 aa, Unknown
  Obtained from environmental sample
  misc_feature (1)..(282): Xaa is any amino acid
MISTKNPISVVDWGSMNGDVFGNGMIESKAFKLLAAISHKEIFVDPDPDPQTSYEERQRLFSSKDGSWSSYDQKLISKGGGVFLRSDKSIELSKEIKKMIGTTKQQLSGEELAKKLLCMKVDMLFNGGVGTYVKGSDESDLDLGDKQNESVRIDANELKAFCVCEGGNLGLTQRARIEYALGGGRINLDGIDNSAGVNISDHEVNLKILLNTIQAKGLINEEERNKTLASLTEQVVKLVLWDNYNQSLALSRDEKLSSIYTKDFTEAIKILEQHVSALNAKI

SEQ ID NO: 12825 - DNA, 816 bp, Unknown
  Obtained from environmental sample
  misc_feature (1)..(816): n is a, c, g, or t
atggtgatgactatggatgatattaaacaaatgagtgtaaaaattattgcattaacctcttttatatcattatttttaattttatttattatttggtttgtaaaacgacttattgtaccttatctttcaatatttgattcaattaaagatgtaatgaaacgagcacatacaggtgattatagtgcgagaattgatgaatttaatagtggtgaagcaaaaaatgtttcacattggataaatgagcatatgagtaaattgcaaaaaagtttagtaactattgaagataaaattgatatattcctaactgcacataaatcagaaactgtggaagaccctatgatggatgttcaaaatacagttgcaagactagcagatatttataagtttagaaaaacaatagaacatgatgaaagtattagtgatgtttataaaagaattgcaacggtacttgaggataaatttaaactagatgattttaatttcctagaagctgacactacaaataaaaaagttgaagttgtttatgttcataaagcactccaatgtgacccattagctaaaggatgtagagctgatagaacaaatacattagtagactcttgtcaattcaaaaaagtatgtagtgcaaataacgaggaaaatacttatctatgtatccccttattcctatatccaaagatatggaattttgttataacctataaataccgccatccaagagagggaaaatggaaaaatttaaggagaaaaatttcccctttttatacaaaaattaatgttaaattcctgccaaaacccggaaaatttgtaaagtaa

SEQ ID NO: 12826 - protein, 271 aa, Unknown
  Obtained from environmental sample
  misc_feature (1)..(271): Xaa is any amino acid
MVMTMDDIKQMSVKIIALTSFISLFLILFIIWFVKRLIVPYLSIFDSIKDVMKRAHTGDYSARIDEFNSGEAKNVSHWINEHMSKLQKSLVTIEDKIDIFLTAHKSETVEDPMMDVQNTVARLADIYKFRKTIEHDESISDVYKRIATVLEDKFKLDDFNFLEADTTNKKVEVVYVHKALQCDPLAKGCRADRTNTLVDSCQFKKVCSANNEENTYLCIPLFLYPKIWNFVITYKYRHPREGKWKNLRRKISPFYTKINVKFLPKPGKFVK

SEQ ID NO: 12827 - DNA, 486 bp, Unknown
  Obtained from environmental sample
  misc_feature (1)..(486): n is a, c, g, or t
atgggattatttaatagaaaatatttagaaagatatattgatggttctttatatagtggtatatataaaaatgtaccgtgtggactgatgatggttgatatagatttctttaaacttattaatgataattatggacatgatattggagatattgcaattaaaactatcgcaaatacacttatagacactacaacagacaaagatgtagttatacgatttggaggagaagagtttattgttatattaaatgattgtaatgaagaaaaacttcacgatacagctgaaaaaattagaatagctttttctcaacaaaaaattcaagcaggttctgaaatttttagtaaaactattagtataggtacagcattattcccgaataaagatcatagtttttggaaatatattaaacaaagtgatgtagcactgtatcaagccaaacattcgggtagaaataaagttgttagatatgaagaggggatggaataa

SEQ ID NO: 12828 - protein, 161 aa, Unknown
  Obtained from environmental sample
  DOMAIN (2)...(152): GGDEF domain
  misc_feature (1)..(161): Xaa is any amino acid
MGLFNRKYLERYIDGSLYSGIYKNVPCGLMMVDIDFFKLINDNYGHDIGDIAIKTIANTLIDTTTDKDVVIRFGGEEFIVILNDCNEEKLHDTAEKIRIAFSQQKIQAGSEIFSKTISIGTALFPNKDHSFWKYIKQSDVALYQAKHSGRNKVVRYEEGME

SEQ ID NO: 12829 - DNA, 822 bp, Unknown
  Obtained from environmental sample
  misc_feature (1)..(822): n is a, c, g, or t
gtgtattttaatgagggatttaattccagtcctatagtcaataatatggccattggtattgttccaaaagataagattattaccggaattgccagcggtatcggcaatcggattgcagtgttaggtgcattgaccggtaacgatgggattgataatgatgcctttgctgctgatgttgttagtcatatcgaaacgaaaaaggtgtcatttgatcagatgatggatgttagtattgagacgaaattgctctcagtcatccaggaatttattgacaagaactgtgtgattggtgttcaaactattggtggtcatggattgataggtgctgcagcagagatgacccaacgtggtaaatcagggatccggctcgacatggcgaaattagcatttagaggtgaaggattaactgccagagagttgttgttttctgaaacttgggggcgcatacttgtgtgttttactcctgataacgaaacgactatcaggaaaatcgctgaggttctcgacctttctttttctgtaattggcgaagtaattgatgagcctgtgctgaagtgttacgctggtgatgaaaagatggctgaaatacctgttgagtatgttggattaggagaaaatgctcctgtgtatganagagaatacagcaccaaaaaacacaaggcaaaatctattgatgttgaagctacccctgagcctgatcattatcctgatgtaataaagccaatgatgaataccttgaatattccctcaaagaagtggttaagtgatgtgtttgaaaagactttgcaaaaggaaagttcccatccaaaatttcccttctga

SEQ ID NO: 12830 - protein, 273 aa, Unknown
  Obtained from environmental sample
  DOMAIN (33)...(189): AIR synthase related protein, C-terminal domain
  misc_feature (1)..(273): Xaa is any amino acid
MYFNEGFNSSPIVNNMAIGIVPKDKIITGIASGIGNRIAVLGALTGNDGIDNDAFAADVVSHIETKKVSFDQMMDVSIETKLLSVIQEFIDKNCVIGVQTIGGHGLIGAAAEMTQRGKSGIRLDMAKLAFRGEGLTARELLFSETWGRILVCFTPDNETTIRKIAEVLDLSFSVIGEVIDEPVLKCYAGDEKMAEIPVEYVGLGENAPVYXREYSTKKHKAKSIDVEATPEPDHYPDVIKPMMNTLNIPSKKWLSDVFEKTLQKESSHPKFPF

SEQ ID NO: 12831 - DNA, 393 bp, Unknown
  Obtained from environmental sample
  misc_feature (1)..(393): n is a, c, g, or t
gtgaggggggaaaatgatattgccattgtgtttttttaccaaagctcaaggtttgccccggacagaaagcatcaaaaatcaattgacatggggaaagattcttttcctagtccagccgtttttgtatatacattgccaaatattgccatcggagaaattagtattaagtacaagttgttttctgaaaatagtttttttatatttgagaactttaatgcgcaacatttattggactattccaatagtttgttagcaacagaaaaaacagataaagtgctttgtggctgggtagaattagatggtgatcagtatgatgcttatttatatttggtgactaaaacaggaacaacaacacacaataaaaagaatataataaaattttataatacataa

SEQ ID NO: 12832 - protein, 130 aa, Unknown
  Obtained from environmental sample
  misc_feature (1)..(130): Xaa is any amino acid
MRGENDIAIVFFYQSSRFAPDRKHQKSIDMGKDSFPSPAVFVYTLPNIAIGEISIKYKLFSENSFFIFENFNAQHLLDYSNSLLATEKTDKVLCGWVELDGDQYDAYLYLVTKTGTTTHNKKNIIKFYNT

SEQ ID NO: 12833 - DNA, 852 bp, Unknown
  Obtained from environmental sample
  misc_feature (1)..(852): n is a, c, g, or t
atggaagagttaaatactttaaacaaaaaatggtcaactattgaaaagatagataataaaacagaacttattctaacaaataaggaacaaaactatttaaaaaacaaacaacatattactatgtgtattgatccctcttggatgccatttgaaagttttaaagatggtgagtatataggtatgacagcagattattttaagatatttataaatgattttaaactaccaataaaagttataaaaacgaccaattggactcaatctattgaatatgcaaaaagtagaaagtgtgatatattatcacttgtgatgaaaactccagaacgaactaaatatttaaattttacaacaccctatttaaaaataccattggttctagctacaaaacataatgtatcttttatctcagattttaaaaccttaacagatgaaaaaataggaataccaaaaggatatgcttttatagagttattaaaaacaaaatatcctaatatcaatataatagaggtaaaaaatctcaaagatggtttagaacaagttaatgaaggaaagctctttggatatatagggacactagcaagtgttggttatatgttccaaacccaatttacaggtgaattaaaaattgctggaaaatttgatgaaacttgggagttaggaattggagtaagaaatgatgaccctactttactaagtatattagaaagtggcgtaaaaaatattaaagaggaaactcatagagcaattttaaataaatggattgctataaaatatgaaaaaaaagttgactacacttttttatggcagatattatttgggatattttatttctcccctcttcataatctatag

SEQ ID NO: 12834 - protein, 283 aa, Unknown
  Obtained from environmental sample
  DOMAIN (39)...(256): Bacterial extracellular solute-binding proteins, family 3
  misc_feature (1)..(283): Xaa is any amino acid
MEELNTLNKKWSTIEKIDNKTELILTNKEQNYLKNKQHITMCIDPSWMPFESFKDGEYIGMTADYFKIFINDFKLPIKVIKTTNWTQSIEYAKSRKCDILSLVMKTPERTKYLNFTTPYLKIPLVLATKHNVSFISDFKTLTDEKIGIPKGYAFIELLKTKYPNINIIEVKNLKDGLEQVNEGKLFGYIGTLASVGYMFQTQFTGELKIAGKFDETWELGIGVRNDDPTLLSILESGVKNIKEETHRAILNKWIAIKYEKKVDYTFLWQILFGIFYFSPLHNL

SEQ ID NO: 12835 - DNA, 510 bp, Unknown
  Obtained from environmental sample
  misc_feature (1)..(510): n is a, c, g, or t
atgaacgaactattggcaactgcaattactgcatcaattaaggcaggtgaggaaatattaaatatatataataccgatttcaaagtagaatacaaaagtgatgaatcgccgttaactatggctgataaactagcacataatataataatgtcattccttgagcctacgcagattcctgttcttagtgaagaaggccgatcaataccatattcggaaagaaaagagtggtcgaagctatggattgttgacccacttgatggcacaaaagaatttgtgaagagaaatggcgagttcactgtaaacattgccctcattgaaaaccaaataccaattatgggagttgtttatgctcctgtactggatgaactatattttggtgattctgaaattggagcatacaaaatggaaaatgtgtcacttgggataatcaatacagtggatattatctctaactcaaaaaaaatcccaacaagaattataaaggattattttcaaataagttccaagtag

SEQ ID NO: 12836 - protein, 169 aa, Unknown
  Obtained from environmental sample
  DOMAIN (1)...(169): Inositol monophosphatase family
  misc_feature (1)..(169): Xaa is any amino acid
MNELLATAITASIKAGEEILNIYNTDFKVEYKSDESPLTMADKLAHNIIMSFLEPTQIPVLSEEGRSIPYSERKEWSKLWIVDPLDGTKEFVKRNGEFTVNIALIENQIPIMGVVYAPVLDELYFGDSEIGAYKMENVSLGIINTVDIISNSKKIPTRIIKDYFQISSK

SEQ ID NO: 12837 - DNA, 843 bp, Unknown
  Obtained from environmental sample
  misc_feature (1)..(843): n is a, c, g, or t
gtgcgtgatactgggataggcttgagtattaaagagcaaaaaagactctttcaatcattttcacaagcagatggcagtaccacaagaaaatatggtggcactggtttaggtcttaccataagcaaacaactagttgaactgatgaatggcaaaatctggttagagagtaatgtaggtgaaggaagtagctttgtttttgagatagagctacaagagagagaatatcatagatcgtacaatatttttagtgataaaaaggtattaatagtagatgataatgagtcatggcatgagattttaacgaataccttagagatatttaaattacaagtagatcatgcttatagtgcgaaagaggcagttaaaaaagctcatgagtgtgaaggtttttatgatcttattcttatggattggaacatgccagaaattgatgggatagaagcgactaaaatgattcaagtgatgtgcgttgaatgtagtaaaaaagagacctgcataaaactattgccacctgctgtgatcatggtaagttcatttagacaagagtctattatcaaattagcaaaagagataggtataaatatatttttacaaaaacctattaatccatcactattaaatgatatattaagcggagtatttttagaagatgttgatatgaaagagagtatcactgaggataaaaagagtttaaaaaatagtatcaacgctttaagaggtagtaaaatactgctaacagaagacaatagtacaaatcaagagataatattaggactcttggaaaatagtggtattgagatagatattgcacataatggaaaagaggccatttggatgttttaa

SEQ ID NO: 12838 - protein, 280 aa, Unknown
  Obtained from environmental sample
  DOMAIN (1)...(71): Histidine kinase-, DNA gyrase B-, and HSP90-like ATPase
  misc_feature (1)..(280): Xaa is any amino acid
MRDTGIGLSIKEQKRLFQSFSQADGSTTRKYGGTGLGLTISKQLVELMNGKIWLESNVGEGSSFVFEIELQEREYHRSYNIFSDKKVLIVDDNESWHEILTNTLEIFKLQVDHAYSAKEAVKKAHECEGFYDLILMDWNMPEIDGIEATKMIQVMCVECSKKETCIKLLPPAVIMVSSFRQESIIKLAKEIGINIFLQKPINPSLLNDILSGVFLEDVDMKESITEDKKSLKNSINALRGSKILLTEDNSTNQEIILGLLENSGIEIDIAHNGKEAIWMF

SEQ ID NO: 12839 - DNA, 699 bp, Unknown
  Obtained from environmental sample
  misc_feature (1)..(699): n is a, c, g, or t
ttgaaaagtgatattgatatgaccaaagcatctggcatgaatgagcatctaaataagcctatagatgtagagagactttatgcaactcttttaaaatatatagataaaaaagtgactgagtatgatttaaatattgatgatgaagatgatatagagattccggaattggagactattgataccaaagtaggattaatatatatgtccaataataagaagttatacttgaaaatcttaaatgattttttaaataactacaaagagctaaaattagaagatttaaatgatcaagagtttaaaatagccactcatacaattaaaggtttgagtgcaaatgttggtgctttatatctccacacgatagcaaacgatcttgatagaacgcaaaataagggttatttaaaatcatttaattatcaacttcatcgcttaattaaagagttagaacttaagctgcctacaaacacaaatgtacaagatgatgaaaaaaatcatatctcaaatgaaaaaaaagatgagctttttaaaagtttaaaagatgctgttgagactaaacgtccaaaaaattgtgatccaataattgagcaactagagagctacaaattaaacagcaaagacagtaatctttttaataaaataaaagttttacttaaaaagtataaatttaaagatattgaaaaactcttacatgaaggataa

SEQ ID NO: 12840 - protein, 232 aa, Unknown
  Obtained from environmental sample
  misc_feature (1)..(232): Xaa is any amino acid
MKSDIDMTKASGMNEHLNKPIDVERLYATLLKYIDKKVTEYDLNIDDEDDIEIPELETIDTKVGLIYMSNNKKLYLKILNDFLNNYKELKLEDLNDQEFKIATHTIKGLSANVGALYLHTIANDLDRTQNKGYLKSFNYQLHRLIKELELKLPTNTNVQDDEKNHISNEKKDELFKSLKDAVETKRPKNCDPIIEQLESYKLNSKDSNLFNKIKVLLKKYKFKDIEKLLHEG

SEQ ID NO: 12841 - DNA, 798 bp, Unknown
  Obtained from environmental sample
  misc_feature (1)..(798): n is a, c, g, or t
atgaatgataaaaaaacttcaaatattatttcgcaattaattaatattgaaaacaatcaagatacaagtatcgaatttacaattaatcaaaaaactaagattttaatttcttgtgtaggagagggagaaaacgaattgttatttgattacggttttctaatgtctggtaaggatacaatttggaaaatgaaatataacaaccgaatatgggcagggggagcttataaaaatatatttaatgtttctattttagatttagaagctggaaaatatattttacattatataagtgatgactctcattcatataataattggaacggatttaaaccgaaattcattgatttttatggctgcaagatattcaatatcaataatttaaacagcatagacacagttttgatagggaatggaataaatgaagaagttattgatcttttattaaccaaaaaacaagaattatgtttattaacacaaaaagggatatacacaagtaagaatagaattaaatttgatttatataaaattaattttaatgaaatatttaacaaaaaatcacgagtcctaaaattggtgaattttaaaaattattttttcattaacactatgtcaggaggtttattattcgacaacaatgaaaaaactatagaaatattaggtaatcgtttttggcaattaatatttgacaaaaaaaataattatatatgggattataaacctgatactattacgtgctatgatttgaataaaaaaaatggaatatccatacaatgtaaacaaaatagggaaaggatttag

SEQ ID NO: 12842 - protein, 265 aa, Unknown
  Obtained from environmental sample
  misc_feature (1)..(265): Xaa is any amino acid
MNDKKTSNIISQLINIENNQDTSIEFTINQKTKILISCVGEGENELLFDYGFLMSGKDTIWKMKYNNRIWAGGAYKNIFNVSILDLEAGKYILHYISDDSHSYNNWNGFKPKFIDFYGCKIFNINNLNSIDTVLIGNGINEEVIDLLLTKKQELCLLTQKGIYTSKNRIKFDLYKINFNEIFNKKSRVLKLVNFKNYFFINTMSGGLLFDNNEKTIEILGNRFWQLIFDKKNNYIWDYKPDTITCYDLNKKNGISIQCKQNRERI

SEQ ID NO: 12843 - DNA, 798 bp, Unknown
  Obtained from environmental sample
  misc_feature (1)..(798): n is a, c, g, or t
atgcaaaacaaattccaacaagttgttttgccttccgaaaaacttgctcaagaaattttggctgaacattttattcttttcaaacctcgcgatattgtcagcggagatttttattggataaaacagattaaaaatttcacaattgttgttgccgccgacagcacaggacacggcgttccaggtgcatttatgagtatgctcggaagttcatttttgaatgaaatcgtaaccagtcgccgactcgatagcactggcgaaatcctaaatcatctgcgcacaaaaataaaaaaatctctccgtcaagacgaaaacgaatcgaaagatggtatggatatggctttttatattgttgatagagagacacttgaacttcaattttctggtgcttacaatcctatttatattatcagaaataataaatatatcgacaataatagaattatagaaagtaaaaaagttaaaatttattctgatagccaatcatttaatcattcaattattgaactaaaagcagaccgtcagcctgtggcgacatatatcgttgaaaaaggatttgagacacaacgttttcaactacaaaagggagattgtttatatactttttcagatggttatccagaccaatttggcggagaaaaaagcgaaaaatttagagcgaaaaatttcagaaatttattactttcaatcgccgaaaaaccaatgtcagaccaacacaaaatactcgacaaaacttttgaagactggaaaggaaaattagaacaaattgatgatgttttggttatggggattcggatataa

SEQ ID NO: 12844 - protein, 265 aa, Unknown
  Obtained from environmental sample
  DOMAIN (43)...(264): Stage II sporulation protein E (SpoIIE)
  misc_feature (1)..(265): Xaa is any amino acid
MQNKFQQVVLPSEKLAQEILAEHFILFKPRDIVSGDFYWIKQIKNFTIVVAADSTGHGVPGAFMSMLGSSFLNEIVTSRRLDSTGEILNHLRTKIKKSLRQDENESKDGMDMAFYIVDRETLELQFSGAYNPIYIIRNNKYIDNNRIIESKKVKIYSDSQSFNHSIIELKADRQPVATYIVEKGFETQRFQLQKGDCLYTFSDGYPDQFGGEKSEKFRAKNFRNLLLSIAEKPMSDQHKILDKTFEDWKGKLEQIDDVLVMGIRI

SEQ ID NO: 12845 - DNA, 732 bp, Unknown
  Obtained from environmental sample
  misc_feature (1)..(732): n is a, c, g, or t
atgttgaaaccaaaggagattttggagttggacgagatgatagctataaaaaatcaattaccacttcagcgtgataaatatggtgatagtttagaaagtgttatcgaagcccaagaggttaaagtagcatacaaaaagcaagagattcaagataatcacatctatccttggtatgaaataaatcacttatttgctattatacctgcagagaaagattctgttgatttatacgaatatgattttgaagtttatcccaattacaccattaaggaggcgcatcaaaaattatcattaaagttatctaaaaaagagtttagggattttgaatcctttatagatcaagatccggtttatgagagtaatgactttaattgggcatacgatatgaatgctcggtattttcaacaagctattgctgcgctagaagctgaaaatgactataaggaggagttgctaagaacgatattaaaaatgtctgattacattgaagttaataatgaatttgatgaaaaggcctttacactacttttggtaaaagaatgggagtcagaaaatttaagcgatgtcttaaatgtgggttcgtatacagagttatcacctataattagtgaaatagatggggtagaaattattacaggatatgaaatattgcataaaatcaatgaaactgatgatgtgacttatcagtatattttcgatttnaactttgtgttattttcggttaaacaataa

SEQ ID NO: 12846 - protein, 243 aa, Unknown
  Obtained from environmental sample
  misc_feature (1)..(243): Xaa is any amino acid
MLKPKEILELDEMIAIKNQLPLQRDKYGDSLESVIEAQEVKVAYKKQEIQDNHIYPWYEINHLFAIIPAEKDSVDLYEYDFEVYPNYTIKEAHQKLSLKLSKKEFRDFESFIDQDPVYESNDFNWAYDMNARYFQQAIAALEAENDYKEELLRTILKMSDYIEVNNEFDEKAFTLLLVKEWESENLSDVLNVGSYTELSPIISEIDGVEIITGYEILHKINETDDVTYQYIFDXNFVLFSVKQ

SEQ ID NO: 12847 - DNA, 420 bp, Unknown
  Obtained from environmental sample
  misc_feature (1)..(420): n is a, c, g, or t
atggaagctactttaaaaaataattatatagatgtactctttactggtactaaagatattgaaaaaacgatggtcaaaggtgaatttatacaggttattacaaaccttataaataacgctaaagatgtatttaaagagagaaaaacaaaagaaccaaaaataatcattgaacttaaagagtatagggatgaaatacttgtaaccattgaagataatggtgggggaattgatgagaacattatagataagatttntgagccatatttcactacaaagcacaaaagtatgggtacaggtttaggactttatatttgtcataaaattatttgtgaaagttttgatggtgatttaagtgttcaaaatagctctgatggtgctatttttacaattgtaatacctcaggataataaaaaaaattaa

SEQ ID NO: 12848 - protein, 139 aa, Unknown
  Obtained from environmental sample
  DOMAIN (24)...(135): Histidine kinase-, DNA gyrase B-, and HSP90-like ATPase
  misc_feature (1)..(139): Xaa is any amino acid
MEATLKNNYIDVLFTGTKDIEKTMVKGEFIQVITNLINNAKDVFKERKTKEPKIIIELKEYRDEILVTIEDNGGGIDENIIDKIXEPYFTTKHKSMGTGLGLYICHKIICESFDGDLSVQNSSDGAIFTIVIPQDNKKN

SEQ ID NO: 12849 - DNA, 726 bp, Unknown
  Obtained from environmental sample
  misc_feature (1)..(726): n is a, c, g, or t
atgataattttaatagtacttggatttatgatattttttgtttataaagaatatctttcaaaaataaaagcaaaagtagaatcaaaaaacaatcaaaagattcttgactcacaaaattcgtttatagttataacagatggaacaagtataaaaagggtaaataatacttttctagaattttttggatatgaatcacttgatgagtttcaaaaacattatagctgtatatgtgatttttttcttgatgaaaaagggaaagggtacttacttaaagagatgaatggtttaaattggtttgagtatataaaacaaaatagagataaaaatattcaagtaaaaatggatgataaaaatcatcaatcccacatattttatatagaatttgatataaataatagaatgtatgataacaattatattatcacttttgtggatataacacacctaanaaatgtagaaaaccaacttttatcttctgaaaaaatggcatctttgggaaatatgataggaaatattgcacatcaatggagacaaccactctctgtaatatcaacagcagcaagtggtgtgcatatgaaacaacaatatggattactgcaagatggagatatagagaagaacatggactatattgtagaaaatgcaaaatatctttccgatactattgatacttttagagattttattaaagagaatgattataaagatttattagtggtagtgtaa

SEQ ID NO: 12850 - protein, 241 aa, Unknown
  Obtained from environmental sample
  DOMAIN (164)...(234): His Kinase A (phosphoacceptor) domain
  misc_feature (1)..(241): Xaa is any amino acid
MIILIVLGFMIFFVYKEYLSKIKAKVESKNNQKILDSQNSFIVITDGTSIKRVNNTFLEFFGYESLDEFQKHYSCICDFFLDEKGKGYLLKEMNGLNWFEYIKQNRDKNIQVKMDDKNHQSHIFYIEFDINNRMYDNNYIITFVDITHLXNVENQLLSSEKMASLGNMIGNIAHQWRQPLSVISTAASGVHMKQQYGLLQDGDIEKNMDYIVENAKYLSDTIDTFRDFIKENDYKDLLVVV

SEQ ID NO: 12851 - DNA, 396 bp, Unknown
  Obtained from environmental sample
  misc_feature (1)..(396): n is a, c, g, or t
atgttcaaagcaaagacaattatgacaactgaggtcatctcagtaacacctgatacccccataaacgatgcagcaaaaaaacttatagaacacaaaataagtgggttaccagtcatagatgcagataataatttagtaggtatattgtctgaaaaagatgtcctaaaccttttaatagctaccgattcaagcgtaaaagaaacagtaaaagattttatgactaaaaatgttttaaccttttcacctgaagacagtgcagttgaaatctgtgagtttttaatggataagccgtttagacgagtacctataacagaaaacggaaaattaattgggttaatatcgcgcagggatctaatacatctaattcttcagattcgtggagtaagcagcaaataa

SEQ ID NO: 12852 - protein, 131 aa, Unknown
  Obtained from environmental sample
  DOMAIN (71)...(123): CBS domain
  misc_feature (1)..(131): Xaa is any amino acid
MFKAKTIMTTEVISVTPDTPINDAAKKLIEHKISGLPVIDADNNLVGILSEKDVLNLLIATDSSVKETVKDFMTKNVLTFSPEDSAVEICEFLMDKPFRRVPITENGKLIGLISRRDLIHLILQIRGVSSK

SEQ ID NO: 12853 - DNA, 414 bp, Unknown
  Obtained from environmental sample
  misc_feature (1)..(414): n is a, c, g, or t
atgatattttttttactatttacatctttaataatctatttatttattgtttttaaaagagctaaaaaatacaaatataacacttcaaaagattatctatataatttagataaaaatctaatatcagaattagagattattaacaacactattaccctgccaaataactataatgaatttgattcactttttgtaaaaataaaactctcttttaatcctttatcatactttttaaaaccatttattagcataaaagagacaaaacatttttttgaatacggagcgcaaggcgataggtatttaaatatatctgatatacaagataataagataaagttcgttctaaaaaatctaagtctatcaacaaccgcagtagatttatatggatttaataacgagtgtaaactcatctaa

SEQ ID NO: 12854 - protein, 137 aa, Unknown
  Obtained from environmental sample
  misc_feature (1)..(137): Xaa is any amino acid
MIFFLLFTSLIIYLFIVFKRAKKYKYNTSKDYLYNLDKNLISELEIINNTITLPNNYNEFDSLFVKIKLSFNPLSYFLKPFISIKETKHFFEYGAQGDRYLNISDIQDNKIKFVLKNLSLSTTAVDLYGFNNECKLI

SEQ ID NO: 12855 - DNA, 645 bp, Unknown
  Obtained from environmental sample
  misc_feature (1)..(645): n is a, c, g, or t
gtgaataaaaaaactattttagaattatgcctttctccagacttgggtggacttgaactttatatgcttagagctgcgaaggctttaagagatgattttaatgttatcagcattattaataaaaactcaaagcttgaacaatattatgatgagaataacaaatatataaaaattaacaaagtttctaatctttttatgtttggtgcggcaagaaagttggctaagataatagatgcgcaagaagtagatgttatacatatgcactggacaaaagatattccttttgtggtgttagcaaaaattctttccaaaagaaaaccaaaaatagctcaaactagaaatatgacaatgactaggtttaaagatgacttttatcatagatttatgtataaaaatatagacttaatgcttcctgtaacttaccaagtaaaagagcagttagaaaagtttataccacaaaatatacaaccaaaaatagaagttttgtatatgggttcggataaacctgagatgctagatgaaaatgagctaagcaatttaaaatcagaattaaactttgatacaaatagttttaacattggactggttggacgtataaatgaagcaaaagggcagcatctccttatcaaagctgttgatatttag

SEQ ID NO: 12856 - protein, 214 aa, Unknown
  Obtained from environmental sample
  misc_feature (1)..(214): Xaa is any amino acid
MNKKTILELCLSPDLGGLELYMLRAAKALRDDFNVISIINKNSKLEQYYDENNKYIKINKVSNLFMFGAARKLAKIIDAQEVDVIHMHWTKDIPFVVLAKILSKRKPKIAQTRNMTMTRFKDDFYHRFMYKNIDLMLPVTYQVKEQLEKFIPQNIQPKIEVLYMGSDKPEMLDENELSNLKSELNFDTNSFNIGLVGRINEAKGQHLLIKAVDI

SEQ ID NO: 12857 - DNA, 681 bp, Unknown
  Obtained from environmental sample
  misc_feature (1)..(681): n is a, c, g, or t
atgtcaatttttactaaagtttttatactgttttctattagtattttgttgatgttgtacttatcaacaaaaacaaatgctataactgacgaaaaaatagaactaatacataaagagaaatatatacaagcctcaaaagaactttttaattatcttgtaaatggagatatgacaacattaaataaaagagttcaagagttaaattatgagaaaagaacattagatacaaatagtgaagatttttctactatatataaacaagctatctcctttggacaaataaaaatatttaaacaagatgatctatattttctttttatggaatatcttgatgataagttttatttttatgatagatctcaaaaaaaagggattgaacaaaaagagcatttaaattatcttatagtagttgatatagctatcttgattattatgtttttagtgatcattaatattttaagaccccttaaatctatatcaaaaggtattaaaaagtttggtagtggtgactactcttcaaggcttgacacatcaaattcaaaagatgagataggagaagttgttgatagatttaatacaatggctgacaatcttgaaagcttaataatagcaagaacccagtttttaaatgatattagtcatgaactaagaactccctcgagccgctcgagccgattctga

SEQ ID NO: 12858 - protein, 226 aa, Unknown
  Obtained from environmental sample
  DOMAIN (131)...(200): HAMP domain
  misc_feature (1)..(226): Xaa is any amino acid
MSIFTKVFILFSISILLMLYLSTKTNAITDEKIELIHKEKYIQASKELFNYLVNGDMTTLNKRVQELNYEKRTLDTNSEDFSTIYKQAISFGQIKIFKQDDLYFLFMEYLDDKFYFYDRSQKKGIEQKEHLNYLIVVDIAILIIMFLVIINILRPLKSISKGIKKFGSGDYSSRLDTSNSKDEIGEVVDRFNTMADNLESLIIARTQFLNDISHELRTPSSRSSRF

SEQ ID NO: 12859 - DNA, 825 bp, Unknown
  Obtained from environmental sample
  misc_feature (1)..(825): n is a, c, g, or t
ttgatacgtcggtatcgacacctggttatccaaaacgggcgtcacatagtagttgtcagtgcccccattataaatcggtcaaaaaaatatatcggtacggatttagtgctgatcgacctttatcaattaaaaaaaattatcagcagcaagacggattcggaaaagaactatgaaacaattttaggatatacatcggatggaatagcttctaaagccttcactgaaattaaaaatataaaaaatgatatgatgaacgatttgatgaaaagggcgttcaaaggccaggaggggatgagtgacgaatcatctgtttttgtggcagcatatcacggtctgaatatcgataactggggacttgttatcctgaaaaacaaagcagaattgtatagaaccttgaataccaggctcatttactggggtcttaccggtagttttgtgtatattgtatttcttgcaggatttcgttttttgatgaaacctctggcaagcaggctgttagtgcgatcagatgaattaaatgaaaaggttaaagaacaaacccgccactttgaagaagagataaaagaacggaaacgaaccgctgctgaattggaaaaaattattacagaacatagacagactgaaatcgcacttagtgaaagtgaacaaaaatatcggttgctggccaacaatgtgaccgatgttatctggtcagtagatatggacctgcactataactatatcagtcccctcattgaaaaaatacatgggtatacgccggaagaagtcatgggaatatcattcgaacaatcatttacgcatgctttccacccaaaaactaattga

SEQ ID NO: 12860 - protein, 274 aa, Unknown
  Obtained from environmental sample
  misc_feature (1)..(274): Xaa is any amino acid
MIRRYRHLVIQNGRHIVVVSAPIINRSKKYIGTDLVLIDLYQLKKIISSKTDSEKNYETILGYTSDGIASKAFTEIKNIKNDMMNDLMKRAFKGQEGMSDESSVFVAAYHGLNIDNWGLVILKNKAELYRTLNTRLIYWGLTGSFVYIVFLAGFRFLMKPLASRLLVRSDELNEKVKEQTRHFEEEIKERKRTAAELEKIITEHRQTEIALSESEQKYRLLANNVTDVIWSVDMDLHYNYISPLIEKIHGYTPEEVMGISFEQSFTHAFHPKTN

SEQ ID NO: 12861 - DNA, 390 bp, Unknown
  Obtained from environmental sample
  misc_feature (1)..(390): n is a, c, g, or t
atgtactctttactggtactaaagatattgaaaaaacgatggtcgaaggtgaatttatacaggttattacaaaccttgataaataacgctaaagatgtatttaaagagagaaaaacaaaagaaccaaaaataatcattgaacttaaagagtatagggatgaaatacttgtaaccattgaagataatggtgggggaattgatgagaacattatagataagatttttgagccatatttcactacaaagcacaaaagtatgggtacaggtttaggactttatatttgtcataaaattatttgtgaaagttttgatggtgatttaagtgttcaaaatagctctgatggtgctatttttacaattgtaatacctcaggataataaaaaaaattaa

SEQ ID NO: 12862 - protein, 129 aa, Unknown
  Obtained from environmental sample
  DOMAIN (14)...(125): Histidine kinase-, DNA gyrase B-, and HSP90-like ATPase
  misc_feature (1)..(129): Xaa is any amino acid
MYSLLVLKILKKRWSKVNLYRLLQTLINNAKDVFKERKTKEPKIIIELKEYRDEILVTIEDNGGGIDENIIDKIFEPYFTTKHKSMGTGLGLYICHKIICESFDGDLSVQNSSDGAIFTIVIPQDNKKN

SEQ ID NO: 12863 - DNA, 390 bp, Unknown
  Obtained from environmental sample
  misc_feature (1)..(390): n is a, c, g, or t
atggatcagtttattaaattttttttattggtatgttttgttgggacttttttaacagcccaagaatcaaagcttgataaaatattagcaacaaatacactcaaagtatgtatttggccagaatactatggtatctcatatttagataaaagaactcaaaaacttgtgggcatcgatagtgatttagcacacgagctagctaaagacttaaatgtaaagttggagtttgtacaaagttcatttgccaaacttattgatgatgtaaccaccacaaaatgtgatataccgatgtttgccataggaaacccacccatcaaaaagaaaaaaaattcgtttttacccacccccacatttatcctagtgagaaatatatgccaattccccacctaa

SEQ ID NO: 12864 - protein, 129 aa, Unknown
  Obtained from environmental sample
  misc_feature (1)..(129): Xaa is any amino acid
MDQFIKFFLLVCFVGTFLTAQESKLDKILATNTLKVCIWPEYYGISYLDKRTQKLVGIDSDLAHELAKDLNVKLEFVQSSFAKLIDDVTTTKCDIPMFAIGNPPIKKKKNSFLPTPTFILVRNICQFPT

SEQ ID NO: 12865 - DNA, 390 bp, Unknown
  Obtained from environmental sample
  misc_feature (1)..(390): n is a, c, g, or t
atgaagaaaacaatatttatggataaatatccagtgtactcattagagatatctaaagatgaaacaagttataaaaatgtagacgagataatcacatatcttcattctctagttgaagagcataagattgctacatttattgcaacttttgatcattatactcatactaaatcagtaaatggagtcatcaacgacgagattaaagatgctaaaaacattatcttttgttttggtaaagctatacctaatacaaaaattctagctgcaagaccaagaagtataggtgtctgtgaattagaaaattcatatgtagtagattttttagaagcacctaacgagcaactgattgaagtaatggaagattgggcaaagtctatatcaaacgtttaa

SEQ ID NO: 12866 - protein, 129 aa, Unknown
  Obtained from environmental sample
  misc_feature (1)..(129): Xaa is any amino acid
MKKTIFMDKYPVYSLEISKDETSYKNVDEIITYLHSLVEEHKIATFIATFDHYTHTKSVNGVINDEIKDAKNIIFCFGKAIPNTKILAARPRSIGVCELENSYVVDFLEAPNEQLIEVMEDWAKSISNV

SEQ ID NO: 12867 - DNA, 426 bp, Unknown
  Obtained from environmental sample
  misc_feature (1)..(426): n is a, c, g, or t
gtgatagttggtgggaaagttagacttacctgcttatcactttgcagcaacatcatttttgaggattttcgaatgaaaaaactattctgcttacttttactgctaaccgcaagcaatgctctggcaggaagtgattcaagcaattttgaaaaacttgatggcaccgggaaatcattacctgtggacgcaataaaatgggctatggttaaagataagagtactggactcatgtgggaagtgaagcatacgaatgactcaatacacggcatggatgcgcgttacgaatggactgatgcaacagcaacatttattgcagcattaaatcagaaacatttcggcggctattcaaactggcgaatgcccacagaagaccaaatctataccatttcgaaaagaaaaaaaatacccccccacacaaactcttga

SEQ ID NO: 12868 - protein, 141 aa, Unknown
  Obtained from environmental sample
  DOMAIN (69)...(131): Protein of unknown function (DUF1566)
  misc_feature (1)..(141): Xaa is any amino acid
MIVGGKVRLTCLSLCSNIIFEDFRMKKLFCLLLLLTASNALAGSDSSNFEKLDGTGKSLPVDAIKWAMVKDKSTGLMWEVKHTNDSIHGMDARYEWTDATATFIAALNQKHFGGYSNWRMPTEDQIYTISKRKKIPPHTNS

SEQ ID NO: 12869 - DNA, 315 bp, Unknown
  Obtained from environmental sample
  misc_feature (1)..(315): n is a, c, g, or t
atgaatgattgcaaaaaactagcagagtcaaaagatattgagatcttagatcaattatctcaacaactttttgcatatagtgaagagttaaaaggtgttcatgaactatcaaatgtttattatgcacttgaacaactttcatcatctatgaacatggctaacatagataaagtgagtgaattactaagtgtagttatgagtgatttaaaagagtggcgttatgaagtattagaaaataaaatagcagtagatattcactttttagatcaaaaaattatctctaacataatgttgataatctctttttctaagtaa

SEQ ID NO: 12870 - protein, 104 aa, Unknown
  Obtained from environmental sample
  misc_feature (1)..(104): Xaa is any amino acid
MNDCKKLAESKDIEILDQLSQQLFAYSEELKGVHELSNVYYALEQLSSSMNMANIDKVSELLSVVMSDLKEWRYEVLENKIAVDIHFLDQKIISNIMLIISFSK

SEQ ID NO: 12871 - DNA, 570 bp, Unknown
  Obtained from environmental sample
  misc_feature (1)..(570): n is a, c, g, or t
ttggggaggctaataagggtggtaccttattctatctttttccaacttttattttttatgctaaggcacaatttttctatcggtttaaatattaggaaaagaacaaagataatggcaaagataattatcttaatatctactttaaatataattctaaatttcgcacttataccatctttagggatcattggagcatctctggcaactctcgtatccagaattttacattttatattaatttatattgtagcccaaagaatttataagataccctatgagatcaaaaaaatatgtactatgatactggttttaatagtaatgatatcagtaggaatgctcgtcaatgagctcgatctaataataaggctgaccctaaaaacgttaatgatcctttcgtttcctgttttattgtattacttcaatttttatgaagaaatagaattgttgcgaataaaacaaacttggcaaaaatggcgtgaccctagagattggaaaaaaaatatcaggagttttaatgtcaaaaaagaagaaacagatcccaaacaaaaaagttgtaacaaaacaaaataa

SEQ ID NO: 12872 - protein, 189 aa, Unknown
  Obtained from environmental sample
  misc_feature (1)..(189): Xaa is any amino acid
MGRLIRVVPYSIFFQLLFFMLRHNFSIGLNIRKRTKIMAKIIILISTLNIILNFALIPSLGIIGASLATLVSRILHFILIYIVAQRIYKIPYEIKKICTMILVLIVMISVGMLVNELDLIIRLTLKTLMILSFPVLLYYFNFYEEIELLRIKQTWQKWRDPRDWKKNIRSFNVKKEETDPKQKSCNKTK

SEQ ID NO: 12873 - DNA, 468 bp, Unknown
  Obtained from environmental sample
  misc_feature (1)..(468): n is a, c, g, or t
ttgacaaaagaagacattaaaatcctaaaaatattagaaaaagatgcaagaataaaaataacagaaatagctcacaagctaaaaatatctgcagaactagcactttacaaattaaaaaatctacaaaagaaaaaagtaattctcggaacaaaaatttattttgacatcagcaaattaggataccattattccctaatttcaattgatttatttaattattcaaaaaaaacagaaagtgaaataaaaaaacttgcaaaagaagacgaatttattaattccctaattctttcaataaacaacccacaaataataattcaactattcaacagaactcaaaaagaattaatttcaacaatcattaaaatcaaaaacacacttgggaatcaaatacaatcgttcaacattatgtttcctcaacaagaagaggagataaatttacttccaaatttagaaaacaaaataatctaa

SEQ ID NO: 12874 - protein, 155 aa, Unknown
  Obtained from environmental sample
  misc_feature (1)..(155): Xaa is any amino acid
MTKEDIKILKILEKDARIKITEIAHKLKISAELALYKLKNLQKKKVILGTKIYFDISKLGYHYSLISIDLFNYSKKTESEIKKLAKEDEFINSLILSINNPQIIIQLFNRTQKELISTIIKIKNTLGNQIQSFNIMFPQQEEEINLLPNLENKII

SEQ ID NO: 12875 - DNA, 711 bp, Unknown
  Obtained from environmental sample
  misc_feature (1)..(711): n is a, c, g, or t
ttgaaattttcaaagggtggaatgggttcaccaaatgctgaagcttatttagcatcaccagcagttgttgcatattctgcaatgaaaggagaaatagattttgattgggaaacaccaattaaacaaataaatggtaaaattgaagtaaatgatccaaaaccaattgaatctaaatctgtgacaattctagatggatttccaaagaaagttgaaggtgatttaatattctgtcatattgataacatgaacaccgatggaatctatcctggtaaatacacatatgtagatgatttcacacctgaagatcaggcaaaagttgctatggaaaattacgatccggaatttcaagatgttgctaaagatggcgacattttaattggtggatataactttggtacaggcagttctagagagcaagcagcaaccgctcttaagtatagaggaattcaattagttattgttggttctgcaagtcagacttacaaaagaaatgctcttaacaatggatttttagtaattgaagttccagaacttgttgacgatttgaaaaacaaatatggatcagataaattaactgtgcaaacttccactaaagcagtattagattataaaaattctgaattactttacgatggcaaaacgtataaattcagtcctgtgggaactgctgcccaagaacttgtggtacttggcggtctgaaaactgggtaa

SEQ ID NO: 12876 - protein, 236 aa, Unknown
  Obtained from environmental sample
  DOMAIN (46)...(178): Aconitase C-terminal domain
  misc_feature (1)..(236): Xaa is any amino acid
MKFSKGGMGSPNAEAYLASPAVVAYSAMKGEIDFDWETPIKQINGKIEVNDPKPIESKSVTILDGFPKKVEGDLIFCHIDNMNTDGIYPGKYTYVDDFTPEDQAKVAMENYDPEFQDVAKDGDILIGGYNFGTGSSREQAATALKYRGIQLVIVGSASQTYKRNALNNGFLVIEVPELVDDLKNKYGSDKLTVQTSTKAVLDYKNSELLYDGKTYKFSPVGTAAQELVVLGGLKTG

SEQ ID NO: 12877 - DNA, 555 bp, Unknown
  Obtained from environmental sample
  misc_feature (1)..(555): n is a, c, g, or t
atggagttatgtaaaccattagaggcagagattgaaggagatgttgttcaatttgaatttatcttcagaaactatttaacaggttcattatttgaagcttgtcaaaacggaaatgacccttatggattaaatttaccatctgatttaaaagagtgggataagtttgaaacacctatttttacacctactacaaaaggtgtaaaagatataccattaaactctagtactgtaagagagaaatttccagaaatcatatctagtttagaaaagctttttaaagactttactgtttttgcacaagaaaatggtattattgtagttgatacaaagtttgaaatatttgtaaattctaagggtgaatggattttaggtgatgagattttaacacctgagagttcaaggtttatagcagatgaagatttccaaaaaggtaattatatctcaatggacaaacagattcttcgaaattttgccaaagaaaatagttggaaagagaaagcaaaagatttaaaatctggtgaaaaactagatgtagaagttccagattccatttaa

SEQ ID NO: 12878 - protein, 184 aa, Unknown
  Obtained from environmental sample
  DOMAIN (4)...(180): SAICAR synthetase
  misc_feature (1)..(184): Xaa is any amino acid
MELCKPLEAEIEGDVVQFEFIFRNYLTGSLFEACQNGNDPYGLNLPSDLKEWDKFETPIFTPTTKGVKDIPLNSSTVREKFPEIISSLEKLFKDFTVFAQENGIIVVDTKFEIFVNSKGEWILGDEILTPESSRFIADEDFQKGNYISMDKQILRNFAKENSWKEKAKDLKSGEKLDVEVPDSI

SEQ ID NO: 12879 - DNA, 543 bp, Unknown
  Obtained from environmental sample
  misc_feature (1)..(543): n is a, c, g, or t
ttggaacatccaaaagcgtgtccgataaaaagagcgatattccagagtaggcttgatcgctttacgcagcaaggctatcccatngtctatatggatgaaagcggctttgaggctgaaaccattcgttctcatggctatgcaccgattggtaaaccctgtatcgatagctacaactggcaagcttcgagacgtactaatgtcatcggagctctctatgaaaaaatgctatttgcgcttgattactttgaacacaatattaacagcagcatattctaccactggtgcaaatacacgctaatcccaagtcttaaaactaaatgcgtgattgtcatggataatgctcgatttcataagagtaagcgtattcaaaagctacttaatagacatggtcatcgtattttatggctgccgccgtacagccctgatctaaaccctatcgagaaaaaatgggcacaggctaagtttctacgccaaggatggatggagaataatctacctaaactgtttcatgatatgggctgtatcgattttataaagacttaa

SEQ ID NO: 12880 - protein, 180 aa, Unknown
  Obtained from environmental sample
  misc_feature (1)..(180): Xaa is any amino acid
MEHPKACPIKRAIFQSRLDRFTQQGYPXVYMDESGFEAETIRSHGYAPIGKPCIDSYNWQASRRTNVIGALYEKMLFALDYFEHNINSSIFYHWCKYTLIPSLKTKCVIVMDNARFHKSKRIQKLLNRHGHRILWLPPYSPDLNPIEKKWAQAKFLRQGWMENNLPKLFHDMGCIDFIKT

SEQ ID NO: 12881 - DNA, 726 bp, Unknown
  Obtained from environmental sample
  misc_feature (1)..(726): n is a, c, g, or t
atgcaacaggttcaaatgatgcttagtgctatgataaaaaaagagtttttactggttttaagagacaagcatgcacttgcagctttatttgtaatgcctgctatttttatattaatcatgtcagtagctatgcgagatcaattttctacaaaaaacatcgagttcactttttttgtagtggactcagacaaaagtgagattagtaaaaagattatcttagagattaaaaaagataaaaacttcactatattaaacgacaaagaagatgctgaatttatagttaatatccctaaagactactctgagaaactggaaaaaaaagtccaaataactataaaagactcaatacaaagcaataaaattgaaatatttaagtccatgctttctaagcatctactgagtgcaagattcaacgctctaggattagatatagatatttctaccgataagctctacaatataaaatacaataaactcaaaaatatacccaattccacacaacaaagtgtacctgcttggatagtttttgagatgttctttatcatcattcctatgtcaaccatctatgtgaatgagagaaaaccaaacactctcgctagactaaattctatgaatgtttcacttttttccatgactctctcaaaaagcataccctacccttctaataaatcaggtccaagtggggaatatgcttggagtaaggctccttttagcacctttttttaa

SEQ ID NO: 12882 - protein, 241 aa, Unknown
  Obtained from environmental sample
  misc_feature (1)..(241): Xaa is any amino acid
MQQVQMMLSAMIKKEFLLVLRDKHALAALFVMPAIFILIMSVAMRDQFSTKNIEFTFFVVDSDKSEISKKIILEIKKDKNFTILNDKEDAEFIVNIPKDYSEKLEKKVQITIKDSIQSNKIEIFKSMLSKHLLSARFNALGLDIDISTDKLYNIKYNKLKNIPNSTQQSVPAWIVFEMFFIIIPMSTIYVNERKPNTLARLNSMNVSLFSMTLSKSIPYPSNKSGPSGEYAWSKAPFSTFF

SEQ ID NO: 12883 - DNA, 771 bp, Unknown
  Obtained from environmental sample
  misc_feature (1)..(771): n is a, c, g, or t
atgagtagtattggtattttaaaatgtgttataaaatcagcccaaggtaaccttgcacaaacactagactccataaaaaatgaagagattaaaatatcttcaaaaacaattccctcagtaatggaaacatctacagttccatactttttatttgagaatgaagtaaaagacaataaagacagcatctatgaagaattgaaagttttagtctctgagcttatatctgaattagatgaaaatcaaagagcatctaccgccattattataggaacttccataattgactggcatctcatagatgctatagaagatacagtttataagcataaaaagtacgcctcaaaaaaacacagcattgactcttatgcaaaaaaactctcacaagagttctctcttaatgatttcacaatgacaatcaacacagcatgtacctcaagtgcaaatgccatgcttgaagcggctaatttgataaacgcttctctttttaaaaatgtcattgtggttgggatagaagtattttcagaagtaatgagcaaaggctttaactccatgcaagtgctctgctcaaaaactcaaaagccttttgataaaaactgcgatggcatggttctaggcgaggggtttgcaggagttttactctcttgcgaaaagtcctcatggacacttcaaggcggagcaaactgttcaaactctcacaacattactgcggcaagtgagagtggtgatcagtttgtagaagttatgaatcaggctttaaaaacaccaaactaa

SEQ ID NO: 12884 - protein, 256 aa, Unknown
  Obtained from environmental sample
  misc_feature (1)..(256): Xaa is any amino acid
MSSIGILKCVIKSAQGNLAQTLDSIKNEEIKISSKTIPSVMETSTVPYFLFENEVKDNKDSIYEELKVLVSELISELDENQRASTAIIIGTSIIDWHLIDAIEDTVYKHKKYASKKHSIDSYAKKLSQEFSLNDFTMTINTACTSSANAMLEAANLINASLFKNVIVVGIEVFSEVMSKGFNSMQVLCSKTQKPFDKNCDGMVLGEGFAGVLLSCEKSSWTLQGGANCSNSHNITAASESGDQFVEVMNQALKTPN

SEQ ID NO: 12885 - DNA, 954 bp, Unknown
  Obtained from environmental sample
  misc_feature (1)..(954): n is a, c, g, or t
ttgaaggaggtaattaaaagttttgctcaagcacaatttaatatcggttgtgagctaagggtccaaggtgacttaaaaggggctttatttgcatggaataacatagaacgttcagctgattctgatatatacgcaaaagccaaagtcaaatctggctttctatttaagaagcgaaaggatactaacggagctatcactgagtggtctaaagttcaacgtatagataatgcagaagcttatgctgttgcacaagcgaatattgggaaattgtcattggatacacctacagttgctaaaaaagccttccttagcattaaaaggtctgatagtcctagaatacatgcactttctcaatttaagttagggctgatatttattaatgaaaagagtatcgaagaagcaataaactcatttaatatatccaaaagctattatccttatgagtcgtattgctgtaaaagaatttgcgatttattaaaattttcagaaacaaagaattttgatctgagcttattacagctattaaatatagtgttagatatagttgatattttgactttagattttagcaagtatgccgatgaagagaagcctttcgagagaaagctcgctcattacacgtcgacatatacttgcaacttgctattaggtaacgagcaaaaggcaatgactccgagcttgttcagactgaatacaattaataatgttaatgaccctagtgagggtcaattgcttatcaaaaagctgaaaggtgtaaaagataataattttactgcattagatttcaatgaagaattccacgcttttataagctgtttcactttcaatcatgacagtcttaatcattttagactttatggtaagcaagataataaagaagcttctggaatgagcttagtctttaaaaagagttttccagtctcagaatnnaaggagcccggagacaaacnntaa

SEQ ID NO: 12886 - protein, 317 aa, Unknown
  Obtained from environmental sample
  misc_feature (1)..(317): Xaa is any amino acid
MKEVIKSFAQAQFNIGCELRVQGDLKGALFAWNNIERSADSDIYAKAKVKSGFLFKKRKDTNGAITEWSKVQRIDNAEAYAVAQANIGKLSLDTPTVAKKAFLSIKRSDSPRIHALSQFKLGLIFINEKSIEEAINSFNISKSYYPYESYCCKRICDLLKFSETKNFDLSLLQLLNIVLDIVDILTLDFSKYADEEKPFERKLAHYTSTYTCNLLLGNEQKAMTPSLFRLNTINNVNDPSEGQLLIKKLKGVKDNNFTALDFNEEFHAFISCFTFNHDSLNHFRLYGKQDNKEASGMSLVFKKSFPVSEXKEPGDKX

SEQ ID NO: 12887 - DNA, 486 bp, Unknown
  Obtained from environmental sample
  misc_feature (1)..(486): n is a, c, g, or t
ttgcatttcctgattcccctaaaatttactcccttaaacagtaaaagaacggtttatggtggcggaggcataatgcctgatgtatttgttcctatagataccagtatgatttctgattacttaagcaaagttacccgagaaggtttggtaaatgaatttgcattggaatacacacaagataacagagaaaaactattggcaaactaccctactgtaagcgattttaaaactaatttcgatgcagaaaaagagctattaacagcattcgttgactttgctgctaaaaatgaagtagaaaaaaatgaggaacaaattaatacttcaaaaacatttttacttacccgattaaaagcaattattgctcgaaacatgtgggacagctctgcatattatcaagttattagcgatatagataacgccttattaaaagccgttgaagaaataaagagcgatacctttaaaaaagaaaaattagtatataagtaa

SEQ ID NO: 12888 - protein, 161 aa, Unknown
  Obtained from environmental sample
  misc_feature (1)..(161): Xaa is any amino acid
MHFLIPLKFTPLNSKRTVYGGGGIMPDVFVPIDTSMISDYLSKVTREGLVNEFALEYTQDNREKLLANYPTVSDFKTNFDAEKELLTAFVDFAAKNEVEKNEEQINTSKTFLLTRLKAIIARNMWDSSAYYQVISDIDNALLKAVEEIKSDTFKKEKLVYK

SEQ ID NO: 12889 - DNA, 390 bp, Unknown
  Obtained from environmental sample
  misc_feature (1)..(390): n is a, c, g, or t
ttgctgcaaccaacttctccattaagaatagttgtagacatagatgaagctatagaaaaatttaatagtgattctaaaaactgcttggtgagtgttcatgagatgatagaacatccttatgagtgtatttatgatattaaagatgataattggaagtatttagcgaaacaagagcaaaaagcaacaagacgtcaagattataaaagttctttttattatataaatggagctttatatttggcaaatacagattttttgaaaaaagagaaaacttttatcaaagaaaaagatacaactttttatgtaatgcctcacgaaagaggaatagatatcgatgagtatcgcgatcttaaaagagcagaatttcatattagaggtcataaaagttga

SEQ ID NO: 12890 - protein, 129 aa, Unknown
  Obtained from environmental sample
  misc_feature (1)..(129): Xaa is any amino acid
MLQPTSPLRIVVDIDEAIEKFNSDSKNCLVSVHEMIEHPYECIYDIKDDNWKYLAKQEQKATRRQDYKSSFYYINGALYLANTDFLKKEKTFIKEKDTTFYVMPHERGIDIDEYRDLKRAEFHIRGHKS

SEQ ID NO: 12891 - DNA, 480 bp, Unknown
  Obtained from environmental sample
  misc_feature (1)..(480): n is a, c, g, or t
ttgggcctgntgccttgtgcctggattgcagttgaagataaactaacaaaacatataacagaatttttactcgaactcggtaaaggatttgcttttattggacgacaatataaattagaaattagtgaatcagattactatatagatttattattctaccatttaaatttaagatgctatatcgttgtagaacttaaagcaggaaaatttaaaccagaatttgctggtaaacttaatttctatttatctgctgttgatagtcaagtaaaaagtgagttagataatccaaccataggtattcttttatgtaaaaagaaagataaaatagaagcagaatatgcattacgcgatataaataaaccaatgggaataagtgaatatagactaactgaatctatacctgacgagataaaaactcaattaccatcaattgaagaattcgaaaataatctaatagataaattaaataaaagcacataa

SEQ ID NO: 12892 - protein, 159 aa, Unknown
  Obtained from environmental sample
  DOMAIN (2)...(144): Protein of unknown function (DUF1016)
  misc_feature (1)..(159): Xaa is any amino acid
MGLXPCAWIAVEDKLTKHITEFLLELGKGFAFIGRQYKLEISESDYYIDLLFYHLNLRCYIVVELKAGKFKPEFAGKLNFYLSAVDSQVKSELDNPTIGILLCKKKDKIEAEYALRDINKPMGISEYRLTESIPDEIKTQLPSIEEFENNLIDKLNKST

SEQ ID NO: 12893 - DNA, 354 bp, Unknown
  Obtained from environmental sample
  misc_feature (1)..(354): n is a, c, g, or t
gtgaagctaaagaggaacaggagaaactttaaaatgaaaatttctgaaatttacaaatttttggataatttgtcaccgtttgaacttcaagagtcctgggataactcaggtcttttacttggtgattttaaccaagatattacaaaaatagttctcagcattgatgttgatgaagctttaattgactcaatggaaaatgacacacttcttatcactcctcatcctatcatttttggagggttaaagcagttggagtttagtaaatatccggcaaaccttattccaaaaatgatacgaaagaacatatccaaaattgcaatgcatacaaattttgacccaaacccctctaaatga

SEQ ID NO: 12894 - protein, 117 aa, Unknown
  Obtained from environmental sample
  misc_feature (1)..(117): Xaa is any amino acid
MKLKRNRRNFKMKISEIYKFLDNLSPFELQESWDNSGLLLGDFNQDITKIVLSIDVDEALIDSMENDTLLITPHPIIFGGLKQLEFSKYPANLIPKMIRKNISKIAMHTNFDPNPSK

SEQ ID NO: 12895 - DNA, 393 bp, Unknown
  Obtained from environmental sample
  misc_feature (1)..(393): n is a, c, g, or t
atgaaagaggtttttaatagtttccaagattatgagataataagtgtttttggtgcaggtggagatagggatagaactaaaagacctatcatgggaaaaatggcagaacaatttagtaaagagataattgtaacagcagataacccaagatttgaagatcctgatattatatgtgaggatatccttaaagggatagaaaataaagagaatgttactgttgaacttaatagaaaagaagcaatcaaaattgcattagaaaaatcaaaaaactataaaaatcctataattttagttttaggaaaaggtgatgaagaatatcaaataatatacgataaaaaacttccacaaaatgataaacaaatgattcaagagatattaaatgagtacaaataa

SEQ ID NO: 12896 - protein, 130 aa, Unknown
  Obtained from environmental sample
  misc_feature (1)..(130): Xaa is any amino acid
MKEVFNSFQDYEIISVFGAGGDRDRTKRPIMGKMAEQFSKEIIVTADNPRFEDPDIICEDILKGIENKENVTVELNRKEAIKIALEKSKNYKNPIILVLGKGDEEYQIIYDKKLPQNDKQMIQEILNEYK

SEQ ID NO: 12897 - DNA, 372 bp, Unknown
  Obtained from environmental sample
  misc_feature (1)..(372): n is a, c, g, or t
atgagtacaaataaaaaagttttaacaatagtaattacaatgctattgagtgtttctcttgtaagtattatggtgtttatttataattttaaacaatttagtataaaaaacacaacagataaagcaataagcatagctcaaaatgtgagagatggtttaacagctcatatggtaaatggtactatggataaaagagcgctatttctagataatattgctaccaatcaaaaaatagaatattttcatcttttaagagctccttctgttgtaaatcaatatggaatagggttttatggagagacaagaatatcttcactagaaaaaaaaagtgtaaaaccgcaaaactacaaactaaacttattgaaactatag

SEQ ID NO: 12898 - protein, 123 aa, Unknown
  Obtained from environmental sample
  misc_feature (1)..(123): Xaa is any amino acid
MSTNKKVLTIVITMLLSVSLVSIMVFIYNFKQFSIKNTTDKAISIAQNVRDGLTAHMVNGTMDKRALFLDNIATNQKIEYFHLLRAPSVVNQYGIGFYGETRISSLEKKSVKPQNYKLNLLKL

SEQ ID NO: 12899 - DNA, 804 bp, Unknown
  Obtained from environmental sample
  misc_feature (1)..(804): n is a, c, g, or t
ttggagaaaaatgcaaaagtttgtagatcattaggaacttcaaatcatgtatattcaagtgactttgatgatttatgtttaaatggtaaacaaaagttgagtgaatatatttgtttaaattatgacatagatgaggtaaactcattagttttacatatacaatcatcatcacaagaagagataaaaagaataaaagaagagatacccgttataagtaactattttgatatggcaaaacctgttattgaaagtaaaatacttatggatattttaaaagagacaacacttagagacccaatgacaggattatataatagaagatttttaaatgagctgttggattcaaatattacaagtcgaatagtaaatgataatatacacgctattttgatgatagatgttgatttttttaaaaaagttaatgatagttttggacatgatgttggagatgaagttattaaaagactagcaaaaattatgaaagaatctactagaaattcagatatcgctgttagatatggtggtgaagagtttcttatattgttacaaaacaccacaaaagaaaaaactttaaaaattgcaaaaatgataaatgagaagtttaaatcagaggtttttagtgcaaattcaaccactttttcgaaaacattaagtgttggaatttcttattatccaagtgatgcagatacattatggaaagcgataaaatatgcagatgatgcactttacaatgcgaagaacaatggacgagataaagtggctgagtttgagctttttatgcatagtggaggagaagattactaa

SEQ ID NO: 12900 - protein, 267 aa, Unknown
  Obtained from environmental sample
  DOMAIN (91)...(252): GGDEF domain
  misc_feature (1)..(267): Xaa is any amino acid
MEKNAKVCRSLGTSNHVYSSDFDDLCLNGKQKLSEYICLNYDIDEVNSLVLHIQSSSQEEIKRIKEEIPVISNYFDMAKPVIESKILMDILKETTLRDPMTGLYNRRFLNELLDSNITSRIVNDNIHAILMIDVDFFKKVNDSFGHDVGDEVIKRLAKIMKESTRNSDIAVRYGGEEFLILLQNTTKEKTLKIAKMINEKFKSEVFSANSTTFSKTLSVGISYYPSDADTLWKAIKYADDALYNAKNNGRDKVAEFELFMHSGGEDY

SEQ ID NO: 12901 - DNA, 546 bp, Unknown
  Obtained from environmental sample
  misc_feature (1)..(546): n is a, c, g, or t
gtgaatattgcaatatttggtggtagttttgatccaccccacatagcacatgaaaatatagtcaatgaagttattgagaatattaatgcagataagttatttgtagtacctacctacctaagtccttttaaggacaaatatcatttagaaccaaaagagagatttgaattacttacaagcctttttgaagaggataaaaaagttgaagtgatagattttgagataaaacaaaatagggcagttcctacaatagaaacagtgaaatatttgaatgaaaaatataagccaaagaatatttatttagtaattggtgcagataatttacaaacactccatttatggaatgattttaatcaactgcaagagcttgtaaagttcattgtaatttctcgagagggatatgaagtaaaaaatgatataatacactttaaagctataaatatggatatagatataagttctacttttttacgagataactttgatttaaaatatatcccaaaaaaaatacaacaaggggtaaagaatatatggaagaaagattaa

SEQ ID NO: 12902 - protein, 181 aa, Unknown
  Obtained from environmental sample
  DOMAIN (5)...(160): Cytidylyltransferase
  misc_feature (1)..(181): Xaa is any amino acid
MNIAIFGGSFDPPHIAHENIVNEVIENINADKLFVVPTYLSPFKDKYHLEPKERFELLTSLFEEDKKVEVIDFEIKQNRAVPTIETVKYLNEKYKPKNIYLVIGADNLQTLHLWNDFNQLQELVKFIVISREGYEVKNDIIHFKAINMDIDISSTFLRDNFDLKYIPKKIQQGVKNIWKKD

SEQ ID NO: 12903 - DNA, 576 bp, Unknown
  Obtained from environmental sample
  misc_feature (1)..(576): n is a, c, g, or t
ttgccgggattctttttccaagagaggtatccaaaaaggtttttggggggggaatgggaagctttaaaaaaaataaggagtgggggtgggggcttacaaaatgtcaaaataaatgcttccttttggaaagaaccacttgttgggggtcaaaaagttatcaaaattatgaataaaaaaggactggtacaaggtaaaaattcacttgaaatttacgcaatgtgtgaaataccaagtaatgtaatctttgcagatgagttcctaaaagtatttgatggttatagtataggttccaatgatttaacacaattaactttaggagttgatagagatagtgctttaatagcgcatatctttgatgagagaaataaagctgtaacaagaatgatagcgatggtgatagagcagtgtaaaaaacaaaataaatatatcggtatttgtggacaagcaccatcagattatccagagattacaagatttttagttgagaatggtatagactctatctctttaaatcctgattcactcttaaaaatgagacaagttgtagttgaacttgaaaactctaagaactcttaa

SEQ ID NO: 12904 - protein, 191 aa, Unknown
  Obtained from environmental sample
  DOMAIN (7)...(187): PEP-utilising enzyme, TIM barrel domain
  misc_feature (1)..(191): Xaa is any amino acid
MPGFFFQERYPKRFLGGEWEALKKIRSGGGGLQNVKINASFWKEPLVGGQKVIKIMNKKGLVQGKNSLEIYAMCEIPSNVIFADEFLKVFDGYSIGSNDLTQLTLGVDRDSALIAHIFDERNKAVTRMIAMVIEQCKKQNKYIGICGQAPSDYPEITRFLVENGIDSISLNPDSLLKMRQVVVELENSKNS

SEQ ID NO: 12905 - DNA, 924 bp, Unknown
  Obtained from environmental sample
  misc_feature (1)..(924): n is a, c, g, or t
ttggctcggttgattacagttagagaaagaacccatgaggtaatcaaacaaaaggaagaaatagaaattcaaaaagaactgttagaaaaagaaaaagaaaaagccgatgaattattgtacaatatccttcctgaagaaatagctattgaactaaaaaacaaaggtaaagcaactgccagacaatacaggttagcttctattatgtttaccgatttccaaagttttaccaaaattgccgagaaaatttcgccacaagatttagttgcagaactagactattactttgtaaattttgatgccatcattgaaaaataccatgtagaaaaaattaaaaccattggagatgcatacatgtgtgctggtggtattccattaagaaataaaagcaatcctatagatactgttttagcagggttagaaattcaacgatttgttgctaaacataaccccgaaagagttgaacaaggtaaacacccttggggattaagaattggagtacacacaggtgaaattacagctggtgttattggtagtaaacgttttgcttatgatatttggggcgacagtgtaaacattggtagccgaatggaagaagctggagaagttggtaaagtaaacatctcgggagctacttatgaatacattaaagaattctttaattgtgaataccgtggtaaaattaaagccaaaaacaaaggtttaattgacatgtattttgttactggaattagagcagaactatctgttgatggcgaangaataataccaaacgatttattccaaaaatatgtggacttacatatttaccgtagtattaactaccgtaaggcagaaaaatacatttttaaaagattacaaaagggttgcccgaacacttgcattatcccgattttaaccacactaaagatgtttgtgctgcaataa

SEQ ID NO: 12906 - protein, 307 aa, Unknown
  Obtained from environmental sample
  DOMAIN (57)...(242): Adenylate and Guanylate cyclase catalytic domain
  misc_feature (1)..(307): Xaa is any amino acid
MARLITVRERTHEVIKQKEEIEIQKELLEKEKEKADELLYNILPEEIAIELKNKGKATARQYRLASIMFTDFQSFTKIAEKISPQDLVAELDYYFVNFDAIIEKYHVEKIKTIGDAYMCAGGIPLRNKSNPIDTVLAGLEIQRFVAKHNPERVEQGKHPWGLRIGVHTGEITAGVIGSKRFAYDIWGDSVNIGSRMEEAGEVGKVNISGATYEYIKEFFNCEYRGKIKAKNKGLIDMYFVTGIRAELSVDGEXIIPNDLFQKYVDLHIYRSINYRKAEKYIFKRLQKGCPNTCIIPILTTLKMFVLQ

SEQ ID NO: 12907 - DNA, 339 bp, Unknown
  Obtained from environmental sample
  misc_feature (1)..(339): n is a, c, g, or t
atggagttttcaatggcaataatgatacaaaagagaaatggtcgtcaagaggttttagatataaccaaaattcanaaacatacaatttcagcaacaaaagatttagaaggtgttagtcagagtgaactagagattgacgctcaaattaaatttatcgatggtatgagttctagcgatatccaagatgctttaatcaaaacagctgttgaaaaaatagatatagatgttcccaaattggacttttgttgctgcacgacttttttctttttgaattgnatcaaaaagttggaaaaagctacccctggtaataaaaaggaaaagcgtaatccgtcatcctaa

SEQ ID NO: 12908 - protein, 112 aa, Unknown
  Obtained from environmental sample
  DOMAIN (7)...(108): ATP cone domain
  misc_feature (1)..(112): Xaa is any amino acid
MEFSMAIMIQKRNGRQEVLDITKIXKHTISATKDLEGVSQSELEIDAQIKFIDGMSSSDIQDALIKTAVEKIDIDVPKLDFCCCTTFFFLNXIKKLEKATPGNKKEKRNPSS

SEQ ID NO: 12909 - DNA, 426 bp, Unknown
  Obtained from environmental sample
  misc_feature (1)..(426): n is a, c, g, or t
atgagcagtaacatgaaaacaggccctgcaaagcagcgggaacagttcactcagggttgtcactatattggaatgaagctcctggctgaacagtaccacagtgtggtggaaaaagccggggaggatactcccggatactttgaatttatccatgatatcgtacaggctgaagctgctaacaaacgtcagagacatgttgagaacctgatcaagaaaagcaagttgcctaagccgctgaagatgcttgaggactttgattttgactttcaggccaaactgaaccgcccactgatcatggatctggcatcactggactttattgaacgaaatgcctctgtcctattgatcggggataatggggaagggaaaatcacatatcccttcagagtctggcgccttatcgctttgccaaaaaagagtatatga

SEQ ID NO: 12910 - protein, 141 aa, Unknown
  Obtained from environmental sample
  misc_feature (1)..(141): Xaa is any amino acid
MSSNMKTGPAKQREQFTQGCHYIGMKLLAEQYHSVVEKAGEDTPGYFEFIHDIVQAEAANKRQRHVENLIKKSKLPKPLKMLEDFDFDFQAKLNRPLIMDLASLDFIERNASVLLIGDNGEGKITYPFRVWRLIALPKKSI

SEQ ID NO: 12911 - DNA, 534 bp, Unknown
  Obtained from environmental sample
  misc_feature (1)..(534): n is a, c, g, or t
gtgtatgtaaaagtttacttagaaggagattttcctgctgcgtacaaaaaaatgcgtgatgaaacacgagagatgttggatgagttcagagcatattctaatgataacttagattatgaatttattaatcccgccgaaagtggggatgaaaaaattaccacagaaatttatctgcagctttttaaacaaggcttacagcctacagatttaaatgaaaaaactactgatggtttttctaacaaactgatttggccgggagctatcttcttctataaaggaaaagaaattcctgttcagttgctaaaaagtaaattaggcagcactccagttaacatgataaacagctctattgaaggattggaatatgaaattgctaatgccatttacaccctttccacagagttaaaacctaaaattgcttttattgatggacatggcgagctaaataaatatgaagtagcttcttttatcctaccttcgttggcagagttttatagcatcgacggaattaagttaatcggagagcctcattag

SEQ ID NO: 12912 - protein, 177 aa, Unknown
  Obtained from environmental sample
  misc_feature (1)..(177): Xaa is any amino acid
MYVKVYLEGDFPAAYKKMRDETREMLDEFRAYSNDNLDYEFINPAESGDEKITTEIYLQLFKQGLQPTDLNEKTTDGFSNKLIWPGAIFFYKGKEIPVQLLKSKLGSTPVNMINSSIEGLEYEIANAIYTLSTELKPKIAFIDGHGELNKYEVASFILPSLAEFYSIDGIKLIGEPH

SEQ ID NO: 12913 - DNA, 300 bp, Unknown
  Obtained from environmental sample
  misc_feature (1)..(300): n is a, c, g, or t
atggtaaaaaataacgcanatagaaatagagatttatctgctttagcaataggaattttgctgattgtcttaatcaacttctcagcgtcattgctttttgagcgtttcgacctaacctcagaaaaaagatattcgcttttctatgcctctaaagagttagtaaaaaatttagatgacattgtttatgtaaaagtttactttaagggagattttccctgcctgcgtacaaaaaactgcgtgatgaaaacacgaaaagatgttggaatgaattccaaagcaaattcccaatggataacttaa

SEQ ID NO: 12914 - protein, 99 aa, Unknown
  Obtained from environmental sample
  misc_feature (1)..(99): Xaa is any amino acid
MVKNNAXRNRDLSALAIGILLIVLINFSASLLFERFDLTSEKRYSLFYASKELVKNLDDIVYVKVYFKGDFPCLRTKNCVMKTRKDVGMNSKANSQWIT

SEQ ID NO: 12915 - DNA, 828 bp, Unknown
  Obtained from environmental sample
  misc_feature (1)..(828): n is a, c, g, or t
ttggttcaagttactacaacttcctttttcataaaactaaatgacttccaacttgatagatatccaggaagtatgtctccatcatcatatgcttctgaagttacagtatttcaagaaaatggaaaatcttatgattatagaatctttatgaatagaacacttcaccaaggaaacttcttgtttttccaaagttcttatgaccaagatgaaaaaggaacagttttgtctgtaaataatgaccctggtaaatggccaacatatttaggatacttttttcttacgctaggtcttgtattaaacttatttagtaaacaatcaagattttggatacttgcaaataaaatgaaagataaaaatattgcttcttttgtacttgcacttggattagcatttacagcttcaaatctacaagcagcagaacaacaaacacaaactactcaagctacacaacaaacacaacaacctattataaaagagtatgatacagctgaagagtatattgaaatgcttaaaaaagactctttagaattagctactaagtttggaacactaactgtacaaagtggcggtggtagaatgaaacccgtagactctttaaatcaagaaattcttttaaagctatcaggtaaaaaatctatgtttggactaaatgctgaccaaatagttatagggatgatttctcgaccagagatttggagaagtgtaaaaatgataaaaatcaccacctccagattaaaaaactatttaggtattgataaagataagaaatatatcccttttgcagaagttttccaaaaatggaaaatatatttttacaagaagagataa

SEQ ID NO: 12916 - protein, 275 aa, Unknown
  Obtained from environmental sample
  misc_feature (1)..(275): Xaa is any amino acid
MVQVTTTSFFIKLNDFQLDRYPGSMSPSSYASEVTVFQENGKSYDYRIFMNRTLHQGNFLFFQSSYDQDEKGTVLSVNNDPGKWPTYLGYFFLTLGLVLNLFSKQSRFWILANKMKDKNIASFVLALGLAFTASNLQAAEQQTQTTQATQQTQQPIIKEYDTAEEYIEMLKKDSLELATKFGTLTVQSGGGRMKPVDSLNQEILLKLSGKKSMFGLNADQIVIGMISRPEIWRSVKMIKITTSRLKNYLGIDKDKKYIPFAEVFQKWKIYFYKKR

SEQ ID NO: 12917 - DNA, 477 bp, Unknown
  Obtained from environmental sample
  misc_feature (1)..(477): n is a, c, g, or t
gtgcgatatatagataccaatggagatgaaaaagttagaatagatggaactcccataaagctttttaaagaaaaagctatctctaaaatagtaccacaaaatcagctacaaaataaaaaagatgaaacttactttaaaaaattcatatctttgagcaaaaatgaaataggtatctctcatataaatcttaatagggaacatgggacagttgaaaaaactaaaaaacctgttataagacttggagtcactatttttgacaaaaacaatataaaaaaaggatttattgttattaatgtatgtttgagaacattttttaaacaactagaacaagcaacactctatcatatctatttaatagatgaacaaggtagatctcttacacataataatcctcaatatgtcttagtgagtgatagttttgaaagttatactctgcttcatcaatttggcagccaaaacgcccaaaagatactttaa

SEQ ID NO: 12918 - protein, 158 aa, Unknown
  Obtained from environmental sample
  misc_feature (1)..(158): Xaa is any amino acid
MRYIDTNGDEKVRIDGTPIKLFKEKAISKIVPQNQLQNKKDETYFKKFISLSKNEIGISHINLNREHGTVEKTKKPVIRLGVTIFDKNNIKKGFIVINVCLRTFFKQLEQATLYHIYLIDEQGRSLTHNNPQYVLVSDSFESYTLLHQFGSQNAQKIL

SEQ ID NO: 12919 - DNA, 327 bp, Unknown
  Obtained from environmental sample
  misc_feature (1)..(327): n is a, c, g, or t
atgtttaaatatctttattacttattggctttagttttatatattttagctatcccctatctacttttaaaatcaagaaatccaaaatactcaaaagcaattccagcaaagttttttttacgagataatccaaagtttccagaagataaaatatggtttcatagttgctcccatggggaaactgtggctttaaaacctatttttgaaaagtttagcaaagaggatataaacttatctgttatcactaatacaggatttgaacaaggtttaaaacttgtagacaatgtacggtatttgccttttgaattgtcttgcctttttggataa

SEQ ID NO: 12920 - protein, 108 aa, Unknown
  Obtained from environmental sample
  misc_feature (1)..(108): Xaa is any amino acid
MFKYLYYLLALVLYILAIPYLLLKSRNPKYSKAIPAKFFLRDNPKFPEDKIWFHSCSHGETVALKPIFEKFSKEDINLSVITNTGFEQGLKLVDNVRYLPFELSCLFG

SEQ ID NO: 12921 - DNA, 717 bp, Unknown
  Obtained from environmental sample
  misc_feature (1)..(717): n is a, c, g, or t
ttgcaagatatattttattatctagagcaatataatgaagcaataaataaaacaaacttagtgagaaaatttgatactagtggaaaagtagtaaatataaatgataagtttaataatactttagcaaactttgcatcaaaagatttgatgaaaaaagtggagtttatcgaagctataaaaaataaaaaacattgcaataagctagttatttatgaaaataaatatgacaaaaaatatataaattcaacctatatacctatatataattttagtaaaaatttagcagagatactcgagataagctatgatgctacaggcatatttaaacttaatgaagagataaaacatacccaagaagcagttatttatatgctaggaactgttattgaaagtcgttcaaaagagacctcttatcatgtaaaaagggtagctttgtatagtgaagttatagcaaaaaaatatggtttaagtgatggagaagttgaactcttaaaaatctcttcacctttgcatgatatagggaaaatagctattgcagatcatattttaaataagccatcttctttnaatgatgaagagtttaaaatagtaaaagagcattctaatatagggtatgagatattaaaaaactcaaataaagagatacttcaaactgctgctatgattgcatactcacaccatgaaaattgggatgggacaggatatcccagaatttaa

SEQ ID NO: 12922 - protein, 238 aa, Unknown
  Obtained from environmental sample
  DOMAIN (136)...(237): HD domain
  misc_feature (1)..(238): Xaa is any amino acid
MQDIFYYLEQYNEAINKTNLVRKFDTSGKVVNINDKFNNTLANFASKDLMKKVEFIEAIKNKKHCNKLVIYENKYDKKYINSTYIPIYNFSKNLAEILEISYDATGIFKLNEEIKHTQEAVIYMLGTVIESRSKETSYHVKRVALYSEVIAKKYGLSDGEVELLKISSPLHDIGKIAIADHILNKPSSXNDEEFKIVKEHSNIGYEILKNSNKEILQTAAMIAYSHHENWDGTGYPRI

SEQ ID NO: 12923 - DNA, 657 bp, Unknown
  Obtained from environmental sample
  misc_feature (1)..(657): n is a, c, g, or t
atgagctataaagctgcatgggatgctatcgatgccataaacaacctttgtccaacacttgttgtagaaaaatctacaggtggtgttggaggagggggagctgtcgtaactccatatggtaaaaacttaattaaaacatattcgactcttaaaaaagaacatgaaaagtttttatcacaattgacaaagatgacagattttaacacaggagcccttaaatctttagaaaggttttcgatgcaaataagtgcaagaaatcaggttcaaggtatagttgaacatattgaacaaggaaaagtaaattcttcagtgtatttaaaattaaaaagtggttatacattagtaagtgttattacaaatggggctattgataatttaaatttacaaatagaagatgaagtggttgctatatttaaatcaagttcagttctccttacaacagatttgagtttaaatattagtgctagaaataaattccaaggtactataactgatattagtttaggtgagataaatagtgaagttctagttgatattggtaatggagataaaatcgcctctgttattacgaaaaatgccacagggagtttagatttgaaagttggtgatagtgtaagtgctattataaaatcatctgatgtgatgataggaaaataa

SEQ ID NO: 12924 - protein, 218 aa, Unknown
  Obtained from environmental sample
  DOMAIN (82)...(145): TOBE domain
  misc_feature (1)..(218): Xaa is any amino acid
MSYKAAWDAIDAINNLCPTLVVEKSTGGVGGGGAVVTPYGKNLIKTYSTLKKEHEKFLSQLTKMTDFNTGALKSLERFSMQISARNQVQGIVEHIEQGKVNSSVYLKLKSGYTLVSVITNGAIDNLNLQIEDEVVAIFKSSSVLLTTDLSLNISARNKFQGTITDISLGEINSEVLVDIGNGDKIASVITKNATGSLDLKVGDSVSAIIKSSDVMIGK

SEQ ID NO: 12925 - DNA, 918 bp, Unknown
  Obtained from environmental sample
  misc_feature (1)..(918): n is a, c, g, or t
ttgagtttaattcctgttgatgagacagatgatttttttacgacttttcaggtcttagagaaggtttcgatgaaaataaaatatttaagatgcggtaacattaatccaagaacaaaagagtgtaatactttaacatctcctcaaagagtttttctctcaggtcacagaggtacaggaaaaactacagagcttttaaaacttaaaaatgacctaaaccaagaaaattgttttttaacaatattttgtgaaattagtagtgaagagttagatgtaaataatatagacttcgtggatatcatgatatttgtcttagaacaattagtaaaagaactcaacaaaagagagataaacgtagacaaaagtggtgttgaatctttttatgattggtatatccaaagaatagttgaaataaataataaaatagatgtttctgccacaattgaaatagaaaaaaatgttgatgtaaatattcaaacattgtttaaacttatcacaaaaacaaaatcaaaactttccgctacacaagatacaaaagatgttataagaagagtttttacaaataatttttcagattttagtctaaaatttaatgagtttgtcttatacgtaaaagaggctttgcaaaaatataatatagctaaagatctacttttcataatagatggttttgagaaaataggaacttttgaatatagaaaaaaaatattgatagatgattcaaataagtttgtagagataaaaataaatatgattattgctctgcctattgatctgtttagttatgttaaaaactctagaaatttttccaactccaatatccttttccttttggagtgcattagaaaaacaaagggaataggaaagattttaaaagatttttattatcccggaccaaatagatggaaaaaatttttttga

SEQ ID NO: 12926 - protein, 305 aa, Unknown
  Obtained from environmental sample
  misc_feature (1)..(305): Xaa is any amino acid
MSLIPVDETDDFFTTFQVLEKVSMKIKYLRCGNINPRTKECNTLTSPQRVFLSGHRGTGKTTELLKLKNDLNQENCFLTIFCEISSEELDVNNIDFVDIMIFVLEQLVKELNKREINVDKSGVESFYDWYIQRIVEINNKIDVSATIEIEKNVDVNIQTLFKLITKTKSKLSATQDTKDVIRRVFTNNFSDFSLKFNEFVLYVKEALQKYNIAKDLLFIIDGFEKIGTFEYRKKILIDDSNKFVEIKINMIIALPIDLFSYVKNSRNFSNSNILFLLECIRKTKGIGKILKDFYYPGPNRWKKFF

SEQ ID NO: 12927 - DNA, 714 bp, Unknown
  Obtained from environmental sample
  misc_feature (1)..(714): n is a, c, g, or t
ttggtaaaaaaagtggtattagagtacggtgatggaacagataaaaaaataaatcctatcatcttagaaaatgagagttataaaaaattatcaaattctacagttaaaaagatgagcagaaaaaaacagaaaaaaatagctatcccaaaagaagatataacaactatcaaagagataaaaatagacaacttctttagtatagaaaaacttagattagataatttagataagaaaaaagagatctacatagtcggtgaaaatggtgatggaaaaactttacttctgcaagctatagcactggctttaaaaggaacaactgagggtagagttgttgactttcttaaaacagataagagaaaaaaagagtatacattagaggttatagacagcaaagatgagttatttactgccaatgcttcaaaaacttatagaaatatgtttgcttacggtgctcatagaaacaataactgtaaaagtgaagatgaagagagtggatatttaactctatttgacaatagcatagatttaaaagatcctaaaaagtggctaatagaactctacaatgcgcaaatgtcacaagaagaaaatatcttatctgttgatgatgcaaaaaaactattaagtgttttactaagtagtgaaaacaatagtgagattgagctagatataagatataacagtgttgatttttttgaaaaagatacttccctgtaa

SEQ ID NO: 12928 - protein, 237 aa, Unknown
  Obtained from environmental sample
  misc_feature (1)..(237): Xaa is any amino acid
MVKKVVLEYGDGTDKKINPIILENESYKKLSNSTVKKMSRKKQKKIAIPKEDITTIKEIKIDNFFSIEKLRLDNLDKKKEIYIVGENGDGKTLLLQAIALALKGTTEGRVVDFLKTDKRKKEYTLEVIDSKDELFTANASKTYRNMFAYGAHRNNNCKSEDEESGYLTLFDNSIDLKDPKKWLIELYNAQMSQEENILSVDDAKKLLSVLLSSENNSEIELDIRYNSVDFFEKDTSL

SEQ ID NO: 12929 - DNA, 453 bp, Unknown
  Obtained from environmental sample
  misc_feature (1)..(453): n is a, c, g, or t
ttgatgaaaaaatatatttactcacttgtgtttatggtttttattgtttttatgacagtgctgcccggtatctcggcagaagaggctgaggcaataaaaaccaatgccgaaccaatgcctcgttatatcagcgccacctattttcataccaccgcccgatgcccgacatgccacacgatagaggaattgtcatctaaggctgttcaattaaattttgaaaatgagctgaaaaccggcaaagtggtctggcggattatcaatgttgatgaaccggaaaacaagcattataatgaggattatcagctttacaccaagtccctgattatttcggagatgaaagacggcaaggaagtacggtggaaaaatctggaaaaagtctggcactatgtcagggacgatgaaaaatttgacgcgtatgtaaaagacgaaatcgtggactggttaaaggaataa

SEQ ID NO: 12930 - protein, 150 aa, Unknown
  Obtained from environmental sample
  misc_feature (1)..(150): Xaa is any amino acid
MMKKYIYSLVFMVFIVFMTVLPGISAEEAEAIKTNAEPMPRYISATYFHTTARCPTCHTIEELSSKAVQLNFENELKTGKVVWRIINVDEPENKHYNEDYQLYTKSLIISEMKDGKEVRWKNLEKVWHYVRDDEKFDAYVKDEIVDWLKE

SEQ ID NO: 12931 - DNA, 432 bp, Unknown
  Obtained from environmental sample
  misc_feature (1)..(432): n is a, c, g, or t
ttgtgtctgttgcggatgcggattgaggtgagtcaaattgaagataaaattatgccttatgttcctatgaatttaaaaaaagaattttcatatattttaggtcttgataaaaacaatatcaaagatgaatttgaaaataaaattattcaaaatgagacaatcacaacagttgcagatatgtctcaatataatcttgataaatataatcctatagatggaaaagcattaaaacaatgtgataaactttctgcatttatagaagctagcttatctatatcacatgggattaaatcaaaagagttaatcagtggtaaaaaacagattatggcatctttacaagaggtacaaggtgtagatttcaaagcaattgcaacttgtattgatgaagagttttgtacaactggaaaaacccaaacaacaatggagttataa

SEQ ID NO: 12932 - protein, 143 aa, Unknown
  Obtained from environmental sample
  misc_feature (1)..(143): Xaa is any amino acid
MCLLRMRIEVSQIEDKIMPYVPMNLKKEFSYILGLDKNNIKDEFENKIIQNETITTVADMSQYNLDKYNPIDGKALKQCDKLSAFIEASLSISHGIKSKELISGKKQIMASLQEVQGVDFKAIATCIDEEFCTTGKTQTTMEL

SEQ ID NO: 12933 - DNA, 348 bp, Unknown; identical to SEQ ID NO: 12163
  Obtained from environmental sample
  misc_feature (1)..(348): n is a, c, g, or t

SEQ ID NO: 12934 - protein, 115 aa, Unknown; identical to SEQ ID NO: 12164
  Obtained from environmental sample
  misc_feature (1)..(115): Xaa is any amino acid

SEQ ID NO: 12935 - DNA, 543 bp, Unknown
  Obtained from environmental sample
  misc_feature (1)..(543): n is a, c, g, or t
atgtctcgttttattagaaagcagaaacatgaaattggccttccacctgatgagctgttgtttattggcgataaaagaactgatgaagtaatactccgacttatagattacgatggtaaaaaccaccaagagctcaaattaaatagtataagggaaattttaccatataagacaaaaaattccgcatcctggctcaatgttgatgggctacacaatcagaaatttatgcatgatatttctcagagttttaatctggataaagttattttagcagatgtaatgaatacttctggtaggccaaaattggcagaacactctaactgtctcttcttatcgataaaaatgatttatactgaccctgaatctgaaaaactttcaatcgaaaatttaagtctggttttatcagaaaatatgctattttcgtttcaggaaaaaagaggtgatgtttttgaccctactagagaaagaataagacaccaaaagaagccaattagaaatcccggggaagaatatcttgcttttgccccgcttgattttggttga

SEQ ID NO: 12936 - protein, 180 aa, Unknown
  Obtained from environmental sample
  misc_feature (1)..(180): Xaa is any amino acid
MSRFIRKQKHEIGLPPDELLFIGDKRTDEVILRLIDYDGKNHQELKLNSIREILPYKTKNSASWLNVDGLHNQKFMHDISQSFNLDKVILADVMNTSGRPKLAEHSNCLFLSIKMIYTDPESEKLSIENLSLVLSENMLFSFQEKRGDVFDPTRERIRHQKKPIRNPGEEYLAFAPLDFG

SEQ ID NO: 12937 - DNA, 510 bp, Unknown
  Obtained from environmental sample
  misc_feature (1)..(510): n is a, c, g, or t
ttggaagaactatcaaataagcatgaagaaaaattagttcaattacaaaataattttgatagaacaaataaaatctatgtacaaaaacaagattttttactcgaaatagcaacagatatttctgaaatatatgctatatccgacgaatatcttagtaagcttttaacaaagaaacatattgaaaacagaggtaaggaggaaaacgaaagaataaataaaaatgtaatagttttatactcaaaatctttagatacaaaaaagaaattatttaataaaatcaattccctatcattattattaaatgataaagagcttataaatgctattggtgcttttgaaaagttcttaattaatttacatgcagaatgttcttttagctgtactcatacttttaaggaactgatgccatataatactaatctaacaaaattaagagatgccatctttgctgtattaagtaatatctttcattctgttgaagaaaaagcatctagagttacacccttgtga

SEQ ID NO: 12938 - protein, 169 aa, Unknown
  Obtained from environmental sample
  misc_feature (1)..(169): Xaa is any amino acid
MEELSNKHEEKLVQLQNNFDRTNKIYVQKQDFLLEIATDISEIYAISDEYLSKLLTKKHIENRGKEENERINKNVIVLYSKSLDTKKKLFNKINSLSLLLNDKELINAIGAFEKFLINLHAECSFSCTHTFKELMPYNTNLTKLRDAIFAVLSNIFHSVEEKASRVTPL

SEQ ID NO: 12939 - DNA, 381 bp, Unknown
  Obtained from environmental sample
  misc_feature (1)..(381): n is a, c, g, or t
atgagtcttttagagataaaaagttttattaaaaatataaaaccttttgataatttattaaataatgagcttgaagaggtgtgtagtcacttagatatattatattttaaagccaatgaagagattttatctcctgctaaaaatgctgaatatctttattttattattaaaggggtagtgcaagaaaaactagaagaggaggtagtatctgtatattctgctaatgagtattttgatcctataacacttatagaaaataagataaaaaatccttttgtcactgtacgaaagtcaattttgtatgcacaaccaaaagagagatttctagaatatatgtatcgaaatgacgctttagaagggtattttttcgcaggtatttga

SEQ ID NO: 12940 - protein, 126 aa, Unknown
  Obtained from environmental sample
  misc_feature (1)..(126): Xaa is any amino acid
MSLLEIKSFIKNIKPFDNLLNNELEEVCSHLDILYFKANEEILSPAKNAEYLYFIIKGVVQEKLEEEVVSVYSANEYFDPITLIENKIKNPFVTVRKSILYAQPKERFLEYMYRNDALEGYFFAGI

SEQ ID NO: 12941 - DNA, 360 bp, Unknown
  Obtained from environmental sample
  misc_feature (1)..(360): n is a, c, g, or t
atgccttacaaaaaaaaatctttagaattgcataaaaaaatgaaaggaaaaattgaaattacttccaaggtgaaagtaaaaactatggatgatttatcaacagtttacactcccggagttggcgctgtttcaatggcaataagcaaaaatataaataaaagctgggaattaaccaatagaggtaatcaagtagcaatagtaacggatggaactgcagtgttggggcttggaaatataggtccagaggctggtatgccggtcatggagggcaagtctatcatattcaaggaattcgctggtattgatgctataccgctttgtatagctacaactgatctagacgagatagtaaagttttga

SEQ ID NO: 12942 - protein, 119 aa, Unknown
  Obtained from environmental sample
  DOMAIN (16)...(119): Malic enzyme, N-terminal domain
  misc_feature (1)..(119): Xaa is any amino acid
MPYKKKSLELHKKMKGKIEITSKVKVKTMDDLSTVYTPGVGAVSMAISKNINKSWELTNRGNQVAIVTDGTAVLGLGNIGPEAGMPVMEGKSIIFKEFAGIDAIPLCIATTDLDEIVKF

SEQ ID NO: 12943 - DNA, 411 bp, Unknown
  Obtained from environmental sample
  misc_feature (1)..(411): n is a, c, g, or t
ttgtttttcgagggaggaaaaaattatattccttttcttcgccgaacatcttgggggaagatttttaagaaacatttaaatagttttttaatgaaagaagttgatcatgataggattatggtttgtggttggattatgggatcatgtttgatgttcgaaaaaaatattttaaataaaattggtggtggatttgatgagagattttttatgtattttgaagatactgacttatgcagaagagtaaatgaatttaataaaaaagttgtatataatcctgatgcaatcgtagttcatgaccacagtcgagatagtgcacgtgagccttggtatatctctccttttgttagtaagttaactagagaacatataaagtcgtatgtaaaatattttattaagtggtatgggaaataa

SEQ ID NO: 12944 - protein, 136 aa, Unknown
  Obtained from environmental sample
  misc_feature (1)..(136): Xaa is any amino acid
MFFEGGKNYIPFLRRTSWGKIFKKHLNSFLMKEVDHDRIMVCGWIMGSCLMFEKNILNKIGGGFDERFFMYFEDTDLCRRVNEFNKKVVYNPDAIVVHDHSRDSAREPWYISPFVSKLTREHIKSYVKYFIKWYGK

SEQ ID NO: 12945 - DNA, 513 bp, Unknown
  Obtained from environmental sample
  misc_feature (1)..(513): n is a, c, g, or t
gtggatttggtggttctttttgatacttatggtccaggataccctcaagttttgccgggaatgagcaaactgaaaaagagacttaacaaagttggctattatttcaataaacatatattaagttttaagaatgctgaccgccaaggcaagatcaattatttgcgttattaccgtgatttttttcctgaatttttaagaatgctgaatcggaatgttctggaaaaaataaaccgttggaaatctgagcggttaattcctgatgagatcaaagaggtgattcggtctaatatggaggcttcagcgaaatatcaacccgaaccttattttggaaaagtcgttctaataaaggttacccaccagcccccgggaataatttcagatccgatgttgggttggggaaatgtggaaataaaagactttagggtccatgaggttgaagcacatcatggaagtattatttttgaaccaagtgtcaaagaagttgttgagatcatgagacaatatttaaactag

SEQ ID NO: 12946 - protein, 170 aa, Unknown
  Obtained from environmental sample
  misc_feature (1)..(170): Xaa is any amino acid
MDLVVLFDTYGPGYPQVLPGMSKLKKRLNKVGYYFNKHILSFKNADRQGKINYLRYYRDFFPEFLRMLNRNVLEKINRWKSERLIPDEIKEVIRSNMEASAKYQPEPYFGKVVLIKVTHQPPGIISDPMLGWGNVEIKDFRVHEVEAHHGSIIFEPSVKEVVEIMRQYLN

SEQ ID NO: 12947 - DNA, 849 bp, Unknown
  Obtained from environmental sample
  misc_feature (1)..(849): n is a, c, g, or t
atgaataaaaacaataaaataacgttcttgtcacacctacttgtttgggttgtcttatttagtatgccttatgcattgtcatatggccaagaacaagatatcaatagagtaattgcgcacttttggattcctttaatattttacgctgttgtattctatctcaattattttattttaatagaccggtttttgtttgtaaaaaaaacgagtttattcatcatcataaatgttgttgttattattgttttcttactcttaaaagaatatattgaaagtactctttttcaagatttcgttggaaaagcacccaaggataatgatggtaatggtcctccatttaagatgtttatttatgtgcaaatgctatcatatttggcacctttgttattttctattgctataaaaaccacaaaacgttgggtaaaaacagaagccgaacgtaaagaagcagcaaattttaagttacaatcagagttgcaacatttacattatcagttgcaaccacactttttttttaattcgttaaacaatatttattcgttggtagatatatcaccagaacaagccaaaacctctattcacagcttaagcaagttaatgcgctatatgctttatgaaaccaatttagaacttgttccgctgtcaaaagaaatcgattttatgaaaaagtatatcgatttgatgaagttgcgagtctccgataaaaccaaggtgaattatagttttccgaaggaagaaaatggccttaaaatcgcacctttattatttatttcattaaaaaaaaaatgctttttaaaccttggtgtttcccgcctagcaaaaaaagttaccctttcaaataaaaaatga

SEQ ID NO: 12948 - protein, 282 aa, Unknown
  Obtained from environmental sample
  DOMAIN (158)...(241): Histidine kinase
  misc_feature (1)..(282): Xaa is any amino acid
MNKNNKITFLSHLLVWVVLFSMPYALSYGQEQDINRVIAHFWIPLIFYAVVFYLNYFILIDRFLFVKKTSLFIIINVVVIIVFLLLKEYIESTLFQDFVGKAPKDNDGNGPPFKMFIYVQMLSYLAPLLFSIAIKTTKRWVKTEAERKEAANFKLQSELQHLHYQLQPHFFFNSLNNIYSLVDISPEQAKTSIHSLSKLMRYMLYETNLELVPLSKEIDFMKKYIDLMKLRVSDKTKVNYSFPKEENGLKIAPLLFISLKKKCFLNLGVSRLAKKVTLSNKK

SEQ ID NO: 12949 - DNA, 807 bp, Unknown
  Obtained from environmental sample
  misc_feature (1)..(807): n is a, c, g, or t
ttggggattttttnngaatatgaagatgatatagatttaattattactgatgttaatatgccaaatatgaatggtttagatatgacaaaagagagtaaagctatcaacccaaatatcccaattgttgtggcaacagcattttcaaactctgaatatctccttgaagctattgaactaggtgttgataaatatgtattaaaacctattaatattaaaaaactacttgatactatgaatcaatcattaatgtatcatgaattaagagatttatataaagatcaactcactcatcttccaaatagaaatgcccttataaaagatgtaaagaattcagactcaacactcttagctcttattgatattgataaattttctgttttaaatgacctttatggagaggaatttggagataaaatacttttaagttttacagaacaaattaaaaatacctttcaaaaattttataaaatttatcgagtaggttcagatagatttgttgtattgtgttcttgtgatgatgatattagttgtcagagtgattttaaagaattagcaaatcaattttctaatatcattgataaggatgggattaatgttgatgatacaaatatagatattaatatcactattggagttgctcaatcaaaagataaacatgcctttgaatatgcacaaagagctatgcaaaaagctcgaaagaagtatttacagattttagaatatgatgaatcattatttgaacaaaagaaagatattcaagaaaatatcacatggataaaaaaagataaaaagtggaattgcagataa

SEQ ID NO: 12950 - protein, 268 aa, Unknown
  Obtained from environmental sample
  DOMAIN (3)...(86): Response regulator receiver domain
  misc_feature (1)..(268): Xaa is any amino acid
MGIFXEYEDDIDLIITDVNMPNMNGLDMTKESKAINPNIPIVVATAFSNSEYLLEAIELGVDKYVLKPINIKKLLDTMNQSLMYHELRDLYKDQLTHLPNRNALIKDVKNSDSTLLALIDIDKFSVLNDLYGEEFGDKILLSFTEQIKNTFQKFYKIYRVGSDRFVVLCSCDDDISCQSDFKELANQFSNIIDKDGINVDDTNIDINITIGVAQSKDKHAFEYAQRAMQKARKKYLQILEYDESLFEQKKDIQENITWIKKDKKWNCR

SEQ ID NO: 12951 - DNA, 750 bp, Unknown
  Obtained from environmental sample
  misc_feature (1)..(750): n is a, c, g, or t
gtggaagtaaaaaaacaaacagaacgcatgaagaaaggagaagtaaagaaattttttgagcaaaccgatatttattttaattacgattacaacataaaaattagaactgaaactgtagctgatttcattaaaaaccttgagtttaacaatgtattagatatgccatgcggaaatggttatatttccctaaaaaacagcaaaaatttcaaacagttaactttggtagatttttctgaaaacatgattaagttggctaaagaaattgccacagaacaagctgccaaaaatgtttctttcctaagaagtgatatttacgatactaacttcgaacccgaagcttttgatttagtgatatctctgggtattttagctcatgttgatgacgtagagaaattcttaacctacatacaatcgttagtacaaccaaaaggacatattattattcaaaataccgattacgaccataattacagtcggctaataaggttttatttaggaataagaaggttggcagggaaagacaaataccaacttaataaagttcctgcaaaattggtggaaaatagctttaaaaaagcaggttttacttgcaaaaataaatttcgatacaaccaatcttttgttggactttcaaaattattttccaacgaaaaaaaatacgaattaacccgaagatggtttggaaatgttgccaaaaacaaaaatgcaaaacttggaagtgattacatttatctatttccaaaaaattga

SEQ ID NO: 12952 - protein, 249 aa, Unknown
  Obtained from environmental sample
  DOMAIN (9)...(218): ubiE/COQ5 methyltransferase family
  misc_feature (1)..(249): Xaa is any amino acid
MEVKKQTERMKKGEVKKFFEQTDIYFNYDYNIKIRTETVADFIKNLEFNNVLDMPCGNGYISLKNSKNFKQLTLVDFSENMIKLAKEIATEQAAKNVSFLRSDIYDTNFEPEAFDLVISLGILAHVDDVEKFLTYIQSLVQPKGHIIIQNTDYDHNYSRLIRFYLGIRRLAGKDKYQLNKVPAKLVENSFKKAGFTCKNKFRYNQSFVGLSKLFSNEKKYELTRRWFGNVAKNKNAKLGSDYIYLFPKN

SEQ ID NO: 12953 - DNA, 741 bp, Unknown
  Obtained from environmental sample
  misc_feature (1)..(741): n is a, c, g, or t
atggctgggcggagaggaatttctgaagctgtagatttgtgttattgcccagcaggttatctcaaacagggcttgttgaacaatcctgttatctatgaaaatcaagcctatagcaccgatatttgcatagatgatgttgttgtaaaaaaacaggaagaggcccgaatcggaaacaattcttccgatgtgaaaaaacgaaaatatgtccataataccgtcgcgcatattgtgagcgccggggaaaaatacacattaaacggatttaatactgtaataacgttacgttatgttctgggttttctattaaacaacagcttggtcgatgataaacgatttcagttttttacagatggtcataaaaccctaaacatctgtatattcaaggccttttcatggaataacaatattggtttgatacttgattggtaccatctacagaagaaatgtaaagaaaagctgagcatggctatgaaaggccgaataattagaaacgaactcttgacagatctcatgcctttattatggcacggtttaacccagggagcgatcgatttactcaagaatacggatgatggcttaataagaaacaagaaacgtatgactgagctgatcgaatatatggagcgaaatcgatcgcatatcccctgcttatgctgtcagaaaaaggttaggccttcgaaattcaagtaccattggagaaaagatgaatcacctggtcgttgcagagaagcagaagcataa

SEQ ID NO: 12954 - protein, 246 aa, Unknown
  Obtained from environmental sample
  misc_feature (1)..(246): Xaa is any amino acid
MAGRRGISEAVDLCYCPAGYLKQGLLNNPVIYENQAYSTDICIDDVVVKKQEEARIGNNSSDVKKRKYVHNTVAHIVSAGEKYTLNGFNTVITLRYVLGFLLNNSLVDDKRFQFFTDGHKTLNICIFKAFSWNNNIGLILDWYHLQKKCKEKLSMAMKGRIIRNELLTDLMPLLWHGLTQGAIDLLKNTDDGLIRNKKRMTELIEYMERNRSHIPCLCCQKKVRPSKFKYHWRKDESPGRCREAEA

SEQ ID NO: 12955 - DNA, 513 bp, Unknown
  Obtained from environmental sample
  misc_feature (1)..(513): n is a, c, g, or t
ttgaatagactttttgtagtaaaaaagcctgtatttattagttcaaatttttatcttaatagaataaaacgaaaatataaaacaaaaaaagctggctttagtgggactttggatccttttgcttgtggttgtttgatagttgcttttgggcagtattctaagctttttcgatatttgaaaaaaacaccaaaatcatatcgtgctactatttttttaggagcagaaagtagttctttagatattgaaaatgtagaagtgacaaatcataattcaaaagtatttacagaagatgatattaaagaaaaactagaaagtttaaaaggtactttagaatatctaccaccaaaatacagtgcaaaaaagatagatggtcaaagagcttataatctagctcgtgagggtatagagtttgatatgaagaaaatcacctcgcaagtatttgatgtgaagtttatcaactactctcatccttttataacatttgatataactgtaagtgaaggaagcatataa

SEQ ID NO: 12956 - protein, 170 aa, Unknown
  Obtained from environmental sample
  DOMAIN (20)...(170): TruB family pseudouridylate synthase (N terminal domain)
  misc_feature (1)..(170): Xaa is any amino acid
MNRLFVVKKPVFISSNFYLNRIKRKYKTKKAGFSGTLDPFACGCLIVAFGQYSKLFRYLKKTPKSYRATIFLGAESSSLDIENVEVTNHNSKVFTEDDIKEKLESLKGTLEYLPPKYSAKKIDGQRAYNLAREGIEFDMKKITSQVFDVKFINYSHPFITFDITVSEGSI

SEQ ID NO: 12957 - DNA, 801 bp, Unknown
  Obtained from environmental sample
  misc_feature (1)..(801): n is a, c, g, or t
atgtcgaattggctggggaacaactttgtaatcattgatactgatgataaaaaaagaattcttaaaacaatagataaagaaactactacagctgtcttagcatcagagatatcaaaatttaaaaactctatagtgagtgtagaggaagcaaaagcaacagcacaagatagaaactataagcaaatagcagatgtatatgagaaatatgaaaactatttagagcaaaacaatcttgtggattttgatgatttattactcctaacatataagatacttcaaaaaaaccctcaactatcaaaagatacaagtgatagatataaatatattatggtagatgagtatcaagataccaacgagttacaatataaacttttaaaacaactttgtagtgaacacaataatatttgtgtagttggagatgatgatcagtctatatatggttggagaggtgcaactattaaaaatatccttacatttagtgatacttttaatgatacactagttataaaactagaagaaaattatcgttcaactcataaaatactttttcatgcaaatgctttaatagaacacaatagagacagactagggaaaaagcttgtagggactagagaagagggtaactctataaaaatttacgaatcaaacgatgaaaatgatgaaacaagaaaaatcgttgatgatattaaaaaacttatcgaacaaggtgaatcagcaaaagatattgcagtcttatttagggtaaatgctttaagtagggcgttagaagaggggctcaatagatcaaatatcaacctataa

SEQ ID NO: 12958 - protein, 266 aa, Unknown
  Obtained from environmental sample
  DOMAIN (2)...(266): UvrD/REP helicase
  misc_feature (1)..(266): Xaa is any amino acid
MSNWLGNNFVIIDTDDKKRILKTIDKETTTAVLASEISKFKNSIVSVEEAKATAQDRNYKQIADVYEKYENYLEQNNLVDFDDLLLLTYKILQKNPQLSKDTSDRYKYIMVDEYQDTNELQYKLLKQLCSEHNNICVVGDDDQSIYGWRGATIKNILTFSDTFNDTLVIKLEENYRSTHKILFHANALIEHNRDRLGKKLVGTREEGNSIKIYESNDENDETRKIVDDIKKLIEQGESAKDIAVLFRVNALSRALEEGLNRSNINL

SEQ ID NO: 12959 - DNA, 579 bp, Unknown
  Obtained from environmental sample
  misc_feature (1)..(579): n is a, c, g, or t
atgagtagaaaattaacaggtccatttggttgggttggtggcaagacaaaacttgcagctgaaatagtagaaatgataccaccacataaattatatattgaagtgtttggtggagctttaaatatactttatggaaaatcaaaatcacatatagaagtggtaaatgatataaactctgagcttataaacttacatcgatcaataagaaataatcctgaaacgctgtcaatatttttaaatcaacttctcatatcaagggaattatttaataatataagagatggaaaaataaaaccaaaaaacaatatagaaagagctgctttttatatgtatatacttacacaatcttttggtgcaaaaggagataactttggtatgaacgcaaaagctatgacaaaaccagttaatatatataaatcatatcaaaaatggagcaaaagattaaaaggtgtaacaatagaaaataaatcatttcacgacttaatacctctctatgacaatgatgaagcatttttttattgcgacccaccttatgttgaaacagagagttactataaaaatactggagggatttggtga

SEQ ID NO: 12960 - protein, 192 aa, Unknown
  Obtained from environmental sample
  DOMAIN (11)...(191): D12 class N6 adenine-specific DNA methyltransferase
  misc_feature (1)..(192): Xaa is any amino acid
MSRKLTGPFGWVGGKTKLAAEIVEMIPPHKLYIEVFGGALNILYGKSKSHIEVVNDINSELINLHRSIRNNPETLSIFLNQLLISRELFNNIRDGKIKPKNNIERAAFYMYILTQSFGAKGDNFGMNAKAMTKPVNIYKSYQKWSKRLKGVTIENKSFHDLIPLYDNDEAFFYCDPPYVETESYYKNTGGIW

SEQ ID NO: 12961 - DNA, 714 bp, Unknown
  Obtained from environmental sample
  misc_feature (1)..(714): n is a, c, g, or t
atggagagcaaactattccagtctgaaaaaatggcctctatgggagaaatgataggaaatatagcacatcaatggagacaaccactttctgtaatatctacaggtgtaacaggtatgaagatgcaaaaagagtatgatttattaactgatgatatttttaatgatacttgtgatgtgattaataaaaatgcacagtatctctctacaacaatagatgattttagaaactatattaaaggggatagagagaaaaaagtttttaatctcaaaaaagatattaatagttttatccatcttgtagagggttcaattcataaatataatataaatatagttttggatttagatgaatctatagagattaatggatatgaaaatgaacttacccagtgttttatcaatattttcaataatgctaaagatgttttagtagagatagaaaatagttctgaacgatatttgtttatatctacaaatatagaaaatgatagagtgctaataaaaattaaagataatggtggtgggatacaagaagatataatgccaaaaatatttgaaccatatttcaccactaaacatcaatctcaaggtacaggacttggtcttcatatgactcatagtcttatagttgaggggatgaatggtactattgaggcaaaaaatatttgttttgattatgaagataaaaactataatgacccgagccaattctga

SEQ ID NO: 12962 - protein, 237 aa, Unknown
  Obtained from environmental sample
  DOMAIN (13)...(83): His Kinase A (phosphoacceptor) domain
  misc_feature (1)..(237): Xaa is any amino acid
MESKLFQSEKMASMGEMIGNIAHQWRQPLSVISTGVTGMKMQKEYDLLTDDIFNDTCDVINKNAQYLSTTIDDFRNYIKGDREKKVFNLKKDINSFIHLVEGSIHKYNINIVLDLDESIEINGYENELTQCFINIFNNAKDVLVEIENSSERYLFISTNIENDRVLIKIKDNGGGIQEDIMPKIFEPYFTTKHQSQGTGLGLHMTHSLIVEGMNGTIEAKNICFDYEDKNYNDPSQF

SEQ ID NO: 12963 - DNA, 672 bp, Unknown
  Obtained from environmental sample
  misc_feature (1)..(672): n is a, c, g, or t
ttgaaaccaagcagaacctctacgaatatttgtcaggattttgttactgaaaacaagcgcacaaaattcgaggaaattataagtaagcggacaaagtatctgactgttgtacttgaggatatttatcagccccacaatgcaagtgctgtattgcgtacctgcgattgttttggggttcaggatgtgcacatcatcgaaaaccaaaataaatatgaagtgaatcctgacattgccctcggttcgtcaaagtggctgacgatgataaaacacaatgggctggaaaataatactcctgaagctttgcaaaagcttcgtgataaaggatataggattgtagctacgacgcctcacaaaaacgatgtcagccttcaggaactttcaatcgataaaggcccgattgctttggtgtttggtactgaaatgcgcggattaaccgaaaacgcccttacgcttgctgatgagtttgtgaaaataccgatgtatggttttaccgaaagttttaacatttctgtatcggcaggcatttcacttttttatttaaccgagaagattagaaactcaaatattgaatggcaaatttcggaagatgaaagaattgatattcttttaaattgggcccgccaagtggtgaagagaagtgaccttttggaaaaagaatttttcaaaacatga

SEQ ID NO: 12964 - protein, 223 aa, Unknown
  Obtained from environmental sample
  DOMAIN (33)...(178): SpoU rRNA Methylase family
  misc_feature (1)..(223): Xaa is any amino acid
MKPSRTSTNICQDFVTENKRTKFEEIISKRTKYLTVVLEDIYQPHNASAVLRTCDCFGVQDVHIIENQNKYEVNPDIALGSSKWLTMIKHNGLENNTPEALQKLRDKGYRIVATTPHKNDVSLQELSIDKGPIALVFGTEMRGLTENALTLADEFVKIPMYGFTESFNISVSAGISLFYLTEKIRNSNIEWQISEDERIDILLNWARQVVKRSDLLEKEFFKT

SEQ ID NO: 12965 - DNA, 642 bp, Unknown
  Obtained from environmental sample
  misc_feature (1)..(642): n is a, c, g, or t
ttgttaaaagataacggtgaagtttcaatcaaacctatttataaaaaaattaatagatttgaaggtgcccaatcgaagtatcctcaccctaactatcttaatatccactggatcgaaaaccaatggggaaatacctatgcgattgttgaaaatatagatggtaaatatggcattattaataaaaatggaaaactattgttaaaagttgtttatgattctattggaagattttataatggatatgcaaagattgaagttaataataaatttggtttaatcgatgaaaattttgaagttgtagtaaaacctatctatgatgaaactttggagtttgtttataattctataattgtgaagaaatttgggaaatatggatgtatcaacaaaaacttagaacttaaaatcgcacctgaaatggatatgatttatttacaacaagaggggttaaaaagatttgaacaaaacaacaaatggggatttttagatactaattgtaattttgttacaaaaccaatttatgattatgcttatgatttttccaatggatttgctaaagtaaaaagtggtaaaaactggggatttttagatacagaaggtaatttattaacaaagcctatttttgaggatgccgatagattttag

SEQ ID NO: 12966 - protein, 213 aa, Unknown
  Obtained from environmental sample
  misc_feature (1)..(213): Xaa is any amino acid
MLKDNGEVSIKPIYKKINRFEGAQSKYPHPNYLNIHWIENQWGNTYAIVENIDGKYGIINKNGKLLLKVVYDSIGRFYNGYAKIEVNNKFGLIDENFEVVVKPIYDETLEFVYNSIIVKKFGKYGCINKNLELKIAPEMDMIYLQQEGLKRFEQNNKWGFLDTNCNFVTKPIYDYAYDFSNGFAKVKSGKNWGFLDTEGNLLTKPIFEDADRF

SEQ ID NO: 12967 - DNA, 657 bp, Unknown
  Obtained from environmental sample
  misc_feature (1)..(657): n is a, c, g, or t
ttgtttgacaaaatatcacaacaagcaaataagcttgtatcaattacaaaaaaacataatagaaattctaaaacaaaagttgtcgtaataacatcaggtaaagggggtgttggaaaatcaacactcacctcaaatatagcttatttactatcaaggcaaggtaaaaatgtcgcagtgcttgatgcggacataggattagcaaatcaacaagtattatttgatataaaaccacaaaaaactttctttgattatttagaaggtatatgtgaactagaagagatatttttagaaacaggatacagtggagtaacattaattgctggcaaaagtggttatcagtatggaaaaataaataatagtatgatattttcaagagtagtagatgatatactagatttaaatagatatgatattttactcattgacacgggtgcagggattaatgaacatgtacgagagtttttatatttcacggataatattttagcgataaccaccacagatccaagtgctttacccgatgtttatgcacttttaaagatgataagtttgaaaaaagagaaagtaatgttatgttttaattataccttcaaatatgaaataggggaaacaataactaactctataacaaattgggccctaaaaaataaactttaa

SEQ ID NO: 12968 - protein, 218 aa, Unknown
  Obtained from environmental sample
  DOMAIN (28)...(209): CobQ/CobB/MinD/ParA nucleotide binding domain
  misc_feature (1)..(218): Xaa is any amino acid
MFDKISQQANKLVSITKKHNRNSKTKVVVITSGKGGVGKSTLTSNIAYLLSRQGKNVAVLDADIGLANQQVLFDIKPQKTFFDYLEGICELEEIFLETGYSGVTLIAGKSGYQYGKINNSMIFSRVVDDILDLNRYDILLIDTGAGINEHVREFLYFTDNILAITTTDPSALPDVYALLKMISLKKEKVMLCFNYTFKYEIGETITNSITNWALKNKL

SEQ ID NO: 12969 - DNA, 807 bp, Unknown
  Obtained from environmental sample
  misc_feature (1)..(807): n is a, c, g, or t
atgattttttcggaccacgaactcggaggagcggtcttagtagaatttgctaaagaattacagataagttgtactagaagtgaagaattgaggctttttagagttagtggagatgaatttgctatattagcagtagatgttcctgctcatatagttgtacaaaaagctcaagaaattgcaaagtttataaactcacatgtttatgatgtaaaagctgaaagtatagaattaagtgcaacgttaagtgtttctttggaagaaaaagaacaattattaattacagcagatatggctctcaaaattgcaagaaaagaagcaaaagatattatagtttatgattcaacaatgaacttggataaagagtatcaaaacaatatgctttggactaaaaaaatcaaagatgcaattgaaaatgataaaatagttctcttttttcaaccaattgttaataatagtgatggcaaaataaaaaaatatgaatcactaataagactaatagacgaagatgacaatgtaatagtgccatccttctttttagatatagcaaaaaaagcaaagctttataagcaacttacaaaaattgttgttcaaaaaagttttgaggcatttagggaaaatgattttgaattttctatcaatcttagtatagatgatattatggataaagatatccattcatacattataaatatgttagatatctataatatttcaaatagagttatttttgaaatcgttgagtctgagagtattgaaaattttgatgagatacaaaagtttataaaaaatgttaaagggtgggcgtag

SEQ ID NO: 12970 - protein, 268 aa, Unknown
  Obtained from environmental sample
  DOMAIN (124)...(268): EAL domain
  misc_feature (1)..(268): Xaa is any amino acid
MIFSDHELGGAVLVEFAKELQISCTRSEELRLFRVSGDEFAILAVDVPAHIVVQKAQEIAKFINSHVYDVKAESIELSATLSVSLEEKEQLLITADMALKIARKEAKDIIVYDSTMNLDKEYQNNMLWTKKIKDAIENDKIVLFFQPIVNNSDGKIKKYESLIRLIDEDDNVIVPSFFLDIAKKAKLYKQLTKIVVQKSFEAFRENDFEFSINLSIDDIMDKDIHSYIINMLDIYNISNRVIFEIVESESIENFDEIQKFIKNVKGWA

SEQ ID NO: 12971 - DNA, 402 bp, Unknown
  Obtained from environmental sample
  misc_feature (1)..(402): n is a, c, g, or t
gtgtatgttggaaattttaatgatagggctataaaagtatttaatcaaggagagatgagtcgtgattttacatatatagatgatataataagtggaatagtgagagtaatagataatccaccattgaagctatgtacaccttttaagatttataatattggaaataattcacctgtaaaattgctagattttataaaaactcttgaaaaatatttaggtaaagatactcaaaaagaatttttacctatgcaagatggagatgttgtttcaacatacgcggatgtaacagaacttattgatgattttaattataaacctagtacatctttaagtgttggaattaaaaaatttgtgaaatggtataaagacttctatggtcagaaaggaaatagtatacaatga

SEQ ID NO: 12972 - protein, 133 aa, Unknown
  Obtained from environmental sample
  misc_feature (1)..(133): Xaa is any amino acid
MYVGNFNDRAIKVFNQGEMSRDFTYIDDIISGIVRVIDNPPLKLCTPFKIYNIGNNSPVKLLDFIKTLEKYLGKDTQKEFLPMQDGDVVSTYADVTELIDDFNYKPSTSLSVGIKKFVKWYKDFYGQKGNSIQ

SEQ ID NO: 12973 - DNA, 753 bp, Unknown
  Obtained from environmental sample
  misc_feature (1)..(753): n is a, c, g, or t
ttggcactggaaaggctgggttttgaaaataatggaaaatttttaaaaaaggattttcaggtaggatttaaaggtgataaatccccccttacggaagcagataaggtttcaaataaaattatttgtagtagtttacaaaaactttatccaaatataccagttcttagtgaagagaataaagaggtattatataaggatagaaaagattgggagtattattggtgtatagatccaattgatggaacgaaagagtttattaaaaaaaatgatgagtttacaataaatatagcgttaatacataatgagacaccaatattgggagttgtatatgcacctgcaattgatgatatgtatagtgcaaaaaaaggtgaaggggcttttttaaataatcaaaaattacctttaaaagtaaatgataatccagaagataaactttttgttgtagcaagtaaatcacacttatctgttgaaacacaagagtttatagataattttgattcaaaagagattgaacaagtttcaaaaggaagttcattaaaactatgtatggttgctgagggaagtgcggatatatatccaagacttgctccaacaatggagtgggatacagcagcggcagatactattgttcgtgaatctggaaagatgacctatcaatatcattcaaaatttaatattgaaaatttaacattagaaaagcctatcatttataacaaagaaaatttattgaatccctattttgttgtagtgtaa

SEQ ID NO: 12974 - protein, 250 aa, Unknown
  Obtained from environmental sample
  DOMAIN (2)...(250): Inositol monophosphatase family
  misc_feature (1)..(250): Xaa is any amino acid
MALERLGFENNGKFLKKDFQVGFKGDKSPLTEADKVSNKIICSSLQKLYPNIPVLSEENKEVLYKDRKDWEYYWCIDPIDGTKEFIKKNDEFTINIALIHNETPILGVVYAPAIDDMYSAKKGEGAFLNNQKLPLKVNDNPEDKLFVVASKSHLSVETQEFIDNFDSKEIEQVSKGSSLKLCMVAEGSADIYPRLAPTMEWDTAAADTIVRESGKMTYQYHSKFNIENLTLEKPIIYNKENLLNPYFVVV

SEQ ID NO: 12975 - DNA, 843 bp, Unknown
  Obtained from environmental sample
  misc_feature (1)..(843): n is a, c, g, or t
atgggagtatttgtagagtacacaagctctagcggagttaaaatctttcatgggttaaatattttagagagtggtgaaaagagagagtatccttatgccaaactactcacacctctcataggttatccacataagcttgaagaagatggctatactagaatccatggagtcaaaggtatagaaaagagctatgaaaaagatctgatttctcatcaaaatggctatgagagagcaaaacgagatgtaaacaactacatgattttaaataaagagggttataaaaaagagactatagatggctatgatattaaactttttaccccgcttacactgcaagttagaattgaaaaagttttagatagatataaaaaagatttagatgcaaatgagattatgatagtagttatgaattcacaaaatggtgcgattttatcactatcgagttcaaatagatttcttcctacagatattaaaaagagtgaatatccatatctgaatacagaccctatcgagtatgagtttgagataggttctgttatgaaaccaatcatcttctcactactgcttgataagaaactgataaatccatatgatctagtanatggtcataacggtcgttttaaaataggtaaaaaaatcataacagatgagcataaatttgattggttgtctgctgaaaatgtaatagtatattcatctaatgtcggtatttctcaacttgcacaaaagttaaatcctcttgactatcatgaaggattaaaaaagttccggtttttcaaaaaaaagcaatatagacgttcccttatgaaaaagcgggttcaattccccccattaaaaaattaa

SEQ ID NO: 12976 - protein, 280 aa, Unknown
  Obtained from environmental sample
  misc_feature (1)..(280): Xaa is any amino acid
MGVFVEYTSSSGVKIFHGLNILESGEKREYPYAKLLTPLIGYPHKLEEDGYTRIHGVKGIEKSYEKDLISHQNGYERAKRDVNNYMILNKEGYKKETIDGYDIKLFTPLTLQVRIEKVLDRYKKDLDANEIMIVVMNSQNGAILSLSSSNRFLPTDIKKSEYPYLNTDPIEYEFEIGSVMKPIIFSLLLDKKLINPYDLVXGHNGRFKIGKKIITDEHKFDWLSAENVIVYSSNVGISQLAQKLNPLDYHEGLKKFRFFKKKQYRRSLMKKRVQFPPLKN

SEQ ID NO: 12977 - DNA, 504 bp, Unknown
  Obtained from environmental sample
  misc_feature (1)..(504): n is a, c, g, or t
atgagaagatacaagttatgtatgaggatagatatgaaaacagaacttttaaatgctgatggtgatctatccattactatacagagaaagtatgattatgtttttggtggaaacttcagagtcagattagataaagatgaaaaaaaactttttgatgccaaactagagtttggaacagatgctattgatcataatgattgtcctaccgtatttaaaagagacattatcttaaaagtatttaaatatctaatgatttttggattcataggtatttttgtcagcttctttgtagatgaaaatagtataaaacttctaagcatgacagaaaattatattatgttaacaatgctggcacttttggttatatatttcttttacgcacagtatgaagctaaagagtacaagcagtgtacatcttgtcaaattggaaatattattggaacaacactaatgaattttgtaaaattgataattctatttttatctaatttctttattttataa

SEQ ID NO: 12978 - protein, 167 aa, Unknown
  Obtained from environmental sample
  misc_feature (1)..(167): Xaa is any amino acid
MRRYKLCMRIDMKTELLNADGDLSITIQRKYDYVFGGNFRVRLDKDEKKLFDAKLEFGTDAIDHNDCPTVFKRDIILKVFKYLMIFGFIGIFVSFFVDENSIKLLSMTENYIMLTMLALLVIYFFYAQYEAKEYKQCTSCQIGNIIGTTLMNFVKLIILFLSNFFIL

SEQ ID NO: 12979 - DNA, 654 bp, Unknown
  Obtained from environmental sample
  misc_feature (1)..(654): n is a, c, g, or t
gtgtatgctgataatataaatgaagcactaaactcgatagatgatgatactgtagctgtgatgctcgaactgattcaaggggaaggtggcatctttatgccagatatagagcacgtgaaaaagttaagtgaggtattggaaaaaaagaaatcattattgataatagatgaaattcacacacgtgtttatagaagtggagaatttctaatgtcacatcactatgagattagaccaaatattataactttagcaaaaggcttagcaccaggagttccaatagggatgatgatgacagatttaaaaaatgttttaaatcaaggtgatcatggttcaacttttggtggaaatcacctttcgacaacagtgtccactaaggttttaaatattttagaaaagtataaaaagagtggaaaactcgaatcaaatattaagtattttaatgattatctagattattttatagaaaaatatccatctttgtttttatcaaaaaatggctttggttttatgcttggagtgaaacttaaagatgaaatcatgctcaacgagattgtcaagttatctttaaagtatggtgttgtaacacctcaatcagggcagcatatagttcgatttttaccacctcgcaatgtatcaatcaaagagatagattag

SEQ ID NO: 12980 - protein, 217 aa, Unknown
  Obtained from environmental sample
  DOMAIN (1)...(217): Aminotransferase class-III
  misc_feature (1)..(217): Xaa is any amino acid
MYADNINEALNSIDDDTVAVMLELIQGEGGIFMPDIEHVKKLSEVLEKKKSLLIIDEIHTRVYRSGEFLMSHHYEIRPNIITLAKGLAPGVPIGMMMTDLKNVLNQGDHGSTFGGNHLSTTVSTKVLNILEKYKKSGKLESNIKYFNDYLDYFIEKYPSLFLSKNGFGFMLGVKLKDEIMLNEIVKLSLKYGVVTPQSGQHIVRFLPPRNVSIKEID

SEQ ID NO: 12981 - DNA, 687 bp, Unknown
  Obtained from environmental sample
  misc_feature (1)..(687): n is a, c, g, or t
ttggaaaatagtaaaagaaaagagttaacttctggaataaagaaatatccagtacaaaatgcttttctaacaaaaacaggatttcttgatgatgaacaagctgatttagaacatcacggaggagaaaataaagcactttttatgttttctcaaaaaacttatgaagagataaataaagagtgtaaaatagatttaaatattgatgaagtgtctcattttggagaaaatattattttttcaaatgtttcagaagttgatatatgtgttggggatatttatcaattaggagaggtaaaaatacagattacacaaccaagacaaccatgttggaaattaagtgccaatacaaataaaaaagagatgacaaaatttatttttcaaagtgctttaactggttggtatgcaaaagttttaatagaaggtgtagtttgtgtaaatgatgagcttattttagaaaagagaaaatatcccaacttaagtattaaaaaacttaatcaacttattgtaaatccattattagatgaaaaaataaccaatgaagcactaagttgtaaagtattaggaaagccatttttggagtcgttgtcaaaacgatataaatttcaagataaagatgaacagttttcattttatcatactttaaaggggagaaatgaaagaaaacaattatttattgccattatataa

SEQ ID NO: 12982 - protein, 228 aa, Unknown
  Obtained from environmental sample
  DOMAIN (26)...(151): MOSC domain
  misc_feature (1)..(228): Xaa is any amino acid
MENSKRKELTSGIKKYPVQNAFLTKTGFLDDEQADLEHHGGENKALFMFSQKTYEEINKECKIDLNIDEVSHFGENIIFSNVSEVDICVGDIYQLGEVKIQITQPRQPCWKLSANTNKKEMTKFIFQSALTGWYAKVLIEGVVCVNDELILEKRKYPNLSIKKLNQLIVNPLLDEKITNEALSCKVLGKPFLESLSKRYKFQDKDEQFSFYHTLKGRNERKQLFIAII

SEQ ID NO: 12983 - DNA, 555 bp, Unknown
  Obtained from environmental sample
  misc_feature (1)..(555): n is a, c, g, or t
atgactgccaatgaagctatcactgtattagagagaggagaaacagatttagccattcttgatattaacatcaagggagataaagatggtatatggctggcaaaacagataaaagagcagtatcagataccattcatttttctaacagcatatggtgatgattctaccattaaaagagccattgaaactgaaccttatggttttctggtaaaaccattaaacaaagtagatgtttttacttccatagaagtagcagcaaagaattttgccaaacaaagtagcgacattacaaaaagagagaatccccttatcgtatccaaggacaatatatttattcaagatgaatacatgtttacaaaactcaaaatagttgatattctttttgtaaagtcaaacaacaattaccttgaagtttatttgcctggcaaaaagcatttagtaagtggtaaactaaccgattttgcaaaaaaattatctgcgaatttcatacaagtacaccaatcatatgtaattaataccgaagctgtggaaaaatttggcacaaatttttattaa

SEQ ID NO: 12984 - protein, 184 aa, Unknown
  Obtained from environmental sample
  DOMAIN (119)...(183): LytTr DNA-binding domain
  misc_feature (1)..(184): Xaa is any amino acid
MTANEAITVLERGETDLAILDINIKGDKDGIWLAKQIKEQYQIPFIFLTAYGDDSTIKRAIETEPYGFLVKPLNKVDVFTSIEVAAKNFAKQSSDITKRENPLIVSKDNIFIQDEYMFTKLKIVDILFVKSNNNYLEVYLPGKKHLVSGKLTDFAKKLSANFIQVHQSYVINTEAVEKFGTNFY

SEQ ID NO: 12985 - DNA, 738 bp, Unknown
  Obtained from environmental sample
  misc_feature (1)..(738): n is a, c, g, or t
gtggctacgtcaagttactttattactacaaaaataagtgagttgtcacaacttgaacttataaatacagcagtggagttaagtagctcatttttaaaacttctagaggttggttcacttgaacttactttaccagaaattaaagagtatagtgatcatcttgagtatttacaagatcaattttttaaaattgatttagcacaaaagcttaatattgtaaaacataattttgatgaaaactcaccaaatgcaaatcgtcttagaagtaaattatctcttttagaaaataggataaaagagagagttgaaactacaaaaaataatattatgcttgaagatttttttagacaacatgatttagctgaaaaagagcagatgatatttttagcacttttaaaagaggaatatggtggaagtgatgaatcaattcgagatatgaactctttgattgcattggtttcaagtgatgattatgagaagataaagcacagaagtttactagaagagagtggaaatcttatctccaatggattgattgattatgacgaaatgttaacaccttttggtggaatcaatagaaacttttatattccagagtcaattttatataagatatcacatccggttaaaaaagagaaaagaccacaaaaaataacgcttgatatgctaatacaagatcaagagatgtttgaacttattgagcctaaaaaatctttaaaagatgttgttttaaaatga

SEQ ID NO: 12986 - protein, 245 aa, Unknown
  Obtained from environmental sample
  misc_feature (1)..(245): Xaa is any amino acid
MATSSYFITTKISELSQLELINTAVELSSSFLKLLEVGSLELTLPEIKEYSDHLEYLQDQFFKIDLAQKLNIVKHNFDENSPNANRLRSKLSLLENRIKERVETTKNNIMLEDFFRQHDLAEKEQMIFLALLKEEYGGSDESIRDMNSLIALVSSDDYEKIKHRSLLEESGNLISNGLIDYDEMLTPFGGINRNFYIPESILYKISHPVKKEKRPQKITLDMLIQDQEMFELIEPKKSLKDVVLK

SEQ ID NO: 12987 - DNA, 576 bp, Unknown
  Obtained from environmental sample
  misc_feature (1)..(576): n is a, c, g, or t
ttgattggtagtaagatttcatctacgtatgggggtgagagtgaaaaaaatgtacgaaaaatatttgatgaatacaaagagttatgtacaaaaactaaaacagaaccagtactattgttaaacgaagcagatcagtttttaagtaatcgtgtaagtggacaaataagtggtagcgataaaatgcacaatcaaatgcaaaatatatttttagagcagattgagagatttgagggaatactagttgcaactactaatttattagatagtatagataaagcattttcaagaagatttaattacaaaattgagtttttaaaaccagatttggagcaaagaaaaattttatgggagaaacttcttccatcagagttacctttggagaaaaactttaatatagagaaattagcaaaatcatcactcacaggtggacaaatagagcttgtgattaaaaatacagcttataaactagcaatagatgaaaaagcagtatttaaagtagaagactttttagaagagattcaaaaagaggaaaaagggcaatttgataaagataaaacagtagggtttatgagttaa

SEQ ID NO: 12988 - protein, 191 aa, Unknown
  Obtained from environmental sample
  DOMAIN (1)...(159): ATPase family associated with various cellular activities (AAA)
  misc_feature (1)..(191): Xaa is any amino acid
MIGSKISSTYGGESEKNVRKIFDEYKELCTKTKTEPVLLLNEADQFLSNRVSGQISGSDKMHNQMQNIFLEQIERFEGILVATTNLLDSIDKAFSRRFNYKIEFLKPDLEQRKILWEKLLPSELPLEKNFNIEKLAKSSLTGGQIELVIKNTAYKLAIDEKAVFKVEDFLEEIQKEEKGQFDKDKTVGFMS

SEQ ID NO: 12989 - DNA, 915 bp, Unknown
  Obtained from environmental sample
  misc_feature (1)..(915): n is a, c, g, or t
atgcttaaagcaaaaaatgccgatggcgtttggatagaagaacccctaactttttctttttcaataactccgccttggtggcaaaccacttggttttatgtaactgctgttattactattcttttaagtttttattttataatggattatagaaccaaaaaacttaaaaaagaacaacaaattttaacacaaaaagtggatgaaagaactaaagaattacgtgaagagaaagaaaaagtagaacaaataaactccaaattagaaacgcaaaagaaaattattgaaatcgctaataaaaacattacggacagtattaattacgctaaaaaaattcaggaagccattttacctaaagccactaaactggaaaaaataatagattttatctctattttgtttgtgcctaaagatgtggtaagtggtgatttttattggtttgaaaaaattggtaaaaagattgtcatagctgctgcagattgtaccggacatggagttccaggagcttttatgagcatgataggcatcaacaatttgaatcaaattgtgttagagaataaaactactgagcccgatactattcttaaagaactgaataactccattaaaaaagccttaaagcaagatgataaggatagcgaaagtaaagatggtatggacatcgcactgacatgtatcgattatgaaaccaataccttaacttattctggagcttttcgtccgttggtgtatataagaaataatgaattgtttgaacttaaaggttctcgacaaccaattggcggtagtgctccaaacgattttgcttacgatttacatactattccattacaaaaaggagatgttttctatttattttctgatggntatcccgaccaaatttggcggaacttaagggaaaagaaattgatggaataa

SEQ ID NO: 12990 - protein, 304 aa, Unknown
  Obtained from environmental sample
  DOMAIN (149)...(304): Stage II sporulation protein E (SpoIIE)
  misc_feature (1)..(304): Xaa is any amino acid
MLKAKNADGVWIEEPLTFSFSITPPWWQTTWFYVTAVITILLSFYFIMDYRTKKLKKEQQILTQKVDERTKELREEKEKVEQINSKLETQKKIIEIANKNITDSINYAKKIQEAILPKATKLEKIIDFISILFVPKDVVSGDFYWFEKIGKKIVIAAADCTGHGVPGAFMSMIGINNLNQIVLENKTTEPDTILKELNNSIKKALKQDDKDSESKDGMDIALTCIDYETNTLTYSGAFRPLVYIRNNELFELKGSRQPIGGSAPNDFAYDLHTIPLQKGDVFYLFSDGYPDQIWRNLREKKLME

SEQ ID NO: 12991 - DNA, 399 bp, Unknown
  Obtained from environmental sample
  misc_feature (1)..(399): n is a, c, g, or t
atggacatcgcactgacatgtatcgattatgaaaccaataccttaacttattctggagcttttcgtccgttggtgtatataagaaataatgaattgtttgaacttaaaggttctcgacaaccaattggcggtagtgctccaaacgattttgcttacgatttacatactattccattacaaaaaggagatgttttctatttattttctgatggttatcccgaccaatttggcggacctaaaggaaagaaattgatgaataaaaatctaaaagataaattcttagctattcaccaagaaagccctgctaaacaaaaagagatacttttaaatgactttaatacttggaaaggcgacaatgaacaaattgatgatattctaattatcgtgattaaaatttaa

SEQ ID NO: 12992 - protein, 132 aa, Unknown
  Obtained from environmental sample
  misc_feature (1)..(132): Xaa is any amino acid
MDIALTCIDYETNTLTYSGAFRPLVYIRNNELFELKGSRQPIGGSAPNDFAYDLHTIPLQKGDVFYLFSDGYPDQFGGPKGKKLMNKNLKDKFLAIHQESPAKQKEILLNDFNTWKGDNEQIDDILIIVIKI

SEQ ID NO: 12993 - DNA, 852 bp, Unknown
  Obtained from environmental sample
  misc_feature (1)..(852): n is a, c, g, or t
gtggcgtttcggcttcgaaatattatcattttagtattggcttcagtagaaaaattaattctaagcatggaaaccatttatgatgtggtaacagctgttgagaaaattggtttagtaacggatttacctttagaaaaagacaatggaactaaacttaataaggataacaatggcattgagattaaagtgaaaaatttaagctaccaatttaaagatgaaaacacgcctattgttaatgatattagttttacattacagaaaggagaaagattaagtgttgttggagcaagtggtgccggaaaatcatttttattacaattaattgctggactttatgaagaatttaaaggttcaattgtgtttgatggacatccaattaacagtctgtgtaaagaaaatttaagaacatatattggagataatttttctaaagaagacatttttaaaggcacaatagctgaaaatatttcaattggtaaaaagtcaattactattgaggatattaaaaatgccgcaactattttaggattaattgattatatagagtctcaacctcaaggttacaatacagtgcttctttctgaaggaaaaaatttaccgaaaagtactcgtttaaaaattattttagcaagagctatagttggaaatcaaaaattattattgctagaagatagctacaaacaattgcccaccattgataaacaacgctttttagattacatttgtgctgaagataaaacgtggtctattattgcagtgactgaagatttggatattgcaaaaaaactcgatgctatacgtggtttaagaaaaaggaaaaacaattggcctagggttcttacgaagccttaa

SEQ ID NO: 12994 - protein, 283 aa, Unknown
  Obtained from environmental sample
  DOMAIN (88)...(272): ABC transporter
  misc_feature (1)..(283): Xaa is any amino acid
MAFRLRNIIILVLASVEKLILSMETIYDVVTAVEKIGLVTDLPLEKDNGTKLNKDNNGIEIKVKNLSYQFKDENTPIVNDISFTLQKGERLSVVGASGAGKSFLLQLIAGLYEEFKGSIVFDGHPINSLCKENLRTYIGDNFSKEDIFKGTIAENISIGKKSITIEDIKNAATILGLIDYIESQPQGYNTVLLSEGKNLPKSTRLKIILARAIVGNQKLLLLEDSYKQLPTIDKQRFLDYICAEDKTWSIIAVTEDLDIAKKLDAIRGLRKRKNNWPRVLTKP

SEQ ID NO: 12995 - DNA, 417 bp, Unknown
  Obtained from environmental sample
  misc_feature (1)..(417): n is a, c, g, or t
atgcaaactataagcatgacaaagcctgaagcaaaagtattcaagatgttagctgaacaagaaattgcaagaagagatccgctatggttagttgatagtggatatttacatattaagacaaaagctggtgaattagttcctttcgtattaaataaagcccaacgtagattacatgagaaaataagagaattgtgggaagctaacaaaatgatacgcttatttgtacttaaagcacgtcaattaggtgttagcacatacattgaagctcttatttattcaatcacttctcgattagataaccaaaatagtacaataatttctgatgatcttgacggctcaaactatatttttgaaatggcaaagctctatcaagaaaagctccctaaacatttgtcagtaaagacaaaaaaaaggtaa

SEQ ID NO: 12996 - protein, 138 aa, Unknown
  Obtained from environmental sample
  misc_feature (1)..(138): Xaa is any amino acid
MQTISMTKPEAKVFKMLAEQEIARRDPLWLVDSGYLHIKTKAGELVPFVLNKAQRRLHEKIRELWEANKMIRLFVLKARQLGVSTYIEALIYSITSRLDNQNSTIISDDLDGSNYIFEMAKLYQEKLPKHLSVKTKKR

SEQ ID NO: 12997 - DNA, 570 bp, Unknown
  Obtained from environmental sample
  misc_feature (1)..(570): n is a, c, g, or t
gtgatgcttaggtggaaatatggaaaagaaagggaagaaaaagctgccgaaaaaagacaacaaccaccagatgcagcttttaccaccaataattttttaatccctaaagaactttttaatagaattaaatttgatgaaagcttagtaaaatatggacatgaagacaccttatttggttacgaattgtcccaacaaaacatcattattcatcatattaacaatccgcttatacatgttggcttaaaaagtgcgaccgtttttttacaaaaaactgaagaaggtataaaaaatcttattcagataatacacactaaaaaaccggaaaaaaaattctatcaagatgttaaattactctcttacttcttaataattaagcaatatacgctaaattggctctttaatttattgcacaaacttttgcaccaaaaaatatataaccacctgaaaaacaacacaattcctaccataaaatatttcgatttatataaaatcttacttcttaattatcactctcaacttatccgcaaaaaaacgttaataaaacaatttaagtcggtgtattttaattag

SEQ ID NO: 12998 - protein, 189 aa, Unknown
  Obtained from environmental sample
  misc_feature (1)..(189): Xaa is any amino acid
MMLRWKYGKEREEKAAEKRQQPPDAAFTTNNFLIPKELFNRIKFDESLVKYGHEDTLFGYELSQQNIIIHHINNPLIHVGLKSATVFLQKTEEGIKNLIQIIHTKKPEKKFYQDVKLLSYFLIIKQYTLNWLFNLLHKLLHQKIYNHLKNNTIPTIKYFDLYKILLLNYHSQLIRKKTLIKQFKSVYFN

SEQ ID NO: 12999 - DNA, 483 bp, Unknown; identical to SEQ ID NO: 10411
  Obtained from environmental sample
  misc_feature (1)..(483): n is a, c, g, or t

SEQ ID NO: 13000 - protein, 160 aa, Unknown; identical to SEQ ID NO: 10412
  Obtained from environmental sample
  DOMAIN (1)...(159): Thiamine monophosphate synthase/TENI
  misc_feature (1)..(160): Xaa is any amino acid

SEQ ID NO: 13001 - DNA, 624 bp, Unknown
  Obtained from environmental sample
  misc_feature (1)..(624): n is a, c, g, or t
gtgaaacccaaacactttttaaaagggggggaaatttgggagaaatgggtgccaaaaagtttgtgggatatgggggaccaacagaagggatttccggaaccaaaaagggtcccgcgtgaatttatacaggcggctggggggctattggctattccgggtcccacgatttttgacagtttgatttcccggggaacagcagattatgaaatagaggtggtgaaaaaggatggaacgctttttcccgcccatatcctcctcaattgtacggataacaatgacccaatggcctggaccattgccactgttattgatatgtcccaaagaaaggcggcggacaaagaaacctatgaacgggaaaggctccagggggttttggagatggccggagccgtttgccatgaaatcaaccaacccctccaggcgattttaggctattctgaacttttgctcatgggcctccccctggaacccatggacaatcatctgaattctattaaatcccaggccacccggttggggaaaataaccaaaagattgtccaacattacccggtacaagacagtggattaccccggcaacaccaagattgtggatatatgggggactgacagcgattctgtctaa

SEQ ID NO: 13002 - protein, 207 aa, Unknown
  Obtained from environmental sample
  DOMAIN (123)...(188): His Kinase A (phosphoacceptor) domain
  misc_feature (1)..(207): Xaa is any amino acid
MKPKHFLKGGEIWEKWVPKSLWDMGDQQKGFPEPKRVPREFIQAAGGLLAIPGPTIFDSLISRGTADYEIEVVKKDGTLFPAHILLNCTDNNDPMAWTIATVIDMSQRKAADKETYERERLQGVLEMAGAVCHEINQPLQAILGYSELLLMGLPLEPMDNHLNSIKSQATRLGKITKRLSNITRYKTVDYPGNTKIVDIWGTDSDSV

SEQ ID NO: 13003 - DNA, 600 bp, Unknown
  Obtained from environmental sample
  misc_feature (1)..(600): n is a, c, g, or t
atggaggaaataatgaaaaaatatattgaagttcccaaaactgtagcaatcgaaactaccaacagatgtaatgcaagttgctggttctgtcctaataactctctctcaagaaacagactgacaatgagtgatgatctttttaagaagatcataaaagattgtatggaattcaatcctgaatacatcgagccctttctcaatggagaaccattaatggatcctcagataattaaaagaattgtctatattaaagaaaagctccctaaaacaaaaatcaaactttacacaaatggaaatctattgactccggataagatcgacgaactttcacaaatcggtattgaagaactttttgtaagcataaactcacttaactgtctgaagtatcataacataatgggactcaaccttaagaaaacacttgagaatatgaactatcttacaaacaaacaaaaacctttagccaaaaagattgtatttcgcatgaccagaactgaagacacatcactttatgaacaggatcagtttttaaaatactgtaaagaccaaggtgtaaaaccttacatagtcggactttttaattatnaggggaagtattga

SEQ ID NO: 13004 - protein, 199 aa, Unknown
  Obtained from environmental sample
  DOMAIN (17)...(180): Radical SAM superfamily
  misc_feature (1)..(199): Xaa is any amino acid
MEEIMKKYIEVPKTVAIETTNRCNASCWFCPNNSLSRNRLTMSDDLFKKIIKDCMEFNPEYIEPFLNGEPLMDPQIIKRIVYIKEKLPKTKIKLYTNGNLLTPDKIDELSQIGIEELFVSINSLNCLKYHNIMGLNLKKTLENMNYLTNKQKPLAKKIVFRMTRTEDTSLYEQDQFLKYCKDQGVKPYIVGLFNYXGKY

SEQ ID NO: 13005 - DNA, 507 bp, Unknown
  Obtained from environmental sample
  misc_feature (1)..(507): n is a, c, g, or t
gtgtttttaagacgactttccatattaatcctcttgctttttgttttcttcactgccaaagcagagctgataaacattggtattctagataaacaagcggttacctcttttgttttttatcctcaagtaggaaaatacattgtttatacagaaagcggaaagttattggatattgacaacaccgaaattcttgaaatctcctacagaaaccaaaaagtatttttaaaaacccttgacaaggattacggatattttaacaaaattagaattattggcgtaagcaatcaaaatgcttttaaactcaagaccaacaagcctgtcgggaaaattattcagtatgaagataatttgtttgtaagagcacatccttttcatagttatttacaactgataaacaacattaacattgataattatgttgcaggtgtagtagaagccgaagtgggtaaaagtccaccggaggaatattttaaattgcaagctattatttgccgtacttatgcgtga

SEQ ID NO: 13006 - protein, 168 aa, Unknown
  Obtained from environmental sample
  SIGNAL (1)...(20)
  misc_feature (1)..(168): Xaa is any amino acid
MFLRRLSILILLLFVFFTAKAELINIGILDKQAVTSFVFYPQVGKYIVYTESGKLLDIDNTEILEISYRNQKVFLKTLDKDYGYFNKIRIIGVSNQNAFKLKTNKPVGKIIQYEDNLFVRAHPFHSYLQLINNINIDNYVAGVVEAEVGKSPPEEYFKLQAIICRTYA

SEQ ID NO: 13007 - DNA, 768 bp, Unknown
  Obtained from environmental sample
  misc_feature (1)..(768): n is a, c, g, or t
ttgacaaggttcataatatcaaatttgattattatattgataggggaggtaaatatggatccattagtatctgaaaataaccatattgataagcttacgaaaattgggatagcactctctgctgaaactgatcttgaggatttttttaatcttgttcttgaagaagctattgcctactcccacgctgatgccggctcaatctatacggtttccaaagataaaagataccttgattttcagtttatttgtactatttctaaaaaggttcaattggggcctgctgatgtatccaaatggcccagtgttcagctttatgatgaacagggagaaaaacggttgaagaattttgtttcctatgtttatcacagcaaagaaactctctgcctggatgatgtctatgatcaggatatttttgataacagcggtactaagggttacgacaggaataacaactatcgttctaaatcgatggtggcaattcccatgatgaatcatgagaaagaagtccttggggttattcaactaataaactctattgataacaattttgacatcgttcccttcactcaatctcatatccgtatgctgacatccctggcatctcaagctggtattgccctatcaaataagaaactgattgaagggttggaaaacttgttgttacaattcatccagaccattgctggagctattgaccgaaaatctaaatatacaggaggtcatatctccagggttgccaaattaaccgagcaacttggtttaaaataa

SEQ ID NO: 13008 - protein, 255 aa, Unknown
  Obtained from environmental sample
  DOMAIN (44)...(207): GAF domain
  misc_feature (1)..(255): Xaa is any amino acid
MTRFIISNLIIILIGEVNMDPLVSENNHIDKLTKIGIALSAETDLEDFFNLVLEEAIAYSHADAGSIYTVSKDKRYLDFQFICTISKKVQLGPADVSKWPSVQLYDEQGEKRLKNFVSYVYHSKETLCLDDVYDQDIFDNSGTKGYDRNNNYRSKSMVAIPMMNHEKEVLGVIQLINSIDNNFDIVPFTQSHIRMLTSLASQAGIALSNKKLIEGLENLLLQFIQTIAGAIDRKSKYTGGHISRVAKLTEQLGLK

SEQ ID NO: 13009 - DNA, 402 bp, Unknown
  Obtained from environmental sample
  misc_feature (1)..(402): n is a, c, g, or t
atgaaggaaaattatatgaagactattttgattgttgaagatgacaaaaatctacagattaccctgtcacatatattgaaagaagagggatacgatgtaattactaccatgtggggtagtatggctatcgaagaagttaaaaaaggtatcccggatctcgttcttttagatattatgttacctggtatgaatggaatgcaggttttggaaaaggtcaaaaaaatcgagaaaaacctgcctgttataatgattaccggttatggcagtacagaaagcgcaatcagagcaattgaactaggtgcctatgattatatcaacaaacctttcgattatgagaagttgatcttcaaaatcagtaatgctattctcaagagtcatcataaaaaacgtggttttctgtga

SEQ ID NO: 13010 - protein, 133 aa, Unknown
  Obtained from environmental sample
  DOMAIN (7)...(126): Response regulator receiver domain
  misc_feature (1)..(133): Xaa is any amino acid
MKENYMKTILIVEDDKNLQITLSHILKEEGYDVITTMWGSMAIEEVKKGIPDLVLLDIMLPGMNGMQVLEKVKKIEKNLPVIMITGYGSTESAIRAIELGAYDYINKPFDYEKLIFKISNAILKSHHKKRGFL

SEQ ID NO: 13011 - DNA, 417 bp, Unknown
  Obtained from environmental sample
  misc_feature (1)..(417): n is a, c, g, or t
atgcttaaatttgaagatagaaaatttctgttgctttttgtcgggattctattttttatcctggtggtttttaattttatctcttggaaaaataaggagcttaatattttagaagtttctttcttggatgtggggcagggagatgcaactttgattagttacttgggaaaataccaagtgttgattgacggaggaccaagtggtaaaaaattgctccaagagcttggtaaacaaatgcctacagtggacaaagagatcgaaatagtcattctgactcatcctgattttgaccatcttgccggactaattgatgttgcaaggaattataaagtaggaatttttttggaccacggacaaaaagctgatactgaaatttttaaagatttggaaaatgttttgattaaagaagaaatttaa

SEQ ID NO: 13012 - protein, 138 aa, Unknown
  Obtained from environmental sample
  misc_feature (1)..(138): Xaa is any amino acid
MLKFEDRKFLLLFVGILFFILVVFNFISWKNKELNILEVSFLDVGQGDATLISYLGKYQVLIDGGPSGKKLLQELGKQMPTVDKEIEIVILTHPDFDHLAGLIDVARNYKVGIFLDHGQKADTEIFKDLENVLIKEEI

SEQ ID NO: 13013 - DNA, 534 bp, Unknown
  Obtained from environmental sample
  misc_feature (1)..(534): n is a, c, g, or t
atgacaaaaaccttactcatactggcacatccgcacttacaaaagtccattagaaataaattgattgcggaggaattagctactgaaaataatttagaaatacgagatttaacagctctttatccaacttacaacatcaatgtagctgaagaacaaaaaaagttggtagaggcagatgtaattgtttttcaataccccttgtattggtatagcgttccaccaattcttaaattatggatagatgaagtgtttacttatggttttgcttttggcaaaggaaattaccaattagaaggcaaaaaaatagtggtttcttgcactattggtagtaatgaagacatttatcctgctgaaacactagaaaaaatatttttcccatttcaaggattggcagactattgtaaaatagattattttgctgaagtaatctcttttggagaggttcatgttcccggagaaccaaaaagtggcttggaaaattcagcaagaaaacatgcagaaaaattgcgtcatttattacgttcggtaacgtaa

SEQ ID NO: 13014 - protein, 177 aa, Unknown
  Obtained from environmental sample
  DOMAIN (2)...(171): Flavodoxin-like fold
  misc_feature (1)..(177): Xaa is any amino acid
MTKTLLILAHPHLQKSIRNKLIAEELATENNLEIRDLTALYPTYNINVAEEQKKLVEADVIVFQYPLYWYSVPPILKLWIDEVFTYGFAFGKGNYQLEGKKIVVSCTIGSNEDIYPAETLEKIFFPFQGLADYCKIDYFAEVISFGEVHVPGEPKSGLENSARKHAEKLRHLLRSVT

SEQ ID NO: 13015 - DNA, 309 bp, Unknown
  Obtained from environmental sample
  misc_feature (1)..(309): n is a, c, g, or t
atgaaaaaaatcttaataaaaaatatcaaacaacttattcaggtagaaacaaccccaaaagaaaaagtagttggtaaagaaatggcaacgcttaatactattgaaaatgcatggttagccatagaaggagatagaataattgcctttggttctatggataactggggtggaattacagattggtctaatttagatctcattgatgctagtgacaaaatagtgatgcctactttttgcgactctcacacgcatatcgtttttgctgctaccagagaaagtctcaagccgatcctgataatcgttctgtaa

SEQ ID NO: 13016 - protein, 102 aa, Unknown
  Obtained from environmental sample
  misc_feature (1)..(102): Xaa is any amino acid
MKKILIKNIKQLIQVETTPKEKVVGKEMATLNTIENAWLAIEGDRIIAFGSMDNWGGITDWSNLDLIDASDKIVMPTFCDSHTHIVFAATRESLKPILIIVL

SEQ ID NO: 13017 - DNA, 552 bp, Unknown
  Obtained from environmental sample
  misc_feature (1)..(552): n is a, c, g, or t
atgtttaaaaatataattatgtctctactattatgcacatttttgagtgctgaaagttttgatgaatttttacaaaaggctataaaaaatagtccttacatggagtcttcagcattagctgttaaacaaactaaagaacagggcaatattcttacaaggtatgaaaaccctacattagaattagagtattcttcttttgaaccagatattggctcaaatgataatggataccgtattggttattcccaacctattcgcttatggggtgtgagtgaagataaaaaaaatctaacagacgcaaataataaaaatgcggacattaactatgctcaaaagagagctatatttattcgtgatatatctcttgcatatacatcttactctgaggcaaacaagctattaaatttatctgatgaaagcttgagtattgccaaaaaaatatatgaaatctctattgctcgacttgagagcggtacaatttctcagggtataaaacttcaagctcaagtagattatgaaatgagtaaaaactcaaaagtactttatctttag

SEQ ID NO: 13018 - protein, 183 aa, Unknown
  Obtained from environmental sample
  SIGNAL (1)...(17)
  misc_feature (1)..(183): Xaa is any amino acid
MFKNIIMSLLLCTFLSAESFDEFLQKAIKNSPYMESSALAVKQTKEQGNILTRYENPTLELEYSSFEPDIGSNDNGYRIGYSQPIRLWGVSEDKKNLTDANNKNADINYAQKRAIFIRDISLAYTSYSEANKLLNLSDESLSIAKKIYEISIARLESGTISQGIKLQAQVDYEMSKNSKVLYL

SEQ ID NO: 13019 - DNA, 444 bp, Unknown
  Obtained from environmental sample
  misc_feature (1)..(444): n is a, c, g, or t
gtgtataatagcacgaggagaaggagaaaaatgcgcctacatactacttcaaaatatgctattcgcatcttgagttatatggctaatggggacagtagttcgctgtttcacgccaaacatatatcagaggagttagatatctcctataagtttcttagtaaaattatgaatgaacttgtaaaagctgagtttattatctctctgcgtggaagagatgggggttataaacttgcaaaagacgcttcatccataagcattatggaaattgtaaacttatttaatgatttcaatcataaagaggagtgcctcttaggtattggaaaatgcgatggagcaaatccatgtgccacgcatgcaaaatgggtaagaccaaaaagcctcttagaagagatgtttgagagcactactttacaaaatcttgaaggggatggatttaagatatga

SEQ ID NO: 13020 - protein, 147 aa, Unknown
  Obtained from environmental sample
  DOMAIN (11)...(132): Transcriptional regulator
  misc_feature (1)..(147): Xaa is any amino acid
MYNSTRRRRKMRLHTTSKYAIRILSYMANGDSSSLFHAKHISEELDISYKFLSKIMNELVKAEFIISLRGRDGGYKLAKDASSISIMEIVNLFNDFNHKEECLLGIGKCDGANPCATHAKWVRPKSLLEEMFESTTLQNLEGDGFKI

SEQ ID NO: 13021 - DNA, 537 bp, Unknown
  Obtained from environmental sample
  misc_feature (1)..(537): n is a, c, g, or t
gtgaatcaccctccagcagaatctatagggttaaatttgttagcatatttaaaatcaaataaacaaaacgagttacacttttggctcgactttaaaaatttatctcctaaaaatgcttcacaagcattaaaaagattagaatttttatgtgctgaactaaccatttcacaaaaacaatttattgtagaagcaacacaaccagagttattgaaactatttaccaacaatggcttccaaacaagttattatttgcactggcccgggttataccaattaagcggggaaaatttaaataaaaccatcacccaaataaaagctaatatttttcctgagttgtcttatatttcttcttcttaccatgattatgaaattatgcagcaacattttcctgaccaagaaaaattattgtggttaacagaaaatgaatctaaattttcatcaacaattaaagaacattggcatagaatggaaatagctaaccatcctaaaacgaaagtgttgttagtgcaaattaacaccaaagcacccaatcgttaa

SEQ ID NO: 13022 - protein, 178 aa, Unknown
  Obtained from environmental sample
  misc_feature (1)..(178): Xaa is any amino acid
MNHPPAESIGLNLLAYLKSNKQNELHFWLDFKNLSPKNASQALKRLEFLCAELTISQKQFIVEATQPELLKLFTNNGFQTSYYLHWPGLYQLSGENLNKTITQIKANIFPELSYISSSYHDYEIMQQHFPDQEKLLWLTENESKFSSTIKEHWHRMEIANHPKTKVLLVQINTKAPNR

SEQ ID NO: 13023 - DNA, 462 bp, Unknown; identical to SEQ ID NO: 11319
  Obtained from environmental sample
  misc_feature (1)..(462): n is a, c, g, or t

SEQ ID NO: 13024 - protein, 153 aa, Unknown; identical to SEQ ID NO: 11320
  Obtained from environmental sample
  misc_feature (1)..(153): Xaa is any amino acid

SEQ ID NO: 13025 - DNA, 525 bp, Unknown
  Obtained from environmental sample
  misc_feature (1)..(525): n is a, c, g, or t
atgattccacaactaaataaatatgaactaaaattcccggatgcttctaaagcgaatacagatgggatactagcctggggaggggatttaactccttcaagactaacttatgcttatcaaaatggcatctttccatggtttaacaacgaagatcccattatatggtggtcaccaaatcccagattaattatggaactagctgattttaagataagtaagtccctaaaaaaaagtatgaaaaagtttgactacaagtttgatacaaactttgaagaagtaatgctcagatgctcaacagtagaaagaaatgatcagactggcacctggataagccaagacataatcgaagcatatacaacacttcatgctatgggaagagcacattctattgagagttatcaggacggagctctagttggtggtttatatggtgtagttgtcggaaaagttttctgtggtgaatctatgtttgcagaggtgagtgatgcttccaaatcgtcttatgctatgttaattaaacattaa

SEQ ID NO: 13026 - protein, 174 aa, Unknown
  Obtained from environmental sample
  DOMAIN (31)...(174): Leucyl/phenylalanyl-tRNA protein transferase
  misc_feature (1)..(174): Xaa is any amino acid
MIPQLNKYELKFPDASKANTDGILAWGGDLTPSRLTYAYQNGIFPWFNNEDPIIWWSPNPRLIMELADFKISKSLKKSMKKFDYKFDTNFEEVMLRCSTVERNDQTGTWISQDIIEAYTTLHAMGRAHSIESYQDGALVGGLYGVVVGKVFCGESMFAEVSDASKSSYAMLIKH

SEQ ID NO: 13027 - DNA, 717 bp, Unknown
  Obtained from environmental sample
  misc_feature (1)..(717): n is a, c, g, or t
atgaaatttctacctacctctcatcaaattttgcttcgtagttccctactagttctgcttttactttgcgtaaagctaaatgctcagaaaaaagaaagtcaacgtattgccttttacaatcttgaaaatctatttcatccggataatgattctttaaaaaatgatggcgagtacactccagaaggaaaacgcaattggagtttttatcgctacaatgaaaagctaaaccatatggcaaaagccatactgagcattggtgaatggcagccaccagctattgtaggcgttgccgaagtggaaaacagacaagccctggaagatctcattaacacggaggtactgcgtaagtttaagtatgaaatcattcactttgaatctcctgacaggcgaggcattgatgtgggcatgctttatagagaagataaattcactccaatcttaagcaaacccattcctataaaaatgccgagtgaccctaagtttgtaacacgtgacattttatacagcaagggtatttttaataaacaggatacagttcatcttttattttgccattggccaagtcgttatggtggccaagctaggtcagagccaaaaaggattcaagcagctcgaaccctaaaaaacattacagattcattgcaaatgctcccttaccctacttacgtaatagctgctggcgactttaatgatgaatggacctcgagccgattctga

SEQ ID NO: 13028 - protein, 238 aa, Unknown
  Obtained from environmental sample
  misc_feature (1)..(238): Xaa is any amino acid
MKFLPTSHQILLRSSLLVLLLLCVKLNAQKKESQRIAFYNLENLFHPDNDSLKNDGEYTPEGKRNWSFYRYNEKLNHMAKAILSIGEWQPPAIVGVAEVENRQALEDLINTEVLRKFKYEIIHFESPDRRGIDVGMLYREDKFTPILSKPIPIKMPSDPKFVTRDILYSKGIFNKQDTVHLLFCHWPSRYGGQARSEPKRIQAARTLKNITDSLQMLPYPTYVIAAGDFNDEWTSSRF

SEQ ID NO: 13029 - DNA, 735 bp, Unknown
  Obtained from environmental sample
  misc_feature (1)..(735): n is a, c, g, or t
gtgatgttagatgtagaacctcttcataatttaagactagagccttatgaacccttagatgtcgtaaccgacctgagcgttaaaagttatcttctttttagcacgatagatgaagaggtctgcgcttttgcctctgagcggtatctggcagaagcaagtaacttttactcaaagatcacacataaatacccttttcaaatccttgacgaagactcctatgaccggctttacaaccgtttcttggaacttcgtaccgataaagccatagagactatgcaagaggactcgagtgtagagagtgatgatgaagacatctccttaacagattttttgcggacctcatccgacatcttgaccagtgaagagtcggctcctatcatcaagtttgtcaatgcccttttttatcaggccatcaaaaaacgcgcttcagacattcacatcgaagtcatgaaaaaacagggtgaggtcagatttagagtcgacgggatgctgagtaaaaatgcagacctcgacaagaagatagtcaacctcatcatccgccgtaataaagtcctctcaaaccctgatatctctgagaaaagaatacctcagggatggacgggacccagattaaagatcgccgggaaaaaaccctgggaaggcccgggtttcccgtccttgcccaactttctatggaaaaacgcggtttgttttgagggatcccttaggccggggtttcctaaaaaccccccgtat

SEQ ID NO: 13030 - protein, 245 aa, Unknown
  Obtained from environmental sample
  misc_feature (1)..(245): Xaa is any amino acid
MMLDVEPLHNLRLEPYEPLDVVTDLSVKSYLLFSTIDEEVCAFASERYLAEASNFYSKITHKYPFQILDEDSYDRLYNRFLELRTDKAIETMQEDSSVESDDEDISLTDFLRTSSDILTSEESAPIIKFVNALFYQAIKKRASDIHIEVMKKQGEVRFRVDGMLSKNADLDKKIVNLIIRRNKVLSNPDISEKRIPQGWTGPRLKIAGKKPWEGPGFPSLPNFLWKNAVCFEGSLRPGFPKNPPY

SEQ ID NO: 13031 - DNA, 507 bp, Unknown
  Obtained from environmental sample
  misc_feature (1)..(507): n is a, c, g, or t
atgagaaaggcatttaccctcatagagatactcgtcgccatcactatcttgtccgtaatgatgctctttttgtaccagagctacagctcgttaaacatctcaaaccgtttttataaagatgaattgggtcagatcacgaatggatatcttaagaaaaaagtattgtttttagatctctcgcttgcacataaagagaagatcaatatcttaaatcaagagaccacagaagatgtgctgtttatgcaaagctcaaactctatacacaaaagacacaacccgtatatcgcctatgtcgtgcacgactccaaactgtatagactcgaatccgcacacgagttcaaaacatatcctcttagtaccgcagaagaatatgtcgccgactgtttaggtgaggtcaacagttttagagtctatgccgctaaaggtgaagaagcatcctatctcgtgcatgcagactttaaagaaggtgaagacatcctgcttaagatcacaacattgtcgcagtaa

SEQ ID NO: 13032 - protein, 168 aa, Unknown
  Obtained from environmental sample
  misc_feature (1)..(168): Xaa is any amino acid
MRKAFTLIEILVAITILSVMMLFLYQSYSSLNISNRFYKDELGQITNGYLKKKVLFLDLSLAHKEKINILNQETTEDVLFMQSSNSIHKRHNPYIAYVVHDSKLYRLESAHEFKTYPLSTAEEYVADCLGEVNSFRVYAAKGEEASYLVHADFKEGEDILLKITTLSQ

SEQ ID NO: 13033 - DNA, 315 bp, Unknown
  Obtained from environmental sample
  misc_feature (1)..(315): n is a, c, g, or t
ttggaaacaggaattgtagttcaatgtcaaaatgagagaagtcagcataaaaataaagcaacagcaatgaaggttttaaaaagccgcttatttgatttctattctgaagaacaggaaaaagagcaggaaaagagtgcaaaagagaagaaagatatatcctggggtagccaaataagatcatatgtttttcatccttacagtatgataaaagaccatcgtacaaaatatgaggttggaaatattcaggctgtaatggatggtaaaattgataaatttatagaatcttatctaaactggaattggtctggattataa

SEQ ID NO: 13034 - protein, 104 aa, Unknown
  Obtained from environmental sample
  DOMAIN (1)...(73): Peptidyl-tRNA hydrolase domain
  misc_feature (1)..(104): Xaa is any amino acid
METGIVVQCQNERSQHKNKATAMKVLKSRLFDFYSEEQEKEQEKSAKEKKDISWGSQIRSYVFHPYSMIKDHRTKYEVGNIQAVMDGKIDKFIESYLNWNWSGL

SEQ ID NO: 13035 - DNA, 663 bp, Unknown
  Obtained from environmental sample
  misc_feature (1)..(663): n is a, c, g, or t
ttggtatccattttttctcaaacaaaattagccgaaaaatacatcgaaatgctaagggaatttgaagatcaaatgaatgaaatgtatagtttgggcttaagccctgtaagtgaaaaactcaaggttagtgttcagaagaatgaagcagagcttaatcttataaaagcaaaaaatggtttgagagtggcaaaaatgtacttaaatcatttaattggtcaggatttatatttggatgtagaagttgttaactcacttgatgaatactcggatatgatagaaatatctaatgatgagtttacagccaatgatcgtaatgaattaaaaattctgacaaaacaacttgaaatttctgaattaagcaaaaaaatagttcagtcagaatatttaccacaaattggagtaagtgcgacttatacaacttattatgtaaaaaatcttttggagaatgttaaatttcatccaagttttgccggacaaatttcaatacccattttaaattgggggcaatcaaaacataaacgaaatgcggctaaaatgaaaataaggcaagcagaaattgaattagataataccagtgaacttttaaatctggaagttcagcaagtaaaaattcaggttcaggaaaactatgaagcgcttctgatgcaaaaaagaattgaatga

SEQ ID NO: 13036 - protein, 220 aa, Unknown
  Obtained from environmental sample
  misc_feature (1)..(220): Xaa is any amino acid
MVSIFSQTKLAEKYIEMLREFEDQMNEMYSLGLSPVSEKLKVSVQKNEAELNLIKAKNGLRVAKMYLNHLIGQDLYLDVEVVNSLDEYSDMIEISNDEFTANDRNELKILTKQLEISELSKKIVQSEYLPQIGVSATYTTYYVKNLLENVKFHPSFAGQISIPILNWGQSKHKRNAAKMKIRQAEIELDNTSELLNLEVQQVKIQVQENYEALLMQKRIE

SEQ ID NO: 13037 - DNA, 351 bp, Unknown
  Obtained from environmental sample
  misc_feature (1)..(351): n is a, c, g, or t
atggctttaaagatagcaattaatggatttggtcgtatagggcgctcactaacgcgtgtaatctgcgatcgtgatgatgttgaaatagttgctattaatgatttggcttctttggagatgatggctaatcttctgaaaaacgactctgtacatggaaagttcaaacacaatattgaaaaaattgataatcatttaataattaaaaacaaaaaaataagactcttttgtgaagcagatcccgaaaatttaaattttgcacaacttggtgctgatgtagttatagagtgcaggggtctttctcttacgcaagatagcacaagaactcccatagaaaagggttttaaaaagtaa

SEQ ID NO: 13038 - protein, 116 aa, Unknown
  Obtained from environmental sample
  DOMAIN (3)...(116): Glyceraldehyde 3-phosphate dehydrogenase, NAD binding domain
  misc_feature (1)..(116): Xaa is any amino acid
MALKIAINGFGRIGRSLTRVICDRDDVEIVAINDLASLEMMANLLKNDSVHGKFKHNIEKIDNHLIIKNKKIRLFCEADPENLNFAQLGADVVIECRGLSLTQDSTRTPIEKGFKK

SEQ ID NO: 13039 - DNA, 489 bp, Unknown
  Obtained from environmental sample
  misc_feature (1)..(489): n is a, c, g, or t
atgaaaaattggaacgagcggccattcgaaataaaaaatctttttaatcctgctttttgtggtgttgtccttcttcgtgctcttcaaggctttgaagaagaagataattcgggcatgccattctcattagcgcttcttgtacttccattaattttgaataaagattctcgcgagatcatttcaataaattcccgtagttatttccttaaaataattaataataatcctcagatgcttgtgggttttgcgagtcgagcaagaagtcttcttccgtatacctttgaggctctgggttttaccatgcaacttcaatctttcaaggttacaagtcaaggacatctcaagttattagaaaaaggtattcgcaaaaaaattgatggtacttcagaatcaattgaatgtcagaaaattgcaaaaattgtgggtaaaaactttgccaaaattggtgaccgtataacaatttatacaaccctgggaattagaccatga

SEQ ID NO: 13040 - protein, 162 aa, Unknown
  Obtained from environmental sample
  misc_feature (1)..(162): Xaa is any amino acid
MKNWNERPFEIKNLFNPAFCGVVLLRALQGFEEEDNSGMPFSLALLVLPLILNKDSREIISINSRSYFLKIINNNPQMLVGFASRARSLLPYTFEALGFTMQLQSFKVTSQGHLKLLEKGIRKKIDGTSESIECQKIAKIVGKNFAKIGDRITIYTTLGIRP

SEQ ID NO: 13041 - DNA, 774 bp, Unknown
  Obtained from environmental sample
  misc_feature (1)..(774): n is a, c, g, or t
atggttaacattaatccaagaacaaaagagtgtaatactttaacatctcctcaaagagtttttctctcaggtcacagaggtacaggaaaaactacagagcttttaaaacttaaaaatgacctaaaccaagaaaattgttttttaacaatattttgtgaaattagtagtgaagagttagatgtaaataatatagacttcatggatatcatgatatttgtcttagaacaattagtaaaagaactcaacaaaagagagataaacgtagacaaaagtggtgttgaatctttttatgattggtatatccaaagaatagttgaaataaataataaaatagatgtttctgccacaattgaaatagaaaaaaatgttgatgtaaatattcaaacattgtttaaacttatcacaaaaacaaaatcaaaactttccgctacacaagatacaaaagatgttataagaagagtttttacaaataatttttcagattttagtctaaaatttaatgagtttgtcttatacgtaaaagaggctttgcaaaaatataatatagctaaagatctacttttcataatagatggttttgagaaaataggaacttttgaatatagaaaaaaaatattgatagatgattcaaataagtttgtagagataaaaataaatatgattattgctctgcctattgatctgtttagttatgttaataattctagtaatttttctactccaatatcttttcctttgattgcattagatcacaagggaatagaaagattttaa

SEQ ID NO: 13042 - protein, 257 aa, Unknown
  Obtained from environmental sample
  misc_feature (1)..(257): Xaa is any amino acid
MVNINPRTKECNTLTSPQRVFLSGHRGTGKTTELLKLKNDLNQENCFLTIFCEISSEELDVNNIDFMDIMIFVLEQLVKELNKREINVDKSGVESFYDWYIQRIVEINNKIDVSATIEIEKNVDVNIQTLFKLITKTKSKLSATQDTKDVIRRVFTNNFSDFSLKFNEFVLYVKEALQKYNIAKDLLFIIDGFEKIGTFEYRKKILIDDSNKFVEIKINMIIALPIDLFSYVNNSSNFSTPISFPLIALDHKGIERF

SEQ ID NO: 13043 - DNA, 714 bp, Unknown
  Obtained from environmental sample
  misc_feature (1)..(714): n is a, c, g, or t
ttggtaaaaaaagtggtattagagtacggtgatggaacagataaaaaaataaatcctatcatcttagaaaatgagagttataaaaaattatcaaattctacagttaaaaagatgagcagaaaaaaacagaaaaaaatagctatcccaaaagaagatataacaactatcaaagagataaaaatagacaacttctttagtatagaaaaacttagattagataatttagataagaaaaaagagatctacatagtcggtgaaaatggtgatggaaaaactttacttctgcaagctatagcactggctttaaaaggaacaactgagggtagagttgttgactttcttaaaacagataagagaaaaaaagagtatacattagaggttatagacagcaaagatgagttatttactgccaatgcttcaaaaacttatagaaatatgtttgcttacggtgctcatagaaacaataactgtaaaagtgaagatgaagagagtggatatttaactctatttgacaatagcatagatttaaaagatcctaaaaagtggctaatagaactctacaatgcgcaaatgtcacaagaagaaaatatcttatctgttgatgatgcaaaaaaactattaagtgttttactaagtagtgaaaacaatagtgagattgagatagatataagatataacagtgttgatttttttgaaaagagatactccctgtaa

SEQ ID NO: 13044 - protein, 237 aa, Unknown
  Obtained from environmental sample
  misc_feature (1)..(237): Xaa is any amino acid
MVKKVVLEYGDGTDKKINPIILENESYKKLSNSTVKKMSRKKQKKIAIPKEDITTIKEIKIDNFFSIEKLRLDNLDKKKEIYIVGENGDGKTLLLQAIALALKGTTEGRVVDFLKTDKRKKEYTLEVIDSKDELFTANASKTYRNMFAYGAHRNNNCKSEDEESGYLTLFDNSIDLKDPKKWLIELYNAQMSQEENILSVDDAKKLLSVLLSSENNSEIEIDIRYNSVDFFEKRYSL

SEQ ID NO: 13045 - DNA, 507 bp, Unknown
  Obtained from environmental sample
  misc_feature (1)..(507): n is a, c, g, or t
ttgtctaccatgaataaaatttttaaaatattacttcttattactataatctcaactattttatttttctatttattgtatcaagatcaacaattcaaaaacaatccattatctcaagagattctttctaaattagaaaataaaaacaatgtaataagacaaactataaaacaaaaatataatataaactataatatcccaattatcatatctgataaactaccaaataatctttatggattagcgagttatcaacaaggtattataaaaattcaacttaataaaaaaagatttcaagaaaatgaaaactacatgatagaatatgttttacctcacgaatatgctcatacacttatgttttattttggtaaatttgacaaagaaaatggtggtcatacaaaactatggcaacaaatttgttttgatattggtgggatgaaatgtgatagatttgtaaatcacaatgatattttaatagaaaaaattggagatatataccaatattaa

SEQ ID NO: 13046 - protein, 168 aa, Unknown
  Obtained from environmental sample
  misc_feature (1)..(168): Xaa is any amino acid
MSTMNKIFKILLLITIISTILFFYLLYQDQQFKNNPLSQEILSKLENKNNVIRQTIKQKYNINYNIPIIISDKLPNNLYGLASYQQGIIKIQLNKKRFQENENYMIEYVLPHEYAHTLMFYFGKFDKENGGHTKLWQQICFDIGGMKCDRFVNHNDILIEKIGDIYQY

SEQ ID NO: 13047 - DNA, 597 bp, Unknown
  Obtained from environmental sample
  misc_feature (1)..(597): n is a, c, g, or t
atggcagacagtttagtaatcattccaacctataatgaaaaagaaaatattgagcgaatcattcgtaaagtattttcattcgaacatgaatttcacatcttggttattgaagataattcacccgacggaacggctgatatagtaaaaggtttaatgaaagaatttcctggaaaacttcacattgaagaacgaaaagggaagcttggattaggaactgcctacattcatggttttaaatggagtttgaaaaataattacgattataccttcgaaatggatgcagatttttctcacaatcctgaggatttgattcgactgcgcaacgcatgtgcaaatgaaggtggtgatgttgccatagggtctcgttatgtaacaggtgtaaatgtagttaactggccaatgggtcgtgtgttgatgtcttattatgcatcagcttatgtgcgcttcattactcgaatgaaaattcgtgatactacagcaggttttaagtgctacagaaaaaaagtattggagactatcaatttggatgaaataaaatttttaggttatgcatttcagatagagatgaaatatgtgagctggaaaatgggtttttaa

SEQ ID NO: 13048 - protein, 198 aa, Unknown
  Obtained from environmental sample
  DOMAIN (5)...(174): Glycosyl transferase
  misc_feature (1)..(198): Xaa is any amino acid
MADSLVIIPTYNEKENIERIIRKVFSFEHEFHILVIEDNSPDGTADIVKGLMKEFPGKLHIEERKGKLGLGTAYIHGFKWSLKNNYDYTFEMDADFSHNPEDLIRLRNACANEGGDVAIGSRYVTGVNVVNWPMGRVLMSYYASAYVRFITRMKIRDTTAGFKCYRKKVLETINLDEIKFLGYAFQIEMKYVSWKMGF

SEQ ID NO: 13049 - DNA, 690 bp, Unknown
  Obtained from environmental sample
  misc_feature (1)..(690): n is a, c, g, or t
atgtataaatttgcaatcaatagacctataacaacacttatgggtgtattgacttttatagtttttggacttatgtcatataaaactatgcctatcaatcttttcccaaatgttgactttccagttgttacaattcaaacagcttataacggtgcagatgcaagtacagttgagacgaaaattactgataaaattgaagaggtagtaagtggaattgatggtatagataaacttatgtcaagtagttatgatggtttaagtgtagtaactgttcagtttgaactgtttaaagatttagatgtggctacaaatgatgtacgagataagataggctctttaatattaccagatgaagcggaaaaatcagttgttaaaaaactaggggctacaggggctgttatctcactttttgtatcaacaaaaaaaggggatgcaactgctttgatgcgattatctgatgaaaaattaaagccaaaacttcaaagaatacaaggggtaggggaagtcaatattgtagggtatcaagatagagagatacgaatatatattaacccttttttactcaacaaatataacttaactccttatgaactccaacaaataataatcagccaaaacatctcacaaggtgctgggaaacttattaatgatgataaagagattattataaaagtacaagcagagccctag

SEQ ID NO: 13050 - protein, 229 aa, Unknown
  Obtained from environmental sample
  misc_feature (1)..(229): Xaa is any amino acid
MYKFAINRPITTLMGVLTFIVFGLMSYKTMPINLFPNVDFPVVTIQTAYNGADASTVETKITDKIEEVVSGIDGIDKLMSSSYDGLSVVTVQFELFKDLDVATNDVRDKIGSLILPDEAEKSVVKKLGATGAVISLFVSTKKGDATALMRLSDEKLKPKLQRIQGVGEVNIVGYQDREIRIYINPFLLNKYNLTPYELQQIIISQNISQGAGKLINDDKEIIIKVQAEP

SEQ ID NO: 13051 - DNA, 834 bp, Unknown
  Obtained from environmental sample
  misc_feature (1)..(834): n is a, c, g, or t
atgctccctgtagctatcaaaatgaagggtgctaaacatgaattcgattcagttcgtgtaatgcttgaagatatatctgatttcatcatcaatcttaaaggtatccgttttaaattaaaagacggtactatggaggctgagattaactactctttcacaggtccatgtgaaataaaaggtagttctttagctaatgaagaagtagatgttgttacaccagacgcttttttagcaactcttaatgaagatgcaacactgaacttttctatcaagatagttcaaggtattgggtatgttccaagtgaagatatccgtgagggcttagatgagtcttatatcgctttagatgcattttttacacctgtacgtaaagctacatactcaatcgagaatgtacttgttgaagacaaccctaactttgaaaaagttatattaaatattgtaactgatggtcaaatttcaccaattgatacatttagaaatgcacttgaagtaatgcatgctcaattagctgtttttaatagcgaaatcagcattaaagctccagctgcaatcgaacgtgttgaagaggctcctgaagttaaaaaattaatgtgccgtattgatgagcttggattatctcctcgtagttttaactgtttagatcgttcagagattaaatttgttggtgaaatagcaattatgagtcaaaacgatcttaaaaatgttaaaaatcttggtaaaaaatcttatgaagagatcatagaaaaaatagaagaatttggctttagtgtagatgctgatctttcacaagatatagtagatacattcaaaaagaaaatttcacaattataa

SEQ ID NO: 13052 - protein, 277 aa, Unknown
  Obtained from environmental sample
  DOMAIN (83)...(175): RNA polymerase Rpb3/Rpb11 dimerisation domain
  misc_feature (1)..(277): Xaa is any amino acid
MLPVAIKMKGAKHEFDSVRVMLEDISDFIINLKGIRFKLKDGTMEAEINYSFTGPCEIKGSSLANEEVDVVTPDAFLATLNEDATLNFSIKIVQGIGYVPSEDIREGLDESYIALDAFFTPVRKATYSIENVLVEDNPNFEKVILNIVTDGQISPIDTFRNALEVMHAQLAVFNSEISIKAPAAIERVEEAPEVKKLMCRIDELGLSPRSFNCLDRSEIKFVGEIAIMSQNDLKNVKNLGKKSYEEIIEKIEEFGFSVDADLSQDIVDTFKKKISQL

SEQ ID NO: 13053 - DNA, 750 bp, Unknown
  Obtained from environmental sample
  misc_feature (1)..(750): n is a, c, g, or t
ttggatgaacggctgtgggattccacaggggtatatgaccctgatttattggccaagaaaaaaatgcagatggtagatagcatttacaaacaagggcagattcgatattcagatagaacgtttgaaaatattaatccaagatactatccaccaaaaccacctgttaagaaggaaaaagacacaacggatgctattgaagagcaagaaacgaacgtggaagccaaagaacgtgctttggagcatcaactcttttttgcttcgcatcctattgaaaatgaggatttgaattcaaaaaataccgatgatttcatttatgtacgagtagatggcacacaaacagttaaaaccaattatcgcttacaaatgcggttgataaaagatgctaccatttatggacaacgctattccaagaatacgcctatttatggatttgtcaattttaaacccaatcgcaccatcatagacattgagaatatcaatcatcaaccagtaaaattgaaagcctatgattttcaggatggtagcgaaggcatttatgttgaaaacagttttagagcagaagttaccaatgaaattgttggcgatatggtggacgacattaatattactggtgttccgcaagtaagcggtttcaagaaaatattccaacgtaaccataaaaacgtaaaggttacgataaccgataattacaaactcattttaagacttcctaaaacaaaatatcaaggaaagcccataatgggcaattaa

SEQ ID NO: 13054 - protein, 249 aa, Unknown
  Obtained from environmental sample
  misc_feature (1)..(249): Xaa is any amino acid
MDERLWDSTGVYDPDLLAKKKMQMVDSIYKQGQIRYSDRTFENINPRYYPPKPPVKKEKDTTDAIEEQETNVEAKERALEHQLFFASHPIENEDLNSKNTDDFIYVRVDGTQTVKTNYRLQMRLIKDATIYGQRYSKNTPIYGFVNFKPNRTIIDIENINHQPVKLKAYDFQDGSEGIYVENSFRAEVTNEIVGDMVDDINITGVPQVSGFKKIFQRNHKNVKVTITDNYKLILRLPKTKYQGKPIMGN

SEQ ID NO: 13055 - DNA, 408 bp, Unknown
  Obtained from environmental sample
  misc_feature (1)..(408): n is a, c, g, or t
ttgtatagctccaatttatatagaaaaaaaaaggatttaaaaatggcaaatttattagtaaacggacaaacacttaagccttttacacttaagtcaaaagagattatagagaagtatttatcaaagcttgaagttgatatcagtgactatacatttgcagcgaattatatttggcttgctaacagcagtggattttatgcaattatacacaaatgtttttgtctttttgtaatgacaggtggagagcttactatgttacctccccctttaggagaaaaaaaatatatacctgattcaataaaaaaatgttttgagatcatgaacggcaataaccgttccacaaatatgtggcccgtagtgaatatgtccagggccccaagaatgaaaaaatttgccccgccccactga

SEQ ID NO: 13056 - protein, 135 aa, Unknown
  Obtained from environmental sample
  misc_feature (1)..(135): Xaa is any amino acid
MYSSNLYRKKKDLKMANLLVNGQTLKPFTLKSKEIIEKYLSKLEVDISDYTFAANYIWLANSSGFYAIIHKCFCLFVMTGGELTMLPPPLGEKKYIPDSIKKCFEIMNGNNRSTNMWPVVNMSRAPRMKKFAPPH

SEQ ID NO: 13057 - DNA, 441 bp, Unknown
  Obtained from environmental sample
  misc_feature (1)..(441): n is a, c, g, or t
atgataattcgtaaggctgagagaggagatgtttcaaaactctttgcattagagaatgaacttttccaaagtgagaattttccgctctcaagaagagcattcgcttaccatttgcgacataatttgatcattgtttgtgagattgatggagatattgtaggttatgctttggttcttatcagacgtaaaaatgctaagctttattcaattggtgtcaataaagcttatagaggtaaaaagatttcacaaaatctactaaaagagatatttgacaaggtaataacattaggattcaaaattctcactcttgaagtaagagttgataatgatatagcaatatctctatataaacactctggctttgaagttaaaaaagtactaaaagatttttatcttgatggatgtgatgcttatcttatggagatgaaaaatgtcggctag

SEQ ID NO: 13058 - protein, 146 aa, Unknown
  Obtained from environmental sample
  DOMAIN (44)...(122): Acetyltransferase (GNAT) family
  misc_feature (1)..(146): Xaa is any amino acid
MIIRKAERGDVSKLFALENELFQSENFPLSRRAFAYHLRHNLIIVCEIDGDIVGYALVLIRRKNAKLYSIGVNKAYRGKKISQNLLKEIFDKVITLGFKILTLEVRVDNDIAISLYKHSGFEVKKVLKDFYLDGCDAYLMEMKNVG

SEQ ID NO: 13059 - DNA, 681 bp, Unknown
  Obtained from environmental sample
  misc_feature (1)..(681): n is a, c, g, or t
atgcactttttttgggttctctctgctatctccataggttttttaaatgcttatttaattgatagatcaagtaaaacattttttcttaaaagtttaagattggagagtgagttagacaatacaaaaaaattggaaaacagattattaacatttaatgaaacactagaaaaaagaatagaggatgaaatagaagtatcaagagagaaagataaaataatttttcagcaaaataaactcgttgccatgggtgaaatgatagaaaatattgcacatcagtggagacagcctatatcacaaattaactcagctgttttagtaatgcatggtactttacaagttgcaaatattaataatcctacactaaaaaataaacttttagagatcgagtatttgacaaagtatatgtcaaataccatagatgcttttagaaacctatttgaaaacagtaagcaaaaagagaaatttactctgcaagaagttataaataactccatctctattttaagaggttctttgttagataataacatagaggtagagttgttaattaacaacaatagtattataaacggatatcctcaagagatacaacaggtgatatttgtgattgtaaataatgccagagatgctctgatatctaaaaaaatagaaaaacctatgattatgattactacctcttga

SEQ ID NO: 13060 - protein, 226 aa, Unknown
  Obtained from environmental sample
  misc_feature (1)..(226): Xaa is any amino acid
MHFFWVLSAISIGFLNAYLIDRSSKTFFLKSLRLESELDNTKKLENRLLTFNETLEKRIEDEIEVSREKDKIIFQQNKLVAMGEMIENIAHQWRQPISQINSAVLVMHGTLQVANINNPTLKNKLLEIEYLTKYMSNTIDAFRNLFENSKQKEKFTLQEVINNSISILRGSLLDNNIEVELLINNNSIINGYPQEIQQVIFVIVNNARDALISKKIEKPMIMITTS

SEQ ID NO: 13061 - DNA, 708 bp, Unknown
  Obtained from environmental sample
  misc_feature (1)..(708): n is a, c, g, or t
ttggtccacattatcgcaattattccaattaaagacatttctgctaaattattttatacaaataaagcagctgcggagatgtggagtgtaagagaattaagaaaacaaatttcaaggaaagcttttgaacggacagaaattgctaattctcaagtaattaattcaaagaaccactcgtttaacacttttaaagatccctatttacttgattttctcgaactaaaaagtggctatttggaaaatgatttagaaaaagcaatcttattcgacttagagcagtttattttagaattgggcaaagggtttacatttgttgaaagacaaaaaagaatgattattgatggagatgatttctatttagacttacttttttatcatcgaaaattacgacgattagtagcaattgaactaaaaataggtaaattcaaggcttcccataaagggcagatggaactttatttaaaatggttagataaatatgaaaagcaaaaaggtgaagaaaagccaatcgggttaatactttgtgcagaatctagtcacgaacaaatagaactcttagaaatgcataaaaatggaattatggttgctgaatattggactgatttacctccgaaagatgagctagaacgtagacttcataaatctttaattgaagcaaaagaaagaatagaacgaaatagattacaaattgaagataatactaattaa

SEQ ID NO: 13062 - protein, 235 aa, Unknown
  Obtained from environmental sample
  DOMAIN (2)...(215): Protein of unknown function (DUF1016)
  misc_feature (1)..(235): Xaa is any amino acid
MVHIIAIIPIKDISAKLFYTNKAAAEMWSVRELRKQISRKAFERTEIANSQVINSKNHSFNTFKDPYLLDFLELKSGYLENDLEKAILFDLEQFILELGKGFTFVERQKRMIIDGDDFYLDLLFYHRKLRRLVAIELKIGKFKASHKGQMELYLKWLDKYEKQKGEEKPIGLILCAESSHEQIELLEMHKNGIMVAEYWTDLPPKDELERRLHKSLIEAKERIERNRLQIEDNTN

SEQ ID NO: 13063 - DNA, 609 bp, Unknown
  Obtained from environmental sample
  misc_feature (1)..(609): n is a, c, g, or t
atgggtggggtcttttttccaggctcgcattttataaagccaacccgggaaatgcagatttccctccggtttcggtggttattacgtgcttcgaatcaatacaacgacctaaaggaaaatttacagcatttcttaacacaggattacccggattacaaagtcttggtggtggttgataattctgacgatggaagcgatgagctaatcgccgatctttcgagacagtttcctaagctaaattttgtggaactcaagcaaaaccttaactggttttcggggcgaaagttcccgctttcgttggggattaaatctgcacaaaacaaccttattctgttgagcgaccccaagtgcaaacccgaaagtaataaatggatcgaacaaatggtttcggcatatttgcccggaaaagagcttattattggatattcgagctttgatacaaaatcaggtatcaaccggtggttgcggtttaccgctttttatgatgcgctgttttatatctcgatggctatgggtggcctgccctataaaggtatcgagaaaaaacctgtcatactcgcgggatctgttctaccaaaaaaaaggtttctcttcacactatgtaattag

SEQ ID NO: 13064 - protein, 202 aa, Unknown
  Obtained from environmental sample
  DOMAIN (26)...(186): Glycosyl transferase
  misc_feature (1)..(202): Xaa is any amino acid
MGGVFFPGSHFIKPTREMQISLRFRWLLRASNQYNDLKENLQHFLTQDYPDYKVLVVVDNSDDGSDELIADLSRQFPKLNFVELKQNLNWFSGRKFPLSLGIKSAQNNLILLSDPKCKPESNKWIEQMVSAYLPGKELIIGYSSFDTKSGINRWLRFTAFYDALFYISMAMGGLPYKGIEKKPVILAGSVLPKKRFLFTLCN

SEQ ID NO: 13065 - DNA, 519 bp, Unknown
  Obtained from environmental sample
  misc_feature (1)..(519): n is a, c, g, or t
atgaacaacgatgtttcaagattaaaagatattacagttttgtattgtgaagatgagcaatacctcagagatgtaactaaaggtattttagaaacatttacaaaaaaacaatatgttgcagaagatggtgcaatagggttggaattatttaaaaaatatgaagatgatatagatttaattattactgatgttaatatgccaaatatgaatggtttagatatgacaaaagagattaaagctatcaacccaaatatcccaattgttgtggcaacagcattttcaaactctgaatatctccttgaagctattgaactaggtgttgataaatatgtattanaacctattaatattaaaaaactacttgatactatgaatcaatcattaatgtatcatgaattaagagatttatataaagatcaactcactcatcttccaaatagaaatgcccttataaaagatgtaaagaattcagactcaacactcttagctcttattgatattgataattttctgttttaa

SEQ ID NO: 13066 - protein, 172 aa, Unknown
  Obtained from environmental sample
  DOMAIN (11)...(132): Response regulator receiver domain
  misc_feature (1)..(172): Xaa is any amino acid
MNNDVSRLKDITVLYCEDEQYLRDVTKGILETFTKKQYVAEDGAIGLELFKKYEDDIDLIITDVNMPNMNGLDMTKEIKAINPNIPIVVATAFSNSEYLLEAIELGVDKYVLXPINIKKLLDTMNQSLMYHELRDLYKDQLTHLPNRNALIKDVKNSDSTLLALIDIDNFLF

SEQ ID NO: 13067 - DNA, 594 bp, Unknown
  Obtained from environmental sample
  misc_feature (1)..(594): n is a, c, g, or t
ttgaacaagagccccaaagaagcgtcaaaagcatttaataaaattaatgaatatttaagggctgacaacgcatccgcaaacctttatcacggagacttccgtgacaatatcctcgtgttcccgggggcaaaagaaaaggaaccggagcaaatccgaagcctcgatgaatgctgcactatacgcggtacccttctgaaaataggtggacgagatgaaactgtccctctagaaattcaagacactttatctggacaggtctttaattgtgaaacaacaactaaagaaatggccaaagaactagcacaccgattgttctcagaaattgagctttcaggtaatgcaacctgggaaattaacacagccacaaacgagtggaagttaaagaaatttgtagtattagggttcaatgaaatccagcaactttcaatagatgagacactaaaaagaatcaaagaagctgccaacttcaacgagaatagcaaaccctatgagactctcaaggaaataagggaaaatggcgaaaataataagcattcatacaaacatcttagttgcgccctttgcaaaagacaaagatgttccgccgtgtgttaa

SEQ ID NO: 13068 - protein, 197 aa, Unknown
  Obtained from environmental sample
  misc_feature (1)..(197): Xaa is any amino acid
MNKSPKEASKAFNKINEYLRADNASANLYHGDFRDNILVFPGAKEKEPEQIRSLDECCTIRGTLLKIGGRDETVPLEIQDTLSGQVFNCETTTKEMAKELAHRLFSEIELSGNATWEINTATNEWKLKKFVVLGFNEIQQLSIDETLKRIKEAANFNENSKPYETLKEIRENGENNKHSYKHLSCALCKRQRCSAVC

SEQ ID NO: 13069 - DNA, 435 bp, Unknown
  Obtained from environmental sample
  misc_feature (1)..(435): n is a, c, g, or t
ttgcaaaaaaaaattgaacaagcaaaactattacttgaagcacttccatatatcaaaagtttttcaaatgaaatatttgttattaaatatggtggttcagctcaaataaacccaggactaaaagataaatttgcacaagatattcttcttttatatctagtaggtattaagcctgttatcgttcatggcggtggaaataagattaactccatgttggataaattacaaattaagagcgaatttattgatggaatgagagtcactactgaagaagtcatggaagttgttgaaatggttctaagcgngaatataaataaagagataacaacacttttgaatgttcacggtgcaaaagcattgggtataacaggaaaagatgcaaactttattacagctgttcaaaaagataatggaaaatatgggattggtaggtga

SEQ ID NO: 13070 - protein, 144 aa, Unknown
  Obtained from environmental sample
  misc_feature (1)..(144): Xaa is any amino acid
MQKKIEQAKLLLEALPYIKSFSNEIFVIKYGGSAQINPGLKDKFAQDILLLYLVGIKPVIVHGGGNKINSMLDKLQIKSEFIDGMRVTTEEVMEVVEMVLSXNINKEITTLLNVHGAKALGITGKDANFITAVQKDNGKYGIGR

SEQ ID NO: 13071 - DNA, 543 bp, Unknown
  Obtained from environmental sample
  misc_feature (1)..(543): n is a, c, g, or t
ttgatagtatgtgcgggaaacaatgaaacattgccatttgctacacctataggggttggtcttatagatagtgctataaatttgactcgattatgtttatttgataagcctgaatatatcttatttgtagggagtgctggtagctatggagagtataacatctttgatatcatagagagctcaaatgcttcaaatatagaactctctttctttgaagataactcatatacaccaatagataatatggttaaatgcgaggatacaaagcttccaagtaagacaatagttaattcttcaaattatatctctacaaatagtgaaataacaaaagaatttttacaatatgggataggaattgaaaatatggagttctattctgtagtaaaaattgccaaagaatttgagatagatgtgaagggaatttttgtagtgacaaactacacaaataaagaagcacataaagactttatatcaaatcataataaagcaatggataatttggtaaagtatttagaagaaaaaaatatcatcataaaaaactag

SEQ ID NO: 13072 - protein, 180 aa, Unknown
  Obtained from environmental sample
  misc_feature (1)..(180): Xaa is any amino acid
MIVCAGNNETLPFATPIGVGLIDSAINLTRLCLFDKPEYILFVGSAGSYGEYNIFDIIESSNASNIELSFFEDNSYTPIDNMVKCEDTKLPSKTIVNSSNYISTNSEITKEFLQYGIGIENMEFYSVVKIAKEFEIDVKGIFVVTNYTNKEAHKDFISNHNKAMDNLVKYLEEKNIIIKN

SEQ ID NO: 13073 - DNA, 453 bp, Unknown
  Obtained from environmental sample
  misc_feature (1)..(453): n is a, c, g, or t
ttgattctttattataaaaatatgaaattaaaaaaacatttttggtggtttttaattcctgtgcttttaatagtagttattggttttactattttatctaaagagtcgcaaagcaatgtttctaaagtaactgtttataaatctccaacatgtgggtgttgtgtaaattatatatctttgctagagaaacgcggttatgaagtagaagtcatagaaactcaagatatggctagcgtcaaacagcaatataacatatcatcagatatggaaagttgccatacttctatttttggcgattacgtggtagaaggacatgtgccatttaatgtcgtagctaaactattagaagaaaaaccagatatcagaggtatagctttgccggatatgccggctggttcgccaggtatgccaggatttaagaaaaggtccttttactatttatgctttgtctga

SEQ ID NO: 13074 - protein, 150 aa, Unknown
  Obtained from environmental sample
  DOMAIN (61)...(149): Protein of unknown function, DUF
  misc_feature (1)..(150): Xaa is any amino acid
MILYYKNMKLKKHFWWFLIPVLLIVVIGFTILSKESQSNVSKVTVYKSPTCGCCVNYISLLEKRGYEVEVIETQDMASVKQQYNISSDMESCHTSIFGDYVVEGHVPFNVVAKLLEEKPDIRGIALPDMPAGSPGMPGFKKRSFYYLCFV

SEQ ID NO: 13075 - DNA, 819 bp, Unknown
  Obtained from environmental sample
  misc_feature (1)..(819): n is a, c, g, or t
atgataggatcggctgagaataaggtgtcttttatgaatataggctataagccaaaagatgttttattatcaagtagtgaagatagtttaaaaaaaatcagattgaaaattaataaatatttaaaaaacttagataaaaagatagttatagttattgatgacatagatagactgacagacaatgagacagaatttatttttagactcacaaaaggtatagctgattttgataatttgatttatatcttattgtatgacaaaacaattgtatctaaatcgcttcaaacatttaaacaagaaaatggagaaaaatatcttgaaaaaatagtacagtactctttatctgtaccaaaaccacataaattaactttgcataatttattatttgaaaaactagatttaattattacaaaacttgaagatgatggtaatcaaatattttttgataaagacaaatggtactatatagtaaataaggtgtttacaaaatatattttaaccatacgagatataaataacattataaatatcatctcttttgagtatccaatagttatagaagatgtaaatctatcagatttttttcttatttcattacttagagtaaagaataattcgttatatgaaagtattcaaaatactcctgaaaaattttttattgatacggaaacgatgattttggatgaacataagaatcaaacgatagaatcattaaaaaaaattattgaagataatcaagaatataaagagatacttgatttattatttccaaccataggaacaaatgaactaggttatgaacaaaaacccaataaatga

SEQ ID NO: 13076 - protein, 272 aa, Unknown
  Obtained from environmental sample
  DOMAIN (1)...(185): KAP family P-loop domain
  misc_feature (1)..(272): Xaa is any amino acid
MIGSAENKVSFMNIGYKPKDVLLSSSEDSLKKIRLKINKYLKNLDKKIVIVIDDIDRLTDNETEFIFRLTKGIADFDNLIYILLYDKTIVSKSLQTFKQENGEKYLEKIVQYSLSVPKPHKLTLHNLLFEKLDLIITKLEDDGNQIFFDKDKWYYIVNKVFTKYILTIRDINNIINIISFEYPIVIEDVNLSDFFLISLLRVKNNSLYESIQNTPEKFFIDTETMILDEHKNQTIESLKKIIEDNQEYKEILDLLFPTIGTNELGYEQKPNK

SEQ ID NO: 13077 - DNA, 570 bp, Unknown
  Obtained from environmental sample
  misc_feature (1)..(570): n is a, c, g, or t
gtgaaaggctttagatcgaacagttataaagagtatcaagaggtcacttctgaacttaataaaattgatgcaagattagtttctgaaacagacaaattagaaaaaactattattcgctcacccgttaatgggatcataaaacagatcaatattaatactattgggggagttgtaaaatctggtgttgatttaatagagatagtaccagatagtgatatattattaatagaagctaaaattgacccaaaagatattgccttcatatctcctgcacaaaaagctgttgtaaaaataactgcttatgatttttccatctatggtggactagaggggaaaataattgagatatctgctgatagtataaaagataaagagagtaaagatgataagagttattatcaggtgacagtaaagactgataaaaactatcttgagagaaatggtgaaaaacttcctattatccctggtatggtagcaagtgtagatattatcacagggaaaaaaactattatggattttttcttaaaaccaataataaaaataaaagagggatcactacgtgaaagataa

SEQ ID NO: 13078 - protein, 189 aa, Unknown
  Obtained from environmental sample
  misc_feature (1)..(189): Xaa is any amino acid
MKGFRSNSYKEYQEVTSELNKIDARLVSETDKLEKTIIRSPVNGIIKQININTIGGVVKSGVDLIEIVPDSDILLIEAKIDPKDIAFISPAQKAVVKITAYDFSIYGGLEGKIIEISADSIKDKESKDDKSYYQVTVKTDKNYLERNGEKLPIIPGMVASVDIITGKKTIMDFFLKPIIKIKEGSLRER

SEQ ID NO: 13079 - DNA, 561 bp, Unknown
  Obtained from environmental sample
  misc_feature (1)..(561): n is a, c, g, or t
gtggcaccagccccngtagaagaagaaaatataataatagaagaagttacacctagctttgtaggtctttatgatgctttaatggaagaatttcaaaatgatcttgaatcttggaatgcagaacttacaaaagatgacctactttttagatttaacaaccctgttgcactttttcaagtaaataaaagtgatcttaaacctggatttacagacatactaactgacttcttcccacgatatttaaaaattatagaacaatacaaaagtgagatacaagagataagaatagaggggcatacatcatctgagtattctcttgcaaaaactgatgatgaaagatatagattaaataaactattatctgaaaaaagagcaaatgaaacaagagattatgcagtaaatgaagcatcaaaaaatagtgaagtaagtaaagagtggattgaaaatacttttaaaccttatggtatgtcttatgataatcctattatgaatcctgatggaactgaaaattttgatgcttcaagaagagttgattttaaaattgtaaaaaaagaacaataa

SEQ ID NO: 13080 - protein, 186 aa, Unknown
  Obtained from environmental sample
  misc_feature (1)..(186): Xaa is any amino acid
MAPAPVEEENIIIEEVTPSFVGLYDALMEEFQNDLESWNAELTKDDLLFRFNNPVALFQVNKSDLKPGFTDILTDFFPRYLKIIEQYKSEIQEIRIEGHTSSEYSLAKTDDERYRLNKLLSEKRANETRDYAVNEASKNSEVSKEWIENTFKPYGMSYDNPIMNPDGTENFDASRRVDFKIVKKEQ

SEQ ID NO: 13081 - DNA, 714 bp, Unknown
  Obtained from environmental sample
  misc_feature (1)..(714): n is a, c, g, or t
ttgtggtggtggcgaaacttggtttctcatgttgtcgagactatcagtgctttcgtccgtataaattatattagagtttctagggtgccttaccttggtggagggattcgagagattgaaaaggtattctcaaaggtcactgaaactttatttaattacaaactaaagtttgggaaagcccttaaaaagataaagcaagataaatggattaatgactatggggcgcagccccttcatcccttatatgcggaatcgtgcgctattaatggtgagatttcagaggttataaagtgcattgaaagtcccaaaaattttgttatttttaatgagtgctacagaataaatatcgcaaacaatgtaagcaaactgacgggtaaggagacaaaagcattctttgacatcaaatatgctggccgcatcctgacgaaagaaagtccctttgccgcatatgatacaattttgatcattgataaaagcattactccaaaagacctttggaaaatgttaaaaatcatagatcatgagaatactgataatatcatccttgttatcttgagagtaaagacaaatctgaggttctcgcagagaacggatagtaaatattttacgcaaataagttccattttaacaaaatctgaactaaaatatttaacatatatatatattccgggtcagggtgtttttgaatttttccggaagttttctaaaaattaa

SEQ ID NO: 13082 - protein, 237 aa, Unknown
  Obtained from environmental sample
  misc_feature (1)..(237): Xaa is any amino acid
MWWWRNLVSHVVETISAFVRINYIRVSRVPYLGGGIREIEKVFSKVTETLFNYKLKFGKALKKIKQDKWINDYGAQPLHPLYAESCAINGEISEVIKCIESPKNFVIFNECYRINIANNVSKLTGKETKAFFDIKYAGRILTKESPFAAYDTILIIDKSITPKDLWKMLKIIDHENTDNIILVILRVKTNLRFSQRTDSKYFTQISSILTKSELKYLTYIYIPGQGVFEFFRKFSKN

SEQ ID NO: 13083 - DNA, 741 bp, Unknown
  Obtained from environmental sample
  misc_feature (1)..(741): n is a, c, g, or t
atgcagtctggcatctatttgtactgggcggaagtacttgtcacttcttttccattttatttcatgtattaccaatgcaataaaaaaggaaattttgcagtgaaatatgttagaagccaaaaacctaaatttaattatagacacttaaacgatccaattgcagataacacgaaatggataaccactcacaaaggcccttttactcaaagaagaataatagatctatcagatttaaaattagttatgaggactcctattgccttattacttctatatactattccagcaattattggattgattgtactaataacattttcaatcgttttttatgaagattttggattaataagtattcttattggattattatttggtggttttgcattatggatgggtattggatcaatattaaagcaatctgtatcagccttttttaataaggaagtaggatatttttggacaagcagaaaaataaaaactgaattctccgatttcaaaaaagcccattgcaagttatctgatattcatgctattcagttaatccacgataatagcggaacattacatagtggttcacatcgtggaagatctggtgggagttatgaaatgaatctgattttaaaagattcaaaaagaataaacgtattcaccaataaaaatagagaaaaatctcagaatgaagccaaaatacttgcagaatttttgaaggtacatttttgggatgcaactgtcggataa

SEQ ID NO: 13084 - protein, 246 aa, Unknown
  Obtained from environmental sample
  misc_feature (1)..(246): Xaa is any amino acid
MQSGIYLYWAEVLVTSFPFYFMYYQCNKKGNFAVKYVRSQKPKFNYRHLNDPIADNTKWITTHKGPFTQRRIIDLSDLKLVMRTPIALLLLYTIPAIIGLIVLITFSIVFYEDFGLISILIGLLFGGFALWMGIGSILKQSVSAFFNKEVGYFWTSRKIKTEFSDFKKAHCKLSDIHAIQLIHDNSGTLHSGSHRGRSGGSYEMNLILKDSKRINVFTNKNREKSQNEAKILAEFLKVHFWDATVG

SEQ ID NO: 13085 - DNA, 720 bp, Unknown
  Obtained from environmental sample
  misc_feature (1)..(720): n is a, c, g, or t
ttgggagccccctcccccttggatgtggtggttggcgccaaaaaatattggggggggaactctcccattttaaaattaaaggggggggtgcaaagaagggggttttttcatcctatctctactgatgaagttttgggaacactggggatgttggggctcttcacgaaggatacaccttacgctccaaactccccatacagggcatcaaaagcaggtagtgatatgatagtgagaagttatcatcacacgtttggtatgaatactgtaattacaaactgctcaaataactacggagcaaaacaacacgatgaaaagctaattccaacaatcgtaagaaaagcattgagcggagataacattcctatatatggtgatggaaaaaatattagagattggctctatgttcttgatcactgtaaaggtatagatttagtctatcacaatggaagaagcggtgaagtatataacataggtggaagaaatgagagagataatctatatatcgtagacaagatatgtgagattctagactctaaagtaccacaagcaaaaagctataaagagcagattacatttgtagaagatcgcgcaggacatgatagacgctacgcaatagatgcaactaaaatagagagtgaactaggttggagtgctaatgagaactttgaatcaggaattattaaaactattgagtggtatttagggaaatataatagatga

SEQ ID NO: 13086 - protein, 239 aa, Unknown
  Obtained from environmental sample
  DOMAIN (7)...(237): NAD dependent epimerase/dehydratase family
  misc_feature (1)..(239): Xaa is any amino acid
MGAPSPLDVVVGAKKYWGGNSPILKLKGGVQRRGFFHPISTDEVLGTLGMLGLFTKDTPYAPNSPYRASKAGSDMIVRSYHHTFGMNTVITNCSNNYGAKQHDEKLIPTIVRKALSGDNIPIYGDGKNIRDWLYVLDHCKGIDLVYHNGRSGEVYNIGGRNERDNLYIVDKICEILDSKVPQAKSYKEQITFVEDRAGHDRRYAIDATKIESELGWSANENFESGIIKTIEWYLGKYNR

SEQ ID NO: 13087 - DNA, 540 bp, Unknown
  Obtained from environmental sample
  misc_feature (1)..(540): n is a, c, g, or t
ttgaccttcaggtcgatttttcaattcgggataaaatcccccgacaatcattacttcagctatattctcaacaacaaaaacaatgaggactttaagcggcgtctagccatttatagcggctacacccggcccttgaatatctgtaacattgaagaagcttcacaagtcattgccattctgggagaagataccgattggttcgacaaattaagtaggatgttcaacggagtcaaagttatacgggcaacatctcccctggatgggaaaaccctatggatggagttttttccacagcatgtttccaaatcctatggaattaaatacctgtgtaaactcttgaacatcgagagagatcaaactgtcgctatcggaaatgactacaatgatctcgatttactcagttattgcaaatacagctttgtcgttgataacgcccccgaagagctcaaaaagaaatatcctgcggtggcatcaaacgatatgaacggatttacccatctggtcaacaatctgatccattcaggattgaaattgtcatag

SEQ ID NO: 13088 - protein, 179 aa, Unknown
  Obtained from environmental sample
  misc_feature (1)..(179): Xaa is any amino acid
MTFRSIFQFGIKSPDNHYFSYILNNKNNEDFKRRLAIYSGYTRPLNICNIEEASQVIAILGEDTDWFDKLSRMFNGVKVIRATSPLDGKTLWMEFFPQHVSKSYGIKYLCKLLNIERDQTVAIGNDYNDLDLLSYCKYSFVVDNAPEELKKKYPAVASNDMNGFTHLVNNLIHSGLKLS

SEQ ID NO: 13089 - DNA, 489 bp, Unknown
  Obtained from environmental sample
  misc_feature (1)..(489): n is a, c, g, or t
atgcaggttatttcaagagaagaaacagttgataactccttaaaccaaggtcaattgcaaggtatagtggcaagattgaatgagattgtggggaataaatggtttaaattaaaaatagacaaaaagaaagagtatccggttagcttgattagaaatctagcttatgaagggatagagtcatattatcgtgattttgaatattatattacctctgaaaaggccaggcagaccgaaaaagttgtaacactaaaagttctggatctgctctggatggaacatttgaaaaatgtcgaagacattcaagaatctgcacttattaattccatcggaaggtctgatttttttgaggaatataaaattcaaatgacaaaagcctatcgaggaatgttactgggcgcaccaaagattatttgttttacattatttagaacaataaatgaactgtttgaaaaggagaagaattttaataacgtagtcgcaacaagatga

SEQ ID NO: 13090 - protein, 162 aa, Unknown
  Obtained from environmental sample
  misc_feature (1)..(162): Xaa is any amino acid
MQVISREETVDNSLNQGQLQGIVARLNEIVGNKWFKLKIDKKKEYPVSLIRNLAYEGIESYYRDFEYYITSEKARQTEKVVTLKVLDLLWMEHLKNVEDIQESALINSIGRSDFFEEYKIQMTKAYRGMLLGAPKIICFTLFRTINELFEKEKNFNNVVATR

SEQ ID NO: 13091 - DNA, 453 bp, Unknown
  Obtained from environmental sample
  misc_feature (1)..(453): n is a, c, g, or t
ttgaaaagacaaaaggatgctaatttttttgtattgagggaatttgggaaagatattgtgggggggaagatgaaaaataacttttctattagtgagatttcagagcaagactgggaagatgttctttttgagaccaaattgccgataaatggaattttttggcaggaggtggaatcccaaacgtattttatatgcgctattgatattcagaatcagttgaatctccttgtaaaaagaaagggtgatttcaagaaagtagatttgtttttagatggtgataaaattaggcatacccagaacaatagctggaaagatggagaatacaatatttattcagtctcgtttgttttagggaaagatttagaatcaaaaaaaagtttagaaaagataatgttacgtttcgatggaaaatttaattggcctaagaaagggttggccaaatttaatttttga

SEQ ID NO: 13092 - protein, 150 aa, Unknown
  Obtained from environmental sample
  misc_feature (1)..(150): Xaa is any amino acid
MKRQKDANFFVLREFGKDIVGGKMKNNFSISEISEQDWEDVLFETKLPINGIFWQEVESQTYFICAIDIQNQLNLLVKRKGDFKKVDLFLDGDKIRHTQNNSWKDGEYNIYSVSFVLGKDLESKKSLEKIMLRFDGKFNWPKKGLAKFNF

SEQ ID NO: 13093 - DNA, 885 bp, Unknown
  Obtained from environmental sample
  misc_feature (1)..(885): n is a, c, g, or t
gtgcaaaaagtattgaatagaaatattgattattatgcaaatgatagctataaagcattaaagaaagttgataaactagtagatgctgatatgtctgagtttgctattgagattttacaaaaacttatagaaaactctatccatactgatagtattgataattttagatttaaattagctgatgtctatatgaaaatagctggatttcaaaaagagtatttacctaaagcaaaacaaatttatgaagatttaattcaagcaaaaataaataatccttatagaaaaagagcaaaaatgtatctcgatgagattatcatgagagaagggaaatttgaaccagcaatgatggcttctaaatatagtggttcagaaacaatgcaatataaagcaatgatgcaagaattactcaatgcaatagaagatgaaaaatttgaacaaataattcgaatgaaaaaaatctaccaaggtatcttcccatcaattgttaaaaggtttggatatgaaagtattgaacaaatatacaatatggtaaattctaaaatgattaagtattatctacaaacaaatcagtgtaatcagcttaatattgttataaaagatatagctgatgatgtactattattacttattaaagatgaaaaaactatagataaacttttttcttgtatgatagaagttccagatgagagaacttataaagtagctaaagatgtgtatggaaaagctaaaaataatagaatttatttttatttagagcgagttgctctccttttgaaaaaatatgatgatgccaaaagctttttctcaaaaacttggatatgtttagtgatgcagaatgtgttatcaaatgaagtttttaaaagaatttttaaaatatgcaaatga

SEQ ID NO: 13094 - protein, 294 aa, Unknown
  Obtained from environmental sample
  misc_feature (1)..(294): Xaa is any amino acid
MQKVLNRNIDYYANDSYKALKKVDKLVDADMSEFAIEILQKLIENSIHTDSIDNFRFKLADVYMKIAGFQKEYLPKAKQIYEDLIQAKINNPYRKRAKMYLDEIIMREGKFEPAMMASKYSGSETMQYKAMMQELLNAIEDEKFEQIIRMKKIYQGIFPSIVKRFGYESIEQIYNMVNSKMIKYYLQTNQCNQLNIVIKDIADDVLLLLIKDEKTIDKLFSCMIEVPDERTYKVAKDVYGKAKNNRIYFYLERVALLLKKYDDAKSFFSKTWICLVMQNVLSNEVFKRIFKICK

SEQ ID NO: 13095 - DNA, 759 bp, Unknown
  Obtained from environmental sample
  misc_feature (1)..(759): n is a, c, g, or t
ttggctgagcttggtatacgaaaacacaaacgtgatttacataccttacaagatagacgggaagttgatactttattagagtgtttgttatttttagctaaatatcataaaagagaaacttctgctgattctttaaagtttaatctacctattcataatagatcttttgatgtacctatgtttataaaggcctcaaaaagaataggactaactacaaaaatagtagaaagagaaagtattgaaaaacttacaaaattagctttaccagttgttttattattggataaagataggtcttgtgttctcttagattatgatgtagaaaattcaagtgcaaaagttatacttccaggtgtaagttctggtgagactgaacttcctttagataaattaaactcagaatttacaggtgaagtaataattataaaaccagaatttaattttaataatagattagataaagagattttagtagagacgccaaaagagtggttttgggggactttatttagaaataaagctatttacaatcaagtaatagtagtatcactatttataaatatgtttatacttgcaactccattatttacaatgaatgtatatgatagagttcttccaaataatgcaattgagacaatgtgggtactttttattggtattagtgttgtgatgttatttgattttcttatgaagattttacggtcatattttttagggaattgcaaggtaaaagaacagaataccattattttcaaatag

SEQ ID NO: 13096 - protein, 252 aa, Unknown
  Obtained from environmental sample
  DOMAIN (15)...(147): Peptidase C39 family
  misc_feature (1)..(252): Xaa is any amino acid
MAELGIRKHKRDLHTLQDRREVDTLLECLLFLAKYHKRETSADSLKFNLPIHNRSFDVPMFIKASKRIGLTTKIVERESIEKLTKLALPVVLLLDKDRSCVLLDYDVENSSAKVILPGVSSGETELPLDKLNSEFTGEVIIIKPEFNFNNRLDKEILVETPKEWFWGTLFRNKAIYNQVIVVSLFINMFILATPLFTMNVYDRVLPNNAIETMWVLFIGISVVMLFDFLMKILRSYFLGNCKVKEQNTIIFK

SEQ ID NO: 13097 - DNA, 387 bp, Unknown
  Obtained from environmental sample
  misc_feature (1)..(387): n is a, c, g, or t
ttggaggggttaaatgctgttaaaactgtagagataggtgatggtatggattctagtagatctaaaggtagtttaataaatgatcaaatcagatctcaaggatttcaaactaatcatagggggggaatattaggggggattagtaatggtgatgagattattacaaaagtttatttcaaacctacaccttcaatttttactgaacaaaaaactgttgatgtaaataatattgaccaagtctacaacttaaaagggagacatgatccatgtgttgcattaagaggtagtgtggtttgtgaatcaatgatgagtttaattttagcagatatggtattacttaatatgaatagtaatataaaaaacataaaaaaagtttattctaaatag

SEQ ID NO: 13098 - protein, 128 aa, Unknown
  Obtained from environmental sample
  DOMAIN (1)...(115): Chorismate synthase
  misc_feature (1)..(128): Xaa is any amino acid
MEGLNAVKTVEIGDGMDSSRSKGSLINDQIRSQGFQTNHRGGILGGISNGDEIITKVYFKPTPSIFTEQKTVDVNNIDQVYNLKGRHDPCVALRGSVVCESMMSLILADMVLLNMNSNIKNIKKVYSK

SEQ ID NO: 13099 - DNA, 381 bp, Unknown
  Obtained from environmental sample
  misc_feature (1)..(381): n is a, c, g, or t
ttgtgtgctgctggtctttgtttcccacccccgcaaaaaaaccctctgtatgatgcagttgaaaagtctttagtggaaaaaaaagaacagcttgaaaaagagaaaaaagcagcagctattctttataaagatgagttgttaggtgaaaagcaaaacttgttgtcaagagttgatgagatcaataaagaccttgaaatagaagatatgattatcactaaagctgagtatgaaaatttagttggttttagtgagatggttgctgttccaaaagataagtttatatcacttattgaaaatacagagatgataaatattcaaaaaacagagtatgaaaaattaactgtagttgaagaggaagagtctaaaggtggagataaatag

SEQ ID NO: 13100 - protein, 126 aa, Unknown
  Obtained from environmental sample
  misc_feature (1)..(126): Xaa is any amino acid
MCAAGLCFPPPQKNPLYDAVEKSLVEKKEQLEKEKKAAAILYKDELLGEKQNLLSRVDEINKDLEIEDMIITKAEYENLVGFSEMVAVPKDKFISLIENTEMINIQKTEYEKLTVVEEEESKGGDK

SEQ ID NO: 13101 - DNA, 441 bp, Unknown
  Obtained from environmental sample
  misc_feature (1)..(441): n is a, c, g, or t
atggaaattgaaaaattaagagcaaagatacaaggtcgtgtattttatagaaaagcaaatatgaaagctataactacaccaaaaactacagagataagagaaaatacagatgctgtaccagtagcaaatacaaaagaaaaacacacatttgtacttatctcaaaagataatgctactgaaagatacgattggtggaaagatgaagtttttatagaagaacttgatctaaatggtgctgacttttcagaacttagaactttttttattgatcacaatcctagtgtagaaaatgcaataggaaaaattgacaataaaagagttgaaaacgatgagctattatcagatgttacttattcaagtgatgatttttcccaactagcgaaactaaaatatgacgaggagattcttactgatgttttcattggatatccaataagatga

SEQ ID NO: 13102 - protein, 146 aa, Unknown
  Obtained from environmental sample
  misc_feature (1)..(146): Xaa is any amino acid
MEIEKLRAKIQGRVFYRKANMKAITTPKTTEIRENTDAVPVANTKEKHTFVLISKDNATERYDWWKDEVFIEELDLNGADFSELRTFFIDHNPSVENAIGKIDNKRVENDELLSDVTYSSDDFSQLAKLKYDEEILTDVFIGYPIR

SEQ ID NO: 13103 - DNA, 645 bp, Unknown
  Obtained from environmental sample
  misc_feature (1)..(645): n is a, c, g, or t
atgattgtagatcaaaatattgaccttgatgatacatatgatagaccagcatatgaaagacatgcaattcagatagatatagacagaatagatgaaaaaccaaatataaaagaaaaaattgtattaaaaaacaaatataatgataatataaaagagattgaagaagatattgttgaatccaaggaagaaaatataaatagtttggataatcaagttattatagaaaaatcattggttaaacaaataaacaaagatacatataaagagagctctacagtaattgtaaatgagttagaagagaataaaaaattacttgatcatctagataaaggccaaatagaaaaacctacaaattttaaactccctcttacagaatttttacaaaagcctattaaacaagatactagtattaatgaagaagagatagataataaaataaaagatctcatagaaaaacttgcccactttaaaattaacggtgatgtagttcgtacttatgcaggaccagttgtttctacttttgagtttaaaccggcagctgatgttaaggtatcaaaaattttaaatcttcaagatgatttagccatggcactttgtgctcaaactattcgtattcaagctccgattcctggcaaagatgtgtag

SEQ ID NO: 13104 - protein, 214 aa, Unknown
  Obtained from environmental sample
  misc_feature (1)..(214): Xaa is any amino acid
MIVDQNIDLDDTYDRPAYERHAIQIDIDRIDEKPNIKEKIVLKNKYNDNIKEIEEDIVESKEENINSLDNQVIIEKSLVKQINKDTYKESSTVIVNELEENKKLLDHLDKGQIEKPTNFKLPLTEFLQKPIKQDTSINEEEIDNKIKDLIEKLAHFKINGDVVRTYAGPVVSTFEFKPAADVKVSKILNLQDDLAMALCAQTIRIQAPIPGKDV

SEQ ID NO: 13105 - DNA, 552 bp, Unknown
  Obtained from environmental sample
  misc_feature (1)..(552): n is a, c, g, or t
atggcaattgataaagtagttgaatatttaaatgatggatacgaatgggtaatagacttagatattgagaaattctttgatacagtaaatcacgataaactgatacaagtactaaggttagaggtaaacgattcaactactttgaacttgattaggaggtatctaaaagcaggagttatggaaaatgggatatttactgaaactaagattggaacaccacagggtggaccaatgagtccaatattatcaaatattcttctcgaccaatttgataaagaaatggagaaaagaggtcgtctatttgtccgttatgcggatgatgtgaacttgtttgtgcgtagtgaaaaagcagctgatagagtaattaaatcggtagtttcttggcttgaaagaaaactattcttaaaagttaacgcaacgaaaacaaagataacaagacctacaaaaagcaagtttctcggttttacattttggaagaataaagaacgggtggaaagccaagcaccgtcactgatgaaagcaagacaagaatctcaagagaaaagtaaataa

SEQ ID NO: 13106 - protein, 183 aa, Unknown
  Obtained from environmental sample
  DOMAIN (3)...(157): Reverse transcriptase (RNA-dependent DNA polymerase)
  misc_feature (1)..(183): Xaa is any amino acid
MAIDKVVEYLNDGYEWVIDLDIEKFFDTVNHDKLIQVLRLEVNDSTTLNLIRRYLKAGVMENGIFTETKIGTPQGGPMSPILSNILLDQFDKEMEKRGRLFVRYADDVNLFVRSEKAADRVIKSVVSWLERKLFLKVNATKTKITRPTKSKFLGFTFWKNKERVESQAPSLMKARQESQEKSK

SEQ ID NO: 13107 - DNA, 765 bp, Unknown
  Obtained from environmental sample
  misc_feature (1)..(765): n is a, c, g, or t
ttgggggggggtgtaatgggtgatatgacaggatttgctgcaagtatttatcaaggaggtatagactttatacagataccaacaacacttttaagtcaagtagatgcaagtgtaggtggaaaaactggtattaataataagttnggtaaaaatcttgttggggcatttcatcaaccaattgctgtacatattgatccacattttttaacaacacttccaaaaagagagtttggtgcaggagttgcagagattataaaaatggcagtgtgttttaataaagattttttccaatggattgaaaataatgatttatatgatcctgaaaatataaaagtagcaattcaaaagtcagtagaaacaaaagcttgggtagtaagtcaagatgagaaagagaaagggcttcgtgctgcactaaactatgggcatacttttggccatgtggttgaaaatgagacaaattatgatacatacttacatggggaagctgtaggtattgggatgatgatggcaaatgatgtttcagttaaattaggactaatgagtttagatgatgcaacaagagtaagatctactttagaaagatatgaaattcctacaacttacaaaataagagatgtggaagatttttatgaacattttttcttagataaaaaatcattagatgataaaattaaatttatactagctgttggtattggtgattgtaagattacagatgaagtttcaaaaaatgatgtgatagatgttttaaaggattttagttga

SEQ ID NO: 13108 - protein, 254 aa, Unknown
  Obtained from environmental sample
  DOMAIN (1)...(251): 3-dehydroquinate synthase
  misc_feature (1)..(254): Xaa is any amino acid
MGGGVMGDMTGFAASIYQGGIDFIQIPTTLLSQVDASVGGKTGINNKXGKNLVGAFHQPIAVHIDPHFLTTLPKREFGAGVAEIIKMAVCFNKDFFQWIENNDLYDPENIKVAIQKSVETKAWVVSQDEKEKGLRAALNYGHTFGHVVENETNYDTYLHGEAVGIGMMMANDVSVKLGLMSLDDATRVRSTLERYEIPTTYKIRDVEDFYEHFFLDKKSLDDKIKFILAVGIGDCKITDEVSKNDVIDVLKDFS

SEQ ID NO: 13109 - DNA, 780 bp, Unknown
  Obtained from environmental sample
  misc_feature (1)..(780): n is a, c, g, or t
ttgcgttcatggaaaagtgatagttttggtgacgaacttttagatggaagaaaagcaattagtgatgtacatactactaaaaaagcagtagtaggttcagagataagtaaaacagatatcaatatgattggtgtagcaccaatagttgatttagatggtaattttgtaggctctgtagaatttaaagcaggatacaactctattataaaatctttgaaaaaacaagataaagcttatgctttaatgcttttagaacaagatattgtaaaatcaaagttagatgataagtcatttcaaaaactttcaaaagttggggattatattctcaaccaaaaaacttttgataaaaattttgcctcatatattgcaacaataaatttaaaggaacttgtatctaaaaaatttatgatgagtgataaatattttttaacaatctctccggttatagattatactggtaataaaataggttattatgtaataggtgaagatagtattgaacttgaagaattagtagcacagtcgcaaggacttatctacacagcaattgggttaattattttaattttaatagttattacgattattattgttgtgttttcaagaagaattattattaatccattaaaagagttagatgaggctattataagtatctctcagaactcaaatacaagtgatagagtcaatgtagaaagggctgatgaaataggggaagttgctgttaattttaataaatacttagacaaaattgaagcctgggatcaaacaagatactaa

SEQ ID NO: 13110 - protein, 259 aa, Unknown
  Obtained from environmental sample
  DOMAIN (183)...(253): HAMP domain
  misc_feature (1)..(259): Xaa is any amino acid
MRSWKSDSFGDELLDGRKAISDVHTTKKAVVGSEISKTDINMIGVAPIVDLDGNFVGSVEFKAGYNSIIKSLKKQDKAYALMLLEQDIVKSKLDDKSFQKLSKVGDYILNQKTFDKNFASYIATINLKELVSKKFMMSDKYFLTISPVIDYTGNKIGYYVIGEDSIELEELVAQSQGLIYTAIGLIILILIVITIIIVVFSRRIIINPLKELDEAIISISQNSNTSDRVNVERADEIGEVAVNFNKYLDKIEAWDQTRY

SEQ ID NO: 13111 - DNA, 321 bp, Unknown
  Obtained from environmental sample
  misc_feature (1)..(321): n is a, c, g, or t
atgtcaaataataatattgaaatagagttagatgacattttaaagcaaattgaccattttcatccaagtgatattgcttatagacttaaaaaaataaaaaaaaacagcaatgagcttttttatgaatacttacataaaattcctaaacaatatctaggggaagttctactagaactcccagaatcacttagggaaaaagcctacaattcactctcacaccaacaaatatctcgtgcacttgaaaatttagaaacagataatgcaaccgatattattcaaggtattgaagagattgatcaaaaaaagcaaaaaatgttttag

SEQ ID NO: 13112 - protein, 106 aa, Unknown
  Obtained from environmental sample
  DOMAIN (3)...(102): MgtE intracellular domain
  misc_feature (1)..(106): Xaa is any amino acid
MSNNNIEIELDDILKQIDHFHPSDIAYRLKKIKKNSNELFYEYLHKIPKQYLGEVLLELPESLREKAYNSLSHQQISRALENLETDNATDIIQGIEEIDQKKQKMF

SEQ ID NO: 13113 - DNA, 408 bp, Unknown
  Obtained from environmental sample
  misc_feature (1)..(408): n is a, c, g, or t
gtgaaatcgagacaggaaattgaggaaaaagtagcagaattattcccagagttacgtatcaggcaatttatcatgaaaaatcttcaccgaaaggaaaagaacgaatttgagtggaagatatatattccaggaattgaggataacctcgatttattatttgacggaatcgacaccattaccaaatttgataaaccgacactttttgtaaaaggtggcaactcagattacatcctgcttgaagattacgaccaaatcaggtacaactttccaaatgcggaaattgtcactattgccgatgcttcacactgggtacatgttgaatcgcctgaaaggttttatcaattaacgatgggatttgcttcgggtaatccaagttggtacgataaggtgaaagaagaattaacctaa

SEQ ID NO: 13114 - protein, 135 aa, Unknown
  Obtained from environmental sample
  misc_feature (1)..(135): Xaa is any amino acid
MKSRQEIEEKVAELFPELRIRQFIMKNLHRKEKNEFEWKIYIPGIEDNLDLLFDGIDTITKFDKPTLFVKGGNSDYILLEDYDQIRYNFPNAEIVTIADASHWVHVESPERFYQLTMGFASGNPSWYDKVKEELT

SEQ ID NO: 13115 - DNA, 564 bp, Unknown
  Obtained from environmental sample
  misc_feature (1)..(564): n is a, c, g, or t
ttgaattttttcttcaggaaattattttaccgggttcatttatttgaaggctgttcaaaaatggaaaatgacccttatgggattaaactttaccatctgattttaaaagagtgggataaatttgaaacaccaattttcacacttactacaaaaggtgtaaaagatataccgttaaactctagtactgtaagagaaaaatttccagaaatcatatctagtttagaaaaactttttaaagactttactgtttttgctcaagacaatggtattattgtagttgatacaaaatttgaaatatttgtaaattctaaaggtgaatggattttaggtgatgagattttaacacctgagagttcgagatttatagcagatgaagattttcaaaaaggtaattatatctcaatggacaaacagattcttcgaaattttgccaaagaaaatagttggaaagagaaagcaaaagatttaaaatctggcgaaaaactagatgttgaagttccagattcaattaaaaatgtaattttagatggatatgaaactatccataatagattacataagtaa

SEQ ID NO: 13116 - protein, 187 aa, Unknown
  Obtained from environmental sample
  DOMAIN (2)...(166): SAICAR synthetase
  misc_feature (1)..(187): Xaa is any amino acid
MNFFFRKLFYRVHLFEGCSKMENDPYGIKLYHLILKEWDKFETPIFTLTTKGVKDIPLNSSTVREKFPEIISSLEKLFKDFTVFAQDNGIIVVDTKFEIFVNSKGEWILGDEILTPESSRFIADEDFQKGNYISMDKQILRNFAKENSWKEKAKDLKSGEKLDVEVPDSIKNVILDGYETIHNRLHK

SEQ ID NO: 13117 - DNA, 621 bp, Unknown
  Obtained from environmental sample
  misc_feature (1)..(621): n is a, c, g, or t
ttgcccctgtcggcggttagtgttattgtgcgttcggctaaacagcgatttcctaaatctaagattcttgtgcttgaaaaaggaatgctaccacaaggcgcaaggactaaaaatgcaggctttgcatgttttggtagtataagtgaaattatcgacgacttaaaacaccactcggaaattgaggtattagatttaattaagaagcgaattaatggacttcaattactgcgtgaaacacttggagataaagctatgggttatcaaaatcttggtggttatgagttgtttttagattcttatgatgccttgtatgattcatgtatagataggcaagacgacatcaatcagtttttacagccactatttaatactaaggtgttttcctttaaagtaaacaatctcggctttaaaaagataaaatctaaacactgctttaactcttacgaaggacagatagatacgggaaaaatgatggatgctttattacaaaaagtacaatctttaggtgtaaaaatattaaataatattactgtcaaagccttttctgaaactttaaattcggtaaaaattgaaacagatccatttcgattttactacccaaaaactatgttttgctactaa

SEQ ID NO: 13118 - protein, 206 aa, Unknown
  Obtained from environmental sample
  misc_feature (1)..(206): Xaa is any amino acid
MPLSAVSVIVRSAKQRFPKSKILVLEKGMLPQGARTKNAGFACFGSISEIIDDLKHHSEIEVLDLIKKRINGLQLLRETLGDKAMGYQNLGGYELFLDSYDALYDSCIDRQDDINQFLQPLFNTKVFSFKVNNLGFKKIKSKHCFNSYEGQIDTGKMMDALLQKVQSLGVKILNNITVKAFSETLNSVKIETDPFRFYYPKTMFCY

SEQ ID NO: 13119 - DNA, 855 bp, Unknown
  Obtained from environmental sample
  misc_feature (1)..(855): n is a, c, g, or t
gtgccaaaagatacttaccaacaaagtagtgaagatgaaagatatttttatgttttaagcaataatacttctcctattgaaaatctttctattcaaacaaaacaacttatcaaacaaaaaattgataccaaaaaagcttttagtatcgcttgttgcaaccaatctgataaacttgtagttacatttttaccaatcaaagatattgaaacacaaaaaaatattgcttattttgtagcctataaaaaaagtaactatttagaggaaatcaacataacatatctaataaccttaataatttttaccttattaaatcttttcttctcctattttgtttataaaataaccgataaaaaaagatttttagaaaaaaaaattttacaaagtaaaaaagaacttcggcaattaaataaaaaattaaaatctcaaatccaacttgaagttcaaaaaaataaagaaaatgaacaaattattctccatcaaacaaaaatggcaactatgggtgagatgatggaaaacattgcacatcaatggaaacaaccactcaactctatttcaattgcaacaagcaatatgattcttgaaagtgaactaggtttactaacaaatgaatcagcactccaagaggctaatcttatcttagatagtagtaaatttcttgcaaatacaattcaagattttaaagaatattttaaaactgataatcaacttgaaaaaataaatcttcaagaatgtatagacaaaactgttaagcttgttttagcaacactgcatcaaaaagggatcgaagtaattattcacactagtgatcaagatatttatctagtcaaaggtttatttacacaagttttactttaa

SEQ ID NO: 13120 - protein, 284 aa, Unknown
  Obtained from environmental sample
  DOMAIN (165)...(235): His Kinase A (phosphoacceptor) domain
  misc_feature (1)..(284): Xaa is any amino acid
MPKDTYQQSSEDERYFYVLSNNTSPIENLSIQTKQLIKQKIDTKKAFSIACCNQSDKLVVTFLPIKDIETQKNIAYFVAYKKSNYLEEINITYLITLIIFTLLNLFFSYFVYKITDKKRFLEKKILQSKKELRQLNKKLKSQIQLEVQKNKENEQIILHQTKMATMGEMMENIAHQWKQPLNSISIATSNMILESELGLLTNESALQEANLILDSSKFLANTIQDFKEYFKTDNQLEKINLQECIDKTVKLVLATLHQKGIEVIIHTSDQDIYLVKGLFTQVLL

SEQ ID NO: 13121 - DNA, 672 bp, Unknown
  Obtained from environmental sample
  misc_feature (1)..(672): n is a, c, g, or t
atgtatgttgaaagtagtattgattatacacttttattagaaatactagcagttattttggttttattggttggtttttactattggaatcgtaagttatctcaactaaataaaacaattcaaaaaagtaaaaataaagtatcagttttacttgataatgcgggacaaggatttttaacttttaatacaaattttcaagttgatgaagagtattcaaaagagtgtattaaaattttaggtaaggatattgtatcgaatgatataaccaatcttttatttagtgatgatagtagaaaagagttttttaaaaatacactaaaattggttttaaaagagaaaagtgatataaaaagaaaatcacttatatcactattgccacaaattattttattaaataaaaaagctattaaaattgaatataaagtattagatgagagttactttatgttgattctaacaaatataacatcccaaaaaaagcttgaaaataaagtaaaaaaagagcaagacaccttgaaaatgatagttgcaattgtgagtgaaccagagatgttttttgatttaagaaaagagtatatccattttataaattcttattctaaattgattgataaaaataaaacaccattacataatataagtactatatatagaactattcctacattttaa

SEQ ID NO: 13122 - protein, 223 aa, Unknown
  Obtained from environmental sample
  misc_feature (1)..(223): Xaa is any amino acid
MYVESSIDYTLLLEILAVILVLLVGFYYWNRKLSQLNKTIQKSKNKVSVLLDNAGQGFLTFNTNFQVDEEYSKECIKILGKDIVSNDITNLLFSDDSRKEFFKNTLKLVLKEKSDIKRKSLISLLPQIILLNKKAIKIEYKVLDESYFMLILTNITSQKKLENKVKKEQDTLKMIVAIVSEPEMFFDLRKEYIHFINSYSKLIDKNKTPLHNISTIYRTIPTF

SEQ ID NO: 13123 - DNA, 774 bp, Unknown
  Obtained from environmental sample
  misc_feature (1)..(774): n is a, c, g, or t
ttggagaaaacatttaaatatgttcaactagaaacaaaaaaagatgatgcactgttttttattgataatcaaaaagatattgataaaatcaataatttatatgatgatgtaaaggacttgttaaggaataatgaattttctataaactatgagtgtactnttagtcacaaaactgatgaaaaggattattcatattttaataatacctatactagaatcaatggcgattatttcttagaagagtgtgtcaaaaaagatacacctctagtgtttgatagtaacaaaattactattgaaaacaagagtattgtatttgatcaagtattaactaatgaagaaaaattaaacacatatgttaactttatgctctttttacataatacaaatatcaaagaaaatcagacactaacaagtaaatataatattgcaataccatttagtttaaatccatcttcttttgagcaaaataaacttattatagatgatgaatttttatcaaaaattagtgtaaaaaccgaacttttaaaaatgttaaaagagaatgattataaagttacagatgataaatctcaggcaaatattattataaatttggaaaacttagcttttgggaataatgatactacagagaaaaaatatcaagatttaattattatagatagtagaaaaagttctgcttataaaggaggattcataaaaggttctagcggtaatttagttttagactctgttgctttaacaatgaatgttatttctacagttagtttctcttag

SEQ ID NO: 13124 - protein, 257 aa, Unknown
  Obtained from environmental sample
  misc_feature (1)..(257): Xaa is any amino acid
MEKTFKYVQLETKKDDALFFIDNQKDIDKINNLYDDVKDLLRNNEFSINYECTXSHKTDEKDYSYFNNTYTRINGDYFLEECVKKDTPLVFDSNKITIENKSIVFDQVLTNEEKLNTYVNFMLFLHNTNIKENQTLTSKYNIAIPFSLNPSSFEQNKLIIDDEFLSKISVKTELLKMLKENDYKVTDDKSQANIIINLENLAFGNNDTTEKKYQDLIIIDSRKSSAYKGGFIKGSSGNLVLDSVALTMNVISTVSFS

SEQ ID NO: 13125 - DNA, 627 bp, Unknown
  Obtained from environmental sample
  misc_feature (1)..(627): n is a, c, g, or t
atgggccttaactttaagggaaaaattcattggagccaaattttctggcgctataaaaaaaccaatatcgtcagggatttctttgtgccatttcgagtgcccatcaatacacactctgtaaaccatgccagccaacaattcgtcgataacatagactctataatcaacggtacttacaaccatgctctggtagaagatttcagcgctagccacgcgttattagaaacactcaaatccgtcgcctttacttacgttttttccgcaaaagaagtacaaaaacaagagttgcaaggctaccgaatcattagtggtttattagacatctacaaaccactactgacacttgataaggccacctttaccagcattctcaatcaagaaaaagacacacccatttatcaaactcgcctgttcaataagctctcggggaaacaccttgcggcttataaacaagcccttcaaaacttaaaagactttaaaattcatttcgcaggcagcaagctggaatccattagcgacgatgcttgggagttctatttccgctgccgtctcattcaagactatatcagcggcatgacagaccaattcgcctacgacgaatatcgcgccttgcacgtaattgattag

SEQ ID NO: 13126 - protein, 208 aa, Unknown
  Obtained from environmental sample
  misc_feature (1)..(208): Xaa is any amino acid
MGLNFKGKIHWSQIFWRYKKTNIVRDFFVPFRVPINTHSVNHASQQFVDNIDSIINGTYNHALVEDFSASHALLETLKSVAFTYVFSAKEVQKQELQGYRIISGLLDIYKPLLTLDKATFTSILNQEKDTPIYQTRLFNKLSGKHLAAYKQALQNLKDFKIHFAGSKLESISDDAWEFYFRCRLIQDYISGMTDQFAYDEYRALHVID

SEQ ID NO: 13127 - DNA, 567 bp, Unknown
  Obtained from environmental sample
  misc_feature (1)..(567): n is a, c, g, or t
atgaataacttagagacagatatattgataataggtggcggtccagctgccatggttactgccatgacagcagttataaacaacatggataaaagagttatggttgtaagatcatttgaaaaatcacaggttccatgtgggataccatatgtttttggagagactcttgggtcagtagaaaaaaatgcgatggtttgcggtggaaacaatccaatagttgagaagatagagagaattgttgataccgtaacagatgtaaatatagaaaataagattgtaactgcaagagaaaatataatcaaatttgacaaacttatttttgcaacgggatcagttccttttgttcatgaaaactttcaaagtgcgcttaatcttgagaatgtttttactgtaaataaagagtatagcaaagttgaagagcttaaaaactatctgccaaatagaaaaaaaatcattgttggtggaactggatttatcggtgttgagatcgcaacaaagctggcaactggtgggaaaagatgtgacctatggtcgggggaagaaatgtattgggctgactccctttga

SEQ ID NO: 13128 - protein, 188 aa, Unknown
  Obtained from environmental sample
  misc_feature (1)..(188): Xaa is any amino acid
MNNLETDILIIGGGPAAMVTAMTAVINNMDKRVMVVRSFEKSQVPCGIPYVFGETLGSVEKNAMVCGGNNPIVEKIERIVDTVTDVNIENKIVTARENIIKFDKLIFATGSVPFVHENFQSALNLENVFTVNKEYSKVEELKNYLPNRKKIIVGGTGFIGVEIATKLATGGKRCDLWSGEEMYWADSL

SEQ ID NO: 13129 - DNA, 546 bp, Unknown
  Obtained from environmental sample
  misc_feature (1)..(546): n is a, c, g, or t
atgataataaatatactttttttaacctcagatgatgattatattttagattttattaaatatgcactagaagatctattaccaaatacagaggtaaatctttttggtgcacattcagaagaacgagcctatgaacttttacaacaagaaaatataaaattaataatagcagatatggatatttgtacaatagaatcatacgagttttatgatgatttaaagaaaaaaaactatagcactattccatttgtatttttatcttcagatatagaaaatcaagaattttcaatgctcaaagggatagaaaatttctttttaacacctttaagtgaaaaaaatttaatagagaagataaatactatacttaatactacatctccatgtagtcaaaataacaaatataaaatctttacagagatagatgaacttagtttaaacatagagagtcctctactaaaagcaaaaagactcagtactcctcctagaaaaaaagcagattgtttaaatactaattccactgaaggagaaaattcgggaactatctct

SEQ ID NO: 13130 - protein, 182 aa, Unknown
  Obtained from environmental sample
  DOMAIN (5)...(126): Response regulator receiver domain
  misc_feature (1)..(182): Xaa is any amino acid
MIINILFLTSDDDYILDFIKYALEDLLPNTEVNLFGAHSEERAYELLQQENIKLIIADMDICTIESYEFYDDLKKKNYSTIPFVFLSSDIENQEFSMLKGIENFFLTPLSEKNLIEKINTILNTTSPCSQNNKYKIFTEIDELSLNIESPLLKAKRLSTPPRKKADCLNTNSTEGENSGTIS

SEQ ID NO: 13131 - DNA, 915 bp, Unknown
  Obtained from environmental sample
  misc_feature (1)..(915): n is a, c, g, or t
atgtatttttattattttgtaataaatagaaaccgaaccacaaaaacaaaacaagttgtaatctatggtgctggtaaagctggtgtaaaacttgatgaagagtttagaaatagtgaatatagggtaaaatattttgtagatgatgatactataatacagggaagaagtatagatggtattaaaattatttctagagatgagttaaaaaacagtatagagaatagaaaactagatttacttgttattgcaataccaagtgcaaaaacagagaatataaatactatttatgatgatttacataattattttaaagatgtacagatactcccatctttagaggatattctaagagataaagatttttcacagcagttaaaacatatctcagtcgaagatttattggcacgacacccaaaagatttagataagacaaagatatcccaatttatttcaaataaagttgttttagttacaggagctgggggaagtatagggagtgagattgtaagacaatgtttattttttaaagcttctaaaataatattactagaccatagtgaatttaatttgtaccaaatagaacaagagatacaacatttaacaacaattgatattatccctattatgcaatcagttgtaaacaaagaagatttggaaaaaacatttgaaaaatatacgccagatatagttatacacgcagcagcatataaacatgtgccattagtagaacataatatcaaagaatcaatagttaataatataataggaactaaaaatacaatagattgtgctattaagtataatgtgggaaaattttttttgatttcaccgataaagcagttcgtccttacaatggtatgggtaccacaaagcctatttggtgagttttatttaccaaatgtaagattcaaaaga

SEQ ID NO: 13132 - protein, 305 aa, Unknown
  Obtained from environmental sample
  DOMAIN (1)...(305): Polysaccharide biosynthesis protein
  misc_feature (1)..(305): Xaa is any amino acid
MYFYYFVINRNRTTKTKQVVIYGAGKAGVKLDEEFRNSEYRVKYFVDDDTIIQGRSIDGIKIISRDELKNSIENRKLDLLVIAIPSAKTENINTIYDDLHNYFKDVQILPSLEDILRDKDFSQQLKHISVEDLLARHPKDLDKTKISQFISNKVVLVTGAGGSIGSEIVRQCLFFKASKIILLDHSEFNLYQIEQEIQHLTTIDIIPIMQSVVNKEDLEKTFEKYTPDIVIHAAAYKHVPLVEHNIKESIVNNIIGTKNTIDCAIKYNVGKFFLISPIKQFVLTMVWVPQSLFGEFYLPNVRFKR

SEQ ID NO: 13133 - DNA, 399 bp, Unknown
  Obtained from environmental sample
  misc_feature (1)..(399): n is a, c, g, or t
atgactaaagaaacagaatttaaaataaataagtttggaaaatgtttgattgcctgtttggtgtatagttcaataattgctgttgtagtaatggcttatttagtttatgatgatgttacaattcctatgaaagataaatatatgatttatgttacatcttttatgacactaggaatattaatagcttataggcaaatagttaataataacgattttcaaaaaagacaattttctatgagtgagacttctaagttactaaaaaataataaatttcatagagatgagttaaacaaaattatagattattctaacttaagccaaaaaagagagcctttttctgtagaggaaatacctaaattaatatgcctaagtgatgaaaaaggaaactatgggaattag

SEQ ID NO: 13134 - protein, 132 aa, Unknown
  Obtained from environmental sample
  misc_feature (1)..(132): Xaa is any amino acid
MTKETEFKINKFGKCLIACLVYSSIIAVVVMAYLVYDDVTIPMKDKYMIYVTSFMTLGILIAYRQIVNNNDFQKRQFSMSETSKLLKNNKFHRDELNKIIDYSNLSQKREPFSVEEIPKLICLSDEKGNYGN

SEQ ID NO: 13135 - DNA, 561 bp, Unknown
  Obtained from environmental sample
  misc_feature (1)..(561): n is a, c, g, or t
atggatatttctcgcgtttctataagtgcccttgaaaaattacaaaaagagaaatctactactttagctccaaaatcaataaaccatatattctctctattgggtgctatttataaccatacaataaataaaggtacttacaaaggtgttaaccctattttaaaactcaaaaaattaaggattgataacaaaagagaaagatatctaaatactgaagagataaaattactcattaatgaagtaagacataatgagttattatatattttttgtttactagcattatcaacaggtggaagagctacaacaataataaatattcaaaagaagcatatagatatatttagtagaaccattacattaaccgattttaaaaatggaacaacttacaaaggatttataactcaagagatagccaatatcttagttccaaaactagaacttttaaatgtaaatgattacatattacaaattaataataagcaaatatcaatcagtcaaatacaaaaaagaatgaagcctattttagatgatctatttaaccangggactagatgctaa

SEQ ID NO: 13136 - protein, 186 aa, Unknown
  Obtained from environmental sample
  misc_feature (1)..(186): Xaa is any amino acid
MDISRVSISALEKLQKEKSTTLAPKSINHIFSLLGAIYNHTINKGTYKGVNPILKLKKLRIDNKRERYLNTEEIKLLINEVRHNELLYIFCLLALSTGGRATTIINIQKKHIDIFSRTITLTDFKNGTTYKGFITQEIANILVPKLELLNVNDYILQINNKQISISQIQKRMKPILDDLFNXGTRC

SEQ ID NO: 13137 - DNA, 792 bp, Unknown
  Obtained from environmental sample
  misc_feature (1)..(792): n is a, c, g, or t
ttggttgtcgtgctcgatggaaaaggctctacaatagttgctgcggacgattggcctgatattattttattagatgttttgatgcctgacatggatggatatgaagttgctgagcatctgaaaagtaatgaaaaaacaaaggatataccttttatatttttaactgcacagtttgacagtgatagtgttgtaaaaggttttaaactaggttccgtagattatatatcaaaaccttttgcaaaagaggagttgcttgttagagtaaaaacacatcttgaattatataccctgaagaattcacttacaaaggcattaagtcagagtaacgaacagttagaaattattaaaaaatattcaaatgaaatagagagttataaaaataatttagaggagagagttgctcaagcagtggcagagatagaatcacaaaatatacttcctctaaaacactctaaatttgctgcaatgggtgagatgatcggcatgatagctcatcagttgaagcagccccttaatggcctttcagttatctctcagagttataaaattgtatacgaattagattcaatagatgaagagtatttgattgaaaatgaagagaattccatgaaatttataagatatatgtctgaaacaatagataactttagaaacttttttcaaactgataaaaatagagaacttgttgatattaacaatcttattgatgactcaatcaaatgtgtctctcatacctttcataattcaaacattaaaattgtcaaaaactactatcaagatagtaaagattga

SEQ ID NO: 13138 - protein, 263 aa, Unknown
  Obtained from environmental sample
  DOMAIN (1)...(96): Response regulator receiver domain
  misc_feature (1)..(263): Xaa is any amino acid
MVVVLDGKGSTIVAADDWPDIILLDVLMPDMDGYEVAEHLKSNEKTKDIPFIFLTAQFDSDSVVKGFKLGSVDYISKPFAKEELLVRVKTHLELYTLKNSLTKALSQSNEQLEIIKKYSNEIESYKNNLEERVAQAVAEIESQNILPLKHSKFAAMGEMIGMIAHQLKQPLNGLSVISQSYKIVYELDSIDEEYLIENEENSMKFIRYMSETIDNFRNFFQTDKNRELVDINNLIDDSIKCVSHTFHNSNIKIVKNYYQDSKD

SEQ ID NO: 13139 - DNA, 585 bp, Unknown
  Obtained from environmental sample
  misc_feature (1)..(585): n is a, c, g, or t
atgagagttgtcgttttagtacttttttctcttttacattttctttttgcggttcaacttgattttggagttgtgccacaacagtctccatctgttatgattaaaaagtggcagcctattgcagattatatctctaaaaaaagttcagatgaggttgtgttacatatagaaaaatcaatagtagagtttgaaaaaaaacttcatgaaggtttttacgattttgcatacatgaacccttatcactatgtcgttgaaaataagtttcaaggttacaatgcaagaattcgtgcaaaaatgacgcttcaaggcatacttgtggctcgtgaagaggttaactttagatcaaaagatattaataaaaagctttttctatttcccacttctttgtcatttgcagcaacacttttaataaagtatgagcttaaaaaatactataaattagatatagataaaaatgtaaaacagatatatgtaaactctcatgactctgtctataaaggggtggctagaggtattggagatataggcggcggcatagagagaacactaaacaacttaaatgatgaaaagtcaaaagctcagtaa

SEQ ID NO: 13140 - protein, 194 aa, Unknown
  Obtained from environmental sample
  SIGNAL (1)...(17)
  misc_feature (1)..(194): Xaa is any amino acid
MRVVVLVLFSLLHFLFAVQLDFGVVPQQSPSVMIKKWQPIADYISKKSSDEVVLHIEKSIVEFEKKLHEGFYDFAYMNPYHYVVENKFQGYNARIRAKMTLQGILVAREEVNFRSKDINKKLFLFPTSLSFAATLLIKYELKKYYKLDIDKNVKQIYVNSHDSVYKGVARGIGDIGGGIERTLNNLNDEKSKAQ

SEQ ID NO: 13141 - DNA, 735 bp, Unknown
  Obtained from environmental sample
  misc_feature (1)..(735): n is a, c, g, or t
gtgaaaatgctttctaaggtacctatgtttaaagagcttgcaaaatttattgatggacatcatgaaagattagatggaagtggatatccaaaaggtttaaaaggggaacagattgcattagaatctcaaattatggcaatatctgatgcttttgacgctatgacaacaagtagaatttataaagcacgaaagagtattcctgaggcgcttaatgagttggaaagtctttcaggaaaacattatagcgaagatgttacaaaaagtgcaataactgtattaaaggatataataattgataataatatctctcaacttccaactacacagatagaaaaagaaagattttcttatttttataaagatcaaactacccaaagttacaacagcaactatttagatttagtcttaagacaaaatagctatgatgaaaaatataaatatctttatataatatctatacataatctaaatcaagtaaacataacctacggttgggaacaaggaagtgagttcttaaaagatttttatcaaaaattaaaaaatatttttagtgaatataatatatttagagtttttagtgatgattttataatattaagtgatgtagagttgaatattgatagagaagtgattcaaagttgtatatcaaaaagggagatctcttttgatatacaaacttatgatattgttaaagaaaaaatagattctatacaaagtatagatattttacaataa

SEQ ID NO: 13142 - protein, 244 aa, Unknown
  Obtained from environmental sample
  misc_feature (1)..(244): Xaa is any amino acid
MKMLSKVPMFKELAKFIDGHHERLDGSGYPKGLKGEQIALESQIMAISDAFDAMTTSRIYKARKSIPEALNELESLSGKHYSEDVTKSAITVLKDIIIDNNISQLPTTQIEKERFSYFYKDQTTQSYNSNYLDLVLRQNSYDEKYKYLYIISIHNLNQVNITYGWEQGSEFLKDFYQKLKNIFSEYNIFRVFSDDFIILSDVELNIDREVIQSCISKREISFDIQTYDIVKEKIDSIQSIDILQ

SEQ ID NO: 13143 - DNA, 546 bp, Unknown
  Obtained from environmental sample
  misc_feature (1)..(546): n is a, c, g, or t
atgttccatttaattgaaagcatacgattccttgatggaattccacaactactttcctatcatcaagaaaggttgagccaatcctataaagaatgtttccgaaaggaatgtccctattctcttagtgagattataagtcatgagaagaacatttccctcaatattgtaaaatgccgtttcctttatactgaaaaggcgtttcagattagcttccatccctatgtatataaagagatccaaactgtaaagctgatacatcataattccattgattaccatcttaaatacaataatagagatcttttaaatagtctttatgcgaagaggggagaggcagatgatattatcatttgcaagaatgaacttcttacagatagttgtttcgccaatattgttctgtttgatgggaaaacttggtttactcccgctggaccattgctaaaaggatgcatgagacaatctcttttggatgaaggtattattcaaaagaaagatatccccctcccacaaattaaattttatttaggggaaatacaattttattaa

SEQ ID NO: 13144 - protein, 181 aa, Unknown
  Obtained from environmental sample
  misc_feature (1)..(181): Xaa is any amino acid
MFHLIESIRFLDGIPQLLSYHQERLSQSYKECFRKECPYSLSEIISHEKNISLNIVKCRFLYTEKAFQISFHPYVYKEIQTVKLIHHNSIDYHLKYNNRDLLNSLYAKRGEADDIIICKNELLTDSCFANIVLFDGKTWFTPAGPLLKGCMRQSLLDEGIIQKKDIPLPQIKFYLGEIQFY

SEQ ID NO: 13145 - DNA, 654 bp, Unknown
  Obtained from environmental sample
  misc_feature (1)..(654): n is a, c, g, or t
atgtcaaaccatatacctatgagtataatagctttaggaagctttggaagagaacaattatgtgtttatagtgatattgatattatgattttatataatgatatcaaaggatacaatataaaaccaattatggaagagtttatgacattatcatgggatagtggactcaaacttggtagtcgcgttcatgagataagagagattgaagaggctgtaaaaacagatgttactattaaaacatctattctggaatcacgactgatatatggttcaaaacatctatggtataagtttcaaagtaaattaaataatattagaaattttgaacaaaaagagtttgtattagagaaattgcaagaacataaagagagactagaaaaatatccactagtgatgcaaccaaacataaaagatggctatggagggatgagagaatctaatatgctgttttggatggcaaatatcacttatggagtttcgagtacaaaggatttaaccggtattttatttagtgaagatgaatataaaaaatatagaatcgctttagaatatatttttcgaacaagaaatgccctacatctttgtgcaaaaaagaaactagataccataacttttgatattttaccagatatcagtacaaaacttggtttttaa

SEQ ID NO: 13146 - protein, 217 aa, Unknown
  Obtained from environmental sample
  misc_feature (1)..(217): Xaa is any amino acid
MSNHIPMSIIALGSFGREQLCVYSDIDIMILYNDIKGYNIKPIMEEFMTLSWDSGLKLGSRVHEIREIEEAVKTDVTIKTSILESRLIYGSKHLWYKFQSKLNNIRNFEQKEFVLEKLQEHKERLEKYPLVMQPNIKDGYGGMRESNMLFWMANITYGVSSTKDLTGILFSEDEYKKYRIALEYIFRTRNALHLCAKKKLDTITFDILPDISTKLGF

SEQ ID NO: 13147 - DNA, 462 bp, Unknown
  Obtained from environmental sample
  misc_feature (1)..(462): n is a, c, g, or t
atgatgaagggaaaagtaaaaagtgatgctttgcaaaaacttattagaaaaaggtccccatatgtagaggtaaatagttttgattacgatttcgatacttttagtattacaaatgaagattatgatttaattattgatgctacagataatttacctgttagaagtaaaatagataaattttcaaaagataaaaatatcccttggttatatggaagtgtagaagcttttcaagggcaggtgtgtttttttgataaatcctcttttaatagtgtatttaaagtctcagatcataaaccagcaggaatagcagctccaattgtgatgcatatagcctctttacaagcaaatattgctttacgatatttagctggattagctattaaaaaagattttttatattattgtttttttgatgaagagggtgaatatacagtacagaaatttggtttaccaaaagagtag

SEQ ID NO: 13148 - protein, 153 aa, Unknown
  Obtained from environmental sample
  misc_feature (1)..(153): Xaa is any amino acid
MMKGKVKSDALQKLIRKRSPYVEVNSFDYDFDTFSITNEDYDLIIDATDNLPVRSKIDKFSKDKNIPWLYGSVEAFQGQVCFFDKSSFNSVFKVSDHKPAGIAAPIVMHIASLQANIALRYLAGLAIKKDFLYYCFFDEEGEYTVQKFGLPKE

SEQ ID NO: 13149 - DNA, 714 bp, Unknown
  Obtained from environmental sample
  misc_feature (1)..(714): n is a, c, g, or t
atggattataaaattcttgatacctacttagaagacattaactctttaaagaaaattgaggaagaaattgttttttctaataaagaaaacgaagaaaacatagagacaaacaaatccctaaaaatattaagtggatttgaatgtgattattttagtgagtattacaattattatgatgaacttagagaaagatgtgattatttaatttttggagttcattttttaaatttaccttctaataaagattttcctattcatcactatccccttgataaaaaagccttaggcatttatgcagatcaatatataaaatcaattgaaagtaatttattttcaatagcagtacatccagaccttttttttatcaagtataataaatgggacgaacaggccaaagccataagtaaagcaataattgaagctgcaagttattatgatattgcattagaaattaatggtaatggaatcataaaagataaaattgaaggctttaatggagaaatgagacatccatatccagttaaagaattttggcagttagcaaaaagttatgaaaatttgaaaatagttgccaatgcagatgctcattcaccctttaatataaacaaatcaatagttgaatgtgaaaagtttgcacaagatatatctttaaattataatagtgttaatatagacaatattgataaattacataaaattgaattcaaaaagtag

SEQ ID NO: 13150 - protein, 237 aa, Unknown
  Obtained from environmental sample
  misc_feature (1)..(237): Xaa is any amino acid
MDYKILDTYLEDINSLKKIEEEIVFSNKENEENIETNKSLKILSGFECDYFSEYYNYYDELRERCDYLIFGVHFLNLPSNKDFPIHHYPLDKKALGIYADQYIKSIESNLFSIAVHPDLFFIKYNKWDEQAKAISKAIIEAASYYDIALEINGNGIIKDKIEGFNGEMRHPYPVKEFWQLAKSYENLKIVANADAHSPFNINKSIVECEKFAQDISLNYNSVNIDNIDKLHKIEFKK

SEQ ID NO: 13151 - DNA, 753 bp, Unknown
  Obtained from environmental sample
  misc_feature (1)..(753): n is a, c, g, or t
ttgcatattggtgtattagaaaataacaaatataatattgaggcttttcagaaacaatttaaatcttttgactcatctttaaataaagaatatattttaggaaatttttacaaatatgatattattttttatattcataatgaaaatactgagattcttcgagagattcgtaacataaatactcaaattcctatcattgtatataatgatgaaggttctcttcaaactatgaaatatatcaaatataatatcgcccattttgtttctagtaaaaatccaacattagaaattatacttctttttcaatatgagatgaaacattgtgataatttaaaaagaaatttatatttagaaaaagagcaagaacaatatttaaatatacttgatgattttattatcatatctcgtactgatttaaaaggaaagataacttatgtaaatgatattttttgtgaaatttcaggatataacaaagatgaacttcttggagctcctcataatatcgtacgacatccagatatgccaaaagaggcttttaaaaaaatgtggcaaacaatcaaagaagataatatctggacaggtgtagttaaaaatagagcaaaaaatggggagacctacatagcanaatcaacaattatgccctattatgtagatgaagtcaaaactggttatataggactacgatatgttattaccgatgagataactgaaaagtcagctatcaaagcttatctaactaaaacaggtggttaa

SEQ ID NO: 13152 - protein, 250 aa, Unknown
  Obtained from environmental sample
  DOMAIN (193)...(234): PAC motif
  misc_feature (1)..(250): Xaa is any amino acid
MHIGVLENNKYNIEAFQKQFKSFDSSLNKEYILGNFYKYDIIFYIHNENTEILREIRNINTQIPIIVYNDEGSLQTMKYIKYNIAHFVSSKNPTLEIILLFQYEMKHCDNLKRNLYLEKEQEQYLNILDDFIIISRTDLKGKITYVNDIFCEISGYNKDELLGAPHNIVRHPDMPKEAFKKMWQTIKEDNIWTGVVKNRAKNGETYIAXSTIMPYYVDEVKTGYIGLRYVITDEITEKSAIKAYLTKTGG

SEQ ID NO: 13153 - DNA, 675 bp, Unknown
  Obtained from environmental sample
  misc_feature (1)..(675): n is a, c, g, or t
gtgctggatctggaagtgtatttttgtaatatagaagatttcataaatgatagtaaaaaatatttagaccaacctaccctcatagcaatctcttacgatacagatacatcagccatagagtccatcgcaaaacataatgaagtttggttaaatgaggcaaaaaaagagccaaatctaaatcttgaaatcagaacaaaaagtgcaaatacaaaactctttttaaaaaatgaacctcttaaaaatgtagttatcgcatggacactttcacctcaaactatcattgatttgtatgagcactttacaccttcaatagttcagagactaaaagcgataaaaagtgtagcagatctgggatggagtgttcgcataagcatagatccagtcatttacaatgaagattttgacaaaatctaccctgagcttattgataaaatatttgaatatatagagccgacaaagctattctctctaacattgggcagttttagaatgagcctaaatcctctaaaaaagataaaaaagatgagaagaagtgatatacccttctacccatacgatacaacttcaaacgtggcaagttaccccaaagagatagagcaaaatattttagaaactctaaccactcaggggagtaaatattcctcaaaagaaaagatacccccatggcagaaatag

SEQ ID NO: 13154 - protein, 224 aa, Unknown
  Obtained from environmental sample
  misc_feature (1)..(224): Xaa is any amino acid
MLDLEVYFCNIEDFINDSKKYLDQPTLIAISYDTDTSAIESIAKHNEVWLNEAKKEPNLNLEIRTKSANTKLFLKNEPLKNVVIAWTLSPQTIIDLYEHFTPSIVQRLKAIKSVADLGWSVRISIDPVIYNEDFDKIYPELIDKIFEYIEPTKLFSLTLGSFRMSLNPLKKIKKMRRSDIPFYPYDTTSNVASYPKEIEQNILETLTTQGSKYSSKEKIPPWQK

SEQ ID NO: 13155 - DNA, 339 bp, Unknown
  Obtained from environmental sample
  misc_feature (1)..(339): n is a, c, g, or t
gtgataatgaatatcttaaataactcaaaagatgttttagaaaaaaaagatattgacgatagagttatcctaataaaaacttttatggaaaatcaaaaagcctatttaactatacaagatagtggaggggggatacctgaagatattattgataaagtatttgaaccatattttacaaccaaacaccaagcacaaggtactggaataggactttatatgtctgctgagattatctccaaacatatgaatggtacagtatccgtagaaaataaaatatttcaatataaagagaaaaaatataaaggagcttgttttataattacatttcctttaagttga

SEQ ID NO: 13156 - protein, 112 aa, Unknown
  Obtained from environmental sample
  DOMAIN (7)...(112): Histidine kinase-, DNA gyrase B-, and HSP90-like ATPase
  misc_feature (1)..(112): Xaa is any amino acid
MIMNILNNSKDVLEKKDIDDRVILIKTFMENQKAYLTIQDSGGGIPEDIIDKVFEPYFTTKHQAQGTGIGLYMSAEIISKHMNGTVSVENKIFQYKEKKYKGACFIITFPLS

SEQ ID NO: 13157 - DNA, 426 bp, Unknown
  Obtained from environmental sample
  misc_feature (1)..(426): n is a, c, g, or t
atgatagaagtttataatgcaataacaaatattgcaaatcaaattgaaaaaaatgtttttatagattacaacaattttactagtgaaacaaaaactgaacagcaaatacatgaagatgtatataaatactgttcagatgttatagaaactgaatttgaatacctaaaaaatgtaaaaagtatcatagggaaagataaaaaacaattttgtagtattaatgaaaatgggaaatatattgttagttttgtagctattgataatattgaacttcttgatttaaacttttctcttggaactatttttggtatctatgaaaatgaatttgaagcagataatttaaaagctgctatttatatcacctatggtccaacttttcaacttggatttgcttcaaaagatgaagggggtaaaatacttctcaaatga

SEQ ID NO: 13158 - protein, 141 aa, Unknown
  Obtained from environmental sample
  misc_feature (1)..(141): Xaa is any amino acid
MIEVYNAITNIANQIEKNVFIDYNNFTSETKTEQQIHEDVYKYCSDVIETEFEYLKNVKSIIGKDKKQFCSINENGKYIVSFVAIDNIELLDLNFSLGTIFGIYENEFEADNLKAAIYITYGPTFQLGFASKDEGGKILLK

SEQ ID NO: 13159 - DNA, 318 bp, Unknown
  Obtained from environmental sample
  misc_feature (1)..(318): n is a, c, g, or t
gtggagcccagctcatatcaaaaggtacatcaagagttggtagacaaagcacctgaaaaagcttttgaaaatattgtactagatgacaataataaatttgtaaaaaataaacttattgtagtatgtaatacagcttcaagagcatcaatcgaagcagaaacatttaaaaagatgggattcaaagaggtaaaaatctatagtatcaatagctggattgatcaatgtaatcctgtagtaaacaaatatagtaaagcaaaagataaacaaggaactaaaataaaatttggtcacttttatgcagaacattgtaaaaaataa

SEQ ID NO: 13160 - protein, 105 aa, Unknown
  Obtained from environmental sample
  misc_feature (1)..(105): Xaa is any amino acid
MEPSSYQKVHQELVDKAPEKAFENIVLDDNNKFVKNKLIVVCNTASRASIEAETFKKMGFKEVKIYSINSWIDQCNPVVNKYSKAKDKQGTKIKFGHFYAEHCKK

SEQ ID NO: 13161 - DNA, 537 bp, Unknown
  Obtained from environmental sample
  misc_feature (1)..(537): n is a, c, g, or t
ttgttaagattaataatcatcatacaattcgttatttttagtgatgttcttttcgctcaaaatccttcttttagtaattacaagtcttccacttctccttacttgcaatttaacgatattgttgaacataaaaataaaatgctgtttattagcagcgaaggtgtttttgaattaaaaaacaataacctatctaaaattataactgaagaaaacctttctaaatttataaaaacccctaacaacctttatgtatggagtatttatggagaaatttttgaaataaaaaagaatcaactcgttccttttccttttaataaattggttcaaaaacgagtagagaacaaaatcattaactctgtaatttttgctgattctactttttatataagtaccatagttggtagtgctttaaatcaaattgatttcaaaacagaaaccatatccaacctcaaactatatccttacccctatgttgtattaacatttagcggccaaattaattttctggaaacaacccaaaccccttctaaaaaatga

SEQ ID NO: 13162 - protein, 178 aa, Unknown
  Obtained from environmental sample
  misc_feature (1)..(178): Xaa is any amino acid
MLRLIIIIQFVIFSDVLFAQNPSFSNYKSSTSPYLQFNDIVEHKNKMLFISSEGVFELKNNNLSKIITEENLSKFIKTPNNLYVWSIYGEIFEIKKNQLVPFPFNKLVQKRVENKIINSVIFADSTFYISTIVGSALNQIDFKTETISNLKLYPYPYVVLTFSGQINFLETTQTPSKK

SEQ ID NO: 13163 - DNA, 606 bp, Unknown
  Obtained from environmental sample
  misc_feature (1)..(606): n is a, c, g, or t
ttgctttgtggctggcgcaacaaagagttaacattagtatgtaatgatgtgatcaaagagtgggagaagagagagtctctactttgtgaaccatatcatttagttgctaatctaccctactatgttgcaacaaatattattttaagagcattagaggagactcattgttcttcaatcttagtaatgattcaaaaagaggttgcacagaaattttctgcacaagttggagatagtaatttttctgcactctctgtacttgcaagtactatttctaattgccgtatactgtttgatgttccaccagaatgctttgatccagcacctaaagttacatcatccatattatggttagataaaaaaaattcgtatataaaagatgataaatataaaggtttttttacatcaaaagaggaatttaataaatttaaaagttttctaagagttagtttttcagctcctagaaaaactttaataaaaaacctcaaaagccaatactctaaagagttaattttaaagtattttcatgaaaacgaaatagtacataccttgcgtccacatcaactctcaatctcatattatcactcattgtttaggagtgtaaattaa

SEQ ID NO: 13164 - protein, 201 aa, Unknown
  Obtained from environmental sample
  DOMAIN (3)...(195): Ribosomal RNA adenine dimethylase
  misc_feature (1)..(201): Xaa is any amino acid
MLCGWRNKELTLVCNDVIKEWEKRESLLCEPYHLVANLPYYVATNIILRALEETHCSSILVMIQKEVAQKFSAQVGDSNFSALSVLASTISNCRILFDVPPECFDPAPKVTSSILWLDKKNSYIKDDKYKGFFTSKEEFNKFKSFLRVSFSAPRKTLIKNLKSQYSKELILKYFHENEIVHTLRPHQLSISYYHSLFRSVN

SEQ ID NO: 13165 - DNA, 501 bp, Unknown
  Obtained from environmental sample
  misc_feature (1)..(501): n is a, c, g, or t
atgtttaatcgcaaaaatagatcaaaaacagctactacaaataatctagttatagatggtgttagtgttacacatgtttataataagagcttaaaaaacagttacattacaattagtaaaaatggtgctgtgacatttaaaacaccaaccacttgcattaaagagcttttttacaaaaaagagcagtggattagaggaaaacttgatttaatagagttaaaacaagagattaaaatagattataaaaagcagatattatatcttggtacacttagagaaataagtagtgatgaagagttttgtagcttggaaaaatccttaaatagatcaaaatctgatgatgtaaagacattacaaaggttacattttaacttttttaaaacaatttccaaagagcacattcaagagcgtgtagatcactatagtactattatgcagctagagtatactcaaattctttggagaaagatgaataagaagatggggcaactgcagttgtaa

SEQ ID NO: 13166 - protein, 166 aa, Unknown
  Obtained from environmental sample
  misc_feature (1)..(166): Xaa is any amino acid
MFNRKNRSKTATTNNLVIDGVSVTHVYNKSLKNSYITISKNGAVTFKTPTTCIKELFYKKEQWIRGKLDLIELKQEIKIDYKKQILYLGTLREISSDEEFCSLEKSLNRSKSDDVKTLQRLHFNFFKTISKEHIQERVDHYSTIMQLEYTQILWRKMNKKMGQLQL

SEQ ID NO: 13167 - DNA, 432 bp, Unknown
  Obtained from environmental sample
  misc_feature (1)..(432): n is a, c, g, or t
ttgcttgagaaaagtataaaagaggggataccgttcatggtagaacaaagagttatggaactacaaaaaattaaagatgatttaaatgagaatttaattacaaatgaaaaagcgctttcgcttacatgggctagttatgatgacacaattcgtgttactaaagagataggtttatttaaacaacagatagattttaatggaaaaaaagttttagcacaaattgctaagattggctcagtagcactctttttttccacacctacaaatgaagttgggtatgttctaaaagataactctaaatatatatataagcatataacaaatccagaagatattgaaaagatagtggctctatttgatgctttacaaaaacagataagaacaggttattttgagttgccgaatgcattagttttacaagggagtaaataa

SEQ ID NO: 13168 - protein, 143 aa, Unknown
  Obtained from environmental sample
  misc_feature (1)..(143): Xaa is any amino acid
MLEKSIKEGIPFMVEQRVMELQKIKDDLNENLITNEKALSLTWASYDDTIRVTKEIGLFKQQIDFNGKKVLAQIAKIGSVALFFSTPTNEVGYVLKDNSKYIYKHITNPEDIEKIVALFDALQKQIRTGYFELPNALVLQGSK

SEQ ID NO: 13169 - DNA, 801 bp, Unknown
  Obtained from environmental sample
  misc_feature (1)..(801): n is a, c, g, or t
gtggaccagggaaaaagatggattttgcaaagggtttcaaaaatagggaaccggttttccaaaaaacaccttaaaaggaaaaaggggaaaatccggaataattggttttggagctgggtaaagggagggttacttgcaaattttattgaaaaccccaaagaagaatcatcaagtataattaaaaaattagattatatagcatttgatttagttgatgatgataaagaagaatgtttatcagtacttcaaaagatttacccagactttaataatagatatttcaatgatatcaattctattttttctcattatgataaggaaagctttgatgttgtcctcatgtgtaatgtcttacacgaaattgatccaaatcaatggctgagccttttttctaaagagggtgatattcctacacttttaacagatcatggaattttattagtagttgaagatcaacaaattcctatcggggaaaaagcatatcaaaaagggttcatcgtattagacacacctgaaatcaaagatgtttttggaattactgaacaagattcagattttggatatactgacgctaaagaagatggtagattaaaagcacatcgaataaagaaagaatacttatgtcgaatcactccagaatctagaattaaatcattacaatctttaaataaaaaagctgcaaaaaatattttaaagattagaaaaaaagagataaattatagaaatgggacaaagcatggtttttggattcagcaactagcaaatacaactttgagcttgaacgaattaactaacaaataa

SEQ ID NO: 13170 - protein, 266 aa, Unknown
  Obtained from environmental sample
  misc_feature (1)..(266): Xaa is any amino acid
MDQGKRWILQRVSKIGNRFSKKHLKRKKGKIRNNWFWSWVKGGLLANFIENPKEESSSIIKKLDYIAFDLVDDDKEECLSVLQKIYPDFNNRYFNDINSIFSHYDKESFDVVLMCNVLHEIDPNQWLSLFSKEGDIPTLLTDHGILLVVEDQQIPIGEKAYQKGFIVLDTPEIKDVFGITEQDSDFGYTDAKEDGRLKAHRIKKEYLCRITPESRIKSLQSLNKKAAKNILKIRKKEINYRNGTKHGFWIQQLANTTLSLNELTNK

SEQ ID NO: 13171 - DNA, 735 bp, Unknown
  Obtained from environmental sample
  misc_feature (1)..(735): n is a, c, g, or t
ttgtttgaggtttttaaaatccgcaaccccaaaaaggatgttttatgggtttttttagagatttttttttggggtggggttcagggggttcatcccttttaccatggcattaaaggaaaatttaaattttgtgtgggccaaaggcaccacggaaaatttattgggggtcaaattagacgaaaaaacctaaaaaagatttttactgcagcaatgaaaggctacagatcaatcttggaaatcacaaaagaaagagccatcaatgcagctaaccaaatcaaaaaagaaaagacagactatcaaggtgatttaagttttaaagtttatgaaaccacatctctactaaataattctctaacgagtatggttaagtttgatgatagtaaaccaaaactatttgatcccagcacattaaaagatgatgatttcaatatgctactaacgacatggaaagtacatgatggtgcgaaattaactgatgacttacaagagataaccttgaaagactacaaagcatactatggggataaaaagctttattttgtaaacaatggatttactactgaagacttaaaagagcttatcaaaaagctagataatgataaaacttttgaaccaaacaagcttatactttttggatatacctttgatagtaaataccaaagagagataagtgaagcactaaatagctataccaataaaaagtctattgaaattgacatgatcgttaggtattaa

SEQ ID NO: 13172 - protein, 244 aa, Unknown
  Obtained from environmental sample
  misc_feature (1)..(244): Xaa is any amino acid
MFEVFKIRNPKKDVLWVFLEIFFWGGVQGVHPFYHGIKGKFKFCVGQRHHGKFIGGQIRRKNLKKIFTAAMKGYRSILEITKERAINAANQIKKEKTDYQGDLSFKVYETTSLLNNSLTSMVKFDDSKPKLFDPSTLKDDDFNMLLTTWKVHDGAKLTDDLQEITLKDYKAYYGDKKLYFVNNGFTTEDLKELIKKLDNDKTFEPNKLILFGYTFDSKYQREISEALNSYTNKKSIEIDMIVRY

SEQ ID NO: 13173 - DNA, 813 bp, Unknown
  Obtained from environmental sample
  misc_feature (1)..(813): n is a, c, g, or t
atgatatatatcgacccaccgtacaatacaggtggcgatggatttgtttataacgatgatagaaaatttactatggaagaactttcgcagcttgcaggagtaagtcttgaagaagcaaaaagaattttagaatttacagagtctaattcaaattcacacagtgcatggcttacctttatgtaccctagactctatatcgccaaagaacttttaaataaggatggggttatcttcattagtattgatgataatgaagttagccaacttaggttgttatgtcatgaagtttttggtgaagaaaatgaactaggaccgattatccacaataaacttaattcaaaaagtgactcttcaagtgttcaaaaaaatcatgaatatttaatttgctatcgtagaagttcaaatactgataaaaactcaactttagtaaaaagtgaaattaaaacaaaagaagcatttaaagaaggaaaacgtttttttatattaaaagattcaatcacgacacgaggtgaaggcggaacattaaacaaaagaaaaaatcttggttatactatttactacaatcctgatactgaagattttgtgggagtttctgactatgatattgagctagcattgacttctaatgatgaaagcaaagtatataacgatgatcaagttcttataaacaaaggatatataaagattagacctcctaaagttaaaaggaaaacttggtgcatggaccttgggccaataaatgaatttaaatactccgcaaagatggaaatattaattcaagaaaaaaaaaagaaatgccctataggtgtttaa

SEQ ID NO: 13174 - protein, 270 aa, Unknown
  Obtained from environmental sample
  misc_feature (1)..(270): Xaa is any amino acid
MIYIDPPYNTGGDGFVYNDDRKFTMEELSQLAGVSLEEAKRILEFTESNSNSHSAWLTFMYPRLYIAKELLNKDGVIFISIDDNEVSQLRLLCHEVFGEENELGPIIHNKLNSKSDSSSVQKNHEYLICYRRSSNTDKNSTLVKSEIKTKEAFKEGKRFFILKDSITTRGEGGTLNKRKNLGYTIYYNPDTEDFVGVSDYDIELALTSNDESKVYNDDQVLINKGYIKIRPPKVKRKTWCMDLGPINEFKYSAKMEILIQEKKKKCPIGV

SEQ ID NO: 13175 - DNA, 429 bp, Unknown
  Obtained from environmental sample
  misc_feature (1)..(429): n is a, c, g, or t
ttgatatcgatgctatccaaaaaatattgcctcaccgctatccattcttattgggttgataaaattaccgaatttgaagctggagaaaagattgtaggcatcaaaaatgttacaatcaacgaaccatttttccaaggtcattttccaggccaccctgtaatgccaggtgtacttatcgtagaagcgatggcacaaacgggtggaatcatgctattgaattcttatgatgaaccagaaaagtatgtagcatatttcgcatcaatcaacaacgtgaaattccgtaagccggtaaaacctggtgacaccttacgtttcgaattgagagtaatctcgatcaaacgtggattggcaaaaatgcacggagatgcttatgtaggctctaagaaagttacagaagctgacttcatggcaaaagttgtagataaataa

SEQ ID NO: 13176 - protein, 142 aa, Unknown
  Obtained from environmental sample
  DOMAIN (45)...(132): Thioesterase superfamily
  misc_feature (1)..(142): Xaa is any amino acid
MISMLSKKYCLTAIHSYWVDKITEFEAGEKIVGIKNVTINEPFFQGHFPGHPVMPGVLIVEAMAQTGGIMLLNSYDEPEKYVAYFASINNVKFRKPVKPGDTLRFELRVISIKRGLAKMHGDAYVGSKKVTEADFMAKVVDK

SEQ ID NO: 13177 - DNA, 447 bp, Unknown
  Obtained from environmental sample
  misc_feature (1)..(447): n is a, c, g, or t
atgattgatgaatcgatgccaagaactgtaaaagatgaagtaaaaaatggtgtatttggagtatttacaacaaaaaataaaaccataatctcatcatctaatcaaaagtattcagttggttcttatttagatataactgataagtttttcaatcttaaaaatggtgaaacatatagtgaaatcatcactttagacaacaaattttatacaataggtgtaaaatgttctaatggatatagagaatttaaaaatgggagtgatgattataaaaatgatgtgtattcgtttttcttcgcatatatcagtcaagcggatatacctatcgaaacatccaaaccaacgctcctcaataatgatgtagttgaaacccaatgtcatgatgctccccacgattcccacattatagaattcgaactacatacccttggtccgcagttaaagagatga

SEQ ID NO: 13178 - protein, 148 aa, Unknown
  Obtained from environmental sample
  misc_feature (1)..(148): Xaa is any amino acid
MIDESMPRTVKDEVKNGVFGVFTTKNKTIISSSNQKYSVGSYLDITDKFFNLKNGETYSEIITLDNKFYTIGVKCSNGYREFKNGSDDYKNDVYSFFFAYISQADIPIETSKPTLLNNDVVETQCHDAPHDSHIIEFELHTLGPQLKR

SEQ ID NO: 13179 - DNA, 660 bp, Unknown
  Obtained from environmental sample
  misc_feature (1)..(660): n is a, c, g, or t
atggtactccggaatatggttatgaagataatgcagttcgtttggggatattttaactactcacttgtaaaacttttgaaactctcatcttttgatgttatccacctaaatgactggcagtgtggtcttagttcacttttaataaagagtgataaagccatagagacaaaagtagtatatactattcacaatcttgcgtatcaaggtgtttttgaaaaaagtgtattggatgatttagatatagatcactctttttttaacattgatggagttgagttttatgataaggtaagttttatgaaagcaggtattgcctattgtgatgctattagcactgttagtccaaattatgcaaaagagattttaactgctgaatttggatgtggattagaggggtttttagatcatcataaatctaagctactcggcatcttaaacggaatcgataccacacacttttcaccatcaaccgacacagcactatttaagagatatactaacttgagtgataaaaaaattaataaaagttcttttctaaaatctacaaagttaaaaggtgttaataaaccgttatttgtatttataggtcgctttacatggcaaaaagagggtggaccttcttatagatatacttccagatttagcaaagagagagtgtaa

SEQ ID NO: 13180 - protein, 219 aa, Unknown
  Obtained from environmental sample
  misc_feature (1)..(219): Xaa is any amino acid
MVLRNMVMKIMQFVWGYFNYSLVKLLKLSSFDVIHLNDWQCGLSSLLIKSDKAIETKVVYTIHNLAYQGVFEKSVLDDLDIDHSFFNIDGVEFYDKVSFMKAGIAYCDAISTVSPNYAKEILTAEFGCGLEGFLDHHKSKLLGILNGIDTTHFSPSTDTALFKRYTNLSDKKINKSSFLKSTKLKGVNKPLFVFIGRFTWQKEGGPSYRYTSRFSKERV

SEQ ID NO: 13181 - DNA, 375 bp, Unknown
  Obtained from environmental sample
  misc_feature (1)..(375): n is a, c, g, or t
atgatttacgatttttggaaagattatgaggaattactttcttatgatcaagcttcacttttggattatcgactagataatataggtatcaaattaaatgatttttttcaaaggttaattataggtcatataaaaaaacgagatataaagtgctatcttgctggttcttgtttgaagtcggataattttgctgatttagatctgtttttcccctcaaatgaagatagagagttaataaataatgctatgaataaagattattttgagtatgagaataattcatatacttatagatacaaaaatgatatatatcaacttgtttatagagaaaggtttaaaggagctactttaaaagagcttgtagaagggttttga

SEQ ID NO: 13182 - protein, 124 aa, Unknown
  Obtained from environmental sample
  misc_feature (1)..(124): Xaa is any amino acid
MIYDFWKDYEELLSYDQASLLDYRLDNIGIKLNDFFQRLIIGHIKKRDIKCYLAGSCLKSDNFADLDLFFPSNEDRELINNAMNKDYFEYENNSYTYRYKNDIYQLVYRERFKGATLKELVEGF

SEQ ID NO: 13183 - DNA, 567 bp, Unknown
  Obtained from environmental sample
  misc_feature (1)..(567): n is a, c, g, or t
ttgaagtcggataattttgctgatttagatctgtttttcccctcaaatgagnatagagagttaataaataatgctatgaataaagattattttgagtatgagaataattcatatacttatagatacaaaaatgatatatatcaacttgtttatagagaaaggtttaaaggagctactttaaaagagcttgtagatggttttgattttgactcaacgaagatagcttttgagtgtaattataatacgaaaaaaagactatttactattgttaaatgtgatatgagaatagagtttgtcgattatattaatacaaggatcaataatttatcgaaagtaagtttgaatccatttgtatcactacaacgagccatttacttcctaaaaagaggagatgatgttccctataatgtatttttacaagtgtgttctaaaatagctgatttaaaaatagaaaataatgaagatacctcttttcatttcaaaaacttacaaggaaatccaaataaattaacaaatattaaagatgcaattacacattatattgaagaccacaaagaggagaactaa

SEQ ID NO: 13184 - protein, 188 aa, Unknown
  Obtained from environmental sample
  misc_feature (1)..(188): Xaa is any amino acid
MKSDNFADLDLFFPSNEXRELINNAMNKDYFEYENNSYTYRYKNDIYQLVYRERFKGATLKELVDGFDFDSTKIAFECNYNTKKRLFTIVKCDMRIEFVDYINTRINNLSKVSLNPFVSLQRAIYFLKRGDDVPYNVFLQVCSKIADLKIENNEDTSFHFKNLQGNPNKLTNIKDAITHYIEDHKEEN

SEQ ID NO: 13185 - DNA, 486 bp, Unknown
  Obtained from environmental sample
  misc_feature (1)..(486): n is a, c, g, or t
atgagagtttttttagtagggtttatggcaagtggaaaatcttcagttgggaaaaaattggcaaaacaaatggaccttccatttattgatttagatgattatattgaagagaaattcaatagtactattcgttctattatttatgataagggaatgaatggttttagagaaattgagagagattctttgcaggcagtaataaataaaaataaaaatgtcttggtttctgtaggtggaggtactccatattattttgataatatgcaagacatgaacgatgctggagaaacagtttatttggaggttgatattcctacactagttgatcgtttaatgcatgcaaaacaagatagacctttaatttggggtaaatcaagagaagatttaacaatttatgctaatgatctttttagcaaaagagagaaattttacttagaagcaaaacataaggtaagtggtaaaaatcttaattatgcaagcctttag

SEQ ID NO: 13186 - protein, 161 aa, Unknown
  Obtained from environmental sample
  DOMAIN (1)...(159): Shikimate kinase
  misc_feature (1)..(161): Xaa is any amino acid
MRVFLVGFMASGKSSVGKKLAKQMDLPFIDLDDYIEEKFNSTIRSIIYDKGMNGFREIERDSLQAVINKNKNVLVSVGGGTPYYFDNMQDMNDAGETVYLEVDIPTLVDRLMHAKQDRPLIWGKSREDLTIYANDLFSKREKFYLEAKHKVSGKNLNYASL

SEQ ID NO: 13187 - DNA, 765 bp, Unknown
  Obtained from environmental sample
  misc_feature (1)..(765): n is a, c, g, or t
ttggaggggtgtgtcaattccaaactatggaagggaccggtttttaacaaaaaaatgattaatcaagttatgcattttaatcaaatttcggatttgtttaattatgcaaatatcgaaggcaccttttggaaattgtacattctcattctggggcctggtctccaaaaattcaataaagattttgcaattgataatataatacaaaacattcaaaaagataaaaaaccaggaattgcgcatacatttcatagttttatagagaaagaatatccatttcaaaaacgtatgactgaaactgcagatataactacgcttctaaacaaagcaaaagaagcagaatttaaaaaatattttacaaatacgccttatgaaattatcccaaatatggtcaattcacatcataataaagaagaagaattgctaaatctaaaaaacgaacttgctccaaacggtgaaaaaattttattatacgtaggccgactggaaaaagaaaaaggcatttattctcttgcgcattcaataaatgaattatataaaactgaaaaaaatattaaagtagtaattgtaggatcacacaccaaaataagcactgaacacgtaactaaaatgaaagaaatattacgcaaaccaataaatgataataaaataaaatttactggatggattagcgaagaacaagtctcagcatatcaacaagttggagatttacaaatagctccaagttatactgaagcattttctttagcaatggcaaaagggatttaa

SEQ ID NO: 13188 - protein, 254 aa, Unknown
  Obtained from environmental sample
  misc_feature (1)..(254): Xaa is any amino acid
MEGCVNSKLWKGPVFNKKMINQVMHFNQISDLFNYANIEGTFWKLYILILGPGLQKFNKDFAIDNIIQNIQKDKKPGIAHTFHSFIEKEYPFQKRMTETADITTLLNKAKEAEFKKYFTNTPYEIIPNMVNSHHNKEEELLNLKNELAPNGEKILLYVGRLEKEKGIYSLAHSINELYKTEKNIKVVIVGSHTKISTEHVTKMKEILRKPINDNKIKFTGWISEEQVSAYQQVGDLQIAPSYTEAFSLAMAKGI

SEQ ID NO: 13189 - DNA, 630 bp, Unknown
  Obtained from environmental sample
  misc_feature (1)..(630): n is a, c, g, or t
atgctacccgaaaaattgaaaataggattaaaattaactaaaaatttcaaaggttttcatcaacggaaaaaagttaccttaaaagacggccaatgcactattgaaaaaatattgcccggtgaatacgacgtaaccttgatgtcgaaattgctaccacgcattactcaaaatatcgaaattctcccaaacaaaaaaacgtacatcgaatttgaggttgaagaaaattattctgtttcaggtgtaatctcatcaaataagacagcgctaaaagatgctgaaataagagtgtccaaaataaataaaagccgtcacagaggtaataataatactaaaagccctataatgagtgatgagaaaggaggctttagtgttaaaggtcttttgcctggaaactataaaataagtgtaaaacaccctaaaacaaatacctatagtcaagatattgaaatcataagagaatctttaggcaatctacaaattgaactaaaatatggcaaaaaaataaccggaaaaatatttaataaatcaggacagccctattgtaaggcaaaggtaagtattagccccactgattacggagggagttttacccctcgtagtagtactagtaaccccgggcgaagaatttaa

SEQ ID NO: 13190 - protein, 209 aa, Unknown
  Obtained from environmental sample
  misc_feature (1)..(209): Xaa is any amino acid
MLPEKLKIGLKLTKNFKGFHQRKKVTLKDGQCTIEKILPGEYDVTLMSKLLPRITQNIEILPNKKTYIEFEVEENYSVSGVISSNKTALKDAEIRVSKINKSRHRGNNNTKSPIMSDEKGGFSVKGLLPGNYKISVKHPKTNTYSQDIEIIRESLGNLQIELKYGKKITGKIFNKSGQPYCKAKVSISPTDYGGSFTPRSSTSNPGRRI

SEQ ID NO: 13191 - DNA, 531 bp, Unknown
  Obtained from environmental sample
  misc_feature (1)..(531): n is a, c, g, or t
ttgggatcaaattttacttaccattgtcaatatcataaatattattaccaaaaatacatcgtaattatcagagtaacatgccttgattgcaaaagcacacatgcccttattccggatttttcattacctggaaccagtatagggactgcagaagccgataaatacataattctcagaagtaaggggttttcacaggcaattgcatcgaagatatttatctcccagggaatggctagaaaatacgggattatttttgaaaaaagaataaaaagttcagttcaaaaagctatagcactttttccaaaagctgatgacattcttcataatccgcttcttttgtttcaacggaatgatgaatcggatgcacctgttattctaaccataaaccaactttttttaattagaggatacaatcctcttttcttttcccgaaataacattctgatgataagagaaattaaatcaggaaaggatccaccacttaataaagaggctatctggtcaggcaatcggagcatagactcaggataa

SEQ ID NO: 13192 - protein, 176 aa, Unknown
  Obtained from environmental sample
  misc_feature (1)..(176): Xaa is any amino acid
MGSNFTYHCQYHKYYYQKYIVIIRVTCLDCKSTHALIPDFSLPGTSIGTAEADKYIILRSKGFSQAIASKIFISQGMARKYGIIFEKRIKSSVQKAIALFPKADDILHNPLLLFQRNDESDAPVILTINQLFLIRGYNPLFFSRNNILMIREIKSGKDPPLNKEAIWSGNRSIDSG

SEQ ID NO: 13193 - DNA, 327 bp, Unknown
  Obtained from environmental sample
  misc_feature (1)..(327): n is a, c, g, or t
atgtatctaatcgctggacttggtaatccaggtgataaatataaactcaaccgacacaatataggttttttggttatcgatgagataaccaaaaatctacaaactacaaatatcacaaatctcaacttcaaagcagaagtgaaaaaaaaccttacaaatatctatgcaaaaccgttaacatatatgaatgacagtggaagttcaattataaatatcgtagagtattataatattgaaaatagcaatgttataatagtacacgatgatttagatttgccatttggtacagttaagtttaaattagtggggtggacatggtggacataa

SEQ ID NO: 13194 - protein, 108 aa, Unknown
  Obtained from environmental sample
  DOMAIN (3)...(108): Peptidyl-tRNA hydrolase
  misc_feature (1)..(108): Xaa is any amino acid
MYLIAGLGNPGDKYKLNRHNIGFLVIDEITKNLQTTNITNLNFKAEVKKNLTNIYAKPLTYMNDSGSSIINIVEYYNIENSNVIIVHDDLDLPFGTVKFKLVGWTWWT

SEQ ID NO: 13195 - DNA, 318 bp, Unknown
  Obtained from environmental sample
  misc_feature (1)..(318): n is a, c, g, or t
ttgttctacgcattagcaagaaaaaaaatgaaagatgttgatgatgttgttggaatgactttcatggctataaacaacaaaaataaagatgttaccaaacaatttatggtgtataacaacgaagaaaactcttatgaaataatacgtgcacgcaaagataaactttggaatttaaaggatttttctgaagaagtaagggcacagatatctatcgctttcgagggtgatttttctgaaaatactaattcaagttgtcacttttgtgggtataaaaaaaacattacttgttctatcagagaaatgaaaggaaatggatga

SEQ ID NO: 13196 - protein, 105 aa, Unknown
  Obtained from environmental sample
  misc_feature (1)..(105): Xaa is any amino acid
MFYALARKKMKDVDDVVGMTFMAINNKNKDVTKQFMVYNNEENSYEIIRARKDKLWNLKDFSEEVRAQISIAFEGDFSENTNSSCHFCGYKKNITCSIREMKGNG

SEQ ID NO: 13197 - DNA, 762 bp, Unknown
  Obtained from environmental sample
  misc_feature (1)..(762): n is a, c, g, or t
ttgataccaaatacaaaagaaagctggaattactctaaaaaagcgtttataattcatacgttgatcgatcaaaatataaaaatacaaaatgaagatttatcagaaaatacccgaatagctttggagggtattggcgtgaattttgatgccatccgagaaaaaaaagaacttcttgaaaaaaatgcagccaatgcatacaaaatagatatgtcaaatgaaaaaacaaaaaaaaatcttaaaacacttttctccccaacgttgagtccctcaagatacaaaaatctaaaaaattgcaaacgaaagtttttattagaaaatattttaaaaatacctcaacaacgtgacaaactgtttggttttgatgcactcgaagagggcaacataatgcatgcagtccttcgttccgtttttgaaaatttatctatagagggtaaactttttgaaaattttaatgattgtgaatttcaaaatttcacggaaacacatcttaaagattatataaaaactgaagttaagagtagaatgtttcatccatctgataccataacatctgtagaatgtgattattttttcaaacaattatctgaatttttatctaaatatagaacgtcaaaaatcaatccttcttatacaaaaaaaaccgaatgggagggtgtgaaattcattccaagtgattttgaaatatctatagataaaaaaactggtataaaattatttgaaaaaccagatatattcctcattggtaaaattgacaggatttga

SEQ ID NO: 13198 - protein, 253 aa, Unknown
  Obtained from environmental sample
  misc_feature (1)..(253): Xaa is any amino acid
MIPNTKESWNYSKKAFIIHTLIDQNIKIQNEDLSENTRIALEGIGVNFDAIREKKELLEKNAANAYKIDMSNEKTKKNLKTLFSPTLSPSRYKNLKNCKRKFLLENILKIPQQRDKLFGFDALEEGNIMHAVLRSVFENLSIEGKLFENFNDCEFQNFTETHLKDYIKTEVKSRMFHPSDTITSVECDYFFKQLSEFLSKYRTSKINPSYTKKTEWEGVKFIPSDFEISIDKKTGIKLFEKPDIFLIGKIDRI

SEQ ID NO: 13199 - DNA, 786 bp, Unknown
  Obtained from environmental sample
  misc_feature (1)..(786): n is a, c, g, or t
atgaaaataaataaaaactctatactttttacaatcactattacatttattatatcaatattttttatgttgataagctttgttattctttatgaaaactcacaaaagagcactcaagagtttatgtttaaacgatcaatagatgtttctaaaacaattttaagagagtgtagaggtggcgtagttacagaagatttaattgggcaccttcaacggatggatttttctatgtttattgataagaaagaacaagaagagttgctgaacaataaacgaataattattttgatggaaaagcaaaagagatattcaatgatagccttattaaaacttgacggtaaatactatgcccatgttcaaacaccaagtctagatgttttagttaaagataatattgatataccagacaataaaatcacacttattatagtagctatatcagttgtatcgttatttatacttttatatcttctaactttaaagaaactattaaaagtgaatgttctaaaagataaggtgaagcatttagcaaatgaaaattttgatatagattgtgctacagagcatcaagatgagatatcgcaactttcanatgagttccataaaacggcaaataaattaaaactcttaaaagaatcaagggatatctttatacgaaatattatgcatgaactaaaaactcctattatcaaagggaaaatttctaacacacctagaacaatccttctgaaaatcaaaaaaagatggaaaaagttttttatagaccaaaatcctttgaataaatga

SEQ ID NO: 13200 - protein, 261 aa, Unknown
  Obtained from environmental sample
  DOMAIN (141)...(209): HAMP domain
  misc_feature (1)..(261): Xaa is any amino acid
MKINKNSILFTITITFIISIFFMLISFVILYENSQKSTQEFMFKRSIDVSKTILRECRGGVVTEDLIGHLQRMDFSMFIDKKEQEELLNNKRIIILMEKQKRYSMIALLKLDGKYYAHVQTPSLDVLVKDNIDIPDNKITLIIVAISVVSLFILLYLLTLKKLLKVNVLKDKVKHLANENFDIDCATEHQDEISQLSXEFHKTANKLKLLKESRDIFIRNIMHELKTPIIKGKISNTPRTILLKIKKRWKKFFIDQNPLNK

SEQ ID NO: 13201 - DNA, 513 bp, Unknown
  Obtained from environmental sample
  misc_feature (1)..(513): n is a, c, g, or t
atggaaaaagtattttatagactagaatctttgataaatgagtttgcaactatagaacagcttatatcttcaagaaaagctatagaaaagaaatcttactttatagaagatattgttgatgatgctattgatattttgatgtgtgaagaggaggaggtgagtgtaaaccttagcaatacaaaaatcaatgtagactttaaactcttttctatagctattaaaaacttgattgacaatggaatcaaacactcaacaaataaaaaagtaacaatagaaactataaatgatcaaatagtatttaaaaatgaagggaaacaattacaatatccattagaaaagtattttgaacctttttttaaaggtgatgatgtaaaatcaaatcaaagttttggactagggttatatataatcaataatattttagatgccaatgactttgagctaaaataccaatatgatgacggtgtaaacaattttataatagtaaaaaagatgaataaaaataaatgttaa

SEQ ID NO: 13202 - protein, 170 aa, Unknown
  Obtained from environmental sample
  DOMAIN (64)...(166): Histidine kinase-, DNA gyrase B-, and HSP90-like ATPase
  misc_feature (1)..(170): Xaa is any amino acid
MEKVFYRLESLINEFATIEQLISSRKAIEKKSYFIEDIVDDAIDILMCEEEEVSVNLSNTKINVDFKLFSIAIKNLIDNGIKHSTNKKVTIETINDQIVFKNEGKQLQYPLEKYFEPFFKGDDVKSNQSFGLGLYIINNILDANDFELKYQYDDGVNNFIIVKKMNKNKC

SEQ ID NO: 13203 - DNA, 330 bp, Unknown
  Obtained from environmental sample
  misc_feature (1)..(330): n is a, c, g, or t
ttgattttcatagtaactattttggtagtgctgacaaacttgttgagggcacaattagaatttgaatttgaaactagtgatatagcacttgacaacccttttagctacaaagagtataaggatgattttaaacttctaaaaaacaaacttaaaagtatggacttaactattcctacactttataaacaatatagtgaattgtgtgaagaaggtggtataaaattttatgattttaacatcgatccagatttttctaactgtatcgatagttttatcgttgttgagattgcaaaaatcaaacaatcaaaacttgataggtatatggggtaa

SEQ ID NO: 13204 - protein, 109 aa, Unknown
  Obtained from environmental sample
  misc_feature (1)..(109): Xaa is any amino acid
MIFIVTILVVLTNLLRAQLEFEFETSDIALDNPFSYKEYKDDFKLLKNKLKSMDLTIPTLYKQYSELCEEGGIKFYDFNIDPDFSNCIDSFIVVEIAKIKQSKLDRYMG

SEQ ID NO: 13205 - DNA, 729 bp, Unknown
  Obtained from environmental sample
  misc_feature (1)..(729): n is a, c, g, or t
atggattttttgaaacaacattcacatttaaaaggatttgaatttgtagaagcagtgttggattattttaaatttgacttttcatattcaagtaaagatattgaaaatatcccctcatcaggtagagttgtgataatatcaaatcatcctttgggtgcattagatgctctttgcttactaaagcttgttagcagtgttagaaaagatgtgagaatcgttgcaaatgattttttagcaggtattgactctttaaactctctatttattaaaattgataactacaaaacaaaacaatcaaaagagaatatcaaaaaaatatatacagctttagacaatgaagaggcggtaattatatttccagctggtgaagtgagtcgtgtatctcctacaggtataaaagatggtaagtggcaaaaaggttttttaaagtttgctaaaaaatcaaatagccctattttaccaatacttgttgatgcaaaaaactctaaaactttttatactgtttctattttaaataaaacattttcaactatccttttatctgatgagatgtttaaacaaagagataaaaatgtcacaataaaagttggaaaacttatagcaaatgagcatatacttcatagcacctcagataaacttagtattgtagatcaatataaaaaacacctctatggtcttaaaaaagggaaaaaacaatattttgaaactatcaatactattgcccggtga

SEQ ID NO: 13206 - protein, 242 aa, Unknown
  Obtained from environmental sample
  DOMAIN (7)...(158): Acyltransferase
  misc_feature (1)..(242): Xaa is any amino acid
MDFLKQHSHLKGFEFVEAVLDYFKFDFSYSSKDIENIPSSGRVVIISNHPLGALDALCLLKLVSSVRKDVRIVANDFLAGIDSLNSLFIKIDNYKTKQSKENIKKIYTALDNEEAVIIFPAGEVSRVSPTGIKDGKWQKGFLKFAKKSNSPILPILVDAKNSKTFYTVSILNKTFSTILLSDEMFKQRDKNVTIKVGKLIANEHILHSTSDKLSIVDQYKKHLYGLKKGKKQYFETINTIAR

SEQ ID NO: 13207 - DNA, 747 bp, Unknown
  Obtained from environmental sample
  misc_feature (1)..(747): n is a, c, g, or t
ttgtttttttattctagagaagcaaaagacagaggaatactaaattcacttcctatggagctttatgaaaaagccacacaagaactatctagtatattaggagataaaccaattataattacagaaggtaaaacagattggaagcacctaaaacaagcactacgaaggtttcaagatgaatattactacctagacctagatattgaatttttgcagtatgaagataacatacaaatgggagatgctcaacttgattctatggttgaatcttttaaaaaaacaaatcagccaagaaaaacaatttttatgtttgatagagataatgataagtatactcgaaaatatggaaatgaagaattttataattataaaaataatgtatacattttctgtattccaaaaataaatgatgagctagataatatttgtttagaattttattatgaagaaaataacttaaaaactgaagatgaaagtggtagaagattatttttggggaaagatttttttactaatggtaatagtaaatgtggtgaatatcaggctaaagaacaaaataaatgtagcaagttgtctattatagatgatagagtttttaaaaaagatgatttagaacatacaagttctgtcgttctttcaaagaatgatttttcagagaatattttagaagaaaaagaaaatttcaataatttcaatattgaaaattttaaaaaaatatttgatcttattgagaagataataaaatga

SEQ ID NO: 13208 - protein, 248 aa, Unknown
  Obtained from environmental sample
  misc_feature (1)..(248): Xaa is any amino acid
MFFYSREAKDRGILNSLPMELYEKATQELSSILGDKPIIITEGKTDWKHLKQALRRFQDEYYYLDLDIEFLQYEDNIQMGDAQLDSMVESFKKTNQPRKTIFMFDRDNDKYTRKYGNEEFYNYKNNVYIFCIPKINDELDNICLEFYYEENNLKTEDESGRRLFLGKDFFTNGNSKCGEYQAKEQNKCSKLSIIDDRVFKKDDLEHTSSVVLSKNDFSENILEEKENFNNFNIENFKKIFDLIEKIIK

SEQ ID NO: 13209 - DNA, 570 bp, Unknown
  Obtained from environmental sample
  misc_feature (1)..(570): n is a, c, g, or t
atgagaaaagagacgcttcaaaaaaagacaaagattgccaacaacattatgttttatatctatactcatatagatacaaatatctccatggatgagttagcagatgattttcatgtaaataaattttacatgcataagatatttaaagagatatttgaaaaaaatatctatgagagcataaaatctatacgtctacaaaaagcctctaacttacttttaacaaacaaatactctaccatctcagatattgcgaaactatgcggttatagctctcaaacttcttttattcgctcttttaaagagcgttttttgatgacaccaaagagctggcgcaaaggcggatacaaagagtactcaaaacagatccttgaacagtcagtaaaagccaaaaactctactgcaaactttgatgatctagaacctaccataattaaaatgccgatttttgaagcttactatataagacaccgtggatatgattcaaaaattaaatctacatggcaaaaacttcaaacatggcttcttacaaatgagattgtaaattttcaacaaattgcccctttttcatga

SEQ ID NO: 13210 - protein, 189 aa, Unknown
  Obtained from environmental sample
  DOMAIN (67)...(112): Bacterial regulatory helix-turn-helix proteins, AraC family
  misc_feature (1)..(189): Xaa is any amino acid
MRKETLQKKTKIANNIMFYIYTHIDTNISMDELADDFHVNKFYMHKIFKEIFEKNIYESIKSIRLQKASNLLLTNKYSTISDIAKLCGYSSQTSFIRSFKERFLMTPKSWRKGGYKEYSKQILEQSVKAKNSTANFDDLEPTIIKMPIFEAYYIRHRGYDSKIKSTWQKLQTWLLTNEIVNFQQIAPFS

SEQ ID NO: 13211 - DNA, 633 bp, Unknown
  Obtained from environmental sample
  misc_feature (1)..(633): n is a, c, g, or t
atgttaaatattaatgaaataattgaaaagttaagagatgtactttcaagtgaaaaaaaccatggaaaaatttttgacaaagatattgctaatgctttagaattaacaagtgtaaatttcgcaacaatgaaaaaaagaaatagtgtaccattttctaatatacttgatttttgtgctataaaaaagatatctattaattggcttttatatggacaagacccaagtagtttagttgatagtacagatagatattggataaagtattttccaacagtaagtgttagtgctggtggtggtgcatatgatggtgaagatgattttgagaaattagatttaccagatttttttgtaaatataattggaggggaagaaaacctaaaaaatattgaagctataaatgttacaggagatagtatggaaccaacactaaataatggtaatataatatttatagatagaacaaaaagtgataccgcaaaagatggcatctatgcttttgtaaatgaaaatggtttatttgtaaagcgtattcaaaaacggatagatggttctcttgatattatttcagataataaagaatatcctatgcaaatagctagcaaaaatgatatacagttagctcgagccatctga

SEQ ID NO: 13212 - protein, 210 aa, Unknown
  Obtained from environmental sample
  DOMAIN (133)...(202): Peptidase S24-like
  misc_feature (1)..(210): Xaa is any amino acid
MLNINEIIEKLRDVLSSEKNHGKIFDKDIANALELTSVNFATMKKRNSVPFSNILDFCAIKKISINWLLYGQDPSSLVDSTDRYWIKYFPTVSVSAGGGAYDGEDDFEKLDLPDFFVNIIGGEENLKNIEAINVTGDSMEPTLNNGNIIFIDRTKSDTAKDGIYAFVNENGLFVKRIQKRIDGSLDIISDNKEYPMQIASKNDIQLARAI

SEQ ID NO: 13213 - DNA, 861 bp, Unknown
  Obtained from environmental sample
  misc_feature (1)..(861): n is a, c, g, or t
atgaacttctccctgttggatactaccacncttgtatttacaatacctcaccagttaaacaatctgtgttttaagaataaaaaaaccatgtatgatattttgtttaaagcagcatcccaaaccgttttagaattatgtacggacactaatcatcttggagcagatactggtttaattacggttcttcatacttgggggcaaaacatgttggaacacccgcatttgcattgcataatgccagctggtggattatcttttgataaaactcaatggattcacactacaaagaagaacgatttttttatttattacaaagttctttccaaaaaatttaaaggtaagtttctggatttattgcaaagcgcatataataatgatgaactttcatttaaggggcaaaccaaaaatatcagtggtgaaaataatttcaaagcattagttatttcattatacaaaaagaactgggttgttaatatccaaaaaccatttgcacatcccgaaaaagttttggaatacctttcacgatatgtttttcgtattgccattagtgataagcgaattgaaaaggtagaaaaaggtatggtatactttagtataaaggacaataaacacaatggtgtttttcggaaaattaagctaactataaacgagttcatccggcgatttctgcttcatctgctacccaaaaactttttcaaagttcgttattatggcatatttgcctctattcaccgcaaggtcaatattacaaaagccaaagcgtttctttattcaagagcagccaaacccaaacacaagaagatatcgaagatggggatccgtgtatgggaaaaggcgggatactatttgggaccgaaataa

SEQ ID NO: 13214 - protein, 286 aa, Unknown
  Obtained from environmental sample
  DOMAIN (57)...(249): Putative transposase
  misc_feature (1)..(286): Xaa is any amino acid
MNFSLLDTTTLVFTIPHQLNNLCFKNKKTMYDILFKAASQTVLELCTDTNHLGADTGLITVLHTWGQNMLEHPHLHCIMPAGGLSFDKTQWIHTTKKNDFFIYYKVLSKKFKGKFLDLLQSAYNNDELSFKGQTKNISGENNFKALVISLYKKNWVVNIQKPFAHPEKVLEYLSRYVFRIAISDKRIEKVEKGMVYFSIKDNKHNGVFRKIKLTINEFIRRFLLHLLPKNFFKVRYYGIFASIHRKVNITKAKAFLYSRAAKPKHKKISKMGIRVWEKAGYYLGPK

SEQ ID NO: 13215 - DNA, 588 bp, Unknown
  Obtained from environmental sample
  misc_feature (1)..(588): n is a, c, g, or t
ttgttttataatcaaataatgaaaaatatacccataatttacatactatttgtgttgatacttacaggatgttcacgcaatattcctacacctaacgaaagacttaatactgttctatctttacaagggaaagactcttttcaaaaaacaattaaaacaaaaaactttgaacttttttctatacaagaaactacaaaagagtgtaaaaatataaaagtatacatagagggagatggactcgcttggaaaacaagaacacaaatctcaaaagacccaactcctataaatccttcaggattaaaactaatgaatgaggatacaagtgattgtaaaatatatatagcaagaccttgtcaatacaccccatatgcaaaaaactgtaaaaataaatactggacaagccataggtttaataagcgtgtaatagatagttatgatgaagcacttaactctataaaaaaagagtatcaaaataatacattttcactcaaaggatatagtggaggaggttctgtagcacttcttgtagctacaaaaagagaggatataaaaaacctccccacaaatagctggaaatatcaaccatag

SEQ ID NO: 13216 - protein, 195 aa, Unknown
  Obtained from environmental sample
  misc_feature (1)..(195): Xaa is any amino acid
MFYNQIMKNIPIIYILFVLILTGCSRNIPTPNERLNTVLSLQGKDSFQKTIKTKNFELFSIQETTKECKNIKVYIEGDGLAWKTRTQISKDPTPINPSGLKLMNEDTSDCKIYIARPCQYTPYAKNCKNKYWTSHRFNKRVIDSYDEALNSIKKEYQNNTFSLKGYSGGGSVALLVATKREDIKNLPTNSWKYQP

SEQ ID NO: 13217 - DNA, 462 bp, Unknown
  Obtained from environmental sample
  misc_feature (1)..(462): n is a, c, g, or t
atgaaacaaattagtggctgtggtttaggtttacgaagagagctttttgatgaaattgatttcaaaaaaaactcttttgtacctgactggtgggaaataacacctgagaactggatagatatacctgtatggtatcaagataagtttgaacaaatagcaaactctatgccacttgttgctcatggagtttcactttctttgggtgcaaatacaagaccaaataaaaagtacctcaaaaaactcaagagtttactagataaatataatataaaatactattctgaacatattagctattcctcttttgacaacttacaattacatgaacttttaccagttccgttaacatataagatgatagataatttaagtgataacattaaaatatacagaagacttcttaggaagaaatatctctgtagaaaatgctacatattaccacgccggcggctcaaaacttag

SEQ ID NO: 13218 - protein, 153 aa, Unknown
  Obtained from environmental sample
  DOMAIN (3)...(153): Protein of unknown function (DUF692)
  misc_feature (1)..(153): Xaa is any amino acid
MKQISGCGLGLRRELFDEIDFKKNSFVPDWWEITPENWIDIPVWYQDKFEQIANSMPLVAHGVSLSLGANTRPNKKYLKKLKSLLDKYNIKYYSEHISYSSFDNLQLHELLPVPLTYKMIDNLSDNIKIYRRLLRKKYLCRKCYILPRRRLKT

SEQ ID NO: 13219 - DNA, 609 bp, Unknown
  Obtained from environmental sample
  misc_feature (1)..(609): n is a, c, g, or t
atgataaaagaaaaagtaatgaaagagcataatttacaaaaagattttatagaacaaatcacagggaaaatagatgtcaaaaaagactctataggtgtgtataaatatcttgtttataataacttttttgatgtgataagtacctcttttccaattttttataaaatactccaacaaaagaatctcgaaaaagagtttgaagaatctctgtatgaatttatccaaacaagtgccttctctccttttatttggaagttgtcaaacgaatatagaaaatttataaaatcatctcagttttttcatactttagaatatagagatgaacttttactatttgaatatagtgagttatatatttttatgcaaaaaaagtctaagaaacagctagaaaagttttctctaaaaaatcattataaactttcacataaagtgatactccaaaaatataactataattttttgactatgaatttagaagagaaacaaaaaacatatattttagggtattttgattataaattagaaaaggtagtgtatagagagataaatgtttatgtgtataagttactaaaatctatgacaaaaacaaaaacactcaaagaaaagtaa

SEQ ID NO: 13220 - protein, 202 aa, Unknown
  Obtained from environmental sample
  misc_feature (1)..(202): Xaa is any amino acid
MIKEKVMKEHNLQKDFIEQITGKIDVKKDSIGVYKYLVYNNFFDVISTSFPIFYKILQQKNLEKEFEESLYEFIQTSAFSPFIWKLSNEYRKFIKSSQFFHTLEYRDELLLFEYSELYIFMQKKSKKQLEKFSLKNHYKLSHKVILQKYNYNFLTMNLEEKQKTYILGYFDYKLEKVVYREINVYVYKLLKSMTKTKTLKEK

SEQ ID NO: 13221 - DNA, 306 bp, Unknown
  Obtained from environmental sample
  misc_feature (1)..(306): n is a, c, g, or t
gtggaaaattattcctacattatggttattggttataatattaatgattgcggcagcttattattttccaatacctactcaaggattatcatgaaactaaataaaacctcacagtatgcgaaaagagttatggttcttatctcaaataatcctggaaaaagatcttttaagtgccaaaatatatcgcgcaagagttatcaattcccaaccaaatatctaaccctctattatgactcacccttggcaaatgcctggcttggattaacctccaacaagagggaaaattttggaggaatccttctttaa

SEQ ID NO: 13222 - protein, 101 aa, Unknown
  Obtained from environmental sample
  misc_feature (1)..(101): Xaa is any amino acid
MENYSYIMVIGYNINDCGSLLFSNTYSRIIMKLNKTSQYAKRVMVLISNNPGKRSFKCQNISRKSYQFPTKYLTLYYDSPLANAWLGLTSNKRENFGGILL

SEQ ID NO: 13223 - DNA, 825 bp, Unknown
  Obtained from environmental sample
  misc_feature (1)..(825): n is a, c, g, or t
atgtataaagcacgtacaaatcaaagtggcatttcatctacagttattaaaggaaattttgaggtaaagggttatcctcacatgagaaaagcagaaatttctgtttacaatatctcaacggatgagttagttggtgtttataaaaccaatcctaaaactggtaattatttggtaattcttattcctaatgtaaaatacgagtttgtaattaacacttatggctatgctccaataaaaaaaactgttgaaattcctgcctatgccagcactaatattattgatgatgtttccagacaaaaaattaccctagaaatagatgaagaacctataaaacatagtttaaatacttggatagtagaagaaaaagaacccacgctatttttacttactgtttatgatgaaaatcttgataaaaaagaacgtatagaactttatgagtcagcagtttttgatgcagaagaactaggcagaagagaaattaaggaacttcagtttgaaaatattgatgaagcacttaaaaaacaagctgagctagaaaataaaaaaccggaattggctgaaaaagcttttcaaaagaaagattacaaaacagccgaacaactttatagtgagttattggcttatgatttaaatgatgctttaatcaattataaaatgggcgttagtacttttcatatggaacataataaacttaaagcacttccttttcttcagcgagcattaaatggtaataacaattcttatgatgttcatcattatttaggggtaatttatcaatcttgggcagattttgcccgaacagaaattgaatttaataagttttaa

SEQ ID NO: 13224 - protein, 274 aa, Unknown
  Obtained from environmental sample
  misc_feature (1)..(274): Xaa is any amino acid
MYKARTNQSGISSTVIKGNFEVKGYPHMRKAEISVYNISTDELVGVYKTNPKTGNYLVILIPNVKYEFVINTYGYAPIKKTVEIPAYASTNIIDDVSRQKITLEIDEEPIKHSLNTWIVEEKEPTLFLLTVYDENLDKKERIELYESAVFDAEELGRREIKELQFENIDEALKKQAELENKKPELAEKAFQKKDYKTAEQLYSELLAYDLNDALINYKMGVSTFHMEHNKLKALPFLQRALNGNNNSYDVHHYLGVIYQSWADFARTEIEFNKF

SEQ ID NO: 13225 - DNA, 654 bp, Unknown
  Obtained from environmental sample
  misc_feature (1)..(654): n is a, c, g, or t
gtgccaaagctgatgctgagtgacaacctcatttacgtttttctgattgcagcactgggcttagctgccttgtcggtgaactatgtcatcacctccagagaaaaatacaaagaaacccgcaatgcccgtctgaagtggctaaaagaacaatcagaacatacacttaattcgctggcggtactgaaagagatcaactgcaggggagacattactgacaagctcaaccagcatgcgctgtcactgattgaagagatcggtgtgcttgcgcccgactctgaactcatgacagatgtcagtaaaatcaaagacactaccgatagaacgcgccccaagcaagaaccattcaataacgacagagcggtcagaaaagcgcagatttatataaatttcgctgaaaaactgattatcgatatggccaataaaggcaaaatgacgccacaactggcccatacctatcagcaagagctttactggctgaatatttccatggttgccgatgcacatatcactcaaggacgcacactgatgcagcagggtgacaaactgggcngccctgtcacactacaaacatgcccaaacatttctggtaagagcgggccgtaccgcaacctcagaaacaggatagactggaaaccggtacaagaatttatttga

SEQ ID NO: 13226 - protein, 217 aa, Unknown
  Obtained from environmental sample
  misc_feature (1)..(217): Xaa is any amino acid
MPKLMLSDNLIYVFLIAALGLAALSVNYVITSREKYKETRNARLKWLKEQSEHTLNSLAVLKEINCRGDITDKLNQHALSLIEEIGVLAPDSELMTDVSKIKDTTDRTRPKQEPFNNDRAVRKAQIYINFAEKLIIDMANKGKMTPQLAHTYQQELYWLNISMVADAHITQGRTLMQQGDKLGXPVTLQTCPNISGKSGPYRNLRNRIDWKPVQEFI

SEQ ID NO: 13227 - DNA, 723 bp, Unknown
  Obtained from environmental sample
  misc_feature (1)..(723): n is a, c, g, or t
ttggaaaatattatcaataggttttttaatagggataaagatatttttaaatatccccaaaaagatgtgaacaaggaacaaaatctcaaaaacacttttataacaattaacacaaaagaggagtactataaaaaacaaactgtagacttctctacctctttaaagatagaaacaccaaataaaaactatagtatgaatctagaagttgctttttcaaaagaactttatgaggcacatagtatggaattgcaatttggaaatccaaacctaaaagatcctttggttattaactatggtgaagatagtaatccttttgaaaatctctcaactctacggtttgaatttgatttgaataatgatggagaaaatgagcttatcccacttttgaaaaaaggttcgggttttttaagtcttgataaaaacaacaatggaaaaatagacaatggtcatgaactttttggacctaaaacagatgagggatttcaagagttagcacaatatgattatgacaacaataactggatagatgaaaatgatgcaatatttaacaaactaaaagtttggcaaatcaatgaagatggagacaacaatcttgtatctcttttagatttgaatattggtgctatatacctaggcagtgtagaaagtggctttgagtatcaaaagaaaatagataaagtagatgcggtacaactaagcaatggaatttatgtaaaaaagtga

SEQ ID NO: 13228 - protein, 240 aa, Unknown
  Obtained from environmental sample
  misc_feature (1)..(240): Xaa is any amino acid
MENIINRFFNRDKDIFKYPQKDVNKEQNLKNTFITINTKEEYYKKQTVDFSTSLKIETPNKNYSMNLEVAFSKELYEAHSMELQFGNPNLKDPLVINYGEDSNPFENLSTLRFEFDLNNDGENELIPLLKKGSGFLSLDKNNNGKIDNGHELFGPKTDEGFQELAQYDYDNNNWIDENDAIFNKLKVWQINEDGDNNLVSLLDLNIGAIYLGSVESGFEYQKKIDKVDAVQLSNGIYVKK

SEQ ID NO: 13229 - DNA, 351 bp, Unknown
  Obtained from environmental sample
  misc_feature (1)..(351): n is a, c, g, or t
ttgtgtggcgtggtgactaggttatatataaatcgaaaggaggtttggaataagcccgaactaggtttattaggtgggcgtttattagaatacattgatgaagataactttaaattagaaaactttaaaaaagagcattggtttgttgatttttctgagcttaatttttatggacatcctaaacctcgtccaggaatgatgattaaaatattaggggaagttcttggtgataataaatttaaggcaattgaaataaggccatgggaaaaggtttggtttgaatcaaaggaagaagaaattgaatataaggttgaaatgaaagaaagtcttcaaccgttgcgtataagataa

SEQ ID NO: 13230 - protein, 116 aa, Unknown
  Obtained from environmental sample
  misc_feature (1)..(116): Xaa is any amino acid
MCGVVTRLYINRKEVWNKPELGLLGGRLLEYIDEDNFKLENFKKEHWFVDFSELNFYGHPKPRPGMMIKILGEVLGDNKFKAIEIRPWEKVWFESKEEEIEYKVEMKESLQPLRIR

SEQ ID NO: 13231 - DNA, 543 bp, Unknown
  Obtained from environmental sample
  misc_feature (1)..(543): n is a, c, g, or t
atgcaattcatatttaatatgaaaaagatgcctgaaaagatgagaaaagattttagagataagaaatctattttatatcagtcatttaaaatccctgagaagtttagtccaaatagaagagcaactcaaaaaatagaaatgccttctggtaatggaataggcgatgcacgatcaattgctaagttatatagtgtttttgcacaagaagcaaaggagcttggagtaaatgaggaaacagttaatttattatctcagcctgccactatcccaaccaaaggagcttttgatattgtaatgggtttagatacatatttttcttatggatttattaagccaggacctgatttattatatggcaataatcaatctgtatttggtacaccaggagctggtgggtcgtttggctttgccgatcctgaaaatgaaattgggtacgcatatgtaatgtcaaaaatgggtttgtatcttgttaatgatccacgtgaggttgctttacgtaaagcaatgtacaggtgtatagagagaatagaaaaagagaaatag

SEQ ID NO: 13232 - protein, 180 aa, Unknown
  Obtained from environmental sample
  misc_feature (1)..(180): Xaa is any amino acid
MQFIFNMKKMPEKMRKDFRDKKSILYQSFKIPEKFSPNRRATQKIEMPSGNGIGDARSIAKLYSVFAQEAKELGVNEETVNLLSQPATIPTKGAFDIVMGLDTYFSYGFIKPGPDLLYGNNQSVFGTPGAGGSFGFADPENEIGYAYVMSKMGLYLVNDPREVALRKAMYRCIERIEKEK

SEQ ID NO: 13233 - DNA, 642 bp, Unknown
  Obtained from environmental sample
  misc_feature (1)..(642): n is a, c, g, or t
ttgaaattgggtgcttttttttgggaagaagaagttaaagctattggacgggaaggtttgtgtaaattaatcgaaacagataaggttacatatcgtgctaaatctgttattattgcatccggagcgcatccaagaaaattagctgttcccggtgaagaaaaatatattggcagaggagtttcttactgtgcaacttgtgatggcgctttctataaagagaaagtggttgcagtcgttggaggtggtgattctgctgttgaagaagcattattcttaacaaaatttgcaaaaaaagtttatataatccatcgtagagatgaattgagagctgtgaaaatagttcaggaaagagtttttaaaaatgataaaattgaagtaatatgggattctgttattcaaggtatagatggtggtgattttgttgaaaaagctatcctctataatagaaaaacaaaagaagtaaaagaacttgaagtggacggaatatttgtctatgtgggtatcatcccaaataatgaattaattgaatcaacggttaatcttgataaatctggattcattttaacagatgataaaatggagacaaatctcccgggaattttgcagccggagaatctccatcgtccctatttnggggagtaa

SEQ ID NO: 13234 - protein, 213 aa, Unknown
  Obtained from environmental sample
  DOMAIN (1)...(209): Pyridine nucleotide-disulphide oxidoreductase
  misc_feature (1)..(213): Xaa is any amino acid
MKLGAFFWEEEVKAIGREGLCKLIETDKVTYRAKSVIIASGAHPRKLAVPGEEKYIGRGVSYCATCDGAFYKEKVVAVVGGGDSAVEEALFLTKFAKKVYIIHRRDELRAVKIVQERVFKNDKIEVIWDSVIQGIDGGDFVEKAILYNRKTKEVKELEVDGIFVYVGIIPNNELIESTVNLDKSGFILTDDKMETNLPGILQPENLHRPYXGE

SEQ ID NO: 13235 - DNA, 714 bp, Unknown
  Obtained from environmental sample
  misc_feature (1)..(714): n is a, c, g, or t
atgcatgctacactgaaaaaagagtttaaaacatatcatttgattttagaagttttacaagaagagatagaggaagatgaggtatatggaagagagattctatcagatgaagtaaagccaatagagataaagcttttttctattatagatgatcttgtttcaaaaacaactaataaatttaatcaaaaatttactgagatatctcagagtattgaaactactgatgatattgtatcaaatacagttactcaaaacattatcattagtctcatagctatagtaacctttagtttaatattctccattgttgctaaaaatatatcttcgttgatatcaaattttaaaaagaatttatttgagttttttgattatcttaataaaaaaaccacaagtactcatatgttggaagagccaaataatgagataggagatatggcaaaagttgtaaatcaaaatataacaacaataaaaaaagatttagaagaagatagaaaagtaatagataatgcaattcatgttctagaaaattttgaacaaggtgatttatctcaaagagtaggggtgagtagtaataatcctgcattgaaagagttaactactttactaaataaaatgggtgaaaatattgagaaaaatattgattcaattttatatatattggaaaaattttcaaattatgattatagagctcagccaatctggcctggnnnntga

SEQ ID NO: 13236 - protein, 237 aa, Unknown
  Obtained from environmental sample
  misc_feature (1)..(237): Xaa is any amino acid
MHATLKKEFKTYHLILEVLQEEIEEDEVYGREILSDEVKPIEIKLFSIIDDLVSKTTNKFNQKFTEISQSIETTDDIVSNTVTQNIIISLIAIVTFSLIFSIVAKNISSLISNFKKNLFEFFDYLNKKTTSTHMLEEPNNEIGDMAKVVNQNITTIKKDLEEDRKVIDNAIHVLENFEQGDLSQRVGVSSNNPALKELTTLLNKMGENIEKNIDSILYILEKFSNYDYRAQPIWPGX

SEQ ID NO: 13237 - DNA, 642 bp, Unknown
  Obtained from environmental sample
  misc_feature (1)..(642): n is a, c, g, or t
atgattctcaccacctatgccatcatccgaaacgacatcgaggtgcttaaagaaaaagcctttcacctcattgtcctggatgaatcccagaacatcaagaacattctctccaagacatccaaggcatcggtgctgctcaacgccgaccatcgtctggctttaagcgggacccccattgaaaataacatcagtgaactctatgccctgttccgattcctgaacccctccatgtttggctcttttgctgattttaataaaaattatctaatccccatccagaagcataatagtaaacctgtcaccgaggagcttcgacggaaaatatatccctttattctacgccgactgaaaatggatgtgttaactgatctgcccgagcgcatggagcaaacgctctatgtggagatgaccgaaccgcaaaaggcgctctacaatcagcgccgggagatgtaccgtaccgccctccgggagcagatccaaaccaagggactcaaacaatcccagttctttatcttccaggcattgaacgagctgcgccagattgcctccattccccaggtcaaaagcgataattctatcatctcccccaaacaaaaaattctcctggagcatgtgatggatgccgtttgccgaaaatcataa

SEQ ID NO: 13238 - protein, 213 aa, Unknown
  Obtained from environmental sample
  DOMAIN (1)...(188): SNF2 family N-terminal domain
  misc_feature (1)..(213): Xaa is any amino acid
MILTTYAIIRNDIEVLKEKAFHLIVLDESQNIKNILSKTSKASVLLNADHRLALSGTPIENNISELYALFRFLNPSMFGSFADFNKNYLIPIQKHNSKPVTEELRRKIYPFILRRLKMDVLTDLPERMEQTLYVEMTEPQKALYNQRREMYRTALREQIQTKGLKQSQFFIFQALNELRQIASIPQVKSDNSIISPKQKILLEHVMDAVCRKS

SEQ ID NO: 13239 - DNA, 858 bp, Unknown
  Obtained from environmental sample
  misc_feature (1)..(858): n is a, c, g, or t
atggctagcgaggatcatgattttgaggagattattcatatacatcttttcaacgataaaatagcatgggataccgataagaaaggtgctgttggtcgttttgaattagatgatattgatgaatttaaagagcaactgcttgagaaatttggtaacaacgaatcatttagtgaatacttgagccaattctatactgaaaaagacaaagatttatccgcagcaacacgaaggtttgttcttgatctattcggtgataaagggctggtaacattagatggagattcgaaagaactaaaagaactttttagtccagtcataaaagaagaactgcaaaatggtttttctggtgaagccgtttctaagactaccgaattgttgttggaagatggctacaaagaccaagtacaccctagggagatcaacttgttctacctatctgctcaaagccgagaacgaattattaggaatgatgatggttcatttacagctggaaataagtcttggggaaaggatgaaatttttgttgaggtagatgaaaaccctgaacgattttctcctaatgtaattttgcgccctgtttatcaagaaactatactccctaatttatcctacttaggtggaggaggagaaatggcttattggctacagttaaaaggagtttttgattgtttaaaattgacgtatccgttgattgcagttagaaattcaatacagatatttgatggtatatcacagaagaaaatgaaaaagctagacctttctgcaaaggatatgttcaagtcgatacacgaaaataaaaaacaatttgttttggtgaacgaccaagaagaactggacttttcagagatgaatcggtag

SEQ ID NO: 13240 - protein, 285 aa, Unknown
  Obtained from environmental sample
  misc_feature (1)..(285): Xaa is any amino acid
MASEDHDFEEIIHIHLFNDKIAWDTDKKGAVGRFELDDIDEFKEQLLEKFGNNESFSEYLSQFYTEKDKDLSAATRRFVLDLFGDKGLVTLDGDSKELKELFSPVIKEELQNGFSGEAVSKTTELLLEDGYKDQVHPREINLFYLSAQSRERIIRNDDGSFTAGNKSWGKDEIFVEVDENPERFSPNVILRPVYQETILPNLSYLGGGGEMAYWLQLKGVFDCLKLTYPLIAVRNSIQIFDGISQKKMKKLDLSAKDMFKSIHENKKQFVLVNDQEELDFSEMNR

SEQ ID NO: 13241 - DNA, 513 bp, Unknown
  Obtained from environmental sample
  misc_feature (1)..(513): n is a, c, g, or t
atgcaaattgaaaaaataaaacgaacgaataccccatatttttcaaaaacagcgaatgaccttgtttataatcaaggtgatttatctaaatatattgaagcaccatatacactggaagagtttaagaatcagattaaggagaagtcatccagcttttcggcaagtcaaagaaaagtattagttgatcaattggtgaagcaacatgaaaattttatagatttaaatagcgttcagtctaatattcgatctttatcaaaagaaaacacttttacagtaacgacaggacatcagcttaatttatacggaggtccattatacgtggcatacaaaataacacatgttataaagctagctgataaattaaaaaagacgtatcccgaatataattttgtcccagttttttggatggctagcgaggatcatgattttgaagagattaatcatatacatcttttcaacgataaaatagcatgggataccgatagaaaggtgctgttggtcgttttgaattag

SEQ ID NO: 13242 - protein, 170 aa, Unknown
  Obtained from environmental sample
  misc_feature (1)..(170): Xaa is any amino acid
MQIEKIKRTNTPYFSKTANDLVYNQGDLSKYIEAPYTLEEFKNQIKEKSSSFSASQRKVLVDQLVKQHENFIDLNSVQSNIRSLSKENTFTVTTGHQLNLYGGPLYVAYKITHVIKLADKLKKTYPEYNFVPVFWMASEDHDFEEINHIHLFNDKIAWDTDRKVLLVVLN

SEQ ID NO: 13243 - DNA, 633 bp, Unknown
  Obtained from environmental sample
  misc_feature (1)..(633): n is a, c, g, or t
atggattgtaaaactttactaaatgtaaaaacttacaacgttattgccgagatgaaagggaaagatgaccaaattatcacttttggcggacatctagattcttgggatgttggtgaaggagctcatgatgatggagctggaattgttaactctattgaagcgttaaggattttaaaaatattgaattatcaaccaaaacataccttacgttgtgtattatttatgaatgaagaaaatggcaattttggtggtaaaagctatactaaactagccaagcaaaacaaagaaaaacaccttgctgctatagaaagcgatagaggtggttttttacctttagggtatgatattttaggttctgataagcacttcgattttgtaaaatctttcgaaaaattattattcgattatgacttaacgaaaataaagaaaggttatagtggtgttgatatcatgcctttaagagaagagtatcctgatatgttacaaataggtattgccattaattctcaattgtattttaactaccaccatgcggaaaccgatgtgtttgaagcagtcaataaaagagaattggaaatgggtgccggagctatggcaactattgtttatttgttagataagtatttggagtga

SEQ ID NO: 13244 - protein, 210 aa, Unknown
  Obtained from environmental sample
  DOMAIN (24)...(93): Peptidase family M20/M25/M40
  misc_feature (1)..(210): Xaa is any amino acid
MDCKTLLNVKTYNVIAEMKGKDDQIITFGGHLDSWDVGEGAHDDGAGIVNSIEALRILKILNYQPKHTLRCVLFMNEENGNFGGKSYTKLAKQNKEKHLAAIESDRGGFLPLGYDILGSDKHFDFVKSFEKLLFDYDLTKIKKGYSGVDIMPLREEYPDMLQIGIAINSQLYFNYHHAETDVFEAVNKRELEMGAGAMATIVYLLDKYLE

SEQ ID NO: 13245 - DNA, 300 bp, Unknown
  Obtained from environmental sample
  misc_feature (1)..(300): n is a, c, g, or t
ttggaagatatgatgcaatgtccccaggagaaaattttcacaccgatgggaaaaataattacaccaaaacagtgggcaaaagatatggtactagattatagaccaggaattgtactatttgataagaaaaaagagatagtaagaatagatgcacttttatatagcttccattttaaagaattatttagatttgtaagtggtggatattatgaaaagtttcatacatttttagattatttaaaacccagacaagatgagcttttacaacaggggattgatatagatatttctgataaataa

SEQ ID NO: 13246 - protein, 99 aa, Unknown
  Obtained from environmental sample
  misc_feature (1)..(99): Xaa is any amino acid
MEDMMQCPQEKIFTPMGKIITPKQWAKDMVLDYRPGIVLFDKKKEIVRIDALLYSFHFKELFRFVSGGYYEKFHTFLDYLKPRQDELLQQGIDIDISDK

SEQ ID NO: 13247 - DNA, 642 bp, Unknown
  Obtained from environmental sample
  misc_feature (1)..(642): n is a, c, g, or t
atgaaagctgcaatcattcaatcaaattatctcccatggaagggatattttgacataattcacgatgtcgacaaatttgtttttcttgaagatgtccaatatacaaaaaatgactggagaaacaggaatcttatcaaaacaccccaagggacaacctggataacagtgcctgtaaaaggtggaatccatcagatgatctttgaggcagagatcaattactctcagagatgggtggataaacagatcaaaacaatccagagcaattatgctgcatccccctattattattcatattgcgacgaaatcaattccatatttaatctcaaacctgcaacaatttcagaactgaatataagcggaataaaaaagatctgtaagttattggatttaaataccgagtttatcaattcaaaagatctgaatgtggggggccataaagatgacaaagtaattggcatctgccagcagatcggagcagaagaatatgtttctggacccgctgcaaaggattacatcgacaattccaaatttgaaaatgcaaaaatatccctgcaatataaagattattcagggtatccagaatattctcaattatgggggggaatttatccacaccgtatccattatcgacctgatctttaa

SEQ ID NO: 13248 - protein, 213 aa, Unknown
  Obtained from environmental sample
  misc_feature (1)..(213): Xaa is any amino acid
MKAAIIQSNYLPWKGYFDIIHDVDKFVFLEDVQYTKNDWRNRNLIKTPQGTTWITVPVKGGIHQMIFEAEINYSQRWVDKQIKTIQSNYAASPYYYSYCDEINSIFNLKPATISELNISGIKKICKLLDLNTEFINSKDLNVGGHKDDKVIGICQQIGAEEYVSGPAAKDYIDNSKFENAKISLQYKDYSGYPEYSQLWGGIYPHRIHYRPDL

SEQ ID NO: 13249 - DNA, 795 bp, Unknown
  Obtained from environmental sample
  misc_feature (1)..(795): n is a, c, g, or t
ttgggctcgatggctggcattatcaattctattgaattacatgtttttttttataatttggtattatttctcagatgtaaatatttagctatacaggagacagatattaaattaaattatttagacggcaacgacatgatagataaaatgttgcaaataagtgaagttacacaaaaaaaattagcacttattttagaaattagtgaatccacactctctagttatagaaaaactaaagtttcaagaaataccataaaaaagtttcttcaaaagtttcctaatgtaaaagaagaagagttattaaaaaaagagagtaacggatattttaaaaacttacatgaatccattggtatatcagacgagggaacattagaattcgctgaggcactcatgaatgtaagtgcaagatttggaacaaagagatatattgatagcttaaaaggcagagagagtgaattggtaaaaaagctatatgactacacatatgagaattgtgatgtatcaggttatcttgccaagtcatacaagcttagacagttagagccactctctagtaataaaataaaatttatgccaataggtttttgtatagacaagcgagagtctaattgtgtaaactgttttgcttgtcctagttatattacaacaaaagattttttacctgttttaaaagcttgtaaactgactatagatgctttagaagagttgattgtttttagaggtgaaatcccattttgtgatacgtgctattacagtaaagatattagtaaagttcttgctgattttattatctaa

SEQ ID NO: 13250 - protein, 264 aa, Unknown
  Obtained from environmental sample
  misc_feature (1)..(264): Xaa is any amino acid
MGSMAGIINSIELHVFFYNLVLFLRCKYLAIQETDIKLNYLDGNDMIDKMLQISEVTQKKLALILEISESTLSSYRKTKVSRNTIKKFLQKFPNVKEEELLKKESNGYFKNLHESIGISDEGTLEFAEALMNVSARFGTKRYIDSLKGRESELVKKLYDYTYENCDVSGYLAKSYKLRQLEPLSSNKIKFMPIGFCIDKRESNCVNCFACPSYITTKDFLPVLKACKLTIDALEELIVFRGEIPFCDTCYYSKDISKVLADFII

SEQ ID NO: 13251 - DNA, 642 bp, Unknown
  Obtained from environmental sample
  misc_feature (1)..(642): n is a, c, g, or t
atggttgatgagtctataaaaatcaaagaggtttggtatgcattaattgagagtttattagatgaaacatcgcttgatatgccagaacaaatatctaagtaccacctttctttaaccgagttatatacaaagttaaaaagctcaaaaagtaaaaatgaggttatagagtacacaaaatcactagataaagagataagcagatttgagagccaactaaaaagaaatataaaaaaactaatagaagaaaccaggtatataaaagttaatagcgataaattacactataaacaaaagatgaaaaaagcttctgaattatccaatctgtaccgtgagccatttaatattatcatgcaaaatcatagtgactcacttatgtctatcattgtagacataagtgaagaagcgaataggccacgatttttaaatactgacactatcttacaaaagctatatacaaaagtttatacagctttttgtagagtagagcgtgaagttcaaaataataataggttgttgatcaacgaggttggaccacttttagagagaataaaatctgagagtgtactcgtgagcggttttagctcatttcttcgaaataataaaaaatttgaagtaccaaaactgttgcttaaaaccaaataa

SEQ ID NO: 13252 - protein, 213 aa, Unknown
  Obtained from environmental sample
  misc_feature (1)..(213): Xaa is any amino acid
MVDESIKIKEVWYALIESLLDETSLDMPEQISKYHLSLTELYTKLKSSKSKNEVIEYTKSLDKEISRFESQLKRNIKKLIEETRYIKVNSDKLHYKQKMKKASELSNLYREPFNIIMQNHSDSLMSIIVDISEEANRPRFLNTDTILQKLYTKVYTAFCRVEREVQNNNRLLINEVGPLLERIKSESVLVSGFSSFLRNNKKFEVPKLLLKTK

SEQ ID NO: 13253 - DNA, 507 bp, Unknown; identical to SEQ ID NO: 8361
  Obtained from environmental sample
  misc_feature (1)..(507): n is a, c, g, or t

SEQ ID NO: 13254 - protein, 168 aa, Unknown; identical to SEQ ID NO: 8362
  Obtained from environmental sample
  misc_feature (1)..(168): Xaa is any amino acid

SEQ ID NO: 13255 - DNA, 774 bp, Unknown
  Obtained from environmental sample
  misc_feature (1)..(774): n is a, c, g, or t
ttggctgaggaacgtatagtaataaaagtaggaagtggagttttaactgaaaatcatgagatagcaaaggagaggatgttaaaccttgtctctctcatagcaaagctaaatcaaaaatatgaagtcattttagttagttctggagcagtagcctctggatatacagcattgaagttagatcgtaaaaaaaagattagcaaaaaagcacttgcatctttaggtcaacctgttttgatgagtagttacaaaaagaaatttgatatatatgatattacaacatctcaaattttactgacagaagaggattttgactctagaaaaagaacagctatctttcaagagatcatgaacacactgctttcaaattcaatcattcctatcgttaacgagaatgatatttcaacaacatctgagcaagtttttggagacaatgaccaactctcagcccatgtttctcattttacaggtgcagatctgttggtaattcttagtgatatagatggatattatgataaaaatcctaatgagaataaagatgcaaaaatattaaaagaggtaaatgaaatacctcaagaacttttaaatgcagatcacacaccaactaatgcatttgcaacaggaggaattgttacaaagctaatggctgcaaaatttcttctagatcgaaataaaaagatgtttttatgtaatggatatgacctaagcagtgctgaagagtatcttttacatcaaaatcatacactaggtacaatttttcaaaaaaaagttaaataa

SEQ ID NO: 13256 - protein, 257 aa, Unknown
  Obtained from environmental sample
  DOMAIN (4)...(230): Amino acid kinase family
  misc_feature (1)..(257): Xaa is any amino acid
MAEERIVIKVGSGVLTENHEIAKERMLNLVSLIAKLNQKYEVILVSSGAVASGYTALKLDRKKKISKKALASLGQPVLMSSYKKKFDIYDITTSQILLTEEDFDSRKRTAIFQEIMNTLLSNSIIPIVNENDISTTSEQVFGDNDQLSAHVSHFTGADLLVILSDIDGYYDKNPNENKDAKILKEVNEIPQELLNADHTPTNAFATGGIVTKLMAAKFLLDRNKKMFLCNGYDLSSAEEYLLHQNHTLGTIFQKKVK

SEQ ID NO: 13257 - DNA, 495 bp, Unknown
  Obtained from environmental sample
  misc_feature (1)..(495): n is a, c, g, or t
ttgccaaaaaagattatgatgaacttgtttttttggataaaaaaacagaggaaaaaagagcttgtcgaggagattgagctatcttctttaattataagcagagtggatgtctttaaatcactctatccacaactaaagtttattttgaatttaaaagagtattgtgtcgaaatagacaaaattggtctctccaaagtgatagataatattttagataatgctattaaatattcatcactaaactctaaaatcagagtctctctngtaggtggagttttagaaatttcagatgagggagttggcatggatgagatggagttgattcatatttttgatagatactatcaagccgatgataattcaagcggttttggaatagggatgaatatgataaaaagtttttgtgatcaaaatagaataggacttttggtaaagtctgaaaaaaacatggggacagatataaatttaaattttttaggggttaaacatggataa

SEQ ID NO: 13258 - protein, 164 aa, Unknown
  Obtained from environmental sample
  DOMAIN (58)...(161): Histidine kinase-, DNA gyrase B-, and HSP90-like ATPase
  misc_feature (1)..(164): Xaa is any amino acid
MPKKIMMNLFFWIKKQRKKELVEEIELSSLIISRVDVFKSLYPQLKFILNLKEYCVEIDKIGLSKVIDNILDNAIKYSSLNSKIRVSLVGGVLEISDEGVGMDEMELIHIFDRYYQADDNSSGFGIGMNMIKSFCDQNRIGLLVKSEKNMGTDINLNFLGVKHG

SEQ ID NO: 13259 - DNA, 636 bp, Unknown
  Obtained from environmental sample
  misc_feature (1)..(636): n is a, c, g, or t
ttgataaatgctatgcaagctttagaaaagttcataaaggaatttgaaaaaatccctataatttcaactcattataattggtttattcctccatcaatgaaaatatctattttaaaaaatatttttaaaaattatgaaaatgaaatagaaattaatgaaatttgtatgaaatactataaagagaatataaatgttttaatagatgaaatatttaaaaaatatcctcaacgaaaaaatataatatatgagggatatcaagctcatttaaataaaattttttattcttcaattattatatttttaactcaaatagatggtatttcaaatgagttaatgagtaaaaatttttttcaaaagagggaatggcaaaagctaaatctaaatgatgatatcaaatctaaagttgcatatttttttttaaaatcttattttgatgactacaataatgaagcaccaataaaacactctctaggtaaaagaaaaaactggaagactagttatataaatagacatcaagtattacacggagaaatacttgattttaatacagaagaaaatagtttaaaagtattttctttattagtttcactagctgaaaacttagagtggataaaaaataactgtatagatttataa

SEQ ID NO: 13260 - protein, 211 aa, Unknown
  Obtained from environmental sample
  misc_feature (1)..(211): Xaa is any amino acid
MINAMQALEKFIKEFEKIPIISTHYNWFIPPSMKISILKNIFKNYENEIEINEICMKYYKENINVLIDEIFKKYPQRKNIIYEGYQAHLNKIFYSSIIIFLTQIDGISNELMSKNFFQKREWQKLNLNDDIKSKVAYFFLKSYFDDYNNEAPIKHSLGKRKNWKTSYINRHQVLHGEILDFNTEENSLKVFSLLVSLAENLEWIKNNCIDL

SEQ ID NO: 13261 - DNA, 366 bp, Unknown
  Obtained from environmental sample
  misc_feature (1)..(366): n is a, c, g, or t
gtggctcggagtaatgatacttatggacatgattatggagatattgttttaaaagaagttgcgaaagtagttcaaaaacatatacgaaaaacagatacttttgctcgatggggaggagaagaatttgtgatactttcacctatgaataatctcaaagactcttttacttttgcagataaaataagagaactaattgcaaatatagattttaaaaaacttgatagaatcacttgttcttttgggttaacagagtttagacaaggagatactgaacaatcactgatgaaaagagcagatgaattattatataaggcaaaacaaaatggaaaaaatagagttgaatatcaactgataaaactagtataa

SEQ ID NO: 13262 - protein, 121 aa, Unknown
  Obtained from environmental sample
  DOMAIN (1)...(112): GGDEF domain
  misc_feature (1)..(121): Xaa is any amino acid
MARSNDTYGHDYGDIVLKEVAKVVQKHIRKTDTFARWGGEEFVILSPMNNLKDSFTFADKIRELIANIDFKKLDRITCSFGLTEFRQGDTEQSLMKRADELLYKAKQNGKNRVEYQLIKLV

SEQ ID NO: 13263 - DNA, 606 bp, Unknown
  Obtained from environmental sample
  misc_feature (1)..(606): n is a, c, g, or t
atgaaattacgagatattatatttttattcttgatggggttgttttttaaacttgatgcacaacaacatgaagttgggtgggttataggaagtgggaaagctaatttaaaagatgaaataggaatcaatacttctcaaaacacttcaaacactagttttattagtagtgagcttagttatggatacactcctaaaaatgcgtttttcaagtttaatacaggcgtaaattatagccatagagaattaacaaaaaacaatatagttatagattatatcaaactaccaatgcaaataaattttataattggcaaccaagttcaacctatcattggtgggggtgtatattttgcatcaattctaaataaaaaaaatgaaaatagtaatgtgttagatttttctctctttcagcttggcgcttccttaaaattaggtattggttttcttctttctcagaatattaaaattgctttaagttataatataaataaagatattatacctatttattacgaaaaaaacgttgggaaatttcaaaatgaaaaatcaattgttagaggagtagacaattttttttctatttcaatatattatgtgattattaaataa

SEQ ID NO: 13264 - protein, 201 aa, Unknown
  Obtained from environmental sample
  misc_feature (1)..(201): Xaa is any amino acid
MKLRDIIFLFLMGLFFKLDAQQHEVGWVIGSGKANLKDEIGINTSQNTSNTSFISSELSYGYTPKNAFFKFNTGVNYSHRELTKNNIVIDYIKLPMQINFIIGNQVQPIIGGGVYFASILNKKNENSNVLDFSLFQLGASLKLGIGFLLSQNIKIALSYNINKDIIPIYYEKNVGKFQNEKSIVRGVDNFFSISIYYVIIK

SEQ ID NO: 13265 - DNA, 648 bp, Unknown
  Obtained from environmental sample
  misc_feature (1)..(648): n is a, c, g, or t
atggttagtccaacacctatgcatgccgactttttagaaatgcctgaccaaagtacatatgcacaaacatgggctaaacaattagtgttacatgaatatcgtcatgcggttcaaatgcagaaagtcaatcaagggtttacaaagggattaacttatgcatttggacaacaagccattggtggcattatgggagtttttctaccattctggtttattgaaggagatgctgtatttagcgaaactatatacagcaacagtggaagaggaagatcaccagattttacgatggatctgaaagcacaagtacttgacaaaaatatatataaatatgacaaagctctctatggatctttcaaaaactatgtccccgatcattatactttagggtatgaattagtggtaagtggcaatataaactatggagaggatttgtggaataatacattaaacaaggttgccagaaggccttatatttttgtccctttcacaaaatccattaaagatattacaggaaaagggaaagttggatactacaataacgtgatgaactcgcgtaaaagtaattggttaaaaactgactcaataatacctgaacttcaaattattaccccctcaaaaaataaacattatagtaactatcccttttaa

SEQ ID NO: 13266 - protein, 215 aa, Unknown
  Obtained from environmental sample
  misc_feature (1)..(215): Xaa is any amino acid
MVSPTPMHADFLEMPDQSTYAQTWAKQLVLHEYRHAVQMQKVNQGFTKGLTYAFGQQAIGGIMGVFLPFWFIEGDAVFSETIYSNSGRGRSPDFTMDLKAQVLDKNIYKYDKALYGSFKNYVPDHYTLGYELVVSGNINYGEDLWNNTLNKVARRPYIFVPFTKSIKDITGKGKVGYYNNVMNSRKSNWLKTDSIIPELQIITPSKNKHYSNYPF

SEQ ID NO: 13267 - DNA, 750 bp, Unknown
  Obtained from environmental sample
  misc_feature (1)..(750): n is a, c, g, or t
atgtcttcatttattgtaaaaaactcaattagtaaaatagattttttagaatttgaaaaagaatataataaaattttcaacaaaatttttgataaatacaactatctttatgaaacgaattgttcaatatgcaacaagccatccacaatagaaactaccatttgggaaaatgatgaaattcaaagagttaaaggtatttgcaaagaacatgctacttttattaaaaatgtgcaaaaagttgatttagataattattcaaattgtactagcttaaaaaataaactgttaaatgataaaaagatctcatttcctactgacaatattatgaaatatgttaaaaggagtggtcgagaaaaaataaatgaactatttaatgatagagcattaattatattatcaggattaattgaagaaataaaaaaaattgataacaacaatataaaagaactattaaagttttgttttacatcaatgcttgctaatacttcaaaaatgttacctggtgacttaaaaaaagtaacttacaagtctggctgggtaatcagtaaattttggacaccaaaaatccatactgaaagatatgtttttaaatgttttgaacttagatataaagcaatttataaaggtaaaaaacaattagaaaatattaacttagatatagcaaaaattatattaggaaactctactaaaataaaagatatagaagacgaatccataaatttatatttttacagatcccccctatggtga

SEQ ID NO: 13268 - protein, 249 aa, Unknown
  Obtained from environmental sample
  misc_feature (1)..(249): Xaa is any amino acid
MSSFIVKNSISKIDFLEFEKEYNKIFNKIFDKYNYLYETNCSICNKPSTIETTIWENDEIQRVKGICKEHATFIKNVQKVDLDNYSNCTSLKNKLLNDKKISFPTDNIMKYVKRSGREKINELFNDRALIILSGLIEEIKKIDNNNIKELLKFCFTSMLANTSKMLPGDLKKVTYKSGWVISKFWTPKIHTERYVFKCFELRYKAIYKGKKQLENINLDIAKIILGNSTKIKDIEDESINLYFYRSPLW

SEQ ID NO: 13269 - DNA, 303 bp, Unknown
  Obtained from environmental sample
  misc_feature (1)..(303): n is a, c, g, or t
atggcccgaaagttttatttttttgggcaaattttacttattttttccgggaaaatttctgtttggaaaggccaaatttttcgtaacctgggaatcattcatcacaaatttaccaacaaaacatcacccgattgtggttttttctatttccggcccgccgagtttgccagcgtcatgggaaaagcaacaattacatttcagggaacatacaaatggccttgcatttcgaacgtgccgaactggctgcccgccgtgcaaatacggttagtaggatcgaagctgccggacttgatggattgctga

SEQ ID NO: 13270 - protein, 100 aa, Unknown
  Obtained from environmental sample
  misc_feature (1)..(100): Xaa is any amino acid
MARKFYFFGQILLIFSGKISVWKGQIFRNLGIIHHKFTNKTSPDCGFFYFRPAEFASVMGKATITFQGTYKWPCISNVPNWLPAVQIRLVGSKLPDLMDC

SEQ ID NO: 13271 - DNA, 300 bp, Unknown
  Obtained from environmental sample
  misc_feature (1)..(300): n is a, c, g, or t
atggagagaaatgaattggatgatatagttacttttttgaatgagcataaagacgagcttcatagtaagtttggtgtggaaaaaattggcgtttttggaagctatgcaaaagatagagaaaatgaaaaaagtgatatagatttttttgtaaaattttctaaaaaatcatttaaaaaccttactcaactctacagttattttgaaaatgtatttcatacaaaaatagacataatcacagaacataaaaacatgagaccttcccttcgccgtgaaattgaaaatagtgtgatatatggataa

SEQ ID NO: 13272 - protein, 99 aa, Unknown
  Obtained from environmental sample
  DOMAIN (9)...(99): Nucleotidyltransferase domain
  misc_feature (1)..(99): Xaa is any amino acid
MERNELDDIVTFLNEHKDELHSKFGVEKIGVFGSYAKDRENEKSDIDFFVKFSKKSFKNLTQLYSYFENVFHTKIDIITEHKNMRPSLRREIENSVIYG

SEQ ID NO: 13273 - DNA, 660 bp, Unknown
  Obtained from environmental sample
  misc_feature (1)..(660): n is a, c, g, or t
atggggaaaaaaatcattttattttttgacaatttgggtatttttctgaataaactaaaaaacaaagaacaccaccggttaagggaagtattaattacctgttcagacatacggataataggagcctcgacatttgtagatgaagcaacctatgactatggaaaaccttttttcgatttttttaagccggtttatttaaaaggtcttaataaagaggatacaattaagttgcttttaaaattaaacgaaaaagctacttcgggcgatgtaaaagaaattatcgaatcaaatccggggaggattgaagccctccgaaggttaaccagtggaattcccagaacgattgttttgttgtatcagatttttgttgacagtagcgccaatggaaattcatttaaagacctggatgcactattggataaggtaactccgctgtataaatcccgaatggatgatttacccccccaacagcaggaaattgcagatattattgccaagaactgggatgcaattactgtgaaagaaattgtaaaaaaatcgaaaatgcccagtaatgcggtttctgcacagttaaaacaattggaaaagaaccggataattaccaaaaaaactacttctacaaaaaataccatgtatccagatttcggagcgcttttttaa

SEQ ID NO: 13274 - protein, 219 aa, Unknown
  Obtained from environmental sample
  misc_feature (1)..(219): Xaa is any amino acid
MGKKIILFFDNLGIFLNKLKNKEHHRLREVLITCSDIRIIGASTFVDEATYDYGKPFFDFFKPVYLKGLNKEDTIKLLLKLNEKATSGDVKEIIESNPGRIEALRRLTSGIPRTIVLLYQIFVDSSANGNSFKDLDALLDKVTPLYKSRMDDLPPQQQEIADIIAKNWDAITVKEIVKKSKMPSNAVSAQLKQLEKNRIITKKTTSTKNTMYPDFGALF

SEQ ID NO: 13275 - DNA, 816 bp, Unknown
  Obtained from environmental sample
  misc_feature (1)..(816): n is a, c, g, or t
gtgttgtttaaattgaatattatggcaacaaaaacaattatcggtcaggcagtaaggggctcagatttctatcttcgtccaaaaataatagacgatttaattttacatcttgaaaagggaaaccatatattattagcggctcccagaagaattggaaaaacatcaatcatgttttatttgatggataatcccaaatcaaattatctgataaaatatttaattacacagtctgttaacagcgaaaatgagttctataagagaatctataaaaaggtaattgaaattctcaaaggctctaaaagtttatggacacaaacaaagaaattaataaaatcaaaacgaatttcttcaataacaatcgaaggagttactatcgatgatgttgaagtgagctactatgatgaattattgctgcttttaaaaagtatggatttaaaatctcagaaattaatcatcatgattgatgagttttctgaaactttagagaatataataaaggatgagggtgaagacaaagcaatttatttcctggaaagcaatcgtgatttcaggcatattcctgaattgcataaaaaagtacaatttatatataccggttcaatcggactcgaaaatattgttagcagactgaacaagataaatacaataaatgatttatattcctatgaagtccatccttttacagatgttgaatcaaaggatttaattgacaaacttattggtggttcagatttagtgattgacgatacacaaaaggaaaatattataaatgaaattggaatggtcgattccttattttatccagattattattga

SEQ ID NO: 13276 - protein, 271 aa, Unknown
  Obtained from environmental sample
  misc_feature (1)..(271): Xaa is any amino acid
MLFKLNIMATKTIIGQAVRGSDFYLRPKIIDDLILHLEKGNHILLAAPRRIGKTSIMFYLMDNPKSNYLIKYLITQSVNSENEFYKRIYKKVIEILKGSKSLWTQTKKLIKSKRISSITIEGVTIDDVEVSYYDELLLLLKSMDLKSQKLIIMIDEFSETLENIIKDEGEDKAIYFLESNRDFRHIPELHKKVQFIYTGSIGLENIVSRLNKINTINDLYSYEVHPFTDVESKDLIDKLIGGSDLVIDDTQKENIINEIGMVDSLFYPDYY

SEQ ID NO: 13277 - DNA, 486 bp, Unknown
  Obtained from environmental sample
  misc_feature (1)..(486): n is a, c, g, or t
atgaagtttgaagatttatttgaatttgaaaaaaataaagtatcttctagacaagatataaagaaacttgaaacaataaattctttagctaatcaacatgcaacttattattttaaagtatttaatgcaattatttcaagtttaaaagatataaaagttagtgaaaaagaaataacacaagttgaacaaaaaaacttctacattgtaatagatgaaataaatagagggaatatatctaaaatctttggagagcttattactttaatagaagaagataaaagggatagttatgaagtaactcttccatactcaaaagagaagtttaaaataccatcaaatctttatatcatagctaccatgaactctactgataaatctatagctactatagatatagcactaagaagaagatttacattttttaagatgaaaccaaatattgatttaggttccgaaatagcaaaagaaattatttacaaaaactaa

SEQ ID NO: 13278 - protein, 161 aa, Unknown
  Obtained from environmental sample
  misc_feature (1)..(161): Xaa is any amino acid
MKFEDLFEFEKNKVSSRQDIKKLETINSLANQHATYYFKVFNAIISSLKDIKVSEKEITQVEQKNFYIVIDEINRGNISKIFGELITLIEEDKRDSYEVTLPYSKEKFKIPSNLYIIATMNSTDKSIATIDIALRRRFTFFKMKPNIDLGSEIAKEIIYKN

SEQ ID NO: 13279 - DNA, 354 bp, Unknown
  Obtained from environmental sample
  misc_feature (1)..(354): n is a, c, g, or t
atgacctttgaaaaaataaaacaaagaattcaaaagtttagtgatgatagagactggaactctcatcataatcccaaaaatttagttatggcactcacaggtgaagttggagagctcaatgagatatttcagtggcttgattttgatgactctacaaatcttccccctgaggtattagagcacacaaaagaggaagtggcagacatagctatctatcttattcgtctttgtatgaaacttgatatagatttagaggatgcgattcatagtaaaatgggtaaaaatgagataaaataccctccagaaagttcatctggtaatcagaaaaaatatagtaaaagtataaatagataa

SEQ ID NO: 13280 - protein, 117 aa, Unknown
  Obtained from environmental sample
  misc_feature (1)..(117): Xaa is any amino acid
MTFEKIKQRIQKFSDDRDWNSHHNPKNLVMALTGEVGELNEIFQWLDFDDSTNLPPEVLEHTKEEVADIAIYLIRLCMKLDIDLEDAIHSKMGKNEIKYPPESSSGNQKKYSKSINR

SEQ ID NO: 13281 - DNA, 669 bp, Unknown
  Obtained from environmental sample
  misc_feature (1)..(669): n is a, c, g, or t
ttgactacaagtaagataagctttaaagatttggatatcatccatatatgcaagccgcatttaaagaacagctacataagcgttaatgatgattctaaagtggttctaaaaacttcaaaagtctctcgcatctacatagaggatctgctaaatgaaaaagagagttggataagaaaacagatcataaaaagaaaagataatccacctataaaaatcaacctagaagatgaagttttactgtttggaatggtttacagtgtggacaccgacgaagcgcaagagcttcgtattttattaaacagactaagaaagccaaatcaaaaaaatatacttagatgctacgatgatttttacaagatgttttcgcaaagatatttaagttctagaacggaatattattctcaaatcatgggcttaaactacaaagagataaaactaaaaaagatgagaagtagatggggaagctgtagctcagataaggttattactttcaatactgggctggttaaactagaaaaagagcagattgattatgttgtaatacatgaactagctcatttaatacatatgaatcattccaagaactttcatgctttagttcaaaactattttccagatgcacctagagttaagaaaaacattagaaatagacaaagttttactttttag

SEQ ID NO: 13282 - protein, 222 aa, Unknown
  Obtained from environmental sample
  DOMAIN (13)...(220): Protein of unknown function DUF45
  misc_feature (1)..(222): Xaa is any amino acid
MTTSKISFKDLDIIHICKPHLKNSYISVNDDSKVVLKTSKVSRIYIEDLLNEKESWIRKQIIKRKDNPPIKINLEDEVLLFGMVYSVDTDEAQELRILLNRLRKPNQKNILRCYDDFYKMFSQRYLSSRTEYYSQIMGLNYKEIKLKKMRSRWGSCSSDKVITFNTGLVKLEKEQIDYVVIHELAHLIHMNHSKNFHALVQNYFPDAPRVKKNIRNRQSFTF

SEQ ID NO: 13283 - DNA, 543 bp, Unknown
  Obtained from environmental sample
  misc_feature (1)..(543): n is a, c, g, or t
ttgaagagattgagtaaataccttaactttataatattatttgttttactagtaattttttttgctagtgatctccctaaacatatctcaacacaaatcacaagtattctccctgctggtgaaaataaaggacttttaagggagtttgaaaaacttaatacaaacaaacaactttttatagcttataaaggggaagataaaaacactttaaatagcttaaaaaaagtggtaaaccaacttttagaacataaaaatatacacccaataacaaattcaagtatcaataaagagtatgaaaaaaaatattactatttacttcataagtttgatgagaaaaaatacaattcattgaacataagagaagaacttacaaatatacatcaaaaaataatcacatcaccttttagtttttcactcaatacagttgatccactcaatatttttgaaaaaaacaccaaacaaaaatccccctacataaaaatagaaaactatgnatatatgactatcttacaacttgacaaaagtattaataattttggataa

SEQ ID NO: 13284 - protein, 180 aa, Unknown
  Obtained from environmental sample
  misc_feature (1)..(180): Xaa is any amino acid
MKRLSKYLNFIILFVLLVIFFASDLPKHISTQITSILPAGENKGLLREFEKLNTNKQLFIAYKGEDKNTLNSLKKVVNQLLEHKNIHPITNSSINKEYEKKYYYLLHKFDEKKYNSLNIREELTNIHQKIITSPFSFSLNTVDPLNIFEKNTKQKSPYIKIENYXYMTILQLDKSINNFG

SEQ ID NO: 13285 - DNA, 456 bp, Unknown
  Obtained from environmental sample
  misc_feature (1)..(456): n is a, c, g, or t
atgactcgtgtggaaatatctcaaaataaagagggggaactcaaagtaaaatctccttttatttcaaacatcctctatgaagataaatttaaagtcacaaatcatgaaattcaaacttttgattatgtggagatagaaaacaatcaattcaaacttgttggacgaagttcacaaattataaaactagcaggaaaaagatactcaactatacaaatagaaaatatattagaaacccaaccaaacatagaaaaagctgttgtatttgtaactacagataaagatgctttgcgaggggaggagctaaatatcacacttcaaacaaaagaaaatatcctcgtaaaagatataaaaactcttcttaaaaaagagctatctaatatgagatttactatcaatctcaaattagttgataagataaaaacaaccctagtaggcaaaaagatgttaatacaatag

SEQ ID NO: 13286 - protein, 151 aa, Unknown
  Obtained from environmental sample
  misc_feature (1)..(151): Xaa is any amino acid
MTRVEISQNKEGELKVKSPFISNILYEDKFKVTNHEIQTFDYVEIENNQFKLVGRSSQIIKLAGKRYSTIQIENILETQPNIEKAVVFVTTDKDALRGEELNITLQTKENILVKDIKTLLKKELSNMRFTINLKLVDKIKTTLVGKKMLIQ

SEQ ID NO: 13287 - DNA, 804 bp, Unknown
  Obtained from environmental sample
  misc_feature (1)..(804): n is a, c, g, or t
gtgactgtcattacagaaatggatgttattgttaaagcattgcaacttaatgtaaataatttcataaaaaaaccaatcatagtaaacgaagttataaacgcgcttatatctgtttccaaacttataattgcaaataattacctagaagctcaaaaaaattctaaattactagagcttaaagctaaggatgaatatagctcttaccaagaagatttagcatttgcaaaagagttaaatatacttagaaacgatttttactatcagatgatggacataaattgtacggtattagttgacttctcataccaacctctggatattttaagcggagatgcttacagtgcaagaaaaatagatgcaaaaagaactttttatcttattgtagatggcatgggaaaaggtctctcggcatcacttacctcaatgctaatagcatcattcataaatcatctcatagacaaaatgatagagctaaacaactttaacttaaatagacttatttatgaatcatcagagtatataaaacctattttacttgacgaagaggccctttcagtagactatgttctactgaattgtactagtaataatttggaatatgcaaaatttgcgatgccttcaatcttaatacagaanacagacaatgaaatagtcacgttaaaatcaaataatggtccgataagtaaatacatgagaggctttaaaatttcaaactttgacgtatcanacatgctaaaattattgatgtatagtgatgggatggttgaagaacacaacaagattccagaggtaaactatatatag

SEQ ID NO: 13288 - protein, 267 aa, Unknown
  Obtained from environmental sample
  DOMAIN (119)...(265): Stage II sporulation protein E (SpoIIE)
  misc_feature (1)..(267): Xaa is any amino acid
MTVITEMDVIVKALQLNVNNFIKKPIIVNEVINALISVSKLIIANNYLEAQKNSKLLELKAKDEYSSYQEDLAFAKELNILRNDFYYQMMDINCTVLVDFSYQPLDILSGDAYSARKIDAKRTFYLIVDGMGKGLSASLTSMLIASFINHLIDKMIELNNFNLNRLIYESSEYIKPILLDEEALSVDYVLLNCTSNNLEYAKFAMPSILIQXTDNEIVTLKSNNGPISKYMRGFKISNFDVSXMLKLLMYSDGMVEEHNKIPEVNYI

SEQ ID NO: 13289 - DNA, 786 bp, Unknown
  Obtained from environmental sample
  misc_feature (1)..(786): n is a, c, g, or t
atggtcaggatcggctcgaggagttcagaaatttcaacttctttgaccggtagaaatgttgtaataaaattgatgcctttttcttttaaagagtttttattatttaaagatacaaaaatcatttttgattctacatcaaaggtagcaaaaattaaaaaattatttaagaaatattttgaaataggaggttttcctttaattgttgaagaagatgatttagaactaataaaaatatattataatgatattttttatagggatattgtatctagatatagggttagtaatgttgatgaaataaaaaatctttcaacttttcttatgagtaattcaggtaaaataatatcttattcgaaattgggaaattttagcgggatatcttcttcaagtcttgtaaaaaaatatttaggattcttttttgattcttatcttttttttgaattgaaaaaatatgatttttctgtaaggaagcaaatattaaattcacgaaaaatatattcaggtgacttggcatttgcaagaaagattggatttcattcttctggagatgatggaaggtttcttgagaatttagtctttttagaattaaagagaaaagaaaaatatgtattttatcatcttaataaaaatgaatgtgattttttaataaaagatgggttgaagataatgcaagcaattcaagttacttgggttttaagtaagatgaatgaagaaagagaatttgaaggaatttatgatgcaatgaaggattataatttaagtgaaggtttaattttaaacatttga

SEQ ID NO: 13290 - protein, 261 aa, Unknown
  Obtained from environmental sample
  misc_feature (1)..(261): Xaa is any amino acid
MVRIGSRSSEISTSLTGRNVVIKLMPFSFKEFLLFKDTKIIFDSTSKVAKIKKLFKKYFEIGGFPLIVEEDDLELIKIYYNDIFYRDIVSRYRVSNVDEIKNLSTFLMSNSGKIISYSKLGNFSGISSSSLVKKYLGFFFDSYLFFELKKYDFSVRKQILNSRKIYSGDLAFARKIGFHSSGDDGRFLENLVFLELKRKEKYVFYHLNKNECDFLIKDGLKIMQAIQVTWVLSKMNEEREFEGIYDAMKDYNLSEGLILNI

SEQ ID NO: 13291 - DNA, 333 bp, Unknown
  Obtained from environmental sample
  misc_feature (1)..(333): n is a, c, g, or t
atggacttaattttaatttcatcgccactaattacactcattaaatctacttttaaggatagatttttaatatttgccaactgcgttccttcaaatttatctactccatcaacagtaacattatcgatagaaaaattaaaattaggaaaggtactaattaagcccaaatcaaactctccaaaatctacttttgcattcaggttagcattggcttgttctttaactatatctattattttacctttaaacataaaaggcaacgaaataattaaaaccaataaaactaataaggttattcctgtgattttgagtgcttttttcataataaattga

SEQ ID NO: 13292 - protein, 110 aa, Unknown
  Obtained from environmental sample
  misc_feature (1)..(110): Xaa is any amino acid
MDLILISSPLITLIKSTFKDRFLIFANCVPSNLSTPSTVTLSIEKLKLGKVLIKPKSNSPKSTFAFRLALACSLTISIILPLNIKGNEIIKTNKTNKVIPVILSAFFIIN

SEQ ID NO: 13293 - DNA, 345 bp, Unknown
  Obtained from environmental sample
  misc_feature (1)..(345): n is a, c, g, or t
atgttgaaaatttatggaataaaaaactgcggaagcgtaaaaaaagctatggcattttttacagttcatgacataaaatttgagtttattgatctgaagaaagttagtgttgactcagacaaaatagattactggctgcaacatgtagatattataaaactttttaatgcaagctcttcaacatacagaaacttgaaattaaaagagttaaatcttgatgatgatggaaaaaaagagtatctctctcgtgaaaatatgctaatcaaacgtcctgttgttgagtataatgacaaagtattagttgcatttgatgaggaagtttacaaaaaggagtttttatcatga

SEQ ID NO: 13294 - protein, 114 aa, Unknown
  Obtained from environmental sample
  DOMAIN (5)...(113): ArsC family
  misc_feature (1)..(114): Xaa is any amino acid
MLKIYGIKNCGSVKKAMAFFTVHDIKFEFIDLKKVSVDSDKIDYWLQHVDIIKLFNASSSTYRNLKLKELNLDDDGKKEYLSRENMLIKRPVVEYNDKVLVAFDEEVYKKEFLS

SEQ ID NO: 13295 - DNA, 498 bp, Unknown
  Obtained from environmental sample
  misc_feature (1)..(498): n is a, c, g, or t
atgggaaaaacaaaccaaagaaaatttgagttgaaaagcatagcagaagcccaatgcggttattttacggctatgcaggcgaaaattataggctattcaaaggttaatcatccttatcatgttcagcagggaaactggctgaaaataagccgaggaacctatagattaccaagttttgaagatacattggaagcaaaattttcttattggagtctatggagcagaaataaaaatgaacaacctcaaggcataataagttatgaatcagcattgatgtattatggttttattgataaagataagacaacatctgttcatataaccgtatcaaaaggattccaaaagagaaatatcccaaaagaagagattatacttcataaagaaaatttaccattatctaatcttgaaaaccatggtgcatttatgacaacaaatcttttcagaacattgaaagatacaaaagaagaattagagcaaaaagggattggaaagaagtag

SEQ ID NO: 13296 - protein, 165 aa, Unknown
  Obtained from environmental sample
  misc_feature (1)..(165): Xaa is any amino acid
MGKTNQRKFELKSIAEAQCGYFTAMQAKIIGYSKVNHPYHVQQGNWLKISRGTYRLPSFEDTLEAKFSYWSLWSRNKNEQPQGIISYESALMYYGFIDKDKTTSVHITVSKGFQKRNIPKEEIILHKENLPLSNLENHGAFMTTNLFRTLKDTKEELEQKGIGKK

SEQ ID NO: 13297 - DNA, 597 bp, Unknown
  Obtained from environmental sample
  misc_feature (1)..(597): n is a, c, g, or t
atggaagataaaaatggaaaatttaatttagagatttataaaattaacctagcaattgttgaggcacttattaaaagggaagatatatctatagatgaaattgatgaaaatctgtatggtgttgatttagataaaaatgggatacttgataaatcagatattataaaatacaaatgggaacctttaaaaggtatcaacatgttttatgtggggatggcaaaagaataccaagaaaaaaataaaatctttgcaagagcagggctttatccaaaaaatacagagtttttacatacagttcgttatttagatataaaaaataatagtataggattatcaaagagattaaaagagctacggtatgcaaaaaaagtttatgcacctaattatatggatttatcaactactacaattcaagcaaatattgaaaaagaggatgatggagatattcacgaagtatttaaaatagaccctgaaattggtattagtaatggaaaagggtggagatatttaggttttcttgaggataaaaatggggatttacgaccatctacaaaagagggagcttatctattgtataggggtgtcataacaatctag

SEQ ID NO: 13298 - protein, 198 aa, Unknown
  Obtained from environmental sample
  misc_feature (1)..(198): Xaa is any amino acid
MEDKNGKFNLEIYKINLAIVEALIKREDISIDEIDENLYGVDLDKNGILDKSDIIKYKWEPLKGINMFYVGMAKEYQEKNKIFARAGLYPKNTEFLHTVRYLDIKNNSIGLSKRLKELRYAKKVYAPNYMDLSTTTIQANIEKEDDGDIHEVFKIDPEIGISNGKGWRYLGFLEDKNGDLRPSTKEGAYLLYRGVITI

SEQ ID NO: 13299 - DNA, 492 bp, Unknown
  Obtained from environmental sample
  misc_feature (1)..(492): n is a, c, g, or t
gtgtgttttggcttgatcttgacttaccggatcagtggagttataggttttggagagcataaattccatacaaatagtataataaaaccagaatctgtaatatttgtaggaaatcatgaatcaattatgttagcaaaaacacttgatgagatgttggatttggatgcaggggattttattattgtatcaagtgtttcagatgaaccttggtttataaaaagatggcaagcgcacactcaaaatacaaaacttaaaggggataaacagttagcgtggatttatgatagagatggaagtataagaaattttttgcaagtaccaacatctgatgcattaaaatattttgtttataatgtaaaaaaagatgggataatagaaaatatctatattggtaaaataaaagttggagcaagtaatggcactatgagtgaaaaagagataaaagaaaacctacaagaggttgtcaaaagagtaaaagaattagaatattaa

SEQ ID NO: 13300 - protein, 163 aa, Unknown
  Obtained from environmental sample
  misc_feature (1)..(163): Xaa is any amino acid
MCFGLILTYRISGVIGFGEHKFHTNSIIKPESVIFVGNHESIMLAKTLDEMLDLDAGDFIIVSSVSDEPWFIKRWQAHTQNTKLKGDKQLAWIYDRDGSIRNFLQVPTSDALKYFVYNVKKDGIIENIYIGKIKVGASNGTMSEKEIKENLQEVVKRVKELEY

SEQ ID NO: 13301 - DNA, 444 bp, Unknown
  Obtained from environmental sample
  misc_feature (1)..(444): n is a, c, g, or t
atggcaaaaaaattaacctttaaacaagtaatattcagcacttttagagagctgtttatacatcatcatacatcattagagtttcgtgccaaattgtttgcactaataattgcagcaggtgaaaaacatgatgatgaatgtgctctagatattgtaaaaaaatgtgggatggatatttacgataacaatgaaagagctagtatgctcactatgactacaaaagagtttatcaataatgtcgtagaagagaatgattatgggcttgattcgctaattcacagtatcatggatgatataaaagcagttcctagatatgcccaaaaaattgatccagcacatttaaaagagcttctctcttgctctgttgataatgattcaaaaatctaccaagagagagttatagaatttttggagagacttaagcaagatcatttgaaagaatag

SEQ ID NO: 13302 - protein, 147 aa, Unknown
  Obtained from environmental sample
  misc_feature (1)..(147): Xaa is any amino acid
MAKKLTFKQVIFSTFRELFIHHHTSLEFRAKLFALIIAAGEKHDDECALDIVKKCGMDIYDNNERASMLTMTTKEFINNVVEENDYGLDSLIHSIMDDIKAVPRYAQKIDPAHLKELLSCSVDNDSKIYQERVIEFLERLKQDHLKE

SEQ ID NO: 13303 - DNA, 687 bp, Unknown
  Obtained from environmental sample
  misc_feature (1)..(687): n is a, c, g, or t
atgctattgcgaataaataaatttttattatatatcttattaacactttttcttagtaccactagctttagttgtgctttatgtcaaatggacatacctatggtaactgtagatacaaaagtatctacactaccaactaaaacacactttgaaatcaaatggaaatttgatgaaaaatttgtatctaatttaactcaatatgacttaaatgaaaatggtcaatttgacaaagatgaaaaagatgccatcacaaaagctctcgaagattatctccatattttaaattatcttacaaaaatcacttattcaaaaagacatttcacatcagataaaatagttgagataaaacccaatgcaacacaaatggtctttgaaaatggttctatgtactacagctttgattttgatgcagattttattttacaaaataattatacactcaatatcaaatttgaagatactcaagaaaatttcaacttcactttaaaagatataattctagacaactaccaaaatnagtatccaataaaaccatcagaacattttgcacaaatcatttttcatgaccctggcagtgtatcaaaaatgaatcctgtaaaaaatgaaaataccactgtacaagatataaagactccaaagaagaaaattttaattttggaacccaataaaaccaatgggttttcttga

SEQ ID NO: 13304 - protein, 228 aa, Unknown
  Obtained from environmental sample
  misc_feature (1)..(228): Xaa is any amino acid
MLLRINKFLLYILLTLFLSTTSFSCALCQMDIPMVTVDTKVSTLPTKTHFEIKWKFDEKFVSNLTQYDLNENGQFDKDEKDAITKALEDYLHILNYLTKITYSKRHFTSDKIVEIKPNATQMVFENGSMYYSFDFDADFILQNNYTLNIKFEDTQENFNFTLKDIILDNYQNXYPIKPSEHFAQIIFHDPGSVSKMNPVKNENTTVQDIKTPKKKILILEPNKTNGFS

SEQ ID NO: 13305 - DNA, 528 bp, Unknown
  Obtained from environmental sample
  misc_feature (1)..(528): n is a, c, g, or t
ttgccggtgtttttaaacgaaaagcagctgagaaaccgtccgctatatattcatattcctcattatacacacgcaacatctccgtattcttctattattgatggaaattataaactctttcggtattacaatgacgctgaaggcacgtatgcactgtttaatttaaaaaaagatattagcgaaaaacgcgacctctctgagcaacatcctgagattgtaaaagagttagagggaaaactaactctccttttagaagatgctaatgctgagtaccctattccggtaaatagcaaaaagggcacagcgctaattgaaaaattctacaaaggcgagacccttggtttttctacaaaaggtgtaaatggctggagaattcgcaccaaaaaatcagaacgtgattatgcagatatggagcgagaatgttttgaaaaaatgattcagggggattcagctacacttatacactacactaagaggtttgaaaaatgcgatatcgacagaaaaagatgggaagcgtatataaaatag

SEQ ID NO: 13306 - protein, 175 aa, Unknown
  Obtained from environmental sample
  misc_feature (1)..(175): Xaa is any amino acid
MPVFLNEKQLRNRPLYIHIPHYTHATSPYSSIIDGNYKLFRYYNDAEGTYALFNLKKDISEKRDLSEQHPEIVKELEGKLTLLLEDANAEYPIPVNSKKGTALIEKFYKGETLGFSTKGVNGWRIRTKKSERDYADMERECFEKMIQGDSATLIHYTKRFEKCDIDRKRWEAYIK

SEQ ID NO: 13307 - DNA, 519 bp, Unknown
  Obtained from environmental sample
  misc_feature (1)..(519): n is a, c, g, or t
atgaagaaactcatacttttactcatacttggtttttctacaaatttaatattttcacaaacagaacttccaagtattaaacttctttttgacaatttgtctgaagaagaatatatctcagccccaggaattagttttgacggcaattatctaattttttcagtaataaatgacgaaagctacaaattttatgaaagtaaaaaaacaaatggaaggtggacagaaccgacagaactaacagatattacaacattttttggagaaaacatttacaaaaattcacctgtatataattatgatgcttcaaaaatatattttgaggctcaaaatggcagtaataaagacatttatgttagcagtagaacttctactaaatggacagagccaatattattatcttcaaaaataaattcaaataaaaatgaaggagacccctcattttctccaaataaaaatttctttattttgtgccgtatgaaaatgaaaaaaaccgaaaaatgccgaaaaatatccctttag

SEQ ID NO: 13308 - protein, 172 aa, Unknown
  Obtained from environmental sample
  SIGNAL (1)...(19)
  misc_feature (1)..(172): Xaa is any amino acid
MKKLILLLILGFSTNLIFSQTELPSIKLLFDNLSEEEYISAPGISFDGNYLIFSVINDESYKFYESKKTNGRWTEPTELTDITTFFGENIYKNSPVYNYDASKIYFEAQNGSNKDIYVSSRTSTKWTEPILLSSKINSNKNEGDPSFSPNKNFFILCRMKMKKTEKCRKISL

SEQ ID NO: 13309 - DNA, 540 bp, Unknown
  Obtained from environmental sample
  misc_feature (1)..(540): n is a, c, g, or t
ttggatattgatttaagcaaaacagtaatctttaacactttcgagaaaaatgtagaaattgtgtctcacaaagcaaaatacacatttcaaatagttgattcacaagaaaatactggcattgaatgcgaaataatcttaataaataaaagtacttcaaaaaaaatagtatcaaaggcaaaaacaaacaaaaatggagaagtctcaatttctgttagaaaaggagatatttatgacattacaataaatccacacggatatgcattctataattctacaattgagattcttgataatgaaaataaaagtaaaaagattgaattacaaccactaaaacaagatgtaaaaatcgaattaaaaaacataacatttgaaacaaattctgctgaattaaacatagaatcttacaaggagctcaatagcgtagttgatttaatgtctcaaaatcctggaatcaaagtagaaatatcagcacatacagacgatattggctcagatacttacaatcaaagattgtcagacaaaagggcaaaaaccgtgtga

SEQ ID NO: 13310 - protein, 179 aa, Unknown
  Obtained from environmental sample
  DOMAIN (122)...(179): OmpA family
  misc_feature (1)..(179): Xaa is any amino acid
MDIDLSKTVIFNTFEKNVEIVSHKAKYTFQIVDSQENTGIECEIILINKSTSKKIVSKAKTNKNGEVSISVRKGDIYDITINPHGYAFYNSTIEILDNENKSKKIELQPLKQDVKIELKNITFETNSAELNIESYKELNSVVDLMSQNPGIKVEISAHTDDIGSDTYNQRLSDKRAKTV

SEQ ID NO: 13311 - DNA, 417 bp, Unknown
  Obtained from environmental sample
  misc_feature (1)..(417): n is a, c, g, or t
atgaaacattttataacttcttttgttttaatatcactcatttttaataactcttatgcatttagttttaaaagtggattaagtatagctggcgaattagatccgacaggtgcagttaatatggctaactctgtatataacactgtaggctatttaaaagatgttcaggtaaccaaacctcagtggaaaacattaaatgataaagtagtatctgaagattctggtttaattgttattaatttattagactacattgaagatccgctagttaaaagatatgatgctttgccaagacccataaacacaataaagtataaatatagtggtactaatagtctacttgatattaagtctgttgctggtgttatgagtttaactcctattacaaatagattggaacaatggagtttgaagtga

SEQ ID NO: 13312 - protein, 138 aa, Unknown
  Obtained from environmental sample
  misc_feature (1)..(138): Xaa is any amino acid
MKHFITSFVLISLIFNNSYAFSFKSGLSIAGELDPTGAVNMANSVYNTVGYLKDVQVTKPQWKTLNDKVVSEDSGLIVINLLDYIEDPLVKRYDALPRPINTIKYKYSGTNSLLDIKSVAGVMSLTPITNRLEQWSLK

SEQ ID NO: 13313 - DNA, 393 bp, Unknown
  Obtained from environmental sample
  misc_feature (1)..(393): n is a, c, g, or t
ttgaacttatttgaaacaattgctgctattctagaacttaaagagaaagattttgaagcagtatgtgataaaggttatgagtttagaggaaatggtggattaaaaattgatacaaattttaatgaagatggatttgactatagtggatttattggatctatcattagttttaaacttgcaggtgttgaagaacattatttagcatattctatttttgaagcattagctgatatgagtattactacacttaacccactaaaagaaaaattcaaaattcaaaatattctaatgatgggtgatatatttgaaaatagtgttttatatagtagaattttaagtaaatttcaactttctaatccatattttagtaaagatattgctttaaatgaatag

SEQ ID NO: 13314 - protein, 130 aa, Unknown
  Obtained from environmental sample
  misc_feature (1)..(130): Xaa is any amino acid
MNLFETIAAILELKEKDFEAVCDKGYEFRGNGGLKIDTNFNEDGFDYSGFIGSIISFKLAGVEEHYLAYSIFEALADMSITTLNPLKEKFKIQNILMMGDIFENSVLYSRILSKFQLSNPYFSKDIALNE

SEQ ID NO: 13315 - DNA, 627 bp, Unknown
  Obtained from environmental sample
  misc_feature (1)..(627): n is a, c, g, or t
ttgggagatcagctgctctttaaagactataattattgcttaaacttggggggctttgctaatatttcctatgaagttaataaggaacgtattgcttttgatgtttgtcctgtaaatattgtattaaattattacgtaggtaaccttaatttagaatatgatgataaaggacaattggcagccacaggaaaagttaataaaaatttattatctgagcttaatgcgcttgcgtatttcaaggaggaagcaccaaaatctttaggcttagaatgggtagatgttaatgtatttcctttaatagaggaatacaaccttcaacttaaagatgtattaagaacatatattgagcatattgcaatgcaggtttcagaggttttagttacacctaatgcaaaacttttaataacaggtggaggagtgtataatagttttttaatggaaagaataaagcatttttctgaagttgaagttattattcctaataacgaaattgtagaatttaaggaggctctaatttttgggttacttggtgtgctaaaagataggaatgaagtcaattgcttaaaaagcgtaactggtgctaaaaaaaatcattcatctggaaaaattttaatgccgaaaaaataa

SEQ ID NO: 13316 - protein, 208 aa, Unknown
  Obtained from environmental sample
  DOMAIN (1)...(206): Uncharacterised protein family (UPF0075)
  misc_feature (1)..(208): Xaa is any amino acid
MGDQLLFKDYNYCLNLGGFANISYEVNKERIAFDVCPVNIVLNYYVGNLNLEYDDKGQLAATGKVNKNLLSELNALAYFKEEAPKSLGLEWVDVNVFPLIEEYNLQLKDVLRTYIEHIAMQVSEVLVTPNAKLLITGGGVYNSFLMERIKHFSEVEVIIPNNEIVEFKEALIFGLLGVLKDRNEVNCLKSVTGAKKNHSSGKILMPKK

SEQ ID NO: 13317 - DNA, 531 bp, Unknown
  Obtained from environmental sample
  misc_feature (1)..(531): n is a, c, g, or t
gtgagagaagatttaattcattatcaaatttttactcaaaaatcactttatgccatgtgtgaaactttacctgtaagtcaaaaggaattaaaagaaattcatggcatgggtaaaactcgagttgataaatatggtgatgaaatcttaaaggttattaaaacttactgcgatgaaaatgatattgagtttaaaagtgaagaaatagcttttaaaactgctaaaccaaaaaagaagaaagctgataccaaaaaaatatctttagatttgtttcaatctggaaaatccattgaacaaattgctttagaacgagaacttacgacaaatactatttttagacatttaacagatttcatagcaacgggtgaaattatggttacggacattatttctaaaaatcattatgaagagttaaaaaatataattcctacgaaaacatttgatagtctttcagatttaaagcatcaaatagatgataaatattcttataacgagattaggttagtgttacaagaattaaatgcaacgatgtaa

SEQ ID NO: 13318 - protein, 176 aa, Unknown
  Obtained from environmental sample
  DOMAIN (2)...(62): HRDC domain
  misc_feature (1)..(176): Xaa is any amino acid
MREDLIHYQIFTQKSLYAMCETLPVSQKELKEIHGMGKTRVDKYGDEILKVIKTYCDENDIEFKSEEIAFKTAKPKKKKADTKKISLDLFQSGKSIEQIALERELTTNTIFRHLTDFIATGEIMVTDIISKNHYEELKNIIPTKTFDSLSDLKHQIDDKYSYNEIRLVLQELNATM

SEQ ID NO: 13319 - DNA, 300 bp, Unknown
  Obtained from environmental sample
  misc_feature (1)..(300): n is a, c, g, or t
gtggctccctcctggttgtctccttcgcgaccagagtctattgaaagtttcacaggagatgaagttatattttcttcaacaacaagtacccataatatcgaaaaagccacgttatctgtaaaggcggtaatggtctctgagaatggattatcggcggcccgtctcgttgaaacagggttcatctctggcaaattcgttgaaatcaagtctgggctcacagagaatgatctcattgtaactgaagggtttgctgagctgaaaactggagtcaaactcaactttaagaaaggtctcaactaa

SEQ ID NO: 13320 - protein, 99 aa, Unknown
  Obtained from environmental sample
  misc_feature (1)..(99): Xaa is any amino acid
MAPSWLSPSRPESIESFTGDEVIFSSTTSTHNIEKATLSVKAVMVSENGLSAARLVETGFISGKFVEIKSGLTENDLIVTEGFAELKTGVKLNFKKGLN

SEQ ID NO: 13321 - DNA, 522 bp, Unknown
  Obtained from environmental sample
  misc_feature (1)..(522): n is a, c, g, or t
atgcttatctttcatgcagtaaaacagttaaaggatattggcattgaagtcttggttctgtgcagtggacatatgaaggactacagaaacccttcatatatagaagagatcaggacgtatatagataaaaataaacttaagaataatataaagctaatggggttaattgattatgatgatgtcctgtattttatgcgctattcaatagctgtaatcaatccttctctatttgaaggatggagttctacagtagaagagtgtaaaagtataggaaaaaacatgcttttatctgatactttgatccataaagaacaaaacccaaaagaaagtatttactttgatccaaacaatgtgcaagatgcagtagaagctcttaaaacattttggttagatgatacttttatccctcccaatataaaactagagactcaagctagagataacttgaaaaaacgtactcttacatttgctgaaatctatcaagatatagttctagagactgttcatggtctatatagatga

SEQ ID NO: 13322 - protein, 173 aa, Unknown
  Obtained from environmental sample
  DOMAIN (6)...(148): Glycosyl transferases group 1
  misc_feature (1)..(173): Xaa is any amino acid
MLIFHAVKQLKDIGIEVLVLCSGHMKDYRNPSYIEEIRTYIDKNKLKNNIKLMGLIDYDDVLYFMRYSIAVINPSLFEGWSSTVEECKSIGKNMLLSDTLIHKEQNPKESIYFDPNNVQDAVEALKTFWLDDTFIPPNIKLETQARDNLKKRTLTFAEIYQDIVLETVHGLYR

SEQ ID NO: 13323 - DNA, 537 bp, Unknown
  Obtained from environmental sample
  misc_feature (1)..(537): n is a, c, g, or t
atgataactatcttacttctaagttcattagtggaagcatttttctttctaccacttcatgcaaaacatatacttcaagtaaatcatagtgaaaaaaaatctgaaactatctgggagtggaacaaaagcctttataaaactatcttagattttgtgttaaagtggaaatatcttttccctataattcttacagtttttatcatcatagcaacaatattttttgcaaaaattttaaagtttgagtttatgccagagtttgatacaacacaagtctatattaatgggtccgttggtgtaggacatgatatcaaagagactgagcaaaagatttatcaactagaaaaaaagatacttgaaaattttgagttaggaaatgaaatagatagtatcagttccgttatagggatgaaactagatggaaaacaactccctcaaaatgaagaattctactttcaaatctttgtaaaccttcaagaaagagctgcttcaaatgtatttgataaatatatcaatccatatttaagtcgcaaaatatga

SEQ ID NO: 13324 - protein, 178 aa, Unknown
  Obtained from environmental sample
  misc_feature (1)..(178): Xaa is any amino acid
MITILLLSSLVEAFFFLPLHAKHILQVNHSEKKSETIWEWNKSLYKTILDFVLKWKYLFPIILTVFIIIATIFFAKILKFEFMPEFDTTQVYINGSVGVGHDIKETEQKIYQLEKKILENFELGNEIDSISSVIGMKLDGKQLPQNEEFYFQIFVNLQERAASNVFDKYINPYLSRKI

SEQ ID NO: 13325 - DNA, 663 bp, Unknown
  Obtained from environmental sample
  misc_feature (1)..(663): n is a, c, g, or t
atggccgtatcaaaaatagaagatgaactagcaaacttaagtgaagcagataccataacaactgttgtaaaaacaggatattttagtattcgaattgatttaaaagagggaaacgatctttcaaaacttttagatgatgtaaaagatattgttacaaaaactcgttcagatttaccaagtgatatggatgaacctatagtaaaagaggtgagtttttcatttccacttattactattgctgtatttggtgataaatcaaatgaagagttactccaaatttcagatgatattaaatcaaagataaacactcttggggatttaagtgatataactatctggggagatagtgacaaagagttactaataacttttgatgaaacaaagatagatgcctttggtttaaataaaaatgcagttataagtgccattgcagctactagttctatttttcctgcagggattataaaagataaagggacacactattatctcagtagtcaaaatggggaaaaagatattcaaaaacttttaaatatgattatcaaaattggtgatacctctatttacctcanagatattgctgctgtagaatataaactagctgatgtaaatacaatttcacattttaatggtcaaaaaaaatatctcaataggtgtcaataa

SEQ ID NO: 13326 - protein, 220 aa, Unknown
  Obtained from environmental sample
  misc_feature (1)..(220): Xaa is any amino acid
MAVSKIEDELANLSEADTITTVVKTGYFSIRIDLKEGNDLSKLLDDVKDIVTKTRSDLPSDMDEPIVKEVSFSFPLITIAVFGDKSNEELLQISDDIKSKINTLGDLSDITIWGDSDKELLITFDETKIDAFGLNKNAVISAIAATSSIFPAGIIKDKGTHYYLSSQNGEKDIQKLLNMIIKIGDTSIYLXDIAAVEYKLADVNTISHFNGQKKYLNRCQ

SEQ ID NO: 13327 - DNA, 801 bp, Unknown
  Obtained from environmental sample
  misc_feature (1)..(801): n is a, c, g, or t
ttgctgggcaagttagcaaatttgcccccaatggggtttagaaggaggggggaagtttcccactggaatttaccggccagaaaattaaatttggttttaaatgaaactaggggttctttacctatcgacaatagaaccctttctttttcttgtaaccaaccggggggttatgggggaaaagatatttataaaggtactaagttacccgatggtacttgggggatagcccaaaatttaggtccaatgataaatacacagttgcatgaagatttccgctttctttttagtgatggtaaagccttatgctttagtagtaagggacatcaaaacatgggcggttgtgatttatttgtttctaccgtttcaaacgaatcgtggtgtgatcctgaaaatttaggaacaccaataaactctgttagagatgaattttgtatagttttggctgccgagggaaaaaatgcatttttttcttctactcgtgaaggtggaattggaggtatagacatttacaaggcttttattaatgaccctccaactaatttattggttttaaaaggaataggattcgataaagactcaaacaaatccatacctgttaaagcaactttaatggaagacaacaaaactattgttggtatttacaatgcaaaagcaagtactggagaatttgtaatgattattgctccagaaaaaaattacaatatattagttgaggctgaaggttatcatcctattgctgaaaacatagattttaatataaaaaaccaaaagccaatcgtatttttattaaataaaaaataa

SEQ ID NO: 13328 - protein, 266 aa, Unknown
  Obtained from environmental sample
  misc_feature (1)..(266): Xaa is any amino acid
MLGKLANLPPMGFRRRGEVSHWNLPARKLNLVLNETRGSLPIDNRTLSFSCNQPGGYGGKDIYKGTKLPDGTWGIAQNLGPMINTQLHEDFRFLFSDGKALCFSSKGHQNMGGCDLFVSTVSNESWCDPENLGTPINSVRDEFCIVLAAEGKNAFFSSTREGGIGGIDIYKAFINDPPTNLLVLKGIGFDKDSNKSIPVKATLMEDNKTIVGIYNAKASTGEFVMIIAPEKNYNILVEAEGYHPIAENIDFNIKNQKPIVFLLNKK

SEQ ID NO: 13329 - DNA, 567 bp, Unknown
  Obtained from environmental sample
  misc_feature (1)..(567): n is a, c, g, or t
ttgaatgggactggcgaggtgatagaagttattcattcgcaccaacttgctcacttactgagaatcaatcctgctcatatcaggcgtgacctgaggttaataaaatttaatggagatgtccacaaaggatataatattgagaaactcattgctagtattagcaaagtaattgatggtgatattgtacgaaaggtagcattcgttggcatcggcgacctgggacgttctgttgctgaatactttaactcttctggaacaaaactaaaaattgctgcaacctttagattaatggaagaacctaaaatgcaatttcagaacgttaataactacaatatttcccggatgaaagaaataatcaaaaaggaaaaaattgagctttgcgtaatagcggtacctatgtcgtatgctaaagaagtaagtaaaactgttgttgaatcaggtgtaaagggcttacttaacttcacctccgtaattctcgacttacctgagaatgtatatgttgaggattatgatatgattgccaaacttgaaaaactttcatattttgttaatgaagataatcaataa

SEQ ID NO: 13330 - protein, 188 aa, Unknown
  Obtained from environmental sample
  DOMAIN (152)...(183): Putative DNA-binding protein C-terminus
  misc_feature (1)..(188): Xaa is any amino acid
MNGTGEVIEVIHSHQLAHLLRINPAHIRRDLRLIKFNGDVHKGYNIEKLIASISKVIDGDIVRKVAFVGIGDLGRSVAEYFNSSGTKLKIAATFRLMEEPKMQFQNVNNYNISRMKEIIKKEKIELCVIAVPMSYAKEVSKTVVESGVKGLLNFTSVILDLPENVYVEDYDMIAKLEKLSYFVNEDNQ

SEQ ID NO: 13331 - DNA, 471 bp, Unknown
  Obtained from environmental sample
  misc_feature (1)..(471): n is a, c, g, or t
atgtatgcacgttccacatcagcagaatcagacagcaaacacttttacctaaaaaacagcaaaggactttactatcgagcaaacaaagacacaaaacaattaattataacagaaagcataatagactttttaagcatctaccaaatagatgaaatcagaaacaattacgacttcttaccaatctacggaaccaacagattgaaccaggatcataaaacagcaataagcaaacttaaacaactgcaggaaatcattttctttcttgatggtgatctggcaggagaagaagcaataaaaaagtatagtaaggatctacacaagctttttagtggaataaaaataagcaaagttaataccccagaaaacgaagacataaacagtcttttacaaggacacacagaggaattgtttacccatctattagaaaccagacaacaactttttctttcaaatgagacaaggtacaaatga

SEQ ID NO: 13332 - protein, 156 aa, Unknown
  Obtained from environmental sample
  DOMAIN (32)...(120): Toprim domain
  misc_feature (1)..(156): Xaa is any amino acid
MYARSTSAESDSKHFYLKNSKGLYYRANKDTKQLIITESIIDFLSIYQIDEIRNNYDFLPIYGTNRLNQDHKTAISKLKQLQEIIFFLDGDLAGEEAIKKYSKDLHKLFSGIKISKVNTPENEDINSLLQGHTEELFTHLLETRQQLFLSNETRYK

SEQ ID NO: 13333 - DNA, 495 bp, Unknown
  Obtained from environmental sample
  misc_feature (1)..(495): n is a, c, g, or t
atgtttactgttaggcacaaacttttatccatggcagaaaattatattagatatcatggatcggcaaattttggagatggtgggcaagctcatgatttattagatgttattgatgaatacggatttgttccagaaaaagtttatgatggaaaaaatattggtttagagattcacaatcatggagaaatgacaacagttattaaaagtatgctggatgcaattcttaaaaagaaaagtggtaaacttacaccaaaatgggatgatgcaatagaatcagtactaaatatatatttaggtactcctcctgaaaaatttaaatacgatggaaaagaatttacaccaaaaacttttgtagaagaaacaggttttgatcctaaaaattatatagaaatcacatcttacaataatgctcctttttacgaaaaatataatttacaattaccagataactggacaaatactgaatattataatcttccaataaataaattatag

SEQ ID NO: 13334 - protein, 164 aa, Unknown
  Obtained from environmental sample
  misc_feature (1)..(164): Xaa is any amino acid
MFTVRHKLLSMAENYIRYHGSANFGDGGQAHDLLDVIDEYGFVPEKVYDGKNIGLEIHNHGEMTTVIKSMLDAILKKKSGKLTPKWDDAIESVLNIYLGTPPEKFKYDGKEFTPKTFVEETGFDPKNYIEITSYNNAPFYEKYNLQLPDNWTNTEYYNLPINKL

SEQ ID NO: 13335 - DNA, 681 bp, Unknown
  Obtained from environmental sample
  misc_feature (1)..(681): n is a, c, g, or t
atgagaatagcaaaaaagataggtttcataagagaaaaaatccgagacttgtttgttgataattttataacaagaaaagagaaagatatcttacttacgtctttgatgtactctgttgacaaaattgcaaatacggtagggcactacgactcttacataaaaaatgatatgagaagtgaagacttggttctcaagatgttagacatagatgcagatgtaaactctgagaataaagtttataacaaagatgcaaatcttttagttagagagatagaatgtgacgtcctataccttgatcctccctataattccagacagtattgtgatgcttaccaccttcttgaaaatttgtctctttggaacaaacccgaagtctttggagtagcgaagaaatttaacagaaaaaagataaaaagtgactactcaaatagacatgccactgagagttttgatgacttgattcaaaatgcaaagtgtaaatatattcttctttcttacaacaacatgggtgaaaaaggaaatattagaagtaatgctaaaattagtgatgaagagattattaaaagtatgtctaatcggggtgaagtaaaggtctttgagaaagactaccaagcctttacgactggaaaaagtaagcatattgataataaagagagagtattttttgttaaagtcaaataa

SEQ ID NO: 13336 - protein, 226 aa, Unknown
  Obtained from environmental sample
  misc_feature (1)..(226): Xaa is any amino acid
MRIAKKIGFIREKIRDLFVDNFITRKEKDILLTSLMYSVDKIANTVGHYDSYIKNDMRSEDLVLKMLDIDADVNSENKVYNKDANLLVREIECDVLYLDPPYNSRQYCDAYHLLENLSLWNKPEVFGVAKKFNRKKIKSDYSNRHATESFDDLIQNAKCKYILLSYNNMGEKGNIRSNAKISDEEIIKSMSNRGEVKVFEKDYQAFTTGKSKHIDNKERVFFVKVK

SEQ ID NO: 13337 - DNA, 603 bp, Unknown
  Obtained from environmental sample
  misc_feature (1)..(603): n is a, c, g, or t
gtgagcgtgcatagattatatgataactctaatatagaatcaattgttacctatgcaaataaattagttaataaaacaattgatgacatattaaaagtatctgagtatgaaaacaacttaaagattaaagataaaggtgctgttggtaagataatagaaaaacattggtttgatattgaaccaaataactctcctaagcctgactttgaaaaagttggagtcgaactaaaaataatcccactaataaaacaaaaaactaaaatagctgtaaaagagagaactaaagtttgcagtattgattataaaaaacttatttctgagagttgggataactcacatgcaaaagagaaacttaacaaagtcctatttatttattatctgtatgataaagaaaatataaaaaattcacaaattaaaaagattgatttatgggaattaagtcgaggaaataatgagtttattataaaagatgattggcttaatgttcaaaaaaaagttcatgagggtaatgctcatgaacttagtgaaagtcaatgtaaagtattagctgcatctagaagtggaagtggggctcacccgatcctggccctgccgcnnncttaa

SEQ ID NO: 13338 - protein, 200 aa, Unknown
  Obtained from environmental sample
  DOMAIN (56)...(158): DNA mismatch repair enzyme MutH
  misc_feature (1)..(200): Xaa is any amino acid
MSVHRLYDNSNIESIVTYANKLVNKTIDDILKVSEYENNLKIKDKGAVGKIIEKHWFDIEPNNSPKPDFEKVGVELKIIPLIKQKTKIAVKERTKVCSIDYKKLISESWDNSHAKEKLNKVLFIYYLYDKENIKNSQIKKIDLWELSRGNNEFIIKDDWLNVQKKVHEGNAHELSESQCKVLAASRSGSGAHPILALPXX

SEQ ID NO: 13339 - DNA, 876 bp, Unknown
  Obtained from environmental sample
  misc_feature (1)..(876): n is a, c, g, or t
atggtccggaattcggctcgagagggtggaattattaataaaaaaaaggatggaaaaagatatattcaaaatgtatctatttttgttataaaaaatgaattgaaagaagtaacaaattattgtgctcttgtatgggatataacaaatgaaaaaaaacgggacaaaataattgaagaacaaataaaaatgtcgtccatgggtgaaatgataggtaatatagcccaccaatggagacaacccttaagtgctattacaacatcatctactggattaaaagtaatgaaagaacatggagtattagatgatcaaagtttttttaaaaatttaaatcacatagaacatactgctcaatatctctctgaaactatagatatatttaaaaacttcctaaaagataaaaaagaatacaaagaggatatcttgcaaaatagagtaaataatgctttatgtattgtaaatgcaactttaacaaataattatatacaacttaaaaataacattgagaaagtagaatctttaaaagtaaaaataataacaggtgaactagaacaagttattataaacattataaataatgctaaagatgcaattttagaaaaaaaagtaaaagatccttggattgaaattaatttaaaaaaatgtaatggtttcgcaattttgacaatagaagataatgggcttggaattccagaagatgttttacccaaaatatttgaatcttatttcacaacaaanaatgaagaccaaggtacagggcttggtcttcatatgagttttaaaattatcaaagaaagtttaaatggtaatatttatgctaaaaacagtcataagggtgcaattttttatattgaattaccattatctgaatctagctaa

SEQ ID NO: 13340 - protein, 291 aa, Unknown
  Obtained from environmental sample
  DOMAIN (177)...(288): Histidine kinase-, DNA gyrase B-, and HSP90-like ATPase
  misc_feature (1)..(291): Xaa is any amino acid
MVRNSAREGGIINKKKDGKRYIQNVSIFVIKNELKEVTNYCALVWDITNEKKRDKIIEEQIKMSSMGEMIGNIAHQWRQPLSAITTSSTGLKVMKEHGVLDDQSFFKNLNHIEHTAQYLSETIDIFKNFLKDKKEYKEDILQNRVNNALCIVNATLTNNYIQLKNNIEKVESLKVKIITGELEQVIINIINNAKDAILEKKVKDPWIEINLKKCNGFAILTIEDNGLGIPEDVLPKIFESYFTTXNEDQGTGLGLHMSFKIIKESLNGNIYAKNSHKGAIFYIELPLSESS

SEQ ID NO: 13341 - DNA, 561 bp, Unknown
  Obtained from environmental sample
  misc_feature (1)..(561): n is a, c, g, or t
atgtacaattatttccctgaaaaagaacaacgaaaagaccgctttcaaatcagtaaatacgcttacggacaagattatcattttattataaaagataaacttaaaacttttttacgactactaattgatgaatttggagaaattaatgctcgtatttttaccgactcagcaccaattttagaaagagcttgggcaaaaaaaagcggattatgttgggtaggaaaaaacaccgtgctaatcaataaagaacaaggctcttttttcttcttagcagaaattattttagatgtagaattgcaatatgactctcctataaaagattattgcggctcttgcaccgcttgtattgatgcttgccctacagaagctattttacccaataatattattgacggaagcaaatgcctctcctattttaccatagagttaaaagaagaattacttccaaaagaacagactaaaaactttaatgatgtggatttttggttgcgatatttgtcaggatgtttgcccttggaacaggttttcaacacctcatcgaaaaccacttttcactcctaa

SEQ ID NO: 13342 - protein, 186 aa, Unknown
  Obtained from environmental sample
  DOMAIN (102)...(125): 4Fe-4S binding domain
  misc_feature (1)..(186): Xaa is any amino acid
MYNYFPEKEQRKDRFQISKYAYGQDYHFIIKDKLKTFLRLLIDEFGEINARIFTDSAPILERAWAKKSGLCWVGKNTVLINKEQGSFFFLAEIILDVELQYDSPIKDYCGSCTACIDACPTEAILPNNIIDGSKCLSYFTIELKEELLPKEQTKNFNDVDFWLRYLSGCLPLEQVFNTSSKTTFHS

SEQ ID NO: 13343 - DNA, 747 bp, Unknown
  Obtained from environmental sample
  misc_feature (1)..(747): n is a, c, g, or t
atgaacaagggaaaaaataattttgaaaacttggatgagtttatttatagaccagcaaataaagatacagactatgaaacaatatttttcacaaaagaggagttagaatatataaaaaataaaaaaagtgtaaaagtatgtgcacacacaaaagagtttccatttgtaatatttgataaagaagagatcagcggaacatcaatagagtttctaaaactaattaccaatatatctaaattaaattttgaaatagtacaatcaaaaagtcttccagagcatttaaaaatgataaaagatggtctgtgtgatgttgctcctattattgtaacaaaacctaatttacatgattttttaactcctacaagccctatattatctgatactatcgtgcttgttacaaaaatcaatgagccatatgttagtgatttaaatgatttacaaaataaaaaagttgctattcaaaaaggcgcaaagaatcttattaaatatgtaaactctatatatccaaatataaacttaatagagatagagggtcatgatttaaagaaaattgtaaatgaagagttttatggctatgtagctccttcttatcaaatgtcatacaaaatagcaactgaatactttaatgtgttgaaaattatgtctaaaattggggataaaaagaaagatggaagttttggaataactctacgtgagccagttttattatctatttttcaacaaaatctattgataaatatcttctga

SEQ ID NO: 13344 - protein, 248 aa, Unknown
  Obtained from environmental sample
  misc_feature (1)..(248): Xaa is any amino acid
MNKGKNNFENLDEFIYRPANKDTDYETIFFTKEELEYIKNKKSVKVCAHTKEFPFVIFDKEEISGTSIEFLKLITNISKLNFEIVQSKSLPEHLKMIKDGLCDVAPIIVTKPNLHDFLTPTSPILSDTIVLVTKINEPYVSDLNDLQNKKVAIQKGAKNLIKYVNSIYPNINLIEIEGHDLKKIVNEEFYGYVAPSYQMSYKIATEYFNVLKIMSKIGDKKKDGSFGITLREPVLLSIFQQNLLINIF

SEQ ID NO: 13345 - DNA, 618 bp, Unknown
  Obtained from environmental sample
  misc_feature (1)..(618): n is a, c, g, or t
gtgagaatttgtctgatacaacaagtaaactgggattcttttgtagaaatacatgctatccttaaggctcatgctgttaatttagaaaagattgtttctgatttacgattattgtcttctgatatttcgagtggggatattaatttaccaaacaaacaagttggtagttccattatgcctggtaaggtgaatccggtgatacctgagtatataatttcagtatctaataaagtatactcaaatgatcaattaatctctaatatggcagcaaaaggacaattggacttaaatgcatatttaccgattattggagatgctttaattgaaagtatagaattacttactagcgcagatattactttaaaagaaaatctattaaagggcttgaaggtgattgtgaataatgataaattatattttaagccatctataacaactgcattaattccttatattggatatcataaatcttcggaattatctaaaataatgaaggaagaatcaattaatgtgtttgatgctaattcaaaattattattacttgatactaataaattaaaggaagttttgagtgtagataaattgcttaaagcaggcttctctttaaatgagatttaa

SEQ ID NO: 13346 - protein, 205 aa, Unknown
  Obtained from environmental sample
  misc_feature (1)..(205): Xaa is any amino acid
MRICLIQQVNWDSFVEIHAILKAHAVNLEKIVSDLRLLSSDISSGDINLPNKQVGSSIMPGKVNPVIPEYIISVSNKVYSNDQLISNMAAKGQLDLNAYLPIIGDALIESIELLTSADITLKENLLKGLKVIVNNDKLYFKPSITTALIPYIGYHKSSELSKIMKEESINVFDANSKLLLLDTNKLKEVLSVDKLLKAGFSLNEI

SEQ ID NO: 13347 - DNA, 345 bp, Unknown
  Obtained from environmental sample
  misc_feature (1)..(345): n is a, c, g, or t
ttgctacttattctactgatttgtgcagtttactccgtgggatgtgctctagctattaacagtaaaaatttagggntctataaagatgatattttttatgatgatgacacaaagtctatttatcaaaatcaagaggagatacttttgagtaaaaaagaatctctatttgttgagttactcataaaaaataaaaatagtattacaagtaaagatgatatcaataattttatttgggaaaatgacattatgagtgaatcggcattgaaaaactttttgttaagagtaagaaaaaaagttggaaaagattttttttatacaattcagaatataggatatacattataa

SEQ ID NO: 13348 - protein, 114 aa, Unknown
  Obtained from environmental sample
  SIGNAL (1)...(18)
  DOMAIN (44)...(114): Transcriptional regulatory protein, C terminal
  misc_feature (1)..(114): Xaa is any amino acid
MLLILLICAVYSVGCALAINSKNLGXYKDDIFYDDDTKSIYQNQEEILLSKKESLFVELLIKNKNSITSKDDINNFIWENDIMSESALKNFLLRVRKKVGKDFFYTIQNIGYTL

SEQ ID NO: 13349 - DNA, 759 bp, Unknown
  Obtained from environmental sample
  misc_feature (1)..(759): n is a, c, g, or t
ttgatcagaatcggctcgaggaattcaaacnctcttagttataaagaattagaaaacctaacaaacaaagccataaaagaacttaatatcactattaatcaagaagcaatagaataccttatagtttcaagtagtggagatggtagagctttattaaacttaattgattttgcatctaaagtagataaagagataactatggagcttttaaaagagctaagagaaacatctatgggtgatggggttagtagttcccaaagccactatgatattataagtgctatgataaaatctatacgaggcagtgatgttgatgcagcattatattatcttgctcgacttattgatggtggagagagtgttgaatttatctgtagaagattagtgatacttgcgagtgaagatattggtaatgcaaacccaaatgcacttaatctagcttctagtacttatctgacaacttcaaaaatagggtatccagaatctagaatcatactctctcaatgtgtaatatatttagcatcatcaccaaaatcaaatagtgcttataatgcaattaatagtgctcttgagtttgtaaaaacagaacaactattagagataccaaaacatctacaagatagtcatatagggtataaatacccacatgattttggaggtttcgtaaaacaaaaatatctagaaaaaaatttaaaattttatgaaactaaaaaaattggttatgaaaaaacattaaaaagagtggctagaaaagattaa

SEQ ID NO: 13350 - protein, 252 aa, Unknown
  Obtained from environmental sample
  misc_feature (1)..(252): Xaa is any amino acid
MIRIGSRNSNXLSYKELENLTNKAIKELNITINQEAIEYLIVSSSGDGRALLNLIDFASKVDKEITMELLKELRETSMGDGVSSSQSHYDIISAMIKSIRGSDVDAALYYLARLIDGGESVEFICRRLVILASEDIGNANPNALNLASSTYLTTSKIGYPESRIILSQCVIYLASSPKSNSAYNAINSALEFVKTEQLLEIPKHLQDSHIGYKYPHDFGGFVKQKYLEKNLKFYETKKIGYEKTLKRVARKD

SEQ ID NO: 13351 - DNA, 870 bp, Unknown
  Obtained from environmental sample
  misc_feature (1)..(870): n is a, c, g, or t
ttgattaatggagaaactatttcttccttattacataaaagattaataattcgttcgggagcaaactataatatctattgggatatctatagagattatttagttacgggagaaataccaataattggagaaagctatttgttgaggcaaggagtaaatctatgtctagaagtatatttattatttgaagattctaaaaaagaaacaattgattccttacttgtaaaacattcaaaagatatcggtttagaaacactaaacaatattttgattgagttaagaaatcttggtatgattcagaaagaaaatgaatcttattatgttactaaaggtatccaaatttcaaaagaagggtttatcgattacactactttaaaatttcaaaattatacaccatatttagcattaaaaaaggcaagtcttaacaagatttcaaaaaatgacgtaatacctattttaaaaactattttcaagcaagaatatcaagataatacttgggacgcctatgcaaaaaacctaatcaattggtttttaatttcaaatcttgatattaaatccaaattagttattcctagaaaaggtagaggtaaaaacatacaaaaaattagtcaaaaagaattaaaaaactttcttccaaaaagttcacttaaagacattcttcaaactttaccattattgttgcttgataaaagttcaataagtagtaggttttatagagacttgttattactaaatgttattgatgaagacagaaatctaacaaaatttggtgatggaataatatttaaagatgaatctgaatgggaaggcattctacaaaaaaaatgtatggctttacctaaaatgcaacgacttaaggaaaatatttga

SEQ ID NO: 13352 - protein, 289 aa, Unknown
  Obtained from environmental sample
  misc_feature (1)..(289): Xaa is any amino acid
MINGETISSLLHKRLIIRSGANYNIYWDIYRDYLVTGEIPIIGESYLLRQGVNLCLEVYLLFEDSKKETIDSLLVKHSKDIGLETLNNILIELRNLGMIQKENESYYVTKGIQISKEGFIDYTTLKFQNYTPYLALKKASLNKISKNDVIPILKTIFKQEYQDNTWDAYAKNLINWFLISNLDIKSKLVIPRKGRGKNIQKISQKELKNFLPKSSLKDILQTLPLLLLDKSSISSRFYRDLLLLNVIDEDRNLTKFGDGIIFKDESEWEGILQKKCMALPKMQRLKENI

SEQ ID NO: 13353 - DNA, 633 bp, Unknown
  Obtained from environmental sample
  misc_feature (1)..(633): n is a, c, g, or t
atgttaaaatcaaataatatagttaaaaggtggttaaaaatggtagcaaatattttttttggaagcaatgaagtttcaagaaatactctccttaagagtataataaatccttataataaagaggtggtttcacagtatcctatatgtacaaaagaggatacattagaagttcttactattgcacaaaaagcaagtatagatacaaaagcttctaaactatctcaaagaatttcatggcttgaggatgtagcaaaaaaacttgaggagaaccttgaagatatagcaaaaaccttatgtgatgaagttggaaaacctattacatttgcaagagtagaggtacaaagatgtattgaaactgtcaaattaagttgtcatgcaatgattaacttaaatggtcacacaattaatacagatgcaatgccaagtggtgtaaaaacaacagcttattacacaagagttcctgttggtgttgtcgcttgtattacaccttttaattttccccttaatcttgtagcacacaagatagctcctgctcttgtaagtggtaatgcggtagtacttagccaactccggaagcaccacttactgcgtataaatttgcgaaactatttatcgaatcaaaatatgcaataa

SEQ ID NO: 13354 - protein, 210 aa, Unknown
  Obtained from environmental sample
  misc_feature (1)..(210): Xaa is any amino acid
MLKSNNIVKRWLKMVANIFFGSNEVSRNTLLKSIINPYNKEVVSQYPICTKEDTLEVLTIAQKASIDTKASKLSQRISWLEDVAKKLEENLEDIAKTLCDEVGKPITFARVEVQRCIETVKLSCHAMINLNGHTINTDAMPSGVKTTAYYTRVPVGVVACITPFNFPLNLVAHKIAPALVSGNAVVLSQLRKHHLLRINLRNYLSNQNMQ

SEQ ID NO: 13355 - DNA, 930 bp, Unknown
  Obtained from environmental sample
  misc_feature (1)..(930): n is a, c, g, or t
ttgccaatatcatttgatgagaaccctttgaaaatagaagaattagaaactacttatcaaatgggtgaagatgaaaagcttggatataaccctatagaaaagtacttaaaagcacagcaactatttaacaaactaattgaaaaatacacagaagacgaagcaattgataaaattaaagattggatgggagagtcaaaagaaaagataaaagactatcttaaaattgtagagttaattgatgaatatttagcataccttgaatatgatggaatatatgctatggctgatacacctagtgatggtaaagaagacctatttttacatctaaaaaaatggatactgaaatattttgataaacaaagttcagatggatttgatggatatactaattttgatgtagaagaattaaaattcatatgttttgattacattagagcgaaaattggaagatcctacgatggtaaactatttagggaaattgctgatggaagaaaagggaatcatttttttggtgacaaagagatttggaaagagtttaaagaaaaacataataatattgtaacttctcatattaaaagaattgatactgaaatgcctatagattctagttcaaaaaatattgaaagtcatttatcctcaagagatactgaatttaagaattctgttattgacgaattagaagataacatagctcaatataaaacagaacttggttataaaagagcttctatacaacctatgaaacttactaatgatgctaaaaaagcattatcagcaatagatagaaaaaataaaagttttgaagataaggatgttctatatgatgttgcaaaagttagtgaagttacagcagatttattaagaacaaaatctataacatctttaattgatcaacttatgtatacttttagtgcttttaaaaaatattga

SEQ ID NO: 13356 - protein, 309 aa, Unknown
  Obtained from environmental sample
  misc_feature (1)..(309): Xaa is any amino acid
MPISFDENPLKIEELETTYQMGEDEKLGYNPIEKYLKAQQLFNKLIEKYTEDEAIDKIKDWMGESKEKIKDYLKIVELIDEYLAYLEYDGIYAMADTPSDGKEDLFLHLKKWILKYFDKQSSDGFDGYTNFDVEELKFICFDYIRAKIGRSYDGKLFREIADGRKGNHFFGDKEIWKEFKEKHNNIVTSHIKRIDTEMPIDSSSKNIESHLSSRDTEFKNSVIDELEDNIAQYKTELGYKRASIQPMKLTNDAKKALSAIDRKNKSFEDKDVLYDVAKVSEVTADLLRTKSITSLIDQLMYTFSAFKKY

SEQ ID NO: 13357 - DNA, 900 bp, Unknown
  Obtained from environmental sample
  misc_feature (1)..(900): n is a, c, g, or t
atggaagagtatgtgtacactactaaaacagactctaaaggtattataactgaggtaagtgactctttttgtagacttacaggttataaaaaagatgaacttatcgaaaaaaaccacaatataatccgtcatcctgagatgaataaagccaaatttaaagagctatggaaaacaattgaaaatgaggatatttgggaaggtgatattcgcagtataaaaaaaaatggcatatctttttggatgcgtgtcattatctttccacgttacaatattcaaaaaaagcttataggttactcttcaattcgtcataatattacggccgctaaagagttggagatagaagtaattcatgatagtcttacaagtctttttaatcgtagatactatgatgaaattatcgaaagagaactcatgcgtgccaaaagagaaaaagtacattttacttttgttatgatggatatagattattttaaactttataatgacacttatgggcatcagcaaggtgataatgtattaagagagatcggtaaattactaaaaaagaaactcaatagaggaagtgatttttgcttcagattaggcggtgaagagtttggattcttttttatagggcaatcactagaagagtctactatttttaccaaagaagtgtgtaaagctattgaaaatcttcacattacacactcaaaaaatagtgccagtcaatatgtaacagcctcatttggtcttgtaaatgttgatatgcaaagtgtgattagtgatgaacaagctctatatatagcagcagattatgccttctatagcgcaaaagattcaggtcgtaatagggttatggtttttaaaaatgaaaaaattgaactttttttaactattaactttttaccctcagaggattaa

SEQ ID NO: 13358 - protein, 299 aa, Unknown
  Obtained from environmental sample
  DOMAIN (111)...(277): GGDEF domain
  misc_feature (1)..(299): Xaa is any amino acid
MEEYVYTTKTDSKGIITEVSDSFCRLTGYKKDELIEKNHNIIRHPEMNKAKFKELWKTIENEDIWEGDIRSIKKNGISFWMRVIIFPRYNIQKKLIGYSSIRHNITAAKELEIEVIHDSLTSLFNRRYYDEIIERELMRAKREKVHFTFVMMDIDYFKLYNDTYGHQQGDNVLREIGKLLKKKLNRGSDFCFRLGGEEFGFFFIGQSLEESTIFTKEVCKAIENLHITHSKNSASQYVTASFGLVNVDMQSVISDEQALYIAADYAFYSAKDSGRNRVMVFKNEKIELFLTINFLPSED

SEQ ID NO: 13359 - DNA, 804 bp, Unknown
  Obtained from environmental sample
  misc_feature (1)..(804): n is a, c, g, or t
ttgcatttatacctatatacttttatcttgatgcctncttttgaaaatcaaaatattaaagataaaatgatgttaaaaaactatagttcctctgtagtttccaaaataagactttttgaagaggaaaacagtgactttttttactatccaaggtctaacatttttacctctgctatttttgatgaaaaaaacaaacctatcttttcactttttaatgcaaatgataaatttacttttgagagtgagttttttaatgatttaaaaaaaatatgtcataaacaatatctacaaaataatatatttggagcaaaatatattattacttgcaaagacattaataactcccaagtgatatataatactattattcttattcttactatgacttgtttaatatttttatcctcatttttcactattaaacaaagtacagaaccttataaaaaactcaatcattatcttgatgactttttaaaagatgcgatgcatgaacttaaaacgcctattggtgttgcaagggtaaatattgacctattacagatgagaataaaagaggataaacatcttctacggataaaatcagctttgaaaaacatgagtataatctatgaagatttagaatattatatgcaacgatttagtggaatagaagagaaaaaagatatagatttgtctttatttttagataaaagagttgactttttcaatgatttagncacagcaaaaaatattaacctcataagagatattcaatctaatatcatacttcattttaacgagatagaactttatagaaatcattga

SEQ ID NO: 13360 - protein, 267 aa, Unknown
  Obtained from environmental sample
  DOMAIN (153)...(214): His Kinase A (phosphoacceptor) domain
  misc_feature (1)..(267): Xaa is any amino acid
MHLYLYTFILMPXFENQNIKDKMMLKNYSSSVVSKIRLFEEENSDFFYYPRSNIFTSAIFDEKNKPIFSLFNANDKFTFESEFFNDLKKICHKQYLQNNIFGAKYIITCKDINNSQVIYNTIILILTMTCLIFLSSFFTIKQSTEPYKKLNHYLDDFLKDAMHELKTPIGVARVNIDLLQMRIKEDKHLLRIKSALKNMSIIYEDLEYYMQRFSGIEEKKDIDLSLFLDKRVDFFNDLXTAKNINLIRDIQSNIILHFNEIELYRNH

SEQ ID NO: 13361 - DNA, 696 bp, Unknown
  Obtained from environmental sample
  misc_feature (1)..(696): n is a, c, g, or t
atgcctgttgagggtaatatagatgctccagactttaaatatggtgcacttatttggagaacttttggaaacttgatagtaaaagcagtagcatctccgtttaaatttttagggtctatgatggggatagacggtgaaaagctctcttttgtagagtttgaacctggactaacgacgatccttcccccagaaaaagagaaacttgataacatcgtaaaactgatggtaaaaagaccaaagatatctttaaaaattgttccacaatacgataaagttcaagatacttggaaactaaaacaagaaaaatttattcagagtgttatgaaaaaaagtggagtgaaaaacaaaaaagagcacctaagtgctgtgaatgttgacttattagaaaatatctatgaagagttagctccaaagaaaaaaccagagttgataaaaaagagtttagaaaaaacatacaagggtgatacactaaaaagagcatacttaaatgctcttataaaagagactacaaagatgcaaacagtaacaccacaagatcttcaggcactggcacttaaaagaacaaatcttttaatagaatatcttgttactcaaaagggtatagatgctaaaagaatagtacctcaaaaagttcagaatattgaggaagtacaagatagttgggttagaactaaactagagattgatatcaagtag

SEQ ID NO: 13362 - protein, 231 aa, Unknown
  Obtained from environmental sample
  misc_feature (1)..(231): Xaa is any amino acid
MPVEGNIDAPDFKYGALIWRTFGNLIVKAVASPFKFLGSMMGIDGEKLSFVEFEPGLTTILPPEKEKLDNIVKLMVKRPKISLKIVPQYDKVQDTWKLKQEKFIQSVMKKSGVKNKKEHLSAVNVDLLENIYEELAPKKKPELIKKSLEKTYKGDTLKRAYLNALIKETTKMQTVTPQDLQALALKRTNLLIEYLVTQKGIDAKRIVPQKVQNIEEVQDSWVRTKLEIDIK

SEQ ID NO: 13363 - DNA, 654 bp, Unknown
  Obtained from environmental sample
  misc_feature (1)..(654): n is a, c, g, or t
atgtatttttacagttttaaaattaaatttgatttaatagatatgaaaattatttgcataggtagaaactacattgatcatgctaaggaactgaataatcccgtaccgaaagaacctgtcttttttattaaacccgataccgctttgttgcctaaaagaaatccttttgtttatcctagttttactaaagatttacattatgaagtagaaattgtattgagaattaatagaatagggaagcatatagaggaaaaatttgctcacaaatattacaatgaaataggagtgggggtagattttactgccagagatgtgcaacagcaatgtaaggaaaaagggttgccttgggaaaaagccaaagcttttgatttttctgctccaacaagtgattttgtttctattaaaaactttaaagatattaatcaactgaattttgaactaaaagtaaatgacgaactaaggcaaaaaggaaataccaaagacatgttatttaattttaatcagatagttgcttatgtatctcaatttgtaacgcttaaaattggcgattatatttacacaggaactcccgcaggtgttggtgctgttaaattaaatgataaaataacttgttttattgagaatgaaaaaatgttggagtttaatgtgaaatag

SEQ ID NO: 13364 - protein, 217 aa, Unknown
  Obtained from environmental sample
  DOMAIN (31)...(198): Fumarylacetoacetate (FAA) hydrolase family
  misc_feature (1)..(217): Xaa is any amino acid
MYFYSFKIKFDLIDMKIICIGRNYIDHAKELNNPVPKEPVFFIKPDTALLPKRNPFVYPSFTKDLHYEVEIVLRINRIGKHIEEKFAHKYYNEIGVGVDFTARDVQQQCKEKGLPWEKAKAFDFSAPTSDFVSIKNFKDINQLNFELKVNDELRQKGNTKDMLFNFNQIVAYVSQFVTLKIGDYIYTGTPAGVGAVKLNDKITCFIENEKMLEFNVK

SEQ ID NO: 13365 - DNA, 771 bp, Unknown
  Obtained from environmental sample
  misc_feature (1)..(771): n is a, c, g, or t
gtgttaagttacagacaaattcaaaataacattaatcaaacagataattcaatacaaaagcagcaaatagctaaattagaaggtgttgattatcaggatatttttgtcccatcttttttgaaattaagaacattgaaaggaaagtttgctataaagtctaatagcacggttttttcttttcctattatgaatatttcattgcctgccgaatattcattttatgcttatcctagcttggataacgaagtttatcttgttgcaaaagttgctgaatgggatacacttggtttagtagatggtattgcgaatgttacttacaataaaaactctgttggtaaaaccatattaaagtttagtgacttttctgatactttactactttctgttggtaaagacaatagtatttattttaaaagaactgaaattgaaaataagaaatatgctaaagaagtaacgtttggcaaaaagaaaaaaataacttttgcctacgaatttcaattaaaaaacaacaaccaacacgatgttactattgagttttttgaacaagtgcctatttctcaaactaaaacaactaatgttattttagaacaattgtcagaaggtgttcatgatgaagaacaaggggaaattagttggaaaattaatttaacccctggaaaactcttaaaaaaacaattgatttatactgttgaatacgaggggagtagttttagtttctcaaaacgtaaatctgctaaatatagagcagttagttcaccaagattcttatag

SEQ ID NO: 13366 - protein, 256 aa, Unknown
  Obtained from environmental sample
  misc_feature (1)..(256): Xaa is any amino acid
MLSYRQIQNNINQTDNSIQKQQIAKLEGVDYQDIFVPSFLKLRTLKGKFAIKSNSTVFSFPIMNISLPAEYSFYAYPSLDNEVYLVAKVAEWDTLGLVDGIANVTYNKNSVGKTILKFSDFSDTLLLSVGKDNSIYFKRTEIENKKYAKEVTFGKKKKITFAYEFQLKNNNQHDVTIEFFEQVPISQTKTTNVILEQLSEGVHDEEQGEISWKINLTPGKLLKKQLIYTVEYEGSSFSFSKRKSAKYRAVSSPRFL

SEQ ID NO: 13367 - DNA, 813 bp, Unknown
  Obtained from environmental sample
  misc_feature (1)..(813): n is a, c, g, or t
atgcttgaacattatgttgttgaacactatgtagagcatataaaatggcttatcaatcttgcacaaaacattaaagataccaatataaattcttttcctcaaacagacaaaacattgtgcaattttggaaaatggttagcacaagatggatcaaatattattaaaaataattcaaaacttaaagagttagaaaaggttcattctcagattcattatatatcatcacaaattaaacatattttaacacttaatgatcataattatgactatgatatattgttaacatatcttgaaaaatgcgaacttttatcactttctataggtacagaacttgctctcatagataatacaattgtcaatcaaaaagctgctaaagacacattaactggtgcattagggagacaagtattagaacaaatatttcaaaatcaatatgagatttcattagcaacctcatcaaaatttgtagtagcaatgtttgatttagattattttaaaaaaatcaatgataattatggacatattgctggagataaagtgttacaagaatttattattattgttaaatctcatattagaaattcagatattattattcgatatggtggggaagaatttgtattaatcttacccgcaataactactaaagatgcctataatgttttagaaaaaattcgaaaaagtttcgagaattttactctctcttttgaaaataataatattaatacaactgtaagtataggtatgattgaaattgaagctaaagatagttataataagcatttattggaagaatatatcccatttagctga

SEQ ID NO: 13368 - protein, 270 aa, Unknown
  Obtained from environmental sample
  DOMAIN (119)...(261): GGDEF domain
  misc_feature (1)..(270): Xaa is any amino acid
MLEHYVVEHYVEHIKWLINLAQNIKDTNINSFPQTDKTLCNFGKWLAQDGSNIIKNNSKLKELEKVHSQIHYISSQIKHILTLNDHNYDYDILLTYLEKCELLSLSIGTELALIDNTIVNQKAAKDTLTGALGRQVLEQIFQNQYEISLATSSKFVVAMFDLDYFKKINDNYGHIAGDKVLQEFIIIVKSHIRNSDIIIRYGGEEFVLILPAITTKDAYNVLEKIRKSFENFTLSFENNNINTTVSIGMIEIEAKDSYNKHLLEEYIPFS

SEQ ID NO: 13369 - DNA, 645 bp, Unknown
  Obtained from environmental sample
  misc_feature (1)..(645): n is a, c, g, or t
atgagagtaatagaaatctttaaagagataacaaaaatcccccgatgtagtggtacttttgaaccatttataaactatataaaagagtttgcaacaaaaaataactatatatgtaaagtggatagtgcaaacaatatattatgttataaagagaatacaaaaatagaattatgtttacaatcacactatgatatggtgtgtttagaagatgggaaaataccaactattatagaagaagatggttatttaaaagcaaaagattctacacttggagctgacaatggaatagggtgtgcttatatgttagctttgatggaagagggggaaagtgtagagctacttttcacaagtgatgaagaggttggactaataggggcaaacaatatagaaattgaacttcaatcatcaaaaatgttaaatcttgatagtgaagcgcaaggtgaaatttgtataggatgtgctggtggaattgatatatttgggataaataacaaaggtgaatatctaaaaaacaaagaccataaaaagctttatgagataacaattgataatcttgatggtggacatagtggagttgatatagacaaaaatatcccaaatgctttgaaacttatgacaaaacctattaaagaagggggaggctga

SEQ ID NO: 13370 - protein, 214 aa, Unknown
  Obtained from environmental sample
  DOMAIN (56)...(135): Peptidase family M20/M25/M40
  misc_feature (1)..(214): Xaa is any amino acid
MRVIEIFKEITKIPRCSGTFEPFINYIKEFATKNNYICKVDSANNILCYKENTKIELCLQSHYDMVCLEDGKIPTIIEEDGYLKAKDSTLGADNGIGCAYMLALMEEGESVELLFTSDEEVGLIGANNIEIELQSSKMLNLDSEAQGEICIGCAGGIDIFGINNKGEYLKNKDHKKLYEITIDNLDGGHSGVDIDKNIPNALKLMTKPIKEGGG

SEQ ID NO: 13371 - DNA, 591 bp, Unknown
  Obtained from environmental sample
  misc_feature (1)..(591): n is a, c, g, or t
ttgttggggatagatttggatccaatatctgtagagacatcaaaagagaatattaaaacggtctcatcttgggataattcggtgaataaagatgccatatctttcaaggagggatcaatacttgaggattgttcaggtctgggacagtttgatattgtttatagctggggggtgttgcatcataccggcgatatgtataaggcgctgaataatgcttcgaaacatgttaagtctggcgggaaactaattatttcaatttacaataaacattttacatcaaaatcatggaaacaaatgaaaaagctgtataacaatagcccaaaagtgataaagatgtttctttttctgatcacttatattgttaaaggggcaggtgtctggatcacacaggggaaaaatccttttcgaaagagtagaggcatgaatttttattttgatatctatgactggataggaggctatccctatgaatatgcttccattgaggaaataagatcattttttgaaaaattaaactttaaggtattagaggtcagacagacaaaagggtttaccggatgcaacgaatttattatcgctaaggagcagtaa

SEQ ID NO: 13372 - protein, 196 aa, Unknown
  Obtained from environmental sample
  misc_feature (1)..(196): Xaa is any amino acid
MLGIDLDPISVETSKENIKTVSSWDNSVNKDAISFKEGSILEDCSGLGQFDIVYSWGVLHHTGDMYKALNNASKHVKSGGKLIISIYNKHFTSKSWKQMKKLYNNSPKVIKMFLFLITYIVKGAGVWITQGKNPFRKSRGMNFYFDIYDWIGGYPYEYASIEEIRSFFEKLNFKVLEVRQTKGFTGCNEFIIAKEQ

SEQ ID NO: 13373 - DNA, 612 bp, Unknown
  Obtained from environmental sample
  misc_feature (1)..(612): n is a, c, g, or t
atgcggggaatatatcgaaccatgaaagagggcgattacgatatagcgcatttacatctgtatttttctaattttctcggacgtattatagcgggcctattttttaggagtaagattaaaatactagttcataaacataacaatcttgataccgattttgggaagtatataatctttccattgatagtttttatggaaaaagtcatgttttccttcacggatcttgttctgtgctgttctgactttgtcagggattattatattaatgatctgggatttgaaagcaaaaaatgtattacgttttataacggtattgaccttgaacacttagatcaggaagcggatgaattgccgccaaggatccgcgaggtcctaaataacagaaaaacaggcgctatggtgtttggttttcttgctaggctcaattacaaaaaagccgcggattatctgatagaagggtttaatgggtttttaaggaaaaactccgaaaacaagaagcatattttgttgatagccgggtatggcaaagaaaaagagaggcttgaaaagctagtaaaagacctggatcttgaggggaatgtatattttcttgggaaaacgaccagaaaatag

SEQ ID NO: 13374 - protein, 203 aa, Unknown
  Obtained from environmental sample
  misc_feature (1)..(203): Xaa is any amino acid
MRGIYRTMKEGDYDIAHLHLYFSNFLGRIIAGLFFRSKIKILVHKHNNLDTDFGKYIIFPLIVFMEKVMFSFTDLVLCCSDFVRDYYINDLGFESKKCITFYNGIDLEHLDQEADELPPRIREVLNNRKTGAMVFGFLARLNYKKAADYLIEGFNGFLRKNSENKKHILLIAGYGKEKERLEKLVKDLDLEGNVYFLGKTTRK

SEQ ID NO: 13375 - DNA, 588 bp, Unknown
  Obtained from environmental sample
  misc_feature (1)..(588): n is a, c, g, or t
ttgaaacatccaaaactcactttagagggtgggatatttttatatgacttctatactttgttaaaagagttaaaaaggatacaaaatccaaataatatgataaaacatatccaaaatcacaagttttttaaaactattctagatacaataacaactgctcgtgcaaaacaaaaagatggaacgatcaacgaaactataaaacaaagtgcctcttttaaagccaatcgaagagtagaaacactaaagcaattatcagctagacacaacaatcttggcaattttataaatgctatgatattaggtggtggagagatgagtgagggtggtggtgttaacctactctcagttcatgctagtaaaggtttagaatttaatgaggtttatgtggttgatttgatggatgggagatttccaaaccgaactttgatgagtaagggtggaagtttagaggaagaaaggcgacttttttatgttgcggtaacacgagcaaaggatattttatatttaagttatgcaacttacgatagaataaagaaattagattttatacatagtccttttttagtggaagctggacttgtacaatag

SEQ ID NO: 13376 - protein, 195 aa, Unknown
  Obtained from environmental sample
  misc_feature (1)..(195): Xaa is any amino acid
MKHPKLTLEGGIFLYDFYTLLKELKRIQNPNNMIKHIQNHKFFKTILDTITTARAKQKDGTINETIKQSASFKANRRVETLKQLSARHNNLGNFINAMILGGGEMSEGGGVNLLSVHASKGLEFNEVYVVDLMDGRFPNRTLMSKGGSLEEERRLFYVAVTRAKDILYLSYATYDRIKKLDFIHSPFLVEAGLVQ

SEQ ID NO: 13377 - DNA, 765 bp, Unknown
  Obtained from environmental sample
  misc_feature (1)..(765): n is a, c, g, or t
ttgggatgtgaaaattgtaccgaaggctatgatagagctttaaaaagaatatttttatccattttgggaatgatttctgttcgggattgcgtaaaaagacttaagaaaaatcctaaaagagtcttggactgcaaagtaaaaacatgtaagtttattgccgaagatgctccatccatgcttgattatctagatgaagaatgctcttctcatttcgataaagttcaagaatacttaaaacagatgaaaattccatttatcgtaaatccgaagatcgtaagaggattggattattattcacaaactgcgttcgaatttatcgatacgaatctgggagctcagaatacactcattggtggtggaagatacgataaattagctgaacagctgggtgggaaaaacctgccgggtataggctttgccggtggttttgaaaggttgctgctttctatggaagaagaaaaactctcttttgggaaacctgtaaatcctaaagtttactttatagtgctaggtgatgaagctagagcaactgctttcagattaataaataatcttagattaagtggtatctctgtagaattcaattctgacaaaacttccatgaatgcacagatgaaaatggcaaataaaacaggcgctgaatttgccttgatcctgggtgaagatgaactgaaaaaaggtaagatcattaagaaaaatcttgctgatggtgaacaagaaaatgttgatcttgatgatattgttaacaacttgaaaggtaagtaa

SEQ ID NO: 13378 - protein, 254 aa, Unknown
  Obtained from environmental sample
  DOMAIN (164)...(254): Anticodon binding domain
  misc_feature (1)..(254): Xaa is any amino acid
MGCENCTEGYDRALKRIFLSILGMISVRDCVKRLKKNPKRVLDCKVKTCKFIAEDAPSMLDYLDEECSSHFDKVQEYLKQMKIPFIVNPKIVRGLDYYSQTAFEFIDTNLGAQNTLIGGGRYDKLAEQLGGKNLPGIGFAGGFERLLLSMEEEKLSFGKPVNPKVYFIVLGDEARATAFRLINNLRLSGISVEFNSDKTSMNAQMKMANKTGAEFALILGEDELKKGKIIKKNLADGEQENVDLDDIVNNLKGK

SEQ ID NO: 13379 - DNA, 456 bp, Unknown
  Obtained from environmental sample
  misc_feature (1)..(456): n is a, c, g, or t
atgtcaaaacttgagattatcaatgataacaatgattttattgttgttaataaaactgccggactcattactgaaaaaagtctctacgaaaaccttactatagaggatcaagtatttcaacatattttgaaaactaagcgaaaaccttatgttggagtaattcataggttagatagagtaacgagtggagttttaatttttgcgaagaaaaaaagtatactatcctcttttaatacgctttttagttcccgtaaggttcataaaacatatctcgccattgttaaaaataaaccttcaaaaagtagtggtaatttggttaattttcttgtgaagaatactttagagaaaaaagctgatattgttaaatctaaaacgaaacagagtttaaattgtagattgtcttataaagtcatgaatcaaaacgattttggtttacctcctagaaatacgacctaa

SEQ ID NO: 13380 - protein, 151 aa, Unknown
  Obtained from environmental sample
  DOMAIN (12)...(135): RNA pseudouridylate synthase
  misc_feature (1)..(151): Xaa is any amino acid
MSKLEIINDNNDFIVVNKTAGLITEKSLYENLTIEDQVFQHILKTKRKPYVGVIHRLDRVTSGVLIFAKKKSILSSFNTLFSSRKVHKTYLAIVKNKPSKSSGNLVNFLVKNTLEKKADIVKSKTKQSLNCRLSYKVMNQNDFGLPPRNTT

SEQ ID NO: 13381 - DNA, 804 bp, Unknown
  Obtained from environmental sample
  misc_feature (1)..(804): n is a, c, g, or t
atgttcactattgaatcagacactcttgatttaatgcaaaaaagaacactgcttgattgggtcataaacaaaagaattcgttctattgacggtgttgccgacacaaatgcacttggtggatatgtgaaaacttatgagatagttcctgattttgcaaagatgaagctatataaaatcaatatgaaattattgcaagaaattttaagcgagaataacaaaaatgatggagtaggaagactttctattggtgagcaaagtttgtttatacgttctgagggaagacttaaaaacttagaagatatctcaaagctgatagtcaagtatgaaaatggtagaaatatcagagtttcagatatagcagaggtaaaaatcggttcacttactagaggtggctttgtaacaaaagatggaaaagaagaagctgtacaaggtttaatactctcaagaaaaggtgttgatacatcaggagttttaaaaagagtaaaagcagaacttgaaaaaatagaaaaagacttaccaaaaggtacatctttaaatatcttttacgaccgttcagatttggtttcaaaagctatagagactgtgtcanaagcacttatagaagcacttgttcttatagttatagtcttgtttttatttttaggaaacttagggtcagcatttagtgtagctattattttaccttttgcaggaatgatgacatttcttgcaatgagttattttggcattagtgcaaacttaatgagtttaggcggtttagccatcgcaattggtatgctcgtagatgcaggtgtggtatggtag

SEQ ID NO: 13382 - protein, 267 aa, Unknown
  Obtained from environmental sample
  misc_feature (1)..(267): Xaa is any amino acid
MFTIESDTLDLMQKRTLLDWVINKRIRSIDGVADTNALGGYVKTYEIVPDFAKMKLYKINMKLLQEILSENNKNDGVGRLSIGEQSLFIRSEGRLKNLEDISKLIVKYENGRNIRVSDIAEVKIGSLTRGGFVTKDGKEEAVQGLILSRKGVDTSGVLKRVKAELEKIEKDLPKGTSLNIFYDRSDLVSKAIETVSXALIEALVLIVIVLFLFLGNLGSAFSVAIILPFAGMMTFLAMSYFGISANLMSLGGLAIAIGMLVDAGVVW

SEQ ID NO: 13383 - DNA, 351 bp, Unknown
  Obtained from environmental sample
  misc_feature (1)..(351): n is a, c, g, or t
atgattcagggtggcggctttgataaatcagaaaaaagaaaagtgcctttggctccgatcaaaaatgaagcaggtaatggtttgataaaccaaaaagggagtatctctatggcacgcactggtgttgtagatagtgcaacctgccaattttttattaatctggctgataataagtctctaaatcatcgcgggacatcttccagagattttggttatgccgtttttggacaagttatcgttgggatggatgtcgttgaaaagataggtaaggtgaaaacgatttccaaaagcgctctctttagggactatcccgagccacaggtcattattgagtctattcgcaggctctga

SEQ ID NO: 13384 - protein, 116 aa, Unknown
  Obtained from environmental sample
  DOMAIN (1)...(116): Cyclophilin type peptidyl-prolyl cis-trans isomerase
  misc_feature (1)..(116): Xaa is any amino acid
MIQGGGFDKSEKRKVPLAPIKNEAGNGLINQKGSISMARTGVVDSATCQFFINLADNKSLNHRGTSSRDFGYAVFGQVIVGMDVVEKIGKVKTISKSALFRDYPEPQVIIESIRRL

SEQ ID NO: 13385 - DNA, 399 bp, Unknown
  Obtained from environmental sample
  misc_feature (1)..(399): n is a, c, g, or t
gtgactcttcgcatcatggagtggcaggcatttttgaatatggttgtattccctagaaaatttgagagtgtacttctgggctggtcgctctcactttcacctgatccatatctgctatggcatagtgagagtgataaaaaaggtggatttaactttatcggttatagaaataaaaaagtcgataaattaatagataaaatgcagtatatgatagatagagaggagttggcaaagatacaaaaagagatatttagctctattgtagaagatgatccatatctttttctttttattccaaacgatataacagttgcagataaaaatattttaaatatagaaccgacaattaacggtatttggcataactatatcaaatgggaaaagcagaggattaagtag

SEQ ID NO: 13386 - protein, 132 aa, Unknown
  Obtained from environmental sample
  misc_feature (1)..(132): Xaa is any amino acid
MTLRIMEWQAFLNMVVFPRKFESVLLGWSLSLSPDPYLLWHSESDKKGGFNFIGYRNKKVDKLIDKMQYMIDREELAKIQKEIFSSIVEDDPYLFLFIPNDITVADKNILNIEPTINGIWHNYIKWEKQRIK

SEQ ID NO: 13387 - DNA, 834 bp, Unknown
  Obtained from environmental sample
  misc_feature (1)..(834): n is a, c, g, or t
ttggcgattgtcacaaatgcaaaagagttaatatatacaaacgatacaatccttaatcttctaggttatgaatctatagatgattttaaaaaagattatgattgtgtctgtgagctttttgtagcagatgaagatgattatttagcacccatgatggatggtatgacttgggtagagtaccttttaaaacatcaaaatagagagaatttaaaagctaaatttattatcaatgattttacaaggatttatgcggttcatgcaaaaactatctcacattatggtgagaatctatatcttgtaatatttgatgagattactgatgttttaaaagagagagaaaatcttaaaaatgttgcgtttaccgactctttaacaaatataactaacagaagacgttttagtgaacttttagatatagagtttaagtattcaaaagaggcatatagagatctctctttgctttttatagatattgatcattttaaaactataaacgatacatttgggcacgaagagggtgatgaagtactgaaaaagatatctaaaattttaaaagagaatatcagaaaacatgatattttagctagatggggcggagaggaatttattgttttgcttcctctatcagatggaaatgaagcttatatgttggcagaaaagttgagaatattggtagaagggtttgcttttagtgcaaaatatagtgttgaaatttcggtaggtatttcacaattaaaagagaatgattctacaaaagattttatttctcgtgctgatggtgctctctatgcagctaaaaatagcggccgaaatcaagtaaagatgggcatatag

SEQ ID NO: 13388 - protein, 277 aa, Unknown
  Obtained from environmental sample
  DOMAIN (115)...(272): GGDEF domain
  misc_feature (1)..(277): Xaa is any amino acid
MAIVTNAKELIYTNDTILNLLGYESIDDFKKDYDCVCELFVADEDDYLAPMMDGMTWVEYLLKHQNRENLKAKFIINDFTRIYAVHAKTISHYGENLYLVIFDEITDVLKERENLKNVAFTDSLTNITNRRRFSELLDIEFKYSKEAYRDLSLLFIDIDHFKTINDTFGHEEGDEVLKKISKILKENIRKHDILARWGGEEFIVLLPLSDGNEAYMLAEKLRILVEGFAFSAKYSVEISVGISQLKENDSTKDFISRADGALYAAKNSGRNQVKMGI

SEQ ID NO: 13389 - DNA, 573 bp, Unknown
  Obtained from environmental sample
  misc_feature (1)..(573): n is a, c, g, or t
ttgaatatccttacacagatattagggaaaaaagttattccagaatatgtttatttttcttattctaagcaaaatgagttgatgaagtatgaagaaatctttggtaaaaaactttattttgaaaaagatgaaaatgcaattttctttaaaaaaacagaattaaatattcctgttaataatgctaatccaggaatgctcacatattttgaagcacaagcagatagtttattaagtcaaattgagaatgattcatggtttaataagatagaaaaagagatattgaaaaatattggagataaagatatatctataaattttattgcctcgtatttaaatataagtgctagaactttacaaaattatttaaaatcagaatcaaaaacttttagtgaggctttgggaaatgtaagaaagaaactagcgaaacattatattttaaatactaaattagatgatgcaacaatatcttttttgttaggatattctgaggtaagtgctttttatagagcctataaaaaatggaatggcacaacgccaaaagagttaagggaaaaaagtaaactatttaattaa

SEQ ID NO: 13390 - protein, 190 aa, Unknown
  Obtained from environmental sample
  DOMAIN (140)...(184): Bacterial regulatory helix-turn-helix proteins, AraC family
  misc_feature (1)..(190): Xaa is any amino acid
MNILTQILGKKVIPEYVYFSYSKQNELMKYEEIFGKKLYFEKDENAIFFKKTELNIPVNNANPGMLTYFEAQADSLLSQIENDSWFNKIEKEILKNIGDKDISINFIASYLNISARTLQNYLKSESKTFSEALGNVRKKLAKHYILNTKLDDATISFLLGYSEVSAFYRAYKKWNGTTPKELREKSKLFN

SEQ ID NO: 13391 - DNA, 315 bp, Unknown; identical to SEQ ID NO: 7175
  Obtained from environmental sample
  misc_feature (1)..(315): n is a, c, g, or t

SEQ ID NO: 13392 - protein, 104 aa, Unknown; identical to SEQ ID NO: 7176
  Obtained from environmental sample
  misc_feature (1)..(104): Xaa is any amino acid

SEQ ID NO: 13393 - DNA, 477 bp, Unknown
  Obtained from environmental sample
  misc_feature (1)..(477): n is a, c, g, or t
atgctccctattatagcaacaaaaaaatatactactgcatacaaagaagcctgtgaaatagccctaagatttggacttgaagagaaagattttataaaatatccaaaagatttaagtggtggaatgaaacagcgagttaattttgcaagagctttaattaccaaaccaagattactttttttggatgaaccattttcggcacttgatattgggcttaaaagagaattacaagattttgtacttaaaagctgtgaagagtttggtactagtgtgttgtttattacccatgatttaatggaagcaattcgattaagtgacaaaattttacttttgaaaagtgaccctggtgaaattatcaaaacatatactatcaatgaaacacaaaatacaagagatgataattttatttttactaaaacacaggagtttttaaatgattgtgatgttatcaatacatttgaaataaaggcaatataa

SEQ ID NO: 13394 - protein, 158 aa, Unknown
  Obtained from environmental sample
  DOMAIN (1)...(114): ABC transporter
  misc_feature (1)..(158): Xaa is any amino acid
MLPIIATKKYTTAYKEACEIALRFGLEEKDFIKYPKDLSGGMKQRVNFARALITKPRLLFLDEPFSALDIGLKRELQDFVLKSCEEFGTSVLFITHDLMEAIRLSDKILLLKSDPGEIIKTYTINETQNTRDDNFIFTKTQEFLNDCDVINTFEIKAI

SEQ ID NO: 13395 - DNA, 807 bp, Unknown
  Obtained from environmental sample
  misc_feature (1)..(807): n is a, c, g, or t
atgggaaaaagcacttttaatttatttaaaaacttaactataaaagttgatttagacaataatataattaaggcaaattctgcttttctaaaatttatcaataaaaatattgaagatgttttaggaaaaaaagagagtgattttttcaaacaactacacatatcaaacaattcaaaacagattttagatgagacaattgaaataaacaaagagatattttatttcaaaataaaaagagtattggtcaaaaaaactaacaaagatccttatataaaaatcatacgaagaaatattacagagtttaaaaaatattcagttttatatgatgaccataaaaatctattaaaatatattgcaacagctaagccaattgaatttattttagatgagattattaaatcagttgaaaaaagaaatgaaaatatgatttgttctattttacttttagatgaatctaaacaaagactaataaaaggtgcagccccatctttgccacagttttataatgaaaaattaaatggcatgaaaataggagcaaatgttggttcttgtggagcggcagtttttctaaaagaaagggttattgtcaaagatatacaaacccacgaaaactggaaatacgcaaaaaagttagctgcaaaggtcaaccttcaggcatgctggtcacagccatttttctcctcttcaaatgaagtattaggctcttttgctatttattatactaccccaaaagaacccacagagtttgatataaaacttatagaagatattgcaaatataactgggattgcagntgaaaacccataa

SEQ ID NO: 13396 - protein, 268 aa, Unknown
  Obtained from environmental sample
  DOMAIN (123)...(265): GAF domain
  misc_feature (1)..(268): Xaa is any amino acid
MGKSTFNLFKNLTIKVDLDNNIIKANSAFLKFINKNIEDVLGKKESDFFKQLHISNNSKQILDETIEINKEIFYFKIKRVLVKKTNKDPYIKIIRRNITEFKKYSVLYDDHKNLLKYIATAKPIEFILDEIIKSVEKRNENMICSILLLDESKQRLIKGAAPSLPQFYNEKLNGMKIGANVGSCGAAVFLKERVIVKDIQTHENWKYAKKLAAKVNLQACWSQPFFSSSNEVLGSFAIYYTTPKEPTEFDIKLIEDIANITGIAXENP

SEQ ID NO: 13397 - DNA, 360 bp, Unknown
  Obtained from environmental sample
  misc_feature (1)..(360): n is a, c, g, or t
atgaaaaaatcagatttaaaaacaggaatgattgtagaatttagaaacggtaaacgtggattaatgttttttggcacagctattggtaattacggaggaattagttctagtaatataagggaagatttaaccagtacttacgctgatgatgaagatgacattataaaagtataccaaccaaatgaaacagaaaactattgcgctgagattaactattggattaaaaatgactttaaacaaatattagaatacagcgaattactttgggaacgcaaagaagaaaagcttatatgtacaattgacggtgttgaatattctgaatcaacattaagaagcatcattaaaaaagtacatgaataa

SEQ ID NO: 13398 - protein, 119 aa, Unknown
  Obtained from environmental sample
  misc_feature (1)..(119): Xaa is any amino acid
MKKSDLKTGMIVEFRNGKRGLMFFGTAIGNYGGISSSNIREDLTSTYADDEDDIIKVYQPNETENYCAEINYWIKNDFKQILEYSELLWERKEEKLICTIDGVEYSESTLRSIIKKVHE

SEQ ID NO: 13399 - DNA, 339 bp, Unknown
  Obtained from environmental sample
  misc_feature (1)..(339): n is a, c, g, or t
ttgaacataagttttatacaaggggatagtttgaatatattaattactggttctggtggacaattaggctctgaatttaaaagtttaagtaaacaatatagcagttacaatttttttttagcttcaaaagataatttaaatattgtagataacaataatatattaaaatatataaaaaaaaataatatagatgtaataattaattgtgctgggtatacagctgttgataaagctgaagatgaaggtaagaaggctaatctaattaataatattgctgttggatatttagctgaaatttcaaaagaacaaaatattaaattaaatccatatctccactga

SEQ ID NO: 13400 - protein, 112 aa, Unknown
  Obtained from environmental sample
  misc_feature (1)..(112): Xaa is any amino acid
MNISFIQGDSLNILITGSGGQLGSEFKSLSKQYSSYNFFLASKDNLNIVDNNNILKYIKKNNIDVIINCAGYTAVDKAEDEGKKANLINNIAVGYLAEISKEQNIKLNPYLH

SEQ ID NO: 13401 - DNA, 582 bp, Unknown
  Obtained from environmental sample
  misc_feature (1)..(582): n is a, c, g, or t
atgccgaaagaaatcgtgttttctgaggaaagtattattcaaactggtttcgagatgattcaagaacatggaatcaatgctgtatcagctcggaaaatcgcagctaaaatgaaatgttctactatgccgatctacagtcatttccaaaaaatcgatgacttgataataaaagtaattcaaaaagcaattgatcttctttgggaatatatgaattgcagatatgatgaaatatatacattttttaatatgggtgttggctatattctttttgccagagacaatccaaaattattcagaatattatttttggaaacgaacaaataccanaatgtaattaatgattttaccaactcagtagtcgggaagatgaaagatgatcccaggttcaattcatggtcaatagaagaaagaagaattctgttcaataaaatatacattttcacacatggttatgccacaatgctttgcataaggaactttttcggtatgaaacctaacggagattttattgaaacaacttccctgaaggtgggcccaatttttaataacccatgtgatttttccaaatggaaccaaaattag

SEQ ID NO: 13402 - protein, 193 aa, Unknown
  Obtained from environmental sample
  DOMAIN (12)...(58): Bacterial regulatory proteins, tetR family
  misc_feature (1)..(193): Xaa is any amino acid
MPKEIVFSEESIIQTGFEMIQEHGINAVSARKIAAKMKCSTMPIYSHFQKIDDLIIKVIQKAIDLLWEYMNCRYDEIYTFFNMGVGYILFARDNPKLFRILFLETNKYXNVINDFTNSVVGKMKDDPRFNSWSIEERRILFNKIYIFTHGYATMLCIRNFFGMKPNGDFIETTSLKVGPIFNNPCDFSKWNQN

SEQ ID NO: 13403 - DNA, 678 bp, Unknown
  Obtained from environmental sample
  misc_feature (1)..(678): n is a, c, g, or t
atgtgtaaaaaaagaataaaagtcaaactattagttaatatttttgtttattctcaaggaggatggttagaaaattttgttaataaaaaagcattttgtaatgcagttactttaaataaaaaacaagctttgaaatatttagctaaagaacttcatcaaaagtttaataaaatttattataacactcaaagtacagcaaatctgataactgcatttaaagaagcagggattaaagataaatatattatgcaaatgtatgagcaagggttttcttttataaaatcacgaattttaaatattaaaaaaactgataatagaatatttgagaataaacttatagactctatgacaatagatgaacaaatgattgttttattattaattaaattaaaaaactattctaaatccaatcaagaagaaatattatatgctcttaattatttactatctcataaaagtaacttattatatgaaccattaaaatggtttttcaataatttagaatactttcctcatatatcaatagctgcagttttagagttacttattatgaataanaaatattgttttgaactttcacacgagntaactgtaaatattatgaatataagagatgtgaataatatgtatttacacaatacattaaatatttttttaatggaattagaaaatgtataa

SEQ ID NO: 13404 - protein, 225 aa, Unknown
  Obtained from environmental sample
  misc_feature (1)..(225): Xaa is any amino acid
MCKKRIKVKLLVNIFVYSQGGWLENFVNKKAFCNAVTLNKKQALKYLAKELHQKFNKIYYNTQSTANLITAFKEAGIKDKYIMQMYEQGFSFIKSRILNIKKTDNRIFENKLIDSMTIDEQMIVLLLIKLKNYSKSNQEEILYALNYLLSHKSNLLYEPLKWFFNNLEYFPHISIAAVLELLIMNXKYCFELSHEXTVNIMNIRDVNNMYLHNTLNIFLMELENV

SEQ ID NO: 13405 - DNA, 801 bp, Unknown
  Obtained from environmental sample
  misc_feature (1)..(801): n is a, c, g, or t
gtgataaatgattactatgttgccgttgccaattatgataaaaaaagtgttgatatcttagatagagacctaaaacctttgcaatcaattgtaacaggttcaaaaaatgtgggaattaaaatctataacgactatctcgtttttgtgcagatggataatgacaaaataactatattagatgataaaaacagaggtttaaaagagccaaagtttgaaattttcagagagtttgaagatatcggagtaatgccttttgatgccatgataaaagataataaatacattgtaggtttttttaaaagtgaacattttggtgttcttgatctaaagtcgatggagtatgaaaagattaagataatgctagcagacagaaagcctgttcttaaagtgccgcactttggattttggagtattagtgatggtcaggtctttatacccgctgtaggtgataataaagtgttagtttacacttctgattttgagtttgttaagaacattgagacagaaggtcttcctgtatttacctctttaagtcctgataaaaaatatctggcagtaacctttagcggtaagcagtttccaattattcagataattgatactacgacacttaaagtgataaaaagatttgagtttgatggaaaagtactgcacgtaagatgggtcaatcaaaaaccgaaactttacgtatcggtaaatgatacaaacaaaagtgcagtattagatacaagagagtggtatctaagtaaagagctgtttcagattaaaaagccatcagtatatttatctatggagggataa

SEQ ID NO: 13406 - protein, 266 aa, Unknown
  Obtained from environmental sample
  misc_feature (1)..(266): Xaa is any amino acid
MINDYYVAVANYDKKSVDILDRDLKPLQSIVTGSKNVGIKIYNDYLVFVQMDNDKITILDDKNRGLKEPKFEIFREFEDIGVMPFDAMIKDNKYIVGFFKSEHFGVLDLKSMEYEKIKIMLADRKPVLKVPHFGFWSISDGQVFIPAVGDNKVLVYTSDFEFVKNIETEGLPVFTSLSPDKKYLAVTFSGKQFPIIQIIDTTTLKVIKRFEFDGKVLHVRWVNQKPKLYVSVNDTNKSAVLDTREWYLSKELFQIKKPSVYLSMEG

SEQ ID NO: 13407 - DNA, 768 bp, Unknown
  Obtained from environmental sample
  misc_feature (1)..(768): n is a, c, g, or t
atggaaactacagagagtgttggattaccaatagcaacaagaaatgacgaaccaatactaaaagatatttttaataaactaattaataacatatctgcagaaaaaaatcaagagatattaaataagtggctatctattaagtatgaagagcagatgaactataaattgcttttttatatagtgagtgtatttttagtaattattctaactgtaattataaaaaatagggctataaataaagttaatttagaagttaagcagataaataatcggttatctgaatatatcgaagtggtagatgagaatgttttaacttcaacaacagacaaaagaggagtaataacttatgtatcgcaagccttttgtgatattagtgggtatacaaaagcagaacttatagggaaaagacataatattataagacatccagataccccaaaagaattatttgaagatttatggtcgacgattacatctggaaaaacttggaaaggtgagattaaaaataaaaataaaaatggaacattctactgggttgatgctgttatctcacctatatttgatgatgataaaaatataacaggatacactgcaatcagacatgatattaccaataagaaacttgttgaagagttatctatcanagatgagttaactaaactttataataagcgatattttaatgaagtatttgaaaaagagctcaatagagcaaaaagagataatcatacttttggtttaatgatattagatattgattttttttaa

SEQ ID NO: 13408 - protein, 255 aa, Unknown
  Obtained from environmental sample
  DOMAIN (94)...(155): PAS domain
  misc_feature (1)..(255): Xaa is any amino acid
METTESVGLPIATRNDEPILKDIFNKLINNISAEKNQEILNKWLSIKYEEQMNYKLLFYIVSVFLVIILTVIIKNRAINKVNLEVKQINNRLSEYIEVVDENVLTSTTDKRGVITYVSQAFCDISGYTKAELIGKRHNIIRHPDTPKELFEDLWSTITSGKTWKGEIKNKNKNGTFYWVDAVISPIFDDDKNITGYTAIRHDITNKKLVEELSIXDELTKLYNKRYFNEVFEKELNRAKRDNHTFGLMILDIDFF

SEQ ID NO: 13409 - DNA, 564 bp, Unknown
  Obtained from environmental sample
  misc_feature (1)..(564): n is a, c, g, or t
ttgactggtacactgctaaagagatatgtaacgatgctcttgaacaaaagttggagaaaatataatctaatgtttataagaaaattagaattactatttttgggaatcataataattgctattttagtactttctaaaaattactatgataattatatttataaaaacagtgacattccagataatttcaaagaactaattgtaaacaaagaaaaagaagtattaaacctaatgcagaaaaactacggttttacttttaaagttccacttattattacagataaattcaaaggcagactctatggacttactgcttataaaaatggcgatataaagatatacctaaacaaaaaagtcatgaaagaaagtatggactatatggtaaacaatgtcattgctcatgagtatgcacatgccttaatatttaaactacaaaaagataagtcaaagtcggatggacactctaaagagtggcaagaggcttgtaaaaaactaggtggaactaactgcgaacgatatgttaataaccatgaggtagttatgggtaagatgccgtttcaatga

SEQ ID NO: 13410 - protein, 187 aa, Unknown
  Obtained from environmental sample
  misc_feature (1)..(187): Xaa is any amino acid
MTGTLLKRYVTMLLNKSWRKYNLMFIRKLELLFLGIIIIAILVLSKNYYDNYIYKNSDIPDNFKELIVNKEKEVLNLMQKNYGFTFKVPLIITDKFKGRLYGLTAYKNGDIKIYLNKKVMKESMDYMVNNVIAHEYAHALIFKLQKDKSKSDGHSKEWQEACKKLGGTNCERYVNNHEVVMGKMPFQ

SEQ ID NO: 13411 - DNA, 918 bp, Unknown
  Obtained from environmental sample
  misc_feature (1)..(918): n is a, c, g, or t
gtgaccattataacgacaaatgattttgagattcaaaatgagagtatctctcttcaagcaactgcttcactatcttttgaaaataaaaaatcagatctgtttattactgctgatatggcaataaaaatgcagaaaagagcagataaagacctacttgtttatgataagtcattggcacttgataaagagtatgaaaataatcttttatggactaaaaagcttaaaagtgcgattagtgaagataggctcactccatactatcaacctatcgtgaataacgtaacaggtgagtttgagaagtatgagtgccttgttagaatgatagatacggatggtaaaataatctctccgtatttctttttagatatagcaaaaagaacaaaaaactatatagaacttacaaagattgtaatagcaaaatcgtttgaaacatttaaagagatggatattgaattttctattaacctgacaatacaagatgtattagatgagggtttaaaagagtttatattttcaaaactaaaagagtacaacaatggaaatagagtagtatttgaaattgtcgaatcagaggggatagagaattttgagctcattatagagtttattaaagatgtaaaagaagcaggttgcaaaatagccatagatgattttggaacgggatactcaaattttgaatatctgcttcaactaaaagctgattatattaagatagacggttctatgataaaaaacattgatactgactcagatgcaagagccgttgtatccacaatcgtagattttgctaaaaagatgaatatgaaaaccatcgcagagtttgtaaaagatgagacaatagactccatcatcaaagagatggggatagactactctcaaggcttttattttggtgagccaaaaccgactcctaactaa

SEQ ID NO: 13412 - protein, 305 aa, Unknown
  Obtained from environmental sample
  DOMAIN (66)...(300): EAL domain
  misc_feature (1)..(305): Xaa is any amino acid
MTIITTNDFEIQNESISLQATASLSFENKKSDLFITADMAIKMQKRADKDLLVYDKSLALDKEYENNLLWTKKLKSAISEDRLTPYYQPIVNNVTGEFEKYECLVRMIDTDGKIISPYFFLDIAKRTKNYIELTKIVIAKSFETFKEMDIEFSINLTIQDVLDEGLKEFIFSKLKEYNNGNRVVFEIVESEGIENFELIIEFIKDVKEAGCKIAIDDFGTGYSNFEYLLQLKADYIKIDGSMIKNIDTDSDARAVVSTIVDFAKKMNMKTIAEFVKDETIDSIIKEMGIDYSQGFYFGEPKPTPN

SEQ ID NO: 13413 - DNA, 825 bp, Unknown
  Obtained from environmental sample
  misc_feature (1)..(825): n is a, c, g, or t
atgtggaaaacaattcaatcaaaaaaagtttggaaaagtactcttaaaaatagaaaaaaagatggtacccactactgggtcgatattaatataaatccaattttagacaatagcggtgagatcatagaatatgttgctataaggcatgatataacagagttggtagggcagcgtcatgagttagagagagtgtctcaaactgatcctctaacaggatatggaaaccgtctaaaattgattaatgatattaaagataattcaataacctcattggcaatagtaaacatagataactttagagagataaatgatttttacggacacaaatttggagattttgtaattatcaaactaggagatctgatccaagaactgattaatgatgatagtgaaaagcatctctatcgtcttcaaggtgacgaatttgctattttaaacacatctgattcaagagatagtttcatcggtcaaatatataatattgtgaacactataacgacaaatgattttgagattcaaaatgagagtatctctcttcaagcaactgcttcactatcttttgaaaataaaaaatcagatctgtttattactgctgatatggcaataaaaattgcaagaagagcagataaagacctacttgtttatgataagtcattggcacttgataaagagtatgaaaataatcttttatggactaaaaagcttaaaagtgcgattagtgaagataggctcactccatactatcaacctatcgtgaataacgtaacaggtgagtttgagaagtatgagtgcctttgtagaatgatagatacggatggtaaataa

SEQ ID NO: 13414 - protein, 274 aa, Unknown
  Obtained from environmental sample
  DOMAIN (61)...(212): GGDEF domain
  misc_feature (1)..(274): Xaa is any amino acid
MWKTIQSKKVWKSTLKNRKKDGTHYWVDININPILDNSGEIIEYVAIRHDITELVGQRHELERVSQTDPLTGYGNRLKLINDIKDNSITSLAIVNIDNFREINDFYGHKFGDFVIIKLGDLIQELINDDSEKHLYRLQGDEFAILNTSDSRDSFIGQIYNIVNTITTNDFEIQNESISLQATASLSFENKKSDLFITADMAIKIARRADKDLLVYDKSLALDKEYENNLLWTKKLKSAISEDRLTPYYQPIVNNVTGEFEKYECLCRMIDTDGK

SEQ ID NO: 13415 - DNA, 882 bp, Unknown
  Obtained from environmental sample
  misc_feature (1)..(882): n is a, c, g, or t
ttgatgggatttgttgaagatagtgatttggacggtattattgatttaacaccagggattagaagtttacaaatccattttgattcaagaatcattagtagagaaaagatcttaaaaactatcaataaaggtgtaaatgctttaaaagatattgaaaatcttgaagttgattcaagaactgtatggcttccattatcatggaatgatccatcaattcaaatagctatcaataaatatcaacaaggtgtacgaccaaatgcaccttggtgtccatctaatattgattttataagaagaatcaatggactaaaagaggttgatgaggttaaggatattatatttaatgctgattatttagtgatgggattaggagatgtttatttaggagctccagttgcaactccactgaatccatctcaaagattagtaacaacaaaatataatccagctcgtacatggacagcacaaaattctgtaggtattggtggggcatatatgtgtgtatatggtatggaaggtccaggtggctatcaactatttggtagaacattacagatgtggaatacctatagaagtacaaaagagtttacaaaaccttggcttttacgattttttgatcaaatcaaattttatcctgtaacaacagaagagttacatgatattagagagaagtttttatatggaaaatatccattaaaaatagaaaatcaaagtttcaaactcaaagagtacaaagagtttttaaaagagaatgaagtggagtcaaaagagtttcaaacacaaagacaaaaagctttccaagatgagagattgatgtggaaagaaaaaggtcttgatagttttgatacaaaaattgagccacagaagataaagatgcactaa

SEQ ID NO: 13416 - protein, 293 aa, Unknown
  Obtained from environmental sample
  misc_feature (1)..(293): Xaa is any amino acid
MMGFVEDSDLDGIIDLTPGIRSLQIHFDSRIISREKILKTINKGVNALKDIENLEVDSRTVWLPLSWNDPSIQIAINKYQQGVRPNAPWCPSNIDFIRRINGLKEVDEVKDIIFNADYLVMGLGDVYLGAPVATPLNPSQRLVTTKYNPARTWTAQNSVGIGGAYMCVYGMEGPGGYQLFGRTLQMWNTYRSTKEFTKPWLLRFFDQIKFYPVTTEELHDIREKFLYGKYPLKIENQSFKLKEYKEFLKENEVESKEFQTQRQKAFQDERLMWKEKGLDSFDTKIEPQKIKMH

SEQ ID NO: 13417 - DNA, 837 bp, Unknown
  Obtained from environmental sample
  misc_feature (1)..(837): n is a, c, g, or t
atgaatctaaatattgaaagtttaaaacaaagttatataaatagtgaagttacagttagagaagttatcacagctataaaagagaaagtacaacaaacaaaaaatcataatatttggatatacattttaagtgatgaacagttagaaccttatttaaaaaacttagagggaaaaaatccaaatgatttacctctatatgggataccatttgccataaaagataatattgatttagtagatattcctacaacagctgggtgtaaagagtatgaatatatcccaaaagattctgcttttgttgttgtaaaattaatccaagcaggagcgataccaattggaaaaacaaatcttgaccaatttgcaacaggacttgtaggtacaagaagcccttatggggagtgtaaaaactcaataaatccagaatatatttcaggtggttcaagctctggaagtgcagtgagtgtggcacttgatatggtaagcttttcccttggaacagataccgctggttcaggaagagtaccagctgcttttaataatctcataggacttaaagcaacaaaaggggtagtaagtacaagtggtgtagttccagcttgtagaagcttggattgtgtaactctgtttgctaaaacattatctgacattgagtctgtatttgaaatagtaaatcaatatgatgaaaatgatatttatagtagagagtatattgttaaaaatgaaagtgttaaagagagttttacttttgctattcctcaaaaagaacagttaaaattttttggagatgaacaagctgaaaagttattttttcaagcagtaaaaaaattgaatcactag

SEQ ID NO: 13418 - protein, 278 aa, Unknown
  Obtained from environmental sample
  DOMAIN (21)...(276): Amidase
  misc_feature (1)..(278): Xaa is any amino acid
MNLNIESLKQSYINSEVTVREVITAIKEKVQQTKNHNIWIYILSDEQLEPYLKNLEGKNPNDLPLYGIPFAIKDNIDLVDIPTTAGCKEYEYIPKDSAFVVVKLIQAGAIPIGKTNLDQFATGLVGTRSPYGECKNSINPEYISGGSSSGSAVSVALDMVSFSLGTDTAGSGRVPAAFNNLIGLKATKGVVSTSGVVPACRSLDCVTLFAKTLSDIESVFEIVNQYDENDIYSREYIVKNESVKESFTFAIPQKEQLKFFGDEQAEKLFFQAVKKLNH

SEQ ID NO: 13419 - DNA, 654 bp, Unknown
  Obtained from environmental sample
  misc_feature (1)..(654): n is a, c, g, or t
atggctngatgctcaccatttggtatgcgactaacatcattagagaaaatagaaaatcaaccctatttactgcctgacatttctgccagagtacccactagtggttcagacagtctttggttgcagttagcactttatagcttgaacaaaacaggtaaagcatttattacccttgctcctggctggttattcagaggcggctacgatgctaaggtccgtgaatatttaattgaacacgaattaatagaatcgataatcatgctgccacaaggctattttagttatacccaaattcagggtgcgttagttattctgcaaaacaacaaaccaaaaggcacgccgattagattgattgatgctcgtgatctaggaagacaatcccgaaaagaacttatcttggagcgcaaagatatttctctgattgctgacctttatgctgcaaaagcccataacgagaatatttgtaaagacattccgttatctgaaatccgagccaaagactataacttaagctttggaagctattttgtgaaagcaatcgaagagattgagttaaaccctgaaaaagagcttcaaaaactggctgagttaactcttaaacatcaacaatcacaacaaaaactgatgcaacttttaaatgagtcaaaaggttag

SEQ ID NO: 13420 - protein, 217 aa, Unknown
  Obtained from environmental sample
  DOMAIN (13)...(169): N-6 DNA Methylase
  misc_feature (1)..(217): Xaa is any amino acid
MAXCSPFGMRLTSLEKIENQPYLLPDISARVPTSGSDSLWLQLALYSLNKTGKAFITLAPGWLFRGGYDAKVREYLIEHELIESIIMLPQGYFSYTQIQGALVILQNNKPKGTPIRLIDARDLGRQSRKELILERKDISLIADLYAAKAHNENICKDIPLSEIRAKDYNLSFGSYFVKAIEEIELNPEKELQKLAELTLKHQQSQQKLMQLLNESKG

SEQ ID NO: 13421 - DNA, 804 bp, Unknown
  Obtained from environmental sample
  misc_feature (1)..(804): n is a, c, g, or t
gtggatgtagctgtacgctcttctggaactgccgaagacctaccagatgcctcatttgccggacaacaagagacttttttaaacatcaactctgcagatgcactgcttaaaagtgtactcaaatgttatgcttcactctttaacgatagagccatcagctatcgaacaagccgtggatttaaccactttgaagttgctctgtctgtaggtattcaaaagatggtacgaagcgataactcttctagtggaatcatgtttagcatcgatactgaaagcggttctgatgatttagttctcataaattccatctggggtttaggtgaaaatgtagtcagtggacaagtaaacgctgatgaattttttgtgtttaaaccaactctcaaaaatggcatcaatactattttaaaacattccttaggaagtaaaaaagagaagatgctttacggtagaaatggcaaagacactctaaatgttgagacttctttagaagagcaaaagagtttctctatcactaatgatgaagtcatagaactcgcaaaacaagcacttatcattgaacaacattacaaacgtccgatggatatagagtgggcaaaagatgcgcttgatggtaaactctacattgtccaagcacgtcctgaaacagtgcaaagcaaacttagcaatgcctcaaccatagagaaattttccataaaaataccctcagatgctaaagttctgacgcaaggaagagcagttggggagaagataggagtcggcaaagtaaatatcataaacggtacttctgaatttgactctttttaa

SEQ ID NO: 13422 - protein, 267 aa, Unknown
  Obtained from environmental sample
  DOMAIN (1)...(247): Pyruvate phosphate dikinase, PEP/pyruvate binding domain
  misc_feature (1)..(267): Xaa is any amino acid
MDVAVRSSGTAEDLPDASFAGQQETFLNINSADALLKSVLKCYASLFNDRAISYRTSRGFNHFEVALSVGIQKMVRSDNSSSGIMFSIDTESGSDDLVLINSIWGLGENVVSGQVNADEFFVFKPTLKNGINTILKHSLGSKKEKMLYGRNGKDTLNVETSLEEQKSFSITNDEVIELAKQALIIEQHYKRPMDIEWAKDALDGKLYIVQARPETVQSKLSNASTIEKFSIKIPSDAKVLTQGRAVGEKIGVGKVNIINGTSEFDSF

SEQ ID NO: 13423 - DNA, 468 bp, Unknown
  Obtained from environmental sample
  misc_feature (1)..(468): n is a, c, g, or t
atgccaaaaataaatttattcagtataaaatggaaattcgcctttttaatcagcaccagccttattctcctcctgggatatctgacctactttagttattttgatacaacaaaggcctttctccagcaggggaagaaggcccagaaccgatattcccatattgcagaagccatcattcgaaattcttcaaagggattggaactatttgctgaatctatttttctggctaaacattccgatgacacaaaaaagttaccccaggatcagacaatatccttgctggataaaaacttgcccaatggacaacttgtctggggacttgaagctgcggtcttaaccgacgataaaggaaaaaggatcaaggagtggggaagtgttctgaaaaacctaaacggacaggtccagagggttttaaaaatggaaaaacccgtgcataccattctctgcgaagaaactcagccgatctga

SEQ ID NO: 13424 - protein, 155 aa, Unknown
  Obtained from environmental sample
  misc_feature (1)..(155): Xaa is any amino acid
MPKINLFSIKWKFAFLISTSLILLLGYLTYFSYFDTTKAFLQQGKKAQNRYSHIAEAIIRNSSKGLELFAESIFLAKHSDDTKKLPQDQTISLLDKNLPNGQLVWGLEAAVLTDDKGKRIKEWGSVLKNLNGQVQRVLKMEKPVHTILCEETQPI

SEQ ID NO: 13425 - DNA, 624 bp, Unknown
  Obtained from environmental sample
  misc_feature (1)..(624): n is a, c, g, or t
ttgcaaaagctgatgaaggtcagcgaaaaactagcgatactaaattttgaaaggtatgcatcatggaagagcaattattctcgtgaagaatcgaatcaggctatcatttctttctccggagaagtgtttaatgggctggatgcaagatctcttaatctggacgacctcgattttgcccagaagcatttaaaaatattatcagggctctatggtgtactttgccctcttgatttaattatgccctacagactagagataggtagcagacttaaaaatgtgcgcgggaaaaacctctatgaattttggcaaaaaatcattccacagaaaattgaacaagcaacagcaaaaagtaaaacgctcatcaacttagcttccaaggagtacctcacatctattaaacccaaaaccttcccctacagaatcatcactccagtattcaaagagcaggatggagatggtttccacatggtgaccatctatgccaaaaaagcccgaggcatgatgctacgctacatactgcaaaataaaatcactgaagccgaatacttgaagggctttgaagatggaggatatcttttcaatcagcaattatctactgtagacaaatgggtattctgtaggtag

SEQ ID NO: 13426 - protein, 207 aa, Unknown
  Obtained from environmental sample
  DOMAIN (1)...(207): Protein of unknown function (DUF328)
  misc_feature (1)..(207): Xaa is any amino acid
MQKLMKVSEKLAILNFERYASWKSNYSREESNQAIISFSGEVFNGLDARSLNLDDLDFAQKHLKILSGLYGVLCPLDLIMPYRLEIGSRLKNVRGKNLYEFWQKIIPQKIEQATAKSKTLINLASKEYLTSIKPKTFPYRIITPVFKEQDGDGFHMVTIYAKKARGMMLRYILQNKITEAEYLKGFEDGGYLFNQQLSTVDKWVFCR

SEQ ID NO: 13427 - DNA, 492 bp, Unknown
  Obtained from environmental sample
  misc_feature (1)..(492): n is a, c, g, or t
atgaataaaagaataaccataaagcaaattgcaaaagctctaggcgtttcaatttcaacagtttcaaaagctttaaatgatagttacgaaataagtgacgaaacaaaaagcaaaattcaagagtatgctaaactgcacaagtacaaaccaaatacacttgcattaagtttacaaaacaaaaaaacaaaaactataggtattcttattcccaatattttaaattattactttgcaagagctctgcgtggaatagaaaaagtagctaccgaaaaagggtatagtataataacttgtattacaaacgaatcttatgaaaaagaagtagaaactatggaaatgctttccaatggaactatagatggctttattgcttgtgtttcggttgaaactttaaaaataaaaaagttcgatcattttcatgatattttaagaagaagaaaccccaaattgttttatatgaccggagctcataaagatattaagtgcgaataa

SEQ ID NO: 13428 - protein, 163 aa, Unknown
  Obtained from environmental sample
  DOMAIN (5)...(30): Bacterial regulatory proteins, lacI family
  misc_feature (1)..(163): Xaa is any amino acid
MNKRITIKQIAKALGVSISTVSKALNDSYEISDETKSKIQEYAKLHKYKPNTLALSLQNKKTKTIGILIPNILNYYFARALRGIEKVATEKGYSIITCITNESYEKEVETMEMLSNGTIDGFIACVSVETLKIKKFDHFHDILRRRNPKLFYMTGAHKDIKCE

SEQ ID NO: 13429 - DNA, 441 bp, Unknown
  Obtained from environmental sample
  misc_feature (1)..(441): n is a, c, g, or t
atgagatcaattatatttgtatgtctggggaatatctgtcgctcaccaatcgcggagggttgtgctactaaactggcattagaaaaatccatcgatattgaaatttattcatcaggaacaagcaattggcatacaggagaagcaccatgtgcaaactctgttaagatatgtaaatctaacggtgtggacatctccatgctcagagcctctcagtttagtaaaaaagatatagacaggtacgatcttgtagtagccttggatgacaacaacgtaaaagatttaaaagctctaggtgcaaaaaatgttgtaaaactcggtgattatggatatgaatcacaagatgttccagacccatacttttttgacacttttgatggttttgataaagtttttacaatgatagaaagttgtgtaaaaaacctgtttgaaaaagagttataa

SEQ ID NO: 13430 - protein, 146 aa, Unknown
  Obtained from environmental sample
  DOMAIN (2)...(144): Low molecular weight phosphotyrosine protein phosphatase
  misc_feature (1)..(146): Xaa is any amino acid
MRSIIFVCLGNICRSPIAEGCATKLALEKSIDIEIYSSGTSNWHTGEAPCANSVKICKSNGVDISMLRASQFSKKDIDRYDLVVALDDNNVKDLKALGAKNVVKLGDYGYESQDVPDPYFFDTFDGFDKVFTMIESCVKNLFEKEL

SEQ ID NO: 13431 - DNA, 789 bp, Unknown
  Obtained from environmental sample
  misc_feature (1)..(789): n is a, c, g, or t
gtgatatttccagattttgttgaagtttatggtttagagtattatgaagattctattgaagctctaaagctttttactcaaaactgttcaagtgagtttgctatacgaccttttttagtgaaatatccacagcttattgaaactttaaaagagtggacaaaagatgaaaatgagcatatccgaagattagcaagtgaaggttcacgacctagacttccttggggtatggcactccaaagatataaaaaagaaccaacaaaagtaatcgaagtattggaacttttaaaagatgatgagagtgaatatgtacgaaaaagtgtagcaaataatcttaatgatatctcaaaagacaatccaaaaatagtgaaagagatatttaaaaagtggtatggaaaatctaaaaacagagattggatagtcaaacatgcctcaagaacacttttaaaagctggagataaagaggtgttagagatttttggctatcgttcagatgatatagaagtgatagatttaatagcagatgataagataaagatggaagagtatttaaacttttcatttactattcaatcaaaaaagactttaggtaaattacgaatagaatataaaataggtcttgtgagacaaaatgagaagatgggatataaggtcttcaaaatatcagaaaaagaggtttcgaatactaaactatctgtaaaaaaagcacaccattttaaatatgtaaccacaagaaaatattatgatgggatccatactctaataatcatcataaatggaaaagaattttaa

SEQ ID NO: 13432 - protein, 262 aa, Unknown
  Obtained from environmental sample
  misc_feature (1)..(262): Xaa is any amino acid
MIFPDFVEVYGLEYYEDSIEALKLFTQNCSSEFAIRPFLVKYPQLIETLKEWTKDENEHIRRLASEGSRPRLPWGMALQRYKKEPTKVIEVLELLKDDESEYVRKSVANNLNDISKDNPKIVKEIFKKWYGKSKNRDWIVKHASRTLLKAGDKEVLEIFGYRSDDIEVIDLIADDKIKMEEYLNFSFTIQSKKTLGKLRIEYKIGLVRQNEKMGYKVFKISEKEVSNTKLSVKKAHHFKYVTTRKYYDGIHTLIIIINGKEF

SEQ ID NO: 13433 - DNA, 462 bp, Unknown
  Obtained from environmental sample
  misc_feature (1)..(462): n is a, c, g, or t
atgcttagacaaaatataattgacgatttcaaatcttacataaaaacagcattttctgagataatatctgatatggctcaagataaattaaattcattaaaatctaaattatcagtagaaattagtgaatcagaatctaaagaagaagagcacgaagacaatggtattataactacagatgaagagatagaaggattttttacagtaaaatctattttatcagaacatatagcattaaatagacttactgcaagagatactaaaagctattttggtatcttagttgatgataacaatagaaaatggattgtaagattattattcaatacaaaacaaaaatacatagaaattcgtacaggtgataaagattctataaaatttacaatagataggatagaagatatttataattataaaaaagaaattataaatacactccatattgtcaataatgaagaataa

SEQ ID NO: 13434 - protein, 153 aa, Unknown
  Obtained from environmental sample
  misc_feature (1)..(153): Xaa is any amino acid
MLRQNIIDDFKSYIKTAFSEIISDMAQDKLNSLKSKLSVEISESESKEEEHEDNGIITTDEEIEGFFTVKSILSEHIALNRLTARDTKSYFGILVDDNNRKWIVRLLFNTKQKYIEIRTGDKDSIKFTIDRIEDIYNYKKEIINTLHIVNNEE

SEQ ID NO: 13435 - DNA, 486 bp, Unknown
  Obtained from environmental sample
  misc_feature (1)..(486): n is a, c, g, or t
atgggatttaatgtagataattttgttcttgctatgaaagaaaaaggattaacaaatcaacattttgtagatattcttaataatgaatatggtttagatataactgttgaaggtgtaaaatcatatcgtagaaaaagtggaaagaatagaactcctaatgctgaaaaaaatactattttttcaaaaatacttggtgttactacagactatttactcggaaaagacaatattgtagaatcaaaacaaattccctctaatcggaaaatcctcatgtggaaaaaccaaaagattatgaccctaaatgggtatgaatccagtaccctgtaccaatggaacctgtaccaaatcagggaatgtatgcttcctagaaccaaaaagggaacagttttgaattccaaaaaaaaaccaaagggggaaaaaggtctaacggctggcccctttccaacctttttggacaatggcccaaaaaaaagcccacctatcggg

SEQ ID NO: 13436 - protein, 162 aa, Unknown
  Obtained from environmental sample
  misc_feature (1)..(162): Xaa is any amino acid
MGFNVDNFVLAMKEKGLTNQHFVDILNNEYGLDITVEGVKSYRRKSGKNRTPNAEKNTIFSKILGVTTDYLLGKDNIVESKQIPSNRKILMWKNQKIMTLNGYESSTLYQWNLYQIRECMLPRTKKGTVLNSKKKPKGEKGLTAGPFPTFLDNGPKKSPPIG

SEQ ID NO: 13437 - DNA, 414 bp, Unknown
  Obtained from environmental sample
  misc_feature (1)..(414): n is a, c, g, or t
ttggaaaaattcatatggttgggtaaatcattttataaatccaaaagccaggtaaaaagaccncacctgacatttcattttggagttgataataatattagtattaatagagaaaagttattagaatttacagaaaatcaaatcattggttcaaatagaaaagaaacattaactcacaaattaactgttagaaacaataagacgtattctatatcaacaaaaataattgatcaaattcctatttccactacaaaagacattcaagtggaattattagaagtttcaaatggaatatataattcagatacaggagaagtgctttggaaaattgacttaaaaccaaatgaaacaaaagacattatcataaaatactctgtaaaatatcctaaagacaagaaagtaattattgagtag

SEQ ID NO: 13438 - protein, 137 aa, Unknown
  Obtained from environmental sample
  misc_feature (1)..(137): Xaa is any amino acid
MEKFIWLGKSFYKSKSQVKRPHLTFHFGVDNNISINREKLLEFTENQIIGSNRKETLTHKLTVRNNKTYSISTKIIDQIPISTTKDIQVELLEVSNGIYNSDTGEVLWKIDLKPNETKDIIIKYSVKYPKDKKVIIE

SEQ ID NO: 13439 - DNA, 885 bp, Unknown
  Obtained from environmental sample
  misc_feature (1)..(885): n is a, c, g, or t
ttgaatgaattagaaaaaagtgaagaaataatattacttaaaaatgaaaaaaaaaaattacagttaaatattgaagaagaagatacttggatcgtaatacttaaagataagttagattttcttaatacaaataagcaaataacaggcaaagaacaagctataaatcctgagacttttacgtcactaaactctatttatggtaaaaatttagaatcattgaattttgatatcttaaagaaaaatagaacaattagcaattataaaaaagatattatcaaacttaataatcagttaaactctctaaatagcaagtctgacttgccttcagggactgtaataattacaattgattcaaaacaaattaaaaaatcacaaattaaacttaattatttagttggaaatgcagagtggaacccatcatatgacattaggtttttaggtattaacaaaccgctttctataacattcaaggctaatattaaccagaaaacaggagttgattggacagatgtaaatcttgttttgtctacaaccaagacaaatatatcagcccaaatgcctaaattaactacaaactatctgcaattttattttcctaaaatagcacaagcattacaaggaagagtcgcaggtgttcaagttacaaatagttctggtgcaccaggtgcttctccagaactaagaataaggggtgcgagttcaataagtggtaataataatccattatacgttgttgatggtgtacctaaaaacaatattgcttccttagatccaaacagtattgaagaaatgaaagtactaaaagatgcatctgcaacttcactttatggttcgagagctgcaaatggtgttgtttttataccgaccaaaccgaataagggttaa

SEQ ID NO: 13440 - protein, 294 aa, Unknown
  Obtained from environmental sample
  misc_feature (1)..(294): Xaa is any amino acid
MNELEKSEEIILLKNEKKKLQLNIEEEDTWIVILKDKLDFLNTNKQITGKEQAINPETFTSLNSIYGKNLESLNFDILKKNRTISNYKKDIIKLNNQLNSLNSKSDLPSGTVIITIDSKQIKKSQIKLNYLVGNAEWNPSYDIRFLGINKPLSITFKANINQKTGVDWTDVNLVLSTTKTNISAQMPKLTTNYLQFYFPKIAQALQGRVAGVQVTNSSGAPGASPELRIRGASSISGNNNPLYVVDGVPKNNIASLDPNSIEEMKVLKDASATSLYGSRAANGVVFIPTKPNKG

SEQ ID NO: 13441 - DNA, 762 bp, Unknown
  Obtained from environmental sample
  misc_feature (1)..(762): n is a, c, g, or t
ttggctcatattgatagttttgaaaaacaccctatatctctaaaaaatgaaacaacttttgaaataattcagacaaataattcaagtacgaaaaccaccctcgtctcccctgatataaaagtgtgtaatgattgtcttgaagatataaaaaataaagaaaaataccacaactattttaatactaactgtacaaattgtggtcctagatatagtattattaaaaccttaccttatgatagagtcaacacttcaatgtctgattttaccctttgtaaaagttgtaggaaagaatatgaagaccctcaaaatagacgctatcatgcacaaccaatttcatgtaaagagtgtggtccacagttaagtcttagtatcaaaaatgaagttctaaattgtaatgatgagatattttcaaaaactgcaaacttactgcaaaagggaaaaataggtgctataaaagggatgggtggatttcatattgtttgtgatgctaccaatgatgacacaatcactaagttaagagcgtataaaaatcgtccagcaaaaccttttgctattatgtgtaaagatttagaacaaattcaaactattggaaaagttaatactacagaagaaaaacttcttatctcaaaagaagctccaatcgtagtgcttgacaagcttcaaaattctagtataagtgattttatcgctcctcatattactaaaattggatgttttttaccttatacaccctattcattatttgcttttcgaacatcttga

SEQ ID NO: 13442 - protein, 253 aa, Unknown
  Obtained from environmental sample
  DOMAIN (140)...(253): yrdC domain
  misc_feature (1)..(253): Xaa is any amino acid
MAHIDSFEKHPISLKNETTFEIIQTNNSSTKTTLVSPDIKVCNDCLEDIKNKEKYHNYFNTNCTNCGPRYSIIKTLPYDRVNTSMSDFTLCKSCRKEYEDPQNRRYHAQPISCKECGPQLSLSIKNEVLNCNDEIFSKTANLLQKGKIGAIKGMGGFHIVCDATNDDTITKLRAYKNRPAKPFAIMCKDLEQIQTIGKVNTTEEKLLISKEAPIVVLDKLQNSSISDFIAPHITKIGCFLPYTPYSLFAFRTS

SEQ ID NO: 13443 - DNA, 633 bp, Unknown
  Obtained from environmental sample
  misc_feature (1)..(633): n is a, c, g, or t
atgaataaaatagttcaaataaaacttaaaaagaaaagcttacagcctcataaggcatcaattaacccaattcttgactcaaaaaatgttttaacaaacagcccttgggatttcgttgaactttggttaaaaaaaaacatgaagaaggaggccttgttttattggtctcaagcaaaagaatttcacaaagcttcgttcgggttaccaacacaatcagcaccattactgcattattattcatttatgaatgctgcaaaagcattattaacatcaaaaagtatagcatttaatccttaccacggcgtttcatctcatagtatgcgcggagcaacgagtaaaatcagtattactaatgaaggggtaaagataaataatcgtggggtactcccatctctatcaaggtatctaggaaaaactgagacttccaatattcattactggcaagatttattattcaaccttccatatatccctagaacctattggcttaacataccccttcctcaaactgaatatgttttattccaagtaaaaaaaggctcagttttggtcctaaaaaaaaaaccccaaattcaggccattttttcaaaaccaattactgtgtcaaaagaaattatggcaaccaaaaatcct

SEQ ID NO: 13444 - protein, 211 aa, Unknown
  Obtained from environmental sample
  misc_feature (1)..(211): Xaa is any amino acid
MNKIVQIKLKKKSLQPHKASINPILDSKNVLTNSPWDFVELWLKKNMKKEALFYWSQAKEFHKASFGLPTQSAPLLHYYSFMNAAKALLTSKSIAFNPYHGVSSHSMRGATSKISITNEGVKINNRGVLPSLSRYLGKTETSNIHYWQDLLFNLPYIPRTYWLNIPLPQTEYVLFQVKKGSVLVLKKKPQIQAIFSKPITVSKEIMATKNP

SEQ ID NO: 13445 - DNA, 858 bp, Unknown
  Obtained from environmental sample
  misc_feature (1)..(858): n is a, c, g, or t
gtgcatcaaagatataagtcttttgtaagaagttggaaacttgataagtttggtgacgatttaagttcatttagagatagtgtagtaaaagtaaatcagacacaaactgctgtaaatacttttgaagttggaaatgctggtttatcattgcgttcagttgcatgtgtaacagatgatgatggaacacacttaggttctttagagtttatgcaaggtcttaactctgttgcaaaaagttttgataaatcaaaagatggctttttactccttatggatgataagtttttaagaggtgagtccactaacaaatttaaaaactatgtaatctcacaaaaatttataaataaagattttttagcagatgcaaacaaaattaatatgcaactactattaaaagataaaatatatatcacaaataaatatttctatacttatgtagatgtaaaagatttcaatgaccaaaaattaggaatcgcactagttgcttcacctatgtctaaagtagcccatgcaattgaagcttcccaagagatgattaatgttgcacttactattattgtattacttgtattatttatcctgattgcattaatgattcttttaaaaagaatcattagtacccctttaaaaagttttgaagatggactattaggatttttcaaatatctaaacaaagagacaacttctgtacaagagcttacaatacactcaaatgatgagattggtatcatgtcaaatgttatcaatgaaaatattagaaaaacaaagaatattatagatttagacaataactttttaaaagaggtagaagatattattctgaccattaaaaatggatttttaaatcaaagactttaa

SEQ ID NO: 13446 - protein, 285 aa, Unknown
  Obtained from environmental sample
  misc_feature (1)..(285): Xaa is any amino acid
MHQRYKSFVRSWKLDKFGDDLSSFRDSVVKVNQTQTAVNTFEVGNAGLSLRSVACVTDDDGTHLGSLEFMQGLNSVAKSFDKSKDGFLLLMDDKFLRGESTNKFKNYVISQKFINKDFLADANKINMQLLLKDKIYITNKYFYTYVDVKDFNDQKLGIALVASPMSKVAHAIEASQEMINVALTIIVLLVLFILIALMILLKRIISTPLKSFEDGLLGFFKYLNKETTSVQELTIHSNDEIGIMSNVINENIRKTKNIIDLDNNFLKEVEDIILTIKNGFLNQRL

SEQ ID NO: 13447 - DNA, 819 bp, Unknown
  Obtained from environmental sample
  misc_feature (1)..(819): n is a, c, g, or t
atggaaactccaaataaactactttatattgatagagaagctgtagcaacacttgctatggctagagatgggttactacaacctgttactaaattaatgaataaacaagaatctgaagaggtaaataaaacaggtttttataaagactctattttccctttctcttttatcctttcacctgctggaaaaagaaacaatgctgtcctaaaaaatgccaaagaaggggatacacttactttaatatgtgaaaataaagagtgtggtacactgattgtagactcagtatttgagataaataaagatgaacgaatccaaaagatttatggtacaaataatccagaacaccctggtgtgaaagatacctataaaagattaggaaacttagcagtttgcggtgaatatacagtagagtttgatgatattaaaaataatattaaaaaaataaacaaaactattactaaccttgaagcaaagaatgtttcctctataattttatcaggaaaaccatttcatagagttcatgaaagacttattagaactgcattggttaaatgtgacttattaattatattcttacaaaagccatatcatgatgatggaagattaagttataaagtaagatatgaaacactaaagtatttcttagataattttataccaaaagatagagtgatacttttaccacttgaaaatacatatatatttggtggactaaatgaactgactctaaattcaatcgtatcaaaaaattatggagcaaacaaagcttatcataggtcaaaacccatccagggtctgggtgcatattgggaatcataa

SEQ ID NO: 13448 - protein, 272 aa, Unknown
  Obtained from environmental sample
  misc_feature (1)..(272): Xaa is any amino acid
METPNKLLYIDREAVATLAMARDGLLQPVTKLMNKQESEEVNKTGFYKDSIFPFSFILSPAGKRNNAVLKNAKEGDTLTLICENKECGTLIVDSVFEINKDERIQKIYGTNNPEHPGVKDTYKRLGNLAVCGEYTVEFDDIKNNIKKINKTITNLEAKNVSSIILSGKPFHRVHERLIRTALVKCDLLIIFLQKPYHDDGRLSYKVRYETLKYFLDNFIPKDRVILLPLENTYIFGGLNELTLNSIVSKNYGANKAYHRSKPIQGLGAYWES

SEQ ID NO: 13449 - DNA, 630 bp, Unknown
  Obtained from environmental sample
  misc_feature (1)..(630): n is a, c, g, or t
atgggtagtttagaaaaattaaaaaatgttgcagccgataaaacaatattatatatagaaagtgacaaggtattacaaaaaaactttggaatatatttacaaaaaatatttaaaaaattttaccaagcatatgatggagaagagggatttgaactttttttaaaaataaaacccaatatagtccttatggatttaaaattagataaaaaagatgcaatagaattaatagctgatattaaagatattgatgaagaggttattatacttactttaagtgctagtgatgaaaattacaatcttttacaatcattggatatgggattagcaggtatgttactaaaaccagtaactttttctcaacttgtagagaagcttattagaattcttcctcccgtaaaaaaagttatatcacaaaaagtagaaaaacaaaaaatagcagctacaccaatagttcctaaatccaaagaagttgcgaaaaaacaaatagagaaaaaagttgaaacaaaaacaacagtagatttaaaaaattctaaaaattcaaaagttncagaaccgataaaacaaaaaaatattgagaaaatacaaatagttgaaaaagagaaacaacctttaaagaaaaacctacagtag

SEQ ID NO: 13450 - protein, 209 aa, Unknown
  Obtained from environmental sample
  DOMAIN (14)...(133): Response regulator receiver domain
  misc_feature (1)..(209): Xaa is any amino acid
MGSLEKLKNVAADKTILYIESDKVLQKNFGIYLQKIFKKFYQAYDGEEGFELFLKIKPNIVLMDLKLDKKDAIELIADIKDIDEEVIILTLSASDENYNLLQSLDMGLAGMLLKPVTFSQLVEKLIRILPPVKKVISQKVEKQKIAATPIVPKSKEVAKKQIEKKVETKTTVDLKNSKNSKVXEPIKQKNIEKIQIVEKEKQPLKKNLQ

SEQ ID NO: 13451 - DNA, 792 bp, Unknown
  Obtained from environmental sample
  misc_feature (1)..(792): n is a, c, g, or t
ttgaaaaaagagaaaccaacccttaaaaagaaaaaacctacagtagcaccaaaggaggcagtaaaaaaagagattaaaactgaaccaaaactagagattaaagtactaaaactttgtatggaagatataaaagaatatgcaaaaaatgaagagagtatattgctaataaatacatataaaggtataacaattcataatcaaggggagcttttaaactgtgaagaaaatagttttgaagtaaaggcctcaactgcacaaattgtagctgcaaaatatgaaaaacatgtaatattaaaagttgaaatgaaaaataaatatatatttgcaaatattattaatattgatttaaaaaataataaattaagattggtaaaaccttactatataagttatcaacaaagagataaaagtgtattaagattaacagctgatagtagttttaaagcaacaatgttttttaacaatacacatattgattttaaagctaaacaactttcatctcagtatgtattattaactacagataccttagatcttgatataaagccaaatatgcaacttgatttaacatttggatttgatatatcttcaccaagtgttttaattaaagagaaaaagtttacaaaaacatttgcaaaaggtacagttatcagagtagataaaacaagtagtggtatacaaatagcaatggcaatcgaggtacaaaaatcaggtcaaagtaatttctcaaaatatttaaaacaaagagaaaatgaaaccatagaagagttaaaacaaataatgaaaagataa

SEQ ID NO: 13452 - protein, 263 aa, Unknown
  Obtained from environmental sample
  misc_feature (1)..(263): Xaa is any amino acid
MKKEKPTLKKKKPTVAPKEAVKKEIKTEPKLEIKVLKLCMEDIKEYAKNEESILLINTYKGITIHNQGELLNCEENSFEVKASTAQIVAAKYEKHVILKVEMKNKYIFANIINIDLKNNKLRLVKPYYISYQQRDKSVLRLTADSSFKATMFFNNTHIDFKAKQLSSQYVLLTTDTLDLDIKPNMQLDLTFGFDISSPSVLIKEKKFTKTFAKGTVIRVDKTSSGIQIAMAIEVQKSGQSNFSKYLKQRENETIEELKQIMKR

SEQ ID NO: 13453 - DNA, 639 bp, Unknown
  Obtained from environmental sample
  misc_feature (1)..(639): n is a, c, g, or t
gtgagagtaatgtctatcaatcctcgtatcatagcaagacttgatgatgatttaaaaaatcagatatctaaaaagttgctgctaaaaaagtattcacattatgatgaaagcaaacttttaagagctgctataaataactttgtagatcagaacttatttaactatgtttcaaacatagatactattataaaagtctcaaatgaaatgattattgacatgaatggacttactgcaaatatatctcaaataacagaacatttaggagttgcagcagatgaagatattaatattataatagataatttctcatattgtaaaaagtcaaatatagaatatgtccaggaactgaaaagattagttaaacttttaagaccttttgaaaagaataaaataaaaaatcatacaattattgctcgagtagatcaaacaatattattggatgttaaaagaaatatagatatctataaaaatctaaaaatggataagtcaaaactcattagagcagctttaaaatactttttagataaaaggtactacatactatcagataatcaaataaaatatgctagagagcttatgaagttaaataatgatgtagcaaatattacaaatgatgttaataggattgcttttgaataa

SEQ ID NO: 13454 - protein, 212 aa, Unknown
  Obtained from environmental sample
  misc_feature (1)..(212): Xaa is any amino acid
MRVMSINPRIIARLDDDLKNQISKKLLLKKYSHYDESKLLRAAINNFVDQNLFNYVSNIDTIIKVSNEMIIDMNGLTANISQITEHLGVAADEDINIIIDNFSYCKKSNIEYVQELKRLVKLLRPFEKNKIKNHTIIARVDQTILLDVKRNIDIYKNLKMDKSKLIRAALKYFLDKRYYILSDNQIKYARELMKLNNDVANITNDVNRIAFE

SEQ ID NO: 13455 - DNA, 648 bp, Unknown
  Obtained from environmental sample
  misc_feature (1)..(648): n is a, c, g, or t
atgtatattggtgatgatacttttaatgatatgctctatatgtctataatacatgacaattcaacagtatatacattatatagttttgatggtgaacagcttaataaaaaagatatcaaacttgaatactttgatttagcacattatagtggtaactttaatcactcaaaatatttaattaaaaatggatattttccacatgattatgatatctttaatattacaaatacaaagataagtcaaattaagaatgtagttatattagagttcatgggagataaagctcttgtatttagatcacttggtaattcattgtttaataatttacaatttcaattatcaacaatagatctattaactggtaaagaagatatcttagttatagaaaatacaaatagtgatgtaaaatatacaataagtaaaactcaaaaacaacttattcttacaaatttaaaaactcaaaagagtataaatgttttaaatttaaaagagatcgatggtgatgttgcagcagctccaaaactcaaaggtaaaatgaatggtgtaattattaataaatttagtttgtatgagcttcaccatgaaacaaaaaatgatgtattaaatagaacatttagaaatgaacctattttttatgaagattattaa

SEQ ID NO: 13456 - protein, 215 aa, Unknown
  Obtained from environmental sample
  misc_feature (1)..(215): Xaa is any amino acid
MYIGDDTFNDMLYMSIIHDNSTVYTLYSFDGEQLNKKDIKLEYFDLAHYSGNFNHSKYLIKNGYFPHDYDIFNITNTKISQIKNVVILEFMGDKALVFRSLGNSLFNNLQFQLSTIDLLTGKEDILVIENTNSDVKYTISKTQKQLILTNLKTQKSINVLNLKEIDGDVAAAPKLKGKMNGVIINKFSLYELHHETKNDVLNRTFRNEPIFYEDY

SEQ ID NO: 13457 - DNA, 321 bp, Unknown
  Obtained from environmental sample
  misc_feature (1)..(321): n is a, c, g, or t
atggggggctacgatatttttaaaagtactttagaaaaagaaaaatggactacccctcaaaatttaggctaccctatcaactcagctggtgatgatgtagcttttgtgctaactgccaatggcgaacatgggtattatacttctggaaaaacaggtggcgaaggcaaaagagatatttataaaatagtttttcttgatgaaattaaaaacaatagtcgcccaaaacttaccttactaaaaggaattgttttcgacaataaaaccaaaaaaccattaagtgctttaatagaaattttgataatgataaaaataaatgtctga

SEQ ID NO: 13458 - protein, 106 aa, Unknown
  Obtained from environmental sample
  misc_feature (1)..(106): Xaa is any amino acid
MGGYDIFKSTLEKEKWTTPQNLGYPINSAGDDVAFVLTANGEHGYYTSGKTGGEGKRDIYKIVFLDEIKNNSRPKLTLLKGIVFDNKTKKPLSALIEILIMIKINV

SEQ ID NO: 13459 - DNA, 456 bp, Unknown
  Obtained from environmental sample
  misc_feature (1)..(456): n is a, c, g, or t
ttggtcagaatcggctcgaggcaggcaaaaagaaagtgcgatatttataactcaaaaattactcttcttgaagatgatatatacacttatgattataaaatgtctgatgttattattagtaactatacacttcaatttatcaggccgcttcaaagagagaaacttgtagaaaaaattgcttcagctctgaatgatgatggtgtatttatttttagtgaaaaagttattagtgaaaataaaagattaaataaagagttgattgactgttattatgattttaagaaagagcagggttatagtgagtatgaaattatgcaaaagcgtgaagctttagagaatgttttaattccatatagtgaaaaagagaatattgacatggttaaaagatgtggatttaaacattgcgaagtgatatttaagtgggcgaattttgctacatttatagcaataaagtaa

SEQ ID NO: 13460 - protein, 151 aa, Unknown
  Obtained from environmental sample
  misc_feature (1)..(151): Xaa is any amino acid
MVRIGSRQAKRKCDIYNSKITLLEDDIYTYDYKMSDVIISNYTLQFIRPLQREKLVEKIASALNDDGVFIFSEKVISENKRLNKELIDCYYDFKKEQGYSEYEIMQKREALENVLIPYSEKENIDMVKRCGFKHCEVIFKWANFATFIAIK

SEQ ID NO: 13461 - DNA, 804 bp, Unknown
  Obtained from environmental sample
  misc_feature (1)..(804): n is a, c, g, or t
ttgggtacatcaaaacttgaatttttagctatactaatcatctccgcactttttatagagtatagatacaaatataaaaagattatccctataagctacgcaatagtaattatagtactattttttaccaataaatataatatttcacaaaataatataaaataccctcctctaaaagtatataaatatgaaacacatataccacaagagcaaaaatgggatagaaagtataaaaaagagataatagaaaataatttaaatgcaatagagttagctataaaaaataatgatgatttaattatatttccagaaactgcttttccgttaattttaaatcatcaaactattctacttaataaactactagaatattcaaaaaaaatatctattgttacaggctcactctatgaaaaggatactttattgtataattcatcctatttatttcaaaatggtactttacaaatagcaaataaagtagttttagtaccatttggtgaagctgtaccaatgcctgaaaaaattaaaaactggatcaatgatactttttatgatggagcaaaagattatatcacagcatcaaaaccgacaacatttactattaaaaatataaaatttagaaatgcaatctgttatgaagctacaaccgataaaatatatactgatatggacacgcaatatgctatagctatctcaaataatggatggtttaccccatncatacaaccaacactacaacaacttctaatgaaatattatgaaaataaatatgatataatgatacttgatgtatcaaatcaataa

SEQ ID NO: 13462 - protein, 267 aa, Unknown
  Obtained from environmental sample
  DOMAIN (59)...(233): Carbon-nitrogen hydrolase
  misc_feature (1)..(267): Xaa is any amino acid
MGTSKLEFLAILIISALFIEYRYKYKKIIPISYAIVIIVLFFTNKYNISQNNIKYPPLKVYKYETHIPQEQKWDRKYKKEIIENNLNAIELAIKNNDDLIIFPETAFPLILNHQTILLNKLLEYSKKISIVTGSLYEKDTLLYNSSYLFQNGTLQIANKVVLVPFGEAVPMPEKIKNWINDTFYDGAKDYITASKPTTFTIKNIKFRNAICYEATTDKIYTDMDTQYAIAISNNGWFTPXIQPTLQQLLMKYYENKYDIMILDVSNQ

SEQ ID NO: 13463 - DNA, 540 bp, Unknown
  Obtained from environmental sample
  misc_feature (1)..(540): n is a, c, g, or t
atgtctttatttgatcgcttagaacttttaaactctatccacccttttgacgaactctctaaaaaggtaaaagaggatttgatctcctctatggatatagcgtactatccaaaaggtacaacccttatttcacctagtttagaggccaagcatctatatattattataaaaggtgttgttcatgagatctttgatgaagagcttcaaaatgtttatggtgacaatgatacatttgatccatcttctcttattaattcaaaaagcgaaaatcattttatagtaaaagaggagctgatttgttatgagcttgaaaaagagagatttttagatcttattcaagactatagtagttttaaaagtttctatctaaataattttgtagagatgcacccaagatttaaagagagacaaaccaaagtgaacttacatctttcatggttgcccgtgttgatgaaatttttatacactcctcttggattggtaaatcaaaatgaatctatattaaactctatcaaaaaaatgaaatcccgaacaatctag

SEQ ID NO: 13464 - protein, 179 aa, Unknown
  Obtained from environmental sample
  DOMAIN (30)...(117): Cyclic nucleotide-binding domain
  misc_feature (1)..(179): Xaa is any amino acid
MSLFDRLELLNSIHPFDELSKKVKEDLISSMDIAYYPKGTTLISPSLEAKHLYIIIKGVVHEIFDEELQNVYGDNDTFDPSSLINSKSENHFIVKEELICYELEKERFLDLIQDYSSFKSFYLNNFVEMHPRFKERQTKVNLHLSWLPVLMKFLYTPLGLVNQNESILNSIKKMKSRTI

SEQ ID NO: 13465 - DNA, 1035 bp, Unknown
  Obtained from environmental sample
  misc_feature (1)..(1035): n is a, c, g, or t
atgaaggcggaaaacctgttctggctgggacgatatctttcacgctcgatttctacgacccggctggtactgcatgtcattaagaagatcaccaatttctaccgatatgaagtcgctatttcaaaagagtctcaagtcatcttgcaaaatgctttgacgcatatgacgatgacctatcccggttttatagatccggataacaaagagaaccttgatatctttcctatggcagagataacatccgttgtcaagcatatccaccggtcaggctctttggcgtcgacggtgatgatgctctccaatgccaacgtcaacatcaaagaccttctgacccttgagtcatggaagctttttgagaagatgcaaaaagagtggaatgatttcatcaacagaaagaacgactctacgatgcgagtcgccagtgagttagaaagtttcttgatctatttgatggcctataaagaactggtcagagagagtatcttcaaagagcagggtcttatcttgtatgatatcggttataagatcgaagatggactgcttctgatctcaaaagcacgttctatgttgtgtttgaagttggacaaatctatcggacacgatgtactcgaagggatgctcaactcgatagagagtttcaatgcctacagagcgcattacaaaagttctttgacactggaaaatgtggttgatttcttgatcttgaatacgcagtttccaaagtcgttgacgtacatcaccgagagtcttttaaaagagttcaaacagttgccccaagcaaacaaggccatggcttcttatgaagataccatgcttaaagtggcagagttactgcagtctatggatttacatactttgatacagatcaaagaaaaagagggggtgtatggtgaagctgacaaagtcctggcccaaacttttcgaatctgttttttggaaatgttcccattgcctttctcaaaaaaccctattttttcccctttaaggagggaggtaaaccaagggatcttttggaaccccctccccccaaaaaag

SEQ ID NO: 13466 - protein, 345 aa, Unknown
  Obtained from environmental sample
  DOMAIN (3)...(310): Bacterial domain of unknown function (DUF403)
  misc_feature (1)..(345): Xaa is any amino acid
MKAENLFWLGRYLSRSISTTRLVLHVIKKITNFYRYEVAISKESQVILQNALTHMTMTYPGFIDPDNKENLDIFPMAEITSVVKHIHRSGSLASTVMMLSNANVNIKDLLTLESWKLFEKMQKEWNDFINRKNDSTMRVASELESFLIYLMAYKELVRESIFKEQGLILYDIGYKIEDGLLLISKARSMLCLKLDKSIGHDVLEGMLNSIESFNAYRAHYKSSLTLENVVDFLILNTQFPKSLTYITESLLKEFKQLPQANKAMASYEDTMLKVAELLQSMDLHTLIQIKEKEGVYGEADKVLAQTFRICFLEMFPLPFSKNPIFSPLRREVNQGIFWNPLPPKK

SEQ ID NO: 13467 - DNA, 834 bp, Unknown
  Obtained from environmental sample
  misc_feature (1)..(834): n is a, c, g, or t
gtgttggaatttctcccagggagatatcgcctccccgtctatgagtattcagagtttgtcgatatgtttggaaacacgaacacctatatgctcataagagagccccatcagctgctcagtgttgtcggaaagtccaagatcgagatattccctgaacgtgtcgaagaacatattgataagatcaagaaaaacagtatcacctacgcacaggcactggaacgcttgtcgaagttccacattgatgacctgtatgctaaacagtacctttttgaatcagatcttattcccaacggctctttgaagatcagagagtatgtcttggagtcttttcgcaaagacagagacctcttcgaggcgacgcatgagtttatgcagcgcatctttaacgatttcaagtttgtctcgggatttagtgatatcacgacacccatagagaagatctttgaggcaaaaaaaggggtctgtcaggattttgcccagtttgccatctcggcactgcgcaccatcggccttccggcaaagtatatgagcggctatatcgagaccttgcctcccgagggtgaaaagaaactcttcggtgcagatgcttcacatgcctggtttgcagtgtatatccccaatgccgggtggatagagtttgatcccaccaacaatcttatcccgaaagaccagcatatccttctgggttcgggaaaagattacaacgacatctcccctctaaaaggggttgtctacagcagcggtaacagtaatctctcggtgatggtagatgtcagaaagtcagacgacaatactaaagtcattacacaacagcaaagtcaaagtcagcaatag

SEQ ID NO: 13468 - protein, 277 aa, Unknown
  Obtained from environmental sample
  DOMAIN (150)...(216): Transglutaminase-like superfamily
  misc_feature (1)..(277): Xaa is any amino acid
MLEFLPGRYRLPVYEYSEFVDMFGNTNTYMLIREPHQLLSVVGKSKIEIFPERVEEHIDKIKKNSITYAQALERLSKFHIDDLYAKQYLFESDLIPNGSLKIREYVLESFRKDRDLFEATHEFMQRIFNDFKFVSGFSDITTPIEKIFEAKKGVCQDFAQFAISALRTIGLPAKYMSGYIETLPPEGEKKLFGADASHAWFAVYIPNAGWIEFDPTNNLIPKDQHILLGSGKDYNDISPLKGVVYSSGNSNLSVMVDVRKSDDNTKVITQQQSQSQQ

SEQ ID NO: 13469 - DNA, 354 bp, Unknown
  Obtained from environmental sample
  misc_feature (1)..(354): n is a, c, g, or t
ttgtctttaattctttgctttagattttttattttatttttcataattacttttatacactacaattgtagtttgattatgaattattacataactatacttacacattactattgtagggtgaatatgaataaaaaaattaatgatttaactgctgatgaattgcataaattaattggtgccaatgttgcaaaactgcgaaaaaaagctaatttaagtcaattagctctgtcattagagatgggaaataaatctccaagtcttgttagttctgctgaactatatacaaataaaagacattttaatattgtgcaacttcaaaagatgcaaagatttagatctcagccgatctga

SEQ ID NO: 13470 - protein, 117 aa, Unknown
  Obtained from environmental sample
  misc_feature (1)..(117): Xaa is any amino acid
MSLILCFRFFILFFIITFIHYNCSLIMNYYITILTHYYCRVNMNKKINDLTADELHKLIGANVAKLRKKANLSQLALSLEMGNKSPSLVSSAELYTNKRHFNIVQLQKMQRFRSQPI

SEQ ID NO: 13471 - DNA, 846 bp, Unknown
  Obtained from environmental sample
  misc_feature (1)..(846): n is a, c, g, or t
atgactgcattaaaactagcacaagctgttgggatatattttaaaaaacattctcgttcaaaaaaaatacttttaggaaaagatactagaaaaagtggttatatgattgaaaatgcactggttagtggtcttacatctgttggctatgatgtgatacaaataggtcctatgccaactccagctattgcttatttaacagaaactatgagatgtgatgctggtattatgttaagtgcaagtcacaactcttttgaagataatggtgtgaagttttttgattgtcatggagataaactatctttaaaaattgaacaagagattgaggatatattttttaatgaagaattattaaaaaactcacaatgtactcatggagatataggtcgtgcaaaaagaatcaatgatgtgattggacgatatatagtttctataaaaagttcattccctacaacattaagtttaagtggtatgagaattgttttagattgtgccaatggtgcaggatataaagtgggaccaactattctagaagaattagatgctgatgtgtttacagtgaatgatgagccaaatggttataatattaatgaaggatgtggtgcattacatccaaatgaattaggaaaacttgtagtacagtatagagcagatgtaggtatcgctcttgatggcgatgcagatagacttgttatcgttgatgaaaatggtcaagtaatagatggagataaacttataggtgcactagctgtttatcttaaaaatactcaaaagctaaaaaatggttgtgtagcaactgttatgagtaataaagctttagaggattatcttaataaaaatgaatattga

SEQ ID NO: 13472 - protein, 281 aa, Unknown
  Obtained from environmental sample
  DOMAIN (138)...(238): Phosphoglucomutase/phosphomannomutase, alpha/beta/alpha domain II
  misc_feature (1)..(281): Xaa is any amino acid
MTALKLAQAVGIYFKKHSRSKKILLGKDTRKSGYMIENALVSGLTSVGYDVIQIGPMPTPAIAYLTETMRCDAGIMLSASHNSFEDNGVKFFDCHGDKLSLKIEQEIEDIFFNEELLKNSQCTHGDIGRAKRINDVIGRYIVSIKSSFPTTLSLSGMRIVLDCANGAGYKVGPTILEELDADVFTVNDEPNGYNINEGCGALHPNELGKLVVQYRADVGIALDGDADRLVIVDENGQVIDGDKLIGALAVYLKNTQKLKNGCVATVMSNKALEDYLNKNEY

SEQ ID NO: 13473 - DNA, 675 bp, Unknown
  Obtained from environmental sample
  misc_feature (1)..(675): n is a, c, g, or t
atgagtgaaaatataggtggacaatttttctcaaaaacaaaaaaactgttacaaaaaatcaaaaatgatgattacaatcccttttataccaaattaaatttagaagatataagcgataaactcacagaggtacaaatactagaaaccgccatcaaatcaaaaaatactattatttgcaactataaaattgatgaaacaactaagataaagataaatccccttaaaatagttaattatgaggggttttggtatcttgtagctgttggtgcaaaaaatgatatactgaaaaaatattatctaaaaaacatctcttttgtaaaaattacaaatgaaacttttgaagttacagaggagttggatgatttacttgaaaactctgtatcaatttggtttcaagaagatatagaaccttttgatgttacgctttatattgatagcaaaattgcaaaatattttcaaagaaaaccaatatcaaaagcacaaattatagaaaaaaaagatgatgatggtagtcttaaaataaaagtaaccatcactcatgagatggaaattttaccaatagtaaaatattggattcccaatattaaaattattgagccacaatgggtcaatgatattttagatgaacaaatcaatttatattataaaaaagggttcggattaaagtctatttaa

SEQ ID NO: 13474 - protein, 224 aa, Unknown
  Obtained from environmental sample
  misc_feature (1)..(224): Xaa is any amino acid
MSENIGGQFFSKTKKLLQKIKNDDYNPFYTKLNLEDISDKLTEVQILETAIKSKNTIICNYKIDETTKIKINPLKIVNYEGFWYLVAVGAKNDILKKYYLKNISFVKITNETFEVTEELDDLLENSVSIWFQEDIEPFDVTLYIDSKIAKYFQRKPISKAQIIEKKDDDGSLKIKVTITHEMEILPIVKYWIPNIKIIEPQWVNDILDEQINLYYKKGFGLKSI

SEQ ID NO: 13475 - DNA, 363 bp, Unknown
  Obtained from environmental sample
  misc_feature (1)..(363): n is a, c, g, or t
atgaaaattattttacttattttttttcttttattaagtttctcttttgcaaatgatagagagttagaagctatatttaaaaaatctaatataaatggtacacttgtattaagcagtttagataacaaagaaaactatatatacaatacaaaaagagccttaacacaatatatcccagcttcaacatttaaaataccaaatacacttatagcacttcaagagcaagtgataaaagatgagtatgaaactataaaatgggatggagtagttcgaacttataaaccttggaatgaaaaccaaaaccttcaaacagcaatagctgtatcgtgtgtatggtgttatgaaaagttgcacaaaaaatag

SEQ ID NO: 13476 - protein, 120 aa, Unknown
  Obtained from environmental sample
  SIGNAL (1)...(17)
  misc_feature (1)..(120): Xaa is any amino acid
MKIILLIFFLLLSFSFANDRELEAIFKKSNINGTLVLSSLDNKENYIYNTKRALTQYIPASTFKIPNTLIALQEQVIKDEYETIKWDGVVRTYKPWNENQNLQTAIAVSCVWCYEKLHKK

SEQ ID NO: 13477 - DNA, 555 bp, Unknown
  Obtained from environmental sample
  misc_feature (1)..(555): n is a, c, g, or t
ttgttccttgatcaccgtgttacgcgtaaattagtgggtgataaatctaagggtaaaaatgtccttaatttatttgcttatactggttctgcgtctgtacatgctgcaattggcggggcaaaatctgtcactactattgatatgtctaatacctacatcagttgggctaaagaaaactttgccttaaacggattgtctggtaaacaatatgactttattcaagcagactgtttacagtggattaaagaaaacagccaccagaagtttgatcttatctttattgatcctcctacgttctctaactcaaaacgcatggaagacagttgggatgtgcaacgcgaccatgcagagatgttaggcgggttgattaagctactgtctccaaatggcgagcttattttctccaataacaaacgtaaatttaaaatggatatcgaagcgttgaaccaagcaggtatcgatgtaacgaatattgaccatttatgtttaccgctggattataagcgtaatccgcatatccataatgtgtggctactgactcatgcaaaaaaatag

SEQ ID NO: 13478 - protein, 184 aa, Unknown
  Obtained from environmental sample
  misc_feature (1)..(184): Xaa is any amino acid
MFLDHRVTRKLVGDKSKGKNVLNLFAYTGSASVHAAIGGAKSVTTIDMSNTYISWAKENFALNGLSGKQYDFIQADCLQWIKENSHQKFDLIFIDPPTFSNSKRMEDSWDVQRDHAEMLGGLIKLLSPNGELIFSNNKRKFKMDIEALNQAGIDVTNIDHLCLPLDYKRNPHIHNVWLLTHAKK

SEQ ID NO: 13479 - DNA, 927 bp, Unknown
  Obtained from environmental sample
  misc_feature (1)..(927): n is a, c, g, or t
atgcaatataaagcaatgatgcaagaattactcaatgcaatagaagatgaaaagtttgaacaaataattcgaatgaaaaaaatttatcaaggtatatttccatcaattgttaaaagatttggatatgaaagtattgaacaaatatataatatggtaaattctaaaatgattaagtattatctacaaacaaatcagtgtaatcagcttaatattgttattaaggatatagctgatgatgtgttattattacttattaaagatgaaaaaactgtagataaacttttttcttgtatgatagaagttccagatgagagaacttataaagtagctaaagatgtgtatggaaaagctaaaaataatcgaatttatttttatttagagagagttgctcttattttgaaaaaatatgatgatgcgaaagctttttctcaaaaacttgatatgtttagtgatgcagatgtattgtcagatgagtttttatatagatttttaatatatgcaaatgaagataactcacaagcgatgcaaaacttttttgcatatgctagagcaaatccagagtttataattaacaataaaaacaaccctttaataattgatttttatcaccaatattatctttatttacttaaagaaaaagaggaaaatgaagcagtagctattttaaaagatttatataaaaaacaaaatgagatgaaggctagagtatactcgccatttgttgagaatgaattatcaaagtatgcaaagttagatgataattatgatgaagctttagagtatttacaatatggacttaatataaaaagactcaaagatggaaaaagcttagatagaaaaatcaaagatggaggatttagttcatatatattaagaaaattgcaaagattttatgaaccatccggggtaaaaaaaaattggttttaa

SEQ ID NO: 13480 - protein, 308 aa, Unknown
  Obtained from environmental sample
  misc_feature (1)..(308): Xaa is any amino acid
MQYKAMMQELLNAIEDEKFEQIIRMKKIYQGIFPSIVKRFGYESIEQIYNMVNSKMIKYYLQTNQCNQLNIVIKDIADDVLLLLIKDEKTVDKLFSCMIEVPDERTYKVAKDVYGKAKNNRIYFYLERVALILKKYDDAKAFSQKLDMFSDADVLSDEFLYRFLIYANEDNSQAMQNFFAYARANPEFIINNKNNPLIIDFYHQYYLYLLKEKEENEAVAILKDLYKKQNEMKARVYSPFVENELSKYAKLDDNYDEALEYLQYGLNIKRLKDGKSLDRKIKDGGFSSYILRKLQRFYEPSGVKKNWF

SEQ ID NO: 13481 - DNA, 906 bp, Unknown
  Obtained from environmental sample
  misc_feature (1)..(906): n is a, c, g, or t
atggatcatttagagctgacatttatctcaaaagattcggcagttcaaagagcaggacgggcaggaaggctctctagcgggaaatgttacagactctggcatgagggaaagatactacaacaatctaccaaacctgaaatactcagagcagatttaacatcacttattttggacttgtcgctgtggggagttgatgaatttgatgagttgaaatggctagatattccgaatgagaagattataaaggagtccaaagaagttttaaaagagcttgccatgctagataactcatttaaaatcacactttttggaaaagatgcgcttagtttaggacttcatcctagatttgcctacatgattttaaaagcccatgatttaggttttgcatacgaagcctgcctcttagcctcacttttaagtgagaaagatatttttacctcttcatccaaagacagcgatattttatctaggtttatacatctttttgaaaaagattttgacagtgcctacataaatagacatagagcaaaagaggttctaaatcaggcagattttttttataacaaactaaaaagcattaaaaaagtggctaaaaaaaacagctctcttaatcaggagatgattagtatcttacttcttttcgcctacccagacagactagcacgtcgcagaaatcaaaatgacaacaaatacaaactgagtaatgcaaaaggagctgtacttcatgtagaagactctctgttcaatcaagagtatttggttgtagcaaacttaaatacgcacgagaaagactcctttataaacctagctatgggcatatctctgcaagagatagaagagtatttttcttcattcatcataaatagagaatcaataacctaccaacaagaaagccaaaaagtttga

SEQ ID NO: 13482 - protein, 301 aa, Unknown
  Obtained from environmental sample
  DOMAIN (83)...(163): Helicase associated domain (HA2)
  misc_feature (1)..(301): Xaa is any amino acid
MDHLELTFISKDSAVQRAGRAGRLSSGKCYRLWHEGKILQQSTKPEILRADLTSLILDLSLWGVDEFDELKWLDIPNEKIIKESKEVLKELAMLDNSFKITLFGKDALSLGLHPRFAYMILKAHDLGFAYEACLLASLLSEKDIFTSSSKDSDILSRFIHLFEKDFDSAYINRHRAKEVLNQADFFYNKLKSIKKVAKKNSSLNQEMISILLLFAYPDRLARRRNQNDNKYKLSNAKGAVLHVEDSLFNQEYLVVANLNTHEKDSFINLAMGISLQEIEEYFSSFIINRESITYQQESQKV

SEQ ID NO: 13483 - DNA, 705 bp, Unknown
  Obtained from environmental sample
  misc_feature (1)..(705): n is a, c, g, or t
gtggtagttttttctctgaacaattcaacatcccagacggtattgttcctgaaaaaatgggaagaattaaaagtttacggtgattatatgcaccttatacataagtacaggtgtataggggtaaatctatcggcttttttaggggggtgggttgacgttgcttattggggtgatagtgacacctatactgatcaccaaggccaatttgatgcatacgcagggctgaaagtttcaagtgctggtaaatttgctgatgataagtttaaagatatcaagtatcttcatagaaatttatcaagcggtataacaaaaaatagaaaacagatttcctgggttagtaaaaattctggtggttctgctattaatttagcttatcacttaggagcaacacgtgtttttatattagggttagatatgtataattctaatacaaacagagtacattggcacactggatatcctgataaatccaaaacccctaatataacccaaataagaaaaggggcaagaataccgagacgaaaagtagataaagaaaaatctgattatttgtttaaaaaacaatctactggttggggtcgtactgctaaagatgctgaaagcttaggaatagaaataataaacgtaaacccaaagagtaacattaaagcttttaaaagaatgagtttaacagaagttatggagatgttaaatgactctaattag

SEQ ID NO: 13484 - protein, 234 aa, Unknown
  Obtained from environmental sample
  misc_feature (1)..(234): Xaa is any amino acid
MVVFSLNNSTSQTVLFLKKWEELKVYGDYMHLIHKYRCIGVNLSAFLGGWVDVAYWGDSDTYTDHQGQFDAYAGLKVSSAGKFADDKFKDIKYLHRNLSSGITKNRKQISWVSKNSGGSAINLAYHLGATRVFILGLDMYNSNTNRVHWHTGYPDKSKTPNITQIRKGARIPRRKVDKEKSDYLFKKQSTGWGRTAKDAESLGIEIINVNPKSNIKAFKRMSLTEVMEMLNDSN

SEQ ID NO: 13485 - DNA, 321 bp, Unknown
  Obtained from environmental sample
  misc_feature (1)..(321): n is a, c, g, or t
atgagtaatctattttcaagaggaataagtgaattaagagataagttaatagatacatcaagaagaaataaacttataaactataaacgacctaataaatccaaaaatctgcaaataatagatgaatctgctgaatttatttatgactacttattaaaagatgagaataaatttaaattcaaatttattccagaacccattatttcaaaaagagatttancaaagattgatgaagagatttccgagaataaagaggaattaaaaaaagctacaataaatgaagatgaaaatgctaaaaaaacaattactaatcttttatag

SEQ ID NO: 13486 - protein, 106 aa, Unknown
  Obtained from environmental sample
  misc_feature (1)..(106): Xaa is any amino acid
MSNLFSRGISELRDKLIDTSRRNKLINYKRPNKSKNLQIIDESAEFIYDYLLKDENKFKFKFIPEPIISKRDLXKIDEEISENKEELKKATINEDENAKKTITNLL

SEQ ID NO: 13487 - DNA, 711 bp, Unknown
  Obtained from environmental sample
  misc_feature (1)..(711): n is a, c, g, or t
gtggaaggtttagaaacttatattgaattatttgaaaagactatnttaaatatagttaaaattgataaaattttaaaacatataaaaaatgaaactaatatttcaaataataaaaatattgaatatatttctcaattaagtataggaattaaatatttaacccatattaatttagagttatattgtactttaaatcaaaattatttagatgtctctttttctaaaaactttgataatatgaaaagagatttatctcaatatgaaactttaaaaaattcattatcaacaatctcaaaaattagtgaaatagataatttttcagttgataaaataaattcaattcaaaaaataatagaagagaaaaaaagttcatttttcaacttcttttcaaaagaatataaacaatcaaaaaataaaattgaaagtgtgttgttaaatcatctaccaagtgataaaacaaaatggagtgaaatactaaataaaataaaagaatatgttttatttaagaagcaatttgaacaaaacaatgattatattcaattttttggaaagctttttgaaggaactaaaactaaaataaatgatattgagaaattacataactgggttttagttattaaaaaagacattaatattacagaaattttaactttattattaagtggagatgatacaaaatataatctacttacatcatataaagactcataa

SEQ ID NO: 13488 - protein, 236 aa, Unknown
  Obtained from environmental sample
  misc_feature (1)..(236): Xaa is any amino acid
MEGLETYIELFEKTXLNIVKIDKILKHIKNETNISNNKNIEYISQLSIGIKYLTHINLELYCTLNQNYLDVSFSKNFDNMKRDLSQYETLKNSLSTISKISEIDNFSVDKINSIQKIIEEKKSSFFNFFSKEYKQSKNKIESVLLNHLPSDKTKWSEILNKIKEYVLFKKQFEQNNDYIQFFGKLFEGTKTKINDIEKLHNWVLVIKKDINITEILTLLLSGDDTKYNLLTSYKDS

SEQ ID NO: 13489 - DNA, 687 bp, Unknown
  Obtained from environmental sample
  misc_feature (1)..(687): n is a, c, g, or t
gtgacaagttcaagcagtaaatcatctggaaaaagtagttcttcaggttttggcttatttaatgtagacaacattactggaggaaaattattagggcaggaagaaagccaaatggatgtgattagtgaattagtgggactaatgggaggtgagttggaaactcttgatgagaaaactaaaggttcccgggtgatttttacccttgcactagagaggtttgatgaaaatgacaatcggtatagtccatccatcttcagtaaaaacgaagtagacccaacattgaagattctttatgcagaagataatccggtgaatcaaaagcttatgatcttaatgttagatgcattggggcttaacgcggatgttgcaaaagatggaagtgaggctgtggaaatggcatctaaaaagtattataacattatcctgatggacattcagatgccggtaatggatggactcgaagcttcgagaagaatcattcaacgatctaatgcgaggccggttataatcgctactacagcaaatttagccgaagtggataaacgaaaatgttttgaggctggtatgaatgattttgtaagcaagcctataaaccaagaggaattgaagctaaccataataaaatggcaagggctaaaaaagtatttggatgattccgatgataatattgtcaagctatcctcctaa

SEQ ID NO: 13490 - protein, 228 aa, Unknown
  Obtained from environmental sample
  DOMAIN (94)...(214): Response regulator receiver domain
  misc_feature (1)..(228): Xaa is any amino acid
MTSSSSKSSGKSSSSGFGLFNVDNITGGKLLGQEESQMDVISELVGLMGGELETLDEKTKGSRVIFTLALERFDENDNRYSPSIFSKNEVDPTLKILYAEDNPVNQKLMILMLDALGLNADVAKDGSEAVEMASKKYYNIILMDIQMPVMDGLEASRRIIQRSNARPVIIATTANLAEVDKRKCFEAGMNDFVSKPINQEELKLTIIKWQGLKKYLDDSDDNIVKLSS

SEQ ID NO: 13491 - DNA, 633 bp, Unknown
  Obtained from environmental sample
  misc_feature (1)..(633): n is a, c, g, or t
atgattcaagataactgcacaaaaaaaaggataaagcctcgacttttaagagatgtaaaaacagaagcgttgcttgtattttcaagaactgcactagaaaggttttttggaagagttgataacaatgaatggcaaccaattgttggaacagatgatgaaacaatctatatatacgatacattaagaaagttaaaagaccaacttcaagagtgtgtagtaaatgtagattatttacttaatctagtgcaaaatgctaaaaaacatccagagttgagatctttagcaaaatttgaagaacctcttattacatactacgatgttttagcaaaaaaagtagaagtagatattccaacaaatcaaacatggtggataccagaacttgttgtagtttgtactcttagtcattgggttttagaaaatgaaagatcaacagtattgtatccatttcttaaagatgttgattacacaacattgattgaaaaatttgaattatatggtaaaaatttagatggtgaaaaaaaagatattgtgataaatatgcataaaattgcagttgaacttatagaaaagctagaaaaaacaaaatataaagtaaacaaaactagagtttcaaaaactagaaagaaaaaataa

SEQ ID NO: 13492 - protein, 210 aa, Unknown
  Obtained from environmental sample
  misc_feature (1)..(210): Xaa is any amino acid
MIQDNCTKKRIKPRLLRDVKTEALLVFSRTALERFFGRVDNNEWQPIVGTDDETIYIYDTLRKLKDQLQECVVNVDYLLNLVQNAKKHPELRSLAKFEEPLITYYDVLAKKVEVDIPTNQTWWIPELVVVCTLSHWVLENERSTVLYPFLKDVDYTTLIEKFELYGKNLDGEKKDIVINMHKIAVELIEKLEKTKYKVNKTRVSKTRKKK

SEQ ID NO: 13493 - DNA, 648 bp, Unknown
  Obtained from environmental sample
  misc_feature (1)..(648): n is a, c, g, or t
atgaaaaatttaattgaattaaacgaagatgaaaaagattgtttacaagagctcatgaatatctcttatggtgctgcaacagcagcaatttctgaaataattggaaagtttgcaacattaagtataccaaatattgatactatttcatcttgtgatttaagaaaacatcttaatgaaaaacttttaagtaaaaataaatactatgtatcaaatcaattagttaatggataccttgcaggtgaaaacatttttatcatagatgaaatttcaagtataaaccttgcacgggaatttgacctaagtgatgatgaaattgatgaaaatgagataaaagatataatactagagattactaatattctttcttctgctacttcagggaaactagcttcattagtagatacaagtatctcatttagtgcccctcatattacaaaaataaactctattgatgaatttgataaaagatttgaaggggaatatagtcatgtaattataatctcaacagaactaaattttaaagagcagaatattaagggtgagctgatgattttaactaaaaaaagatcatctatttttctaaaaaaagcacttgataatgcctttagaaaaacttttaatttaaggctctattatgcaaataaataa

SEQ ID NO: 13494 - protein, 215 aa, Unknown
  Obtained from environmental sample
  misc_feature (1)..(215): Xaa is any amino acid
MKNLIELNEDEKDCLQELMNISYGAATAAISEIIGKFATLSIPNIDTISSCDLRKHLNEKLLSKNKYYVSNQLVNGYLAGENIFIIDEISSINLAREFDLSDDEIDENEIKDIILEITNILSSATSGKLASLVDTSISFSAPHITKINSIDEFDKRFEGEYSHVIIISTELNFKEQNIKGELMILTKKRSSIFLKKALDNAFRKTFNLRLYYANK

SEQ ID NO: 13495 - DNA, 807 bp, Unknown
  Obtained from environmental sample
  misc_feature (1)..(807): n is a, c, g, or t
gtgtttattatggccaatcaactcacagagcttacggacagagtcttaaaagaagtcataaaaaatgaggtcatcctgccctcgacctataaagagcactttgacaatcatgcacgcgagatgcagatcgatcttgactatgagaatattacaagcgaagagacacagcggcagctcaaccaagcaagcgaactgacagaaaagacctattgtaatcttgacacactgcaaaagaccacacaggatgcccaagatgccatacgcgataaagaccttgataaattagccataatcacacaagagatatccggtctcaaagatgccttgggcgagttgaaagcacagcttcacacagatacacttaccaatattcacaatagaaaatggctaatggagaatatcttatatgaaggagattttgtctcaaacggcatacttgctttcatagacctggataaattcaaacccatcaatgataaatacggacatgttatcggagacaaggtcctgcaatatctggccggatttttaaaatcgaacctaaaaggtatggatatcattcgttatgcaggcgatgaatttatcatcgtctctaaaaatgagcatatggaacagtgctatttaagacttaaaaagcttcaagaagatcttctaagcaagaagcttaaggcggccaacggtgagttgctgtacctctccttttcatttggaatggcacgttttgaggcgggaacaaactttagggacactttggagattgcggattctttgatgtatgaaaacaaaaagagcaaaaaagcttcctga

SEQ ID NO: 13496 - protein, 268 aa, Unknown
  Obtained from environmental sample
  DOMAIN (112)...(268): GGDEF domain
  misc_feature (1)..(268): Xaa is any amino acid
MFIMANQLTELTDRVLKEVIKNEVILPSTYKEHFDNHAREMQIDLDYENITSEETQRQLNQASELTEKTYCNLDTLQKTTQDAQDAIRDKDLDKLAIITQEISGLKDALGELKAQLHTDTLTNIHNRKWLMENILYEGDFVSNGILAFIDLDKFKPINDKYGHVIGDKVLQYLAGFLKSNLKGMDIIRYAGDEFIIVSKNEHMEQCYLRLKKLQEDLLSKKLKAANGELLYLSFSFGMARFEAGTNFRDTLEIADSLMYENKKSKKAS

SEQ ID NO: 13497 - DNA, 927 bp, Unknown
  Obtained from environmental sample
  misc_feature (1)..(927): n is a, c, g, or t
atggctgagatctcagggagatcgaaaatgagttttttatttcctgagtatttttggctattcttgtttttagttgctggatatataaaaaaagattttagaggtttgagtgttgtttctttaggctacataatcacctttgtttttatagtatttgctttaactcgtccggtcatagaacaagaacccataaaaagtgaacaagtgttaagtgatgtagttatagcagttgatttatcttactcaatgcaggcgaatgacataaagccatcaagactgaaaaaagcaaaagagattttaacagagtttataaaaagtgagcaaaagagtaggtttgcaatactggggtttactacaaacgccattatcctttcaccaatgacagaagatactgaactattagagcatctatttaattctcttgatgaaaagctcatcattacaagaggcagttctattatgccagctttgaaattggcaaggaagatgtcacagtcaaaaaacttaagtgttcttatcttaagtgatggagcggatgaaatctcttatgaagaagaagcgaagtttgcaaaagagaactctcttgtcgtaaatatttttatgcttggtacaaagatgggaggaactcttttacttgaaaatggagaactcttaaaagatgaaacaaacgatattgtagtaagtagagaaaatacagcaataaaaactatctcagatgctacagacggagtttatacaaaaagcttggacgagttggtggatgccttagatgcacaaaagacagacgataaaaaatctcaaactattatcattaaaaatcttgaattgttttactacttgattgttttagcaattatctcttttttagtaagtgttacaactctaaaaagatacattcttgcttttttacttctgttttggaggtaa

SEQ ID NO: 13498 - protein, 308 aa, Unknown
  Obtained from environmental sample
  DOMAIN (72)...(256): von Willebrand factor type A domain
  misc_feature (1)..(308): Xaa is any amino acid
MAEISGRSKMSFLFPEYFWLFLFLVAGYIKKDFRGLSVVSLGYIITFVFIVFALTRPVIEQEPIKSEQVLSDVVIAVDLSYSMQANDIKPSRLKKAKEILTEFIKSEQKSRFAILGFTTNAIILSPMTEDTELLEHLFNSLDEKLIITRGSSIMPALKLARKMSQSKNLSVLILSDGADEISYEEEAKFAKENSLVVNIFMLGTKMGGTLLLENGELLKDETNDIVVSRENTAIKTISDATDGVYTKSLDELVDALDAQKTDDKKSQTIIIKNLELFYYLIVLAIISFLVSVTTLKRYILAFLLLFWR

SEQ ID NO: 13499 - DNA, 675 bp, Unknown
  Obtained from environmental sample
  misc_feature (1)..(675): n is a, c, g, or t
ttggaaacagcaaaaaaaggaaattattattatccaaatgaaaaagccgtggttaatgtatcactacaagcattcaagcttgggaaatataatctgcaatataaaattttagatcgcaagggaaaacttgttagaaaaaaaactctttcattaaactttactgcgcaagatcaaaagaaaaatataaaaatagatctttcgaacaaaacttttggctggtacaaaatagttgttgagctaaaaacaaacagaaataaaaaattggtgaaaacagattgttcattagtcctgctaccaacagataaacgtaaagcaaaatttgattcaccgtatttttgctggtggcatcatgcccatggtttacctcagaaactggatgaagtaggcaatctgcttaaagcattcggctgtcactacagcactactaataagcagcgtaattctcttgaagaaaataaaaaatggaatataagtcaagaacagatttcctatattccgttgcacagaattttatttggtcgtggctacaagaaatatatagagccgacagaaaaaaaacgtcagaaagctatagcgtatataaataggcagattaagaataatactcttattaaaagnggctatgattctttcaggaatcatatacctttcccaaaagcaaggttttccccctga

SEQ ID NO: 13500 - protein, 224 aa, Unknown
  Obtained from environmental sample
  misc_feature (1)..(224): Xaa is any amino acid
METAKKGNYYYPNEKAVVNVSLQAFKLGKYNLQYKILDRKGKLVRKKTLSLNFTAQDQKKNIKIDLSNKTFGWYKIVVELKTNRNKKLVKTDCSLVLLPTDKRKAKFDSPYFCWWHHAHGLPQKLDEVGNLLKAFGCHYSTTNKQRNSLEENKKWNISQEQISYIPLHRILFGRGYKKYIEPTEKKRQKAIAYINRQIKNNTLIKXGYDSFRNHIPFPKARFSP

SEQ ID NO: 13501 - DNA, 723 bp, Unknown
  Obtained from environmental sample
  misc_feature (1)..(723): n is a, c, g, or t
atggaacccatcatttcagttattttcaatagtttcgggggcaatggagttatgttcagacactatgaaagtatgtatccgacagtaaactttgctgcttctgcgacattaacctcggtcttggacaaagcaaaattcatacgccttgttcggactgcgtcaaacagtttatatattcttgagttcaagagttataaaggtatgatttatgtatactggataccgcgtggtcatcgagatatctcactcaattttgcaaaatcaagcaaagctgaaattgtatatatgtgtggaaaaaacaagtttgtcacagccagaagttttcgagtcaaagtgtctggagaaccagaatatttaatcacttctgaaaaaataaaatcagtttcaattttgagcgataccaaacttaaattcccgactggagctcattcgattgttgacaacaagatgaataatgttaaatcttggactattgacaattctattaataaaaagattgatgaacctcttaaagagaaagcaattcctccattcagacagccggggcaattttctctgcgtcaggtaaaagataaacagaaaggtaatgtattagaagtagaattgaatatgaagccggaaagaaaaaaattagacattcaattttacggcatgttgcgttctacacaagaaatcgttcttacaggcaaacctacgaccattggaatgtgggtaaaagngtga

SEQ ID NO: 13502 - protein, 240 aa, Unknown
  Obtained from environmental sample
  misc_feature (1)..(240): Xaa is any amino acid
MEPIISVIFNSFGGNGVMFRHYESMYPTVNFAASATLTSVLDKAKFIRLVRTASNSLYILEFKSYKGMIYVYWIPRGHRDISLNFAKSSKAEIVYMCGKNKFVTARSFRVKVSGEPEYLITSEKIKSVSILSDTKLKFPTGAHSIVDNKMNNVKSWTIDNSINKKIDEPLKEKAIPPFRQPGQFSLRQVKDKQKGNVLEVELNMKPERKKLDIQFYGMLRSTQEIVLTGKPTTIGMWVKX

SEQ ID NO: 13503 - DNA, 756 bp, Unknown
  Obtained from environmental sample
  misc_feature (1)..(756): n is a, c, g, or t
atgaaagagtttttagataaagaagtaacagatttaagtgataaagagtttgaagaaagatttggaacacttgataataatgtaaaagaactactcttagaagaatttacaaaaataagacttcaaaaaaataatgaatttgccataaaagatgtatttgatcaagaaacatttgatgaaaatgcaattgttgtaaaagagatagttgaattattacaaaattataaaataagatatacaaaaaaacaacagtttttaagtgatttttttgagttacttttgacaactgggcttaagcaagaggtagggcagttttttactcccgtaccaatagctagatttataataagaagtatcccttttgatcaaattatcaaagaaaaacttttaaaaggtgagcgagatgaacttttaccaaatgttattgactatgcagtaggaagtggacattttataactgaggctatggatgagatacaaaaaaatataaatactatctctacaaatgattttataagtgatactgcaaaaaaaataaaaagctggaaagaagaccattttgattgggcatttgattatgtgtatgggattgaaaaagattacagacttgtaaaaactgcaaaagttggatgttatttacatggggacggcttagcaaaagttatccctggagatggactctctaactttaccaatacaaaagagtataaagggaaattgggccacataacgataaaaacttattccccaagataa

SEQ ID NO: 13504 - protein, 251 aa, Unknown
  Obtained from environmental sample
  misc_feature (1)..(251): Xaa is any amino acid
MKEFLDKEVTDLSDKEFEERFGTLDNNVKELLLEEFTKIRLQKNNEFAIKDVFDQETFDENAIVVKEIVELLQNYKIRYTKKQQFLSDFFELLLTTGLKQEVGQFFTPVPIARFIIRSIPFDQIIKEKLLKGERDELLPNVIDYAVGSGHFITEAMDEIQKNINTISTNDFISDTAKKIKSWKEDHFDWAFDYVYGIEKDYRLVKTAKVGCYLHGDGLAKVIPGDGLSNFTNTKEYKGKLGHITIKTYSPR

SEQ ID NO: 13505 - DNA, 432 bp, Unknown
  Obtained from environmental sample
  misc_feature (1)..(432): n is a, c, g, or t
ttgtcattcacaaaaagagagttaatgaaaatacttgcgattgattttggaaaaaagaggatgggatttgctgttgccagtgtaatacttaaagttgcaacccctatagaacatttggaaagaaaagatatgagtagtgatttattgtatattaataatcttatcaatgatcatgatatcgggaaaattttgattgggcttcccttaaatatggatggatcaaaaggagctattgtaaaagaagtggaaaacttttatagatttctaaagaaaagaattaccctgaaaattgagctggttgatgaaaggttaaccagttttgaagctgaagaaatattaaaggaaaatataaaagattttaaaaagaggaaggggaaaattgattcaatgtctgctatggtaattctaaatcagtattttttaaacaaatga

SEQ ID NO: 13506 - protein, 143 aa, Unknown
  Obtained from environmental sample
  DOMAIN (9)...(142): Uncharacterised protein family (UPF0081)
  misc_feature (1)..(143): Xaa is any amino acid
MSFTKRELMKILAIDFGKKRMGFAVASVILKVATPIEHLERKDMSSDLLYINNLINDHDIGKILIGLPLNMDGSKGAIVKEVENFYRFLKKRITLKIELVDERLTSFEAEEILKENIKDFKKRKGKIDSMSAMVILNQYFLNK

SEQ ID NO: 13507 - DNA, 690 bp, Unknown
  Obtained from environmental sample
  misc_feature (1)..(690): n is a, c, g, or t
gtgacaataaaagagggtaagacgcttgatgaaataattgtatttcttgctaaaaattattcttttaataaagtgaagcttgttcatgcttttaaaaagacgagtttgataagagagtttgacaatgaagcaaaagatcttgaaggctatattctccccgaaacatattttgttagaaaaggtatatctgaagaagagttagtgaaaattgttgttggaaaattcaaagatatctttaccgaaagaatgcgtttacaggcccgggacatggggctttctattagagaaattgtggttttagcatcattaattgaaaaagaaacttctctggagtcggaaagaagactcgttgcatctgtctaccataatcgtttgaaaaagaaaatgttgcttcaatgtgatccgacaatgatatatgcattaaaaaaagcgggtatctataataaaatgaagtggaaaaaattaggacggaaaattgattctccatttaatacatataaatacctgggattaccgcccggacctatttgtaatcctgggaaagcatcacttgaagcagcagttgtaccagagaatacagagtttgtatattttgtaagaaagcagagagggaaacgggcgcatcacttttcaaaaagctataaagagcatagatgggccataaaaaaaagcttaaaaggttggaattga

SEQ ID NO: 13508 - protein, 229 aa, Unknown
  Obtained from environmental sample
  DOMAIN (1)...(227): Aminodeoxychorismate lyase
  misc_feature (1)..(229): Xaa is any amino acid
MTIKEGKTLDEIIVFLAKNYSFNKVKLVHAFKKTSLIREFDNEAKDLEGYILPETYFVRKGISEEELVKIVVGKFKDIFTERMRLQARDMGLSIREIVVLASLIEKETSLESERRLVASVYHNRLKKKMLLQCDPTMIYALKKAGIYNKMKWKKLGRKIDSPFNTYKYLGLPPGPICNPGKASLEAAVVPENTEFVYFVRKQRGKRAHHFSKSYKEHRWAIKKSLKGWN

SEQ ID NO: 13509 - DNA, 474 bp, Unknown
  Obtained from environmental sample
  misc_feature (1)..(474): n is a, c, g, or t
atggcaaaagaaaaacagtttaatagtatgaattcagatgaatatatgacatttattttaggtgagatgaagtatgccgtagagttacctaaaattagagaaattttaacttatccagagttaataacaattttaccaaatacaaaagattgggtaaaaggacttattaatttaagaggtgaagttgttccaattttagatattagaataaaatttaatacaggtaagattgaatataatgaaaatacagcagtaattgcagtaataacaaatgataatagaatgttaggattagttgtagataaagtagatgatgtacaaaaattagactcagcttctttatatcctgtttctgacatgggttctggtatccctgcaaaatatttaaaaggttttgttagacttgaaaataatcaaatgttagttattatggatgtagaaaatgttgtccataaagaagaattaaaaggttaa

SEQ ID NO: 13510 - protein, 157 aa, Unknown
  Obtained from environmental sample
  DOMAIN (14)...(154): CheW-like domain
  misc_feature (1)..(157): Xaa is any amino acid
MAKEKQFNSMNSDEYMTFILGEMKYAVELPKIREILTYPELITILPNTKDWVKGLINLRGEVVPILDIRIKFNTGKIEYNENTAVIAVITNDNRMLGLVVDKVDDVQKLDSASLYPVSDMGSGIPAKYLKGFVRLENNQMLVIMDVENVVHKEELKG

SEQ ID NO: 13511 - DNA, 408 bp, Unknown
  Obtained from environmental sample
  misc_feature (1)..(408): n is a, c, g, or t
atgaaaaattggattaaaagagataaaacctttacgatggtattgaggagttatttaacctctttacagaaagattttaggcttactattgctacaaatgcctcaagagattttgcaataaggatgattgacattttaaatatagataaatattttgatattgttattggtgcttcttgtgtagaaaaaccaaaaccacatccagatatggtattgaaaacattaaatgatttacaaatacaccatcacaaatctattttaattggtgatagcttaaaagatatacgagctgctaaggctgcaaatgtagatagtttcttagtggaatggggctttagtacttatgaaaatcatactactataagaagttcaaatgaactttatgaaaaactatcaaggttaaaatag

SEQ ID NO: 13512 - protein, 135 aa, Unknown
  Obtained from environmental sample
  misc_feature (1)..(135): Xaa is any amino acid
MKNWIKRDKTFTMVLRSYLTSLQKDFRLTIATNASRDFAIRMIDILNIDKYFDIVIGASCVEKPKPHPDMVLKTLNDLQIHHHKSILIGDSLKDIRAAKAANVDSFLVEWGFSTYENHTTIRSSNELYEKLSRLK

SEQ ID NO: 13513 - DNA, 483 bp, Unknown
  Obtained from environmental sample
  misc_feature (1)..(483): n is a, c, g, or t
ttggttttcaccattaatcatgaaccaatgactttagagggttatgaccttttagtagaagagtttaaatttttactagaggttgaaaaacctaaaactgctgaggaaaaacttgtcgcagcagcccaaggtgatagaagtgaaaatgctgactatcatgcggctaaagagaaactccgttttatggataaaagacttttttatctaaactcaatgatacaaaaatctcaaatcatagacccttcaaaatttccacatgccaaggttagttttggaagtactgtaaaagttattaatatcgatactgacgaggaagagacttataccctatgcggtgttttagagtctgagccagaaaatggattgataacggtacattcaccattagcaaaagcaatgattggtaaaagtgtagaagatgagtttaaagttaaacttccacatgccaacaaagagtatgaaattttagaaatatcatantaa

SEQ ID NO: 13514 - protein, 160 aa, Unknown
  Obtained from environmental sample
  DOMAIN (6)...(78): Prokaryotic transcription elongation factor, GreA/GreB, N-terminal domain
  misc_feature (1)..(160): Xaa is any amino acid
MVFTINHEPMTLEGYDLLVEEFKFLLEVEKPKTAEEKLVAAAQGDRSENADYHAAKEKLRFMDKRLFYLNSMIQKSQIIDPSKFPHAKVSFGSTVKVINIDTDEEETYTLCGVLESEPENGLITVHSPLAKAMIGKSVEDEFKVKLPHANKEYEILEISX

SEQ ID NO: 13515 - DNA, 462 bp, Unknown
  Obtained from environmental sample
  misc_feature (1)..(462): n is a, c, g, or t
atgggaaatcatgaagcattgttacttgacgctttcgaaaatgaaaagaatatttcaaaatggattcaaagcggaggcaatgaaacactaaaaagttttcaaattacttccataaaaaatattgaacccacctatctaaagttcttcaaggagttgaaatattattattcattgaatgaatttctttttgtacatgctggttttaacgataatgtagttaatccatttaccgatttcttttcaatgctttggaaatgcaaagagtcttacaataatcccttactaacagataaaacaatagttcatggacataaccctgtaagtgtatctaaatgtactaataggattcaatctaaacttagtgtaattaatattgatacaggttctgtgtataaggataatgaagggtttggaaaacttacagcatttgaatgtaatactggaagaatactttttgtttga

SEQ ID NO: 13516 - protein, 153 aa, Unknown
  Obtained from environmental sample
  misc_feature (1)..(153): Xaa is any amino acid
MGNHEALLLDAFENEKNISKWIQSGGNETLKSFQITSIKNIEPTYLKFFKELKYYYSLNEFLFVHAGFNDNVVNPFTDFFSMLWKCKESYNNPLLTDKTIVHGHNPVSVSKCTNRIQSKLSVINIDTGSVYKDNEGFGKLTAFECNTGRILFV

SEQ ID NO: 13517 - DNA, 309 bp, Unknown
  Obtained from environmental sample
  misc_feature (1)..(309): n is a, c, g, or t
ttgattgatcggtgtatcactttagaagtaaatagttttacagacccagtgaaaagtaacttcactccgccaaatgaagatctaaaagaaatgatggaccaatataatttatcagaaaacgatatactgagcgcctacagaacgtacatgacattgaaaaaattaaaacaagaattaaatgtgttggctggaaaatatttggatagaccagaagcaaaaacagcaattgacagaatcaataaatcgattgataaagctagaatttctgttggaaaaacttcttttaagtataaagaatttgaggagtaa

SEQ ID NO: 13518 - protein, 102 aa, Unknown
  Obtained from environmental sample
  misc_feature (1)..(102): Xaa is any amino acid
MIDRCITLEVNSFTDPVKSNFTPPNEDLKEMMDQYNLSENDILSAYRTYMTLKKLKQELNVLAGKYLDRPEAKTAIDRINKSIDKARISVGKTSFKYKEFEE

SEQ ID NO: 13519 - DNA, 378 bp, Unknown
  Obtained from environmental sample
  misc_feature (1)..(378): n is a, c, g, or t
atgacaaagcatcaagcgcaatggtttatggttattgacgatatccaacaacttatcataatttcagttgcatcccaagcggggtcattccaagaacgagtattctccacagaatgcatttccttctcaaccctttttaagggtccatatggggggggaaattattttttcaagaaaaaacaaaaatttttggttcgagattcttccttccaaaaaaaaacttgccgacccaaaaggattttgggaaattcctcccgaaaattatattttattttgaattccgaaaggggggggttggccaattcccaacgggggttcttttattttctcccttttttttccaccaaaaatttacctccgtggccctggcccaaaagg

SEQ ID NO: 13520 - protein, 126 aa, Unknown
  Obtained from environmental sample
  misc_feature (1)..(126): Xaa is any amino acid
MTKHQAQWFMVIDDIQQLIIISVASQAGSFQERVFSTECISFSTLFKGPYGGGNYFFKKKQKFLVRDSSFQKKTCRPKRILGNSSRKLYFILNSERGGLANSQRGFFYFLPFFSTKNLPPWPWPKR

SEQ ID NO: 13521 - DNA, 480 bp, Unknown
  Obtained from environmental sample
  misc_feature (1)..(480): n is a, c, g, or t
atgagtgcaaaaaaatatattgaaagacatgttcaaaaagcagaaattttaactaccaccttagataaaaactcaaaagatgctgcaaaatacatatgtaaaatgattgatagttttgataaaaaatataactcattttgtttattaataggcggtgagacaactgtaaaagtcacaggaagcggaaatggcggtagaagtagtgaacttgctttaagattgttagatagtggttgcataaatgaagagttgactatattatgtgcaggaagtgatggtatagatggcaactctgctgctaatggtgcttttatagatgtaactattttaaaaaatatcaaagaatcaaagttaaatataaaagagtatttacaaaacagtgacagtaatagcttttttaaaaaaataggttacgagtttaaaactgggctaagcggtacaaatgtaatggattttgtatttgttttaaaactaaaataa

SEQ ID NO: 13522 - protein, 159 aa, Unknown
  Obtained from environmental sample
  DOMAIN (47)...(151): MOFRL family
  misc_feature (1)..(159): Xaa is any amino acid
MSAKKYIERHVQKAEILTTTLDKNSKDAAKYICKMIDSFDKKYNSFCLLIGGETTVKVTGSGNGGRSSELALRLLDSGCINEELTILCAGSDGIDGNSAANGAFIDVTILKNIKESKLNIKEYLQNSDSNSFFKKIGYEFKTGLSGTNVMDFVFVLKLK

SEQ ID NO: 13523 - DNA, 447 bp, Unknown
  Obtained from environmental sample
  misc_feature (1)..(447): n is a, c, g, or t
atggcggacttttttcaaaatgggataataacaactttacaaaatgtatctgatagaacattagaagatattgaaactgagctggaggggtattcaaaacgccgtaatatggtattactcttaccagcactctactcagagtttgaaacaccggctatgaaaaatatattaaaagagcttaagggtgttaaatatttatataaaattattttaggtctcgatagagctacaaaagagcagtatgaagaagtaaaaaagataatgtctgttcttgatgtagaggttgatatattgtggaatgatggacctaaaatgaagaagctttatgaaaagatagaagatgaaggctttagaagtttagatataaaaggaaaaggcagaaatgtttgggacaatgataggttatgcgctatcagatccaaatgcctatgcatttgctctacatga

SEQ ID NO: 13524 - protein, 148 aa, Unknown
  Obtained from environmental sample
  misc_feature (1)..(148): Xaa is any amino acid
MADFFQNGIITTLQNVSDRTLEDIETELEGYSKRRNMVLLLPALYSEFETPAMKNILKELKGVKYLYKIILGLDRATKEQYEEVKKIMSVLDVEVDILWNDGPKMKKLYEKIEDEGFRSLDIKGKGRNVWDNDRLCAIRSKCLCICST

SEQ ID NO: 13525 - DNA, 372 bp, Unknown
  Obtained from environmental sample
  misc_feature (1)..(372): n is a, c, g, or t
ttgctggaggatgttatgcgtttagttctactattactctttctatttatcttcaatggatgtaacaacaacacagatgttacaaaagatagagacaacacacaaatagaaaatgaaaaggcaaaagtgatatttcaaagatgtcaaaggtgtcatggtatgaaaggtgaaaaatctgctttaaatgtctcagacattatttcttattatagtaaaaatgatttaacaaaagcattaacactttatcaaaaaagtaaacgagacagacatagatttggttctttaatgacaggaattattaaagacttgtctaataatgatattaaaattctagctgattatatttcaaatttaaaagagagaactaaataa

SEQ ID NO: 13526 - protein, 123 aa, Unknown
  Obtained from environmental sample
  misc_feature (1)..(123): Xaa is any amino acid
MLEDVMRLVLLLLFLFIFNGCNNNTDVTKDRDNTQIENEKAKVIFQRCQRCHGMKGEKSALNVSDIISYYSKNDLTKALTLYQKSKRDRHRFGSLMTGIIKDLSNNDIKILADYISNLKERTK

SEQ ID NO: 13527 - DNA, 459 bp, Unknown
  Obtained from environmental sample
  misc_feature (1)..(459): n is a, c, g, or t
ttgtccgtattcaaatgcataagtactcggtccaaagtatttttcaaatgtctcatctttattctgattattttttgcatcatggttattatcatgattaccaaaaacatagtaccacggaatttcaatttgagaaataccttcacttattccttngaacaaatctacatcatgccccacaatatcaccaagagtcactccaaactttgcatcagtaccaataagttcttcaactacatcagggttaatataattaacttcttgcgggctgctggcttgcgtgtcaccaaaaaaaatgcagaatatttttcaggttctttattaaataccaaaggaaatccattgaacttggaagctcaccagtggtttgatcccgctttttcaaacttggggacccactggttgggcaaaaaaaaatttgggggaccctttttctttaacggaacccagaaattgtag

SEQ ID NO: 13528 - protein, 152 aa, Unknown
  Obtained from environmental sample
  misc_feature (1)..(152): Xaa is any amino acid
MSVFKCISTRSKVFFKCLIFILIIFCIMVIIMITKNIVPRNFNLRNTFTYSXEQIYIMPHNITKSHSKLCISTNKFFNYIRVNIINFLRAAGLRVTKKNAEYFSGSLLNTKGNPLNLEAHQWFDPAFSNLGTHWLGKKKFGGPFFFNGTQKL

SEQ ID NO: 13529 - DNA, 753 bp, Unknown
  Obtained from environmental sample
  misc_feature (1)..(753): n is a, c, g, or t
ttgaaaaagtattttatgaatcaattttctcatggcggagatataaaaagttatgcccaaaatttgaattgctcagttgatgaagtttgtgatctctcttcaaatattaactttttaaaacccagaatttcactcgatttcaactctttagatatctcatcttatccatcttatgatgagctctacggggcactatcaaaaaaatacggtgtttcatttgagatgatggaaatttttaacggtggaagttcggctatcttttcactattttctcatctgaaactgcaaaagtgtgttatctactctcctgcttatttggagtataaaaaagctgcgcatatttttggctatgagactcagcttataaatcgatttaaaaatatttatgagtcggttgagaaaagctctctggttatttttgtaaatccatctactcctgatgggaaggtttatgatattgaggcactttttaagagttgggtagaggcagatgcaactgttttagtggatgaatcttttttagattttacgccacatgagagtgttacaaagtatctaaaagagtatgagaaactctacatattaaaatcactcacaaagttttactcttcagcgggtatcagagtagggctgatactctcaaatgaaaaaaatatagcaactattaaaaaaagtgagccactatggaaaatatctcagtttgactcttactacattcaagaggctctaaaagatagtgagtttgaaagataa

SEQ ID NO: 13530 - protein, 250 aa, Unknown
  Obtained from environmental sample
  misc_feature (1)..(250): Xaa is any amino acid
MKKYFMNQFSHGGDIKSYAQNLNCSVDEVCDLSSNINFLKPRISLDFNSLDISSYPSYDELYGALSKKYGVSFEMMEIFNGGSSAIFSLFSHLKLQKCVIYSPAYLEYKKAAHIFGYETQLINRFKNIYESVEKSSLVIFVNPSTPDGKVYDIEALFKSWVEADATVLVDESFLDFTPHESVTKYLKEYEKLYILKSLTKFYSSAGIRVGLILSNEKNIATIKKSEPLWKISQFDSYYIQEALKDSEFER

SEQ ID NO: 13531 - DNA, 672 bp, Unknown
  Obtained from environmental sample
  misc_feature (1)..(672): n is a, c, g, or t
atgagccacctgctattttcaacgtcagttttaattctcttggtagtatcatgtaccggatcgaaggaaataaaaccaataagggtaacaacagaactggatatcggtgaatccagtgaaataacgctcaccaatggtgaaatggtagtgctcaaactacttgacatcaatgcagttcgggacagccttcgcaatgccatccgtgctgtaaaagttaaagtcagcattaatggcgatgaatttacactggaatcgggtagctatcttttaccggttgaagctgtcggtatacagattgattgtccgggttgtaagaattattccacccaatcccccaagaaatcgctggagattgtcaaaagaagcacgttttcaggttgtggcccaaaaggatcaatcttttatggaaccgggggatattcgcatacccccatcaaacaaaaatggtttgcaaccgatgtcccggtcaggaaaatgaaccacccattgtggattggggtggagaatcctgccaaccaaaagtatcttcctaccatttcccgaaattattttcgaagaaactttaagggaaagaagaatatttgtttcgcccccaaaacggactggtttttctcccaatggggggaacacccgggagggaattgtaaaacccccgaagaagggggctccgaa

SEQ ID NO: 13532 - protein, 224 aa, Unknown
  Obtained from environmental sample
  SIGNAL (1)...(17)
  misc_feature (1)..(224): Xaa is any amino acid
MSHLLFSTSVLILLVVSCTGSKEIKPIRVTTELDIGESSEITLTNGEMVVLKLLDINAVRDSLRNAIRAVKVKVSINGDEFTLESGSYLLPVEAVGIQIDCPGCKNYSTQSPKKSLEIVKRSTFSGCGPKGSIFYGTGGYSHTPIKQKWFATDVPVRKMNHPLWIGVENPANQKYLPTISRNYFRRNFKGKKNICFAPKTDWFFSQWGEHPGGNCKTPEEGGSE

SEQ ID NO: 13533 - DNA, 882 bp, Unknown
  Obtained from environmental sample
  misc_feature (1)..(882): n is a, c, g, or t
gtggaagtatggaataatattgcgggaattgatgattctcatactaagtacaaaattattctaggtccacgatcatcactttttcttcctttcgataacctggggttgataattgttgatgaagaacatgatagttcctataaacaatatgatcctagtccaaggtataatgcacgtgatgcagctatttatcttgcaactcttcataatgcaaaggtgttattgggttcggctactcctgccatcgagagttattacaatgcaaaatcaggtaaatatggatttgcagagataactgatagatatggtggtgttaaacttccaaaaattgttgttgtaaatcttaaggaagaaaaaaagcgacgtatgatgaaatctcacttttcatcagtcctgttaaaaggaattgatgttgcacttgagaataaacatcaggtgatattatttcaaaatcgcagaggtttttcgttgcgaatagaatgtgatgtttgtcattgggttcctgagtgtaagaggtgtgatgtaacattaacatatcataaatatagtgagttgcttaagtgccactattgtggatattctacaacagtacctccaatttgtcctgattgtggtaataccggactaaagatgcttgggtttggaacagagaaagtttcggaagaattgggtatgttgttgcctaatcttaaaatagatcgaatggatcttgataccacacgcacaaaaaatgcctttgggagaataatttccaattttgagaatcgaaaaacggatattctcataggaactcaaatggaaaccaaaggattggattttgataatgtcccaatttgtaggagtattaagcgccgaatgtttattgagtttcccagattttag

SEQ ID NO: 13534 - protein, 293 aa, Unknown
  Obtained from environmental sample
  misc_feature (1)..(293): Xaa is any amino acid
MEVWNNIAGIDDSHTKYKIILGPRSSLFLPFDNLGLIIVDEEHDSSYKQYDPSPRYNARDAAIYLATLHNAKVLLGSATPAIESYYNAKSGKYGFAEITDRYGGVKLPKIVVVNLKEEKKRRMMKSHFSSVLLKGIDVALENKHQVILFQNRRGFSLRIECDVCHWVPECKRCDVTLTYHKYSELLKCHYCGYSTTVPPICPDCGNTGLKMLGFGTEKVSEELGMLLPNLKIDRMDLDTTRTKNAFGRIISNFENRKTDILIGTQMETKGLDFDNVPICRSIKRRMFIEFPRF

SEQ ID NO: 13535 - DNA, 720 bp, Unknown
  Obtained from environmental sample
  misc_feature (1)..(720): n is a, c, g, or t
gtgggtcttgaattgaatagaagaacttttttaacacttatcggcatttcatcactaacatgcgcaaaaggtttgtcccctttcgcaatgttagattacaaaaaatgtagagagtacattgatgaacaaagtaaaaaagattttgttttcaatagtaatgaactaattaatgcaaataatctatttaacaagattagaagagctaaatccatcgtcggatatacacaatttaatcttttaggttttgatggtatgctccaaattgctaaaaactactctaaagtagggcaatttacaaaagatgaatctacactgtttgaaaaactattttatgaaaatgcaactcaatatggtttttatggtgaaaaagttataacatcactaacggatgatatagcaaaaaaagatactatctacatagaaaatacaggacatttcctatatcgtggtaaacctcatgatatgtataaaacaataaccaaagatgtaggtgagactattgttttaacatctggtgtacgcagtattgttaaacagatggatctatttttaaataaagtgattagaagcaatggagatctctctgttgcagctcactcactggcacctgctggttattcatttcatggtataagtgattttgatgtaggtaaagtgggatttggatacaaaaatttacatcagactttgccccaaccgatgaatataanaaaattatag

SEQ ID NO: 13536 - protein, 239 aa, Unknown
  Obtained from environmental sample
  misc_feature (1)..(239): Xaa is any amino acid
MGLELNRRTFLTLIGISSLTCAKGLSPFAMLDYKKCREYIDEQSKKDFVFNSNELINANNLFNKIRRAKSIVGYTQFNLLGFDGMLQIAKNYSKVGQFTKDESTLFEKLFYENATQYGFYGEKVITSLTDDIAKKDTIYIENTGHFLYRGKPHDMYKTITKDVGETIVLTSGVRSIVKQMDLFLNKVIRSNGDLSVAAHSLAPAGYSFHGISDFDVGKVGFGYKNLHQTLPQPMNIXKL

SEQ ID NO: 13537 - DNA, 345 bp, Unknown; identical to SEQ ID NO: 10759
  Obtained from environmental sample
  misc_feature (1)..(345): n is a, c, g, or t

SEQ ID NO: 13538 - protein, 114 aa, Unknown; identical to SEQ ID NO: 10760
  Obtained from environmental sample
  misc_feature (1)..(114): Xaa is any amino acid

SEQ ID NO: 13539 - DNA, 627 bp, Unknown
  Obtained from environmental sample
  misc_feature (1)..(627): n is a, c, g, or t
atgataaatagtcttttgaataagggtgctatacttctaatatctggtcctagtggatgtgggaaaagttcccttttaaagaagctttatgcggtaatagataattattatttttctatctcaacaactacacgaagtccgagaattggtgaaactgacggagttgattatttttttgttacaaaagaggaatttgaacaagatattaaagataatagctttttagaatgggcagaagttcatggaaactattacggtacatctttaaagccaatttataaagcattggatgagggaaaacttgtaatatttgatattgatgttcaaggttttgaacaagttattgaaaagttaagagatattacaacaactgtttttataacaactccaacactaaaagagttagaacaaagattaaccgctagaggtacagatactattgatgtaatagaaaaaagaatcaaaaatgcacaagttgagataaagtatactgaagagtatgattatttaattataaatgatgatttagatgaagcagctgataaattaatttctgtagcaaaaagtgcactaatcaaatcaaaaatgtttgataacaccactttagtaaagatatggaattcgtaa

SEQ ID NO: 13540 - protein, 208 aa, Unknown
  Obtained from environmental sample
  DOMAIN (44)...(149): Guanylate kinase
  misc_feature (1)..(208): Xaa is any amino acid
MINSLLNKGAILLISGPSGCGKSSLLKKLYAVIDNYYFSISTTTRSPRIGETDGVDYFFVTKEEFEQDIKDNSFLEWAEVHGNYYGTSLKPIYKALDEGKLVIFDIDVQGFEQVIEKLRDITTTVFITTPTLKELEQRLTARGTDTIDVIEKRIKNAQVEIKYTEEYDYLIINDDLDEAADKLISVAKSALIKSKMFDNTTLVKIWNS

SEQ ID NO: 13541 - DNA, 525 bp, Unknown
  Obtained from environmental sample
  misc_feature (1)..(525): n is a, c, g, or t
gtggaaatatggaaagaaaggggagaaaaagctgccgaaaaaagacaacaacaaccaaatgcagctttnaccaccaataattttttaatccctaaagaactttttaatagaattaaatttgatgaaagcttagtaaaatatggacatgaagacaccttatttggttacgaattgtcccaacaaaacatcattattcatcatattaacaatccgcttatacatgttggcttagaaagtgcgaccgtttttttacaaaaaactgaagaaggtataaaaaatcttattcagataatacaaactaaaaaaccggaaaaaaaattctatcaagatgttaaattactctcttacttcttaataattaagcaatataagctaaattggttctttaatttattgtacaaacttttgcaccaaaaaatatataaccacctgaaaaacaacacaattcctaccataaaatatttcgatttatataaaatcttacttcttaattattacttcaacttatccgcaaaaaaacgttaa

SEQ ID NO: 13542 - protein, 174 aa, Unknown
  Obtained from environmental sample
  misc_feature (1)..(174): Xaa is any amino acid
MEIWKERGEKAAEKRQQQPNAAXTTNNFLIPKELFNRIKFDESLVKYGHEDTLFGYELSQQNIIIHHINNPLIHVGLESATVFLQKTEEGIKNLIQIIQTKKPEKKFYQDVKLLSYFLIIKQYKLNWFFNLLYKLLHQKIYNHLKNNTIPTIKYFDLYKILLLNYYFNLSAKKR

SEQ ID NO: 13543 - DNA, 729 bp, Unknown
  Obtained from environmental sample
  misc_feature (1)..(729): n is a, c, g, or t
atgaaatttattcttacaacattaatgatggcatatttaattttacctggaatggcggagcctgaaaaagcaaaggaaatagcggaacaatggcgtgccttttcgggaaccgaagaacaaactgcatcagggttaccggataaaattgattttgattttaaaaaattagacggcacagtacttctttttatgcaaccaaccgctgcatggtgtagatactatcccaaagactattataaaactgttaatgtagagaaagtgttttatttcctaaaaaacattggagttactggcattatatataacggtggctttaaaagtaacggcaccatgattacaaaaggcaaactacctccattgtgttttagatataataagtatatacgtggacgtgatgatttgcaggaagcggctgttgcctgtaaaaaatacgatatggggctatggatggggatgcatggtttaggagaaccaaaatgcaaaaaccctataattttaaaagcgcataaagacctctatgctcgtaacttgcaaggtcaagtaatgtctatatacggaaacaataataaaggaggtgcttttgatatcaatagtccaaaagtatttaaatacctcagctcacagattgactttttcatagataaactaaaaccctacggctgccttaaagggtttttctgggatgagttttggtttaatatttatcaaattcttttgtcagtattatga

SEQ ID NO: 13544 - protein, 242 aa, Unknown
  Obtained from environmental sample
  SIGNAL (1)...(19)
  misc_feature (1)..(242): Xaa is any amino acid
MKFILTTLMMAYLILPGMAEPEKAKEIAEQWRAFSGTEEQTASGLPDKIDFDFKKLDGTVLLFMQPTAAWCRYYPKDYYKTVNVEKVFYFLKNIGVTGIIYNGGFKSNGTMITKGKLPPLCFRYNKYIRGRDDLQEAAVACKKYDMGLWMGMHGLGEPKCKNPIILKAHKDLYARNLQGQVMSIYGNNNKGGAFDINSPKVFKYLSSQIDFFIDKLKPYGCLKGFFWDEFWFNIYQILLSVL

SEQ ID NO: 13545 - DNA, 942 bp, Unknown
  Obtained from environmental sample
  misc_feature (1)..(942): n is a, c, g, or t
gtgagatttaaattccaagggatagaaattgacattgagaatgtagatttagaagatgttaaaacctatgaattatattcaaaagggaatacaactgcccttttccaatttgaatcggatgggatgaaaaaacatcttaaagaactcaaacctaataaatttgaagatttaattgccatgaatgccctgtatcgtccagggccaatggaatacattcctcaatttactgcacgtaaaaacggtaaagaaaagatagaatacgatttaccaatgatgaaagaatacctggaggaaacctatggtattacagtttatcaagaacaggtgatgctactctcccgacagcttgccggctttagtcgtggtcagtctgattcattacgaaaagcaatgggtaagaaaattatatcgatgatggacgaattaaaagttctttttatcgatggatgtaaagctaatcctcaatttattaaagagtgttccgaaaccaaaaaagatgtagataaaataattcataaaatttggtcggattgggaagcttttgccaaatatgcttttaacaaatcgcatgccacttgttattcctacgtctcatttcaaacggcttatctcaaagcgaattacccagctgaattcctcgctgctgtactgagtaacaatatgaataatatagaaaaggttacttttttcatcaacgaatgtagtcgtatgaaaataaaggttcttggcccaaacatcaatgaatccagaaccaagtttacggttaacagcgaaggcaacattcgatttggattagctgctattaaaggtgttggtgaggccgcagtactcagtctgattgaagaacgtgaaaccaatggaaatgtaacanatgtctttgattttgtaaacgaaataaacttcgaacangtaataagaagagtatcgaatcgatggttttag

SEQ ID NO: 13546 - protein, 313 aa, Unknown
  Obtained from environmental sample
  misc_feature (1)..(313): Xaa is any amino acid
MRFKFQGIEIDIENVDLEDVKTYELYSKGNTTALFQFESDGMKKHLKELKPNKFEDLIAMNALYRPGPMEYIPQFTARKNGKEKIEYDLPMMKEYLEETYGITVYQEQVMLLSRQLAGFSRGQSDSLRKAMGKKIISMMDELKVLFIDGCKANPQFIKECSETKKDVDKIIHKIWSDWEAFAKYAFNKSHATCYSYVSFQTAYLKANYPAEFLAAVLSNNMNNIEKVTFFINECSRMKIKVLGPNINESRTKFTVNSEGNIRFGLAAIKGVGEAAVLSLIEERETNGNVTXVFDFVNEINFEXVIRRVSNRWF

SEQ ID NO: 13547 - DNA, 798 bp, Unknown
  Obtained from environmental sample
  misc_feature (1)..(798): n is a, c, g, or t
atgatgatgacattaagtttatgtgatgaatattcattagttttaaatcataaatatgaaaactcaaaaaaagaaaaccttaaaataatttctcaagaaattataaatactctaaacaaagactccataagtaaaaaaatactaaatttttcacctaatgagtacataaaaaaaggattaaataactttgataatactaacttacaatattctgtaataaaacttttaagagaggagttaaatagtcatatatattttaaagaagcaataaaagaattagaggataactataaaataaaaaataaaaaaacaattcatataatactaaataatttaatatcattattgaatcataatggatttagtaatgcatatttattttatttttgtaaagaatatttttcaaatagaactacaaaatctattcctagtttctttgaagagattgtaaatgttggtaacgaatatacagtatttattggtattgattttttgccaacgattattgaaagccaattgtcaaaaatttctggattgaacattcaaatattaaaaggaaataataaaaatcctttaaaaggatttccaaaaactataaagtttaataatattaaaaatacaaatccatatggagcaattgaaaatagcctagatattattgaaagaattaaacaagcatacagtgtttttaatcatactaaacaaattgaaattggaaataaatgtattgcanaagataatanagataataaatactattatgacaataatatttcacatttaactcaccagaaataa

SEQ ID NO: 13548 - protein, 265 aa, Unknown
  Obtained from environmental sample
  misc_feature (1)..(265): Xaa is any amino acid
MMMTLSLCDEYSLVLNHKYENSKKENLKIISQEIINTLNKDSISKKILNFSPNEYIKKGLNNFDNTNLQYSVIKLLREELNSHIYFKEAIKELEDNYKIKNKKTIHIILNNLISLLNHNGFSNAYLFYFCKEYFSNRTTKSIPSFFEEIVNVGNEYTVFIGIDFLPTIIESQLSKISGLNIQILKGNNKNPLKGFPKTIKFNNIKNTNPYGAIENSLDIIERIKQAYSVFNHTKQIEIGNKCIAXDNXDNKYYYDNNISHLTHQK

SEQ ID NO: 13549 - DNA, 600 bp, Unknown
  Obtained from environmental sample
  misc_feature (1)..(600): n is a, c, g, or t
atgagtaaaaactttaaaaactatttgccaagctttagacatatctatattgacctaccaggttttggaaaaagttctaatgagtatgtcttatgtacaaatgattatataaatatcatggagatatttttaaaagcaattcatgtttcaaaagagacaattatggggcactcttatggtggaaaagttgctacaaaattaaatcccaaaaatcttatacttttaagtagtgctggaatagtagaagaaaaatcagctaaagtaaaaagtaaaatcaagatggttaagttttttaaagcatttggattaggtagtattactaagatttttagaagtaaagatgtagataatatgagtcaaaatatgtatgaaacttttaaaaatgtactaaatgaagattttacagatgagtttaaaaattatgatggaaaagcatatatattttggggtgaaagtgatactgcaacctctttagaatcaggtaaaaaaatagcctcacttataaaaaatagtgagtttaaatcatatgaagggactcactttttctttgttgaacatgcaaaagatataagtgaaagagcagaaaatggaatactttaa

SEQ ID NO: 13550 - protein, 199 aa, Unknown
  Obtained from environmental sample
  DOMAIN (12)...(196): alpha/beta hydrolase fold
  misc_feature (1)..(199): Xaa is any amino acid
MSKNFKNYLPSFRHIYIDLPGFGKSSNEYVLCTNDYINIMEIFLKAIHVSKETIMGHSYGGKVATKLNPKNLILLSSAGIVEEKSAKVKSKIKMVKFFKAFGLGSITKIFRSKDVDNMSQNMYETFKNVLNEDFTDEFKNYDGKAYIFWGESDTATSLESGKKIASLIKNSEFKSYEGTHFFFVEHAKDISERAENGIL

SEQ ID NO: 13551 - DNA, 423 bp, Unknown
  Obtained from environmental sample
  misc_feature (1)..(423): n is a, c, g, or t
gtgaaagagcagaaaatggaatactttaatatatttacacacatagttttagttatgagcttaggttggtatttaattaccaacttacaatggtacagctataaaatagaaagagttatatttaaacatcacaagctaaattggcacataatatattttgttatgccttttgttatgtattatcttttaccttcattatattttttgaaatatttttatgctttatatctgcccattttgattttatggaatatgaaacttgataaaacctttggtattaaacttcaaggagtccaaagaatttttagccattacttttggttccgtaaccatttttccactaaatcctttttttgttttttgaaaaggaaaaaaattgtaaaaaacttctcaggctttattttataccctcctattttatag

SEQ ID NO: 13552 - protein, 140 aa, Unknown
  Obtained from environmental sample
  misc_feature (1)..(140): Xaa is any amino acid
MKEQKMEYFNIFTHIVLVMSLGWYLITNLQWYSYKIERVIFKHHKLNWHIIYFVMPFVMYYLLPSLYFLKYFYALYLPILILWNMKLDKTFGIKLQGVQRIFSHYFWFRNHFSTKSFFCFLKRKKIVKNFSGFILYPPIL

SEQ ID NO: 13553 - DNA, 939 bp, Unknown
  Obtained from environmental sample
  misc_feature (1)..(939): n is a, c, g, or t
gtgaacacaatatcgnctttttataaagaaatatggaaccaacttcttcaaaaaagtttttataagggtgaaattattaataaaaaaaaggatggaaaaagatatattcaaaatgtatctatttttgttataaaaaatgaattgaaagaagtaacaaattattgtgctcttgtatgggatataacaaatgaaaaaaaacgggacaaaataattgaagaacaaataaaaatgtcgtccatgggtgaaatgataggtaatatagcccaccaatggagacaacccttaagtgctattacaacatcatctactggattaaaagtaatgaaagaacatggagtattagatgatcaaagtttttttaaaaatttaaatcacatagaacatactgctcaatatctctctgaaactatagatatatttaaaaacttcctaaaagataaaaaagaatacaaagaggatatcttgcaaaatagagtaaataatgctttatgtattgtaaatgcaactttaacaaataattatatacaacttaaaaataacattgagaaagtagaatctttaaaagtaaaaataataacaggtgaactagaacaagttattataaacattataaataatgctaaagatgcaattttagaaaaaaaagtaaaagatccttggattgaaattaatttaaaaaaatgtaatggtttcgcaattttgacaatagaagataatgggcttggaattccagaagatgttttacccaaaatatttgaatcttatttcccaacaaaaaatgaagaccaaggtcccgggcttggtccttcaatgagttttaaaatttatcaaagaaagtttaaatgggtaatattttttgctaaaaaacgtcataaagggggcaatttttttatattggaattaccatttatctggaatcctggcttaggtaaaggttaa

SEQ ID NO: 13554 - protein, 312 aa, Unknown
  Obtained from environmental sample
  DOMAIN (22)...(64): PAC motif
  misc_feature (1)..(312): Xaa is any amino acid
MNTISXFYKEIWNQLLQKSFYKGEIINKKKDGKRYIQNVSIFVIKNELKEVTNYCALVWDITNEKKRDKIIEEQIKMSSMGEMIGNIAHQWRQPLSAITTSSTGLKVMKEHGVLDDQSFFKNLNHIEHTAQYLSETIDIFKNFLKDKKEYKEDILQNRVNNALCIVNATLTNNYIQLKNNIEKVESLKVKIITGELEQVIINIINNAKDAILEKKVKDPWIEINLKKCNGFAILTIEDNGLGIPEDVLPKIFESYFPTKNEDQGPGLGPSMSFKIYQRKFKWVIFFAKKRHKGGNFFILELPFIWNPGLGKG

SEQ ID NO: 13555 - DNA, 933 bp, Unknown
  Obtained from environmental sample
  misc_feature (1)..(933): n is a, c, g, or t
ttggcattttttttatattttagttggttatccgtttctgaaaacccattggatgttgatgtttctcatgttgagttggagctagaagtaaaagcattgaaaaaagatttgtttcaaaaagaagaaaaaattaccaacgaagaaattgatgctttagcccaaaaataccaacctttttttgatgactttaccaatcaaattatcaatattggagatgcaagaagaggggatttcaattttcagttaaatgcatttaggactgaccccggagtaagagatgtttatgcagatgtgcaaatacaatttccagatttttctccctaccaaaaagagctaacagacgcttttaaacattataaattttattttccaaatgaaaaagtgcctaccataattacttacgtttcggggtttaattatgccattgctacaggaaaagactatttaggaattggtttagatatgtttttagggagtgattacaaagcttatgctcagttaggtttacctcaatataaaagtggtttaatgacaaaagaatatttggtttcgagtgttttattggggtgggtttctacagaatttgaaatgcctattgctcagccaaatttattagaagaaatgatacatcaaggaaaattaatatatatgttagatgcacttattcccaaggaaaaagatgctaaaaaaattaactatactcaagaacaatatgattggtgcgaaaacaacaaaaaagaaatttggttttactttatggataatgaattactttacaccaaagaaaatagccagattattaagtttatgggcgaatctccatttacacaaggttttccagaaggctctccaggaagaataggccattatttaggctggcaaattgttaaagcttatatgaaaaagaatcctgaaataactgtccctgaatga

SEQ ID NO: 13556 - protein, 310 aa, Unknown
  Obtained from environmental sample
  misc_feature (1)..(310): Xaa is any amino acid
MAFFLYFSWLSVSENPLDVDVSHVELELEVKALKKDLFQKEEKITNEEIDALAQKYQPFFDDFTNQIINIGDARRGDFNFQLNAFRTDPGVRDVYADVQIQFPDFSPYQKELTDAFKHYKFYFPNEKVPTIITYVSGFNYAIATGKDYLGIGLDMFLGSDYKAYAQLGLPQYKSGLMTKEYLVSSVLLGWVSTEFEMPIAQPNLLEEMIHQGKLIYMLDALIPKEKDAKKINYTQEQYDWCENNKKEIWFYFMDNELLYTKENSQIIKFMGESPFTQGFPEGSPGRIGHYLGWQIVKAYMKKNPEITVPE

SEQ ID NO: 13557 - DNA, 525 bp, Unknown
  Obtained from environmental sample
  misc_feature (1)..(525): n is a, c, g, or t
ttgtcaattagtaaattaggaggaaacctatcttatgtagattatttttatgataaagataatgatgtttatttgcttactcagatagaccaatcttacaacataaaatacattgaaattccatttaccttaaaattaagaactaatgaaattggttacatgacttactatggtaattttggtgtaaaggcaggttttaactacagctctaatggtgattttgattacaaaaatgtaagcggaggaatttctaaaagtgatgtagatattaaagatgatattaaatttttcaactcttggttagttgttggaattggtgctgaatacagtatttctggcaatacagcagttatgtttggctttacttttaataatggtttcttaaatgccttagacaataagctaatagaaactgatggtaacagcgtacctgttagaaatgcagatggatctcctaaatataaaaataaatctgctagtgcaacgcttaattacttttctttagatttaggcatctacttttaa

SEQ ID NO: 13558 - protein, 174 aa, Unknown
  Obtained from environmental sample
  misc_feature (1)..(174): Xaa is any amino acid
MSISKLGGNLSYVDYFYDKDNDVYLLTQIDQSYNIKYIEIPFTLKLRTNEIGYMTYYGNFGVKAGFNYSSNGDFDYKNVSGGISKSDVDIKDDIKFFNSWLVVGIGAEYSISGNTAVMFGFTFNNGFLNALDNKLIETDGNSVPVRNADGSPKYKNKSASATLNYFSLDLGIYF

SEQ ID NO: 13559 - DNA, 735 bp, Unknown
  Obtained from environmental sample
  misc_feature (1)..(735): n is a, c, g, or t
atgataccaccacataaattatatattgaagtgtttggtggagctttaaatatactttatggaaaatcaaaatcacatatagaagtggtaaatgatataaactctgagcttataaacttacatcgatcaataagaaataatcctgaaacgctgtcaatatttttaaatcaacttctcatatcaagggaattatttaataatataagagatggaaaaataaaaccaaaaaacaatatagaaagagctgctttttatatgtatatacttacacaatcttttggtgcaaaaggagataactttggtatgaacgcaaaagctatgacaaaaccagttaatatatataaatcatatcaaaaatggagcaaaagattaaaaggtgtaacaatagaaaataaatcatttcacgacttaatacctctctatgacaatgatgaagcatttttttattgcgacccaccttatgttgaaacagagagttactataaaaatactggaggatttggtgaaaaagaacatattttattagcaaatactctagcaaatataaatggtaagtttttagttagctataatgatcatgaaatagtaagagaactctataaagattttaatataaaagttacaaaagagatagaatatactctaggtaaaaatgcacatggtaagagtaaaaaagtaagagaaatatatattactaattatgatttaaaagaaaatctttttagttattggtaa

SEQ ID NO: 13560 - protein, 244 aa, Unknown
  Obtained from environmental sample
  DOMAIN (1)...(214): D12 class N6 adenine-specific DNA methyltransferase
  misc_feature (1)..(244): Xaa is any amino acid
MIPPHKLYIEVFGGALNILYGKSKSHIEVVNDINSELINLHRSIRNNPETLSIFLNQLLISRELFNNIRDGKIKPKNNIERAAFYMYILTQSFGAKGDNFGMNAKAMTKPVNIYKSYQKWSKRLKGVTIENKSFHDLIPLYDNDEAFFYCDPPYVETESYYKNTGGFGEKEHILLANTLANINGKFLVSYNDHEIVRELYKDFNIKVTKEIEYTLGKNAHGKSKKVREIYITNYDLKENLFSYW

SEQ ID NO: 13561 - DNA, 489 bp, Unknown
  Obtained from environmental sample
  misc_feature (1)..(489): n is a, c, g, or t
atgaaaacactatatattataaggcatgcaaaatctagctggaaagatattgctttagatgactttgatagacctttaagtcaaagaggtagagatgatgcattactaatggcaaataagttagtagagttaaacattttcccagacttaattatctcaagcccttcaaaaagaacaaaatgcacaataaacattatagctccacaattgggttatgaaaaagatattgtatatgacgataaaatttatgaatcaaatatgacaaatttaaaaaagatagtgaagaatctcgataataaaaataattcagtatttctttttgggcataatcctggtttaaatatgttagcagaagatttatgcggatttataaaaaatattgcaacgacaggtatattgattataaattttgattgtaactcttggagtgaagtatcaaatctcaatagtaatttaagtgattatatttatccaaaaaaatataaataa

SEQ ID NO: 13562 - protein, 162 aa, Unknown
  Obtained from environmental sample
  DOMAIN (2)...(146): Phosphoglycerate mutase family
  misc_feature (1)..(162): Xaa is any amino acid
MKTLYIIRHAKSSWKDIALDDFDRPLSQRGRDDALLMANKLVELNIFPDLIISSPSKRTKCTINIIAPQLGYEKDIVYDDKIYESNMTNLKKIVKNLDNKNNSVFLFGHNPGLNMLAEDLCGFIKNIATTGILIINFDCNSWSEVSNLNSNLSDYIYPKKYK

SEQ ID NO: 13563 - DNA, 891 bp, Unknown
  Obtained from environmental sample
  misc_feature (1)..(891): n is a, c, g, or t
atgagagaaactctagctaaatgtaggattatcgggtacatggataagcgtgatggaaacatcaaacctatcagaattccttttgctccaaaatcagaagtccttctagcacaagacagatttatcatggaaatgatgaaacttgatggaaatcaaggtgcatatattggtaaacttgaaggcaaaaatattccagtacaactcgatcttaaaaatcttctaacaaaacacgttgctataatggcaaaatcaggtgcaggtaaatcttactgtactggcgttttacttgaagaaatcatggatagaaatgtccctcttctaataattgatcctcacggcgaatattcatctatgaaatatgctaatgacgacaaaaaagacattcaaaagatgaaacattataagattaaaccaaaaagatatactaataacatcaaagaatatggttatcttgaaggtatgaatccaatcaaacttaatgataatattaaagcagaagaattaatacatcttttaccaactaaactttcttcaagtcaaatggcattactctacaatgcaattaaaaacatgccaaaggttgatttagcaaatttaatactagaacttgaatacgaagaaagtcctagcaaatacaacataataagtgttgtaaatcatgttaaagaaatgaatattttttcagtaaattatactcctttcaatgaactaattcaaccaggacgagcttcaattcttaatctcaaaggattacctcctgaaggtcaacaaattgttgtatacaaattaatgaaagacttgtttgaacaaagaaaattaaataaaatccctccttttttcgctgtagttgaagaagcacataacttttgtcccagaacgagtttttggtga

SEQ ID NO: 13564 - protein, 296 aa, Unknown
  Obtained from environmental sample
  DOMAIN (1)...(269): Domain of unknown function DUF87
  misc_feature (1)..(296): Xaa is any amino acid
MRETLAKCRIIGYMDKRDGNIKPIRIPFAPKSEVLLAQDRFIMEMMKLDGNQGAYIGKLEGKNIPVQLDLKNLLTKHVAIMAKSGAGKSYCTGVLLEEIMDRNVPLLIIDPHGEYSSMKYANDDKKDIQKMKHYKIKPKRYTNNIKEYGYLEGMNPIKLNDNIKAEELIHLLPTKLSSSQMALLYNAIKNMPKVDLANLILELEYEESPSKYNIISVVNHVKEMNIFSVNYTPFNELIQPGRASILNLKGLPPEGQQIVVYKLMKDLFEQRKLNKIPPFFAVVEEAHNFCPRTSFW

SEQ ID NO: 13565 - DNA, 402 bp, Unknown
  Obtained from environmental sample
  misc_feature (1)..(402): n is a, c, g, or t
gtggtaatcaaagagttattaaataaaaatagttcttttaatagctctttaaaagaactgtttaaagatattttactgaaaacttttggtgatgatatttatctttttgtagattcaaatgagactttagagtatacactacattttggcttaaaaggtattaaagcaagagagctaatacgaacacttgctctagatgagatacttattacaaatggggaagggtgttcattaggattatcaaaaccttcaagagtaattcaagagatggggtatacccaagatcagagtagaaatgctatatcaatatcttttagtgaagatatgacagaggcagagataatagaagttgtagaattgatgtttaaaagatataaacaaataaggatattaaatgactaa

SEQ ID NO: 13566 - protein, 133 aa, Unknown
  Obtained from environmental sample
  misc_feature (1)..(133): Xaa is any amino acid
MVIKELLNKNSSFNSSLKELFKDILLKTFGDDIYLFVDSNETLEYTLHFGLKGIKARELIRTLALDEILITNGEGCSLGLSKPSRVIQEMGYTQDQSRNAISISFSEDMTEAEIIEVVELMFKRYKQIRILND

SEQ ID NO: 13567 - DNA, 450 bp, Unknown
  Obtained from environmental sample
  misc_feature (1)..(450): n is a, c, g, or t
atgcagggagaattgatgtctagtattgatgataatgtaaaagtatctttgagtgaaaaacaaaagcagataataaaaaaccatctcaatgataatggaaaactatcatgtataaaagcttttaaagttgctaggttaattgatgttgagccttttgcaatatctgcaattacaaaaagtcttaatattaggattacagattgtgaacttggggtatttgggaatttagagttctcaaataaagatgagaatatttataatgatttagtacaacagtatgaaaaagaaaagaaactagactgtaaagtttattgggatgaggcaaaaaaatcaagcttacataaagttggttcaactgttaaaaacagtgattttgaagttataaattgtcaacttggatgttttagattnaaagaaagncaaggagataaaaatggaagtaagagttaa

SEQ ID NO: 13568 - protein, 149 aa, Unknown
  Obtained from environmental sample
  misc_feature (1)..(149): Xaa is any amino acid
MQGELMSSIDDNVKVSLSEKQKQIIKNHLNDNGKLSCIKAFKVARLIDVEPFAISAITKSLNIRITDCELGVFGNLEFSNKDENIYNDLVQQYEKEKKLDCKVYWDEAKKSSLHKVGSTVKNSDFEVINCQLGCFRXKEXQGDKNGSKS

SEQ ID NO: 13569 - DNA, 612 bp, Unknown
  Obtained from environmental sample
  misc_feature (1)..(612): n is a, c, g, or t
ttggccggaggattttctatctcaattttatttttcttaattgcagaacttgattggcaaatatatcaacatttaggggatagtttcttggaaacctttttgattatgttcccccatgtttggtttatttttcttggtatctttctttttgtttcttatcaaaatttgcgtcatacaaaaaaaggttatcattatgaattgattttagtggcaattgttattgtttttataagcataatcttaagtctacttttttcttttactaaaataaatcaaaaattgaatcagatttttattgataaggttccgggttatgagagagttattcacaccaaagaacatcaatggtcacagccagaaagaggtttgttttttggagagattcttgcaatagaaattaaaaatgacactagagtcttgatcttagaaaacccaaaaaaaggaaattggcgaattgtgattaacggagaaactgttattcgcggaaaggttagtctgaaaaaaggagtagtaataaaaataattggaaaaaagagtgaagataagaatgaatttgaagcagaagagattcggccatggggagggcaaggaaatcgtcgtattttaaagtga

SEQ ID NO: 13570 - protein, 203 aa, Unknown
  Obtained from environmental sample
  misc_feature (1)..(203): Xaa is any amino acid
MAGGFSISILFFLIAELDWQIYQHLGDSFLETFLIMFPHVWFIFLGIFLFVSYQNLRHTKKGYHYELILVAIVIVFISIILSLLFSFTKINQKLNQIFIDKVPGYERVIHTKEHQWSQPERGLFFGEILAIEIKNDTRVLILENPKKGNWRIVINGETVIRGKVSLKKGVVIKIIGKKSEDKNEFEAEEIRPWGGQGNRRILK

SEQ ID NO: 13571 - DNA, 303 bp, Unknown
  Obtained from environmental sample
  misc_feature (1)..(303): n is a, c, g, or t
ttgaatacgacaatatcgaatccattgcagatggatacacaaataatgcgttcatcggaatttggaaaagcaataagactaacaaagagaaaatttgtaattgggctgattttagagttccaaaagcaaatcgagattttgacattggagctggagaattttcaccgagcgaaaagtattttaataaaggttggtctaactataaaccaatggaaacagaacaatggtggaaataaagccagttgccaacaactaagtattcgtctcggcgatagcccagagatgaatactccagttgactaa

SEQ ID NO: 13572 - protein, 100 aa, Unknown
  Obtained from environmental sample
  misc_feature (1)..(100): Xaa is any amino acid
MNTTISNPLQMDTQIMRSSEFGKAIRLTKRKFVIGLILEFQKQIEILTLELENFHRAKSILIKVGLTINQWKQNNGGNKASCQQLSIRLGDSPEMNTPVD

SEQ ID NO: 13573 - DNA, 924 bp, Unknown
  Obtained from environmental sample
  misc_feature (1)..(924): n is a, c, g, or t
atgtgcgaaaaaatagttacattaagtacttatgatatgcaatgttatttttgtaatagtggagctgaagcaaatgaaagtgctattaaattagctagaaaatatggaaatatagctttttctaaaacaaagtataaaattataactattaaaaattcttttcatggaagaacaatagcaactttaaaagcaacagcacaagaggaaaaacataaatattttggaccttatcctgatggatttgtttatgctgataatataaatgaagcaataaacttgatagatgatgatactgtagctgttatgcttgaactgattcaaggggaaggtggcatctttatgcaagataaagaacaagtaaaaaagttaagtgaggtattggaaaaaaagaaatcattattgataatagatgaaattcaaacaggtgtttatagaagtggagaatttctaatgtcacatcattatgagattagaccaaatattataactttagcaaaaggcttagcaacaggagttccaatagggatgatgatgacagatttaaaaaatgttttaaatcaaggtgatcatggttcaacttttggtggaaatcacctttcgacaacagtgtccattaaggttttaaatattttagaaaagtataaaaagagtggaaaacttgaatcaaatattaagtattttaatgattatctagattattttatagaaaaatatccatctttgtttttatcaaaaaatggctttggttttatgcttggagtgaaacttaaagatgaaatcatgctcaatgagattgtcaagttatctttaaagtatggtgttttaacacttaaatcagggcaggatatagttcgatttttaccacctttgaatatatcaaaaaaagagataaaaataggatttaaaagattgaaaaagcagtaa

SEQ ID NO: 13574 - protein, 307 aa, Unknown
  Obtained from environmental sample
  DOMAIN (5)...(305): Aminotransferase class-III
  misc_feature (1)..(307): Xaa is any amino acid
MCEKIVTLSTYDMQCYFCNSGAEANESAIKLARKYGNIAFSKTKYKIITIKNSFHGRTIATLKATAQEEKHKYFGPYPDGFVYADNINEAINLIDDDTVAVMLELIQGEGGIFMQDKEQVKKLSEVLEKKKSLLIIDEIQTGVYRSGEFLMSHHYEIRPNIITLAKGLATGVPIGMMMTDLKNVLNQGDHGSTFGGNHLSTTVSIKVLNILEKYKKSGKLESNIKYFNDYLDYFIEKYPSLFLSKNGFGFMLGVKLKDEIMLNEIVKLSLKYGVLTLKSGQDIVRFLPPLNISKKEIKIGFKRLKKQ

SEQ ID NO: 13575 - DNA, 642 bp, Unknown
  Obtained from environmental sample
  misc_feature (1)..(642): n is a, c, g, or t
atgaacagttttcattttatcatacttaaaaggggagaaatgaaagaaaacaattatttattgccattatataatagattagatgtatcatttgtaaaaggtaaaaattctattttatatgatgaaaaagggagagattatattgatttttcttctgggattggtgtaaatagtttgggttattgtgataaaaaaattgttaaaacaataactaaacaagccaataaaattttacacacatcaaatatttatcatataaagtcgcaagaaaaatgtgcgaaaaaaatagttacattaagtacttatgatatgcaatgttatttttgtaatagtggagctgaagcaaatgaaagtgctattaaattagctagaaaatatggaaatatagctttttctaaaacaaagtataaaattataactattaaaaattcttttcatggaagaacaatagcaactttaaaagcaacagcacaagaggaaaaacataaatattttggaccttatcctgatggatttgtttatgctgataatataaatgaagcaataaacttgatagatgatgatactgtagctgttatgcttgaaactgattcaggggaaggtggcatctttatgncagataaagaaacagtaaaaagttaa

SEQ ID NO: 13576 - protein, 213 aa, Unknown
  Obtained from environmental sample
  DOMAIN (18)...(213): Aminotransferase class-III
  misc_feature (1)..(213): Xaa is any amino acid
MNSFHFIILKRGEMKENNYLLPLYNRLDVSFVKGKNSILYDEKGRDYIDFSSGIGVNSLGYCDKKIVKTITKQANKILHTSNIYHIKSQEKCAKKIVTLSTYDMQCYFCNSGAEANESAIKLARKYGNIAFSKTKYKIITIKNSFHGRTIATLKATAQEEKHKYFGPYPDGFVYADNINEAINLIDDDTVAVMLETDSGEGGIFMXDKETVKS

SEQ ID NO: 13577 - DNA, 408 bp, Unknown
  Obtained from environmental sample
  misc_feature (1)..(408): n is a, c, g, or t
ttgagaaattcatctgattatcaggaagttacacgaaatttgtatttgatgaaaattgcaattggagaagtaattgtacttaataatgtgttttttgcacaaggctctgccgaattacaaagcacttcattttctgaacttgataggattgtaaaaataatgaaagataaccctaaaatgaaagttgaattgcttggtcatactgacaatcgtggagatgctaagaaattattgggattatcaaaagatagggttaatgcagtaaaagattatattgtagaaaaaggaatttcaacaaatagaattcaagcaaatgcttttggtggttcactgccaattcataaaaatgacacagaatttgaacacagcaaaaatcgtagagttgaatttaaaattttggaattgtaa

SEQ ID NO: 13578 - protein, 135 aa, Unknown
  Obtained from environmental sample
  DOMAIN (31)...(126): OmpA family
  misc_feature (1)..(135): Xaa is any amino acid
MRNSSDYQEVTRNLYLMKIAIGEVIVLNNVFFAQGSAELQSTSFSELDRIVKIMKDNPKMKVELLGHTDNRGDAKKLLGLSKDRVNAVKDYIVEKGISTNRIQANAFGGSLPIHKNDTEFEHSKNRRVEFKILEL

SEQ ID NO: 13579 - DNA, 336 bp, Unknown
  Obtained from environmental sample
  misc_feature (1)..(336): n is a, c, g, or t
ttgtcttgggcatcaaagcatagcacaagcatttgtggtgaagttataaaagctcctaaaatgatgcatgggaaaacatcacanatagaggtaatagaagatgatttattatttaaaaatcttccaaaaattattacccaaacaagataccattcacttacagtaaataaagagaatcttcctaggaatattatagtaacatcaaaatctttggatgatcaagagataatgtctttaaaaataaaagataaagatatctatggtgtacagtttcatccagagtctgttatgagtgaatatggacatgagatgttggataactttctaaaactataa

SEQ ID NO: 13580 - protein, 111 aa, Unknown
  Obtained from environmental sample
  DOMAIN (1)...(111): Glutamine amidotransferase class-I
  misc_feature (1)..(111): Xaa is any amino acid
MSWASKHSTSICGEVIKAPKMMHGKTSXIEVIEDDLLFKNLPKIITQTRYHSLTVNKENLPRNIIVTSKSLDDQEIMSLKIKDKDIYGVQFHPESVMSEYGHEMLDNFLKL

SEQ ID NO: 13581 - DNA, 321 bp, Unknown
  Obtained from environmental sample
  misc_feature (1)..(321): n is a, c, g, or t
ttgcaggcagccggattggatccggatggctgtcacaaggccaaaacaatatcaaatctaagaagttattggctatccaatttaaaagaatttatcaatttagtaatagagaaatccacgaattcctccatctcactatctattatttcaggtttatgtacaattatcgcagtaactccaaaacaatgtatccacaaggaacgggcaatgaaatcagggttaccattttcaaagattttattctcaatcaaattattcacaaaacctttaagtataagatatttggtgttttcagttgattcttgcacccgatctttctga

SEQ ID NO: 13582 - protein, 106 aa, Unknown
  Obtained from environmental sample
  misc_feature (1)..(106): Xaa is any amino acid
MQAAGLDPDGCHKAKTISNLRSYWLSNLKEFINLVIEKSTNSSISLSIISGLCTIIAVTPKQCIHKERAMKSGLPFSKILFSIKLFTKPLSIRYLVFSVDSCTRSF

SEQ ID NO: 13583 - DNA, 606 bp, Unknown
  Obtained from environmental sample
  misc_feature (1)..(606): n is a, c, g, or t
ttgacaccgttaagatggaggtgtgcaatgaagaaggatgtgaagaagctgataaagaaaactgctcagaagattttcttaacccgtggcttagaaaaaatctctatgcgaaatattgcatctaagataggatattctcctacaaccatatacctttactacaagaataaagatgaactgttacgtgatattctggctgattataatagtgattttgagagtcaaatggctaagttgattctggaggataaagaagttatagtgaagctcaaagatttcttgattctttatgtcagtaatggtctggaatatcctgacatgttcaagcttttaacagattattttttcaatcagaaagatcgggtgcaagaatcaactgaaaacaccaaatatcttatacttaaaggttttgtgaataatttgattgagaataaaatctttgaaaatggtaaccctgatttcattgcccgttccttgtggatacattgttttggagttactgcgataattgtacataaacctgaaataatagatagtgagatggaggaattcgtggatttctctattactaaattgataaattcttttaaattggatagccaataa

SEQ ID NO: 13584 - protein, 201 aa, Unknown
  Obtained from environmental sample
  DOMAIN (18)...(64): Bacterial regulatory proteins, tetR family
  misc_feature (1)..(201): Xaa is any amino acid
MTPLRWRCAMKKDVKKLIKKTAQKIFLTRGLEKISMRNIASKIGYSPTTIYLYYKNKDELLRDILADYNSDFESQMAKLILEDKEVIVKLKDFLILYVSNGLEYPDMFKLLTDYFFNQKDRVQESTENTKYLILKGFVNNLIENKIFENGNPDFIARSLWIHCFGVTAIIVHKPEIIDSEMEEFVDFSITKLINSFKLDSQ

SEQ ID NO: 13585 - DNA, 597 bp, Unknown
  Obtained from environmental sample
  misc_feature (1)..(597): n is a, c, g, or t
atggcaataattgtagacaaggtacaaaaaagaaaagatatcgcactttcttgtatagatttacttctagaaaaaggtattaagaagttaactgtatctgaagtagcaattcaagcaggtgtttcaaagggaagtatttatgattactttgaaaacaaagaagatattgtttttgagattattagaaatgatatagaaaattatcaaaataacctttatgaacagataactcctactatatcaacaagagaaaaagtttttttgttatttgattttttgttaagtgaaaatgatatgtttcaaaaacatcaaaatatatataaagagtatgtgagtataaatttaggaactcataatgataatatgagtgaatttaataaagagtgttctgttttttttaaaacaactatagaaaagcttataaaagaggggataactaaaggtgaaattattgaagattctttaaagctcgtaggtggttttttagctgttgaaaaaggttttttaatgatacactggacagaaggaaaagatgtaaagggtgaacttaaagagtttataaatatgatatttgatttaatagaggtgaaaaaatga

SEQ ID NO: 13586 - protein, 198 aa, Unknown
  Obtained from environmental sample
  DOMAIN (14)...(60): Bacterial regulatory proteins, tetR family
  misc_feature (1)..(198): Xaa is any amino acid
MAIIVDKVQKRKDIALSCIDLLLEKGIKKLTVSEVAIQAGVSKGSIYDYFENKEDIVFEIIRNDIENYQNNLYEQITPTISTREKVFLLFDFLLSENDMFQKHQNIYKEYVSINLGTHNDNMSEFNKECSVFFKTTIEKLIKEGITKGEIIEDSLKLVGGFLAVEKGFLMIHWTEGKDVKGELKEFINMIFDLIEVKK

SEQ ID NO: 13587 - DNA, 924 bp, Unknown
  Obtained from environmental sample
  misc_feature (1)..(924): n is a, c, g, or t
atgaaaagaatcagaacaagattatgtgatcgaagcgttgaaagagttgttgcaatcatgaaaacttgccctcggaacagctcagtttggtatggattatgggggtcgccaataaaaaaagggcatgtgagtctgtctgatgtgaaaagcatactgtcattagcaagaaaatatggcatatcgactatagatacagcggccgcatatggtagtagtgaaaatgcacttggacttgcaggagtgaatgatttcaatattgtttccaaactacctccccgtgattcaaaatgccttgatacaattggatggattgaaaaatccgttaaaaattctctcgaaaatctgaaggtagattccctgtatggttttcttttacatcgaccgcatgaacttctgagcagtgagggagaaaaaatttttgaaaccctttcggtcttaaaaagcaaaggaataataaaaaaaattggagtttcaatatatgagccggaacagcttgatcagttatatcagtattatagttttgaccttgttcaaaccccaatgaacttgattgatcatagaataattgaaacaggttggttgcagaggctgaaggaaagtggagctgaggtacatattagatcagcatttctgcaaggtttgcttttgatgaaatcaatagaccgacctgcatattttaatacgtggaatagaatttttgcgcattttgacgagtggcttatatctgagaatatatcgccattagaagcatgtcttggatttttaaatagccacccagaaatcgataaagttatcgtgggtattgattctgtaaagcaattgtcagaaattatggatgctgtcagtgtaaaaattcctgaaattcctgattcacttaaatctggtgatctcgcattaattaacccaggttgttggaaattatga

SEQ ID NO: 13588 - protein, 307 aa, Unknown
  Obtained from environmental sample
  DOMAIN (20)...(297): Aldo/keto reductase family
  misc_feature (1)..(307): Xaa is any amino acid
MKRIRTRLCDRSVERVVAIMKTCPRNSSVWYGLWGSPIKKGHVSLSDVKSILSLARKYGISTIDTAAAYGSSENALGLAGVNDFNIVSKLPPRDSKCLDTIGWIEKSVKNSLENLKVDSLYGFLLHRPHELLSSEGEKIFETLSVLKSKGIIKKIGVSIYEPEQLDQLYQYYSFDLVQTPMNLIDHRIIETGWLQRLKESGAEVHIRSAFLQGLLLMKSIDRPAYFNTWNRIFAHFDEWLISENISPLEACLGFLNSHPEIDKVIVGIDSVKQLSEIMDAVSVKIPEIPDSLKSGDLALINPGCWKL

SEQ ID NO: 13589 - DNA, 450 bp, Unknown
  Obtained from environmental sample
  misc_feature (1)..(450): n is a, c, g, or t
ttgcaagaaaaatattattatggttatgatgagtttaaaaatgatactcaagttttagtagacaaatgtagagattatgagcctgatatcttattgggagtagcacgaggtggtttaactttgtcacatcttatgggacaggctttaaatatgagaaatgtatttacgattaattctatacattatgagggtgagttaaaactagatacttttaacatctttaatattcctgacttatcccatgcaaaaagagttttggttattgatgatatcgttgatagtggtgaaactatgagggaaattttaaagcttttaaataaaaagtttccaaatacagaatttaaactagctaccatcttttataagccaacagcctgtattaaggctgattatagtgttaaaatagctgataagtggatagagtttttttgggaagtagatattaaataa

SEQ ID NO: 13590 - protein, 149 aa, Unknown
  Obtained from environmental sample
  DOMAIN (1)...(131): Phosphoribosyl transferase domain
  misc_feature (1)..(149): Xaa is any amino acid
MQEKYYYGYDEFKNDTQVLVDKCRDYEPDILLGVARGGLTLSHLMGQALNMRNVFTINSIHYEGELKLDTFNIFNIPDLSHAKRVLVIDDIVDSGETMREILKLLNKKFPNTEFKLATIFYKPTACIKADYSVKIADKWIEFFWEVDIK

SEQ ID NO: 13591 - DNA, 585 bp, Unknown
  Obtained from environmental sample
  misc_feature (1)..(585): n is a, c, g, or t
atgttatttaatattgacaacagtgttcaaattttttcaggagatagtaaatttgaaaattttatacctgcaaaagtgattaatagtttaaatattaaaaaaataaacagtgagaataattttattatctctatgcctatagtcttaactaatcagtggggtgtgatacatattgtatattcacttaaagagctaaaagaggagatatataaagcagaagaaaatatacaaaacaaaataaatttaaatataaaaaaagctatttatacctctcttcttttagcatttgctctaatgctctttagctacttttttataaggagacttatatcaccaattttattgctaaccaaaactgcaaaagagatatcttatgggaatcttgatgttagcaaagagttaaataaaattgagtctcatgatgaaattggactgttgtctaaatcatttaaagagatgagcaagaaacttgatagatcatataaagacctaaagagtctaaatgagagtttggagcagaagataaaagagagaacgcatgagttagagattgcaaaattaaagctgaagagggaacaaaattaa

SEQ ID NO: 13592 - protein, 194 aa, Unknown
  Obtained from environmental sample
  DOMAIN (87)...(159): HAMP domain
  misc_feature (1)..(194): Xaa is any amino acid
MLFNIDNSVQIFSGDSKFENFIPAKVINSLNIKKINSENNFIISMPIVLTNQWGVIHIVYSLKELKEEIYKAEENIQNKINLNIKKAIYTSLLLAFALMLFSYFFIRRLISPILLLTKTAKEISYGNLDVSKELNKIESHDEIGLLSKSFKEMSKKLDRSYKDLKSLNESLEQKIKERTHELEIAKLKLKREQN

SEQ ID NO: 13593 - DNA, 693 bp, Unknown
  Obtained from environmental sample
  misc_feature (1)..(693): n is a, c, g, or t
gtgcgtgatactgggataggcttgagtattaaagagcaaaaaagactctntcaatcattttcacaagcagatggcagtaccacaagaaaatatggtggcactggtttaggtcttaccataagcaaacaactagttgaactgatgaatggcaaaatctggttagagagtaatgtaggtgaaggaagtagctttgtttttgagatagagctacaagagagagaatatcatagatcgtacaatatttttagtgataaaaaggtattaatagtagatgataatgagtcatggcatgagattttaacgaataccttagagatatttaaattacaagtagatcatgcttatagtgcgaaagaggcagttaaaaaagctcatgagtgtgaaggtttttatgatcttattcttatggattggaacatgccagaaattgatgggatagaagcgactaaaatgattcaagtgatgtgcgttgaatgtagtaaaaaagagacctgcataaaactattgccacctgctgtgatcatggtaagttcatttagacaagagtctattatcaaattagcaaaagagataggtataaatatatttttacaaaaacctattaatccatcactattaaatgatatattaagcggagtatttttagaagatgttgatatgaaagagagtatcactgaggataaaaagagttaa

SEQ ID NO: 13594 - protein, 230 aa, Unknown
  Obtained from environmental sample
  DOMAIN (1)...(71): Histidine kinase-, DNA gyrase B-, and HSP90-like ATPase
  misc_feature (1)..(230): Xaa is any amino acid
MRDTGIGLSIKEQKRLXQSFSQADGSTTRKYGGTGLGLTISKQLVELMNGKIWLESNVGEGSSFVFEIELQEREYHRSYNIFSDKKVLIVDDNESWHEILTNTLEIFKLQVDHAYSAKEAVKKAHECEGFYDLILMDWNMPEIDGIEATKMIQVMCVECSKKETCIKLLPPAVIMVSSFRQESIIKLAKEIGINIFLQKPINPSLLNDILSGVFLEDVDMKESITEDKKS

SEQ ID NO: 13595 - DNA, 648 bp, Unknown
  Obtained from environmental sample
  misc_feature (1)..(648): n is a, c, g, or t
atgtcaagacacaaaaacaaaccacaaaataaagttgaaccaaaagagcccgtaaaagtgaaaatgactttgaaagactttggcaaattaaactggcaaccatttcttgtgtttattcttttttcatttattctttattacaacaccttaagtcatgagtatgctctcgacgatgcaattgtaatcactaacaaccagttcactcaacaaggcactgaaggaatccctgatattttcaaatacgatacatttgtaggattttggctaactagctataaagacaaaacagcagaacaaatccaagaagagaaaaaacttgttgctggaggcagatatcgtcccctttcattggcaacatttgcaatggaagttgagttttttggtaaagacattaaagatgcaaatggaaaagtagtgcacaagggtaatcccaaaataagtcactttnataatattattatatatatacttactggttgcgtattgtttattattctaatgagattattcccaccagaaaaagaaaaaaagtggtatttcaaatttccgtttatagaaacccttttatccttagcccatcctattcatacagaagctgttgcaaacattaaaggtcgccatggaactatgacactttggggtctctaa

SEQ ID NO: 13596 - protein, 215 aa, Unknown
  Obtained from environmental sample
  misc_feature (1)..(215): Xaa is any amino acid
MSRHKNKPQNKVEPKEPVKVKMTLKDFGKLNWQPFLVFILFSFILYYNTLSHEYALDDAIVITNNQFTQQGTEGIPDIFKYDTFVGFWLTSYKDKTAEQIQEEKKLVAGGRYRPLSLATFAMEVEFFGKDIKDANGKVVHKGNPKISHFXNIIIYILTGCVLFIILMRLFPPEKEKKWYFKFPFIETLLSLAHPIHTEAVANIKGRHGTMTLWGL

SEQ ID NO: 13597 - DNA, 366 bp, Unknown
  Obtained from environmental sample
  misc_feature (1)..(366): n is a, c, g, or t
atgatatactacctaacttataataaaattggagtttgtatgaatagtactatagttaactttttagacaatattcctacctcatcaaaagaagagatatttcaaactattacacaaaataaaaacataaaaatagagagaatcatctcttatggacaaactacaccaaaagagtattggtatgaccaaagtgaagatgaatttgttttaattttagagggtgaagcaaagataaggtacgatgataaaagtatatatcatcttaaaaaaggtgataatctctatataaaagcaaaccaaaaacatcaagttacatatacttcaaatcctactatttggctagctatctttattactaaaaattaa

SEQ ID NO: 13598 - protein, 121 aa, Unknown
  Obtained from environmental sample
  misc_feature (1)..(121): Xaa is any amino acid
MIYYLTYNKIGVCMNSTIVNFLDNIPTSSKEEIFQTITQNKNIKIERIISYGQTTPKEYWYDQSEDEFVLILEGEAKIRYDDKSIYHLKKGDNLYIKANQKHQVTYTSNPTIWLAIFITKN

SEQ ID NO: 13599 - DNA, 597 bp, Unknown
  Obtained from environmental sample
  misc_feature (1)..(597): n is a, c, g, or t
atgaataaaaaagacctcaaagtcatagcatttttagcatataaaaatattgttaaaagtaaatctacttttcttgtaatcatagctgtgatggcaatgagttttctttcaattacattttttgcagctataattgatggattaggttatgagtttgaagaaggaatgattgaaggtttaacaggacatcttatgatagaacccactcaagacaatttatatttagaaaatgtcaatacccttgtcaagaatattaaacgaataccaggcgttgtgggggtggcaccgaggttagaatcgagtgttattgcatcgtataaaaatactgaaatgggaatccctgtattttttattaatcctcaagatgaaataaaagtttcaaattttcatgatagtatgattttgggagattatctttcagaaaaagatgataatgaattaattattggagttaatcttgtacaatcttatgcancagaagatgatacacaaaaacgattaaatattaatgtaggggatactattcaattaagtttgagtaatggttttgttgatgattataaggtaaaaggattttcaaacaggatcaaaatttag

SEQ ID NO: 13600 - protein, 198 aa, Unknown
  Obtained from environmental sample
  misc_feature (1)..(198): Xaa is any amino acid
MNKKDLKVIAFLAYKNIVKSKSTFLVIIAVMAMSFLSITFFAAIIDGLGYEFEEGMIEGLTGHLMIEPTQDNLYLENVNTLVKNIKRIPGVVGVAPRLESSVIASYKNTEMGIPVFFINPQDEIKVSNFHDSMILGDYLSEKDDNELIIGVNLVQSYAXEDDTQKRLNINVGDTIQLSLSNGFVDDYKVKGFSNRIKI

SEQ ID NO: 13601 - DNA, 660 bp, Unknown
  Obtained from environmental sample
  misc_feature (1)..(660): n is a, c, g, or t
atggtttttgttgatgattataaagtaaaaggaatttacaaaacaggatcaaaatttagtgatgataaaatacttctcanctatgatgaatataatcaaatttttcatacagaagatgtggctagtaaaattttaattaaattgccaggaagagggagcgaagattattataaacaaaaaattatagatctaggggtaagtgaccagattaatccttggcaaacaaagatgggagctgtaaaacagtttgtaggtagtttacaaataacaaataagattactgggtttatagggctattaactgcatttgcaacaatttacataatcattttcataaatgtaacaaataaaagaaaacaaataggtctcttaaaagctgtaggaattaaaaaagagattattcttgggtcgtatgtattacaatcaatcatttatggtgttgttggagtgataattggtaatcttgtaatgcaaggattgttaattcttttaaccatgcaccctctaaacatgcccataggtgctgttgttccaattcttacaagagagagattaattacaatttcattaacattagtttttgcttcaatagttgcaggttttttcccttcaagaaaggcagcaaatgataatatacttgatgcaatatttggtggataa

SEQ ID NO: 13602 - protein, 219 aa, Unknown
  Obtained from environmental sample
  DOMAIN (41)...(212): Predicted permease
  misc_feature (1)..(219): Xaa is any amino acid
MVFVDDYKVKGIYKTGSKFSDDKILLXYDEYNQIFHTEDVASKILIKLPGRGSEDYYKQKIIDLGVSDQINPWQTKMGAVKQFVGSLQITNKITGFIGLLTAFATIYIIIFINVTNKRKQIGLLKAVGIKKEIILGSYVLQSIIYGVVGVIIGNLVMQGLLILLTMHPLNMPIGAVVPILTRERLITISLTLVFASIVAGFFPSRKAANDNILDAIFGG

SEQ ID NO: 13603 - DNA, 750 bp, Unknown
  Obtained from environmental sample
  misc_feature (1)..(750): n is a, c, g, or t
atgaattttaaaaatatattatatagtcttcttatttcaggttgtctatatggtagtacagctggaaatatttcaatgtttactgagacttatccaccttacaatatgaaagaagatggaaagttaacgggacttagtattgagatactaaaagcagtgttaaaacaactaaattcaaaacagaccattgaggatgttctccttactaactggtctagagcttactcaatagctttaaaaaacaataattcaatggtattttcaactacaagaacagaatcaagagagcccttatttaaatgggttggacctattgtgaacacaaaagttggagctattgctttaaaaggtaaaaaaataactataaattctatagaagattttaataaatataaaattggtgctgttttaaaagatgtaggggaaacaacattagcagaactaggtgtaaatagtcagcaaattcagtctgtatctggtgaaaatgcaataaacctttcttttttaaaactacaaaacaagagaattgatatatttgcctatgagacaaaagcagcttttgaaaatgcaaaaaagctaggatttgatacaaataaatatgagataatttatactcttaaagagggagatctttatttcgcttttaataaaaacaccgatgatgaaattattcaaaagtggcaaagagcactagatactattaaaaataatggtatatacaataaaatattgttaaaatatacacattaa

SEQ ID NO: 13604 - protein, 249 aa, Unknown
  Obtained from environmental sample
  SIGNAL (1)...(18)
  DOMAIN (24)...(248): Bacterial extracellular solute-binding proteins, family 3
  misc_feature (1)..(249): Xaa is any amino acid
MNFKNILYSLLISGCLYGSTAGNISMFTETYPPYNMKEDGKLTGLSIEILKAVLKQLNSKQTIEDVLLTNWSRAYSIALKNNNSMVFSTTRTESREPLFKWVGPIVNTKVGAIALKGKKITINSIEDFNKYKIGAVLKDVGETTLAELGVNSQQIQSVSGENAINLSFLKLQNKRIDIFAYETKAAFENAKKLGFDTNKYEIIYTLKEGDLYFAFNKNTDDEIIQKWQRALDTIKNNGIYNKILLKYTH

SEQ ID NO: 13605 - DNA, 525 bp, Unknown
  Obtained from environmental sample
  misc_feature (1)..(525): n is a, c, g, or t
atgtcgcccagaaaactgtattttaatgaggttattggtaagcgatggcttgcaaacattgatatacccgatttagagcttttccctcggcgttataagccggttacttcggtaaaatttcaagcgggtttagaattacccttgttacacctcggcatggtgtttatggcgttattagccaaaattggcctagtgaaaaactggtcaaaatttaccaagcttatctatacctccagtgagctgttcaagggtttcggtacagacactggcggcatgcaggttaatctatccggcttggatgagaataatcaacccaaacaaattaaatggacgctctgtgccgagaaaggcgtgggcccttatatacccacgctgtcagcaatcattttggcgaaaaaattgttaactgagactatcgatgtcagaggagcgactccttgtttagggtattacaccttagaagagtttgatcaggaggcaatacccctaggcatctatcatcaaacagaggttagcattggatag

SEQ ID NO: 13606 - protein, 174 aa, Unknown
  Obtained from environmental sample
  misc_feature (1)..(174): Xaa is any amino acid
MSPRKLYFNEVIGKRWLANIDIPDLELFPRRYKPVTSVKFQAGLELPLLHLGMVFMALLAKIGLVKNWSKFTKLIYTSSELFKGFGTDTGGMQVNLSGLDENNQPKQIKWTLCAEKGVGPYIPTLSAIILAKKLLTETIDVRGATPCLGYYTLEEFDQEAIPLGIYHQTEVSIG

SEQ ID NO: 13607 - DNA, 639 bp, Unknown
  Obtained from environmental sample
  misc_feature (1)..(639): n is a, c, g, or t
atgaaaaaaataatattaagtttaggtgtagcaacacttttattaacaactaacttacaggcgaaagagtgtccaactacttgtgacagaatactatttggaactgtgggtgtactacaaggtatttttattggtggtccagttggagcattttgggggttaggtacagctatttttgctgataactatgaaggggataattgcgaagaaaagccaactgaaactactgaagttcagtcgtcagttgaaaacaatgcaaaagatgagcaaaatagtgcaaagatgacagagcaagttgaagaaaaaagtaaagtagaggaaaaatctgtaagtgttgatgatagattggatagtatttctgaaaatagtacaagtaagatgaaagttaaaggttatgtatttatccctagtattgttaattttgaatatgattcatataaagtgccaactattcctcaaaagttagcagagttaanaaatgatggcattacatctataacaattgatggtcatacagattctgtagggagtgatgagtacaattttgccttaggattaaaaagagcaaatgcagtaaaaaatattttgctttctcaaggtattgaaagtggaaaaaatgtcaacagtttcatatggtga

SEQ ID NO: 13608 - protein, 212 aa, Unknown
  Obtained from environmental sample
  SIGNAL (1)...(19)
  DOMAIN (140)...(209): OmpA family
  misc_feature (1)..(212): Xaa is any amino acid
MKKIILSLGVATLLLTTNLQAKECPTTCDRILFGTVGVLQGIFIGGPVGAFWGLGTAIFADNYEGDNCEEKPTETTEVQSSVENNAKDEQNSAKMTEQVEEKSKVEEKSVSVDDRLDSISENSTSKMKVKGYVFIPSIVNFEYDSYKVPTIPQKLAELXNDGITSITIDGHTDSVGSDEYNFALGLKRANAVKNILLSQGIESGKNVNSFIW

SEQ ID NO: 13609 - DNA, 822 bp, Unknown
  Obtained from environmental sample
  misc_feature (1)..(822): n is a, c, g, or t
gtgaatgtagttgtatcgccattaacaattaccgcagaaagagaagtgaagtttgattttactcattcatattacactacaggattaagtattgcagtttcaaatgattctgatggcagtttggtaaagacaatatttaatttgtttagcacaaagctattaacaattgtattgataattatttttgtcctcttttttgttgcttttatcgtctggttatntgaaagaaaaaaaaatgagaagcaatttggagatggtgttcttaaaggtcttgcttctagtttttggtgggctgctgttactatgacaactgttggatatggtgacaaagcgcccaaaaccattggtggaagaacaattgctcttgtttggatgtttgctggattgataatgatatctggatttacagcagcagttgcatcagcacttactgtagaaagactagatattggaataaactccgcttctgatttacataatataagagtgtgtacaattaagagttcttcaagtgaagaatatcttttggcaaatggagtggattatattattgtaagaaatattaaagaaggaataaatttagttagaaaaaacaaaatagatgccttggtttatgatgctccaattttgaagtatcatattaaaaagcaaaatataaccaacgaaataaaagttcttccaatagttttagatccaattaactatgcttttgctcttccaacaaatagtccacttaccgaaaaattaaatcaaatacttttgcgtaagatagatgatttagagtggacaaaaacaataaattcttatctaggcagaaaatag

SEQ ID NO: 13610 - protein, 273 aa, Unknown
  Obtained from environmental sample
  DOMAIN (1)...(272): Bacterial extracellular solute-binding proteins, family 3
  misc_feature (1)..(273): Xaa is any amino acid
MNVVVSPLTITAEREVKFDFTHSYYTTGLSIAVSNDSDGSLVKTIFNLFSTKLLTIVLIIIFVLFFVAFIVWLXERKKNEKQFGDGVLKGLASSFWWAAVTMTTVGYGDKAPKTIGGRTIALVWMFAGLIMISGFTAAVASALTVERLDIGINSASDLHNIRVCTIKSSSSEEYLLANGVDYIIVRNIKEGINLVRKNKIDALVYDAPILKYHIKKQNITNEIKVLPIVLDPINYAFALPTNSPLTEKLNQILLRKIDDLEWTKTINSYLGRK

SEQ ID NO: 13611 - DNA, 921 bp, Unknown
  Obtained from environmental sample
  misc_feature (1)..(921): n is a, c, g, or t
atgctacaaaaatttttgtataatagtatggtaaattatgagaaaggagtacttatgaacaatctatcaatcaaatggaaactaacactgcttattgcaattatagttttagtaatgtcgctatttttagttagtcttagtatatatgatataaaaaaaacctctagtgatgacacaaaactttttaaagaaaaagcttttagtgcaaaacaagatgaattaaaatcaaatatagacatagttttaaaaactatcgattctttttatgagagaacatcaaaagaaaaagtcaaactagaagttcaagagaaacttgtaactcaagcacaaatgttagaaaatatcttaaaccaatattatctaaaacatcaaaatagtaaaacagtacaatcagaacttatcgatatcgttaaaaatagtaaatatggtaaaagtggttatttttggataaataacactgatgcaaaaatggttatgcatccaattaaaccaagtcttgatggaaaagatttatctaatttaaaagaccctaatggtaaaaaattttttatagagatggttaacctttctaaaaacaactcgcaagggtttgtagattatcaatggccaaaaccaggatttgataaaccacaagataaagtttcttatatttttacatttaaaccatttaattggattataggaactggtgaataccttgataatgtaacagctcaaatgcaaaaagaagctttaaaaactatctctaaaatgagatatggtaaagatagtagtaactatttttggataaatgacactgaaccaaaaatggttatgcatcccattaagccttcattaaataataccaatatatcaagtgtaaaagatccaaatggaaaactattattgtcgaaatggcaaaagtgctccgagccgatctga

SEQ ID NO: 13612 - protein, 306 aa, Unknown
  Obtained from environmental sample
  misc_feature (1)..(306): Xaa is any amino acid
MLQKFLYNSMVNYEKGVLMNNLSIKWKLTLLIAIIVLVMSLFLVSLSIYDIKKTSSDDTKLFKEKAFSAKQDELKSNIDIVLKTIDSFYERTSKEKVKLEVQEKLVTQAQMLENILNQYYLKHQNSKTVQSELIDIVKNSKYGKSGYFWINNTDAKMVMHPIKPSLDGKDLSNLKDPNGKKFFIEMVNLSKNNSQGFVDYQWPKPGFDKPQDKVSYIFTFKPFNWIIGTGEYLDNVTAQMQKEALKTISKMRYGKDSSNYFWINDTEPKMVMHPIKPSLNNTNISSVKDPNGKLLLSKWQKCSEPI

SEQ ID NO: 13613 - DNA, 366 bp, Unknown
  Obtained from environmental sample
  misc_feature (1)..(366): n is a, c, g, or t
atgaaaaagattgaaataaattttaaagacgaagcattgaaagaatatattaatttaaaagattatgttaaacaaaataaaacctcaagaaataagccaacttattttcaattacttaattctattgaaaaaactcttactttaattgaaatcaatccttaccatgggaatttaattcctaaaaaatatcttaacaagaatttaattaaaatttatggtactgataaaatttatcgagaagaattaattggttattggaggttaatttatactttgattggaaatgaaattaaaattgttgctattattcttgattttatgaatcacaatgattataataatttattcgggtataaaaaaagatga

SEQ ID NO: 13614 - protein, 121 aa, Unknown
  Obtained from environmental sample
  misc_feature (1)..(121): Xaa is any amino acid
MKKIEINFKDEALKEYINLKDYVKQNKTSRNKPTYFQLLNSIEKTLTLIEINPYHGNLIPKKYLNKNLIKIYGTDKIYREELIGYWRLIYTLIGNEIKIVAIILDFMNHNDYNNLFGYKKR

SEQ ID NO: 13615 - DNA, 789 bp, Unknown
  Obtained from environmental sample
  misc_feature (1)..(789): n is a, c, g, or t
ttgctctatccgaagagaaaggatgaagcggaaatcatttacagtgaaatctcacatgtagacagcttaatagacaactttaaaaatccaaatagaaaccctcaaatagcgataagcgtagatatgcttgacactggaatagatgtaccggagatattaaacctcgtcttttttaaacctataaaatcaaaaattaaattttggcagatgataggcagaggaacgagactttgtcctaatctacttggagagaacaaagataaacagagttttaatatatttgatttttgtgccaatttttcatattttgacattcatgctaaaggcttgccatctcaaaaaagcagttctttaaaagagagactttttttaaaaagagtgggaattcttaaaattatgaaaaaaagtgatttacatgatgagatgcttatgattgtaaaatcacaagtgtatgcactagattcaagtgagtataatctaaaaaaacataggcatattatagaagagttacaaagtagtgatttagagtatattacagatgatgtttacaataatttaaaggttgttgccgaatatatcgaagatgaatcaaattttgaagttcaaagatttcagatgcttattttgaatgcacaagaggcaattttaaaagacaaagagaataaagcatacaccccagagataaaagagcgatgcactatcttaaaatcaaaagcaaataatgttaatgctttaaaagagaaagtagatgttattgaacatgtttataaacggagtttactcccttag

SEQ ID NO: 13616 - protein, 262 aa, Unknown
  Obtained from environmental sample
  DOMAIN (2)...(78): Helicase conserved C-terminal domain
  misc_feature (1)..(262): Xaa is any amino acid
MLYPKRKDEAEIIYSEISHVDSLIDNFKNPNRNPQIAISVDMLDTGIDVPEILNLVFFKPIKSKIKFWQMIGRGTRLCPNLLGENKDKQSFNIFDFCANFSYFDIHAKGLPSQKSSSLKERLFLKRVGILKIMKKSDLHDEMLMIVKSQVYALDSSEYNLKKHRHIIEELQSSDLEYITDDVYNNLKVVAEYIEDESNFEVQRFQMLILNAQEAILKDKENKAYTPEIKERCTILKSKANNVNALKEKVDVIEHVYKRSLLP

SEQ ID NO: 13617 - DNA, 642 bp, Unknown
  Obtained from environmental sample
  misc_feature (1)..(642): n is a, c, g, or t
ttgggggttttaaaagcctttaggaccacccctgggcctttgggtaatctttcggtaggaaaagggtctgcccccgtaaaaacacgtttttggatgaaatacaagaagggcgtaacggctctagtgtggattttattgataaaagcatctgtaaaaacagaagctcaaaaaatatttgatgagtatattgaagcattgcgagttataaaagagcttgaaagtacgattctcataactgatgatgatataagtgaaatcaagtatcatgtttttgatcttgaaaaaatagttgaagataagatgaacagcaatgacgattttaatcttttgattcatgatattcttaaaagttctaaaaaagaagtagctaacaaaatacttgataatttcatatcttccggtagttatacgcaaaagcaaatagaacttatcaataaaattaaaaatatactgtttggcaaaaagtatgcaaacattcatgactctttgataaatgtaaaagaggtattgtttagtgatattcatccattggcgaatgattttggatatttaagtgagcaagaacaaaatgatattttcaatgttattcatttgatagatagagttgatgatagtgcaaatacttctctctacgtaacatga

SEQ ID NO: 13618 - protein, 213 aa, Unknown
  Obtained from environmental sample
  misc_feature (1)..(213): Xaa is any amino acid
MGVLKAFRTTPGPLGNLSVGKGSAPVKTRFWMKYKKGVTALVWILLIKASVKTEAQKIFDEYIEALRVIKELESTILITDDDISEIKYHVFDLEKIVEDKMNSNDDFNLLIHDILKSSKKEVANKILDNFISSGSYTQKQIELINKIKNILFGKKYANIHDSLINVKEVLFSDIHPLANDFGYLSEQEQNDIFNVIHLIDRVDDSANTSLYVT

SEQ ID NO: 13619 - DNA, 906 bp, Unknown
  Obtained from environmental sample
  misc_feature (1)..(906): n is a, c, g, or t
atgctcagttttaattcaaatggcgtttctgcagatttttatcatgcaggattaattaatgatgaaagaagcagaaagcaacacgattggataaacaataaaattagagtaatcgtttctaccaatgcttttgggatgggaatagacaagcctgatgtaagaacggtagtgcatttagatttgccggattctttagaagcttactttcaagaagcaggaagagcaggaagagatgaaaaaaaagcctatgctattttgttggtagaacaggctgatagaatggatttagaacaacgaattattagcagttttccgcctatagaaactataaaacaagtttatcaggcattagcaaattattatcaaattcctattggagcagcgttgtcagaaaattataatttcgatattgcagcttttagcaaacaatataattttcaaataactaccgtatttaattgcttaaaatttttagaaaaagaagggtacattatcttatcagaagcttattaccaaccttcacgaataaaaattgaagtaaataaaacggtattgtatgactttcaggtgaaaaattctaagtacgattttttcattaaaaccttgttacgttcctattctggtttgtttgaaaattacattaaaattgatgaaaatgatttagctaaaagactttctactgataggaaaaccgttataaaagcattagattttctgcataaccaacaaattatagattatataaagcaaacacaattgcctcaaataacttataccacaccaagattagatataaaagaggtaactatttcggcagccaattataacgaacggaaaaaagtggccattaaaaaaatggaaagtgtaatttattattcatcggttactcacaaatgccgaaagtga

SEQ ID NO: 13620 - protein, 301 aa, Unknown
  Obtained from environmental sample
  DOMAIN (3)...(79): Helicase conserved C-terminal domain
  misc_feature (1)..(301): Xaa is any amino acid
MLSFNSNGVSADFYHAGLINDERSRKQHDWINNKIRVIVSTNAFGMGIDKPDVRTVVHLDLPDSLEAYFQEAGRAGRDEKKAYAILLVEQADRMDLEQRIISSFPPIETIKQVYQALANYYQIPIGAALSENYNFDIAAFSKQYNFQITTVFNCLKFLEKEGYIILSEAYYQPSRIKIEVNKTVLYDFQVKNSKYDFFIKTLLRSYSGLFENYIKIDENDLAKRLSTDRKTVIKALDFLHNQQIIDYIKQTQLPQITYTTPRLDIKEVTISAANYNERKKVAIKKMESVIYYSSVTHKCRK

SEQ ID NO: 13621 - DNA, 579 bp, Unknown
  Obtained from environmental sample
  misc_feature (1)..(579): n is a, c, g, or t
ttgaaagaaaatttaaaaaagcttataaatattggaaaaaatttaaaaattctaattgtagaagatgatccacttttaagaagagagattgtgagtatcttaaatgttatttttgatgatataacatttgcagtagatggtcaagatggatttcaaaagtatctagatacaaagtatgattttataattacagatatccatatgccaaatctaaatggtataaatatggcaaaaaaaattcgagaaaaaaatgacagaattcctattattatcctctctgcaaatagtgacccacactattttatagagagtattaaaataggagttgctggctacattttaaagcctcttgattttgaacagatgtatcatgttttgtatgagaccattgaaaatataaaattaaaacatgatgtatttagacaaaagcaacttctctctgaaattaataatgatttagaacaacagatgataggaagaatatctgaaatctactctttaaatgaggagattcaagcaactcaaaaagaggttctctttactatgggaactattgtgagagagactcagccaatctga

SEQ ID NO: 13622 - protein, 192 aa, Unknown
  Obtained from environmental sample
  DOMAIN (15)...(134): Response regulator receiver domain
  misc_feature (1)..(192): Xaa is any amino acid
MKENLKKLINIGKNLKILIVEDDPLLRREIVSILNVIFDDITFAVDGQDGFQKYLDTKYDFIITDIHMPNLNGINMAKKIREKNDRIPIIILSANSDPHYFIESIKIGVAGYILKPLDFEQMYHVLYETIENIKLKHDVFRQKQLLSEINNDLEQQMIGRISEIYSLNEEIQATQKEVLFTMGTIVRETQPI

SEQ ID NO: 13623 - DNA, 672 bp, Unknown
  Obtained from environmental sample
  misc_feature (1)..(672): n is a, c, g, or t
gtggatactgagagtgacattgggttgcttaatcttaaggataccgaagggagtcctgcattgtatattaccggagctaattcatctgagggggaaatagctatccctgctggccaggcttttaatattggtcattgggatgggacttttgaatcaagaattgaaattgatggtcaaggaaatgttggcattggaacaaccgatcccacttctcttcttacagtaaacggcgatgcagctaaacccggcggtggggtctggataacatggtcggataagaatcttaaagatgttaaaggagattacaataaaggattgaatgaaatactgcagctgcatcctgtagtttattcttataaaaaagataccccatttaacttaccttctgataaagaatacactggtttaatagctcaggaagtgcagatagtttttccggaggcggtaacaaaaggaaaagacggatatctttcgttagatatgcaggcagtgaatattgcggttttcaatgccataaaaatactgaatagccagaatactgatttgctaaaaagcaatgaaaaactagaaaaaagggttattcaagtggaaaaagaaaacatggatattaaaaagagtataataaatctggagcatttattggaacaaatgaattacagcaagaaaaaataa

SEQ ID NO: 13624 - protein, 223 aa, Unknown
  Obtained from environmental sample
  misc_feature (1)..(223): Xaa is any amino acid
MDTESDIGLLNLKDTEGSPALYITGANSSEGEIAIPAGQAFNIGHWDGTFESRIEIDGQGNVGIGTTDPTSLLTVNGDAAKPGGGVWITWSDKNLKDVKGDYNKGLNEILQLHPVVYSYKKDTPFNLPSDKEYTGLIAQEVQIVFPEAVTKGKDGYLSLDMQAVNIAVFNAIKILNSQNTDLLKSNEKLEKRVIQVEKENMDIKKSIINLEHLLEQMNYSKKK

SEQ ID NO: 13625 - DNA, 336 bp, Unknown
  Obtained from environmental sample
  misc_feature (1)..(336): n is a, c, g, or t
atggaacaggcaatcggtttgggtcatgttaaaaaccttccccgggttttagggaaaatttacgtggcttttgaaaccctgcttccgaaaaaaaaaattgtttattttgttattttcccgaaccccagtttgttgggggggattgccctggccgataaaaaaaggatttatgcgaattcgggtacttggattgacaataatctaccgaaaccaaccatgaattttgtggtcattaccccacaaaatgcggatgcttcttctctaacttttgtaaagctttataattacgaaaacgaagttgtaacagatatggctcaagactcattacgctattaa

SEQ ID NO: 13626 - protein, 111 aa, Unknown
  Obtained from environmental sample
  misc_feature (1)..(111): Xaa is any amino acid
MEQAIGLGHVKNLPRVLGKIYVAFETLLPKKKIVYFVIFPNPSLLGGIALADKKRIYANSGTWIDNNLPKPTMNFVVITPQNADASSLTFVKLYNYENEVVTDMAQDSLRY

SEQ ID NO: 13627 - DNA, 879 bp, Unknown
  Obtained from environmental sample
  misc_feature (1)..(879): n is a, c, g, or t
atgatgggtacaatctttcctgatttcggtactggccggggcaggaataaacaaatcagtgatctagctcactatgtgggtagctctctgcttcctaaactgatatatgaaaatgctgaaaccgaggcgtggaaagcatttgctttgggttggttgctacatgttcacatggatattaacggtcacccttttataaacagattggcaggtgaacacaaaggtgggcaagaagagctaacttatgaagatgatatagccttgcatgccaagcttgaattcgggcttgatctttgcttacagagtaagtttggggagatagatgtcactagaatcagattccctgattttattgaaaatcctctttcaactgcatatatcttatattatggtattgagataacaaaagctgagattgaaggttttaaacaaattcctaaacagatgaattggctatctaacttgcagaaatatttctccaaacataaaaaacaaagagaattcataaccaaaattgcaaacataatttcccccggaaatgctgaaatgcttgatgcaattatacatcccataaagcaagctgatgatgttatagaacattatctaggcgttatcgaacaggcaaagaatgtcttgttggataagggaaaaccaaattggctgaagcataattataaccttgatacaggaagtatatcgtcaattggagattacaaactcgcagataaaatgtttaaatctgtagacagattgatgattccaaaacaaattatagaacgttaccctgacaaggcagaaaaaattctggctaattgggaaagtgttaggaaagagtataatggaaatgtcattcagaagaatcttacaaaggtaatctcatga

SEQ ID NO: 13628 - protein, 292 aa, Unknown
  Obtained from environmental sample
  misc_feature (1)..(292): Xaa is any amino acid
MMGTIFPDFGTGRGRNKQISDLAHYVGSSLLPKLIYENAETEAWKAFALGWLLHVHMDINGHPFINRLAGEHKGGQEELTYEDDIALHAKLEFGLDLCLQSKFGEIDVTRIRFPDFIENPLSTAYILYYGIEITKAEIEGFKQIPKQMNWLSNLQKYFSKHKKQREFITKIANIISPGNAEMLDAIIHPIKQADDVIEHYLGVIEQAKNVLLDKGKPNWLKHNYNLDTGSISSIGDYKLADKMFKSVDRLMIPKQIIERYPDKAEKILANWESVRKEYNGNVIQKNLTKVIS

SEQ ID NO: 13629 - DNA, 813 bp, Unknown
  Obtained from environmental sample
  misc_feature (1)..(813): n is a, c, g, or t
atggaagataaaaatacagtaattaatgctcttgatttatttgcaggtgcaggtggtttttcaataggaatggtaaatgcaggtataaatattgtagccgctgttgaattcaataaaaaaatctctcctacttataaatacaatcataaaaaaacaactttacttgaggaagacatacaaaatgtagcagcttcaataaaagatccattatataaaaaatctaaatattgtattgatcaaatatttaaaaataaagagtgtgatataatatttggtggtcctccatgtcaaggttttagtatgtctggtaatagaatccgagaaaaaaaatcatttttagatgatgaaagaaactttttatttaaagaatttattagaatggtagaatacttaaatcctaaagtttttattatagaaaatgtaccaggaattttaaattataatgatggtgtaattaaggaagagatatttaatacatttaataaattaggatacgatataaaagctaaagtattatgttcagctgattatggtgtccctcaactaagaaatagagcattttttataggtaacagaattggcattgactcaaacttattatttcctgaagccaactatacaaatgagaattatgtaaccgtaaaagatgccattagtgatttgccttctcttgacgcaggaacaggtttggaaattactgaatatcctacaagtacttatctttcagattatcaaaaaaagttacgaaaaaacagtagccatatatttaatcatattagtacaaaacataagattgaaacaataaaatattaa

SEQ ID NO: 13630 - protein, 270 aa, Unknown
  Obtained from environmental sample
  DOMAIN (8)...(270): C-5 cytosine-specific DNA methylase
  misc_feature (1)..(270): Xaa is any amino acid
MEDKNTVINALDLFAGAGGFSIGMVNAGINIVAAVEFNKKISPTYKYNHKKTTLLEEDIQNVAASIKDPLYKKSKYCIDQIFKNKECDIIFGGPPCQGFSMSGNRIREKKSFLDDERNFLFKEFIRMVEYLNPKVFIIENVPGILNYNDGVIKEEIFNTFNKLGYDIKAKVLCSADYGVPQLRNRAFFIGNRIGIDSNLLFPEANYTNENYVTVKDAISDLPSLDAGTGLEITEYPTSTYLSDYQKKLRKNSSHIFNHISTKHKIETIKY

SEQ ID NO: 13631 - DNA, 636 bp, Unknown
  Obtained from environmental sample
  misc_feature (1)..(636): n is a, c, g, or t
ttggagataatatatcttaagagtataaactctacccatacatatttaaaagaatttatccaaacaaatggatataacaagccattagctgtagcaacaaacaatcaaacagatggaatagggagtcgagacaataaatgggttggcttaaaaggaaatctttttttctcatttgttatccataaaggtttattacctgaagatttacctattcaatcgtattcaatatattttagttttttattaaaagaggttttagaaaaacttggttctaatgtttggttaaagtggccaaatgatttttatattaatgaaaataaaattggtggcacaataacaaatattaagggtgatttggtattttgtggtataggattaaatttagttgctatagagaatacttacagttctttagatattaatgtagatatagaggggttattaaaagagtattttttttatctattgagaaaaaaaacttggaagcaaatttttagtaagttttcgatagaatttgaaaaaagtaaagtttataaaaccacaatagataataaaaaagtctcacttaagacagctcaactgaatggtgatggctctatatttatagacaataaaaagatatttagttttagataa

SEQ ID NO: 13632 - protein, 211 aa, Unknown
  Obtained from environmental sample
  DOMAIN (5)...(134): Biotin/lipoate A/B protein ligase family
  misc_feature (1)..(211): Xaa is any amino acid
MEIIYLKSINSTHTYLKEFIQTNGYNKPLAVATNNQTDGIGSRDNKWVGLKGNLFFSFVIHKGLLPEDLPIQSYSIYFSFLLKEVLEKLGSNVWLKWPNDFYINENKIGGTITNIKGDLVFCGIGLNLVAIENTYSSLDINVDIEGLLKEYFFYLLRKKTWKQIFSKFSIEFEKSKVYKTTIDNKKVSLKTAQLNGDGSIFIDNKKIFSFR

SEQ ID NO: 13633 - DNA, 489 bp, Unknown
  Obtained from environmental sample
  misc_feature (1)..(489): n is a, c, g, or t
atgtatgaggatagatatggaaaacagaactttttaaatgctgatggtgatctatccattactatacagagaaagtatgattatgtttttggtggaaacttcagagtcagattagataaagatgaaaaaaaactttttgatgccaaactagagtttggaacagatgctattgatcataatgattgtcctaccgtatttaaaagagacattatcttaaaagtatttaaatatctaatgatttttggattcataggtatttttgtcagcttctttgtagatgaaaatagtataaaacttctaagcatgacagaaaattatattatgttaacaatgctggcacttttggttatatatttcttttacgcacagtatgaagctaaagagtacaagcagtgtacatcttgtcaaattggaaatattattggaacaacactaatgaattttgtaaaattgataattctatttttatctaatttctttattttataa

SEQ ID NO: 13634 - protein, 162 aa, Unknown
  Obtained from environmental sample
  misc_feature (1)..(162): Xaa is any amino acid
MYEDRYGKQNFLNADGDLSITIQRKYDYVFGGNFRVRLDKDEKKLFDAKLEFGTDAIDHNDCPTVFKRDIILKVFKYLMIFGFIGIFVSFFVDENSIKLLSMTENYIMLTMLALLVIYFFYAQYEAKEYKQCTSCQIGNIIGTTLMNFVKLIILFLSNFFIL

SEQ ID NO: 13635 - DNA, 486 bp, Unknown
  Obtained from environmental sample
  misc_feature (1)..(486): n is a, c, g, or t
ttgtatgaaaataattatgggaaaattttcaactatattaaagcaccgtattcacttttaatttttggaagtggagtccatgtaactcctgtaattgaaattgctaatattatgggatgggagactactgttgtagatataaagattcacaaagagtttattaaagaagctgataattttatagagcttaaaaacttagatgatattttaaccttcgatttaaacttttataatgcttctgtgatacttagtcatagctccaaaacagatgatatatacctaaaaacactcctaaattcaaaagtggaatatataggtcttatgggaaataaaaaaaatatgcaaagaaaaaaagaacaatttttattagaaaacaataaaagattttttgctcctattggattagatattagtaaccatacacaccaatctattgcactatcaatttgtgcacaaattgaggctagaaaaaatggaaaaatctaa

SEQ ID NO: 13636 - protein, 161 aa, Unknown
  Obtained from environmental sample
  misc_feature (1)..(161): Xaa is any amino acid
MYENNYGKIFNYIKAPYSLLIFGSGVHVTPVIEIANIMGWETTVVDIKIHKEFIKEADNFIELKNLDDILTFDLNFYNASVILSHSSKTDDIYLKTLLNSKVEYIGLMGNKKNMQRKKEQFLLENNKRFFAPIGLDISNHTHQSIALSICAQIEARKNGKI

SEQ ID NO: 13637 - DNA, 378 bp, Unknown
  Obtained from environmental sample
  misc_feature (1)..(378): n is a, c, g, or t
ttgatagaaaaacttacatattttgaatatactacacttattggattgtatctcagtaataatttggaatttttagttttagaagctggtcttggtggagagtttgatgcaacaaatgttgttgtaaatgatttaacggttataacaacaattgatcttgatcatcaatcgtttttaggtgatacaatagaaaaaatagctagtacaaaactgagaagttgtgataatgcttttataatatcttctcagataaataatgaagtatatgaggtaaaaaatctacttttaaaagataaaaaagagattgagctgaaaaatatccactctctgtggaatctaataatttaccacaatatttacaaaataatttgcaagtag

SEQ ID NO: 13638 - protein, 125 aa, Unknown
  Obtained from environmental sample
  misc_feature (1)..(125): Xaa is any amino acid
MIEKLTYFEYTTLIGLYLSNNLEFLVLEAGLGGEFDATNVVVNDLTVITTIDLDHQSFLGDTIEKIASTKLRSCDNAFIISSQINNEVYEVKNLLLKDKKEIELKNIHSLWNLIIYHNIYKIICK

SEQ ID NO: 13639 - DNA, 387 bp, Unknown
  Obtained from environmental sample
  misc_feature (1)..(387): n is a, c, g, or t
ttgagcgataaaacttctaataatatgaaaaagagctttttactaatttgtgttatatttatttcggttttcgtcagtgcccaaagcgattggggtgaagtaaaatgggataacgggctgaaactcgaaaatgaagaaaaagactacaaaattaaatttggcggaagactgatgctcgacgggctgattgtaagccctgaaaacaatggtgttattgatacaattgttaatggaggttcaggtgtcgaattccgacgtatcaggttatacagtgcaggccagatttacgggaacatcaagtataaacttcagtttgattttgccggaggtacggcagcactaaaagatgcgtacataacactaaccaaaatcccctggtgtaggtaa

SEQ ID NO: 13640 - protein, 128 aa, Unknown
  Obtained from environmental sample
  misc_feature (1)..(128): Xaa is any amino acid
MSDKTSNNMKKSFLLICVIFISVFVSAQSDWGEVKWDNGLKLENEEKDYKIKFGGRLMLDGLIVSPENNGVIDTIVNGGSGVEFRRIRLYSAGQIYGNIKYKLQFDFAGGTAALKDAYITLTKIPWCR

SEQ ID NO: 13641 - DNA, 858 bp, Unknown
  Obtained from environmental sample
  misc_feature (1)..(858): n is a, c, g, or t
atgataaaaaaacttcaggatagaggtatagatacaataacagaactaaaccttagaaatgcagtggcaaaaaataaaaatatcatttgtaaaagtggtggtattcgacacaagttaaatgaactagatctctttttctcatataatgcaggggaacaaactcaataccaagtctatttatatcaagctctaaatcgaatgataccaatgattaattcttatgacgcatttgctttaacagaagataaatttcatacctcctttgtacttcgaaataacggtgttatgactgcagattataaactatgtcacagagatgatactgttgaattgaaaaaaattcttagaagatggggcaaaatgatatataaaccaactgatggttggggtggtgttggacttacaaagatagaaaatagggcaagtcttgatatgcttatgccatttttaaatcaaatggatttacgatatttttatgttgaaaaatttatagattatgataatacagactttagagtagatatagtagatgggcaatttgtaggttgttatggtagaaaagctagtggaacagattggagaaccaatattacaagtggtggaagtgtatttttaagagaaccaaatgatgagataattgatattgcaattaaagcatcaaatgcttgtggtactgatattgctggagtggatataatttatgatagaacaaaagaggaatatgtagttcttgaagtaaatggaatacctgcatttgcaacaccagaacaagaaaagttaggacttgattttaacgataaaaagatagatttaatagtagatttaatagacagaaaaacaaacaaaggggaaaaataa

SEQ ID NO: 13642 - protein, 285 aa, Unknown
  Obtained from environmental sample
  DOMAIN (82)...(277): D-ala D-ala ligase C-terminus
  misc_feature (1)..(285): Xaa is any amino acid
MIKKLQDRGIDTITELNLRNAVAKNKNIICKSGGIRHKLNELDLFFSYNAGEQTQYQVYLYQALNRMIPMINSYDAFALTEDKFHTSFVLRNNGVMTADYKLCHRDDTVELKKILRRWGKMIYKPTDGWGGVGLTKIENRASLDMLMPFLNQMDLRYFYVEKFIDYDNTDFRVDIVDGQFVGCYGRKASGTDWRTNITSGGSVFLREPNDEIIDIAIKASNACGTDIAGVDIIYDRTKEEYVVLEVNGIPAFATPEQEKLGLDFNDKKIDLIVDLIDRKTNKGEK

SEQ ID NO: 13643 - DNA, 492 bp, Unknown
  Obtained from environmental sample
  misc_feature (1)..(492): n is a, c, g, or t
atggaatatcttaacgacttagaacagatttgtaaaataaactcttacacaaaaaacaaatcaggtgtagacaaagttggtttagtgatgaaacagtggcttgaagctattggatttgagttaacaacatatgaaagagataccataggaaaccatcaacttttttcaactcctaaaacaagtggagaaaaaatacttcttttaggtcataatgatactgtatttcctgaaggtacttttgatagttatcatgaagatgagcaatgggtttatggagctggtgtttgtgatatgaaaggtgggaatatagttgcactggaagccttaaaaaatatttataaatgcaatggaaaaattgaaaatatcgactttttgcttgtaagtgatgaggaaacaggaagtgatgatagtaagtttatcactttagagttagcaagaaactatgattattgttttgtatttggagcagctggaaaaaatcttgattggtga

SEQ ID NO: 13644 - protein, 163 aa, Unknown
  Obtained from environmental sample
  DOMAIN (64)...(146): Peptidase family M20/M25/M40
  misc_feature (1)..(163): Xaa is any amino acid
MEYLNDLEQICKINSYTKNKSGVDKVGLVMKQWLEAIGFELTTYERDTIGNHQLFSTPKTSGEKILLLGHNDTVFPEGTFDSYHEDEQWVYGAGVCDMKGGNIVALEALKNIYKCNGKIENIDFLLVSDEETGSDDSKFITLELARNYDYCFVFGAAGKNLDW

SEQ ID NO: 13645 - DNA, 480 bp, Unknown
  Obtained from environmental sample
  misc_feature (1)..(480): n is a, c, g, or t
ttgagcgaaaacatcacaaaatcattaattttcctcttcgagaaatgggcgggggaaaaagttgttgaaattcaattattacccgaatcaggttcgtaccgaaagtatttcagaataaagggaagtacccgtaatgccattggtgcgttttatgacagccctcacgaaaaccatgcttttattgaactgagcaagcatttcaaaaaggaaggaatgaatgttccggaaatttatgctgtaggcgatgatggcttaagctacctgttggaagatattggtgatactattttatttgatgaaatatcaaaaataaggcaacaggaaggttttagcaaacgattgatcggaatttacaaatccgttattaacgaattgataaagttccagatgacagccggtgaaaatgtggattattcggtttgctatccatcagcagaatttgatggacaagcctatatgtgggatctgaattatttttag

SEQ ID NO: 13646 - protein, 159 aa, Unknown
  Obtained from environmental sample
  misc_feature (1)..(159): Xaa is any amino acid
MSENITKSLIFLFEKWAGEKVVEIQLLPESGSYRKYFRIKGSTRNAIGAFYDSPHENHAFIELSKHFKKEGMNVPEIYAVGDDGLSYLLEDIGDTILFDEISKIRQQEGFSKRLIGIYKSVINELIKFQMTAGENVDYSVCYPSAEFDGQAYMWDLNYF

SEQ ID NO: 13647 - DNA, 651 bp, Unknown
  Obtained from environmental sample
  misc_feature (1)..(651): n is a, c, g, or t
ttgaaaagggcatttgtcacttttgatggtaaaccattaggcgattcaatttcaacgaaagaggctaaagattatatttttggaatgtgtatcatgaatgactggtcggcaagagatattcaaaagtgggaatatgtacctttaggaccattcttagcaaagagttttgcttcttctgtttcaccttggatcgttactatggatgcacttgagccatttagtattgaaggtccgaaacaagaacctgaagtactcgattatctgaaatatgaaggaaatcatcattacgatatcaatttagaagtaggaattatacctgaaaagagcgaagagactgtagtttgtaaatcgaactataagcacatgtattggaatatggctcaacagctagcacatcattcagtgaatgggtgcaatatccgatgtggtgacatgatggcttcaggtacaatatcaggaccttcaccagaatcttttggttcaatgttagaaatatcatggaaaggaacaaaaccagttaaactaaaagatggttcggaacgcaaattcatacaagatacagatacagtagttatgcgaggtcattgtaaaaaagacggtgttcgcataggttttggagaagtttctacaaaagtgttgccagcaaattaa

SEQ ID NO: 13648 - protein, 216 aa, Unknown
  Obtained from environmental sample
  DOMAIN (1)...(159): Fumarylacetoacetate (FAA) hydrolase family
  misc_feature (1)..(216): Xaa is any amino acid
MKRAFVTFDGKPLGDSISTKEAKDYIFGMCIMNDWSARDIQKWEYVPLGPFLAKSFASSVSPWIVTMDALEPFSIEGPKQEPEVLDYLKYEGNHHYDINLEVGIIPEKSEETVVCKSNYKHMYWNMAQQLAHHSVNGCNIRCGDMMASGTISGPSPESFGSMLEISWKGTKPVKLKDGSERKFIQDTDTVVMRGHCKKDGVRIGFGEVSTKVLPAN

SEQ ID NO: 13649 - DNA, 882 bp, Unknown
  Obtained from environmental sample
  misc_feature (1)..(882): n is a, c, g, or t
ttgatccgtaatatgatagcagaaattgttaccgtatttgaagagagcctgaaaccaactgattatgaagccttaataatgttgggtggatatggtcgtggtgaaggtggtgtggtgatagaagatggtgtggaaaaaccccataataattttgattttatcttattaagtaagaatagaacagatgatgaaaatagtaaattgaagcaggatttgatggtgaaggttggtgaaaaatcacaaaagttgaatatcggaattgatatgagtgtgatttctgccagcaaattgcagcatgctgcttgtcgaataatctggtttgatatgaggtttgggcataaaacactattgggaaatactgaatttgtaccttcgcttactagattcagtgtagataaaatccctgcttgggatgctcgaaatctgttggtaaatcgcggaactttgatgataataaatgatctgcttctggaaaaagaagagcttaatgaagacttcaagaaacttatagtgaagcatattatcaaagcgataatcggttatggagatacacttctgtttttcttggatgattatagctggagctatgtagggaaacaaaaaaacatgcagaaacgaactgacgtggatgtagattttaaggctatctatgatgatgcaatgaatttccgtttccagcctgattatcctaaatatctaaaaaaagatctacgcgaatggagcgaagaattgcgcggtcatttccaaaaggtatttttaatttgtgaagcaaagcgcttgaataaaaagaatattacttgggctgagtatccattaaggcatttgaaaatgcctggggtgacgaaatttttcagccaaaaccatttgctaaaaaattattga

SEQ ID NO: 13650 - protein, 293 aa, Unknown
  Obtained from environmental sample
  misc_feature (1)..(293): Xaa is any amino acid
MIRNMIAEIVTVFEESLKPTDYEALIMLGGYGRGEGGVVIEDGVEKPHNNFDFILLSKNRTDDENSKLKQDLMVKVGEKSQKLNIGIDMSVISASKLQHAACRIIWFDMRFGHKTLLGNTEFVPSLTRFSVDKIPAWDARNLLVNRGTLMIINDLLLEKEELNEDFKKLIVKHIIKAIIGYGDTLLFFLDDYSWSYVGKQKNMQKRTDVDVDFKAIYDDAMNFRFQPDYPKYLKKDLREWSEELRGHFQKVFLICEAKRLNKKNITWAEYPLRHLKMPGVTKFFSQNHLLKNY

SEQ ID NO: 13651 - DNA, 471 bp, Unknown
  Obtained from environmental sample
  misc_feature (1)..(471): n is a, c, g, or t
atggcaatctcagtagtagttatatcaatctcatcaccaattcttataggtatttataaagaaaatattttaatagatacaatccaaaatgaaggaaaaacaagcgatatactcccttggatatttgatatgttattagaaaaatacaatattgaaaatatatattatgtaaatggtccagggagttatatggcaattaaaatatcatatatttttttaaaaacattatcaataacaaaaaacataccattaaaagctgcaagtggatttttatttaatgaaaatagtccaatcaaagcattggggaaaaaatatttttttaatggacaagatgataaaataactatagattttatagaagatttagaagagttaaaagattttaaactcccaaatgatatatctaacatatcatttagtgaagatactttgcctaatatcatctaccagcagtataaatataaagtttag

SEQ ID NO: 13652 - protein, 156 aa, Unknown
  Obtained from environmental sample
  DOMAIN (23)...(98): Glycoprotease family
  misc_feature (1)..(156): Xaa is any amino acid
MAISVVVISISSPILIGIYKENILIDTIQNEGKTSDILPWIFDMLLEKYNIENIYYVNGPGSYMAIKISYIFLKTLSITKNIPLKAASGFLFNENSPIKALGKKYFFNGQDDKITIDFIEDLEELKDFKLPNDISNISFSEDTLPNIIYQQYKYKV

SEQ ID NO: 13653 - DNA, 342 bp, Unknown
  Obtained from environmental sample
  misc_feature (1)..(342): n is a, c, g, or t
atgaaagaaaacacagaacttttttttagcaacaccctgttacagcaaaaactcgataggtgcgaaaaggataaagaggatcataaaatcgcagggcaactgaccgagaatctgtttgagacagctaatgcaatgataatcactctggatgttgaggcaacaatcacatcctttaatcgttacgcccaacagttaaccggatataagaaaaaagaagttattggtagaaactggtttgatatttttaccctacgaggagatatagaaaataaatctgatgattttcgcccaaaacacatggcatgcctgaagcttctcagggtgagcgttcaattgtattga

SEQ ID NO: 13654 - protein, 113 aa, Unknown
  Obtained from environmental sample
  DOMAIN (33)...(100): PAS domain
  misc_feature (1)..(113): Xaa is any amino acid
MKENTELFFSNTLLQQKLDRCEKDKEDHKIAGQLTENLFETANAMIITLDVEATITSFNRYAQQLTGYKKKEVIGRNWFDIFTLRGDIENKSDDFRPKHMACLKLLRVSVQLY

SEQ ID NO: 13655 - DNA, 696 bp, Unknown
  Obtained from environmental sample
  misc_feature (1)..(696): n is a, c, g, or t
gtgcagttcgtaggctttatctcatatttagaaaacagatatagatttgatttgagcgaacttaaatctgaaggtttatctttttacggtgatactacaagttcagatagagagctatttgttcatataccgacagataataataaaaacaagattatatttgttacatcagcacttttactgcttcttcttctaattatttttacactctataaaggaaatttatttcagcagagtagtaaagaagaagttttaaataatagtgttataaatcaagcactagaaaagatagatgaaaaagaggctgaagtactatctcctattgttgatgtaaataaaacagaagaagttgtagaagaaaaaccagcgccaatacaggagaagcttcctgaaaagaaagtaagtaaaaagagtagtagtataaaattaattcctagaagtgatgtatggttgggcgtgattgatgctaaaacgtttaaaaaaataaacaactctgttgtgtcaaagccttatgagttagatactgccaaagatcttcttattgtcttaggtcatggacacatagctttggaagattcaaatgttactactgagtataaagagggtaatagaatgagattctatttgaaagattctaaaattgagaagatcgatcttgagagatttaaagagttgaatcaggggaaagtttggtaa

SEQ ID NO: 13656 - protein, 231 aa, Unknown
  Obtained from environmental sample
  misc_feature (1)..(231): Xaa is any amino acid
MQFVGFISYLENRYRFDLSELKSEGLSFYGDTTSSDRELFVHIPTDNNKNKIIFVTSALLLLLLLIIFTLYKGNLFQQSSKEEVLNNSVINQALEKIDEKEAEVLSPIVDVNKTEEVVEEKPAPIQEKLPEKKVSKKSSSIKLIPRSDVWLGVIDAKTFKKINNSVVSKPYELDTAKDLLIVLGHGHIALEDSNVTTEYKEGNRMRFYLKDSKIEKIDLERFKELNQGKVW

SEQ ID NO: 13657 - DNA, 375 bp, Unknown
  Obtained from environmental sample
  misc_feature (1)..(375): n is a, c, g, or t
atgagcgcaagtctagaatttttaaaagctaaagatctttatgaactttatgaggagactcatataacgcaacagaatttaaaatatttactagatcactcttttgaaaatataaaaaaagtgcagttcgtaggctttatctcaatattagaaaacagatataagattgatttgagcgaacttaaatctgaaggtttatctttttacggtgatactacaagttcagatagagagctatttgttcatataccgacagataataataaaaacaagattatatttgttacatcagcacttttactgcttcttcttctaattatttttacactctataaaggaaatttatttcagcagagtagtaaagaagaagtttaa

SEQ ID NO: 13658 - protein, 124 aa, Unknown
  Obtained from environmental sample
  misc_feature (1)..(124): Xaa is any amino acid
MSASLEFLKAKDLYELYEETHITQQNLKYLLDHSFENIKKVQFVGFISILENRYKIDLSELKSEGLSFYGDTTSSDRELFVHIPTDNNKNKIIFVTSALLLLLLLIIFTLYKGNLFQQSSKEEV

SEQ ID NO: 13659 - DNA, 867 bp, Unknown
  Obtained from environmental sample
  misc_feature (1)..(867): n is a, c, g, or t
ttgtacgcaatttatacagaattattttttctacaaaaaaattggaaacttgctgaagaaaatatagcaaaacatcttactatagcggaaaatcttgattcttatcaagaaaaaaaaattgctttttataactatgcgaagctctacaagtttattgaagattacaaaaatgccacattgtggtatgataaacattttgaattatacacgaaaaatatcaataatgaaagaattaaaatggtaacagaagctgcccaaaaatttgagagtgaaagaaatgagaaggaagcagaaatatataaactaaaacatattcaactaaaaaatctaaatattgaactagtagaaaacaaagaactgttacaagataaaaatcaacagcttaataattcaaacattaaattgagtgagcttgctaaggagttaaaaaatacaataataacaaatgacaaaatgtattctgttatagctcatgatttaagaaatccaatcagtgcaatagtttcatgtactgatctgattgatctctttgttgccaataatgagatagatgaaattcaacgatttgttgaacttataagaacttcatcaaaacaagttgttgaaattttggaaaatatgttggaatggtccaaagcgaactgtgacatgatagttactcaaccaacttttatttccatcaatgatataattaaacaatgtattaatttggttgaactcattactattcaaaaggatattaagatcaattttgatgatgaaaaccagtatcacatttttgcggataatgaaatgttaaaagtcattattagaatattgtcagcaatgcaattaagttttcacataaaaatagtgagattgatataa

SEQ ID NO: 13660 - protein, 288 aa, Unknown
  Obtained from environmental sample
  DOMAIN (148)...(216): His Kinase A (phosphoacceptor) domain
  misc_feature (1)..(288): Xaa is any amino acid
MYAIYTELFFLQKNWKLAEENIAKHLTIAENLDSYQEKKIAFYNYAKLYKFIEDYKNATLWYDKHFELYTKNINNERIKMVTEAAQKFESERNEKEAEIYKLKHIQLKNLNIELVENKELLQDKNQQLNNSNIKLSELAKELKNTIITNDKMYSVIAHDLRNPISAIVSCTDLIDLFVANNEIDEIQRFVELIRTSSKQVVEILENMLEWSKANCDMIVTQPTFISINDIIKQCINLVELITIQKDIKINFDDENQYHIFADNEMLKVIIRILSAMQLSFHIKIVRLI

SEQ ID NO: 13661 - DNA, 723 bp, Unknown
  Obtained from environmental sample
  misc_feature (1)..(723): n is a, c, g, or t
gtggtactattaggatatataggatatgttcatggtacaaaagagatggtgaaaaaagaccatataaaagaaaactatattaaaaaagatgatgtatcatttgatactttacctttgtatacacaagataaatatgtattaaagtctctttatgactataaagtaaatgaattagaaacaaaaaaccttacaattttgaaaaaattagaagaggctatagttaaaaaagaaccacaagttgtagaaaaaattatagcagcagaaaaagcaacacatacaagaatggatacaagtattgagttgataccaaaggaacaaaatataggttcacaaaccgtatctaaatctacagttagtgatagtactaaaacgaaaacatatacttgtaaaacattaaatagtagtagtgaatatataaccaaatattgtaaaaagcaactaatcaaatttttagatgaaaataaagatgccaaaagatttgaagtgataggtttgattgataaacaagaatttaaattagtagaaaaattagaagatgtttatgggaaacaaagagttggaaatctttctaaatatgcacaacacggactttcaaaacaaagagtgatagaagctagttgggtaatacgacaacacttaggcaaacaagtacaagtagatagtgtaaattatacaataaccaaaaagaataaaagaggatttgtcgtaaaagcttatagataa

SEQ ID NO: 13662 - protein, 240 aa, Unknown
  Obtained from environmental sample
  misc_feature (1)..(240): Xaa is any amino acid
MVLLGYIGYVHGTKEMVKKDHIKENYIKKDDVSFDTLPLYTQDKYVLKSLYDYKVNELETKNLTILKKLEEAIVKKEPQVVEKIIAAEKATHTRMDTSIELIPKEQNIGSQTVSKSTVSDSTKTKTYTCKTLNSSSEYITKYCKKQLIKFLDENKDAKRFEVIGLIDKQEFKLVEKLEDVYGKQRVGNLSKYAQHGLSKQRVIEASWVIRQHLGKQVQVDSVNYTITKKNKRGFVVKAYR

SEQ ID NO: 13663 - DNA, 852 bp, Unknown
  Obtained from environmental sample
  misc_feature (1)..(852): n is a, c, g, or t
atgattatgttgggtggttttactggctacactactaataacatagcaattaagatgctgttcaagaaattccctattttgggtggtggtgtaatagctgatagatatggagcgtttatcaaggatatgtctgatttggtcgaaagagacctaataaatcacgagactttaaccgaggaatttaattctgaaagttttagagaagtgttaaagaaagttattcaagacactattaaaatagaacttcctaagagttcaggtgaagtttctttaggtacacttcctaatattgataatagcatggataatctaaatgaatatattcaaagcaacctaagttctttactagaatctctttttactgtcgttaaagataaaagtatagcagagattatttcaaaagagcaatatgattatattatagataacagtacaaaagatatttttgataaactagataaatatgaatctaatttaagtaaaatggcttatgtttttcttggtggtaaaagtatttcttctttaataacagagcgttctatacataaaataactgcgaatataataggaataataaataaaactgatttatcaaactatgatggcttaataaataaatcatatagagagtttcttaaaatcattgatttagatgagttagttaaaaatcttgaaggtaatctagaaaaaatgaaagttgcagattttgttaataattcagataatctttcanaagagttaatcaaaaaagttgttgctattgttaattctaaagatggttctaggatattgacaagtttaatagaaaatatcttagttgagctagaaaagatatcaatgagtctaaactaa

SEQ ID NO: 13664 - protein, 283 aa, Unknown
  Obtained from environmental sample
  misc_feature (1)..(283): Xaa is any amino acid
MIMLGGFTGYTTNNIAIKMLFKKFPILGGGVIADRYGAFIKDMSDLVERDLINHETLTEEFNSESFREVLKKVIQDTIKIELPKSSGEVSLGTLPNIDNSMDNLNEYIQSNLSSLLESLFTVVKDKSIAEIISKEQYDYIIDNSTKDIFDKLDKYESNLSKMAYVFLGGKSISSLITERSIHKITANIIGIINKTDLSNYDGLINKSYREFLKIIDLDELVKNLEGNLEKMKVADFVNNSDNLSXELIKKVVAIVNSKDGSRILTSLIENILVELEKISMSLN

SEQ ID NO: 13665 - DNA, 516 bp, Unknown
  Obtained from environmental sample
  misc_feature (1)..(516): n is a, c, g, or t
atgacctctattaaattatcaaaagaggatattgtaaacttagttcgaattttaaaggcattatttcctgaatatataagaattgaagtacggaatactagtactccttatatattatttagcaaagtaaagaaatatagtatttacaatgttataggtaaaaaactactaatgactaaaatttctttagtagaattatttataagggaagtaccaaaaagactgtcaatctaccaatttggtaatgacacaaatacgcctatttattgggctacagctgcgatattgattgcggatcaacctacacatctagtaaattactttaaagagtgtttagatggaatggtaaaatctactatgtatggagaaccatacgcagtaactaaaaataaaatagaaagactcactaccaatataggtaatggagagtacttattattaaaaggaatattaaaaacagcaaatcccgaaatattacctaatagtaatttattggaaaatcttattaccgaataa

SEQ ID NO: 13666 - protein, 171 aa, Unknown
  Obtained from environmental sample
  misc_feature (1)..(171): Xaa is any amino acid
MTSIKLSKEDIVNLVRILKALFPEYIRIEVRNTSTPYILFSKVKKYSIYNVIGKKLLMTKISLVELFIREVPKRLSIYQFGNDTNTPIYWATAAILIADQPTHLVNYFKECLDGMVKSTMYGEPYAVTKNKIERLTTNIGNGEYLLLKGILKTANPEILPNSNLLENLITE

SEQ ID NO: 13667 - DNA, 480 bp, Unknown
  Obtained from environmental sample
  misc_feature (1)..(480): n is a, c, g, or t
atgaaaatattgttactagaagatgatgtaatactcaatgaacttatagaagagtttctagttagtttagggtatgaagtggattctttttatgatgggcaagaggctttagatactttatacgatgaaagttttgatttgttgcttcttgatgtgggcgttccctctttagatggttttagtgtattaaaaagtattaaagaggctaaaattgatattcctgcaatatttataacttcattgaacacaacggatgatttacaaaaaggttttgatgtgggttgtgatgattatataaaaaaaccttttgaactcaaagagttagagataagaataaatcatattaaaaagataaaacatatcgagtcttctgatactgtaaagatttatgaaaatatccaatatgacttttcaaatcataaaatccaaaaagagaatgaaaccatagagttatctaataaagaagcaaaaaatatttga

SEQ ID NO: 13668 - protein, 159 aa, Unknown
  Obtained from environmental sample
  DOMAIN (1)...(120): Response regulator receiver domain
  misc_feature (1)..(159): Xaa is any amino acid
MKILLLEDDVILNELIEEFLVSLGYEVDSFYDGQEALDTLYDESFDLLLLDVGVPSLDGFSVLKSIKEAKIDIPAIFITSLNTTDDLQKGFDVGCDDYIKKPFELKELEIRINHIKKIKHIESSDTVKIYENIQYDFSNHKIQKENETIELSNKEAKNI

SEQ ID NO: 13669 - DNA, 573 bp, Unknown
  Obtained from environmental sample
  misc_feature (1)..(573): n is a, c, g, or t
atgaaaaaaactttttggagaaatttaaaaaaaagtgctaattgctataaaattaaatatttattttcacatgatcattttaagattgatttaattgactatcctaaagggttgccagtgcttttatctggacaggttcagaggtctgggggaacagtttttgcacgtttttttgatgggcatccacaagttatggcacatcctggtgaaataatttttttaaaaaaaacatataaaacctataatgataaagagctttttttggggatagacaggctcatacaaaacagtaaaaatggatataccaaagggaaaaatgttggagatataaggttaccttttgctttttgtggggaaaagtttttcaaggatttcattagccagaagtttcaatctaaaaaaaatatgattgatttctattttgataacttttttaagtactggttggattgtaatgattttaacattactgcagataagaagaagttgataacaggatttgctccgaatgcgctaaaaggatctttagtgtcttttatggaagagaacccaaggataaattttttcacataa

SEQ ID NO: 13670 - protein, 190 aa, Unknown
  Obtained from environmental sample
  misc_feature (1)..(190): Xaa is any amino acid
MKKTFWRNLKKSANCYKIKYLFSHDHFKIDLIDYPKGLPVLLSGQVQRSGGTVFARFFDGHPQVMAHPGEIIFLKKTYKTYNDKELFLGIDRLIQNSKNGYTKGKNVGDIRLPFAFCGEKFFKDFISQKFQSKKNMIDFYFDNFFKYWLDCNDFNITADKKKLITGFAPNALKGSLVSFMEENPRINFFT

SEQ ID NO: 13671 - DNA, 693 bp, Unknown
  Obtained from environmental sample
  misc_feature (1)..(693): n is a, c, g, or t
atgagtggaaaacaaatttatgataaactttccttgatgcgaaaaattatttttttcttcgtatatttaggactgtttctgggaacagtatttttgggagaaattgttttagtaaaagccgcaccacgattagcacaattgggacgagcatataagtttgatggaacggatgattatgtggacttcgggttagtagatatgtcagatgtaaaaaaaatcgaatttgatatacttttttactcgcttggtacaaaaccaattatggctcaacgagaagattcaggaacaaatcatagttttgatatttttatggtgagtgacaaattaagagtacaagtagtaaatgaaaattcagttttgtctgattttactatgtcagaatcgttagttgttgatactttttatcacgtagaaattataaaaaatgaaagtaacacatttgatgtatatctgaatggagttttaaaggaacaacggaggtggcagttctttcaatgtctcctacggagtcgcctaccgtttggtttgctaaaaaaaaatccgggaaattttgaagggtcctccggggaaattataaacttttttaaaaaaaaacaacaaactccctttatttctgggaccttttatataaagggccggggattaaaaaagttttttatcccctgtaaaaaacggtggtattgggggagaaaa

SEQ ID NO: 13672 - protein, 231 aa, Unknown
  Obtained from environmental sample
  misc_feature (1)..(231): Xaa is any amino acid
MSGKQIYDKLSLMRKIIFFFVYLGLFLGTVFLGEIVLVKAAPRLAQLGRAYKFDGTDDYVDFGLVDMSDVKKIEFDILFYSLGTKPIMAQREDSGTNHSFDIFMVSDKLRVQVVNENSVLSDFTMSESLVVDTFYHVEIIKNESNTFDVYLNGVLKEQRRWQFFQCLLRSRLPFGLLKKNPGNFEGSSGEIINFFKKKQQTPFISGTFYIKGRGLKKFFIPCKKRWYWGRK

SEQ ID NO: 13673 - DNA, 897 bp, Unknown
  Obtained from environmental sample
  misc_feature (1)..(897): n is a, c, g, or t
atgaaaattgtcactgaaaaggtaaactcaaatgattcagagttatataaaaatgctgatgagattgaaaaatttctagctccatctgatagacctaaagaagctacaaaaattgttccagaactgatcagtaaatttatatcccaagcaaaattcagctttgatgatcaaaacggtggattctcacaatcgccaatatttccacaaagtgctgcattaaatacacttttggatatctactctttaaactcggatgagagtgctaaagagatggtaattaaaacacttgacaatctatctcttggtggcatgtatgatctaattgacggtggtttttgtcgttatagtgttgatgagagatggctagttccacattttgaaaagatgtgttacgataatgcacttttaatagatatttatacaaaatcatataaaactttcggtgatgaatattacaaaaaattagctcttgactctacagagtttatgattaactttatgagtaaagagtatcttttctactcagcaagcgatgcagatacaaatggtactgagggcgaatattttgtatatagttatgatgagttattatcttgcatagatgataaagagttattatctcatattgaaatttctacaaaaggtaattttgagggtaaaaatattattagattaaaacagagagttatacctganaactttaaaatgttaaaagtcaagttagctgatatacgcaaaagcaggacttatccatttgtagataaaaagataattacagcgtggaatgccatgatgataaaaactctttttaatatatncagtttcgatgagaaatatctaaattttgcaaaaaaatcgctagagaacctttttagataccatgtatataaaccataa

SEQ ID NO: 13674 - protein, 298 aa, Unknown
  Obtained from environmental sample
  misc_feature (1)..(298): Xaa is any amino acid
MKIVTEKVNSNDSELYKNADEIEKFLAPSDRPKEATKIVPELISKFISQAKFSFDDQNGGFSQSPIFPQSAALNTLLDIYSLNSDESAKEMVIKTLDNLSLGGMYDLIDGGFCRYSVDERWLVPHFEKMCYDNALLIDIYTKSYKTFGDEYYKKLALDSTEFMINFMSKEYLFYSASDADTNGTEGEYFVYSYDELLSCIDDKELLSHIEISTKGNFEGKNIIRLKQRVIPXNFKMLKVKLADIRKSRTYPFVDKKIITAWNAMMIKTLFNIXSFDEKYLNFAKKSLENLFRYHVYKP

SEQ ID NO: 13675 - DNA, 423 bp, Unknown
  Obtained from environmental sample
  misc_feature (1)..(423): n is a, c, g, or t
ttgagaaatatattacttgtcgatgatgatccaataataatagctattctccaaaaaaagcttattgaacagattaaaaatataaatattctaattgctagaaattataaagaagcactaaagcatattttaaataatgatctgagaattgatattgcaatattagatttaaatctaccagatgtaagagatggggaacttgttgattattcaatcaaaaagaaaataccaactattgttttaagtggtacaaaaatcagtaatatgagaaaagatattttagaaaaagatattttagaatatattgctaaggatggtgtaaatagtatcaactacactattaattctataaagagagttctccttaattatgatactaatgttcttatcgtagatgattcttcagtacaactttcaatctaa

SEQ ID NO: 13676 - protein, 140 aa, Unknown
  Obtained from environmental sample
  DOMAIN (2)...(125): Response regulator receiver domain
  misc_feature (1)..(140): Xaa is any amino acid
MRNILLVDDDPIIIAILQKKLIEQIKNINILIARNYKEALKHILNNDLRIDIAILDLNLPDVRDGELVDYSIKKKIPTIVLSGTKISNMRKDILEKDILEYIAKDGVNSINYTINSIKRVLLNYDTNVLIVDDSSVQLSI

SEQ ID NO: 13677 - DNA, 888 bp, Unknown
  Obtained from environmental sample
  misc_feature (1)..(888): n is a, c, g, or t
ttggggtatttaaaaggagatattaaagaaaatattcttatatctagtcataagtatccaaatcataagtttatcaaaattgatttatcagataaaaagtttattgataaattatttaaggctgagaagtttgattctgtatgcaacttagcagctcaagcaggagttcgttatagtcttgaaaatccaaatgcgtatattcaaaataatgtggtggggtttatgaatatattagaggcttgtcgttattttggtgtaaaaaacttatcttatgcttcatcatcttcagtatatggattaaataaatcacaaccttttaaaacaacagatattacagatacaccagcaagtttatatgctgccacaaaaaaatcaaatgaattaatggctcatacctattctcatctttataatattgcaactacaggattacgattttttacagtttatggtccatggggaagacccgatatggcacctatgctttttagtgatgcaattttaaataatagggctataaaagtatttaatcaaggagagatgagtcgtgattttacatatatagatgatataataagtggaatagtgaaagtaatagataatccaccattgaagctatgtacaccttttaagatttataatattggaaataattcacctgtaaaattgctagattttataaaaactcttgaaaaatatttaggtaaagatactcaaaaagaatttttacctatgcaagatggagatgttgtttcaacatacgcggatgtaacagaacttattgatgattttaattataaacctagtacatctttaagtgttggaattaaaaaatttgtgaaatggtataaagacttctatggtcagaaaggaaatagtatacaatga

SEQ ID NO: 13678 - protein, 295 aa, Unknown
  Obtained from environmental sample
  DOMAIN (1)...(287): 3-beta hydroxysteroid dehydrogenase/isomerase family
  misc_feature (1)..(295): Xaa is any amino acid
MGYLKGDIKENILISSHKYPNHKFIKIDLSDKKFIDKLFKAEKFDSVCNLAAQAGVRYSLENPNAYIQNNVVGFMNILEACRYFGVKNLSYASSSSVYGLNKSQPFKTTDITDTPASLYAATKKSNELMAHTYSHLYNIATTGLRFFTVYGPWGRPDMAPMLFSDAILNNRAIKVFNQGEMSRDFTYIDDIISGIVKVIDNPPLKLCTPFKIYNIGNNSPVKLLDFIKTLEKYLGKDTQKEFLPMQDGDVVSTYADVTELIDDFNYKPSTSLSVGIKKFVKWYKDFYGQKGNSIQ

SEQ ID NO: 13679 - DNA, 447 bp, Unknown
  Obtained from environmental sample
  misc_feature (1)..(447): n is a, c, g, or t
gtgaaatcaacttcaaatcttattgaaatagtgagtaatggtaactcaaaagaaacagctgtaagtgttttagataaacttgtaagtgctcttcaattaaaacataaaagcttagttgatagttacaagtctttggttattgctaatattaataatcttaaatcacaaaaagatttattagagaagaaagaaaaccagtttgatggaagtttagctgtgaaatttgacttgatttcaaacatcaatgcacttgaactaagtatatcaaaatataatattatagagacaaaacaagtgggtaaatatatagtatctaacaccccaataaaacccaaaaagagacttattgttacagtttcttttgtatctggacttattttatcaatatttttagtattttttattgaatttattaatggtatgagaaaagaagaggaaaacaaataa

SEQ ID NO: 13680 - protein, 148 aa, Unknown
  Obtained from environmental sample
  misc_feature (1)..(148): Xaa is any amino acid
MKSTSNLIEIVSNGNSKETAVSVLDKLVSALQLKHKSLVDSYKSLVIANINNLKSQKDLLEKKENQFDGSLAVKFDLISNINALELSISKYNIIETKQVGKYIVSNTPIKPKKRLIVTVSFVSGLILSIFLVFFIEFINGMRKEEENK

SEQ ID NO: 13681 - DNA, 321 bp, Unknown
  Obtained from environmental sample
  misc_feature (1)..(321): n is a, c, g, or t
ttgttttcctcttcttttctcataccattaataaattcaataaaaaatactaaaaatattgataaaataagtccagatacaaaagaaactgtaacaataagtctctttttgggttttattggggtgttagatactatatatttacccacttgttttgtctctataatattatattttgatatacttagttcaagtgcattgatgtttgaaatcaagtcaaatttcacagctaaacttccatcaaactggttttctttcttctctaataaatctttttgtgatttaagattattaatattagcaataaccaaagacttgtaa

SEQ ID NO: 13682 - protein, 106 aa, Unknown
  Obtained from environmental sample
  misc_feature (1)..(106): Xaa is any amino acid
MFSSSFLIPLINSIKNTKNIDKISPDTKETVTISLFLGFIGVLDTIYLPTCFVSIILYFDILSSSALMFEIKSNFTAKLPSNWFSFFSNKSFCDLRLLILAITKDL

SEQ ID NO: 13683 - DNA, 447 bp, Unknown
  Obtained from environmental sample
  misc_feature (1)..(447): n is a, c, g, or t
atgaagatagcaatagcaggtacaggatatgttggactctctaatggtatcctactttctcaacataatgaggtggtagcacttgatattattccccaaaaagttgagatgataaataaaaaaagatctccaatagaagataaagagatagaagagtatttaaaaaaagataatttaaactttaaagcaacacttgataagaaagaagcttatgaaggtgcagattatgttattatagctacacctacagattatgatccaaaaacaaattattttaatacaaaatctatagaatatgttattagtgatgttttagagataaatcctagtgcagttatgattattaaatctactattccagtaggatatacaaaaagttacaagaacagtttatacacaaaatattattttttcacagaatttttaagagaagaaaagcatatatga

SEQ ID NO: 13684 - protein, 148 aa, Unknown
  Obtained from environmental sample
  DOMAIN (1)...(148): UDP-glucose/GDP-mannose dehydrogenase family, NAD binding domain
  misc_feature (1)..(148): Xaa is any amino acid
MKIAIAGTGYVGLSNGILLSQHNEVVALDIIPQKVEMINKKRSPIEDKEIEEYLKKDNLNFKATLDKKEAYEGADYVIIATPTDYDPKTNYFNTKSIEYVISDVLEINPSAVMIIKSTIPVGYTKSYKNSLYTKYYFFTEFLREEKHI

SEQ ID NO: 13685 - DNA, 597 bp, Unknown
  Obtained from environmental sample
  misc_feature (1)..(597): n is a, c, g, or t
ttgggagagtttaatgtaacccatgtaaataactctcaaaagcttttagaactcacttttgaaaatagatatgatttgtatctacttgatataaatcttcctgatatttgtggtttagatttactgaaagaattgcgttctagtagtgatgaaacacctgctatatttttaacatcttataaagataaagaaactttaaaagagggctttcatagtggagctgatgactttttaacaaaaccctttgatatggatgagttggttttacgaataaactctttaattaaaaggtttaaaaaacactcaattgtgagtattggaaatttagaatttaactttgataataaaactgtgacaaaagatggtgttattattaagtttagtctaaaagctttagatctgtttgagttattttatcaaaacaaccactcaattgtttcaaaagagatgattataaataaactttggaatgtaaatgaagagtatagtgaaggttcaattcgtgtctatgtgaataacataaaaaaactttttgatgatgatactatttttactatatcaaatctaaaaaatattggatataagattgaatattaa

SEQ ID NO: 13686 - protein, 198 aa, Unknown
  Obtained from environmental sample
  DOMAIN (121)...(196): Transcriptional regulatory protein, C terminal
  misc_feature (1)..(198): Xaa is any amino acid
MGEFNVTHVNNSQKLLELTFENRYDLYLLDINLPDICGLDLLKELRSSSDETPAIFLTSYKDKETLKEGFHSGADDFLTKPFDMDELVLRINSLIKRFKKHSIVSIGNLEFNFDNKTVTKDGVIIKFSLKALDLFELFYQNNHSIVSKEMIINKLWNVNEEYSEGSIRVYVNNIKKLFDDDTIFTISNLKNIGYKIEY

SEQ ID NO: 13687 - DNA, 549 bp, Unknown
  Obtained from environmental sample
  misc_feature (1)..(549): n is a, c, g, or t
ttgattatgaaacatcaatattggcaaaaaaaatcagaagaagagataaaaaaaattgtcttcggcgcgttagataaaaacattaattatgttgataaaaacgttcttggcgttccagcttcttatcttgatgacaaagtcttttctcaagatgcgagttttttaaaagatgctccttttttatctactttaataaaaaatcctaaccacattggttgtcacaccattggtgaatcagaatctttctttgctggaactcaagagatagaacgagaactcattgacatctgttcatatgatattttgaacggaaccgacgatcattttgatgggtatgtagcctcgggaggcaccgaagcgaatatgcaggcgatatggatttacagaaattattttaaatctgagaagcgttttgaaaacgacgaaagttgtattctgtgctctgaagataaccactattcgatggataaagcaggaaatgtttttaatattccagttcaaaaagtggaagtcgatgaaaacatcgaacaatctcaaaggaaactgtag

SEQ ID NO: 13688 - protein, 182 aa, Unknown
  Obtained from environmental sample
  misc_feature (1)..(182): Xaa is any amino acid
MIMKHQYWQKKSEEEIKKIVFGALDKNINYVDKNVLGVPASYLDDKVFSQDASFLKDAPFLSTLIKNPNHIGCHTIGESESFFAGTQEIERELIDICSYDILNGTDDHFDGYVASGGTEANMQAIWIYRNYFKSEKRFENDESCILCSEDNHYSMDKAGNVFNIPVQKVEVDENIEQSQRKL

SEQ ID NO: 13689 - DNA, 498 bp, Unknown
  Obtained from environmental sample
  misc_feature (1)..(498): n is a, c, g, or t
atggatagactctatgcaccttggagaacacaatatatatcaaaagcaaaaaaatccatagaggggtgtgtcttttgtcatattgtagataataaagatgatgatgaaaatcttggagttttgtatagagatgaggagttttttatagtgatgaataagtatccttatagtccaggtcattttatgataataccaaactttcatacagctaatttagaagatttggatgaaaatgtttttgcgaaaatgtcattgtatgctcaaaaaggtgtacgacttttaaaaaaggtgctcaatgcaaaaggggtaaatatagggatgaatcttggaagtgcagggggagcagggattgctgaacatattcatctgcatttggttcctagatgggttggtgatacgaattttatcacaactattggagatactagagtatatagctctgatatgaatgaagtttataagaagttaaaagagcacagtgacagttactttagataa

SEQ ID NO: 13690 - protein, 165 aa, Unknown
  Obtained from environmental sample
  DOMAIN (23)...(131): HIT domain
  misc_feature (1)..(165): Xaa is any amino acid
MDRLYAPWRTQYISKAKKSIEGCVFCHIVDNKDDDENLGVLYRDEEFFIVMNKYPYSPGHFMIIPNFHTANLEDLDENVFAKMSLYAQKGVRLLKKVLNAKGVNIGMNLGSAGGAGIAEHIHLHLVPRWVGDTNFITTIGDTRVYSSDMNEVYKKLKEHSDSYFR

SEQ ID NO: 13691 - DNA, 354 bp, Unknown
  Obtained from environmental sample
  misc_feature (1)..(354): n is a, c, g, or t
gtgacagttactttagataatcatagttttgaacttatacacagaacaaacaaaaaaataaaacgggtaagtctctctttagaaaataaaaatgagataattgtaaaaacaccattgaagttcaaatcacatatgataaaagaggtggtgtatgatcataaagattggattttacgaactataaacaaagtgccacctaaaaatagttttgattttgtttcagggggagtggtcccatttttagggaaaaattatcccatagagcttaaagaagatgagcgtatcaaaaatgtgaagtatacttttgaaaatgatacttttgtagtacagtaccacccacaaaaaccatcctaa

SEQ ID NO: 13692 - protein, 117 aa, Unknown
  Obtained from environmental sample
  misc_feature (1)..(117): Xaa is any amino acid
MTVTLDNHSFELIHRTNKKIKRVSLSLENKNEIIVKTPLKFKSHMIKEVVYDHKDWILRTINKVPPKNSFDFVSGGVVPFLGKNYPIELKEDERIKNVKYTFENDTFVVQYHPQKPS

SEQ ID NO: 13693 - DNA, 417 bp, Unknown
  Obtained from environmental sample
  misc_feature (1)..(417): n is a, c, g, or t
atgagcgtacaaaaaagtgaagtatattttgaaaatgatacttttgtagtacagtacaaccaacaaaaacatccctatgaagattttgtagagggactaaaaaagttttatcaatacaatgctataaagataatagacccaatctntgatgagtggtgttttaaaactaagctttaccctcaaaatattagctatcgatttaataaagggagatggggaagttgtagttttgaaaataatatctctataaattataagcttttacagtttgagaaaaaagctatagagtatgtagttttacatgagttgtgtcatattgaggagaaaaatcactcacaaagattttggaatctggtgagtttatatatgcctgattataaagaggtggaaaaaactttaaaatctaagttgttttag

SEQ ID NO: 13694 - protein, 138 aa, Unknown
  Obtained from environmental sample
  DOMAIN (1)...(138): Protein of unknown function DUF45
  misc_feature (1)..(138): Xaa is any amino acid
MSVQKSEVYFENDTFVVQYNQQKHPYEDFVEGLKKFYQYNAIKIIDPIXDEWCFKTKLYPQNISYRFNKGRWGSCSFENNISINYKLLQFEKKAIEYVVLHELCHIEEKNHSQRFWNLVSLYMPDYKEVEKTLKSKLF

SEQ ID NO: 13695 - DNA, 672 bp, Unknown
  Obtained from environmental sample
  misc_feature (1)..(672): n is a, c, g, or t
atgtggaataccataggattattattcttattaacaattacttctttttttccagtgagttattgttttgccgcatcaaactcatcaaaagaaatacacaataacgacagcatactaatatcggtttacgccgatttaagcaaacattatcaacatatcaatgttgattcttcaacattctttttgaaaaaaatacttgaaattgccaaaaagaatgacctaaaatctattgaagccagaacaatagttaaatatggagccaatttatatattcggggagactatgaaatggctctcgattactttatgttaagtttaaaaaaacacgaagccttacacgataaaaacggaattgcagttggatacaacaatattggaatgatctacaatgttcaaggtagaccaaagaaagcaattaaataccataaaagatcaattgatctttgcaaatacataaacaacagcatcttactagcaactaactactttaatattgggattagttttcatcagaaaaaaatattagacagtgccattatttatgccaataaagcaattattattaataaaaatattaataaagaagacaaaaactttaaaatttacaatctaaaaggcagaatttatacagaatcgaacaatttcttcaatgccaaagaaatgttcaactaa

SEQ ID NO: 13696 - protein, 223 aa, Unknown
  Obtained from environmental sample
  DOMAIN (119)...(152): TPR Domain
  misc_feature (1)..(223): Xaa is any amino acid
MWNTIGLLFLLTITSFFPVSYCFAASNSSKEIHNNDSILISVYADLSKHYQHINVDSSTFFLKKILEIAKKNDLKSIEARTIVKYGANLYIRGDYEMALDYFMLSLKKHEALHDKNGIAVGYNNIGMIYNVQGRPKKAIKYHKRSIDLCKYINNSILLATNYFNIGISFHQKKILDSAIIYANKAIIINKNINKEDKNFKIYNLKGRIYTESNNFFNAKEMFN

SEQ ID NO: 13697 - DNA, 558 bp, Unknown
  Obtained from environmental sample
  misc_feature (1)..(558): n is a, c, g, or t
atggcaaaacacttcaggcgaaaaaaaattaactttttcatcaagaaagatctgcagggtaaactcacctggcaattcttcctgctcacgattggtggacttctggttgttctggcaattttttctgctttaacagctgaccacatgaccatttcatacgaaaacaatgcggttcagatcagtagcactccttttatgttgctaagagaactggtcaccagaaactgggcattctttctgtcaacagggctggttatggtgctaacatttattctgctgacccacaaaatagcaggtccaatttatcgatttgaagtcgttaccaaaaatatgtgtaaaaaagacctagaccagcccatctatttacgcaagcacgatgaagctaaagaacttggagattcactgaatcaatttcatcatctcctctctgatgacatccgntacctaatggataaaagccaacagatcgatgattccattcacaaaaacaatcttggaattagctcctgcaggaaaatccaaatctggcagaaaacctttaaattcttatattcttaa

SEQ ID NO: 13698 - protein, 185 aa, Unknown
  Obtained from environmental sample
  DOMAIN (75)...(144): HAMP domain
  misc_feature (1)..(185): Xaa is any amino acid
MAKHFRRKKINFFIKKDLQGKLTWQFFLLTIGGLLVVLAIFSALTADHMTISYENNAVQISSTPFMLLRELVTRNWAFFLSTGLVMVLTFILLTHKIAGPIYRFEVVTKNMCKKDLDQPIYLRKHDEAKELGDSLNQFHHLLSDDIRYLMDKSQQIDDSIHKNNLGISSCRKIQIWQKTFKFLYS

SEQ ID NO: 13699 - DNA, 525 bp, Unknown
  Obtained from environmental sample
  misc_feature (1)..(525): n is a, c, g, or t
ttgatgaaacttcacaccttgataagtctcatattcgctgtcttgatgtttattttctgtatggccggtcaggcgatagcagatagcgttgagacccgctacgcgaccgttaattacgatgatgtagcgttactgcagacattcaatcgtaaggtcaaattaaggggtgttggttttagttttggtaaaaaagtcagcaccaatatacagagtgaagtgagaaaaaaaatcaatctgttaaatggacgagttcaagagattttggagatgaagctccccaacatcaaatttaacattgtgttgcttccaaataaaaaggaagtacaaaaaatctatagggatctgtaccagcgcgaagtcaaattcattgctttttactcaccaaagacaaaaactgcctatttttcagttagggatctaaagctcagggtttatgctcacgaaattgctcatgcaacaataaaccactacttgaaagagatcccccagtcaagattcacgaaatgctggccngagccgatctga

SEQ ID NO: 13700 - protein, 174 aa, Unknown
  Obtained from environmental sample
  SIGNAL (1)...(21)
  misc_feature (1)..(174): Xaa is any amino acid
MMKLHTLISLIFAVLMFIFCMAGQAIADSVETRYATVNYDDVALLQTFNRKVKLRGVGFSFGKKVSTNIQSEVRKKINLLNGRVQEILEMKLPNIKFNIVLLPNKKEVQKIYRDLYQREVKFIAFYSPKTKTAYFSVRDLKLRVYAHEIAHATINHYLKEIPQSRFTKCWPEPI

SEQ ID NO: 13701 - DNA, 318 bp, Unknown
  Obtained from environmental sample
  misc_feature (1)..(318): n is a, c, g, or t
atggtgctaacatttattctgctgacccacaaantagcaggtccaatttatcgatttgaagtcgttaccaaaaatatgtgtaaaaaagacctagaccagcccatctatttacgcaagcacgatgaagctaaagaacttggagattcactgaatcaattcaatcatctcctctctgatgacatccgttacttaatggataaaagccaacagatcgatgattccattcacaaaaacaatcttgaattagctctgcaggaaaatcaaaatctgcagaaaactttaaaatcttatattctaaaacaaccaaaccgaaaataa

SEQ ID NO: 13702 - protein, 105 aa, Unknown
  Obtained from environmental sample
  misc_feature (1)..(105): Xaa is any amino acid
MVLTFILLTHKXAGPIYRFEVVTKNMCKKDLDQPIYLRKHDEAKELGDSLNQFNHLLSDDIRYLMDKSQQIDDSIHKNNLELALQENQNLQKTLKSYILKQPNRK

SEQ ID NO: 13703 - DNA, 960 bp, Unknown
  Obtained from environmental sample
  misc_feature (1)..(960): n is a, c, g, or t
atgattttttatattaaatatgagaaaacttctataattacacatttcaacttctcaacagcatcacttcttgccatggggattatagatatttttcatgcctcagttatgcctggagagatgtttgtatggcttcactctatagccatgtttttcggcggtatcttgtttataactgtgtggatcaaagagaaaaaagtatctcatacaacatataaactaattcctataatattttttatattccctattattgtctctgtagcatcaattctcaactacgatttaatacctcaaatgttaaatcctgataaaagtttcactacatatgcaaatgctctaaatatcattggtggtataggcttctttattgcatcaataaaatttatattaaactactataaaagtgaaaatattgaagagcttctttttgctggacatacaatgcttttttctattgccggtctattatttgtttcatcaatggtctgggatatgcagtggtggctgtggcatctacttagattagtagcatatatatttgcattttacattctttatatggagtatcacagggaaattgttcaattagaatttgtcaataaagagttaaaagagactacaattgagctaaacaagaatctctcatattatgaaagttttcaaaaagcaactgatgagggaaatattgtcagtaaaagtgacctaaaaggtattattacatatgttaatgataatttttgccgtattaccggatataccagagaagaggttatcggtaaagctcacaatatagtccgtcatgaagataatccaaaagagatctttgaagatatgtggaaaaacattcaatcaaaaaaagtttggaaaagtactcttaaaaatagaaaaaaagatggtacccactactgggtcgatattaatataaatcccattttagacatagcggtgaaatcataa

SEQ ID NO: 13704 - protein, 319 aa, Unknown
  Obtained from environmental sample
  DOMAIN (216)...(281): PAS domain
  misc_feature (1)..(319): Xaa is any amino acid
MIFYIKYEKTSIITHFNFSTASLLAMGIIDIFHASVMPGEMFVWLHSIAMFFGGILFITVWIKEKKVSHTTYKLIPIIFFIFPIIVSVASILNYDLIPQMLNPDKSFTTYANALNIIGGIGFFIASIKFILNYYKSENIEELLFAGHTMLFSIAGLLFVSSMVWDMQWWLWHLLRLVAYIFAFYILYMEYHREIVQLEFVNKELKETTIELNKNLSYYESFQKATDEGNIVSKSDLKGIITYVNDNFCRITGYTREEVIGKAHNIVRHEDNPKEIFEDMWKNIQSKKVWKSTLKNRKKDGTHYWVDININPILDIAVKS

SEQ ID NO: 13705 - DNA, 378 bp, Unknown
  Obtained from environmental sample
  misc_feature (1)..(378): n is a, c, g, or t
ttgaaaattgtcgaatcagaggggatagagaattttgagctcattatagagtttattaaagatgtaaaagaagcaggttgcaaaatagccatagatgattttggaacgggatactcaaattttgaatatctgcttcaactaaaagctgattatattaagatagacggttctatgataaaaaacattgatactgactcagatgcaagagccgttgtatccacaatcgtagattttgctaaaaagatgaatatgaaaaccatcgcagagtttgtaaaagatgagacaatagactccatcatcaaagagatggggatagactactctcaaggcttttattttggtgagccaaaaccgactcctgaactaaaaaagagttaa

SEQ ID NO: 13706 - protein, 125 aa, Unknown
  Obtained from environmental sample
  DOMAIN (1)...(116): EAL domain
  misc_feature (1)..(125): Xaa is any amino acid
MKIVESEGIENFELIIEFIKDVKEAGCKIAIDDFGTGYSNFEYLLQLKADYIKIDGSMIKNIDTDSDARAVVSTIVDFAKKMNMKTIAEFVKDETIDSIIKEMGIDYSQGFYFGEPKPTPELKKS

SEQ ID NO: 13707 - DNA, 918 bp, Unknown
  Obtained from environmental sample
  misc_feature (1)..(918): n is a, c, g, or t
atgccgggtatgaacgggtacgatgtctgtagagagatcaagaaacgaaaacggcatagattttccaagatattaatggttagtggaaaaacactggttgaagagcgacttgaaggatatagcgcaggagcagatgattatataaccaaaccatttatagacgatgaactccttgcaaaattaaaggtattctcagatcttaagaagactgaagaaatagatgagcttaaaaccggtattctacaactcttctcccatgagacgaaaacgccactcaatgggatactactcggcagccaacttatactcgacacccctgccctgccagacaaagtaattgaatatgcaaaacttataaaaatatctggagaacgtattcacgatctggtgcgtaaaatactcctgctttccagcctgaaaaatagtcgttctttaaactttggagttcagctggttaaccagtatttagaaggcatcgttaaccagagtaaacatcccttaccggaagaatacaggtttgaaatagattgccctgaagacttcgccatggaagttgactggaaattatttcatgaagctttttttgcagccatccagaatgcgatacaattttcaccaaagggtggtatcattaccatttctgcaaagcatgatgataaaaatgtctgctttcgtattaaagatgaggggcctggtattaagcccgatttaatcgaacgaatatttgatgagttttactcgcagaacatagaaaaccattctaaaggaactgctctcagccttgccattggccagaaaattctcaacctccacaatggcaatttagtagctgaatctacacccggccagggggcaacttttgtctttacattgcctctttcaccgtggttattttacaggtcttcaggtagcccatga

SEQ ID NO: 13708 - protein, 305 aa, Unknown
  Obtained from environmental sample
  DOMAIN (76)...(142): His Kinase A (phosphoacceptor) domain
  misc_feature (1)..(305): Xaa is any amino acid
MPGMNGYDVCREIKKRKRHRFSKILMVSGKTLVEERLEGYSAGADDYITKPFIDDELLAKLKVFSDLKKTEEIDELKTGILQLFSHETKTPLNGILLGSQLILDTPALPDKVIEYAKLIKISGERIHDLVRKILLLSSLKNSRSLNFGVQLVNQYLEGIVNQSKHPLPEEYRFEIDCPEDFAMEVDWKLFHEAFFAAIQNAIQFSPKGGIITISAKHDDKNVCFRIKDEGPGIKPDLIERIFDEFYSQNIENHSKGTALSLAIGQKILNLHNGNLVAESTPGQGATFVFTLPLSPWLFYRSSGSP

SEQ ID NO: 13709 - DNA, 318 bp, Unknown
  Obtained from environmental sample
  misc_feature (1)..(318): n is a, c, g, or t
ttgcataaaatattaaatgtaaatataaattggctactaagtggagagggcgaaatgtttataaaagataataaatatatggataaagtatctgaaccacaaacagaatatcagacatcaaataaactaacaataccaggaaaaatagattttcacttatctcaaaaagagacagaaatcttgaatgcatacagagaattagataaagattatcaaatagaattttatggtgaagttataagagcagctgcaagagaaagaagaaagattaaagaacaaaatgaaatattagacaaagatgtaaaatcagcagtatga

SEQ ID NO: 13710 - protein, 105 aa, Unknown
  Obtained from environmental sample
  misc_feature (1)..(105): Xaa is any amino acid
MHKILNVNINWLLSGEGEMFIKDNKYMDKVSEPQTEYQTSNKLTIPGKIDFHLSQKETEILNAYRELDKDYQIEFYGEVIRAAARERRKIKEQNEILDKDVKSAV

SEQ ID NO: 13711 - DNA, 600 bp, Unknown
  Obtained from environmental sample
  misc_feature (1)..(600): n is a, c, g, or t
atgagtaacaaatctgtgatttcaacactaataataagcatattctttacagcttgtacggatcaaaaagaagcaaataatcaaaactttacaaatgcacttaacgaatatgttaaaactggtaaacaccaattaaattgttttcatgttggttataattttcccttaattaaaaatacatttaatgaaaaatctattgaaaaatcaaaacaacaaggttttttagttgaatcaaaagcacaagttgcaaatacactactaacacaaatcaaaggttccaatccatacggaataggttggagaccgccaaaagaacaagaagaaaaaaaatacactgaaaaaactgtttacaatctgaatagtaaagcaaaaaaatattacaaagatggttatgtatgtttaggaaaagcaaaaataaatgaagtaataagttttactgaaccaataacaataagctcatataaattaacaaatgtaaaattctcatatactattgaagatcttccaaattgggtaaacatagaggataatattaaaactaaaaatatagagctatatttaaaagataacaaatgggaacacaaatcaagttcattttaa

SEQ ID NO: 13712 - protein, 199 aa, Unknown
  Obtained from environmental sample
  SIGNAL (1)...(20)
  misc_feature (1)..(199): Xaa is any amino acid
MSNKSVISTLIISIFFTACTDQKEANNQNFTNALNEYVKTGKHQLNCFHVGYNFPLIKNTFNEKSIEKSKQQGFLVESKAQVANTLLTQIKGSNPYGIGWRPPKEQEEKKYTEKTVYNLNSKAKKYYKDGYVCLGKAKINEVISFTEPITISSYKLTNVKFSYTIEDLPNWVNIEDNIKTKNIELYLKDNKWEHKSSSF

SEQ ID NO: 13713 - DNA, 765 bp, Unknown
  Obtained from environmental sample
  misc_feature (1)..(765): n is a, c, g, or t
ttgggggtcatggtgccgaccgaaacaattatagaaaaggcgattgaggaaaaggttgacgttgtcggactcagtggattaattaccccctcactggatgagatggtgacgattgcaaaagagatggaaaaggctggattaaagacaccgctgctgttgagcggggcaaccacttcaaaaatccataccgtgatcaaaattgcacctcactattcatatccctgtatacatgtcaaagatgcatctgatggggtgaatgtggtcagtaaactattatctccaaaacttaaagaggcatatttgaaagacctgaatgaagcgtataaattaaccagagaaaattatcatattaagagggattcaaaaaattatattgaaatcagcagggcaagagacaatcgtttaaaaattgattggcaaaacgagaagattaccaagccccaatttacaggaaataagatacttgataattattcaatcgatgaaatttcaaaatatatcaactggaatgctttttttaatgcctggaaactgaaaggacattatcctgaaattctatcagataaagaaaaaggtgaagaggcacagagtctattcaatgatgcacagtcaatgttaaaacgggtcattaaggaaaatattttaacggcaaacggaataattggaatatatccggcaaattcagtaatggaagatattgaagtttatccggaaggtgataaggataaaattatttttaattttttaangaatcagngaaaatag

SEQ ID NO: 13714 - protein, 254 aa, Unknown
  Obtained from environmental sample
  DOMAIN (128)...(253): Vitamin B12 dependent methionine synthase, activation domain
  misc_feature (1)..(254): Xaa is any amino acid
MGVMVPTETIIEKAIEEKVDVVGLSGLITPSLDEMVTIAKEMEKAGLKTPLLLSGATTSKIHTVIKIAPHYSYPCIHVKDASDGVNVVSKLLSPKLKEAYLKDLNEAYKLTRENYHIKRDSKNYIEISRARDNRLKIDWQNEKITKPQFTGNKILDNYSIDEISKYINWNAFFNAWKLKGHYPEILSDKEKGEEAQSLFNDAQSMLKRVIKENILTANGIIGIYPANSVMEDIEVYPEGDKDKIIFNFLXNQXK

SEQ ID NO: 13715 - DNA, 645 bp, Unknown
  Obtained from environmental sample
  misc_feature (1)..(645): n is a, c, g, or t
atgaaatcgctaactaaaaaaagctacttaattaatttattgttgtttttaacgactttagggattgcccaaaaccctattgaaaaagaaggttggacacttacttttaatgatgaatttaatgatacagtattggataaaaacaaatggcaaacctctttttattggggaggaagaaactacgaaaacgacattgtatattatggagaaaatcaatttgaattttctgattcatctttattaattaaagctgaaaaaaaagaagaaaaaagcggaattccatacacttctggactaatagattgccatttttcttttaaacaacaatatggttattttgaaataagaagcaaaaacccaacaggaactggtttttggccagcattttggttggtaagcaccgaacaatggcctccagaaatagatatttttgagttttatacaagtcaccccaataattggagtacctcgcaacattggaaaaccaaaagaggaaaaaataaacgccaaactaaaaattacaaaattgatgatgatgcttcagcaagttttcaaacctatgcagttgagtggactcccaaaaaaatcatttggtattacaacaataaaaaattccgaacagcaagaagaggtgtaaaaccataa

SEQ ID NO: 13716 - protein, 214 aa, Unknown
  Obtained from environmental sample
  DOMAIN (60)...(213): Glycosyl hydrolases family 16
  misc_feature (1)..(214): Xaa is any amino acid
MKSLTKKSYLINLLLFLTTLGIAQNPIEKEGWTLTFNDEFNDTVLDKNKWQTSFYWGGRNYENDIVYYGENQFEFSDSSLLIKAEKKEEKSGIPYTSGLIDCHFSFKQQYGYFEIRSKNPTGTGFWPAFWLVSTEQWPPEIDIFEFYTSHPNNWSTSQHWKTKRGKNKRQTKNYKIDDDASASFQTYAVEWTPKKIIWYYNNKKFRTARRGVKP

SEQ ID NO: 13717 - DNA, 702 bp, Unknown
  Obtained from environmental sample
  misc_feature (1)..(702): n is a, c, g, or t
ttgtatatggatgattgtttaaaaactcaaaataacaactacaatcagattgaaaaagctattaaatatatagatgaaaattttaaagaacaaccttctatagatgagatagcttctaatattggtatgagtaaataccattttattcgagtgtttaaagaatatgtcggtgtgactccaaagcagtttttacattcactaactctaaactatgcaaaagaacatattagagaatcaaaatccatactagatagtagtcttgatattggactttcaagcacaagtagactccatgaactttttgtaaatcttataggagtaacgccaaaagagtatagagaaaaagggaaaaatgtaactataacttatggatatggagagacaccttttggtgaagcacttattgcttttacacttaaaggtatctgttatctgggatttatagataaaaataaagaggaaaattttgatagattttatgaaatttggggcaatgcaaatctcatacatgacaatgaaaaagcaaaagagtatattgaaaatatttttatcaaaaacaaaaaatacaatcttctagtcaaagggacaaaattttcagtgaatgtttggaaagctcttttaaatcttcccaatgtggtagttactacctatcaagaattggctaatcttattgataaacccaaaagctgtaagaacctgtag

SEQ ID NO: 13718 - protein, 233 aa, Unknown
  Obtained from environmental sample
  DOMAIN (71)...(114): Bacterial regulatory helix-turn-helix proteins, AraC family
  misc_feature (1)..(233): Xaa is any amino acid
MYMDDCLKTQNNNYNQIEKAIKYIDENFKEQPSIDEIASNIGMSKYHFIRVFKEYVGVTPKQFLHSLTLNYAKEHIRESKSILDSSLDIGLSSTSRLHELFVNLIGVTPKEYREKGKNVTITYGYGETPFGEALIAFTLKGICYLGFIDKNKEENFDRFYEIWGNANLIHDNEKAKEYIENIFIKNKKYNLLVKGTKFSVNVWKALLNLPNVVVTTYQELANLIDKPKSCKNL

SEQ ID NO: 13719 - DNA, 324 bp, Unknown
  Obtained from environmental sample
  misc_feature (1)..(324): n is a, c, g, or t
atgaagttaactaagataataacagtttttatgatggtatttagcctatcgctcatggcacgtgaacaggtaaatatgagtttttcggatctatctatagaagatttcattaaacttgtctcaaagataacaaataaaaatatacttgtcaactacaaagtagcaggtaaaattgatcttattacaacaactgcaatatatgatgatgaagttatggatatattaatatcagtgcttgaatctaaagggtacacacttgttcaaaacggctctgtttatgagataataagaagtgtagatgcggctcagcaaaatctaaaatag

SEQ ID NO: 13720 - protein, 107 aa, Unknown
  Obtained from environmental sample
  SIGNAL (1)...(20)
  misc_feature (1)..(107): Xaa is any amino acid
MKLTKIITVFMMVFSLSLMAREQVNMSFSDLSIEDFIKLVSKITNKNILVNYKVAGKIDLITTTAIYDDEVMDILISVLESKGYTLVQNGSVYEIIRSVDAAQQNLK

SEQ ID NO: 13721 - DNA, 687 bp, Unknown
  Obtained from environmental sample
  misc_feature (1)..(687): n is a, c, g, or t
atgccctcaatattagagaatataggcattggcttttttaataactcccaaaaaaaatcaaacccgtgggagcatgttacacaagttgtaagctctacgcctatatcagatatgattttaacaggtatctataaactacaaggcggtggatacataattgtttctcttaaaaaagagagagactcttcgatcatatcgataggtgaagtttcaaacggatataaactaatcgagatagagacaaaacgtgctatctttgaaaaaaactcaaaaagatatgtagtaaatatgttagattcagatgttaaacttcctaatgtaacaactgcaaaacttaacaatgatggaagtaaaaaaagttcagcagcagcatctaaaagagtctcaaaaaaagatattgcttactatgccaaaaactttaatgatatttggaaagatattggcataaaagagacaaaagaaaatggtaagataactggttttgaagtgactaaaattcgtgataaatcatctttcgcagagttaggacttttaaaaggcgatgtaatcattaaagcaaataatgtagaactgcatagttatgcagatgcactgagcatttacaaaaatataaacaaattagatgcactagagttagtagtgctaagagataatcaagaagtggagataatttatgaagttaactaa

SEQ ID NO: 13722 - protein, 228 aa, Unknown
  Obtained from environmental sample
  misc_feature (1)..(228): Xaa is any amino acid
MPSILENIGIGFFNNSQKKSNPWEHVTQVVSSTPISDMILTGIYKLQGGGYIIVSLKKERDSSIISIGEVSNGYKLIEIETKRAIFEKNSKRYVVNMLDSDVKLPNVTTAKLNNDGSKKSSAAASKRVSKKDIAYYAKNFNDIWKDIGIKETKENGKITGFEVTKIRDKSSFAELGLLKGDVIIKANNVELHSYADALSIYKNINKLDALELVVLRDNQEVEIIYEVN

SEQ ID NO: 13723 - DNA, 756 bp, Unknown
  Obtained from environmental sample
  misc_feature (1)..(756): n is a, c, g, or t
ttgagagatgtgaaaaaacttctaccttcactctttgatgacattattttagaagatgatgatagctataactatagtgcatataaagatggtgatagttatcttatttttgcttatcaagatagtaaaattttagattcactatctaaaaaggggataaaatcctcacaaataaatagagtcttttttgctcaaagcgaattttcaaatatttcaaccgctataagtatagacgaacatagtgtacttgcagttaaagactcaatagttataaaaattccatctattatggttcaagatagccaagacctatatttaaacaggcaccaactctcaaaaaacaatatatctatagaaaaatattctcatataatagatacaaaaactcaaatcagtataatctctttagtagctgtttttattattatattctcagtagaactttttatcagttcatctaaagtagcctcaattcaaagcagagaagagtcactatttcaagataataaacttttagcaacaagttttcaaaatgaagcagtactgaaaagattagagagaactttccatgaacaaaacagagtcagagagatactctcaataatattctcacacaaagtaggaaaagatgagtatcttcaaaatgtagagataaaaaacaaaaaagtatatgctacatttaaacttacatcatcggcaaatatcaaatctacccatgaaaagctaaaaaatgcgaaagtaaaaaaccataagtaa

SEQ ID NO: 13724 - protein, 251 aa, Unknown
  Obtained from environmental sample
  misc_feature (1)..(251): Xaa is any amino acid
MRDVKKLLPSLFDDIILEDDDSYNYSAYKDGDSYLIFAYQDSKILDSLSKKGIKSSQINRVFFAQSEFSNISTAISIDEHSVLAVKDSIVIKIPSIMVQDSQDLYLNRHQLSKNNISIEKYSHIIDTKTQISIISLVAVFIIIFSVELFISSSKVASIQSREESLFQDNKLLATSFQNEAVLKRLERTFHEQNRVREILSIIFSHKVGKDEYLQNVEIKNKKVYATFKLTSSANIKSTHEKLKNAKVKNHK

SEQ ID NO: 13725 - DNA, 765 bp, Unknown
  Obtained from environmental sample
  misc_feature (1)..(765): n is a, c, g, or t
atgatatatattttaggaatatcttcatactatcatgatagtgcagcggcattaatttgtaatggtgaaatagttgcggctgctcaagaagaacgtttttcaagaaaaaaaaatgatgcttcatatccgaaagagtctatcaactatctattaaaagagggagatatatctatacaagatatatcatatgtggtgttttatgacaaaccatttttgaaatttgaaagacttcttgaaacatatttagcttttgcacctaaaggactaacctcatttttaaaagctatgccaatatggctaaaagaaaagttatttttaaaaaatttacttttaaaagagttaaagaaattagataaatattttgattctagtaagataatgtttagtgagcatcattttagtcatgcagcaagtgctttttatccatcaaatttcaatgaggctataatccttgtaattgatggtgttggggagtgggttacaacaactgttgcaataggaaaaggtgaatctttaaaaatcatcaaagagatacatttccctcactctttaggacttttatactcagcttttacatattattgtggttttaaggtcaatagcggtgaatataaattaatgggattggcaccctatggagaaccaaaatataaagatcttattttagaaaacttaatagatttaaaagatgatggttcatttaagatgaatcaaaaatattttaattatgcaacaggtttaaacatgacaaataaaangttttga

SEQ ID NO: 13726 - protein, 254 aa, Unknown
  Obtained from environmental sample
  misc_feature (1)..(254): Xaa is any amino acid
MIYILGISSYYHDSAAALICNGEIVAAAQEERFSRKKNDASYPKESINYLLKEGDISIQDISYVVFYDKPFLKFERLLETYLAFAPKGLTSFLKAMPIWLKEKLFLKNLLLKELKKLDKYFDSSKIMFSEHHFSHAASAFYPSNFNEAIILVIDGVGEWVTTTVAIGKGESLKIIKEIHFPHSLGLLYSAFTYYCGFKVNSGEYKLMGLAPYGEPKYKDLILENLIDLKDDGSFKMNQKYFNYATGLNMTNKXF

SEQ ID NO: 13727 - DNA, 537 bp, Unknown
  Obtained from environmental sample
  misc_feature (1)..(537): n is a, c, g, or t
ttgaaactaaaaaggcttatgtcggttgttttgactataggaatactatcattcatatttatcatttatttttacggcttacaaaaagattttacaaagcatcatagagagtttcttattgctgtaaatacattggaaaactcatatcttgacttagagcataaaatactgcaaaactcaatttacgcttacaataatctagatgaaatctcatcttcgacaaatagtgttgaaaatgaatttaaaaacttaacagagacgcatatactcaaatataaagagtataaagatattaaaataaatctagatatacttaaagagaaaatcaacttaaatatacaaaacatagatgaatatctcatgctaaatgccggtataaaaaactcactagtctatttaagttcttatatagaaaaagcagcttttttagaagaacaagataaaaatctttatataaaagctatacaaattttaaaacacttccatgatgccaaaagattacaggattttgactatttaaataaaaaaaggtttttt

SEQ ID NO: 13728 - protein, 179 aa, Unknown
  Obtained from environmental sample
  misc_feature (1)..(179): Xaa is any amino acid
MKLKRLMSVVLTIGILSFIFIIYFYGLQKDFTKHHREFLIAVNTLENSYLDLEHKILQNSIYAYNNLDEISSSTNSVENEFKNLTETHILKYKEYKDIKINLDILKEKINLNIQNIDEYLMLNAGIKNSLVYLSSYIEKAAFLEEQDKNLYIKAIQILKHFHDAKRLQDFDYLNKKRFF

SEQ ID NO: 13729 - DNA, 795 bp, Unknown
  Obtained from environmental sample
  misc_feature (1)..(795): n is a, c, g, or t
atgaacgattttaaagcacttgatatttttgcttcaattttatttagtgtgtttattgcatctcttttactgattgttattctcattcttaaatacataaaagaaaacaaaaaacttgaagaaactactgaatcacttaaacactcaataatgtacgataatttgacagatttgtataatcgaaaagcatttataaagcagctcaaaaaaacaaaaaaaccgctactacttcttatagatatagacggttttaaatatataaatgacatctatggaaatgttgtaggtaatcttgtacttaaaaagttgtcagaaattttaaaaaaagagtttgaaagtattttagatactggtgtttatcgtcttgccggagatgaatttggaattttatttaaagatatctcaagtaaaaaggcactagaaatcgccaagaaccttgagaataaaatatcaaattataattttataataagtgatttaactctgcatctacatgtaagtattgcaagtaactccgttactcctattctagaaaatgcagacttagccttaaaacttctaaaagacaatccgatgaaaagggtgatagagtacaatgaaagtctaaactttaaaatggatgtaaaagaaaacatgcatacaattgagcagataaaatatgctgtagaagaggatagaatcgttccattctttcaaccaatagtcaatctaaaaacattaaaaatagagaagtatgaagcccttgccagactaaaactaaaagatggtacttttttaccaccattaagtttttag

SEQ ID NO: 13730 - protein, 264 aa, Unknown
  Obtained from environmental sample
  DOMAIN (46)...(194): GGDEF domain
  misc_feature (1)..(264): Xaa is any amino acid
MNDFKALDIFASILFSVFIASLLLIVILILKYIKENKKLEETTESLKHSIMYDNLTDLYNRKAFIKQLKKTKKPLLLLIDIDGFKYINDIYGNVVGNLVLKKLSEILKKEFESILDTGVYRLAGDEFGILFKDISSKKALEIAKNLENKISNYNFIISDLTLHLHVSIASNSVTPILENADLALKLLKDNPMKRVIEYNESLNFKMDVKENMHTIEQIKYAVEEDRIVPFFQPIVNLKTLKIEKYEALARLKLKDGTFLPPLSF

SEQ ID NO: 13731 - DNA, 642 bp, Unknown
  Obtained from environmental sample
  misc_feature (1)..(642): n is a, c, g, or t
atgatattttcccaaatccaaaatattacacaaatgcacaaagtttttttgagtgatgagatatatgattttgtaagaggcagctcgctgaaaaccatagtctatatgccaccatacagagagaacagcttcgcttcaaatccactaaattntgagatgttaaataagtttgcaaaagagaacaaccttttcatcatcataaaactgcacccattttcaactctagggatgtttgatacactctcttcagagaggtttgaattcagaaagaactatgatgaaaatatactcttctatcccaatggtaaagatatctaccctattttaaaatttagtgatatgctcataacagactactcctctatctattttgattatcttcttttaaataagccgatactcttttttgtttatgacatggatgagtatattgggtcgcgtggtgactttatgctggattttgagagagttaccccaggtaaaaaatgttacgattttgacgatctaagagaaggaattctcgatcagcttcaaaataacacttttgcacttgatcgagaaaaattaaaagataaactatttgaagaaagttctaaaagtgccagtgaagagattttcaaaaaattaaaggattttagttga

SEQ ID NO: 13732 - protein, 213 aa, Unknown
  Obtained from environmental sample
  DOMAIN (18)...(211): CDP-Glycerol:Poly(glycerophosphate) glycerophosphotransferase
  misc_feature (1)..(213): Xaa is any amino acid
MIFSQIQNITQMHKVFLSDEIYDFVRGSSLKTIVYMPPYRENSFASNPLNXEMLNKFAKENNLFIIIKLHPFSTLGMFDTLSSERFEFRKNYDENILFYPNGKDIYPILKFSDMLITDYSSIYFDYLLLNKPILFFVYDMDEYIGSRGDFMLDFERVTPGKKCYDFDDLREGILDQLQNNTFALDREKLKDKLFEESSKSASEEIFKKLKDFS

SEQ ID NO: 13733 - DNA, 414 bp, Unknown
  Obtained from environmental sample
  misc_feature (1)..(414): n is a, c, g, or t
ttgaatgaaaagggtatttctgaaattgaaaagcaaggcacttcagtgattgattctgacggtgatttagttacaccaattatcaatgataaagaatgcgtttatacggtttttgaaaatggcttggctttatgtggtatcgaaaaagcttttcttgatggaaaaataaagtatcgtaaaccaatttcatgctccttgtaccctatacgtattcagaagtatgaagagttcgatgctgtaaattataacaagtggaatatttgtgcaccagctcgtgatttaggttacaaaatgggaacaccagtttataaattcttaaaagaaccgttgatccgtaagtatggcgaagactggtataaggaattagaatatgctgctgaaaatcttgaagaaatttatcagataagaagatag

SEQ ID NO: 13734 - protein, 137 aa, Unknown
  Obtained from environmental sample
  misc_feature (1)..(137): Xaa is any amino acid
MNEKGISEIEKQGTSVIDSDGDLVTPIINDKECVYTVFENGLALCGIEKAFLDGKIKYRKPISCSLYPIRIQKYEEFDAVNYNKWNICAPARDLGYKMGTPVYKFLKEPLIRKYGEDWYKELEYAAENLEEIYQIRR

SEQ ID NO: 13735 - DNA, 513 bp, Unknown; identical to SEQ ID NO: 8665
  Obtained from environmental sample
  misc_feature (1)..(513): n is a, c, g, or t

SEQ ID NO: 13736 - protein, 170 aa, Unknown; identical to SEQ ID NO: 8666
  Obtained from environmental sample
  DOMAIN (15)...(144): Cytidylyltransferase
  misc_feature (1)..(170): Xaa is any amino acid

SEQ ID NO: 13737 - DNA, 828 bp, Unknown
  Obtained from environmental sample
  misc_feature (1)..(828): n is a, c, g, or t
ttgattattacagatataaatatgccacttctaagtggattagatatggcaaaagagataaaaaaaataaatgaaaatcaaaatatactaattgtttctgcctattcagatacacagaactttatagaatccataaaaattggaattgatggatatattttaaagcctattgaatataatcagctcaatacagaactttataaaaccacatttaaaattaaacaatttaaagaaagtatagaatataaatctcttttagaacagcttattgaaactaaaacagaagatgtgaaagagctacaaaaacaaaaaatatataactataaaaacaccttatatgctttagtaaaaatggtggaagatagagatacctatacaggtggacattcattacgagttgctaaatattctaaattgattgctcaaaatttaaatttagatgaagaaacttgtgaaaatatttatgaggctggaattcttcatgatataggtaaaatagcaatacctgataatgtgttattaaagccaagaagtttaaatgatttagaatatacacttatacaagaacatgtcaacttaggagtgaaaatgctttctaaggtacctatgtttaaagagcttgcaaaatttattgatggacatcatgaaagattagatggaagtggatatccaaaaggtttaaaaggggaacagattgcattagaatctcaaattatggcaatatctgatgcttttgacgctatgacaaccagtagaatttataaagcacgaaagagtattcctgaggcgcttaatgagttgggaaagtctttcaagaaaacattatag

SEQ ID NO: 13738 - protein, 275 aa, Unknown
  Obtained from environmental sample
  DOMAIN (126)...(248): HD domain
  misc_feature (1)..(275): Xaa is any amino acid
MIITDINMPLLSGLDMAKEIKKINENQNILIVSAYSDTQNFIESIKIGIDGYILKPIEYNQLNTELYKTTFKIKQFKESIEYKSLLEQLIETKTEDVKELQKQKIYNYKNTLYALVKMVEDRDTYTGGHSLRVAKYSKLIAQNLNLDEETCENIYEAGILHDIGKIAIPDNVLLKPRSLNDLEYTLIQEHVNLGVKMLSKVPMFKELAKFIDGHHERLDGSGYPKGLKGEQIALESQIMAISDAFDAMTTSRIYKARKSIPEALNELGKSFKKTL

SEQ ID NO: 13739 - DNA, 561 bp, Unknown
  Obtained from environmental sample
  misc_feature (1)..(561): n is a, c, g, or t
atggttttgatttctaatcctgccaaagaaaaagggcaaacttttttgaaagtagatgacgaaatgtggatgtggactccaagtattagtagaattgtaaaacttgggccttcaatgatgtcgcaaggttggatgaattcggattattctaatgatgaacttatgaatagtggttcgattgtaaatgattatgacaaaaaaataactggttcggaaactatttctggcactgattgttacattatcaaattaataccaaaaaatgaaacaacaattatttggggcaaacaaattttgtggatttcaaaagattcagatttaattcttaagaatgaattttatgacgaggatgaatttcttgttaaaacccatttagcaggtgatattaaaaatatggatgggcgtataattccaacgagatttgaaattatctcagaagatgaccctggaagcaaaacaattttgacaatgaacgtaattaaatttgatataaaagttgaaaaaagcttttttactcaacaaaatatgcgaaaaggaatgtctttacaatttccaaaataa

SEQ ID NO: 13740 - protein, 186 aa, Unknown
  Obtained from environmental sample
  misc_feature (1)..(186): Xaa is any amino acid
MVLISNPAKEKGQTFLKVDDEMWMWTPSISRIVKLGPSMMSQGWMNSDYSNDELMNSGSIVNDYDKKITGSETISGTDCYIIKLIPKNETTIIWGKQILWISKDSDLILKNEFYDEDEFLVKTHLAGDIKNMDGRIIPTRFEIISEDDPGSKTILTMNVIKFDIKVEKSFFTQQNMRKGMSLQFPK

SEQ ID NO: 13741 - DNA, 672 bp, Unknown
  Obtained from environmental sample
  misc_feature (1)..(672): n is a, c, g, or t
atgaaccaactttttgtagcatataaacctacaggaatcagttcaaacttttttttatcacggttaaaaagaaaatacaacaataaaaaagcaggtttctcaggaacacttgacccttttgcaaaaggagttttgcttataggtttcggttctcatacaaaactttttcgctttttaaataaaacccctaaaacttaccgtgctactctctggctaggtgcggcatctgattctttagatactgagttgatagaaaatgtagagatgctagaagagtttaagctagaaaagattcaagaagttgttaagtcactagagggggaattagaatatgaaccacctatctttagtgcaaaacgtataaatgggcagagagcttatgacttggcaagggctggtaaagaatttactctaaataaaattaattctagcatctatgaaataaaattaattagttactgtcatccatttgtgacttttgaagctacagtttctgaaggtacatatattcgttcacttggtcgtataattgctcagagattaggtttagaacatggtagcttaagtgccctagaaagattgagtgaaggtcagtttaaatatgatgaagaaaaaagtttagatattaaaaaatctcttaatattcctgaaaatttttacccttggagatag

SEQ ID NO: 13742 - protein, 223 aa, Unknown
  Obtained from environmental sample
  DOMAIN (20)...(170): TruB family pseudouridylate synthase (N terminal domain)
  misc_feature (1)..(223): Xaa is any amino acid
MNQLFVAYKPTGISSNFFLSRLKRKYNNKKAGFSGTLDPFAKGVLLIGFGSHTKLFRFLNKTPKTYRATLWLGAASDSLDTELIENVEMLEEFKLEKIQEVVKSLEGELEYEPPIFSAKRINGQRAYDLARAGKEFTLNKINSSIYEIKLISYCHPFVTFEATVSEGTYIRSLGRIIAQRLGLEHGSLSALERLSEGQFKYDEEKSLDIKKSLNIPENFYPWR

SEQ ID NO: 13743 - DNA, 486 bp, Unknown
  Obtained from environmental sample
  misc_feature (1)..(486): n is a, c, g, or t
atgaatttaatgaaactattacttataaattttattatctgctcaactcttttagctgatcataagggtgctccgcagcttctatctgctaaagacacacttatttcacttgagcctataaagagtgatgctattgtatttggtgagggaaaaaaagagattcatgcttttatagatccgctttgttctctgtctcagaggtatctatctttcgtatttgcgaaaaaagagttaatgtttaaaaagtataaattctacttctacctttatgagctccctagtaaaaattccaaagagcttatctcaacaatactctcatcagagtataaaaacacaatgcttaaaaccgttatgttaaatcatcaagatgttattattgatgaaggtgaaggagaagatatagctgataaaattgaagaggttgcaaaaaagataggcgttttcaagcgaccgtatatcttaattaatgggaaagtgaaattatga

SEQ ID NO: 13744 - protein, 161 aa, Unknown
  Obtained from environmental sample
  misc_feature (1)..(161): Xaa is any amino acid
MNLMKLLLINFIICSTLLADHKGAPQLLSAKDTLISLEPIKSDAIVFGEGKKEIHAFIDPLCSLSQRYLSFVFAKKELMFKKYKFYFYLYELPSKNSKELISTILSSEYKNTMLKTVMLNHQDVIIDEGEGEDIADKIEEVAKKIGVFKRPYILINGKVKL

SEQ ID NO: 13745 - DNA, 429 bp, Unknown
  Obtained from environmental sample
  misc_feature (1)..(429): n is a, c, g, or t
ttgaatatatatatttacggtgaactatcttttaaaatggaaattcataaaattttagaccatgggaatatacggtttaaaattggagatggtgaagttattgatgttgagtacctttatgatcttgaagagcttattgaagaagatcctactcaaatatttataatcgatcaaaataaaattatagaagatagtgtaacgactaaactctttaaattcttaataccaaaagatgggataacacaaaaatatttagaccattatggtatgggggatgttagcattcgaacctataaagaccttatgattcatatagaaaaaaggttagaatttatagaaaactcaaaacctaaagcacatgaaatcacttctatagaggatatgttagaggatgatactctagaggctattagtaaatctcttaactag

SEQ ID NO: 13746 - protein, 142 aa, Unknown
  Obtained from environmental sample
  misc_feature (1)..(142): Xaa is any amino acid
MNIYIYGELSFKMEIHKILDHGNIRFKIGDGEVIDVEYLYDLEELIEEDPTQIFIIDQNKIIEDSVTTKLFKFLIPKDGITQKYLDHYGMGDVSIRTYKDLMIHIEKRLEFIENSKPKAHEITSIEDMLEDDTLEAISKSLN

SEQ ID NO: 13747 - DNA, 570 bp, Unknown
  Obtained from environmental sample
  misc_feature (1)..(570): n is a, c, g, or t
atggaagatttactacatcaaggcgaacaagaaggttatatagaaattgacaaagaaacaaactatataacatatgtacaccaaaagaaaagaagaaattttaataatccagaagaaaaaatacaagcacaaacttttttaaaattgattttagaatacaaatatccagttgaaaatattgaacaatttgttactgtacaaatgggtgttgcaaaaaaagaagctgatattatcgtttacaatgataaagaacatctatctccttatatcatcgttgagtgtaaaaaagaggatatttcagaattagaatttaaaaccgcagttaatcaagcttttagttatgctgtaagtgagggtgcaaagtttgtttggacaacttcaggcatcaaaaatgaatgttatcaagtacccaagaaaaagccaaaagatagaattacaatcgttgatattccaccatttggtgaaaagtttgtacctaaatttaaatatgtaaagggtgatcctaaatatcacgaattagaagtcgtaagtgaagataatcttactaaaagatttaaaccagccacataa

SEQ ID NO: 13748 - protein, 189 aa, Unknown
  Obtained from environmental sample
  misc_feature (1)..(189): Xaa is any amino acid
MEDLLHQGEQEGYIEIDKETNYITYVHQKKRRNFNNPEEKIQAQTFLKLILEYKYPVENIEQFVTVQMGVAKKEADIIVYNDKEHLSPYIIVECKKEDISELEFKTAVNQAFSYAVSEGAKFVWTTSGIKNECYQVPKKKPKDRITIVDIPPFGEKFVPKFKYVKGDPKYHELEVVSEDNLTKRFKPAT

SEQ ID NO: 13749 - DNA, 408 bp, Unknown
  Obtained from environmental sample
  misc_feature (1)..(408): n is a, c, g, or t
ttgagttgtgttgttaaaaaaaatgaaaataccattaatgtacaggctattaattattctcagaaatatctaataggaagttatagcttggaattattgaccttgccacgcattaaaattgaggatgtgaagattaaagcgtctgaaacaaccgtaattgaagttcctcaaccaggcttggcaactatatttaaacctacttatggaccgtgcgacttattcattaaaattgatggtaagatggaatgggtttgtgctattgatagtagggttcttcgtaaaacattaacacttcaacctggaaattatcacgttgtatttagaagcaaaacagtacgcttatctcactatacaaaaaagcgtgcttttgtaattattcctggaagttcaatctcagttcgtttgtaa

SEQ ID NO: 13750 - protein, 135 aa, Unknown
  Obtained from environmental sample
  misc_feature (1)..(135): Xaa is any amino acid
MSCVVKKNENTINVQAINYSQKYLIGSYSLELLTLPRIKIEDVKIKASETTVIEVPQPGLATIFKPTYGPCDLFIKIDGKMEWVCAIDSRVLRKTLTLQPGNYHVVFRSKTVRLSHYTKKRAFVIIPGSSISVRL

SEQ ID NO: 13751 - DNA, 849 bp, Unknown
  Obtained from environmental sample
  misc_feature (1)..(849): n is a, c, g, or t
ttggtcaagatcggctcgagtgtcgttgagcttattcgagcatcacaaaatccagcagaagcaaaagcagagcttatttctcgttttgatctttcagaaattcaggctcaatccattctggatatgcgtttgcaacgtttgacaggtttagagcgtgataaaatcatcaaggattatgaagagatcatggcagttatcaccaaactgaaagagatccttggtgatgaaaaactggttatgaagattattcgtgaagagtttgttgaaataaaagaaacctatggtgacgagcgacgtactgaaataattgatgctgtagatgagatccttcctgaagatatgattacccaggaagatatggcggtaacggtaacccataccggctatattaaaagaaatcctgtatctatttatcgttcccagcgtcgtggtggcaaaggagtggttggtgtgaaaaacatcgaggaagattttgtttcaaacctctttgtggcttccactcatgatacatttctcttctttacaaacctgggtaaggttttctggcgtaaggtgtatcagttgcctcttgccggacgaaccgctcgtggtaaggctatagttaatcttcttgaacttgcagacggtgaaaaagtagctgcaatccttcctgttgttgatcttggtaaagaagaaaataacaataccattctcatggtcacaaaacttggtcgcgtgaagaaaacaagccttcaggaatttgtgaagccattgaaacgtggaaagaaagcactgaccattaatgaagatgatgagattatctcaacccacattttaaagggtgatgatactatttttcctcctttctaa

SEQ ID NO: 13752 - protein, 282 aa, Unknown
  Obtained from environmental sample
  DOMAIN (227)...(274): DNA gyrase C-terminal domain, beta-propeller
  misc_feature (1)..(282): Xaa is any amino acid
MVKIGSSVVELIRASQNPAEAKAELISRFDLSEIQAQSILDMRLQRLTGLERDKIIKDYEEIMAVITKLKEILGDEKLVMKIIREEFVEIKETYGDERRTEIIDAVDEILPEDMITQEDMAVTVTHTGYIKRNPVSIYRSQRRGGKGVVGVKNIEEDFVSNLFVASTHDTFLFFTNLGKVFWRKVYQLPLAGRTARGKAIVNLLELADGEKVAAILPVVDLGKEENNNTILMVTKLGRVKKTSLQEFVKPLKRGKKALTINEDDEIISTHILKGDDTIFPPF

SEQ ID NO: 13753 - DNA, 570 bp, Unknown
  Obtained from environmental sample
  misc_feature (1)..(570): n is a, c, g, or t
ttgatggctgagattggtaacagacaacgaaggaacatacttgatgggtcatttagatttgatattacagatattgacaaagacaaaagaatcattagaagcataggtatgttggctgacacccctatatttagagatatgatgggcaaaaagttctacatgacttttccgcctgacgttgtagagcgtatggccttcaagttcatgaaagatcaacacaccaaaaatataaacaaggagcatgacggtacggatcaagtgaacaatgtttacgttgtagagacttttctacataacgagaagagaaacggtaagttacctgaatacttatcgcatgctacacccggtagttgggttctgtcattcaaagttgaggacgaccagctgatggatgacataaatacgggtaaggttaacggtatttcacttgagggagattttggtttaaagttaaatttctcagaaaattttgttggaatagataaaagtattatcttagacaaaaatattagcacagttggtaagtttaatgctattaagaaagcggtaaatgaaaatcgacaaaactaa

SEQ ID NO: 13754 - protein, 189 aa, Unknown
  Obtained from environmental sample
  misc_feature (1)..(189): Xaa is any amino acid
MMAEIGNRQRRNILDGSFRFDITDIDKDKRIIRSIGMLADTPIFRDMMGKKFYMTFPPDVVERMAFKFMKDQHTKNINKEHDGTDQVNNVYVVETFLHNEKRNGKLPEYLSHATPGSWVLSFKVEDDQLMDDINTGKVNGISLEGDFGLKLNFSENFVGIDKSIILDKNISTVGKFNAIKKAVNENRQN

SEQ ID NO: 13755 - DNA, 387 bp, Unknown
  Obtained from environmental sample
  misc_feature (1)..(387): n is a, c, g, or t
atgaaaatcgacaaaactaatatagtagtctattcagacgtagaaaaggtagagctcttagaacatctaaaagataagggagaagttgcaccaagcggctggcagttgattcataaagaacaatgcggccccaacgaattggaaacgccaatcaaagaaattttattaaaactttcaggattcaagtttgcagttggaattgttagcaaccctgacctcgttagctttttagataaaggacaaatcanagttaggtataggtatgttcttgatccttctcacttcggagagagaccaatcaagtcaaatactagagaattttgcgaacgtttgataagagctgataaaatttacagacgggaggatataaatattatggagttttag

SEQ ID NO: 13756 - protein, 128 aa, Unknown
  Obtained from environmental sample
  misc_feature (1)..(128): Xaa is any amino acid
MKIDKTNIVVYSDVEKVELLEHLKDKGEVAPSGWQLIHKEQCGPNELETPIKEILLKLSGFKFAVGIVSNPDLVSFLDKGQIXVRYRYVLDPSHFGERPIKSNTREFCERLIRADKIYRREDINIMEF

SEQ ID NO: 13757 - DNA, 708 bp, Unknown
  Obtained from environmental sample
  misc_feature (1)..(708): n is a, c, g, or t
ttgttattgttgatgagtgtcaccatataccagcactctacttttgaaaaaattataaagcaattttgtggaaaatatatcttaggactgagtgcaacaccaaatagaaaagatgggatggaaccacttatttatcaacagttaggttcaatagcatatgaggtaaaaagtaaaaaagtatttacaaataaattaaaaatagtagaaactgattttataagtaatgtggataattttgcagacttagtaaacgaaatgataaatgatgagaagagaaataatgtaatcatagagcaaattatccaatacaaagatagaaaaattttacttttaactgatagaatagagcatattgataatttagaattgatattaaaatctcaacaaataccgtatgttgcgattcatggaagtttaaataaaaatgatcaaaagataaatatggaaaaagtaaataatgcctcattagtaatagcaacaacttcttattttggagaggggatagattttcctcatctaaatactataatatttgcaactccaatatcttattatggaagattggttcaatatcttggtagaatagggaggggagggagtgattgtttagcaatagatatacttgatatacaaaatccttttgccttaagtagctataaaaaaagaaaagatgggtacaaacaattacactatataaagtctaaatga

SEQ ID NO: 13758 - protein, 235 aa, Unknown
  Obtained from environmental sample
  DOMAIN (124)...(199): Helicase conserved C-terminal domain
  misc_feature (1)..(235): Xaa is any amino acid
MLLLMSVTIYQHSTFEKIIKQFCGKYILGLSATPNRKDGMEPLIYQQLGSIAYEVKSKKVFTNKLKIVETDFISNVDNFADLVNEMINDEKRNNVIIEQIIQYKDRKILLLTDRIEHIDNLELILKSQQIPYVAIHGSLNKNDQKINMEKVNNASLVIATTSYFGEGIDFPHLNTIIFATPISYYGRLVQYLGRIGRGGSDCLAIDILDIQNPFALSSYKKRKDGYKQLHYIKSK

SEQ ID NO: 13759 - DNA, 921 bp, Unknown
  Obtained from environmental sample
  misc_feature (1)..(921): n is a, c, g, or t
atggttttctgtggcttggagcgaaatctgggttttgattcaattgaggaatgttttgaggatttgactccctacatttcagctgtagaaaccggcttgtctaccaacgctccgatgaatgggatgtgcagttttctcgacaaatacacattgttatcaaattccgatgcccattcacctgaaaaattgggacgtaatgccaatatcatggattgtgacttatcctacaacggaatcatcgattcaatgaaaaatggtgataattttgtcggtacaatcgatatgtatccacaggaaggaaaatatcattacgatggacatcgaaaatgcggagtctgttataatcctgttgaaacgatggaaaacaatgggatatgcaccaaatgtggacgtaaaataacagtgggtgtgatgaatcgaattgtacaattatccgatagagcaaatttacaggaacggccaaatcggaaaccttttcactccattattccgttaaaagaaattctatcggaaattactggtgttagtccttcaacaaaaactgtggcaagaaaatataatgaaattcttaccaatctgggaagtgaactggatattttgctaaacaaaccaattgatgaaattgaaaaaaatgctggcaatgtgctggccgaagcaattgatcgcatgcggaacaacaaagttcatgtcaaagaaggttttgacggagagtttggagtgataaaagttttttctgaaggtgaactgcttcaaaataaaaatgaaccaaaattatttcccgaaaaagtaaaaaaagagattgatcattacaaaagtcaaaatttattgaatttttctttggaaaggtttcatgaactttttagaaataatccgaatgtcgattttactaaagaaaagaaatttccaaatcagattaaataa

SEQ ID NO: 13760 - protein, 306 aa, Unknown
  Obtained from environmental sample
  misc_feature (1)..(306): Xaa is any amino acid
MVFCGLERNLGFDSIEECFEDLTPYISAVETGLSTNAPMNGMCSFLDKYTLLSNSDAHSPEKLGRNANIMDCDLSYNGIIDSMKNGDNFVGTIDMYPQEGKYHYDGHRKCGVCYNPVETMENNGICTKCGRKITVGVMNRIVQLSDRANLQERPNRKPFHSIIPLKEILSEITGVSPSTKTVARKYNEILTNLGSELDILLNKPIDEIEKNAGNVLAEAIDRMRNNKVHVKEGFDGEFGVIKVFSEGELLQNKNEPKLFPEKVKKEIDHYKSQNLLNFSLERFHELFRNNPNVDFTKEKKFPNQIK

SEQ ID NO: 13761 - DNA, 945 bp, Unknown
  Obtained from environmental sample
  misc_feature (1)..(945): n is a, c, g, or t
atggatcagaatcggctcgagggaggttttgaaactaaaagtgtcaaacctaccaaaaatttattttgtcaaaactggcctataacattgagctcaagatcgaagaactgcagaggagaactttcaagtgatgcatataaaggcaaatattcattaaagctgattctagaaggtgataaaaaaactaatgacctttggacaggacaaaaaataaaagttactcctggaacaaaactgggcttcaaattttacgcaaaaggagctaaaggaggaaggttttatatccagtttatgccgcaagttggtacaaaatatttaaaatcagcctggcttgtgaattctctctctccaaaatggactgaaatatccggcagctatgttgttcctgaaaacgttcgctatgtacactgcttaattcatatagtaaaacagaaaggcgcaagttattttgatgaatttgaattgactttagatagtagcacagttttaagcaacaagagtatttcattgattattaatccaattctcggtggttgtattgatagtttcattgacaaaaaagatggatttaattatacaatagctagacagcccggcaaagctggcggtatgggactggatattctgccggggaatcaacatccaggattgttcgccaattctatatataaaagtgaagttattgttccatataaaaaaatacaagtatcacacactctcacatccaagaaattgcgtggtttgaatatttgtaaaacatacagcctgccttccgatgataaagctaaagcagaaataaacgtaaaaataacaaataaaagtgacaagactttgtcatttgtctaccgtgcgcaaaatgtaataaatcctgataatggaatatttttcgttcccctcacggggactggctttactttatttaacaaaaactcccaaatccaataa

SEQ ID NO: 13762 - protein, 314 aa, Unknown
  Obtained from environmental sample
  DOMAIN (2)...(158): Carbohydrate binding domain
  misc_feature (1)..(314): Xaa is any amino acid
MDQNRLEGGFETKSVKPTKNLFCQNWPITLSSRSKNCRGELSSDAYKGKYSLKLILEGDKKTNDLWTGQKIKVTPGTKLGFKFYAKGAKGGRFYIQFMPQVGTKYLKSAWLVNSLSPKWTEISGSYVVPENVRYVHCLIHIVKQKGASYFDEFELTLDSSTVLSNKSISLIINPILGGCIDSFIDKKDGFNYTIARQPGKAGGMGLDILPGNQHPGLFANSIYKSEVIVPYKKIQVSHTLTSKKLRGLNICKTYSLPSDDKAKAEINVKITNKSDKTLSFVYRAQNVINPDNGIFFVPLTGTGFTLFNKNSQIQ

SEQ ID NO: 13763 - DNA, 729 bp, Unknown
  Obtained from environmental sample
  misc_feature (1)..(729): n is a, c, g, or t
atgagtgaagaaatgttgcaaagagatttaataaaaaatcctgagaaaattggaaaatgggatttttataatataggtgctacaacaataaaagcccttaagagacataaaaaaattcgtgatattgattatggtattttggaaaggaaaaagccagatgctttaattattaatcaaaaacaagttatagctgtaattgaatataaaacacctaaagagtttagaacagaagctcaaaagaaaaaagctatcaaacaagaaattgacgttgcagaaaaactaggagcaaaaatatttatcgctactgacacaaaagaatctgtttgggtaaatgtttttacaaaaaatagaattggtgatgaaaatggaaacgagataaaatatttatttaatcctaaagatgaaaaaattgaagacttgatgttgaaaatttatgattccataaatgaagaaacagacaacattaagccgaaggaatttgttaatcctacaaatcttgctaaaagtatttggcaagacatttggtcagtaagtggagctaccccagaaaattgcctttatacttttgttgaactttttatcttcaaatatctgagtgatttgggagttttgaaagaaccggaaaattttgattatttaatgaatttgtataataaaagagaagaggactttgttttagaatattatgcaaacaatattcggaaaaaaataaagactttgtttccctga

SEQ ID NO: 13764 - protein, 242 aa, Unknown
  Obtained from environmental sample
  misc_feature (1)..(242): Xaa is any amino acid
MSEEMLQRDLIKNPEKIGKWDFYNIGATTIKALKRHKKIRDIDYGILERKKPDALIINQKQVIAVIEYKTPKEFRTEAQKKKAIKQEIDVAEKLGAKIFIATDTKESVWVNVFTKNRIGDENGNEIKYLFNPKDEKIEDLMLKIYDSINEETDNIKPKEFVNPTNLAKSIWQDIWSVSGATPENCLYTFVELFIFKYLSDLGVLKEPENFDYLMNLYNKREEDFVLEYYANNIRKKIKTLFP

SEQ ID NO: 13765 - DNA, 870 bp, Unknown
  Obtained from environmental sample
  misc_feature (1)..(870): n is a, c, g, or t
ttgggagttttgaaagaaccggaaaattttgattatttaatgaatttgtataataaaagagaagaggactttgttttagaatattatgcaaacaatattcggaaaaaaataaagactttgtttcctgaaaatttaattgataaaacaacaataataaatggaactatttttgtaagtaaagatcaaaaggcagtagaaggatatagtacaacatttaggacggttttgaagaaatttaataattatgggaagttggagaatattgattatgactttaagagtcagctttttgagagttttcttaaagagagtataagtaaaaaaaattggggacaattttttactccattaaaagttattcgtcccataattgaaatggctaaggatgaaattaaagagggtgctaaaatatgtgatcctgcttgtggtgttggaaaatttcttttggagcctgtagttaagagacttgatgaattttataaaattgggaaaaataatatttctccaaagattgagatacatggttttgataagggttttgataaagatgagcaaaaaacaattattttggcaaaagccaatatgcttatttatttttcagaattaataaaaaataatccagacaaaacagaggactttgccgaactttttaataatagttttactcttaaaacaaattctattcttgggactttgagtgatccagttgaagaagaatatgatttaattttaacgaatcctccttatgtgacaagtggaagtggaaatttgaaggatgagataaagaaggatggagatttggttaattactataaggtaaatgcgatgggtgttgaagggctttttatggaatggattataagggcatga

SEQ ID NO: 13766 - protein, 289 aa, Unknown
  Obtained from environmental sample
  misc_feature (1)..(289): Xaa is any amino acid
MGVLKEPENFDYLMNLYNKREEDFVLEYYANNIRKKIKTLFPENLIDKTTIINGTIFVSKDQKAVEGYSTTFRTVLKKFNNYGKLENIDYDFKSQLFESFLKESISKKNWGQFFTPLKVIRPIIEMAKDEIKEGAKICDPACGVGKFLLEPVVKRLDEFYKIGKNNISPKIEIHGFDKGFDKDEQKTIILAKANMLIYFSELIKNNPDKTEDFAELFNNSFTLKTNSILGTLSDPVEEEYDLILTNPPYVTSGSGNLKDEIKKDGDLVNYYKVNAMGVEGLFMEWIIRA

SEQ ID NO: 13767 - DNA, 609 bp, Unknown
  Obtained from environmental sample
  misc_feature (1)..(609): n is a, c, g, or t
atgcaaatcttcaaagcagcaatcggtattttaatcatcattcttctagcgtcctgcagctcgaatgacgacaaagaccagcaatacgagttcttactcacctgctatgaagactattatttaaattacgacctggaaatcactcccatcttagacgatttcgagcaggaacttatcgcagagggacatctaaaagacggttctggcaagtcgtacaaagaacttctgaactatctcaaagagaacaactatttcaaaacaccacttaagaaaattgacttcgaaaatgagatactatacaaaacgccaaagaacattgcaaaatgtggaatttctgtctttggattggactcaacggatatcgctcaaacctcctacttcaaagccgaaaggaaaattgcagaagcactagaaaataatgaggagatttctgttaatttcatatttgatgtttattctaagatattaagtgatgaagaccttgaaaagccttttgtcagacagtccatgttagtgtttttctatcgttggtattttcaaagtaagtatgatcgagatattcctattaatttgaatggggctagtgaggaggaaggttcggagtcttag

SEQ ID NO: 13768 - protein, 202 aa, Unknown
  Obtained from environmental sample
  misc_feature (1)..(202): Xaa is any amino acid
MQIFKAAIGILIIILLASCSSNDDKDQQYEFLLTCYEDYYLNYDLEITPILDDFEQELIAEGHLKDGSGKSYKELLNYLKENNYFKTPLKKIDFENEILYKTPKNIAKCGISVFGLDSTDIAQTSYFKAERKIAEALENNEEISVNFIFDVYSKILSDEDLEKPFVRQSMLVFFYRWYFQSKYDRDIPINLNGASEEEGSES

SEQ ID NO: 13769 - DNA, 792 bp, Unknown
  Obtained from environmental sample
  misc_feature (1)..(792): n is a, c, g, or t
atggctagattaaaaaaacttactcaaaaaaactttttaaaagatttataccaaatctttgactttgaaagtgaagatgaattagaaaaaagaaaagcaagactctttcctattgggaaaagtacagatgaaaatcaaacaacatcaatattcttagcttcattaagtgctgtaaaagagtttagagaagaattatttaatcaaattggaataaagaaaataaataatcaaaatattaaattacatacttatactgaaataccatctataagtaaggaagatagaccagatgggcttattgttattacaagtggcattcataatcctgtaatcgaatggatttgttttgtagaatcaaaaataggaaatcaagatatagatggaactcagattgataaatatattaaatttggaaaagaaattggcattgaacatactattacaatttcaaatcaattagtttcgacacctacagaaagtcctataaatatcgggaataggattaagtttgatttatatcattggtcttggatttatttatctgttactgctggtcgactattgaatagcaatgcaatcgaagatgaagaccatatctacattctacaagaattaagaagatattttagtacacataatggaataaaaaactatacaggtatgggaaaaaactggaaaagaattaccgaagaatttgtagacaaaagtaataaaactttaatagatgaaataatcaagtcttataaacaggaagaaaaagatatttgtttacaaatggacagaagatcctgg

SEQ ID NO: 13770 - protein, 264 aa, Unknown
  Obtained from environmental sample
  misc_feature (1)..(264): Xaa is any amino acid
MARLKKLTQKNFLKDLYQIFDFESEDELEKRKARLFPIGKSTDENQTTSIFLASLSAVKEFREELFNQIGIKKINNQNIKLHTYTEIPSISKEDRPDGLIVITSGIHNPVIEWICFVESKIGNQDIDGTQIDKYIKFGKEIGIEHTITISNQLVSTPTESPINIGNRIKFDLYHWSWIYLSVTAGRLLNSNAIEDEDHIYILQELRRYFSTHNGIKNYTGMGKNWKRITEEFVDKSNKTLIDEIIKSYKQEEKDICLQMDRRSW

SEQ ID NO: 13771 - DNA, 603 bp, Unknown
  Obtained from environmental sample
  misc_feature (1)..(603): n is a, c, g, or t
ttggtagacaaaagtaataaaactttaatagatgaaataatcaagtcttataaacaagaagaaaaagatatttgtttacaattgacagaagatactggacattatgtaaatttaaaaatcacttcaaaatctagagaagaattaatgaaaaaatctttagagcaaaataaatcaataacttcaactttctatataaatgataatacaaataaaacattttctcttgatattgattttgtatctagaaaaattgtttgttcgactaaatacacaataaataatgttaaggcaaaagcacaaacaactagattactaaatatatttttaaaagaagtttcaaatgaagatgatattctcattggtgcaatttatccaagaaggtcaaataatgttatatacaagtctttatcatcattaataaaagaaaaagaagaaattacatattcaattttaaataaagattatggagatacagtaaaagaatttgaaatcaaaataattgatgatttaggaagagattttcataggtctcaattaattgtaaaaagaatggagtcattagcacaattatttttagaaaaagtatttataatcttgaaataa

SEQ ID NO: 13772 - protein, 200 aa, Unknown
  Obtained from environmental sample
  misc_feature (1)..(200): Xaa is any amino acid
MVDKSNKTLIDEIIKSYKQEEKDICLQLTEDTGHYVNLKITSKSREELMKKSLEQNKSITSTFYINDNTNKTFSLDIDFVSRKIVCSTKYTINNVKAKAQTTRLLNIFLKEVSNEDDILIGAIYPRRSNNVIYKSLSSLIKEKEEITYSILNKDYGDTVKEFEIKIIDDLGRDFHRSQLIVKRMESLAQLFLEKVFIILK

SEQ ID NO: 13773 - DNA, 873 bp, Unknown
  Obtained from environmental sample
  misc_feature (1)..(873): n is a, c, g, or t
gtgtcattttataaatatattaaaaatcctataaaaaaagaaaaaatagatatattatattttacaagaaaatctgaattacaagatattattcatcaaaagttatttaatagatattcagatacactaaaatatttttttgatgaacaatataaaattaaagttttagaaatcaaagataatgagatagatgctgatgtaacatatattgattttctaataaaaatagtacaagttaaaattaaaataaaaaaattatttaagttaaatcagaactttgatgtaagatcaataaatgatgtaataaagagtgagtttaactttacattagatatagttacattaaagaataatttatttttaatttatgaattatctttaatgtttgaaaaaatcctcaaaaaactagatccaaaagtagtctttcttgtatgcttttatagagttgatgctatggctatgtctctagcttgtcataatctagggataaaaaccgttgaataccaacatggtgctcaaaatgacaatcatttaatgtacactagttggttacattgtcctaaaaaaggatatgaacttatacctgatacattttggatgtggggtgatataaataagcaaagaatagataaatgggctacaaagacaaataaacataaagctattataggtggcaacatgtggcttgcttacaataaaaaaattagtattggtgaaactatagaaaaaatagataatgacaagctaactatattagtatcactacagggtgatagtttcatacctgaattttttatagagtttattgaaaaatttggaagtaattataactggtattttcgagatcatccaaggatacctatatcaaaataa

SEQ ID NO: 13774 - protein, 290 aa, Unknown
  Obtained from environmental sample
  misc_feature (1)..(290): Xaa is any amino acid
MSFYKYIKNPIKKEKIDILYFTRKSELQDIIHQKLFNRYSDTLKYFFDEQYKIKVLEIKDNEIDADVTYIDFLIKIVQVKIKIKKLFKLNQNFDVRSINDVIKSEFNFTLDIVTLKNNLFLIYELSLMFEKILKKLDPKVVFLVCFYRVDAMAMSLACHNLGIKTVEYQHGAQNDNHLMYTSWLHCPKKGYELIPDTFWMWGDINKQRIDKWATKTNKHKAIIGGNMWLAYNKKISIGETIEKIDNDKLTILVSLQGDSFIPEFFIEFIEKFGSNYNWYFRDHPRIPISK

SEQ ID NO: 13775 - DNA, 915 bp, Unknown
  Obtained from environmental sample
  misc_feature (1)..(915): n is a, c, g, or t
ttgcaaaacagcgttattgatggtgttactaaaatagtaaatgattatggaaaatttatagttcttgaagatgatttgattacgagtccttactttttgaagtttatgaatgaagctttagagttttataaggatgaagagaaagtttatagtataacgggatattcatttactgatgagatagaagatattgatagtacttatatgctttctattcccagttcttggagttgggcaacttggtctgataagtggaaaacttttgaaagagattcgaataagctaaaagaatttatacaaaacaagtcaaatcataataagcttaattttgatagttcttatgattttatttctatggctaaattacaattagaaaataagattgattcatgggctatatactggtatttttcagtttttttaaaaaggggcttaactctttatccagctaaaagtttagttcaaaatattggtttcgataatagtggtgtacattgtggaaaaagtgaaaggaagaaagaattaatatcatataaacctatcttatcaaatgatatttttgagaaagaagaaaataaacaacaagttacaaatattttaagaacaaataattttacaatatggagaagcaagatgaagaatttcattaaaggaattataaaagtaaaacataaacaatttctattaatacttatttcaaaaattaaattatttttttataaaaaagatataggaaataatacatacatggataaaacagtgaatgcatttggttggaaacatataagaattggttctaatacacttattggagagcagacttggcttaatattaatggtagagtaagtaatcataaacatatacaaataggcaactattgttacctggaagaaggaacctcgagccgattctga

SEQ ID NO: 13776 - protein, 304 aa, Unknown
  Obtained from environmental sample
  misc_feature (1)..(304): Xaa is any amino acid
MQNSVIDGVTKIVNDYGKFIVLEDDLITSPYFLKFMNEALEFYKDEEKVYSITGYSFTDEIEDIDSTYMLSIPSSWSWATWSDKWKTFERDSNKLKEFIQNKSNHNKLNFDSSYDFISMAKLQLENKIDSWAIYWYFSVFLKRGLTLYPAKSLVQNIGFDNSGVHCGKSERKKELISYKPILSNDIFEKEENKQQVTNILRTNNFTIWRSKMKNFIKGIIKVKHKQFLLILISKIKLFFYKKDIGNNTYMDKTVNAFGWKHIRIGSNTLIGEQTWLNINGRVSNHKHIQIGNYCYLEEGTSSRF

SEQ ID NO: 13777 - DNA, 579 bp, Unknown; identical to SEQ ID NO: 7491
  Obtained from environmental sample
  misc_feature (1)..(579): n is a, c, g, or t

SEQ ID NO: 13778 - protein, 192 aa, Unknown; identical to SEQ ID NO: 7492
  Obtained from environmental sample
  SIGNAL (1)...(19)
  misc_feature (1)..(192): Xaa is any amino acid

SEQ ID NO: 13779 - DNA, 300 bp, Unknown
  Obtained from environmental sample
  misc_feature (1)..(300): n is a, c, g, or t
gtggtggctaaccgttttagggcgaaattattagatgctctcatgaataatatggccgacgataatttggatgatagtacaaaaatgaatataaattacaagttgcttaaaggtgttagtaaatataaagaatttcaaccaacaattaaaagatatttaagtactcatgtaaaaagtaaattcataaaaatacatccctcagagtgggaagtttttatttttctaccaacagcaaaatgggaaaaagcaggccaaagagaagtatggaaagattcagaagcgataataaaaggaaaataa

SEQ ID NO: 13780 - protein, 99 aa, Unknown
  Obtained from environmental sample
  misc_feature (1)..(99): Xaa is any amino acid
MVANRFRAKLLDALMNNMADDNLDDSTKMNINYKLLKGVSKYKEFQPTIKRYLSTHVKSKFIKIHPSEWEVFIFLPTAKWEKAGQREVWKDSEAIIKGK

SEQ ID NO: 13781 - DNA, 483 bp, Unknown
  Obtained from environmental sample
  misc_feature (1)..(483): n is a, c, g, or t
atgtttagcaccaacaaaaaaacaaaagacacgcaatttaaaattgaaatacctaatttaccttcgataaaagagtttaccgaaggtaattctgattcggtaaaggaaaataataccccagaattactcgtcaatattaatgatagtctgactaatatttataaaaaatctatattggataattctgattcggcaaaatcttctaccgaaggtaattctgattcggtaaaggaaaataataccccagaattactcgccaatattaatgatagtctgactaatatttataaaaaatctatattggataattccgagcaaaagaaagaaaagcagcatacagacagtaatgacatctttggagaaattaatagaaacctgagtaatatttataaaaaatcaataatgagtgcgaaacgtttaacgataatatcgaaaaatacaggcaatatttatagagagattctaaaacaaataagaacctga

SEQ ID NO: 13782 - protein, 160 aa, Unknown
  Obtained from environmental sample
  misc_feature (1)..(160): Xaa is any amino acid
MFSTNKKTKDTQFKIEIPNLPSIKEFTEGNSDSVKENNTPELLVNINDSLTNIYKKSILDNSDSAKSSTEGNSDSVKENNTPELLANINDSLTNIYKKSILDNSEQKKEKQHTDSNDIFGEINRNLSNIYKKSIMSAKRLTIISKNTGNIYREILKQIRT

SEQ ID NO: 13783 - DNA, 507 bp, Unknown
  Obtained from environmental sample
  misc_feature (1)..(507): n is a, c, g, or t
atgttaaacgttgcattatttggccctccaggagccggcaaaggtacacagtcggaaaaactgttacagaaatacaatctcacatacatttcaacaggcgatatgctacgatcagaaattgctgaaggctcagcattgggtcttgaagcaaaatctgttattgccaaaggtggattggttgacgatgaattgattgttcgcattattgaaaaaaaaatccgtacaaaccccgattcaaaagggattctattcgatggttttccacgtacaaccgtgcaggcatatattcttgaaggtttattgttaaagctaaatagttcactcgattgcatggttagtcttgatgctcccgatcaggaattgattgatcgattattgctcagggcaaaaacatcaggacggagtgatgacacactcgatgttatcaaggtcaggctgaaagaatacgagngaccaaacaaaaacagtttgctgatttttatgacaaaagaagtaagttatttgtaa

SEQ ID NO: 13784 - protein, 168 aa, Unknown
  Obtained from environmental sample
  DOMAIN (6)...(165): Adenylate kinase
  misc_feature (1)..(168): Xaa is any amino acid
MLNVALFGPPGAGKGTQSEKLLQKYNLTYISTGDMLRSEIAEGSALGLEAKSVIAKGGLVDDELIVRIIEKKIRTNPDSKGILFDGFPRTTVQAYILEGLLLKLNSSLDCMVSLDAPDQELIDRLLLRAKTSGRSDDTLDVIKVRLKEYEXPNKNSLLIFMTKEVSYL

SEQ ID NO: 13785 - DNA, 615 bp, Unknown
  Obtained from environmental sample
  misc_feature (1)..(615): n is a, c, g, or t
ttgttcaagcaaatcgccttttatgaagaatccacaaatataccatttgtgataagcggaaaaaatctcggaaaacctgattcagaaaataaagacctgctggtaacttcgctcgacttgttccctactttatgtgatattgccaaaataactccacctgaaggcttgcagggaaaatcattgatcccatatattaatggtgaaaaaacagctaaagaagatgactatatcgtttctgaatgggtttcagaatatatgtttaccgtttctcccggacgcatgattcgctctaaacgctacaagtacatcaactatctcgaaggaaaaagtgaagaattgtacgacatagaaaaagatcccggcgagacccataatctggcaccgctggcggaatataagaaaattttggtttcacaccgtgatattttgaaaaaacatgtcaaagatactaaggacagctatttctctctgcccgtactagttgacaagcgatatcgcagccacactcccggatatcccaatcatacaggcagtaacgcaataactgaagggcgtgaggaaaaaactggacatgaagagaaaaattataaaaccctcatgactaagctaaaataa

SEQ ID NO: 13786 - protein, 204 aa, Unknown
  Obtained from environmental sample
  misc_feature (1)..(204): Xaa is any amino acid
MFKQIAFYEESTNIPFVISGKNLGKPDSENKDLLVTSLDLFPTLCDIAKITPPEGLQGKSLIPYINGEKTAKEDDYIVSEWVSEYMFTVSPGRMIRSKRYKYINYLEGKSEELYDIEKDPGETHNLAPLAEYKKILVSHRDILKKHVKDTKDSYFSLPVLVDKRYRSHTPGYPNHTGSNAITEGREEKTGHEEKNYKTLMTKLK

SEQ ID NO: 13787 - DNA, 618 bp, Unknown
  Obtained from environmental sample
  misc_feature (1)..(618): n is a, c, g, or t
ttgttacaaagcaaatcgcncttttatgaagaatccacaaatataccatttgtgataagcggaaaaaatctcggaaaacctgattcagaaaataaagacctgctggtaacttcgctcgacttgttccctactttatgtgatattgccaaaataactccacctgaaggcttgcagggaaaatcattgatcccatatattaatggtgaaaaaacagctaaagaagatgactatatcgtttctgaatgggtttcagaatatatgtttaccgtttctcccggacgcatgattcgctctaaacgctacaagtacatcaactatctcgaaggaaaaagtgaagaattgtacgacatagaaaaagatcccggcgagacccataatctggcaccgctggcggaatataagaaaattttggtttcacaccgtgatattttgaaaaaacatgtcaaagatactaaggacagctatttctctctgcccgtactagttgacaagcgatatcgcagccacactcccggatatcccaatcatacaggcagtaacgcaataactgaagggcgtgaggaaaaaactggacatgaagagaaaaattataaaaccctcatgactaagctaaaataa

SEQ ID NO: 13788 - protein, 205 aa, Unknown
  Obtained from environmental sample
  misc_feature (1)..(205): Xaa is any amino acid
MLQSKSXFYEESTNIPFVISGKNLGKPDSENKDLLVTSLDLFPTLCDIAKITPPEGLQGKSLIPYINGEKTAKEDDYIVSEWVSEYMFTVSPGRMIRSKRYKYINYLEGKSEELYDIEKDPGETHNLAPLAEYKKILVSHRDILKKHVKDTKDSYFSLPVLVDKRYRSHTPGYPNHTGSNAITEGREEKTGHEEKNYKTLMTKLK

SEQ ID NO: 13789 - DNA, 981 bp, Unknown
  Obtained from environmental sample
  misc_feature (1)..(981): n is a, c, g, or t
gtggtggatcatctatcctttactatcccttacgatggtttgattgagatacggggtgaagttgttatcaaaaaagatgactttctcaaaataaatcaagaacgattagcaaatggggagcccacttttgcaaacccacgaaatgcagcagcaggaagtttacgacaacttgattcaagtatcactgcaaaacgaaaactctttttcaatgtttggggtgtgggacaaaactctttaactttttcaaaaagcagtgaggtgataaacttcatccactcttttggtttctcaaaaccaccaattcaaactatctgtactacagttgaagagattgaagcagtgtatcacgagattatcaaacaaagagatactatctctatgggtcttgatggtatggttatcaaaatagattccctagaagcacaaagtgatttaggatatacagtaaaattcccacgatggtcttgtgcctataagtttccagcagttgaaaaaactacaaaacttcttgatattattttacaagttggaagaactggtgctattactcctgttgcaattgtagagccaacacttattgatggttcaactgttagtcgagcgacacttcataactttgatgagatacaaagactggatttaaaaattggcgatgaagttatcatcattaaaagtggagatatcatcccaaagattacaaaagtttttactgatagaagagatgggagtgaaaaagagataataccacctacgaactgtccaaaatgtgatagtgaacttttagttgaagatatacttatcaagtgtcagaaccttgattgtccaagtcgtgtggtcaatagtatcatctattttgcatctaaaaattgtatgaatatagatggtctttggccacagatagtagaattacttgntaacaaagaaaaaatcaaagatgtacttgatttgtataggttaaatacgaagatttggatggtttaa

SEQ ID NO: 13790 - protein, 326 aa, Unknown
  Obtained from environmental sample
  DOMAIN (251)...(276): NAD-dependent DNA ligase C4 zinc finger domain
  misc_feature (1)..(326): Xaa is any amino acid
MVDHLSFTIPYDGLIEIRGEVVIKKDDFLKINQERLANGEPTFANPRNAAAGSLRQLDSSITAKRKLFFNVWGVGQNSLTFSKSSEVINFIHSFGFSKPPIQTICTTVEEIEAVYHEIIKQRDTISMGLDGMVIKIDSLEAQSDLGYTVKFPRWSCAYKFPAVEKTTKLLDIILQVGRTGAITPVAIVEPTLIDGSTVSRATLHNFDEIQRLDLKIGDEVIIIKSGDIIPKITKVFTDRRDGSEKEIIPPTNCPKCDSELLVEDILIKCQNLDCPSRVVNSIIYFASKNCMNIDGLWPQIVELLXNKEKIKDVLDLYRLNTKIWMV

SEQ ID NO: 13791 - DNA, 693 bp, Unknown
  Obtained from environmental sample
  misc_feature (1)..(693): n is a, c, g, or t
atgttaaaacttaaccacatactaccttctattgctattgttaccagtaatgaaaaaaaactaaaaagtattcaatcattttttaaagagaaaagaattaacattgctactattatcattactgaaaatacgcccttagaccttgttaaccaaaagcaatacgatgtttttttagtagaactacacctggctcaatttgatggtatagaagtttgtgaaatcattaaaaagaaattcgacaaagcaagtattatacttgtttcagaagaaacccaagaatacattcaggtggaagcttacaaagcaggagcagatgattttattactccaaccatacaacctaaattgctattgaaaaagatagacgctttgctaaaaagaaaaatcatagcaaaaaacgaaacaaaatcgaatatttaccacaactccataaaagtaaatagagaaagttatttaattgaaaaagataaccaagaaatttctcttcaaaaaaaacagtttgaattactttaccttctcatcagtaatcctaaaagaatttttaccagggacgaactctataattctgtttgggaaaatacagataataacaatccaagaattattgatgtacatattagaaaaattagagaaaaagtaggagaaaacatcatcaaaaccattaaaggtagaggttatcgttttgccgaataa

SEQ ID NO: 13792 - protein, 230 aa, Unknown
  Obtained from environmental sample
  DOMAIN (9)...(129): Response regulator receiver domain
  misc_feature (1)..(230): Xaa is any amino acid
MLKLNHILPSIAIVTSNEKKLKSIQSFFKEKRINIATIIITENTPLDLVNQKQYDVFLVELHLAQFDGIEVCEIIKKKFDKASIILVSEETQEYIQVEAYKAGADDFITPTIQPKLLLKKIDALLKRKIIAKNETKSNIYHNSIKVNRESYLIEKDNQEISLQKKQFELLYLLISNPKRIFTRDELYNSVWENTDNNNPRIIDVHIRKIREKVGENIIKTIKGRGYRFAE

SEQ ID NO: 13793 - DNA, 912 bp, Unknown
  Obtained from environmental sample
  misc_feature (1)..(912): n is a, c, g, or t
atgatgcataatgatgaattaattctaataaataagagatttatggagttttttaatgttcaagatatagaagaatttactaaaaaatatcaagatattaatagattgctaatagagcataaggagtttttgtactctacttcaaataaaaattggtacaacgttgccacatctaattcaggaaaactttttcatacaaaaattgaaaatcacaaaggtgaaaaacgtcacttaattttaaagtctcgtgaaattcctgaaaaagagggacattttatcttatcttttgatgatgttacagagctaaacttgatgtcactttatgatagagatgcaactcaaaatgatagattaactaaagataataaagcaattatagatttaatgcaagttgtaaaagagaactcggcagaagttaaaatacataatttttataaaggattaacaattgtaaatcctgccgtcattgttaaaattgatgaaggagaactcactcttaaaagtgtaaatactcaactaaaaattatacagatagaaaaatctatgctgattacatcagaactctttcctacaaatatactttgtaaatccattaaaaatatagatattgataatcaaagtatattaatcaacgattttaactttactatgaaaagtgctatagatagggaatatatccgtttagtgccagaagatactcatggatgtagtatattttataaagatataagattagcaggtaaaacacgtatcttggatatttctgaagtttcagtaaaaattgagattgattccctacccccagggataactattgattctgttatgaaaatatcaataaaaataaatttaaatggtcatctgacatcaataacaactgatgcaaaaatttttaaaattgatgaaacttaa

SEQ ID NO: 13794 - protein, 303 aa, Unknown
  Obtained from environmental sample
  misc_feature (1)..(303): Xaa is any amino acid
MMHNDELILINKRFMEFFNVQDIEEFTKKYQDINRLLIEHKEFLYSTSNKNWYNVATSNSGKLFHTKIENHKGEKRHLILKSREIPEKEGHFILSFDDVTELNLMSLYDRDATQNDRLTKDNKAIIDLMQVVKENSAEVKIHNFYKGLTIVNPAVIVKIDEGELTLKSVNTQLKIIQIEKSMLITSELFPTNILCKSIKNIDIDNQSILINDFNFTMKSAIDREYIRLVPEDTHGCSIFYKDIRLAGKTRILDISEVSVKIEIDSLPPGITIDSVMKISIKINLNGHLTSITTDAKIFKIDET

SEQ ID NO: 13795 - DNA, 831 bp, Unknown
  Obtained from environmental sample
  misc_feature (1)..(831): n is a, c, g, or t
atgaacttgcatgacataccagttaaatttagactaatacttgcatttagtacaagtataattgtaactgttgttatctctatttttagtattcttgagattaaaaaaggcggagaaattacaaaaaatatatttaagcatccatatgttgtaagtaactcaataaagcaggttcaaatagattttctaaaaatttataatttagaattacatttaacagcagattctaaaacccaaaatataaaagatattgctatggagatagagagacttcatcataatattcttgaaaactttaatattatcaccaaatattatttgggaccaaaaaatgatattaaaactccttatgacttttatcttaaaacgtatggatacagaaaaaatttagtagactttatcaaatctaataatcaaataaatataatagatcatactaaagagggctctattatagagcctactaattttgataatcagattcttaaattaaaaatatttgcagacaataaagcaaaagagtttttttctaacgttaaagaacaagaagagaaagtaattaaatatcttattattactctaatattttttataattatgagtttaataattgccataacaattacgaaaagtattataaaaccattaactaatcttgttaatatcacaaataaaatacatgaaggtgatttaacaattataaacttacaagctacaaaagatctagcaaaaagaggtgatgaaataggtttactttgtaactcctactataatttactcaactatttactacttccatatagagatattataaaaataacgctccattag

SEQ ID NO: 13796 - protein, 276 aa, Unknown
  Obtained from environmental sample
  DOMAIN (190)...(265): HAMP domain
  misc_feature (1)..(276): Xaa is any amino acid
MNLHDIPVKFRLILAFSTSIIVTVVISIFSILEIKKGGEITKNIFKHPYVVSNSIKQVQIDFLKIYNLELHLTADSKTQNIKDIAMEIERLHHNILENFNIITKYYLGPKNDIKTPYDFYLKTYGYRKNLVDFIKSNNQINIIDHTKEGSIIEPTNFDNQILKLKIFADNKAKEFFSNVKEQEEKVIKYLIITLIFFIIMSLIIAITITKSIIKPLTNLVNITNKIHEGDLTIINLQATKDLAKRGDEIGLLCNSYYNLLNYLLLPYRDIIKITLH

SEQ ID NO: 13797 - DNA, 303 bp, Unknown
  Obtained from environmental sample
  misc_feature (1)..(303): n is a, c, g, or t
atgaagatcgattatcacctgcacggagagttcagctccgacagcagaatggattatgataaattatgtactaaagctatagagaatggctatagtgagattgccataacagagcattttgattttcttgcttccgaaatatatcattttgggataccatcatataaagattacttcaaacgaattaagcagatcaaaaataattatccaaattttagaattatttttggtgtagaattaggagaatatcacagaattaaggatatggcagacgctattatggcctgtcagaacctgagctaa

SEQ ID NO: 13798 - protein, 100 aa, Unknown
  Obtained from environmental sample
  DOMAIN (3)...(82): PHP domain N-terminal region
  misc_feature (1)..(100): Xaa is any amino acid
MKIDYHLHGEFSSDSRMDYDKLCTKAIENGYSEIAITEHFDFLASEIYHFGIPSYKDYFKRIKQIKNNYPNFRIIFGVELGEYHRIKDMADAIMACQNLS

SEQ ID NO: 13799 - DNA, 948 bp, Unknown
  Obtained from environmental sample
  misc_feature (1)..(948): n is a, c, g, or t
atggccgttacagagatagaagacaatgtaaaatctttagaaggtgtgattgaaactactacagtaataagtcctgggaaattttctattattttagagctacaaaaagggaaagatagatataacatagctgataaagttaaggatgcagtagctttaactaaaggagaccttcccattgatatggatgaaccaactgtaagtgtaatagatagaagtagagatcttataaatatctcgcttacttctgaaaaactcaatgtagatcaaatgaaaaaatttgcagatgattttaaaagtgaaattctaacaattagtggtattagtgaagttactgtatttggagatagtgataaatattatgagattcttttagatgataaaaaacttgaagcgtataatatagataaaaatgaacttttcaatacaattagtacactttcttatatatttccaattggaaaaatagaaggggcaacaaaacactactatatctccacatataatggagcaaaaacagcaaatgaattagcaaacacacttataaaactctcaaatgctacactttatttaagcgatattgcatcaattaaaaaaagatatgaagattcagatactttgtactcttttaatggtaaaaacgctatctctcttgcaataaagcaacttgatatcgcaaacgccatggagatatctacagatattacaaaacttatagaaaaagtacaaccaaaacaaccaaatatagagataagtattagtgatgacaatagtgatagaattaaagagagacttgatattgttggttctaatatacttattggaattattgctatcgttcttcttatatggttacttattaatgctcgaatgtcatttatcatctttataggtattcctacatcttttgttatagcagctatttataggtatctatttgggccatag

SEQ ID NO: 13800 - protein, 315 aa, Unknown
  Obtained from environmental sample
  misc_feature (1)..(315): Xaa is any amino acid
MAVTEIEDNVKSLEGVIETTTVISPGKFSIILELQKGKDRYNIADKVKDAVALTKGDLPIDMDEPTVSVIDRSRDLINISLTSEKLNVDQMKKFADDFKSEILTISGISEVTVFGDSDKYYEILLDDKKLEAYNIDKNELFNTISTLSYIFPIGKIEGATKHYYISTYNGAKTANELANTLIKLSNATLYLSDIASIKKRYEDSDTLYSFNGKNAISLAIKQLDIANAMEISTDITKLIEKVQPKQPNIEISISDDNSDRIKERLDIVGSNILIGIIAIVLLIWLLINARMSFIIFIGIPTSFVIAAIYRYLFGP

SEQ ID NO: 13801 - DNA, 504 bp, Unknown
  Obtained from environmental sample
  misc_feature (1)..(504): n is a, c, g, or t
atgcttgatattaaaatagaatcactcaataaagacgattttgaaaactttaaaaatacaccaatacctataaataatggaactgtacgacttaatgaagtttgtgattttgttataaaaaaatcatttgaacaactcacaaaagataatggtgaaaaaaacttctatatctatgcaaatgtggatacaaaaatagtgacatccacagaagttatggaaaaaattcaaccacttctagatgagattaaaaaaaatggtgttaaaatagttcttaaaggggaagctaaaaagaaaaaagagttggcggctgatatgcttgcagctgccctattagcacttactcttataatgctctctatgttatatctgtttaactcatttagagaaactgctattttaatgtctgtaataccattttcatttttaggggttttaatagggcatgctcttttgggactaaatctctctatgccttctatatgggagcacaccgagccgatctga

SEQ ID NO: 13802 - protein, 167 aa, Unknown
  Obtained from environmental sample
  misc_feature (1)..(167): Xaa is any amino acid
MLDIKIESLNKDDFENFKNTPIPINNGTVRLNEVCDFVIKKSFEQLTKDNGEKNFYIYANVDTKIVTSTEVMEKIQPLLDEIKKNGVKIVLKGEAKKKKELAADMLAAALLALTLIMLSMLYLFNSFRETAILMSVIPFSFLGVLIGHALLGLNLSMPSIWEHTEPI

SEQ ID NO: 13803 - DNA, 747 bp, Unknown
  Obtained from environmental sample
  misc_feature (1)..(747): n is a, c, g, or t
atggttcaaacattgagttatacaaaaatttctttagttgttgattcactaaaagatgaagaagatattagcaacacagtagagcatctgaaatcacactataaaatagaaccaaatattatctctgcaaaagatgagctgattgatgaaaacagtagaatatatctactctatcttagtgatgaggagattaagaatttttttgaaacaaatattttaaaagatttacatctatcaatactcccaaatgagaagtgtctaaattctgctaaaagctatagtatttcaaaagatatttttgaagcaattgatgatgcacttaatcaaaagctactctctaaaattgatctactattatgtaatggaagagttgtatttaacaaagtttctataggtgatatgcatgactctcataaatatgagattcaggatataacattttttggaaaaataaaaaactttctatctcactttaacagtataaaatataataatttaacactaacaacttcaaaagaccatgttgtacaaactgctgctagcggtatcatgattttagaacatacaaactctttaaactcaagtatcagtgaagagttgtcatttcatgatggaaagttaaatgcctttatacttgcaccagcaagcctactttcatatttttattatttaatattaatttttctttataataaattttctactttttctctacctaaaaagcttgggttttataagatcctctaa

SEQ ID NO: 13804 - protein, 248 aa, Unknown
  Obtained from environmental sample
  misc_feature (1)..(248): Xaa is any amino acid
MVQTLSYTKISLVVDSLKDEEDISNTVEHLKSHYKIEPNIISAKDELIDENSRIYLLYLSDEEIKNFFETNILKDLHLSILPNEKCLNSAKSYSISKDIFEAIDDALNQKLLSKIDLLLCNGRVVFNKVSIGDMHDSHKYEIQDITFFGKIKNFLSHFNSIKYNNLTLTTSKDHVVQTAASGIMILEHTNSLNSSISEELSFHDGKLNAFILAPASLLSYFYYLILIFLYNKFSTFSLPKKLGFYKIL

SEQ ID NO: 13805 - DNA, 369 bp, Unknown
  Obtained from environmental sample
  misc_feature (1)..(369): n is a, c, g, or t
atgtttataacactaggtggaagaaacgagagaacaaatcttcaaatagttgatgctatatgtactatacttgatgagaaagttccaagagaaagctatctgccacttcaaggtgaattgagtgaaactcaagagagggaccatctgggtggaaatggtgatacccccgtcgctaaagcgaaagtggggtacaaagagttaatcactttcgtagaagacagagctggacacgatagacgctacgccatagacgcaacaaaacttgagactcagcttggttggaaagcggatgagaactttgatagtgggattgttaagactattgagtggtatttaaataagtatgtaaaggagaaagtaataaaatga

SEQ ID NO: 13806 - protein, 122 aa, Unknown
  Obtained from environmental sample
  misc_feature (1)..(122): Xaa is any amino acid
MFITLGGRNERTNLQIVDAICTILDEKVPRESYLPLQGELSETQERDHLGGNGDTPVAKAKVGYKELITFVEDRAGHDRRYAIDATKLETQLGWKADENFDSGIVKTIEWYLNKYVKEKVIK

SEQ ID NO: 13807 - DNA, 471 bp, Unknown
  Obtained from environmental sample
  misc_feature (1)..(471): n is a, c, g, or t
atgaaagtaatgttattagccggaggtttcggaacaagaatttcagaagaaacagatctcaaacccaaaccaatggtagagattggtggtaaaccaatactttggcatatcatgaagatatactcgaagtatggatataacgattttgtagtactgcttggttacaaaggatactacataaaagagtactttgcaaattattttctccaccaaagtgatgtaaccattgatatgcaagatggaagcatggaagttcttaacaactcaagcgaaccatggaaggtaacacttttagacactggacttaacagtatgactggtggccgtataaaacgtgcacaagatttcatcggagatgagccatttatgctcacttatggcgatggtgtgagtgatatcaacatagaagagcttgtagagtttcataagtctcatggtaaagcaatgacaatgacttctgctnncacctga

SEQ ID NO: 13808 - protein, 156 aa, Unknown
  Obtained from environmental sample
  misc_feature (1)..(156): Xaa is any amino acid
MKVMLLAGGFGTRISEETDLKPKPMVEIGGKPILWHIMKIYSKYGYNDFVVLLGYKGYYIKEYFANYFLHQSDVTIDMQDGSMEVLNNSSEPWKVTLLDTGLNSMTGGRIKRAQDFIGDEPFMLTYGDGVSDINIEELVEFHKSHGKAMTMTSAXT

SEQ ID NO: 13809 - DNA, 387 bp, Unknown
  Obtained from environmental sample
  misc_feature (1)..(387): n is a, c, g, or t
atgaaaaacagtaaactgaaacatttttttgagttggtagttcaagggttattttggcttttgccaatagttgttataaccatgatagttttatggttatatgataagatagatttaattgtaggcggtctctttaatctcataagttttcaccctgagaagaaccaatttttatggtttttgttagttattgctctgttctttgtacttctatattttgttggttattttatggaaacaagattggcaaactggacacaaaaaatattaaataagatacctttttactcaatcataaaagatattgtaggaatatttaattcttcaaaaaaaggcgatacaaaagttttagttgtagcaataagaggattcgcaaatgaaggttaa

SEQ ID NO: 13810 - protein, 128 aa, Unknown
  Obtained from environmental sample
  misc_feature (1)..(128): Xaa is any amino acid
MKNSKLKHFFELVVQGLFWLLPIVVITMIVLWLYDKIDLIVGGLFNLISFHPEKNQFLWFLLVIALFFVLLYFVGYFMETRLANWTQKILNKIPFYSIIKDIVGIFNSSKKGDTKVLVVAIRGFANEG

SEQ ID NO: 13811 - DNA, 774 bp, Unknown
  Obtained from environmental sample
  misc_feature (1)..(774): n is a, c, g, or t
atgccgtttagcgaggatatacttcttaaatatttttatactctagctgaaagttacagattgccgttgtcatcaagttttatgtattctccaaattttaatggagtgaaagttcatccttccgtgatgcttttttcttccgaacttctgataaacggtgacagtgttctaaaacctgaaaagatacttctgtggttaacttctgtcgatactcaactaaaggagtatccagctgacttttatgcaaacctcctttcacttaagatcgcaaaaaagctgtataccgaaaaaccatcgtttcttggtggggcagaacttcttaatatgacgactgaggttccttttgagccaattaggcagcatctgtttactgctggaacagtttccgtgtttggatcccttgacagccatctttatctctactccgaagatgttttaagtgaatattcttcatatattgatattggaaaatcaaaggcagtgaaagctttttacggttcgcctaaaaatgcttctgatattatagtttcgtttgttctgagagctcataattcagaagtgatgatagagaaaatagataagattctaactgacaacggctttgatcccatacagacaattgtggaacatatttcgcagaatgattcttggggttctatttcgatcaggacgggaatcaaaaaagaatcaaaagttcttgatatatataagaaattaaagaaattaaacagtactctttcaataggagtgtatcgtgtctcgaaagaaaactaa

SEQ ID NO: 13812 - protein, 257 aa, Unknown
  Obtained from environmental sample
  misc_feature (1)..(257): Xaa is any amino acid
MPFSEDILLKYFYTLAESYRLPLSSSFMYSPNFNGVKVHPSVMLFSSELLINGDSVLKPEKILLWLTSVDTQLKEYPADFYANLLSLKIAKKLYTEKPSFLGGAELLNMTTEVPFEPIRQHLFTAGTVSVFGSLDSHLYLYSEDVLSEYSSYIDIGKSKAVKAFYGSPKNASDIIVSFVLRAHNSEVMIEKIDKILTDNGFDPIQTIVEHISQNDSWGSISIRTGIKKESKVLDIYKKLKKLNSTLSIGVYRVSKEN

SEQ ID NO: 13813 - DNA, 738 bp, Unknown
  Obtained from environmental sample
  misc_feature (1)..(738): n is a, c, g, or t
atgatttgtaagctaaagaagaaagatgttgaagaactccaaacaacgaacatcttacctcaaacagcattctggggacgaataaaaagcaatcaagggttatctcctattgggtttgaattaactgtttcaaaaaatttattgtacaatgatacagactcctttttaaaaacaggagatgatatactagtgcttttaaaatatattgacaattctacctgttttgcttatgttccttatggccctaagttagaaccttcctttgaaaatcaagggttatttctagagcagttatcagaatcaataaaaccttttttaccagccaattgcatatttattcgttatgatttaatttgggaaaaccaatgggctatagaagatcagtattttgatgattcaggaaattggataggtgctcctagaagtcaggtacaagaatatagggtgaattttaaaaccgctaaatggaatttaaaaaaaagtgtaaacgattttcttcctaaaaataccttctttattgatttatcaataacaaagcaaaaattacttagtaatatgagatataacactaggtataatgttaaaaaagcacttatgaatggaattagtgttaaagaatatagtattgaatacatgaatgattggtacaaattatattatgatactgcagcaagacataatatgccattacaaagtcaagaatacttctctactattttaaaaaccaagacaatataa

SEQ ID NO: 13814 - protein, 245 aa, Unknown
  Obtained from environmental sample
  misc_feature (1)..(245): Xaa is any amino acid
MICKLKKKDVEELQTTNILPQTAFWGRIKSNQGLSPIGFELTVSKNLLYNDTDSFLKTGDDILVLLKYIDNSTCFAYVPYGPKLEPSFENQGLFLEQLSESIKPFLPANCIFIRYDLIWENQWAIEDQYFDDSGNWIGAPRSQVQEYRVNFKTAKWNLKKSVNDFLPKNTFFIDLSITKQKLLSNMRYNTRYNVKKALMNGISVKEYSIEYMNDWYKLYYDTAARHNMPLQSQEYFSTILKTKTI

SEQ ID NO: 13815 - DNA, 510 bp, Unknown
  Obtained from environmental sample
  misc_feature (1)..(510): n is a, c, g, or t
atgtataattacaaaatgaaaaataatgataatcacaaaacagttgttgcaaaaacgtttactccactatatgatgaactagaagatagaataagattagttataaactatgaagagatgagttctcgagttgattttatgataactaggagttttattttaaatttactgccatccatggatgagtttatactaaaacattatgcagatgatttagtagtagaagataatattacagtaaatgcaagtacaaatgctacgcagtctcaagagagaaaaaatgtatcaaagacagatggtgttaatttagaactattaaaaacagaagaggaacttttaattaaagttgatatgtcttacgatcaaaacagtaaaaactcacttttagtactttattcaaaaaatattgttgcaaaagcagttatcgatgcaaatatgtttcaacaggtgttaaaagtactaaaatcttcaataccatattttaaatggggaatatctcaaaacttttaa

SEQ ID NO: 13816 - protein, 169 aa, Unknown
  Obtained from environmental sample
  misc_feature (1)..(169): Xaa is any amino acid
MYNYKMKNNDNHKTVVAKTFTPLYDELEDRIRLVINYEEMSSRVDFMITRSFILNLLPSMDEFILKHYADDLVVEDNITVNASTNATQSQERKNVSKTDGVNLELLKTEEELLIKVDMSYDQNSKNSLLVLYSKNIVAKAVIDANMFQQVLKVLKSSIPYFKWGISQNF

SEQ ID NO: 13817 - DNA, 312 bp, Unknown
  Obtained from environmental sample
  misc_feature (1)..(312): n is a, c, g, or t
atgaatatgatgaattccggtaaatacaacttcccaaaaatcaaaaaagtaaaattgaggaatttttctttgtacacaaaaaagacatctattgaggaagatattaatattggcgttttctgtcttgctggtgctaatggtttgggtaaaacaacatttttgaatgcaataaattatggacttactggtattgttcttcaaccagaaaaagaagtatacatacctgatgaaatagttaaatggaataagggttatactgagagatattttcaaggtaggataaaagcagaagacaaagaaaagctgaaatag

SEQ ID NO: 13818 - protein, 103 aa, Unknown
  Obtained from environmental sample
  misc_feature (1)..(103): Xaa is any amino acid
MNMMNSGKYNFPKIKKVKLRNFSLYTKKTSIEEDINIGVFCLAGANGLGKTTFLNAINYGLTGIVLQPEKEVYIPDEIVKWNKGYTERYFQGRIKAEDKEKLK

SEQ ID NO: 13819 - DNA, 558 bp, Unknown
  Obtained from environmental sample
  misc_feature (1)..(558): n is a, c, g, or t
atgtcagatcggctgagagggttacggatgtcgcaaccgacaagtattgttctggccgaaaacctggggaatgacctttcgaagattgaaaatgagcttaataaattcgggatcaacttaccaaaaggaactgagattacacctgaaattattgaagaatatattgggattagcaaggattacaacgtatttgaattgcaaaatgcactgggtaaaagagatgttttaaaagtcaatcgtatcgtcaattattttggatccaaccctaaagaaaatccggcgattaaagtcaatgctattttgtttggctatttcaaaaaagtattcctgtatcatttcattaaggataaatctgataacaatttagctgcccaactttcggtgaatcgtttttttgttaaggattatcgtcaggcagcaacaaattactccacccaaaaactgcgacaggttttctccattcttcgcgagtacgatttaaaatcgaaaggtgtggaagcggcacctatggaagatggcgagattatgcgcgagatggtgtttaagattttgcactaa

SEQ ID NO: 13820 - protein, 185 aa, Unknown
  Obtained from environmental sample
  misc_feature (1)..(185): Xaa is any amino acid
MSDRLRGLRMSQPTSIVLAENLGNDLSKIENELNKFGINLPKGTEITPEIIEEYIGISKDYNVFELQNALGKRDVLKVNRIVNYFGSNPKENPAIKVNAILFGYFKKVFLYHFIKDKSDNNLAAQLSVNRFFVKDYRQAATNYSTQKLRQVFSILREYDLKSKGVEAAPMEDGEIMREMVFKILH

SEQ ID NO: 13821 - DNA, 594 bp, Unknown
  Obtained from environmental sample
  misc_feature (1)..(594): n is a, c, g, or t
ttgtattgttataattacgttataaaaaggtcattaatgattgcaaaagatttaatcaatttaaaatcacaagaagcattacaatttatagttgatgggattgatgctattatttatataatcgatatagaaaactacgagatactatatgcaaataaacactgtttagaacaatttggatccatcattggaaaaacttgctatagtgccttacaaaaagacagaaaacaaccttgtgattactgtgatcttttagataataaataccctaaagagataggttcaacttataaatgggaacatcacaatactttaaacaataaacactatatttttagtgataaaataactctcataaatgatagaaaagtcaaagttcaaattggaataaatatcacgaaacaaaaagagttagaaacaaaaattcttgaacaaaaaactaaaaacatagaaacatttgaagctttatcaaactctacaatagagggattaatcatttatgatgaaaataaaaaatgtattagcacaaatagtgtagcccctgaactatttggctacgaagctcaagaaatgattggaaaaagtgctttttga

SEQ ID NO: 13822 - protein, 197 aa, Unknown
  Obtained from environmental sample
  misc_feature (1)..(197): Xaa is any amino acid
MYCYNYVIKRSLMIAKDLINLKSQEALQFIVDGIDAIIYIIDIENYEILYANKHCLEQFGSIIGKTCYSALQKDRKQPCDYCDLLDNKYPKEIGSTYKWEHHNTLNNKHYIFSDKITLINDRKVKVQIGINITKQKELETKILEQKTKNIETFEALSNSTIEGLIIYDENKKCISTNSVAPELFGYEAQEMIGKSAF

SEQ ID NO: 13823 - DNA, 567 bp, Unknown
  Obtained from environmental sample
  misc_feature (1)..(567): n is a, c, g, or t
atgcaaagaatacgatactctctttacagcatcttagcaattacagtttctactattattattttagttatgactctctctctgagctataactatattgatacaaaaaataagttgataactaatctagcagttgattctcaaactattttaactagattacaaaagagtatattaccttttgttgaatcgtactctgtaaatgaatatgaaaaactttttttgaacgaaatgaataataaaaatatatttgcaattgtagttgaggattacaatatgggaactgttttagggacaaaaacttttattacagggaaaataagagataaaaactggagcgtaaaagaatatgaagcttcacctttaaatacaaaaaatttagagaactctttctttactcaagaggtttttgtcacctcttttgatgataaacacttagctactattacaatttattttactgataaatttatacaatcagaattaaaaatgcttattgaaaaaagtatctttatcacttttttaatctctattatacttatattttttctatttatttttaattaa

SEQ ID NO: 13824 - protein, 188 aa, Unknown
  Obtained from environmental sample
  misc_feature (1)..(188): Xaa is any amino acid
MQRIRYSLYSILAITVSTIIILVMTLSLSYNYIDTKNKLITNLAVDSQTILTRLQKSILPFVESYSVNEYEKLFLNEMNNKNIFAIVVEDYNMGTVLGTKTFITGKIRDKNWSVKEYEASPLNTKNLENSFFTQEVFVTSFDDKHLATITIYFTDKFIQSELKMLIEKSIFITFLISIILIFFLFIFN

SEQ ID NO: 13825 - DNA, 951 bp, Unknown
  Obtained from environmental sample
  misc_feature (1)..(951): n is a, c, g, or t
gtgaatatggagtttacaaaaggatggataatcatgagatctttaaattcatttttagatgtttgtacaagaaggatcacaaaagagaagattgcttcaaaattaaaacatcttagatatgcaaaaaaacgagatttttgcaaaaatgctcttgatggggtattgnatatctctgatcgttttgagtttaacacacttcttaactataaaatatttaatcaatcttttaaaaagatacatacattaaaaagtgaaactatatccctctcttttttacttgatacagatgaaaatgaaatagtagcagagataacgaaaataaaacaggagataacaaaacagaaacaacatgatttagacctatttttaaactccataaaacctgatcacagatacctctcaaaagaacagataatacagattttaaaatcatctgaacctgcaaacagtccgatagaacctgagatagatgatgaattattagagtctatattgcatcatcatgtaaaaaatcttcatgatgttagcagtgatagtgatgttgttattattaccgttttaagtagttataaatcaatacattttcaaaaaccttttgaacactttttagaagtacctctatataaagaggagctatataagcagatatggagttctgaagatattaagagtgaagagattatttttgctacgcagatggctgaagattcatttgagcatgagttagaggggctctttcatgagtgtaaaaaaacagcgcaaggtttagaaataagtgatgaagagatatatgagaaaatatatgagatactcaggagtaaacttaactctactctctatattagtcataaaatgtttacaaaagtgctcagagcttttcatttctccattcaagatgcacttcttaaacgtcaacgtcaagagctttggctagaacaattcgagatttaa

SEQ ID NO: 13826 - protein, 316 aa, Unknown
  Obtained from environmental sample
  misc_feature (1)..(316): Xaa is any amino acid
MNMEFTKGWIIMRSLNSFLDVCTRRITKEKIASKLKHLRYAKKRDFCKNALDGVLXISDRFEFNTLLNYKIFNQSFKKIHTLKSETISLSFLLDTDENEIVAEITKIKQEITKQKQHDLDLFLNSIKPDHRYLSKEQIIQILKSSEPANSPIEPEIDDELLESILHHHVKNLHDVSSDSDVVIITVLSSYKSIHFQKPFEHFLEVPLYKEELYKQIWSSEDIKSEEIIFATQMAEDSFEHELEGLFHECKKTAQGLEISDEEIYEKIYEILRSKLNSTLYISHKMFTKVLRAFHFSIQDALLKRQRQELWLEQFEI

SEQ ID NO: 13827 - DNA, 327 bp, Unknown
  Obtained from environmental sample
  misc_feature (1)..(327): n is a, c, g, or t
atgtctcaaaaaataagttcagattttaaattaggaattattggcggtggccagttaggaaaaatgttgatacaagcagcaagcaggtgggatattacaacctatgtgttagacccagacgaaaattgttcggcagccaacttatgtacaaaatattttaaggggagttttaaaaattatgatgatgtgtatcagtttgctcaggaagtagatttggtaacttttgaaatagaacatgtaaatattgatgcacttaatcaattaaccaaagagggaaaaatggtgcatccttcatcaaaagcatggctttatcagataaggatctag

SEQ ID NO: 13828 - protein, 108 aa, Unknown
  Obtained from environmental sample
  misc_feature (1)..(108): Xaa is any amino acid
MSQKISSDFKLGIIGGGQLGKMLIQAASRWDITTYVLDPDENCSAANLCTKYFKGSFKNYDDVYQFAQEVDLVTFEIEHVNIDALNQLTKEGKMVHPSSKAWLYQIRI

SEQ ID NO: 13829 - DNA, 381 bp, Unknown
  Obtained from environmental sample
  misc_feature (1)..(381): n is a, c, g, or t
atgaaaaatttagggttaatattattggtgttatttttaggattaataagcacatcaatcgcacaacaatctcatgaaaatgcatcaaaaaaaataaatgctattactaaaaaaggagattatgctattttagagttacgtttaaataatgaggatgaatttagaaccattgaaggaagcgaaaccagtttaactagggtttccatttttacaggaaaaaatcaaggggcagaagttatccgaaaaggttttgaaggaatgaatacggttgtagagattttaaatgatttaaagtcgaatggttggttgttggagcaagtttattccatgaaaggagagtctttaatcattacgcattatcttttagtgaggaaaaaatga

SEQ ID NO: 13830 - protein, 126 aa, Unknown
  Obtained from environmental sample
  SIGNAL (1)...(19)
  misc_feature (1)..(126): Xaa is any amino acid
MKNLGLILLVLFLGLISTSIAQQSHENASKKINAITKKGDYAILELRLNNEDEFRTIEGSETSLTRVSIFTGKNQGAEVIRKGFEGMNTVVEILNDLKSNGWLLEQVYSMKGESLIITHYLLVRKK

SEQ ID NO: 13831 - DNA, 612 bp, Unknown
  Obtained from environmental sample
  misc_feature (1)..(612): n is a, c, g, or t
ttgtcaattcaaaaaaattttatcctaaaaaacatgaataaattaatcttatcgcttttaaccatcctttttatactaggatgtaaaaccactgaaaccattacgcttcctgagcaagtaattgaaattgagaacccgtttaaaaccgagcgacctatctatcaggctgcttacactaaaaaatttgatttaattcacactaaattagcagtaagttttaattgggaaaaagctcacctttatggtaaagccgacattacgttacgtccgtatttttactccactcagcaattagaattaaatgcacgaggaatggatattcataaagtagcattagtagaaaatggcaacaaaaagcctttaaactttacttatgatagcttaatcattactataaatttagaaaaaatctatacccgaaatgataccctcactatttttattgattacacttctaaacccgaagaactaaaagaaggtggcagcagtgccatttcatctgataaaggcttgtattttattaatcctaaaggtgaagagaaaaataaaatgcctcaaatttggacacaaggagaaactgaagctaactctgctttggtttcctactattga

SEQ ID NO: 13832 - protein, 203 aa, Unknown
  Obtained from environmental sample
  misc_feature (1)..(203): Xaa is any amino acid
MSIQKNFILKNMNKLILSLLTILFILGCKTTETITLPEQVIEIENPFKTERPIYQAAYTKKFDLIHTKLAVSFNWEKAHLYGKADITLRPYFYSTQQLELNARGMDIHKVALVENGNKKPLNFTYDSLIITINLEKIYTRNDTLTIFIDYTSKPEELKEGGSSAISSDKGLYFINPKGEEKNKMPQIWTQGETEANSALVSYY

SEQ ID NO: 13833 - DNA, 858 bp, Unknown
  Obtained from environmental sample
  misc_feature (1)..(858): n is a, c, g, or t
atgagtgatagtggaaaaactatctttgtaaaaagctttagctttagtggaaatgtacatatcagtagtgataaactgcaagaattagcaaaagagtatgaaaacaaagatttaacctttaaagagatatctgaacttaccacaaaaatcacaaaactctatagagaaaaaggatatttcgttgcacgagcttatcttccatctcaaaatatcctaaaaaataataatgttctagagatagcaatcattgaaggtaactatggaaagtttagattaaaaaataattccctagtaaaagatagtatcgtacaaggtatgttagaccatgcaaaaagagataatatagtttcaacagatactcttgaaagagctatgcttattatcaatgacacaccagatgcaatagtaacagcagctgatgttatgccaggtagtgcggtaggaacttcagattttgctattacaacagaagcttcaaattcttatgatggatatgtagtcgttgataatacaggaagtagatataccggaaaaaacagagtaatggcaggagtaaattttaactctccttttaaaataggtgataaaatatcactgtcaggacttctatcaaatggaactaatcttaaaaatggaagagttgcatactcagctcctttgatgccaaatggtctaagaggagaagtctcttattctaaaacaacctatgccctagttgatagttataaatcacttgatgcaaaaagtaattccaccacactagatgccacattatcatatccctataaaaagaaccagaattggaaaatctctatacaaggtttaacctattgccaaataaagattttaaaagaatga

SEQ ID NO: 13834 - protein, 285 aa, Unknown
  Obtained from environmental sample
  misc_feature (1)..(285): Xaa is any amino acid
MSDSGKTIFVKSFSFSGNVHISSDKLQELAKEYENKDLTFKEISELTTKITKLYREKGYFVARAYLPSQNILKNNNVLEIAIIEGNYGKFRLKNNSLVKDSIVQGMLDHAKRDNIVSTDTLERAMLIINDTPDAIVTAADVMPGSAVGTSDFAITTEASNSYDGYVVVDNTGSRYTGKNRVMAGVNFNSPFKIGDKISLSGLLSNGTNLKNGRVAYSAPLMPNGLRGEVSYSKTTYALVDSYKSLDAKSNSTTLDATLSYPYKKNQNWKISIQGLTYCQIKILKE

SEQ ID NO: 13835 - DNA, 798 bp, Unknown
  Obtained from environmental sample
  misc_feature (1)..(798): n is a, c, g, or t
atgacagaatttaaacaaattataggacgtggaacaagagtaaatgaaaaacatggtaaaacattttttacaattatggatttagagggagtaagtagactttttgctgatccagattttgatggagatccaattcaagatgaagattatgaaagtttttcagataatgaaaaagattttgttgaatctggtgaaaaagatgaagattttggtttggaagaggaagaggtaaaagaaaaaagaattaaatattatgtggatgatgtagaagtatttttaattaataaaagagttcaatatcttgatagtaatggaaaattaataactgaatcattaactgattattctaaaaataatttaaaaaagatattcccaacattagaaagctttttaaaatcttggaactctagaaaaagaaaacaaattatcattaatgaattatcagagaaaggaatcttttttgaggaactaaaagatgaagttggaaaagattttgacgaatttgatttgatttgtcatatcgcttttgatcaaaaaccattaactaaacaagaaagaataaataatgtaaagaaaagagattattttgctaaatatagtgaaaaagcaaaagaggttttaaatattttactaaataattataaagataaaggatataaagatatcgaagatataaaaatacttaaattagaagagtttaagaaaattggttctgcaaatcaaattgtaaaactgtttggaagtaaagaagagtatcttgatgcagttgctgagttggagagtgagttgtgtagttag

SEQ ID NO: 13836 - protein, 265 aa, Unknown
  Obtained from environmental sample
  misc_feature (1)..(265): Xaa is any amino acid
MTEFKQIIGRGTRVNEKHGKTFFTIMDLEGVSRLFADPDFDGDPIQDEDYESFSDNEKDFVESGEKDEDFGLEEEEVKEKRIKYYVDDVEVFLINKRVQYLDSNGKLITESLTDYSKNNLKKIFPTLESFLKSWNSRKRKQIIINELSEKGIFFEELKDEVGKDFDEFDLICHIAFDQKPLTKQERINNVKKRDYFAKYSEKAKEVLNILLNNYKDKGYKDIEDIKILKLEEFKKIGSANQIVKLFGSKEEYLDAVAELESELCS

SEQ ID NO: 13837 - DNA, 600 bp, Unknown
  Obtained from environmental sample
  misc_feature (1)..(600): n is a, c, g, or t
atgaagaggaactttattgaacatcttttagatataactgataaaaaatatgaaaaattaagtctaaaaatttttggactttataatagagagaagtggtatcaatatgtaacaattgcatctattatacaaaaagaatctgcttcaaaagaggagatgcaccttgtttctagtgttatacataaccgtatcaacaaaggtatgaaacttcaaatggatggaacattaaattatggaaaaaattcacatattactgttacaccacagatgatcaaaaatgatacttcacaatataatacctacaaaagaaaaggggtaccagataatccaatttgtgctattgagtttgaagcaattcgctcagcaatttttccaacaaaaacaagttatctctattttatgagatctacagatggaaatagtcataatttttcctcgtcttacaaagagcatatagcaaatattagaaatgtacaaaagaacaatagaagtcctaaaaagaaacaaactagtataaatcaaacaaaaaaaatcaaacagaaacaacaaacagttgaaaagtcagtttttaaaagggatttaaaagcattatggaaataa

SEQ ID NO: 13838 - protein, 199 aa, Unknown
  Obtained from environmental sample
  DOMAIN (1)...(161): Aminodeoxychorismate lyase
  misc_feature (1)..(199): Xaa is any amino acid
MKRNFIEHLLDITDKKYEKLSLKIFGLYNREKWYQYVTIASIIQKESASKEEMHLVSSVIHNRINKGMKLQMDGTLNYGKNSHITVTPQMIKNDTSQYNTYKRKGVPDNPICAIEFEAIRSAIFPTKTSYLYFMRSTDGNSHNFSSSYKEHIANIRNVQKNNRSPKKKQTSINQTKKIKQKQQTVEKSVFKRDLKALWK

SEQ ID NO: 13839 - DNA, 798 bp, Unknown
  Obtained from environmental sample
  misc_feature (1)..(798): n is a, c, g, or t
atgaaagttaaattttcaattgaaagcttttttgataattattttattgaggtctatgagtatgttttatttgaaccatacctaaaagcatcaggaaaatttatagttaacttagatgatttgtcacttgagtcaataataaaagatacaaatataaatgattttgcattacaatttaataacaaccttaagtttataacagcccagagttgttttgtaacttttaaggataataatttttattttagttttaaaaaacctatgtatgaaggggttaatttagaggggagtaaagctacaatccttgatttggatagattaaaactagagcttacttctggggataaattaaaaaaaccactattggaacttttgagtaactataaaatcaatcttcctttagttcaagaatatggttcaaatacaatttttacagaacttttaataccctttaatatacaaaaagaacttacagttcaatcaaaaattgcattagaaaatgctaaagtatatctttataatattccattatatactaaaaaatttgatatttttttagataataatatcttaacagggagtgggaaacttcataaaacagatgatgacaatagcactttagcatatgattctgatgttgtatttgatatagactttaaaaagaatagtgtcaaaggtaattttataacacaaagtataaattttaaagatattaatataaccaatattgagggtgattttaatcttgattttaataatagctttttttcagatattagaatacaaaatggaaattaa

SEQ ID NO: 13840 - protein, 265 aa, Unknown
  Obtained from environmental sample
  misc_feature (1)..(265): Xaa is any amino acid
MKVKFSIESFFDNYFIEVYEYVLFEPYLKASGKFIVNLDDLSLESIIKDTNINDFALQFNNNLKFITAQSCFVTFKDNNFYFSFKKPMYEGVNLEGSKATILDLDRLKLELTSGDKLKKPLLELLSNYKINLPLVQEYGSNTIFTELLIPFNIQKELTVQSKIALENAKVYLYNIPLYTKKFDIFLDNNILTGSGKLHKTDDDNSTLAYDSDVVFDIDFKKNSVKGNFITQSINFKDINITNIEGDFNLDFNNSFFSDIRIQNGN

SEQ ID NO: 13841 - DNA, 669 bp, Unknown
  Obtained from environmental sample
  misc_feature (1)..(669): n is a, c, g, or t
atgcttacttcaataaaaggtattggatttaaaagagcagatgagatagggacaaaactaggaattgataaagagagctcttttaggatcacagcttgtatgaactatacattaaaagagttttgtgaagcaaatggaaatagttctataggaaaagaacagcttttttctcttatgaatgatgcattacattttaaagagaaagatactttatatgaaaatgcattgataaaccttgtagctaaagaggagataaatgaaactataaaagataggtttgcaccaaatatctactttcgatgtgaaacaaaaattttagaaattttaaaaaatagaaaagagtacaatagagataaaaaaataattaaagattttgatacttatattactaaaaaacaagaaaccttaggatttaccttaagtagcgagcaacaaaaagctgtaagtttaatcaatgatggggaaaatactattttacttataggatatgcaggtacaggtaaatctacctcaagtcgagccatacttgaactccttgaagagatagtaagttatgatgatatccattgtatggcacttagtggtattgcagctcaaagaatctctgatactacaggatacaaaagtagtaccataccatcatcactagtaaaaataggaaataggtga

SEQ ID NO: 13842 - protein, 222 aa, Unknown
  Obtained from environmental sample
  misc_feature (1)..(222): Xaa is any amino acid
MLTSIKGIGFKRADEIGTKLGIDKESSFRITACMNYTLKEFCEANGNSSIGKEQLFSLMNDALHFKEKDTLYENALINLVAKEEINETIKDRFAPNIYFRCETKILEILKNRKEYNRDKKIIKDFDTYITKKQETLGFTLSSEQQKAVSLINDGENTILLIGYAGTGKSTSSRAILELLEEIVSYDDIHCMALSGIAAQRISDTTGYKSSTIPSSLVKIGNR

SEQ ID NO: 13843 - DNA, 906 bp, Unknown
  Obtained from environmental sample
  misc_feature (1)..(906): n is a, c, g, or t
atgatttntatagatttttctcaaaaaatgattacttggacaagagaaatcaaatgggatatagaaaaaggtgttaaatatgaatttgaaccagattgtattgtaactgctctttaccgtccatttgtaaaacaaaatttgtactttaataaaggttggaataatatgcaatatctaattccaaaattattcccaaccaaatcatctaataataaagtgatctgtttatcaggtgttggagctagtaagagtttttcttgtttaatttcgaataatatacctgacctacaagttcaatttaatggtcaatgcttccccctctattattatgaagaaaatacaacacagcaaaccactttatttgatgctgacaatgatgacaaatacatccgcagagatggaatttcaaattttatttgggagcaagctaaaaagatttacggaaagaatgtaaacaaagaggacattttctattatgtttacggcattttacacagtccagattataaaaccaaatttgccaatgatttaaagaaaatgttgcctcgaattcctttggtagatgaaccgcgtgaattttggaaattcagtaaagcaggtagagaattagcagatttacacattaattatgaaagtgttccgcctgctccaggagttcttgttctttacgatacagtaccgcaagatatacttaataaagctatgcaaaatgaagaaatgaaagcagttaattatcgagttcaaaaaatgcgttttcctaaaaaagatcaaaaagacaaaattatctacaatagccaaattacaattgagaacatacccaccgaaagcttacgaatatattgtaaatgggtaaatctgcaatcgaaatggataatgggaacgnttatcaagttaaaggtccgataa

SEQ ID NO: 13844 - protein, 301 aa, Unknown
  Obtained from environmental sample
  misc_feature (1)..(301): Xaa is any amino acid
MIXIDFSQKMITWTREIKWDIEKGVKYEFEPDCIVTALYRPFVKQNLYFNKGWNNMQYLIPKLFPTKSSNNKVICLSGVGASKSFSCLISNNIPDLQVQFNGQCFPLYYYEENTTQQTTLFDADNDDKYIRRDGISNFIWEQAKKIYGKNVNKEDIFYYVYGILHSPDYKTKFANDLKKMLPRIPLVDEPREFWKFSKAGRELADLHINYESVPPAPGVLVLYDTVPQDILNKAMQNEEMKAVNYRVQKMRFPKKDQKDKIIYNSQITIENIPTESLRIYCKWVNLQSKWIMGTXIKLKVR

SEQ ID NO: 13845 - DNA, 351 bp, Unknown
  Obtained from environmental sample
  misc_feature (1)..(351): n is a, c, g, or t
atgtacccagccaaaggaattaatttttataagttagaaaccgggatattaatgcgatactttacttcattaaaaaaagagagcggtataatgagagatataaaggcaaagatcttatctgctaaacagacggatacaaccctcttttataatgatgcaggcagcaaacaggcttatcaacttggtgtcatgcatctcagtacagctgagtttatgggttttgcagacaccttgcccaatggcgacctacggatcaaaaaagagtttttattagtcgattttaacaataatgaaatagtaagcattcacaaaggttcacgcatcacaccggtaaagcttgagagttgctaa

SEQ ID NO: 13846 - protein, 116 aa, Unknown
  Obtained from environmental sample
  misc_feature (1)..(116): Xaa is any amino acid
MYPAKGINFYKLETGILMRYFTSLKKESGIMRDIKAKILSAKQTDTTLFYNDAGSKQAYQLGVMHLSTAEFMGFADTLPNGDLRIKKEFLLVDFNNNEIVSIHKGSRITPVKLESC

SEQ ID NO: 13847 - DNA, 423 bp, Unknown
  Obtained from environmental sample
  misc_feature (1)..(423): n is a, c, g, or t
ttgagaaatatattacttgtcgatgatgatccaataataatagctattctccaaaaaaagcttattgaacagattaaaaatataaatattctaattgctagaaattataaagaagcactaaagcatattttaaataatgatctgagaattgatattgcaatattagatttaaatctaccagatgtaagagatggggaacttgttgattattcaatcaaaaagaaaataccaactattgttttaagtggtacaaaaatcagtaatatgagaaaagatattttagaaaaagatattttagaatatattgctaaggatggtgtaaatagtatcaactacactattaattctataaagagagttctccttaattatgatactaatgttcttatcgtagatgattcttcagtacaacttcanatctaa

SEQ ID NO: 13848 - protein, 140 aa, Unknown
  Obtained from environmental sample
  DOMAIN (2)...(125): Response regulator receiver domain
  misc_feature (1)..(140): Xaa is any amino acid
MRNILLVDDDPIIIAILQKKLIEQIKNINILIARNYKEALKHILNNDLRIDIAILDLNLPDVRDGELVDYSIKKKIPTIVLSGTKISNMRKDILEKDILEYIAKDGVNSINYTINSIKRVLLNYDTNVLIVDDSSVQLXI

SEQ ID NO: 13849 - DNA, 489 bp, Unknown
  Obtained from environmental sample
  misc_feature (1)..(489): n is a, c, g, or t
atgcataattcccctgaactaattagaggacttgaacaaaagtatgacttacaatttaacgaaagcaagttggagttttcaggtaatctatttgttgaggaaaacgattgttatcaaattagcattagtattactccgtttcctaattcttttccaattgtgaaagaattaggggaacggattccttttaatatagataggcataaatacagtgatgcaagttgttgcttgacaacaaaagccaaagaacaactacttttaaaaaagaaaatcaaaacactggacagttttattgcggatattgttattccattttttcagaataattcatattttgaaataaacaaagaatacattaatggcgattacaaacatggtattacaggtgtatttgaggcttatcaggaaatagcaaatctcactgatgtaaaattattgttagatttcttgcatgacagaattgtaaggaaaaaaatatcgccgaaataa

SEQ ID NO: 13850 - protein, 162 aa, Unknown
  Obtained from environmental sample
  misc_feature (1)..(162): Xaa is any amino acid
MHNSPELIRGLEQKYDLQFNESKLEFSGNLFVEENDCYQISISITPFPNSFPIVKELGERIPFNIDRHKYSDASCCLTTKAKEQLLLKKKIKTLDSFIADIVIPFFQNNSYFEINKEYINGDYKHGITGVFEAYQEIANLTDVKLLLDFLHDRIVRKKISPK

SEQ ID NO: 13851 - DNA, 894 bp, Unknown
  Obtained from environmental sample
  misc_feature (1)..(894): n is a, c, g, or t
atggcccagaccatgaccagagagaagtttgacacactaaaaaatcacaaaacaaaaacggccggatggacgattgcccgtgccataaataccggaacgctttacccatcatcatctgtcggatgccatgctggcgatcatgaatcctataccgactttgcgaacctttttaaatctgtcatagaatcttatcatgtgggatttaacctggataagaacaaacatgtaactgatctcaatgtaaataagatcagttcagatcttactgaacaggccagaagtaaaataatctcaacccggataagagttgcaagaaacctggatttttttccactgaatccaggcgggacacaacaaaccagattagatattattaaactgattgaagaagttgttctgaccctgaaaggcgatcttaaaggagaactttttcatcacactacgatgactccagaacaaactcaaaagcttattgatgatcatcttctcttcaaaggaaatgataagatgcaagcagcttccggtcatcacgagcattggcctattgggagagggatctatctcaatgaggccaaagaatttatcgtatggattaatgaaggagatcatctccgaattatatcgatggagcaagggggagatgttaagagtgtttttgaacggttgagtcgtggaatttctgcacttgaaaacggcctgaaaaaagtcaccggaaaagatccggtattcatgtctgatgacgttttaggcatgattacatgctgcccgtcaaatcttggcacggccatgcgtgcaagtgttcatattcttgttcctaaactcattgctaaaatgggactccaaggaattgataaaattgctcacaaaagctattgcccaggccagaggcagtag

SEQ ID NO: 13852 - protein, 297 aa, Unknown
  Obtained from environmental sample
  DOMAIN (1)...(70): ATP:guanido phosphotransferase, N-terminal domain
  misc_feature (1)..(297): Xaa is any amino acid
MAQTMTREKFDTLKNHKTKTAGWTIARAINTGTLYPSSSVGCHAGDHESYTDFANLFKSVIESYHVGFNLDKNKHVTDLNVNKISSDLTEQARSKIISTRIRVARNLDFFPLNPGGTQQTRLDIIKLIEEVVLTLKGDLKGELFHHTTMTPEQTQKLIDDHLLFKGNDKMQAASGHHEHWPIGRGIYLNEAKEFIVWINEGDHLRIISMEQGGDVKSVFERLSRGISALENGLKKVTGKDPVFMSDDVLGMITCCPSNLGTAMRASVHILVPKLIAKMGLQGIDKIAHKSYCPGQRQ

SEQ ID NO: 13853 - DNA, 381 bp, Unknown
  Obtained from environmental sample
  misc_feature (1)..(381): n is a, c, g, or t
ttgttttttatcgaacgtcgtcaaatggggagtgcatactacaccagcgtaattacgacgattgcgattgtcgaagataagattgataatatctcaaatgaaaaagattttattcttagatgtagaaaaagaagtatatttacggataaagaactttcagctcattggaattggagcaaatacagcaaaccatttattcttaaatttttatatattcattcattcccagttggaaaaagaatgaaccgaaagatgttgcttgatctcggaattttaactggcgagaaaaacgaaatgagaggtctaaaaatgataacaaaagaacaatttaaattaatattacaaaaaacagaaacaaatgaaaatattattgtcgattaa

SEQ ID NO: 13854 - protein, 126 aa, Unknown
  Obtained from environmental sample
  misc_feature (1)..(126): Xaa is any amino acid
MFFIERRQMGSAYYTSVITTIAIVEDKIDNISNEKDFILRCRKRSIFTDKELSAHWNWSKYSKPFILKFLYIHSFPVGKRMNRKMLLDLGILTGEKNEMRGLKMITKEQFKLILQKTETNENIIVD

SEQ ID NO: 13855 - DNA, 417 bp, Unknown
  Obtained from environmental sample
  misc_feature (1)..(417): n is a, c, g, or t
ttgatcagcatcggctcggcgagagttagtgataaaaataataaattagtcgaagatattgagttgactcaggataggttaattaggggcctaaatcgggtaataaaaaatgattttgtatatttattagatggtcactattgcttattaaactcacaaaaagaaataaaaaagattgagcaaggggtatttgaatttattaatccaaaagtttttgttattgtaactgaagaaatttctatagtcgctatgcgtctttttaaaagagataataaaaaatacgactacactttacttgataaaatgcaaaaaatggaaattaattatgcacaattcttgtcaaaatctctaaaaattcccttggttaaagttagctccaatgaatattctaaattactaaaatatatagttttatga

SEQ ID NO: 13856 - protein, 138 aa, Unknown
  Obtained from environmental sample
  misc_feature (1)..(138): Xaa is any amino acid
MISIGSARVSDKNNKLVEDIELTQDRLIRGLNRVIKNDFVYLLDGHYCLLNSQKEIKKIEQGVFEFINPKVFVIVTEEISIVAMRLFKRDNKKYDYTLLDKMQKMEINYAQFLSKSLKIPLVKVSSNEYSKLLKYIVL

SEQ ID NO: 13857 - DNA, 543 bp, Unknown
  Obtained from environmental sample
  misc_feature (1)..(543): n is a, c, g, or t
atgaaagctcttttagatactaacattataatacatagagaatcaaatcgcataataaacaaggatattggagttttatacaagtggttagataaaggaggttacattaaatgtgttcatccaattacaatagaagaaattaataaaaatagtaataaaggtgttgttgacacatttaatgttaaattggatagttacgaaaaactaataattacttctcaactttctgaagatgttaaaagtgtctcaacagatattgattctaattcaaatgacataaatgatacaattttattaaatgaggtatatattgaacgtgtagattttctcataaccgaagataaaaaaattcatagaaaagcagagatgttaggtatttctgatagagttttttcaattgattcttttttggaaaaagtggtttcagagaatcctgagttagttaattataaaattctttctgntaaaaaagaatattttgggaaaataaatattactgattcattttttgacagttttaaagaagactacataggattttga

SEQ ID NO: 13858 - protein, 180 aa, Unknown
  Obtained from environmental sample
  misc_feature (1)..(180): Xaa is any amino acid
MKALLDTNIIIHRESNRIINKDIGVLYKWLDKGGYIKCVHPITIEEINKNSNKGVVDTFNVKLDSYEKLIITSQLSEDVKSVSTDIDSNSNDINDTILLNEVYIERVDFLITEDKKIHRKAEMLGISDRVFSIDSFLEKVVSENPELVNYKILSXKKEYFGKINITDSFFDSFKEDYIGF

SEQ ID NO: 13859 - DNA, 963 bp, Unknown
  Obtained from environmental sample
  misc_feature (1)..(963): n is a, c, g, or t
ttgatggctcggatggatatgaacttaatggaagattataagaaagagccaggagggaaacaaaaattgcaagaaaaaaattcaaaatttataaacgatgattatgttaagttcctaagatatggacaacattttattgaaaaaaatggagaaggtgttttagcttttattaatccacatgggttcttagataatcctacttttaggggaatgcgatggaatctattaaaaacgtatgataaaatatatactatcgacctgcatggtaattctaagaaagacgaagtttgcccagatggtacacccgatcaaaatgtttttgatattatgcaaggagtgtctataaacctatttgttaaaactggtcttaaaaagggtaatgaattgggaatagtattgcattttgatttatttgggaaaagagatattaagtatgattttttaagagagaattcaattaattcaatccattttaagaaattagaattacctaagcctaattacttctttgcacaaaaagactttaaagctcttaaaaagtataatgaatatatctcgcttccaattttatttcctaataatagtttaggatatcttacgaaaaaagataagtttattattgactttgataaagctgcaattgaagaacggttaagtgattttttaaataaggaattaactgataatgatattgctaataaatataatttaaaacttgcagataaagataagtggaatttaaacaaggctcgtaggaatataattgataatggaataaaacaggatgtttttaaattaactgattatcgttgttttgataagagatatgtttattatgataaagattttgtcgctcgacttaatacacgtgttttggctcatctaaataataaagaaaattattcaattatttcagttcgtcaattagcatctaaagattttcttcaatgttttataaagtaa

SEQ ID NO: 13860 - protein, 320 aa, Unknown
  Obtained from environmental sample
  misc_feature (1)..(320): Xaa is any amino acid
MMARMDMNLMEDYKKEPGGKQKLQEKNSKFINDDYVKFLRYGQHFIEKNGEGVLAFINPHGFLDNPTFRGMRWNLLKTYDKIYTIDLHGNSKKDEVCPDGTPDQNVFDIMQGVSINLFVKTGLKKGNELGIVLHFDLFGKRDIKYDFLRENSINSIHFKKLELPKPNYFFAQKDFKALKKYNEYISLPILFPNNSLGYLTKKDKFIIDFDKAAIEERLSDFLNKELTDNDIANKYNLKLADKDKWNLNKARRNIIDNGIKQDVFKLTDYRCFDKRYVYYDKDFVARLNTRVLAHLNNKENYSIISVRQLASKDFLQCFIK

SEQ ID NO: 13861 - DNA, 543 bp, Unknown
  Obtained from environmental sample
  misc_feature (1)..(543): n is a, c, g, or t
atggaaataatccctatatttgaaaaatctttatcttcttttaaatatgacaatggatcgcaagatgaatttgctagattatttgatttatggaacgatccagaattactcgaggagttctttgaaaaaaataaatcagatctaaataataaattttgggattctattcaaattgaagaagctataattaaaacaagaaatgatgcaagttattttgaaaagaaacttcttaaactttctaaaaaatcatggaaagaacagacttatggtctcgaaactttgtttcagccattggataacctacaaacccgtatttatgtattaaataagagtaaggcgaggcaaagctggcttcgtatttatgctttaagagttaatgaaaatgcatttattataacaggtggtgcaataaaactaacaaaaacgatgtcagagtgtgaacatacacggctcgaattacataagatatctaaatgtaaagattttttaaaagaaaaaggtgtggttgatattgatggagttattgaagaattagaaatctaa

SEQ ID NO: 13862 - protein, 180 aa, Unknown
  Obtained from environmental sample
  misc_feature (1)..(180): Xaa is any amino acid
MEIIPIFEKSLSSFKYDNGSQDEFARLFDLWNDPELLEEFFEKNKSDLNNKFWDSIQIEEAIIKTRNDASYFEKKLLKLSKKSWKEQTYGLETLFQPLDNLQTRIYVLNKSKARQSWLRIYALRVNENAFIITGGAIKLTKTMSECEHTRLELHKISKCKDFLKEKGVVDIDGVIEELEI

SEQ ID NO: 13863 - DNA, 603 bp, Unknown
  Obtained from environmental sample
  misc_feature (1)..(603): n is a, c, g, or t
atgagtattaataaagctgtgttcgtaaaatcaagtttgacagtcagcgattgtccagaagaaaaatatccagaatatgcatttatcggacgatcaaatgtaggaaaatcttctttaattaatacattgaccaatcaaaaagagttagcgaaaacttcctcgaagccggggaaaactcaaatgataaatcacttttttatcgacaataagtggaatcttgtagatttgcctggatatggatttgcaaaggctgggaaaggggaaatgcatgaatttaatgaaatgattctgcaatacattgagcgacgcaaaagtttacatcatctatttgttctcatagacattcgtcatacgcctcaagtaaatgatgttgagtttatggcgtggttagtgcgacacgaaattccgttttctatgattttcacgaaagcagataaactttcaaaaaatcaggtgaatcaaagtgttcgaaagtatgagaaaattgttttggaatatcttactggaatgccgcagtatttcattacatcagctcatcaaaagcttggaaaagaaatggttgtggaatttattgagaaaatgaacaaggaaaaaatttcttga

SEQ ID NO: 13864 - protein, 200 aa, Unknown
  Obtained from environmental sample
  misc_feature (1)..(200): Xaa is any amino acid
MSINKAVFVKSSLTVSDCPEEKYPEYAFIGRSNVGKSSLINTLTNQKELAKTSSKPGKTQMINHFFIDNKWNLVDLPGYGFAKAGKGEMHEFNEMILQYIERRKSLHHLFVLIDIRHTPQVNDVEFMAWLVRHEIPFSMIFTKADKLSKNQVNQSVRKYEKIVLEYLTGMPQYFITSAHQKLGKEMVVEFIEKMNKEKIS

SEQ ID NO: 13865 - DNA, 549 bp, Unknown
  Obtained from environmental sample
  misc_feature (1)..(549): n is a, c, g, or t
atgaaagtcatagatactcatatcccagatgtaaaagttattgaaccaagcgtgtttggagacgaacgcggattctttatggaaacttggaatcaaaataaatttgaggaattagttacaggcaaacctacaaaatttgtgcaagacaatcactcaaaatccaagaatggaatcttgcgtggattacattaccagactgagaatactcaagggaaactagttcgtgtagtgtctggagaagtatttgatgtggcagtcgatattagaaaggggtcgcctactttcggtcactgggttggcgaatatctttctgcagacaacaaaagacagctttgggtaccagaagggtttgcgcatggcttttatgtaacgagtgaggaagctgagtttgtttataaatgcaccgattattataatcctaatgctgaattgagtattgcttgggacgataagtctattaatattgaatggcctttgactggtaagcccgtgttgtcgaaaaaggactctataggcctgaacattaatgatattcataagataatttaa

SEQ ID NO: 13866 - protein, 182 aa, Unknown
  Obtained from environmental sample
  DOMAIN (3)...(178): dTDP-4-dehydrorhamnose 3,5-epimerase
  misc_feature (1)..(182): Xaa is any amino acid
MKVIDTHIPDVKVIEPSVFGDERGFFMETWNQNKFEELVTGKPTKFVQDNHSKSKNGILRGLHYQTENTQGKLVRVVSGEVFDVAVDIRKGSPTFGHWVGEYLSADNKRQLWVPEGFAHGFYVTSEEAEFVYKCTDYYNPNAELSIAWDDKSINIEWPLTGKPVLSKKDSIGLNINDIHKII

SEQ ID NO: 13867 - DNA, 345 bp, Unknown
  Obtained from environmental sample
  misc_feature (1)..(345): n is a, c, g, or t
atggaactaaaacgaacttttgatattgtagaattaaattttaaaaactaccaaaaagatgatgcgctagctgtaaagcgaaatggcaaatgggagaaatttagcacccttgaatacaaagaatttgtagatgctattagttacggactgctggcaatgggttttcaaaaaggagataaaatagttacaatctccaataatcgtcctgaatggaattttctcggacatggaatgacacaaattggagtttgtcatgttcccatttatgccaatcagggcaaattagaatatgagcatattttaaatcatttcgatgccagaataggtatttgcctctcctcctga

SEQ ID NO: 13868 - protein, 114 aa, Unknown
  Obtained from environmental sample
  misc_feature (1)..(114): Xaa is any amino acid
MELKRTFDIVELNFKNYQKDDALAVKRNGKWEKFSTLEYKEFVDAISYGLLAMGFQKGDKIVTISNNRPEWNFLGHGMTQIGVCHVPIYANQGKLEYEHILNHFDARIGICLSS

SEQ ID NO: 13869 - DNA, 795 bp, Unknown
  Obtained from environmental sample
  misc_feature (1)..(795): n is a, c, g, or t
gtggagcagcacttcagctcggatgggcacgtgttttttatgcggccagaatacccaattcttgagggttacggattaactgaaacatcgcctgttattgctgtaaatcagcgtcattttccaaatattaaatttggaactgttggcccggttttggaaaatgtggaagttaaaattgacgaagatggcgaaatccttatgaaaggtcctagcctgatgatgggttattacaaagatgaagagaaaactaatgaagttattgatgaaaatggatggtttcatacaggagatattggcgaactacacgagaataatattttgaaaattaccgatcgtaaaaaagaaatattcaaactttcgactggaaaatatattgctccacaagttgttgaaaatatcttcaaagaatcatcttttattgagcaaattatggttgttggtgctgatgaaaaatttgccgccgcaataatttgtccctcttttcattttttgcatgtttggtgtacaaaacataatgtaaaatttcgcgacaataaagatcttattcaacatccaaaagtgattgagagatatcaaaaagaaattgataagattaataaaaaacttggtcgtcatcgtcaacttaaaaagtttgaacttacttgtcaggattggactcccgaaaccggagaactctcacctactttgaaagttaaacgtaaagttttaaaggaaaaatataaaatcaaattggataaactttatggttattcctcggaagatggtcatgttggaattccagattcagggaaataa

SEQ ID NO: 13870 - protein, 264 aa, Unknown
  Obtained from environmental sample
  misc_feature (1)..(264): Xaa is any amino acid
MEQHFSSDGHVFFMRPEYPILEGYGLTETSPVIAVNQRHFPNIKFGTVGPVLENVEVKIDEDGEILMKGPSLMMGYYKDEEKTNEVIDENGWFHTGDIGELHENNILKITDRKKEIFKLSTGKYIAPQVVENIFKESSFIEQIMVVGADEKFAAAIICPSFHFLHVWCTKHNVKFRDNKDLIQHPKVIERYQKEIDKINKKLGRHRQLKKFELTCQDWTPETGELSPTLKVKRKVLKEKYKIKLDKLYGYSSEDGHVGIPDSGK

SEQ ID NO: 13871 - DNA, 855 bp, Unknown
  Obtained from environmental sample
  misc_feature (1)..(855): n is a, c, g, or t
gtggtggatgtgactagcttaaaatttatctctgtaaaagatgctttttatgtagtgggaagtaaacaagctggaactatgagtcgtactagtaaatatgcttttgccacagaaaaagatgctttagaatttgttaaaaaatatggtggagaaattgtaaattttagaaaagcagtttattttgcaatgcaagatttttcaaaaaaaccttatggaactcgtacagaaaaaactgttttagatttaacccaaccattatatcttacacttaaagacccatctacatctaaagaaaaatcaggtgaacacatgcacggtggtggtggaaaaccaaaaccaaaaggatatatacctacacaaaaggtttatatttcaactcttgaaaataaaagtgtgactccaaaaaatatagagtttttttactatgatataaaacaaaataaaaaagatattatcaaaaatagttcaagaggaaaagaaacatatagttttgaagtgccaaataatggatactataatctttttgcagtagcacaaagtacaaaagatgataaaaaattttacaatgtagcaaaactagagtatcttcaagggaaacatggtattgaagatatttatgatgaagaacttaaaaaaaatcttgaacaaaacctgactaaaattgacttaataagaataaaaaacgaagatganaatagctttttttataaatttaaaatgggtgaaactttaaaatttcaagcaatatttgatcaaaaacccttagcaaatacaaaaatacatatcaaactccaaagtggttgggaaaaaacttcaattacaaatgataaaggtgaagtagaatttacattataa

SEQ ID NO: 13872 - protein, 284 aa, Unknown
  Obtained from environmental sample
  misc_feature (1)..(284): Xaa is any amino acid
MVDVTSLKFISVKDAFYVVGSKQAGTMSRTSKYAFATEKDALEFVKKYGGEIVNFRKAVYFAMQDFSKKPYGTRTEKTVLDLTQPLYLTLKDPSTSKEKSGEHMHGGGGKPKPKGYIPTQKVYISTLENKSVTPKNIEFFYYDIKQNKKDIIKNSSRGKETYSFEVPNNGYYNLFAVAQSTKDDKKFYNVAKLEYLQGKHGIEDIYDEELKKNLEQNLTKIDLIRIKNEDXNSFFYKFKMGETLKFQAIFDQKPLANTKIHIKLQSGWEKTSITNDKGEVEFTL

SEQ ID NO: 13873 - DNA, 828 bp, Unknown
  Obtained from environmental sample
  misc_feature (1)..(828): n is a, c, g, or t
gtggctgtaactaagtttgtatacacagatgaagggcctaaaacgaaaacattcatcacaaataataaatcagaaatccttaatgctcagggttctaagtattgccctgtcgacatctctgaggctattaaggaggtgaaaaaaacagaaggaaagatcgcctatgttggaacgccgtgtcagatagctggaattagaagcattcaagagatagatcaagaatttgatagaaagatatgtatcaccgtctctaacttctgcggtgggtttaaaaatttcaataacataaaaaaaatagcacacaggcattcgattgactacaacagcatgtccttttttcggtttcgtgggggggggcaacccggtagtatgataatgaaggattcaaggggtaatgagtttgagtcttcttataagctatacggtgggttttcaggttactcaaagatattaagatgtcatttatgtgttgatgctacgggtgaacttgcagatatatcttttggtgatgcgtggcttgataggtatttagatcagaaggaagcatggtcagttattttaacgagaagtgctgaaatgacctctttaatcaaggatatggtcaaagcaggcagaattaacacagaaaaattatcacatacagatgtttgcctatctcagaaatcaaacataacttcaaaaaaatataggcaatactctcgacatcgtttgtatcgggctttgggatattctatacccgagtttgatggtggttttgatatgaaacaaacatcattaaaggtcgagctgtgtgtctactgtaagcataggattccgagccgattctga

SEQ ID NO: 13874 - protein, 275 aa, Unknown
  Obtained from environmental sample
  DOMAIN (51)...(211): Coenzyme F420 hydrogenase/dehydrogenase, beta subunit C terminus
  misc_feature (1)..(275): Xaa is any amino acid
MAVTKFVYTDEGPKTKTFITNNKSEILNAQGSKYCPVDISEAIKEVKKTEGKIAYVGTPCQIAGIRSIQEIDQEFDRKICITVSNFCGGFKNFNNIKKIAHRHSIDYNSMSFFRFRGGGQPGSMIMKDSRGNEFESSYKLYGGFSGYSKILRCHLCVDATGELADISFGDAWLDRYLDQKEAWSVILTRSAEMTSLIKDMVKAGRINTEKLSHTDVCLSQKSNITSKKYRQYSRHRLYRALGYSIPEFDGGFDMKQTSLKVELCVYCKHRIPSRF

SEQ ID NO: 13875 - DNA, 1005 bp, Unknown
  Obtained from environmental sample
  misc_feature (1)..(1005): n is a, c, g, or t
atgggttttagtgaatcccctggacatcaaaatcaattattaccgtggacagaaccaactcactaccgttatgttagtgagataatgagaggatgttctcgtgggtgtcgattctgtcatgctggtatgttctatcgtcctgtgcgggaaaaaaatttggagatgattttagaaaatcttctcaatgaaattgatcaatatggttggtctgaggttgctttatcttcactatcttcaagtgattatacctgtatcaaagacttattaatgctacttttcaaggagttatcgaaaagagaaacatctctttctttgccttcattaagagtagacagtttagacgaacagattattaaattgttgaatgttttaagacaatcagggctaacaatagctccagaagctggttcacagcgactcagagatgtaatcaataagaatatcactgaagaagagatacttgaaggtattaagattgctctggataatggctggaaagttgtaaaactctatttcatgatcggacttccttttgaagagcaggaagatattgatgctattgtgaatttgattaataaaatacttgcaataaccaaaaaacgtttgaagattaatattactctatctccatttgtgccaaaatcttttactccatttcaatgggctagaatggatagtaaggctgtcttaaaaaagaaagcaacgtatgtaaaaagcattttcaagatntacagacagattaagataagctatcatgaaatcgaatcatcccaattggaatgcattttangtagagggaccagagatgcagggaaaataatctatcaagcatacaaaagatggagcaaaattcgatggttggnaatgagttcctggaatgcgggcctatggcagccaggcagccaaaaaaaatttgatctatccttgggaaaaatgcccctatcccaactttacccaattggattccgccgtttcccatggggaatcctttttcgaccattagcc

SEQ ID NO: 13876 - protein, 335 aa, Unknown
  Obtained from environmental sample
  DOMAIN (26)...(191): Radical SAM superfamily
  misc_feature (1)..(335): Xaa is any amino acid
MGFSESPGHQNQLLPWTEPTHYRYVSEIMRGCSRGCRFCHAGMFYRPVREKNLEMILENLLNEIDQYGWSEVALSSLSSSDYTCIKDLLMLLFKELSKRETSLSLPSLRVDSLDEQIIKLLNVLRQSGLTIAPEAGSQRLRDVINKNITEEEILEGIKIALDNGWKVVKLYFMIGLPFEEQEDIDAIVNLINKILAITKKRLKINITLSPFVPKSFTPFQWARMDSKAVLKKKATYVKSIFKXYRQIKISYHEIESSQLECILXRGTRDAGKIIYQAYKRWSKIRWLXMSSWNAGLWQPGSQKKFDLSLGKMPLSQLYPIGFRRFPWGILFRPLA

SEQ ID NO: 13877 - DNA, 642 bp, Unknown
  Obtained from environmental sample
  misc_feature (1)..(642): n is a, c, g, or t
ttgaaagagacaactttaatagtactatgtgcaggtaattcatctagatttgagcttcaagcaaaaaaacaatggttgcgaatagaagatgaaccactgtggctatatgtaacaaaaaggatagatagcttccataattttgataaaatcattgtagtttcacatcagaatgagctaaattatatgaaatcctttagcgataaatttgattttgttgcaggtggtagcactcgacaacaatctattaaaaatgctttgcaaaaagtaacatccccttatgtgatgattacggatgttgctagatgttgtatccctaaaaatgttattcaagagcttataaactcaaaagatattgcctcttgtatcgttcctgttttagatgtatcagatactgtaatttataaaaatgagactatcaatagagaagatgtaaagctcatacaaactcctcaactttcaaatactactatcttaaaagaagcactaaatacttcagttgaatttacagatgaaagtagtgctattaaaaatataaatcaatcaattcactacataaaaggttcaaaaagatctataaaattaacttttgggaagagttacaccaatagatgtttatctgaccatcaaaagatttttttatag

SEQ ID NO: 13878 - protein, 213 aa, Unknown
  Obtained from environmental sample
  DOMAIN (4)...(203): Uncharacterized protein family UPF0007
  misc_feature (1)..(213): Xaa is any amino acid
MKETTLIVLCAGNSSRFELQAKKQWLRIEDEPLWLYVTKRIDSFHNFDKIIVVSHQNELNYMKSFSDKFDFVAGGSTRQQSIKNALQKVTSPYVMITDVARCCIPKNVIQELINSKDIASCIVPVLDVSDTVIYKNETINREDVKLIQTPQLSNTTILKEALNTSVEFTDESSAIKNINQSIHYIKGSKRSIKLTFGKSYTNRCLSDHQKIFL

SEQ ID NO: 13879 - DNA, 492 bp, Unknown
  Obtained from environmental sample
  misc_feature (1)..(492): n is a, c, g, or t
ttgcatgggcataaaatttttgtcggccatcttgccaagattctcctcaagaagctgaataaaatagaggagacgttcttttttattattacctatattgtataccctatacggacaataggatgttgcggtatcggggttttcactatcccatttaaaatcgggttcagcaggtttttggataacccgagcaactccttcaactatatcgtcaacaaaggtaaaatcccgttccatgttgccgttgttaaaaacattaatcggttcacctgccagaattgctttagcaaaaagcatgggagccatatcaggccgtccccatgggccatatactgtaaaaaaacgaaggcctgtgcaaggcaagccatagagatgactataggaatgtgccatcaactcattggcttttttggatgcagcatagagagatacagggtgattcacattatcgtgctcggaaaaaggctgtttggtgttagcgccataaactga

SEQ ID NO: 13880 - protein, 163 aa, Unknown
  Obtained from environmental sample
  misc_feature (1)..(163): Xaa is any amino acid
MHGHKIFVGHLAKILLKKLNKIEETFFFIITYIVYPIRTIGCCGIGVFTIPFKIGFSRFLDNPSNSFNYIVNKGKIPFHVAVVKNINRFTCQNCFSKKHGSHIRPSPWAIYCKKTKACARQAIEMTIGMCHQLIGFFGCSIERYRVIHIIVLGKRLFGVSAIN

SEQ ID NO: 13881 - DNA, 618 bp, Unknown
  Obtained from environmental sample
  misc_feature (1)..(618): n is a, c, g, or t
gtgataaagagaacattttcggtagatatgacactgaaatttatattcatattttttttaaacactatgatatgctacgcttcctttacaaaagtaggtgatattaacactaccttgagcactcatgaaaagtcttggttattgtcacatcccattttaaaagtaggtgttgataatgattttaaaccttatgagtggatcgatcaaaatggcgaatataggggtatgattgctgattatatagctttagttcaagagtatcttggtattaaaattgaaattgttaaagataaatcttgggctgagatattaatgatggcaaaacgcggtgagatagatatgatctctgatgcagttaaaacaccagaacgtgataaatatttaaatttcacagagccgtttatctctactccgattgtaattgttgatcatggaaaacttggttatttggacacattagagagattaaaaggaaaaagagtcgctgtagaaaaaggttattttatatcagagttgttagctcgtgactatcctgagatcaatcaagtagttgttgaaaatggaaatattgcttttaatgcagttttagatggagatgctgatgcatattttgggtga

SEQ ID NO: 13882 - protein, 205 aa, Unknown
  Obtained from environmental sample
  DOMAIN (53)...(205): Bacterial extracellular solute-binding proteins, family 3
  misc_feature (1)..(205): Xaa is any amino acid
MIKRTFSVDMTLKFIFIFFLNTMICYASFTKVGDINTTLSTHEKSWLLSHPILKVGVDNDFKPYEWIDQNGEYRGMIADYIALVQEYLGIKIEIVKDKSWAEILMMAKRGEIDMISDAVKTPERDKYLNFTEPFISTPIVIVDHGKLGYLDTLERLKGKRVAVEKGYFISELLARDYPEINQVVVENGNIAFNAVLDGDADAYFG

SEQ ID NO: 13883 - DNA, 753 bp, Unknown
  Obtained from environmental sample
  misc_feature (1)..(753): n is a, c, g, or t
gtggtacctttgacctgtgcacttaagattcttctatataaaacaacacaatcaattagtgatcataaattagttagcactttttataaacaagtagaagatttaaatatgaaacttcatgaacaaaatgaagaaatcaataaagaaaaattaaagttagaagagcaggtaaggttactaaaaattcaggttaatactactaatactaaacatcatcaggttgaacagttgcttaaacaacaaacacttaaaaatgaagagtctactttaagtgagtattttacaaaagatgaagatgatggagatgaaaaagttatttttttaaatgatgattgtgatgagatgtctgaaattttaaatgagcttcctgaacttttaatgcagtttggtgaaactaaagatatagatcttattcatacaatggctcatgaattatcaaaagtttcatcgatattgctacgttatacaccttttttagatcctcttgctaaaagttttagtgaactatcttctgctattgatgataatattgatctatttataaacatattagataaaaatttagatagtaccatgatgatttatgatgccgtaagtgttgatatggaactttacatacagcgttttagtgttgaaagtatggctatgaagaatattcaccatatccatcatccaacgactttaagtattcaacaaattatcagctttattactccagaggaagttgatgaaggtgaaattgattttttttaa

SEQ ID NO: 13884 - protein, 250 aa, Unknown
  Obtained from environmental sample
  misc_feature (1)..(250): Xaa is any amino acid
MVPLTCALKILLYKTTQSISDHKLVSTFYKQVEDLNMKLHEQNEEINKEKLKLEEQVRLLKIQVNTTNTKHHQVEQLLKQQTLKNEESTLSEYFTKDEDDGDEKVIFLNDDCDEMSEILNELPELLMQFGETKDIDLIHTMAHELSKVSSILLRYTPFLDPLAKSFSELSSAIDDNIDLFINILDKNLDSTMMIYDAVSVDMELYIQRFSVESMAMKNIHHIHHPTTLSIQQIISFITPEEVDEGEIDFF

SEQ ID NO: 13885 - DNA, 690 bp, Unknown
  Obtained from environmental sample
  misc_feature (1)..(690): n is a, c, g, or t
atgaaagttcttaaattatttatcattcttgtttcgatcatatccttatcttcatgtaaaaaatttaataatgaagctccaatcaagaagaacaaaatgcaaacacttagtgttccaaacaactttaattggtcaaccagtaaaaaattcgaagtaacagtaaatgcaaatttaataaaagatggttccactttggttttatataatcttgatggaaaaattattgacaagcaaagccttcttaaccatcaggccaaatttagaattcagcttcaacaacctagcgatactttgcgattatactctcctcttacacgaaagagtttatattttcaggccagcgaaacatatattagtttcgactcaaacaccctaaaaaatactcaagcagacacaaaagattatgccatgcattttgatgggtctcagcataattatctaaaaataaacaatggcaactctggaggtataattagtggattccctttttcttttagtgcctggttcaaaatttcggggctatccgatgtaacagatganatggtattagttaatattgccaaccctaattatgccagtaaatattatggaatttgtattagaaaatatacaaacagttataaagccataatcgtagcccgaaatggatcccgtgaaagggttaaaagctataatccaaattttggctga

SEQ ID NO: 13886 - protein, 229 aa, Unknown
  Obtained from environmental sample
  misc_feature (1)..(229): Xaa is any amino acid
MKVLKLFIILVSIISLSSCKKFNNEAPIKKNKMQTLSVPNNFNWSTSKKFEVTVNANLIKDGSTLVLYNLDGKIIDKQSLLNHQAKFRIQLQQPSDTLRLYSPLTRKSLYFQASETYISFDSNTLKNTQADTKDYAMHFDGSQHNYLKINNGNSGGIISGFPFSFSAWFKISGLSDVTDXMVLVNIANPNYASKYYGICIRKYTNSYKAIIVARNGSRERVKSYNPNFG

SEQ ID NO: 13887 - DNA, 423 bp, Unknown
  Obtained from environmental sample
  misc_feature (1)..(423): n is a, c, g, or t
ttgaaaatgttagaagaagcgattgcaactttaagtggagaacttaaagaggaaactaaagaggttgatattaagttaagtattactgcttttatttctagtgattatataagtgaagatagagtacggcttgaactttacagacgattgagtcgtgctgaatcgaaaaaagatgtatttatgatacaagatgagatggaagatagatttggaaaacttgatttacctacaaaacagtttatagagcttataattataaagataaatgcacttgaaaaacatattaaaactataagtaattatgatatgaacataacaatagtgtataatgatgaaacaaaagagacaattaaggcaaatagtagggatgatgatgaccttattaatgcaacaatgaattatttgacaaaaaaaggaaaataa

SEQ ID NO: 13888 - protein, 140 aa, Unknown
  Obtained from environmental sample
  DOMAIN (25)...(130): TRCF domain
  misc_feature (1)..(140): Xaa is any amino acid
MKMLEEAIATLSGELKEETKEVDIKLSITAFISSDYISEDRVRLELYRRLSRAESKKDVFMIQDEMEDRFGKLDLPTKQFIELIIIKINALEKHIKTISNYDMNITIVYNDETKETIKANSRDDDDLINATMNYLTKKGK

SEQ ID NO: 13889 - DNA, 435 bp, Unknown
  Obtained from environmental sample
  misc_feature (1)..(435): n is a, c, g, or t
atgtcaactaggtttacaatgtctttatgttttttatcattagaatcaggaaaagtgttcaataaagttatcttagaaagattacaaaaaaaaggttttcaaggacttagtgaagctctcattgttcttttcccatatattgaccaagcacaaaatatctctatttctgaactttcacgacaagttggatactcaagacaagctatgcataaaaatattaaaaaacttaaagagctaggatatattaccctctctttagaaaatcaaaaagagaaaactgtacattttacttctaaaagtaaacagcttatgattgaagcaaataagattatacaagagattgaaagcgaattaagttcacttcttggaaaagaggaattagatagttataggataaatcaagagaagatttacaactatttaacctctttatag

SEQ ID NO: 13890 - protein, 144 aa, Unknown
  Obtained from environmental sample
  DOMAIN (36)...(137): MarR family
  misc_feature (1)..(144): Xaa is any amino acid
MSTRFTMSLCFLSLESGKVFNKVILERLQKKGFQGLSEALIVLFPYIDQAQNISISELSRQVGYSRQAMHKNIKKLKELGYITLSLENQKEKTVHFTSKSKQLMIEANKIIQEIESELSSLLGKEELDSYRINQEKIYNYLTSL

SEQ ID NO: 13891 - DNA, 540 bp, Unknown
  Obtained from environmental sample
  misc_feature (1)..(540): n is a, c, g, or t
atgaaatatttcttactgcttcttttgataataacaacccttaatgcaaaggataatagtatgagcatctatgattttaatgttacaaatattgatggaaaagaaatccctatgtctagctacaagggaaaagttttgcttattgtaaatgttgctagtgagtgtggatttacgcctcagtacgagggtttagaaaaactttatcagacatataaagagcaaggctttatggttcttggatttccatcaaaccagtttggcaaacaagaatcaggaagtaatgaaaaaataaagttcttttgccaaggaacttatgatgttcactttgatatgttttctaagatagacgttaatggtgacggggcttccccactatacaaatatctcaaaaatgaacagggtggttttttatggatggatggcattaaatggaactttacaaagtttttagtagatgctaatggtaaagtagttgatagatattcaccttcaactaaaccactagatataaaaaaagatatagaaaaactactaaaatag

SEQ ID NO: 13892 - protein, 179 aa, Unknown
  Obtained from environmental sample
  SIGNAL (1)...(16)
  DOMAIN (22)...(130): Glutathione peroxidase
  misc_feature (1)..(179): Xaa is any amino acid
MKYFLLLLLIITTLNAKDNSMSIYDFNVTNIDGKEIPMSSYKGKVLLIVNVASECGFTPQYEGLEKLYQTYKEQGFMVLGFPSNQFGKQESGSNEKIKFFCQGTYDVHFDMFSKIDVNGDGASPLYKYLKNEQGGFLWMDGIKWNFTKFLVDANGKVVDRYSPSTKPLDIKKDIEKLLK

SEQ ID NO: 13893 - DNA, 768 bp, Unknown
  Obtained from environmental sample
  misc_feature (1)..(768): n is a, c, g, or t
ttgatggctggatatagaattctaaacaaagttgtagtaataacatcaggtaaagggggtgttggaaaatcaacactcacttcaaatatagcttatttgttatcaaggcaaggtaaaaatgtcgcagtacttgatgcggatataggattagcaaatcaacaagtattatttgatataaaaccacagaaaacattctttgattatttagaaggtatatgtgaactagaagagatatttttagaaacagggtacaatggagtaacattaattgctgggaaaagtggttatcaatatggaaaaatcaataacagcatgatattttctagagtagtagatgatatactagatttaaatagatatgatattttactaattgatacgggtgcagggattaatgaacatgtacaagaatttttaaatttaacagataatattttagcaataacaacaacagatcctagtgctttaacagatgtttatgcacttttaaagatgataagtttaaaaaaagagaagctaatgttatgttttaattatacttcaaaatatgaaattggggaaacaataaccaaatccataacaaatttggcgctaaaaaataaacttaatagaaaatttatggtacaatatatgggaaatgtaagtgagatgaagagtattgcaattaccggtagattaagaaaactgtttaccaaagagttaaagcaagaaatagcatctcaagagttgcgtatggtagtggacaatttaataaagcaaatagggtaa

SEQ ID NO: 13894 - protein, 255 aa, Unknown
  Obtained from environmental sample
  DOMAIN (12)...(216): CobQ/CobB/MinD/ParA nucleotide binding domain
  misc_feature (1)..(255): Xaa is any amino acid
MMAGYRILNKVVVITSGKGGVGKSTLTSNIAYLLSRQGKNVAVLDADIGLANQQVLFDIKPQKTFFDYLEGICELEEIFLETGYNGVTLIAGKSGYQYGKINNSMIFSRVVDDILDLNRYDILLIDTGAGINEHVQEFLNLTDNILAITTTDPSALTDVYALLKMISLKKEKLMLCFNYTSKYEIGETITKSITNLALKNKLNRKFMVQYMGNVSEMKSIAITGRLRKLFTKELKQEIASQELRMVVDNLIKQIG

SEQ ID NO: 13895 - DNA, 681 bp, Unknown
  Obtained from environmental sample
  misc_feature (1)..(681): n is a, c, g, or t
atgtggagaactcttaaagaagagtctatttgggttggagaggttaaagatcgaagaaaaaatggagaactatatattagtttatcaactcttattgtaataaaagattgtgatggaaatattacaaattacatcggtattactagagatgttacagatatgaaaagagcggagaatcatattaaatcattagcctattatgatcctctgaccgatcttcccaatagaactctatttaatgacaggttagagcaaaatattatctattgtaaaagaaatgaaggcaaaattgcacttctttttattgatcttgataactttaaaagtgtaaatgatatacatggacaccatatgggtgatatgctgcttcaaaaagttgctaaaatatttaccagtagtgtcagaggtagtgatactgttagcaggttgggtggagatgagtttactattattttaagaaaaatccatgacagggatgatgtaataaaagtagcaaacattattatagagaagttgatgaaccctatcgtcattaatgatataccactagagatagggagcagtatcggtgccgctatatttccggatgacacccaagataatgagacactgatgaagatggctgacatagctatgtatgaagctaagaaaaggggtaaaaatcgttttgaaattttttga

SEQ ID NO: 13896 - protein, 226 aa, Unknown
  Obtained from environmental sample
  DOMAIN (12)...(54): PAC motif
  misc_feature (1)..(226): Xaa is any amino acid
MWRTLKEESIWVGEVKDRRKNGELYISLSTLIVIKDCDGNITNYIGITRDVTDMKRAENHIKSLAYYDPLTDLPNRTLFNDRLEQNIIYCKRNEGKIALLFIDLDNFKSVNDIHGHHMGDMLLQKVAKIFTSSVRGSDTVSRLGGDEFTIILRKIHDRDDVIKVANIIIEKLMNPIVINDIPLEIGSSIGAAIFPDDTQDNETLMKMADIAMYEAKKRGKNRFEIF

SEQ ID NO: 13897 - DNA, 750 bp, Unknown
  Obtained from environmental sample
  misc_feature (1)..(750): n is a, c, g, or t
atgactaattccagaaattcatatcgcatatttgggcaagtctttaatgaagaagccttaagattgttttgccgcgaaaagattaatatatccagaacaccggtttgggaaagatatatctggacttttgttttggaatggctttcttttgatgaagccattgaagtaaatacctccgggtcaacaggcaaacccaggccgattgttttgcaaaaaaaattcatgattgaaagtgcaaaggcaaccctttctttttttggattgaaacccggggattctgcattgctttgcctgcccgcaaagtatattgccggaaaaatgatgatcgtgcgggctttggttgccggattggatttgcaatacaccgaaccaacatctaaaccttgtttggccaagtttgataaaattggatttgccgcgatgactccaatgcaggtagtgaatttgttaaaggatgaaaatgggattcaaaacattaataaaattgagaaactaattgttggtggctcaggaatgccactcaaacttgaagagaaacttcagtattcgaaaccagagatatggcaaactttcggcatgactgaaaccattacgcatatcgccttgcgaaaaataaatggtgataaccgctcagtatggtatcaaaacctgaaaggagttaacatcaatatggacgaaaggaaatgccttattattgattatctgaaaataggggttgagaacctgcatacaaatgatgtgttgaaataa

SEQ ID NO: 13898 - protein, 249 aa, Unknown
  Obtained from environmental sample
  misc_feature (1)..(249): Xaa is any amino acid
MTNSRNSYRIFGQVFNEEALRLFCREKINISRTPVWERYIWTFVLEWLSFDEAIEVNTSGSTGKPRPIVLQKKFMIESAKATLSFFGLKPGDSALLCLPAKYIAGKMMIVRALVAGLDLQYTEPTSKPCLAKFDKIGFAAMTPMQVVNLLKDENGIQNINKIEKLIVGGSGMPLKLEEKLQYSKPEIWQTFGMTETITHIALRKINGDNRSVWYQNLKGVNINMDERKCLIIDYLKIGVENLHTNDVLK

SEQ ID NO: 13899 - DNA, 756 bp, Unknown
  Obtained from environmental sample
  misc_feature (1)..(756): n is a, c, g, or t
atgagttacaaacagttaaccttgtcaaaaagataccatatttcaactttactaaagcaaggttataagcaaaaagatatagcaaatgagattggcgtagatccatcaacaatctgcagagagttaaaacgtaatagaacaaatatgagaggatatagtgccgagagtgcagaaataaaatcatcttcaagacataaacaaaaacaaaaaagaacttttttaaccaaaccaatagagaaatatattagagctaaactaaaactagattggtcaccagagcaactatcaggacgaatgaagctagatattggagtcagtgttgctcatgagagtatttatcgttatatctatgctaataaagcaaatggtggaaaactatacacatacctgagacacaaaaataagaagtatcataaacgttcaaatgtgtataaagctagaggtaccatcatagaccgagttatgatagacaaacgacctaagatagtagagaagaagaatagaattggtgatcttgaaatagatactgtcataggaaaaaatcatattggtgcattagtcactgttgtagatagaaaatctaaatttacaatgattaaaaatgttcaatcaaaagaaagcaaagtggttacagaagctctaatagagatgataccacccatcaaaaatataactcataccatccccagtgacaatgggaaagagtttgcatatcacaaagagatttcagctgcactagacactaagttttacttc

SEQ ID NO: 13900 - protein, 252 aa, Unknown
  Obtained from environmental sample
  misc_feature (1)..(252): Xaa is any amino acid
MSYKQLTLSKRYHISTLLKQGYKQKDIANEIGVDPSTICRELKRNRTNMRGYSAESAEIKSSSRHKQKQKRTFLTKPIEKYIRAKLKLDWSPEQLSGRMKLDIGVSVAHESIYRYIYANKANGGKLYTYLRHKNKKYHKRSNVYKARGTIIDRVMIDKRPKIVEKKNRIGDLEIDTVIGKNHIGALVTVVDRKSKFTMIKNVQSKESKVVTEALIEMIPPIKNITHTIPSDNGKEFAYHKEISAALDTKFYF

SEQ ID NO: 13901 - DNA, 429 bp, Unknown; identical to SEQ ID NO: 13745
  Obtained from environmental sample
  misc_feature (1)..(429): n is a, c, g, or t

SEQ ID NO: 13902 - protein, 142 aa, Unknown; identical to SEQ ID NO: 13746
  Obtained from environmental sample
  misc_feature (1)..(142): Xaa is any amino acid

SEQ ID NO: 13903 - DNA, 414 bp, Unknown
  Obtained from environmental sample
  misc_feature (1)..(414): n is a, c, g, or t
ttggttatggggaaagtgattttagaacaaaacgaagtaatgggaaatatcaaaaacctaggagccatggagccggggcagcatgttagttttaacagtacaactggttcggttatatgcaccaaaggaaacgttgaaaagtacattgcctggaaagagggcaaattggtattcgatgatgcaaccgtaactcaagttgctaagaggcttagccgcatgtttaatgtagatatacaagttgctgatgatataaagaatcacatctacacagttacttttgttgatgaacctctctttcagattcttgacctgatgaccatggctactccagtccagtataaaacatttccgcgaaaaaaattatctgatggtacattctcaagacaaaaaataaaaattgaaaacaaaaaataa

SEQ ID NO: 13904 - protein, 137 aa, Unknown
  Obtained from environmental sample
  misc_feature (1)..(137): Xaa is any amino acid
MVMGKVILEQNEVMGNIKNLGAMEPGQHVSFNSTTGSVICTKGNVEKYIAWKEGKLVFDDATVTQVAKRLSRMFNVDIQVADDIKNHIYTVTFVDEPLFQILDLMTMATPVQYKTFPRKKLSDGTFSRQKIKIENKK

SEQ ID NO: 13905 - DNA, 588 bp, Unknown
  Obtained from environmental sample
  misc_feature (1)..(588): n is a, c, g, or t
ttgctatctaacaaatcaaataaagaactactccagctcattcaaaaggatgacagggttgctttttataatttgtatgagcgatatagtaaaagattatatggttttgttttaagatatttaaagcaagaagcagatgtggaagagattgtgcaggaagtttttattaaaatttgggaaaccagaaataaaattgatgttttttcctcattcgagtcatttctgtttactattgcctataacgctacgataagcctttttcgaaagagggtaaatgagaaaaaatacctggaacacctaaaatccttacaacaaattgataatgccccagatttaacagacgaaattcattttaaggaattaaataatagggtacagcaacttctgaatgaattaactccacgccagaaagagatttttcaattaagccgcgaacaagggcttactcacaatgaaatagcgggaaaacttaatgtctctgttaataccgttaagaaacacatggtaaatgcgctttcgtatttaaaatcccacattgatagtggtttgattatcaacgttttgtttatctgtttattcctttcgtaa

SEQ ID NO: 13906 - protein, 195 aa, Unknown
  Obtained from environmental sample
  DOMAIN (132)...(177): HTH DNA binding domain
  misc_feature (1)..(195): Xaa is any amino acid
MLSNKSNKELLQLIQKDDRVAFYNLYERYSKRLYGFVLRYLKQEADVEEIVQEVFIKIWETRNKIDVFSSFESFLFTIAYNATISLFRKRVNEKKYLEHLKSLQQIDNAPDLTDEIHFKELNNRVQQLLNELTPRQKEIFQLSREQGLTHNEIAGKLNVSVNTVKKHMVNALSYLKSHIDSGLIINVLFICLFLS

SEQ ID NO: 13907 - DNA, 705 bp, Unknown
  Obtained from environmental sample
  misc_feature (1)..(705): n is a, c, g, or t
gtgattgccaataatatgcgtataggtggaatacaaaaatcaacattgattgattatccaggtaatattgctgcaattatttttacccaaggttgtaattttagatgtccatattgtcataatcctgaattagtaaaaccaaaattatttgaagcaaatattccagaagaaaaaatatttagatttcttgaattaagaaaaggaaaattagatgcagtgtctattactggcggagaaccaactcttcagcttgatttatatgattttataaaaaaggtaaaagaaatgggtttcaaagttaagttagatactaatggaactaattttgaaattttaaaaaaacttatagatgaaaagttgattgattatgctgcaatggatataaaagcgccattagaaaaatatgaagaagttgtaaaaatgaaagttgatttagaaaatatcaaaaaaagtattaagcttattataaattcaaatattgaatcagagtttaggactacgattgtaaaatctttactaagttttgaggattttgaaaaaataggggagatgataaaagatgctccatattatgtagttcaaaaatttgtagagtcaaaagcaattgatgaagatgtttttaattttgaaatgtatgatgatgaaggttatgaaaaaataagtaaaattatgagtaaatatgtggagaaagtagaaataagataa

SEQ ID NO: 13908 - protein, 234 aa, Unknown
  Obtained from environmental sample
  DOMAIN (26)...(188): Radical SAM superfamily
  misc_feature (1)..(234): Xaa is any amino acid
MIANNMRIGGIQKSTLIDYPGNIAAIIFTQGCNFRCPYCHNPELVKPKLFEANIPEEKIFRFLELRKGKLDAVSITGGEPTLQLDLYDFIKKVKEMGFKVKLDTNGTNFEILKKLIDEKLIDYAAMDIKAPLEKYEEVVKMKVDLENIKKSIKLIINSNIESEFRTTIVKSLLSFEDFEKIGEMIKDAPYYVVQKFVESKAIDEDVFNFEMYDDEGYEKISKIMSKYVEKVEIR

SEQ ID NO: 13909 - DNA, 438 bp, Unknown
  Obtained from environmental sample
  misc_feature (1)..(438): n is a, c, g, or t
ttgggaaaaagatacaatgcggataaacgtaccagtatgtttatccgcatgttggcggtaataaaaaacaacatgaatcaaaaagtaaattggttcttcgacaaggacacaaagtggcagatagaatataaaaagctaagagctattataattgactgtggtttaacagaagagttgaaatggggatgtccttgttatacctttaacgggaataatattgttttaatccatggatttaaagattactgcgccctactttttcataaaggagttttacttaatgactcggacaaattattaattcaacaaacagaaaacgtacagtcagcaagacagattcgattttctaatattaatgaaatcaacgaattagagcagactatccaagcttatgtttttgaagcaattgaagtagaaaaagcaagattggaaatttaa

SEQ ID NO: 13910 - protein, 145 aa, Unknown
  Obtained from environmental sample
  misc_feature (1)..(145): Xaa is any amino acid
MGKRYNADKRTSMFIRMLAVIKNNMNQKVNWFFDKDTKWQIEYKKLRAIIIDCGLTEELKWGCPCYTFNGNNIVLIHGFKDYCALLFHKGVLLNDSDKLLIQQTENVQSARQIRFSNINEINELEQTIQAYVFEAIEVEKARLEI

SEQ ID NO: 13911 - DNA, 417 bp, Unknown
  Obtained from environmental sample
  misc_feature (1)..(417): n is a, c, g, or t
ttggtaatttttctaggagtttcaattatctacgatggtcagttgtcgcagaaaaattttactccgaataaatatagggatattactcagcaatttgttaagaaacctcttggcgagaccaccattctggctcccatgacttttgtgtttgatcaggtttctgattacaaagaaataataagcttaatgtcgttcaacgaacgctcgaaaacagagttgaatttattgagtccacattttttcaccatcgccaatgaagaaagaatcgattacattgtaattaataatcattacattgagaagtttaaccttggcgatttaaatctgaagaaaaataccggtagttacaaactattgggagaagtagacggtctggctgttttggaaaatgtatttgtttacgataagtttaattaa

SEQ ID NO: 13912 - protein, 138 aa, Unknown
  Obtained from environmental sample
  misc_feature (1)..(138): Xaa is any amino acid
MVIFLGVSIIYDGQLSQKNFTPNKYRDITQQFVKKPLGETTILAPMTFVFDQVSDYKEIISLMSFNERSKTELNLLSPHFFTIANEERIDYIVINNHYIEKFNLGDLNLKKNTGSYKLLGEVDGLAVLENVFVYDKFN

SEQ ID NO: 13913 - DNA, 342 bp, Unknown
  Obtained from environmental sample
  misc_feature (1)..(342): n is a, c, g, or t
atggaaatacaaccaggactcttcaaagaaaaagaattccgacgaaccttacacaacaacgagtggtggttcgccatcattgatgtgattgcagctttaaccgtaagagccgaccctaaacagtatgtaaaaaagatgtgccaacgagatagcgaattgaattcctactggggtacaatttgtaccccccttccgttacaagctcaagatgggaagacaagaaaaatcaactgcgccaacaccgaaggcattttccatattatccaatccatctcttccccaaaggcagaaccgttcaaacgctggctggcaaaggtgggtcatgatcggggaaagaaatga

SEQ ID NO: 13914 - protein, 113 aa, Unknown
  Obtained from environmental sample
  misc_feature (1)..(113): Xaa is any amino acid
MEIQPGLFKEKEFRRTLHNNEWWFAIIDVIAALTVRADPKQYVKKMCQRDSELNSYWGTICTPLPLQAQDGKTRKINCANTEGIFHIIQSISSPKAEPFKRWLAKVGHDRGKK

SEQ ID NO: 13915 - DNA, 384 bp, Unknown
  Obtained from environmental sample
  misc_feature (1)..(384): n is a, c, g, or t
atgaaaaagttttttttagctctatttttaacgtcaattgttactatttcaatagcagcaaaaacatttacggttggggtagaaaatattaactactatccatactattcaactgaaaatgacgcttacattggtttttctagggaagtacttgatatgttttctcaagataataaccatacgttcatatacaaatctcttccaataaaacgtctatatggtgagtttattaaaggtgctgtagatttcaaatatcctgataatagtgactgggcatctgataaaaaatcagataagaaaatattctatagctccccaattatagaaattatagatgcacttatggttaaaccttctaatattgataaaagtgtgatgctataa

SEQ ID NO: 13916 - protein, 127 aa, Unknown
  Obtained from environmental sample
  SIGNAL (1)...(20)
  misc_feature (1)..(127): Xaa is any amino acid
MKKFFLALFLTSIVTISIAAKTFTVGVENINYYPYYSTENDAYIGFSREVLDMFSQDNNHTFIYKSLPIKRLYGEFIKGAVDFKYPDNSDWASDKKSDKKIFYSSPIIEIIDALMVKPSNIDKSVML

SEQ ID NO: 13917 - DNA, 525 bp, Unknown
  Obtained from environmental sample
  misc_feature (1)..(525): n is a, c, g, or t
atgatatattctaaacaatttatactcgaccaactagctcctatcgccgtttattctaaactaaaaagcatgttcaaaggtgagatttctcaccttcttgagagtgccggacaaagtgacggaaactacagttttatctgtatcggtgcaagagaaagacttcaatacataaatgatgaaactatctacacagatgctaatggtactaaacacacacaaaaagaaaatccctttacatttttaaaagagtactataaaaacatagatacaactaagtacaaagaagctacagcccaactgaaaattggttatgttgatggttttattggctatatcggttacgatatggttaaagtatttgaaccgaaacttggctcaagtatggacaacttagaagatgaactaaatactcctgaccttgatttaatgctacctaaacttattttagtatattcacataaaaaccaccaaatcactcttattagtacacttaaagagatgaactatagatttgactcctattga

SEQ ID NO: 13918 - protein, 174 aa, Unknown
  Obtained from environmental sample
  DOMAIN (3)...(160): Anthranilate synthase component I, N terminal region
  misc_feature (1)..(174): Xaa is any amino acid
MIYSKQFILDQLAPIAVYSKLKSMFKGEISHLLESAGQSDGNYSFICIGARERLQYINDETIYTDANGTKHTQKENPFTFLKEYYKNIDTTKYKEATAQLKIGYVDGFIGYIGYDMVKVFEPKLGSSMDNLEDELNTPDLDLMLPKLILVYSHKNHQITLISTLKEMNYRFDSY

SEQ ID NO: 13919 - DNA, 762 bp, Unknown
  Obtained from environmental sample
  misc_feature (1)..(762): n is a, c, g, or t
ttgccatttgtactaaaagagtttccagcagtacctggaaaaaaaattcaacaatttttaatagatgatgttggtttaacaatttctagttctcaaaagttattagcaaaatgtagagtgtttgatcaaaatgacaaagtattgcaaaatggtgaaaaactcaaatgtgattttataaagattgctatgtttgagggacaaactagaggtttaaaacctattttcaatacaaaagagtttgcaatatttgataaaccatcaggagtgatagtacatccaacttcaagaaacacagaatactctttacttgatgagatacgatttcattttggtgatgctgcaaacttagctcataggatagatcaagaaacatcaggattggtacttgttacaaaaaataagtatagtgatatggttttaaaagatatgtttgaaaataaattgtatgaaaaaaaatatttagcaattgttgagggaaaaatagataaaaatatcactatagatgagggtataaaaaaagcaacaaatagtaaaattggtgtgaaaatggtaaccgcagctgatggaaaggaatctgttactcatattagccctttacaatataataaaatcaaaaatcaaactttagttgaagccacaccaataacaggaagacaacatcaaataagagtacatcttcattctattggacataaaatagtaggagatccaatttatggagttgatgaagatattgcagataagtatcttttaaaaaactaa

SEQ ID NO: 13920 - protein, 253 aa, Unknown
  Obtained from environmental sample
  DOMAIN (79)...(228): RNA pseudouridylate synthase
  misc_feature (1)..(253): Xaa is any amino acid
MPFVLKEFPAVPGKKIQQFLIDDVGLTISSSQKLLAKCRVFDQNDKVLQNGEKLKCDFIKIAMFEGQTRGLKPIFNTKEFAIFDKPSGVIVHPTSRNTEYSLLDEIRFHFGDAANLAHRIDQETSGLVLVTKNKYSDMVLKDMFENKLYEKKYLAIVEGKIDKNITIDEGIKKATNSKIGVKMVTAADGKESVTHISPLQYNKIKNQTLVEATPITGRQHQIRVHLHSIGHKIVGDPIYGVDEDIADKYLLKN

SEQ ID NO: 13921 - DNA, 693 bp, Unknown
  Obtained from environmental sample
  misc_feature (1)..(693): n is a, c, g, or t
ttgatgcttgcttctcaccttaaaagtagtaatgtatgcttgatagatagcaatacgaaagttggtgctaaaataaaagtatcaggtggagcaaagtgtaatattactaataaaaaagttacatcaaataactatttaggagatagtgcttttgtaagttctgttttaaaagagtattcaaacgaagacttaataagttttctaaaaaaacaaaacttaatttttaacctcaatgaaaaaatagtaaaaggaacttttttttgtaatacatcacaagatgttattgatatgtttttaaaactaataaaagataaaagactttttttaaatacccaagtttccgatatagagtttgataatttttataaaattaaaacaaataatcaaatcattgaagcaaaaaaagttgtgattgcaagtggaggtttgagttatcaaagtttgggagctagttccatagcatttgatattgcaaaaaagtttaaacacaaagtcaattccttaaatcctgcacttgtgggttttactgtacaaaaagagcagttttggtttaaaaatctaagcggtatttctatgtatgtaaatgctaaagttgaaaataaaacttttgaaggaggtctactttttgcccataaaggcataactggacctgtgattttaaatagttctttgtattggaaaaaggaaaaatga

SEQ ID NO: 13922 - protein, 230 aa, Unknown
  Obtained from environmental sample
  DOMAIN (33)...(230): HI0933-like protein
  misc_feature (1)..(230): Xaa is any amino acid
MMLASHLKSSNVCLIDSNTKVGAKIKVSGGAKCNITNKKVTSNNYLGDSAFVSSVLKEYSNEDLISFLKKQNLIFNLNEKIVKGTFFCNTSQDVIDMFLKLIKDKRLFLNTQVSDIEFDNFYKIKTNNQIIEAKKVVIASGGLSYQSLGASSIAFDIAKKFKHKVNSLNPALVGFTVQKEQFWFKNLSGISMYVNAKVENKTFEGGLLFAHKGITGPVILNSSLYWKKEK

SEQ ID NO: 13923 - DNA, 885 bp, Unknown
  Obtained from environmental sample
  misc_feature (1)..(885): n is a, c, g, or t
ttgatggctgaggttgagaatttcaaagataaagcaataaaaatagcccacatcctatcaacactagatgacaaaatagaactaaatcgtaaaatgaaccaaacattagaggagatggcgcaggttatctttaaatcttggtttgtagattttgacccagttcatgcccttgcaaatcgtggcgatagtgagttagaagaagtagccagtgaacttggaatatcaaaagaggttttagagctatttcctagtgagtttgaagagagtgaacttgggatgattcctaaggggtgggaagtaataagatttggaaaaactgtagaaaaatatattgataatcgtggtaaaacaccacctactgtagaagatggaatacctctattagaagttagaaatatgccagatgagatgcttacatcaaatccaaatgtaacaaaatatgtgacagaagatatttataatagttggtttcgttcttatttagaagaaaatgacattttaatttctacggttggaacaattggtaagacttgtattgttccaaaaaattcaaagattgcaatagctcaaaatgttttaggtttaagatttgaaaatgatatattgaataataaatttatgttttatcaaatgaaaaataaacagtttctaaatgctatcgatgctagattagttgttacagtacaagcaagtattaaaagaaaagatttagatactattgatgtacttattccaccaaaagagatacaagaaatttttgtaaaacaaatacaacctctaattgaaaaacaacaaagtaatgaaaatattaatcttggaaaattagagatactttgttaccgaaactttttagtggtaagattgaggtataaatggagtttttaa

SEQ ID NO: 13924 - protein, 294 aa, Unknown
  Obtained from environmental sample
  DOMAIN (98)...(262): Type I restriction modification DNA specificity domain
  misc_feature (1)..(294): Xaa is any amino acid
MMAEVENFKDKAIKIAHILSTLDDKIELNRKMNQTLEEMAQVIFKSWFVDFDPVHALANRGDSELEEVASELGISKEVLELFPSEFEESELGMIPKGWEVIRFGKTVEKYIDNRGKTPPTVEDGIPLLEVRNMPDEMLTSNPNVTKYVTEDIYNSWFRSYLEENDILISTVGTIGKTCIVPKNSKIAIAQNVLGLRFENDILNNKFMFYQMKNKQFLNAIDARLVVTVQASIKRKDLDTIDVLIPPKEIQEIFVKQIQPLIEKQQSNENINLGKLEILCYRNFLVVRLRYKWSF

SEQ ID NO: 13925 - DNA, 429 bp, Unknown
  Obtained from environmental sample
  misc_feature (1)..(429): n is a, c, g, or t
ttgaatatatatatttacggtgaactatcttttaaaatggaaattcataaaattttagaccatgggaatatacggtttaaaattggagatggtgaagttattgatgttgagtacctttatgatcttgaagagcttattgaagaagatcctactcaaatatttataatcgatcaaaataaaattatagaagatagtgtaacgactaaactctttaaattcttaataccaaaagatgggataacacaaaaatatttagaccattatggtatgggggatgttagcattcgaacctataaagaccttatgattcatatagaaaaaaggttagaatttatagaaaactcanaacctaaagcacatgaaatcacttctatagaggatatgttagaggatgatactctagaggctattagtaaatctctaaactag

SEQ ID NO: 13926 - protein, 142 aa, Unknown
  Obtained from environmental sample
  misc_feature (1)..(142): Xaa is any amino acid
MNIYIYGELSFKMEIHKILDHGNIRFKIGDGEVIDVEYLYDLEELIEEDPTQIFIIDQNKIIEDSVTTKLFKFLIPKDGITQKYLDHYGMGDVSIRTYKDLMIHIEKRLEFIENSXPKAHEITSIEDMLEDDTLEAISKSLN

SEQ ID NO: 13927 - DNA, 897 bp, Unknown
  Obtained from environmental sample
  misc_feature (1)..(897): n is a, c, g, or t
atgcttttgatgaagctgcgctttaaagaggggaaagatattgctaatgcatttaaagataagcttaaagaaatgcatgttgaggtgagtaaacttcttatgcaaagaggtgagttcccattcctggttagtcttaccagttttagtgataaattatcgcgatggtgtaataaagaatacagctattacctgacgaaacctgacgaatttgaagacgaattgctggataccaaagaagacttgctcgaccccataaagcgctttatgaatggtgaacaggctaagatttacagcgacatcaaaaacctgctggctggtgatacctctaatcttgattatgttgaaggcaatgagataaatgtattacatagtataattgatgccgacaaaccctatacaggcaacaaaataaaagatgcaaaggcaagtaaggatgcactctcaaagaaggtgcaggacaagatctcttcagaaaaaacagaagctgttcaatccatcgaaaaggcaattgttgatttaatggcaaaagatgatttctccgaattagaggaactccagcaaagaacaattgtaaagcctcttgaggatgaactggagaagctgcaaaagacaaaatatattgcccgtatacgtgatattaaaagaagagctaccgatgatatattcaccaagcaattaaatgcgatggtcgcacttgccaatctggtagagcaaccaaatgatggtgcaagtgtggtggcggaacctaaagttcattacataaaaagaagcaacgtanaaccaccattttcaaagtctgagttaaaaacagaagaagaggtggatgagtatgtggaagcattaaaattagcgttaaaagacacattagaaacaacccgaaggatcaattatagatga

SEQ ID NO: 13928 - protein, 298 aa, Unknown
  Obtained from environmental sample
  misc_feature (1)..(298): Xaa is any amino acid
MLLMKLRFKEGKDIANAFKDKLKEMHVEVSKLLMQRGEFPFLVSLTSFSDKLSRWCNKEYSYYLTKPDEFEDELLDTKEDLLDPIKRFMNGEQAKIYSDIKNLLAGDTSNLDYVEGNEINVLHSIIDADKPYTGNKIKDAKASKDALSKKVQDKISSEKTEAVQSIEKAIVDLMAKDDFSELEELQQRTIVKPLEDELEKLQKTKYIARIRDIKRRATDDIFTKQLNAMVALANLVEQPNDGASVVAEPKVHYIKRSNVXPPFSKSELKTEEEVDEYVEALKLALKDTLETTRRINYR

SEQ ID NO: 13929 - DNA, 558 bp, Unknown
  Obtained from environmental sample
  misc_feature (1)..(558): n is a, c, g, or t
gtgagtaagatggcaaacagattacaagaaagatataatgcagagattaaaccagttttagaaactgagtttcctaaaaacaagacgttaactgctaagttagaaaaagtagttatctctgttggtgctggtgaagcaatgaaagatactaagttgatgcaaaatattcaagatactatctctttaattgcagggcaacatgctgtgcaaattattgctaaaaaatcagttgctggttttaaagtaagagaaggtatgccagtaggtgtaaaagttacacttagaggtgaaaatatgtatgcattcgtggacaaattatgttcagttgcattaccaagagtaaaagactttttaggtcttgacagaaatggttttgatggaagaggtaactttaactttggtcttaacgagcaattaatgttcccagaagttgaatacgataacattattaaaactcatggtatgaatatttctattactacatcttcagcttctgataaagaagcttatagattattagagttagtaggaattccatttacaaaaggtagagaataa

SEQ ID NO: 13930 - protein, 185 aa, Unknown
  Obtained from environmental sample
  DOMAIN (27)...(83): Ribosomal protein L5
  misc_feature (1)..(185): Xaa is any amino acid
MSKMANRLQERYNAEIKPVLETEFPKNKTLTAKLEKVVISVGAGEAMKDTKLMQNIQDTISLIAGQHAVQIIAKKSVAGFKVREGMPVGVKVTLRGENMYAFVDKLCSVALPRVKDFLGLDRNGFDGRGNFNFGLNEQLMFPEVEYDNIIKTHGMNISITTSSASDKEAYRLLELVGIPFTKGRE

SEQ ID NO: 13931 - DNA, 975 bp, Unknown
  Obtained from environmental sample
  misc_feature (1)..(975): n is a, c, g, or t
gtggaccatccaatgtcaattgattatagaataaaaaataattttgttccagcagcgatgaaaggattaacaaaccatcttactacagatgttacaggtgcaaaaattattaatacttttgatgcattaagtagagaatttacaataggtcttgatagcagtaagagaaattgggatggaaaatattatagcaatatgaatccctctataagaaaaagtatcaacgatacagatacaaaaaacaatgcaatatttataaagtgtaaaaatcaattagacaaattaactctagaattaggtgcaagatatgactcaacaaaaatagatactaatggcgcagagcaagataataaatatactgattttagtggaaatattatggctacatataatagtgatgaaaatacaaagtattttattggattaggacaagctagccgtgttccagatgcaagagaattatattttgtagcttcaaatggtactagcgtaggaacagaagatttaaaagctacaacaaatagagagttagactttggaacagaacactattataaagatggaaaaattaaagcaaaatttttctatagtgatttaaaaaactatatctactatagagatacaggtgcagcaactaataagtttgaaaatattgatgctaagatatatggattagagcttagtggttcttattatatcaatgaacaatttacacttgatggtggatatacttacaaaattggtaaaaaagataaagccatagctggtcaaacagatacagatttagcagatattacaccagcaaaaactactcttgcactntactatgattataataaccacaacaaatgcatgatagaatttatcaatgtatcatcatggaataaatatgatagtgataatggagagcaacatatatctggatacaatatagttaatcctaaagcacaaaacaactgttgcccaaaattttga

SEQ ID NO: 13932 - protein, 324 aa, Unknown
  Obtained from environmental sample
  misc_feature (1)..(324): Xaa is any amino acid
MDHPMSIDYRIKNNFVPAAMKGLTNHLTTDVTGAKIINTFDALSREFTIGLDSSKRNWDGKYYSNMNPSIRKSINDTDTKNNAIFIKCKNQLDKLTLELGARYDSTKIDTNGAEQDNKYTDFSGNIMATYNSDENTKYFIGLGQASRVPDARELYFVASNGTSVGTEDLKATTNRELDFGTEHYYKDGKIKAKFFYSDLKNYIYYRDTGAATNKFENIDAKIYGLELSGSYYINEQFTLDGGYTYKIGKKDKAIAGQTDTDLADITPAKTTLALYYDYNNHNKCMIEFINVSSWNKYDSDNGEQHISGYNIVNPKAQNNCCPKF

SEQ ID NO: 13933 - DNA, 585 bp, Unknown
  Obtained from environmental sample
  misc_feature (1)..(585): n is a, c, g, or t
gtgtttatgaataaaaaagtatatatttcgctaatcacggcattagtagttaatgcaaatgcagcagatttaggaactattagtgttgagtcttcaactattgatgataagtttgaaactaaaaaaacagaagtttcaagtagtactataattacaactaatgatgtggaaaaaataaatccaactaacattgaaaacattttaaatacaataccaggtattaccgcttcaaatgtagggaatgacagagttaagatacatatcagaggtatagacaatcaaatgtacatgggagaaaaacctggtgttgccgttgtaattgatggtgttccagtacaagaaacaactggtaaaatcaacctcgatttagataatattgctagtattaaagttattaaaggaagtgctagttacttatatggaaatgatgcgatagcaggtgcagttgttattactacaaaaagaccaaagggcttaagtagttcaaaactagaaacagaaattggtagttttggatttaaaagatttttagcttctacgaatcaatcattaaaacgggggctttacaactacaaggaacagtaa

SEQ ID NO: 13934 - protein, 194 aa, Unknown
  Obtained from environmental sample
  SIGNAL (1)...(19)
  misc_feature (1)..(194): Xaa is any amino acid
MFMNKKVYISLITALVVNANAADLGTISVESSTIDDKFETKKTEVSSSTIITTNDVEKINPTNIENILNTIPGITASNVGNDRVKIHIRGIDNQMYMGEKPGVAVVIDGVPVQETTGKINLDLDNIASIKVIKGSASYLYGNDAIAGAVVITTKRPKGLSSSKLETEIGSFGFKRFLASTNQSLKRGLYNYKEQ

SEQ ID NO: 13935 - DNA, 549 bp, Unknown
  Obtained from environmental sample
  misc_feature (1)..(549): n is a, c, g, or t
ttgagaggtggccggtaccaatgctggctaaaatatggttctcaggttttaacagcggaatttaattatgcgggaaaacctcttttagaaaaacctgaacaaatctaccctttcagcgttgtaaatgcttatgcaaaaaatttaaaaactcttcaaaagaagatgcaaaaaaagatatctcattcaacaatagggataataacacaaccggtttatgatttagaaaatgcaaaaatacttttggagttaatgagtaacgcaaaaaaagaggctagaactgatattaatgatgcaacactaattttaggatttttcccaattactaaactgcgtactgctcaatttttatcggctcatgttcctggtattgatgttccgccttactggatagataagctaagagttgcaaatgaaaaaggagaagatgaggagagaaaagttggatttgagatgagtaaaaatctgtttgaagagctaaaatcagttcatccaaagattcatctcatgacagcaaatcaatttcaattagcaaaagagatattactctaa

SEQ ID NO: 13936 - protein, 182 aa, Unknown
  Obtained from environmental sample
  misc_feature (1)..(182): Xaa is any amino acid
MRGGRYQCWLKYGSQVLTAEFNYAGKPLLEKPEQIYPFSVVNAYAKNLKTLQKKMQKKISHSTIGIITQPVYDLENAKILLELMSNAKKEARTDINDATLILGFFPITKLRTAQFLSAHVPGIDVPPYWIDKLRVANEKGEDEERKVGFEMSKNLFEELKSVHPKIHLMTANQFQLAKEILL

SEQ ID NO: 13937 - DNA, 852 bp, Unknown
  Obtained from environmental sample
  misc_feature (1)..(852): n is a, c, g, or t
gtgatactatctatgcaaactaaatctaaactacttcttatagtagccttaatgctacttgccataacaactgcaacaataataaacatagcactaaactttagagactacagtattaagagtgccatagaaaagtcaaaaatgacagcaactattgttaaagacggcttaacagcgcacatggttaatggaattatggataaacgagaatattttttaaatcaaatatctaccaataataaagctgtaaaatccttgtggcttgcaagagctgatggtgtgataaaacaatatggtaaaggtttaaaccatgagaccgctagagatgctatagataaaaaagttttaaagactggaaaagttattagaaaaatcattgaaaataccaatgagataactcttcgagtaacaataccttataaagcgacagtcagtggtggagatacaaattgtcttacttgtcataacgtaaaaagaggagatacccttggtgcaataagcatggagttcgatataagcgatatgagaacaagcggaatgtttactattttaaaaatatttggcatcaatatgttgtttttactaattgtccttctcttgctaaatcattatgtaactccgtatataaaattgttctcaaatcttcaaaacggtatcaaaaaagcatatagcggtgacttcactcataaatttgaaactacagtaggaggggatgctaaaagtattatagaccaaatgaatactctattttcaaagatgcaagaaacatttggagatatcaaatacaatcctttctacatttatcccctcaggctgtgtcttctagctcagatccacctatatgaagcctaa

SEQ ID NO: 13938 - protein, 283 aa, Unknown
  Obtained from environmental sample
  misc_feature (1)..(283): Xaa is any amino acid
MILSMQTKSKLLLIVALMLLAITTATIINIALNFRDYSIKSAIEKSKMTATIVKDGLTAHMVNGIMDKREYFLNQISTNNKAVKSLWLARADGVIKQYGKGLNHETARDAIDKKVLKTGKVIRKIIENTNEITLRVTIPYKATVSGGDTNCLTCHNVKRGDTLGAISMEFDISDMRTSGMFTILKIFGINMLFLLIVLLLLNHYVTPYIKLFSNLQNGIKKAYSGDFTHKFETTVGGDAKSIIDQMNTLFSKMQETFGDIKYNPFYIYPLRLCLLAQIHLYEA

SEQ ID NO: 13939 - DNA, 690 bp, Unknown
  Obtained from environmental sample
  misc_feature (1)..(690): n is a, c, g, or t
ttgaatttaaactatactattggagctatgatggctaaaatgaattttgcaaaaaaagaaaataaagaaacctcagttgaaaaaagttttttcaagatacttattgttgacgatgaacaagaggtacataatatcactaaagcagttttaagaaattttacatttgaaaataaaagcgtagagatattaagtgcttttaatggacaagaagcgattgaagtattaaaagagcatccaaatattgctttaattttacttgatgtagttatggaaactgatgatgctgggcttattgttgcaaaaagaataagagaagaattacataataaaaatgttcgtattgttttaagaacaggacaaccaggatgtgctcctgaaaaagaggtgattgataattatgatatcaatgattataaagaaaaaactgaacttacctctataaagctttatactactattgttgcatcacttcgttcatacagagatttaactattattgaaagaaataaaaagggtttacaaaaaattattttagcttctaagtctatttttcaactaagctctttagttatatttacggaaggtgtattagaacaacttgtatctattttaaatataggtgatagttttatccaatccaaagcaagtgatgctttttttgcccccattaaaaaaatccaagatttttga

SEQ ID NO: 13940 - protein, 229 aa, Unknown
  Obtained from environmental sample
  DOMAIN (31)...(161): Response regulator receiver domain
  misc_feature (1)..(229): Xaa is any amino acid
MNLNYTIGAMMAKMNFAKKENKETSVEKSFFKILIVDDEQEVHNITKAVLRNFTFENKSVEILSAFNGQEAIEVLKEHPNIALILLDVVMETDDAGLIVAKRIREELHNKNVRIVLRTGQPGCAPEKEVIDNYDINDYKEKTELTSIKLYTTIVASLRSYRDLTIIERNKKGLQKIILASKSIFQLSSLVIFTEGVLEQLVSILNIGDSFIQSKASDAFFAPIKKIQDF

SEQ ID NO: 13941 - DNA, 384 bp, Unknown
  Obtained from environmental sample
  misc_feature (1)..(384): n is a, c, g, or t
atgaaatttaaaaatattattacaaaactttacattgctttaggttttattgttagtatatcacttgctattgttatgttttcaaactattcaagttctatacttgaaaaaaacaataaaaaaagacatgagatcaataatgagattatattttttgaatcaatgctagggaaacatgaaaagtatgtaaaagagatgttacattcaatgatatttcaaacaaaatttacaaaagaattaaacccaaaaaaatgtaattttggacagtggtattacaaaatgataaactctgaaaagtttaaagaacttccaaaaaatatacaaaaagatattttaggtattgaacttagtcacacaatactcaccaacactcagccgatctga

SEQ ID NO: 13942 - protein, 127 aa, Unknown
  Obtained from environmental sample
  misc_feature (1)..(127): Xaa is any amino acid
MKFKNIITKLYIALGFIVSISLAIVMFSNYSSSILEKNNKKRHEINNEIIFFESMLGKHEKYVKEMLHSMIFQTKFTKELNPKKCNFGQWYYKMINSEKFKELPKNIQKDILGIELSHTILTNTQPI

SEQ ID NO: 13943 - DNA, 828 bp, Unknown
  Obtained from environmental sample
  misc_feature (1)..(828): n is a, c, g, or t
ttgaagattgtggatgttagtgatgaaataaatgctttacaagtagatattcctaaaagacttgaagagtttgaagcatatctagccgatatagataatgagccagacattgatattggaagtcattgtaacaagccttatgaatgtgatgcaaaagagtactgctggaaagttcagagaagtatacctgagtactcattgttcaatatttttaatcttggcagtaagaagcagatagaactttatgaacaaggcatagttaatatagaagatattcctgagagttatgctatgacagctatacaaaaacaaaaagttcaaaactggaaagatcaactaacttttgtagatgaagataatataaaagattttcttaacacactgagctatcctatttatcatttagattttgagacctttcaacaagccattcctgagtggaaaggtattagcccataccaacagataccatttcagtattcgcttcatatagagcattctaatggagctatagagcataaagagtttttagcagaagatggtgttgaccctcgttatgaattggctaagagactgattgaagatattcctacagatgttacagttttagcttataacatgagttttgaaaaaggagttaattctaagctagctgagagttttcctgagtttaaagaacatctactctctataaatgagaatactaaagatttaatgcttccttttcaaaagcagtactatgtaatacctagtatgcaaggaagttactctataaagtatgtattaccatctttagttccagaaatggcagaagcatataaaagttaa

SEQ ID NO: 13944 - protein, 275 aa, Unknown
  Obtained from environmental sample
  misc_feature (1)..(275): Xaa is any amino acid
MKIVDVSDEINALQVDIPKRLEEFEAYLADIDNEPDIDIGSHCNKPYECDAKEYCWKVQRSIPEYSLFNIFNLGSKKQIELYEQGIVNIEDIPESYAMTAIQKQKVQNWKDQLTFVDEDNIKDFLNTLSYPIYHLDFETFQQAIPEWKGISPYQQIPFQYSLHIEHSNGAIEHKEFLAEDGVDPRYELAKRLIEDIPTDVTVLAYNMSFEKGVNSKLAESFPEFKEHLLSINENTKDLMLPFQKQYYVIPSMQGSYSIKYVLPSLVPEMAEAYKS

SEQ ID NO: 13945 - DNA, 846 bp, Unknown
  Obtained from environmental sample
  misc_feature (1)..(846): n is a, c, g, or t
atgcaactctctaaatctctctatacaaaagcaatccagtgtccaaaagcattttggttaaagaagtataaaaaatatgtacttacacctccagatgcaactgcattagcaagatttgaaactggtaatgtagttggggaattagcttgtaaactttttccaaatggaaaagaagttatttatactcctgacgattttaacggtatggtagagactactacagaatggatagaggagagcttagagtatatttatgaagctacttttctttataatggaatcttagttttagtagatgttttaaaagtgactcctgatggattagagatatatgaagtaaaaagttctagtagtgttaaagatatttatttacatgatgtttcgatacagttgtatgtacttcaacagcttggatacagtgtaattagtagtaatgttgtacatattgacagttcttatgttcgaggtgatgagcttgatttaaatgggctattgaagattgtggatgttagtgatgaaataaatgctttacaagtagatattcctaaaagacttgaagagtttgaagcatatctagccgatatagataatgagccagacattgatattggaagtcattgtaacaagccttatgaatgtgatgcaaaagagtactgctggaaagttcagagaagtatacctgagtactcattgttcaatatttttaatcttggcagtaagaagcagatagaactttatgaacaaggcatagttaatatagaagatattcctgagagttatgctatgacagctatacaaaaacaaaaagttcaaaactggaaagatcaactaaacttttgtggatga

SEQ ID NO: 13946 - protein, 281 aa, Unknown
  Obtained from environmental sample
  misc_feature (1)..(281): Xaa is any amino acid
MQLSKSLYTKAIQCPKAFWLKKYKKYVLTPPDATALARFETGNVVGELACKLFPNGKEVIYTPDDFNGMVETTTEWIEESLEYIYEATFLYNGILVLVDVLKVTPDGLEIYEVKSSSSVKDIYLHDVSIQLYVLQQLGYSVISSNVVHIDSSYVRGDELDLNGLLKIVDVSDEINALQVDIPKRLEEFEAYLADIDNEPDIDIGSHCNKPYECDAKEYCWKVQRSIPEYSLFNIFNLGSKKQIELYEQGIVNIEDIPESYAMTAIQKQKVQNWKDQLNFCG

SEQ ID NO: 13947 - DNA, 900 bp, Unknown
  Obtained from environmental sample
  misc_feature (1)..(900): n is a, c, g, or t
ttgaagagtgatgacatagttggtgaaagtgcgaccatattgtactctaatctcaattcaattgagatatatgatgaattgaaatcttccatcagtgatggaaaaagttggtcaggtgaattggctggttatgataaaaatggagatgttatgtttgaaagagttatgacaaaaccattgtatgatgataatggaatacttgatgcctatttgacagtaaaactagatattactaaagataaaaaatatcaaaaagagatagagaaaaaaaatgatcagattactaaaaaacattatatagacaatttaacttctatacctaatagaaatgcacttattgagaggttggatactcaaaagggtgttgtattactctttaatatagactcatttaagcatataaatgactattatggaatgaaaataggtgatcaaattcttgtagaattttctaaattactaaaaaaaataaaaaatgattttgcctttagtgatatatttagagtacatacggatgaattttgtctgtacacttcagagttatcaataataaaaaatatagatgagatgttaaacactatgattgatactatagatagtagtgagttctttgttgaagagatcagcattagtgtaggagcaactataggtgttgcttattctgatgagctagaagctgatagagaacttttaatgagtgctgatttagccttaaaacatgctagaagagaaaagagatcatacagtatatttacagactcaaataaacttcaagaggagtatcatgcaagtttgaagtatgctcatatattgaaagatgccatactgaatgatagagtggtaccttacttttcaccctataataaataccggataatttcaagcctccccctcttatga

SEQ ID NO: 13948 - protein, 299 aa, Unknown
  Obtained from environmental sample
  DOMAIN (94)...(248): GGDEF domain
  misc_feature (1)..(299): Xaa is any amino acid
MKSDDIVGESATILYSNLNSIEIYDELKSSISDGKSWSGELAGYDKNGDVMFERVMTKPLYDDNGILDAYLTVKLDITKDKKYQKEIEKKNDQITKKHYIDNLTSIPNRNALIERLDTQKGVVLLFNIDSFKHINDYYGMKIGDQILVEFSKLLKKIKNDFAFSDIFRVHTDEFCLYTSELSIIKNIDEMLNTMIDTIDSSEFFVEEISISVGATIGVAYSDELEADRELLMSADLALKHARREKRSYSIFTDSNKLQEEYHASLKYAHILKDAILNDRVVPYFSPYNKYRIISSLPLL

SEQ ID NO: 13949 - DNA, 369 bp, Unknown
  Obtained from environmental sample
  misc_feature (1)..(369): n is a, c, g, or t
atggaacaaccacaaaaaaacaaaaaaatgatggtcaatgatatgataatacttcctttccctggtggaaagatatttaaaactgagaagattaaactcagtgataaacaaaaagaacagttggctacagaggttcgaccaattatgcatggaaaatataatcctttaatgcaagagatatttgtattagaaaaatctatccaaagagtaataaagaaaaataaaactatttttgatgcaagacttcaagataaaatagacaaaatagcagatttgaaaaaagaggctattgaatataaactaaaagcactcatgaaaattaaatctattcttactccagaacaatggcaagtatggattaatcattaa

SEQ ID NO: 13950 - protein, 122 aa, Unknown
  Obtained from environmental sample
  misc_feature (1)..(122): Xaa is any amino acid
MEQPQKNKKMMVNDMIILPFPGGKIFKTEKIKLSDKQKEQLATEVRPIMHGKYNPLMQEIFVLEKSIQRVIKKNKTIFDARLQDKIDKIADLKKEAIEYKLKALMKIKSILTPEQWQVWINH

SEQ ID NO: 13951 - DNA, 645 bp, Unknown
  Obtained from environmental sample
  misc_feature (1)..(645): n is a, c, g, or t
atgagtaaaaaaaatgaaaccattctaattagactagactctaaaacaaaagaacgatttagattgtattgtgaatctaaacgattgacaatgacagatgtattaatagatgaaataaatatattattgaactctgatgatagtgaaacatcgcctgatttttctattataaaaaaagaacgtgatttttttaagacagaattatccaggtatgaagaaacatatcatgatatgtatagaatgtttaattcattaaagagaaaacatctttttggcatggacaagttatatactaatctgtttatcgaacactttgaaagaattgaacagtttcaagggtatgaacttattgaaaataacataaacacaaaccgtagagctgaaatgattgcatttaacaaatttacaaatcataaattattatttgaatttagaatttctctacattccaattcacttagtcttaaaaataaacctcaatattattcttggctagaaaactatggagaaaaaagtagtatagagttagtacttattagtttagaaactgtcgatcataaaatacttaaacaatatgaaagtttaagtacaaaaattaattatgatataagtgcctactgtatagatgaattattgaaattctaa

SEQ ID NO: 13952 - protein, 214 aa, Unknown
  Obtained from environmental sample
  misc_feature (1)..(214): Xaa is any amino acid
MSKKNETILIRLDSKTKERFRLYCESKRLTMTDVLIDEINILLNSDDSETSPDFSIIKKERDFFKTELSRYEETYHDMYRMFNSLKRKHLFGMDKLYTNLFIEHFERIEQFQGYELIENNINTNRRAEMIAFNKFTNHKLLFEFRISLHSNSLSLKNKPQYYSWLENYGEKSSIELVLISLETVDHKILKQYESLSTKINYDISAYCIDELLKF

SEQ ID NO: 13953 - DNA, 489 bp, Unknown
  Obtained from environmental sample
  misc_feature (1)..(489): n is a, c, g, or t
atgaatattaaatatagcaaatttgcaaagcgattgacattattgtttataaaagaagagacacactcttatgatgagtggctagttgatagttttggttctttagttttagcgtataatgtagaagatggacttgcaaaattcaatcaaaactatattgatttagttttaattgaattagaaaataactatgaagagaagtttaagcttattgaagagattagaaaaaaaagaccttttataattatcttgatcctctcaaaagatacaaagtatgaaacattaatcaagaatatagaattgggaacagatggttattttacacatcccattgataatcaagagtttttaacaaaagtaaataatctagagggaagatatcaaattggagaagagtacgaaaaatacaaaggaaaatataaatctactcaaacaatatcaagatattgcagaataaaatttcaatcattatccaaaaacttgatatag

SEQ ID NO: 13954 - protein, 162 aa, Unknown
  Obtained from environmental sample
  misc_feature (1)..(162): Xaa is any amino acid
MNIKYSKFAKRLTLLFIKEETHSYDEWLVDSFGSLVLAYNVEDGLAKFNQNYIDLVLIELENNYEEKFKLIEEIRKKRPFIIILILSKDTKYETLIKNIELGTDGYFTHPIDNQEFLTKVNNLEGRYQIGEEYEKYKGKYKSTQTISRYCRIKFQSLSKNLI

SEQ ID NO: 13955 - DNA, 390 bp, Unknown
  Obtained from environmental sample
  misc_feature (1)..(390): n is a, c, g, or t
atggcaggaaaaagattgatatttgagctattagaggatgaaaatatcaaagattttgataatataattagttttattaaaactgtaaaagcgcaaggagtttcaatagctattgatgattttggtgcaggatattctaattttgaacgattattaaaatttgaaccagatattttaaaaattgatggaagtattattaaaaatattgttcatgatgagtatagtagaaatgtagtggaaactatagtaacatttgccaaaaaacaaaatatccaaacagtagctgaatttgttgaaacaaaagagatatttgattatcttaaagaacttggtgttgattactcacaaggatattattttggaaaaccagaagagttaaagttgtattaa

SEQ ID NO: 13956 - protein, 129 aa, Unknown
  Obtained from environmental sample
  DOMAIN (1)...(123): EAL domain
  misc_feature (1)..(129): Xaa is any amino acid
MAGKRLIFELLEDENIKDFDNIISFIKTVKAQGVSIAIDDFGAGYSNFERLLKFEPDILKIDGSIIKNIVHDEYSRNVVETIVTFAKKQNIQTVAEFVETKEIFDYLKELGVDYSQGYYFGKPEELKLY

SEQ ID NO: 13957 - DNA, 774 bp, Unknown
  Obtained from environmental sample
  misc_feature (1)..(774): n is a, c, g, or t
gtgggtcttgaattgaatagaagaacttttttaacacttatcggcatttcatcactaacatgcgcaaaaggtttgtcccctttcgcaatgttagattacaaaaaatgtagagagtacattgatgaacaaagtaaaaaagattttgttttcaatagtaatgaactaattaatgcaaataatctatttaacaagattagaagagctaaatccatcgtcggatatacacaatttaatcttttaggttttgatggtatgctccaaattgctaaaaactactctaaagtagggcaatttacaaaagatgaatctacactgtttgaaaaactattttatgaaaatgcaactcaatatggtttttatggtgaaaaagttataacatcactaacggatgatatagcaaaaaaagatactatctacatagaaaatacaggacatttcctatatcgtggtaaacctcatgatatgtataaaacaataaccaaagatgtaggtgagactattgttttaacatctggtgtacgcagtattgttaaacagatggatctatttttaaataaagtgattagaagcaatggagatctctctgttgcagctcactcactggcacctgctggttattcatttcatggtataggtgattttgatgtaggtaaagtgggatttggatacaaaaattttacatcagactttgcacaaacagatgaatataaaaaattaatagattcaggatatattcagatacgttatccaagagataaccctttttggcgttag

SEQ ID NO: 13958 - protein, 257 aa, Unknown
  Obtained from environmental sample
  misc_feature (1)..(257): Xaa is any amino acid
MGLELNRRTFLTLIGISSLTCAKGLSPFAMLDYKKCREYIDEQSKKDFVFNSNELINANNLFNKIRRAKSIVGYTQFNLLGFDGMLQIAKNYSKVGQFTKDESTLFEKLFYENATQYGFYGEKVITSLTDDIAKKDTIYIENTGHFLYRGKPHDMYKTITKDVGETIVLTSGVRSIVKQMDLFLNKVIRSNGDLSVAAHSLAPAGYSFHGIGDFDVGKVGFGYKNFTSDFAQTDEYKKLIDSGYIQIRYPRDNPFWR

SEQ ID NO: 13959 - DNA, 801 bp, Unknown
  Obtained from environmental sample
  misc_feature (1)..(801): n is a, c, g, or t
atggaacttacagatgctagagctaaaggtgctgatgtacgctttgtttactctcctcttgattgtctcaaaattgctagggataatgagaataaaacaatcatcttttttgctattggatttgaaacaacaacccctatgaccacagcacttatcaatcaagtgataaaaaaagatattaaaaatatactttttcatatcaaccatatcacagtaccagagcctatgagagttttactcgatgataaaacaaatactattgatgcttttataggaccatcacatgtaagtgttataagtggaagtaaaatttatgatgagtttgcagataaatataacaaacctgtagttgtaagtggatttgaaccacttgatgtgatgcagtctgttttgatgattttaaaacagttcaatgaagaaagatgcgaagtagaagtggaatatagtagaagtgtctcaaaagatggtaacattgtagcacaaaaactcaacgataaatactttgaaagaagagaacattttagatggagagggattggggatattgcaaatagtgctttaaaactaaaagataagtatgcctatttagatgccgaagtaaaatatgctgatattcttccaacaaaacttatagatgaccacaagctatgtatttgtggagagatacttaaagggaaagcaaatccaaaagattgtaaagtttttggaactgcttgtacaccatcttctcctttaggaagttgtatggtaagtagcgaaggtgcttgtgctgcgtattacaagtatggtaatttactttaa

SEQ ID NO: 13960 - protein, 266 aa, Unknown
  Obtained from environmental sample
  DOMAIN (1)...(265): Hydrogenase formation hypA family
  misc_feature (1)..(266): Xaa is any amino acid
MELTDARAKGADVRFVYSPLDCLKIARDNENKTIIFFAIGFETTTPMTTALINQVIKKDIKNILFHINHITVPEPMRVLLDDKTNTIDAFIGPSHVSVISGSKIYDEFADKYNKPVVVSGFEPLDVMQSVLMILKQFNEERCEVEVEYSRSVSKDGNIVAQKLNDKYFERREHFRWRGIGDIANSALKLKDKYAYLDAEVKYADILPTKLIDDHKLCICGEILKGKANPKDCKVFGTACTPSSPLGSCMVSSEGACAAYYKYGNLL

SEQ ID NO: 13961 - DNA, 834 bp, Unknown
  Obtained from environmental sample
  misc_feature (1)..(834): n is a, c, g, or t
atgagaaaatataacaagcaaaatcacaaacagaaattttcaaattcaaaaaacattcagaatcaaagaaatatatcttttggagtaaaacttagtgttgtgtttggtggagttatggtttttatcggactggcatttaccataatgggcttaatttttataatcccatttgcatcaaatgtaaactataacggtctaaaaatctcaaaagatgacccgaccacatctggacagcttataaacgtcagttcaacaaattcgtatgtaaacgacattcaggtttatgaatataattacgaatattatgttcgtaatgaaaaatatactggttcgagctatgaaccaggaaactatgaatttgcaaatattaagattcaatatgtggaagattctcctgaaatttcaagaattgaaggaatgggaagtagcacttttccaatgtggttctttttaataatgggtattttcccaataattggaggttttatgctttttgctggcctaaaaaaacggctaatgtatctcaaaatattacaaataggcaaagttacatttggtgtttttgacagaatggaagcaacgggagcaagtataaatgagcagactgtttacaaattattttttaattatgtggcagaagatcagaaaacgtatagtgcttttggagaaacacatagaactcataaactaaaagatgaacaatttgaaccactggtttttaatcctgcaaatcctgaagaagcaataatgattgatggacttccaaattcagtgaggaaaagcattagccaaatgaaattgctgtttgctaaaaatcctttttttgaaaaataa

SEQ ID NO: 13962 - protein, 277 aa, Unknown
  Obtained from environmental sample
  misc_feature (1)..(277): Xaa is any amino acid
MRKYNKQNHKQKFSNSKNIQNQRNISFGVKLSVVFGGVMVFIGLAFTIMGLIFIIPFASNVNYNGLKISKDDPTTSGQLINVSSTNSYVNDIQVYEYNYEYYVRNEKYTGSSYEPGNYEFANIKIQYVEDSPEISRIEGMGSSTFPMWFFLIMGIFPIIGGFMLFAGLKKRLMYLKILQIGKVTFGVFDRMEATGASINEQTVYKLFFNYVAEDQKTYSAFGETHRTHKLKDEQFEPLVFNPANPEEAIMIDGLPNSVRKSISQMKLLFAKNPFFEK

SEQ ID NO: 13963 - DNA, 834 bp, Unknown
  Obtained from environmental sample
  misc_feature (1)..(834): n is a, c, g, or t
gtgattaaattgatattgatacaattctcacttttatttatatttgcaggagaattaatgagtaatagtctaccaaaatattttacaaaaactttagacaatggattacaaatagtagctattcctatggataatgggtctaatgttgtctctactgatatcttttataaagttggaagtagaaatgaagttatggggaaaagtggtatagcacatatgcttgaacacctaaacttcaaatcaactaaaaacctaaaagctggtgaatttgatgagattgtaaaaggctttggtggagttaacaacgcttcaacttcttttgattatacgcactattatatcaaatcaagctctaaaaatatgggtaaatctttaagtctttttgcggatttgatggaaaacttaactttaaaagataaagaatttcaacctgaacgtgatgtagttgcagaagagagacgttggagaacagataataacccaatgggctatttgcaatttagacttttcaataacgcatatatctaccatccatatcactggacacctattggatttatgagtgatattaaaaattggactataactgatattagagactttcatagcacttattatcaacccaaaaatgcaatagtagtaattgcaggagatataaataaagatgatgttttcaaattagttaaaaaacattttaaagatataaaaaataaaaaagatattccaaaaactgttcacatgactgaaccaaaaattgatggggcaaaaagagcaatagtaaaaaaagactctcaagtagagatgtggctattcatatcaactgagccgatctga

SEQ ID NO: 13964 - protein, 277 aa, Unknown
  Obtained from environmental sample
  DOMAIN (39)...(187): Insulinase (Peptidase family M16)
  misc_feature (1)..(277): Xaa is any amino acid
MIKLILIQFSLLFIFAGELMSNSLPKYFTKTLDNGLQIVAIPMDNGSNVVSTDIFYKVGSRNEVMGKSGIAHMLEHLNFKSTKNLKAGEFDEIVKGFGGVNNASTSFDYTHYYIKSSSKNMGKSLSLFADLMENLTLKDKEFQPERDVVAEERRWRTDNNPMGYLQFRLFNNAYIYHPYHWTPIGFMSDIKNWTITDIRDFHSTYYQPKNAIVVIAGDINKDDVFKLVKKHFKDIKNKKDIPKTVHMTEPKIDGAKRAIVKKDSQVEMWLFISTEPI

SEQ ID NO: 13965 - DNA, 354 bp, Unknown
  Obtained from environmental sample
  misc_feature (1)..(354): n is a, c, g, or t
atgttcagatcggctcgagaacaaaactcgaaaacttctttacataagaaattttctgatcaaaatgttattaaatttgctgatggctatcatcttgatattagtctaaatgagactttttataaaaataaaaagttaaaacttacaaaaaaagagacatcatttattcagctattaatagcgcagttagatcaggtagtagattttaatcaagcagttaactatatttgggaaaacaagggtgcaacggaaaataatatccgaactctagtgtggagattaagaaataaactcccaaccgatatcataaaaagcagctcaggacatggctactacatagaatccagtaaataa

SEQ ID NO: 13966 - protein, 117 aa, Unknown
  Obtained from environmental sample
  DOMAIN (43)...(113): Transcriptional regulatory protein, C terminal
  misc_feature (1)..(117): Xaa is any amino acid
MFRSAREQNSKTSLHKKFSDQNVIKFADGYHLDISLNETFYKNKKLKLTKKETSFIQLLIAQLDQVVDFNQAVNYIWENKGATENNIRTLVWRLRNKLPTDIIKSSSGHGYYIESSK

SEQ ID NO: 13967 - DNA, 303 bp, Unknown
  Obtained from environmental sample
  misc_feature (1)..(303): n is a, c, g, or t
atgatagttatggagttgattactaattcattaaaatatgcatttaaagaaaaacaaaaaggtataatagaattaaagctgacaaaatccaatgtaccccatacatattcattagtaattgcagatgatggagaaggttttccagaagatgtagatttttcttcaacaaaaactttaggtatgcaattggtattgggcttgtcagcacaattacaaggtaccataaataaaaaatcgaaaaaaggtacttgttttgaaataacatttaaagatacaaagagacataagtatgaagaaaactaa

SEQ ID NO: 13968 - protein, 100 aa, Unknown
  Obtained from environmental sample
  DOMAIN (1)...(92): Histidine kinase-, DNA gyrase B-, and HSP90-like ATPase
  misc_feature (1)..(100): Xaa is any amino acid
MIVMELITNSLKYAFKEKQKGIIELKLTKSNVPHTYSLVIADDGEGFPEDVDFSSTKTLGMQLVLGLSAQLQGTINKKSKKGTCFEITFKDTKRHKYEEN

SEQ ID NO: 13969 - DNA, 372 bp, Unknown
  Obtained from environmental sample
  misc_feature (1)..(372): n is a, c, g, or t
atgaagaaaactaaaatttttattacagaagatgaatttatagtatcacaaaatcttaaaaataagcttataacacttggttatgatgtaattggaactgcttcttcaggagaggaagctttagaaaaaataaaagacaatcaacccgatttaatattaatggatataatgctttccggtaaaatggatggtatagatacggcaaaagtgattaagcaaaattttaatatccctttgatttttttaactgcttattcctctaaagaaatttaccaacgtgccgaaataacagaaccttacgcatatattctaaagccttttgaagaaagagaattggaaataaatatttccatttgctttatacaagcatga

SEQ ID NO: 13970 - protein, 123 aa, Unknown
  Obtained from environmental sample
  DOMAIN (4)...(123): Response regulator receiver domain
  misc_feature (1)..(123): Xaa is any amino acid
MKKTKIFITEDEFIVSQNLKNKLITLGYDVIGTASSGEEALEKIKDNQPDLILMDIMLSGKMDGIDTAKVIKQNFNIPLIFLTAYSSKEIYQRAEITEPYAYILKPFEERELEINISICFIQA

SEQ ID NO: 13971 - DNA, 603 bp, Unknown
  Obtained from environmental sample
  misc_feature (1)..(603): n is a, c, g, or t
atgcaaaagacgggagggtgccgggaaaatgttttaaacccaagtcgcgaatatttaatgaatttggtagacgacataattcagaaagatataactgcatttcacgctattaagaatcaccagatagttagagattatttcactctgttaatggaaagaagtggtaaacagcttagtattaataaaattggtaaaattcttggtatctctccagatacttccaaaaggtatctggctttttttgaatcaacctatcttattcacctgttgccacgttggggaaaaacaaaccagaaattattatccgcaaaaaaaatatatgcttcagaccttggtataaaatatatgtttatgggggaaagagatcttggcagttattttgaaaactatatctacttactccttcgcaataaaaagactttgtactatctgtatgaaaatacaactgaaatcgatttcattactgaagataaaatactaattgaatcaaagttctattcagagttaaatgcgaaacaagaaaaattgtttagcgaatatccagcaaatacgaaactgcttattgactcagtagaaaaattgtcagtgctggatgaaatgtaa

SEQ ID NO: 13972 - protein, 200 aa, Unknown
  Obtained from environmental sample
  misc_feature (1)..(200): Xaa is any amino acid
MQKTGGCRENVLNPSREYLMNLVDDIIQKDITAFHAIKNHQIVRDYFTLLMERSGKQLSINKIGKILGISPDTSKRYLAFFESTYLIHLLPRWGKTNQKLLSAKKIYASDLGIKYMFMGERDLGSYFENYIYLLLRNKKTLYYLYENTTEIDFITEDKILIESKFYSELNAKQEKLFSEYPANTKLLIDSVEKLSVLDEM

SEQ ID NO: 13973 - DNA, 468 bp, Unknown
  Obtained from environmental sample
  misc_feature (1)..(468): n is a, c, g, or t
ttggatgaactgcctcttgagtggcactttgtcggaaatcttcaaaaaaataagatcaataaacttatagagttaaatccatttttagttcactctatagactctcttgagctggctgttgcactagataaaagattggcagaaaaaggtatgagttttgatgcacttttacagataaacagtgcaaacgaatctacaaaagcaggtgtaaatagcctcgaagcaaaagatatttttgagcagataagtgagagctgtccaaacatagacctaaaaggtgttatgagcataggcgctcacagtgatgataaaaaactgattagaaaaagttttgaagatactcacaaagtgtttgaatcactacaaggtgccactatctgttctatgggtatgagcggtgattttgaagaggctataagatgtggctcaaatatgattagactcggctctattatttttaataaatag

SEQ ID NO: 13974 - protein, 155 aa, Unknown
  Obtained from environmental sample
  DOMAIN (1)...(153): Alanine racemase, N-terminal domain
  misc_feature (1)..(155): Xaa is any amino acid
MDELPLEWHFVGNLQKNKINKLIELNPFLVHSIDSLELAVALDKRLAEKGMSFDALLQINSANESTKAGVNSLEAKDIFEQISESCPNIDLKGVMSIGAHSDDKKLIRKSFEDTHKVFESLQGATICSMGMSGDFEEAIRCGSNMIRLGSIIFNK

SEQ ID NO: 13975 - DNA, 774 bp, Unknown
  Obtained from environmental sample
  misc_feature (1)..(774): n is a, c, g, or t
atggtcgtaaatatgcaaggtgtaacttttattgccgattttaaaagactctcaaatgataagtttttattaaagataaaatcttatctgattacaaatctgctttttggcgcaaatgatattcgatatgagatattcagacatgactactccatggatattgagctacaatataagcttcttcatgagatagaacactcacttaactttagcacaagatggatggtgaaatatttagataagcatcaagtagatattaaccacatcttagattataaagatagattatttgatcttttagctaaaaacaatattcgtaaaagagagatattaaaagataatgagagttttaatctattcttctcatccatagattatttacgttttgcagttgcagctatcatgatcaaagagacttctcgtcacacttttgagaatgtatcaactctattttacttagtactcaaagagtttaaagtgttagagatgattacatcactagataccattaagactacatctgcaaacgaaaagatattaagacatcaggtacttcaatttttagagtttatagttgttcactacacagaaaatgtactctcttttcaacgtataaatgagactccagatcaagcattcgccagttacttagagaatgagaaagagacatttacatcagtaaaagagaaaattgactcttttacaaaaacagagtcaaaaaatattaatgaagttgcaattacagtaaaccagattatggcttctattatttag

SEQ ID NO: 13976 - protein, 257 aa, Unknown
  Obtained from environmental sample
  misc_feature (1)..(257): Xaa is any amino acid
MVVNMQGVTFIADFKRLSNDKFLLKIKSYLITNLLFGANDIRYEIFRHDYSMDIELQYKLLHEIEHSLNFSTRWMVKYLDKHQVDINHILDYKDRLFDLLAKNNIRKREILKDNESFNLFFSSIDYLRFAVAAIMIKETSRHTFENVSTLFYLVLKEFKVLEMITSLDTIKTTSANEKILRHQVLQFLEFIVVHYTENVLSFQRINETPDQAFASYLENEKETFTSVKEKIDSFTKTESKNINEVAITVNQIMASII

SEQ ID NO: 13977 - DNA, 342 bp, Unknown
  Obtained from environmental sample
  misc_feature (1)..(342): n is a, c, g, or t
gtgtctattatagataatgataaaccagttatacctttaagcggtgtagcagatatgcttgatgcaaaaagtagaacacttagaatgtatgaagataaggggcttttacctaaacatgatggagtagaaaagaaactttactcaataaatgatatccaaaaaatagcttttgtgcactatatcgcaagtgttaaaaagataaatgcaaacggtatcagatatatattggaactcttagagcataacatggcttttgatgaaagagagaagattatgaaaagtattgagaaacagttagatgagataccatctagagagatagaagatatagaaactttttaa

SEQ ID NO: 13978 - protein, 113 aa, Unknown
  Obtained from environmental sample
  misc_feature (1)..(113): Xaa is any amino acid
MSIIDNDKPVIPLSGVADMLDAKSRTLRMYEDKGLLPKHDGVEKKLYSINDIQKIAFVHYIASVKKINANGIRYILELLEHNMAFDEREKIMKSIEKQLDEIPSREIEDIETF

SEQ ID NO: 13979 - DNA, 819 bp, Unknown
  Obtained from environmental sample
  misc_feature (1)..(819): n is a, c, g, or t
atggagaaacaactgtggcaatcgggcatccttatggactcaactataccgcgactgaaggaatcgtttcaaaaggcttcaagactttatgatgactnggaatacatccagatagatgcagctataaaccctggaaatagtggtggaccacttttaaatgttgaaggtgaggtatcgggagtaaatacttttatcatacaaaacgcgaataaccttggttttgctctaccatatttttatgttgaggagaccattggaaattttaaagagataaatgacataaatatcatcaaatgtccctcttgtaaaaacctcatcaaagaagaaaagataaataatgactactgcccagagtgtggtacaaaacttgaagttgcaaaactaagaagaaaaggttataacccaactggtgcgacaaagcttatggaagagatattaacttctcttgatgtaaatgttaccctagcaagacgttcacaggcttcttggagagtagaccatggaactgcaagagttgagataaactactatgaaaacggcatcatcatcggtgattcaaaactgtgtagacttccaaaagagaatataaatgacatttatgattatctgctaagtgaaaatgaaaaactcacatacttgcaattttcaataaatgaaaatagcatctatctctcttatctgattgttgattcatcacttacgcttgatgagggtaagattgcactagagagactttttaacttatcagacaagtatgatgagattttaataaacaaatacaaagccataaaattaaaacgagacgaggaagacgaataa

SEQ ID NO: 13980 - protein, 272 aa, Unknown
  Obtained from environmental sample
  misc_feature (1)..(272): Xaa is any amino acid
MEKQLWQSGILMDSTIPRLKESFQKASRLYDDXEYIQIDAAINPGNSGGPLLNVEGEVSGVNTFIIQNANNLGFALPYFYVEETIGNFKEINDINIIKCPSCKNLIKEEKINNDYCPECGTKLEVAKLRRKGYNPTGATKLMEEILTSLDVNVTLARRSQASWRVDHGTARVEINYYENGIIIGDSKLCRLPKENINDIYDYLLSENEKLTYLQFSINENSIYLSYLIVDSSLTLDEGKIALERLFNLSDKYDEILINKYKAIKLKRDEEDE

SEQ ID NO: 13981 - DNA, 717 bp, Unknown; identical to SEQ ID NO: 8401
  Obtained from environmental sample
  misc_feature (1)..(717): n is a, c, g, or t

SEQ ID NO: 13982 - protein, 238 aa, Unknown; identical to SEQ ID NO: 8402
  Obtained from environmental sample
  misc_feature (1)..(238): Xaa is any amino acid

SEQ ID NO: 13983 - DNA, 786 bp, Unknown
  Obtained from environmental sample
  misc_feature (1)..(786): n is a, c, g, or t
ttgcaggtagcagcccgaacgcagacatgccacagtgccgtcatcaattttgttatctttggcactcgttataattgggaaatgcaagagaaaccatcgtcgggaaaaaagaccagtaagaagcatcagccaaaagggcttaccattcttcatgaagatcaggatattattgttatagacaaatcaaattgcctacttacaatcagtactgatacggagaaagcgcgcacggcctattatattctaaccgattatgtaaagaaaggaaatcccaaatcgagaaatcgaatttttattgtccatcgcctcgatcgcgacacatccggggtgctggtatttgcaaaaaacgaaaatgccaaacgctttttacaagataattggagagaattcagcaaaacgtactatgccgttattcacggcaaaatgaatgaaagagaaggattgatcacttcttatttattagaaaatagtgctcatagagtctattcggttcgtgatccggaaaagggaaaattagccaaaactagctataaggtaattaaagaatcagccaattatagcttggttgagatcaatttacttacaggcagaaagaaccagatcagagttcattttgcagaaaaaagacaccccgttgttggagataagatgtatggcgatatgccttccggtggcaatcgtttggctctgcatgcctcaacattaacaataattcatccctattcgcgaaagcaaatgacatttaaaaccgagttgcctttatgctttaaaatgcttgttaagtaa

SEQ ID NO: 13984 - protein, 261 aa, Unknown
  Obtained from environmental sample
  DOMAIN (55)...(207): RNA pseudouridylate synthase
  misc_feature (1)..(261): Xaa is any amino acid
MQVAARTQTCHSAVINFVIFGTRYNWEMQEKPSSGKKTSKKHQPKGLTILHEDQDIIVIDKSNCLLTISTDTEKARTAYYILTDYVKKGNPKSRNRIFIVHRLDRDTSGVLVFAKNENAKRFLQDNWREFSKTYYAVIHGKMNEREGLITSYLLENSAHRVYSVRDPEKGKLAKTSYKVIKESANYSLVEINLLTGRKNQIRVHFAEKRHPVVGDKMYGDMPSGGNRLALHASTLTIIHPYSRKQMTFKTELPLCFKMLVK

SEQ ID NO: 13985 - DNA, 894 bp, Unknown
  Obtained from environmental sample
  misc_feature (1)..(894): n is a, c, g, or t
gtgattatccacaatagtgctatttgtaatgacaatatcatcaaagatgaagtaaaagcaaattttggtgttattatggctgaacattgtgagattggaaaaaaagttagctttgaaaaagatattatgatgtggcctgataaaattatcgatgctaactctgttgtaagtaataatgtaatttggggaaataaatacaaagcttctatttttgaagatgggaaagtaattggtagaactaacattgaactatctcctgatatcagtgtaaaactcgcagaatcttttgggtcaattttaacaattggaagcaaagtatatatctcaagagattatcataaaagttcaagaatgttaaaaagagcatttttatcagggattctctcaacaggaattgatgtaatagatatagaaaatgtaccatcaaatgtgatgagacactgtttagcaaatgatgaaaaaatagcagcaggggtacattttagacaatctgtagaagaccctgcaaatacagaaattgtactttacacaagtgaaggattagctatagattcaaaattagctaaatctattgagcgaattttctttagagaaaacttcagacgagtggactatacagagattggtgagatttcaaacaaaaaaaatattaacaatagatatctaagtgccgtaatagaaaaacttgatttaactatctttaaaaacaataacttanaaatagcagtagatatgatgtttggctcaactgcagatatctatcctaaaattatgaatcatcttggaattgaaatattctactnncatggtatcatgatgagaaaaaagttgtctaaatgcccaatttgtgtacaaaatcacaaaaagatatggcaaatatgggtaaagctatga

SEQ ID NO: 13986 - protein, 297 aa, Unknown
  Obtained from environmental sample
  DOMAIN (68)...(202): Phosphoglucomutase/phosphomannomutase, alpha/beta/alpha domain I
  misc_feature (1)..(297): Xaa is any amino acid
MIIHNSAICNDNIIKDEVKANFGVIMAEHCEIGKKVSFEKDIMMWPDKIIDANSVVSNNVIWGNKYKASIFEDGKVIGRTNIELSPDISVKLAESFGSILTIGSKVYISRDYHKSSRMLKRAFLSGILSTGIDVIDIENVPSNVMRHCLANDEKIAAGVHFRQSVEDPANTEIVLYTSEGLAIDSKLAKSIERIFFRENFRRVDYTEIGEISNKKNINNRYLSAVIEKLDLTIFKNNNLXIAVDMMFGSTADIYPKIMNHLGIEIFYXHGIMMRKKLSKCPICVQNHKKIWQIWVKL

SEQ ID NO: 13987 - DNA, 747 bp, Unknown
  Obtained from environmental sample
  misc_feature (1)..(747): n is a, c, g, or t
ttgaaagtgaaacataaatttttgtttattatgaaaaggagattccaattgaaaaaatggtatagtttaatagataaagtttatactacacaaaatctttttgatgctttttattcagtcaaaaagaacaaaggtgtgggcgatattgatggtataaccataaaacaatacgaagagaacttacctagaaatatatatcaaatgcaaaaggaattgaagagtggtacttatgtaccattgcctgttaaaagagttgaaattcctaaaggaaatggaaaaaccagacccttaggtataccaacagtaagagatagaattgctcaacaagcaattgtcaatattatacaaccaatctttgaacctgaatttcatccacaaagctatggttatagacctaagaaaagctgtcaaatggcagttgctagagcaaaacaagttgctgtaggtttagaattaccttttgtggttgatatggatttatcaaagtgttttgatacactaaatcataaattcataatgaaaactcttaacaaaagaattagtgatggtacattgctacgattaattgagagcatattgaaatcaggagtaatgcaaaatggtaagtttaacacgacaaaaataggtagtccacaaggtggagtaatatctccattactgatgaatatctatcttgatgaatttgacccaagcatgagaattaaaggctcgaatagttcttatgctgatgaattctcatattgctaa

SEQ ID NO: 13988 - protein, 248 aa, Unknown
  Obtained from environmental sample
  DOMAIN (78)...(247): Reverse transcriptase (RNA-dependent DNA polymerase)
  misc_feature (1)..(248): Xaa is any amino acid
MKVKHKFLFIMKRRFQLKKWYSLIDKVYTTQNLFDAFYSVKKNKGVGDIDGITIKQYEENLPRNIYQMQKELKSGTYVPLPVKRVEIPKGNGKTRPLGIPTVRDRIAQQAIVNIIQPIFEPEFHPQSYGYRPKKSCQMAVARAKQVAVGLELPFVVDMDLSKCFDTLNHKFIMKTLNKRISDGTLLRLIESILKSGVMQNGKFNTTKIGSPQGGVISPLLMNIYLDEFDPSMRIKGSNSSYADEFSYC

SEQ ID NO: 13989 - DNA, 618 bp, Unknown
  Obtained from environmental sample
  misc_feature (1)..(618): n is a, c, g, or t
atggaaaaaattttagatattatagattcaattgctcatgaaaaagggctaaaacaagaagatgttcaagaagcacttaaaaaagcattcgtacaaactgcaaaaagagttattagtgaagacttcgcttttcaagcagagataaataaagaagaaaaaactttaaaactattacaaataattactgttgtggcagatgatgatgtaagattacaagctgaacacaacaaagcttatatgtctttaagtgatgcaaaagagtatgatgaagatgcagaactagaagatgaacnttcaatggaacataatctagatgattatggaagaactgcagctagtcagcttcatcgtgaagttgagtatcatgttcaacgtctagtagaagaatacatattttataaatataaaaataaaataggtacaattgttttcagtcgtgtaactagagtcgacgatncacaaaatacatatattgagattgatgaagtaaaagctgttcttcctatgaaaagccggtataaaggtgaaaattataaccnnagagagatgctacgcgctctagttagacttgtaatatcgataagaagatggatctcgattgagtatccgtacttctca

SEQ ID NO: 13990 - protein, 206 aa, Unknown
  Obtained from environmental sample
  misc_feature (1)..(206): Xaa is any amino acid
MEKILDIIDSIAHEKGLKQEDVQEALKKAFVQTAKRVISEDFAFQAEINKEEKTLKLLQIITVVADDDVRLQAEHNKAYMSLSDAKEYDEDAELEDEXSMEHNLDDYGRTAASQLHREVEYHVQRLVEEYIFYKYKNKIGTIVFSRVTRVDDXQNTYIEIDEVKAVLPMKSRYKGENYNXREMLRALVRLVISIRRWISIEYPYFS

SEQ ID NO: 13991 - DNA, 684 bp, Unknown
  Obtained from environmental sample
  misc_feature (1)..(684): n is a, c, g, or t
gtgaagcttttagttttaggaagcaatagcttctctggaggttcttttataaattatgttttggatgctcttaaagaggttgaaatatttgcaataagtagatcatgtgaatatcatagttcgcagttaaaatatataaataatccaaaaaaaaacagtgttttgttttttcaatatgatcttaattatgatcttgataagatagttgatcttatatcagcaaataaaatagagtacatatttaattttgctgctcaaggtatggttgctcaaagctgggaatctccaaatcaatggtttgaaacaaatacattaagtttggtaaatctattgaataagatatataaatttgactttatcaaaaagtttgtacaggcttcaactccagaggtttatggtccttgtgataatattaaagaatctatgtgtttttatccctcttcaccttatgcagcatcaaaagcaagtgcagaccttatacttcacagttattttacaacacataagtttcctataaactatacgagagcctcaaatgtttatggctcatatcagcaactctatagaataataccaaaaacagtaatgatgataaaaaaagggaaaccatgcaacttcacggtggaggaaaagcataagaagtttatacatattgatgatngtagttgtgctacattaaaatag

SEQ ID NO: 13992 - protein, 227 aa, Unknown
  Obtained from environmental sample
  DOMAIN (3)...(227): NAD dependent epimerase/dehydratase family
  misc_feature (1)..(227): Xaa is any amino acid
MKLLVLGSNSFSGGSFINYVLDALKEVEIFAISRSCEYHSSQLKYINNPKKNSVLFFQYDLNYDLDKIVDLISANKIEYIFNFAAQGMVAQSWESPNQWFETNTLSLVNLLNKIYKFDFIKKFVQASTPEVYGPCDNIKESMCFYPSSPYAASKASADLILHSYFTTHKFPINYTRASNVYGSYQQLYRIIPKTVMMIKKGKPCNFTVEEKHKKFIHIDDXSCATLK

SEQ ID NO: 13993 - DNA, 831 bp, Unknown
  Obtained from environmental sample
  misc_feature (1)..(831): n is a, c, g, or t
atgttaatggactgnnntggtaagccatctgttgggaaatcgactttttttaaagctgctactttggctgaggttgaaattgcgtcttatccttttacaacaattaaagctaatcatggtattggttatgttaaggttagatgtatagaagaagattttaatgctaaatgtaatcctagtcatggattttgtattaggggaaatagatttgttcctgttgacttaatggatgttgcaggattggttcctggtgcctctgaagggaagggattggggaatcagtttctgaatgatttgcgtgatgcagatgtttttattcatattgttgatatttcaggcactactgatattgaaggaaagccaactgaagatcataatccttctgatgatattagatttttggaagatgaattgaataagtggtatcataatattttgatgaaggcttggccggttttttctagaaaagttgatatggagggtaggaaattaagtgctgctgttcataaacaattttcaggattgaaggttactgaagatgagattactgatgttttgttgaaattaaagttgccagaaaaatgctcttcttggagtgatgatgatttgattgaatttgctaaaatgttgaggtgtatttctaaaccgatgattattgctgctaataaaatagatgtttttaagggggcggataattacgaaagaattctgaaagaatttccgaatttgaaaattgtcccttgttctgcagattctgagttggctttaaggcaggctcataaagctggaattttggattatattcctggagaaagggattttaaagtatga

SEQ ID NO: 13994 - protein, 276 aa, Unknown
  Obtained from environmental sample
  misc_feature (1)..(276): Xaa is any amino acid
MLMDXXGKPSVGKSTFFKAATLAEVEIASYPFTTIKANHGIGYVKVRCIEEDFNAKCNPSHGFCIRGNRFVPVDLMDVAGLVPGASEGKGLGNQFLNDLRDADVFIHIVDISGTTDIEGKPTEDHNPSDDIRFLEDELNKWYHNILMKAWPVFSRKVDMEGRKLSAAVHKQFSGLKVTEDEITDVLLKLKLPEKCSSWSDDDLIEFAKMLRCISKPMIIAANKIDVFKGADNYERILKEFPNLKIVPCSADSELALRQAHKAGILDYIPGERDFKV

SEQ ID NO: 13995 - DNA, 387 bp, Unknown
  Obtained from environmental sample
  misc_feature (1)..(387): n is a, c, g, or t
ttgagcaaagatatcatcttctacgataactattttttgattgtttttcataaaacaaattatacaacaattcaactctttcttttgcgacaagtttacgacaaattctattttataatatgcaataaaagttttgaggagaattccatgaatctattaatcgattacagttcacggtttcgtatattaaaaggtgggaaaatatcccttgtggtttcggcactattaggaggtgtaacccttagttttgcagctcctagtggtggagtggtcactagtggaagtgctactatttctcagggtggaaaagtaaccaacatcaaccaatccacacaaaaagcttccatcaactggcaaaagtttaatatatccgtgatgaaacagtaa

SEQ ID NO: 13996 - protein, 128 aa, Unknown
  Obtained from environmental sample
  misc_feature (1)..(128): Xaa is any amino acid
MSKDIIFYDNYFLIVFHKTNYTTIQLFLLRQVYDKFYFIICNKSFEENSMNLLIDYSSRFRILKGGKISLVVSALLGGVTLSFAAPSGGVVTSGSATISQGGKVTNINQSTQKASINWQKFNISVMKQ

SEQ ID NO: 13997 - DNA, 489 bp, Unknown
  Obtained from environmental sample
  misc_feature (1)..(489): n is a, c, g, or t
ttgtcgcaaaagaaagagttgaattgttgtataatttgttttatgaaaaacaatcaaaaaatagttatcgtagaagatgatatctttgctcaagagtttttagctcaaacattaaatactcttggatacagcagtattttagtagtaagcaaagcagatgatgcgataaacttttgtaaaaaagaaaaaatagacattatatttatggatataaatattgaaggtactatggatggaatacagtgtgctagagagatatcactatattataatatacctattatatttacaactgcatatgcagatagtgttactatcgatgaagcaagctataccaacctatatggatatctcatcaaaccttttactcaaaaagaggtagaaatagctttgaaaaataattcaaaacaacttttttcaaaaaataaacttcctataaaatttcataattcaaagactctttttataattttgatactaaagctttaa

SEQ ID NO: 13998 - protein, 162 aa, Unknown
  Obtained from environmental sample
  DOMAIN (19)...(139): Response regulator receiver domain
  misc_feature (1)..(162): Xaa is any amino acid
MSQKKELNCCIICFMKNNQKIVIVEDDIFAQEFLAQTLNTLGYSSILVVSKADDAINFCKKEKIDIIFMDINIEGTMDGIQCAREISLYYNIPIIFTTAYADSVTIDEASYTNLYGYLIKPFTQKEVEIALKNNSKQLFSKNKLPIKFHNSKTLFIILILKL

SEQ ID NO: 13999 - DNA, 660 bp, Unknown
  Obtained from environmental sample
  misc_feature (1)..(660): n is a, c, g, or t
atgaaaattttactcctagaagatgactatctgtacaaaatatctataaaagagttcttagaagaacttgattttgaagtggatgattttgataatggagatgaagcactcgatgcaatctatgaaaacagatacaatcttcttctactagatataagagtaccaggaattgacggctttacacttattgaagatatcagaaaagaagctatcaatacacctgtcattatccttacttcacttacagatatgtcaaatttaagcaaaggatatgaacttgggtgtaatgattatttaaaaaaaccttttgatctaatagagttacgatatagaattgaccaacttataaaaaataaatgttttacttctgatgaaaatataataattctcaacgataactttgcctttgatattcaaaaaaatatattatacaaagaacaaaagcctattgatttaacacaaaaagaaagtgaagtaataagctttttgattcaaaatagaggtttttatatctccatagagtctttacatgaaaatatctgggataacaaagatatccaatacgcggatatacgaatgtgtatcaaaaggataagagggaaaacggataaaaactttatcattaccaaaagatttgtagggtataaaattgataaataa

SEQ ID NO: 14000 - protein, 219 aa, Unknown
  Obtained from environmental sample
  DOMAIN (147)...(217): Transcriptional regulatory protein, C terminal
  misc_feature (1)..(219): Xaa is any amino acid
MKILLLEDDYLYKISIKEFLEELDFEVDDFDNGDEALDAIYENRYNLLLLDIRVPGIDGFTLIEDIRKEAINTPVIILTSLTDMSNLSKGYELGCNDYLKKPFDLIELRYRIDQLIKNKCFTSDENIIILNDNFAFDIQKNILYKEQKPIDLTQKESEVISFLIQNRGFYISIESLHENIWDNKDIQYADIRMCIKRIRGKTDKNFIITKRFVGYKIDK

SEQ ID NO: 14001 - DNA, 699 bp, Unknown
  Obtained from environmental sample
  misc_feature (1)..(699): n is a, c, g, or t
atgataaaaacatataaaaattttataattttctttctcattataattgtaacacttctttttttccttaaaaaatataacgatattataaaacaaaatcaaatagatatacttgtttcaaacaatatagaacttattagtagtgaaatatctcaccagaaaaaatatgccctatctttagcaatacttttttcaaaaaaccaacatattatcgatgcattaaaactaaatcaaccacaacaattaaaaaatgaactagataatttactaaaaactatctctgagtatacaaaattaaaaaatattcaaattcaagtacacacaaaaaacttaaaagtgtttgttcgaagttgggaagataaggatactgggcttaatcttacgagctttagacatggacttgtcaaagtaaaacaaacgcaacaaccttttgtatctaatgagcttggtaaaagatttaacataaaagctatctctcctatatttgatggaaaagaatatattggttcacttgaagttattatggattattcctctttaaaagaacgattgaaaatggcagatatagaggtattaccactacttaatagncaagttcttaacatagncaaatatcacccnaaacataaaaaactctataacttttgtatcattgaaaaccaatatatgaaaatatttattatactttatcaatcataa

SEQ ID NO: 14002 - protein, 232 aa, Unknown
  Obtained from environmental sample
  misc_feature (1)..(232): Xaa is any amino acid
MIKTYKNFIIFFLIIIVTLLFFLKKYNDIIKQNQIDILVSNNIELISSEISHQKKYALSLAILFSKNQHIIDALKLNQPQQLKNELDNLLKTISEYTKLKNIQIQVHTKNLKVFVRSWEDKDTGLNLTSFRHGLVKVKQTQQPFVSNELGKRFNIKAISPIFDGKEYIGSLEVIMDYSSLKERLKMADIEVLPLLNXQVLNIXKYHPKHKKLYNFCIIENQYMKIFIILYQS

SEQ ID NO: 14003 - DNA, 855 bp, Unknown
  Obtained from environmental sample
  misc_feature (1)..(855): n is a, c, g, or t
gtgaatgaatcccccgaaaataatgaatccccagaaaatatggatgaagctgagatgacaatggctgcggccatggagagcataaagcctattgaaaatggcacaatcgtaacaggatgtgttgttgaggtaaatgaggatgagctcatcgttgatgttgggtacaaatcagaaggtttaatctataaaaaggatattccttataatgaagagtacgcagaaggcgattccattgaagtaatggtaatgagcaaagaggacaaaagcggaaaccttcttctttcccgtcgtcgtgttcgtgataaaaaggcctgggataagattttcacagccaaggaaaatgattctattatagaaggaaaggttaccaagaaggtcaagggcggcctcaatgttgacatctgcggtcttacagcttttgtacccggttcacagatagatataaaaagagaagccaattttgaaaagtatattgataatacttatgaattcaaggttatcgaggctaacagaagacgcacaaatattattctttcaagaagaaaaatacttgagggcgttagaaacgaagcacttgaaaaactttacggttcagtcaaagagggcgacacagtcaagggaacagtacgcagaatcacagaattcggcgcatttgttgatcttggcggagttgatggacttcttcatattacagacctttcatgggcacatgttaaaaaggttactgatgtagttaatgttgatgaagagattgaattaaaatctcacatagaccagaaaaggcaaaatagtctggtcttaacagagagtgagatccatggcttatcagctgaaagtatcaaagattcagtgtga

SEQ ID NO: 14004 - protein, 284 aa, Unknown
  Obtained from environmental sample
  DOMAIN (30)...(97): S1 RNA binding domain
  misc_feature (1)..(284): Xaa is any amino acid
MNESPENNESPENMDEAEMTMAAAMESIKPIENGTIVTGCVVEVNEDELIVDVGYKSEGLIYKKDIPYNEEYAEGDSIEVMVMSKEDKSGNLLLSRRRVRDKKAWDKIFTAKENDSIIEGKVTKKVKGGLNVDICGLTAFVPGSQIDIKREANFEKYIDNTYEFKVIEANRRRTNIILSRRKILEGVRNEALEKLYGSVKEGDTVKGTVRRITEFGAFVDLGGVDGLLHITDLSWAHVKKVTDVVNVDEEIELKSHIDQKRQNSLVLTESEIHGLSAESIKDSV

SEQ ID NO: 14005 - DNA, 540 bp, Unknown
  Obtained from environmental sample
  misc_feature (1)..(540): n is a, c, g, or t
gtgagtcgtgctgcttataagttaaaatattttttagaagagtttgttattgatttacatgataaggtagctttagacataggctcttcaacgggtggctttacacaaatattattagcatcaaatgtacaacgagtaacttgtgtagatgtggggactaatcaacttcacgaaactttaaaagatgatacaagaattattatcaaagagaacaccgatattagagagtttcatagtgatcaaaaatataatttagttacttgtgatgtttcttttataagtatattaaatattataaaagatatagatagacttagcagtgataaaatcattatattatacaaaccacaatttgaagttggaagagaagtaaaaagagatagtaaaggtatggttgtagatacaaaagccattgagaagtgtagaaaagagtttttaaaagtagtaatagagttaggatggaaacttatatataataagagtagtcaactttcaggtaaaagtggaaacattgaagaacttttttattttgagaagtag

SEQ ID NO: 14006 - protein, 179 aa, Unknown
  Obtained from environmental sample
  DOMAIN (2)...(179): FtsJ-like methyltransferase
  misc_feature (1)..(179): Xaa is any amino acid
MSRAAYKLKYFLEEFVIDLHDKVALDIGSSTGGFTQILLASNVQRVTCVDVGTNQLHETLKDDTRIIIKENTDIREFHSDQKYNLVTCDVSFISILNIIKDIDRLSSDKIIILYKPQFEVGREVKRDSKGMVVDTKAIEKCRKEFLKVVIELGWKLIYNKSSQLSGKSGNIEELFYFEK

SEQ ID NO: 14007 - DNA, 741 bp, Unknown
  Obtained from environmental sample
  misc_feature (1)..(741): n is a, c, g, or t
atgattaagacagggcttatcctgacccccactcccctggtaagtcagtggaaggaggagatgaaatcaaagttcggccttgatattccgtcaacagatgattctgatttcaaaaagaagggccggagtttctgggatgctccctttatccttgcctccatcaaccaggcaaagtcaaagaagaattttgacctggtaacctccagggagtacgacatgctcatcgttgatgaggcccaccatcttaaaaacaggacaaccctgaactggaagcttgtcaacaccattcagaaacgatttatcctccttctcacggcaactcctgttgagaataacctcatggagctttacaatcttatcaccctgctaaaacccggccagcttgagactgcaacggctttcagggaaaaatttatgaaaaagggtgatcccacagaccccaggaacagggccttgctcaaggaacttctccatgaggtgatgatccgtaacacaagggccctggcaggaatcaacatccctccgaggtatgccaggaccatccgtcttgagccgtcaaaaaacgagattaagctctatgcaaggcttgaatcccttgtaatggcattgaacagcagtgcaaaaggccggggaaaacttatttccaagaatcttctggcccaggcaggttcgtcacccaaggccgtggaagattccatttcaaggatgcttacaaaaaagagagtatcttggggagtatga

SEQ ID NO: 14008 - protein, 246 aa, Unknown
  Obtained from environmental sample
  DOMAIN (3)...(229): SNF2 family N-terminal domain
  misc_feature (1)..(246): Xaa is any amino acid
MIKTGLILTPTPLVSQWKEEMKSKFGLDIPSTDDSDFKKKGRSFWDAPFILASINQAKSKKNFDLVTSREYDMLIVDEAHHLKNRTTLNWKLVNTIQKRFILLLTATPVENNLMELYNLITLLKPGQLETATAFREKFMKKGDPTDPRNRALLKELLHEVMIRNTRALAGINIPPRYARTIRLEPSKNEIKLYARLESLVMALNSSAKGRGKLISKNLLAQAGSSPKAVEDSISRMLTKKRVSWGV

SEQ ID NO: 14009 - DNA, 834 bp, Unknown
  Obtained from environmental sample
  misc_feature (1)..(834): n is a, c, g, or t
atgggatcgcagattccatttaaattcaaaacagatcgtgaagagatagccgttatttttagaaataactcctcagctgatggtatcgaagtagcacttcgtgaactaaatattccttgtcggcgtaaagggggaacaagtttttttgactctcgtgaagttaaagctctgcttgacgcatatacacttttggtaaatgagtctgatatgatgtcatttatccatctttttgagtttgcaaagggtgttggaagtgccatagcaaaagagatatttattgcacttcaaaagttaggacatggctcactctttaacgggctttatcatcctgatatagatattttaaatccgtttgaagagcgtaaaaagaatcatcagctaggactctttgatgatttttttgagttaagttcagctgcaagatttgcaaatatgaattttgagggtaaatttttaaaaaatacagttttaagacatccaaaactaacacgagacggtgcagagtttttatttaacttctatcttctttttaaggatcttaaaaaaatcaccaaacctttggatgttgtaaaaaagatagcatcatcaaaactgtatgaaataattaaaggtacactctctcataaacgtgctcaacttcaagacggttcagtagatgagaagataaaagaggatgcccttacaaatatagctaanaaggctcttcttcttcaagagttatcacgtccatacaaagagcatgaacgttttttaaatgctatgatcttaggttcaggtgacttaacccagggggagggtgtacatctgctcagtatccatgcttcaaaaggttag

SEQ ID NO: 14010 - protein, 277 aa, Unknown
  Obtained from environmental sample
  misc_feature (1)..(277): Xaa is any amino acid
MGSQIPFKFKTDREEIAVIFRNNSSADGIEVALRELNIPCRRKGGTSFFDSREVKALLDAYTLLVNESDMMSFIHLFEFAKGVGSAIAKEIFIALQKLGHGSLFNGLYHPDIDILNPFEERKKNHQLGLFDDFFELSSAARFANMNFEGKFLKNTVLRHPKLTRDGAEFLFNFYLLFKDLKKITKPLDVVKKIASSKLYEIIKGTLSHKRAQLQDGSVDEKIKEDALTNIAXKALLLQELSRPYKEHERFLNAMILGSGDLTQGEGVHLLSIHASKG

SEQ ID NO: 14011 - DNA, 549 bp, Unknown
  Obtained from environmental sample
  misc_feature (1)..(549): n is a, c, g, or t
atgttagctgaaaattatattaaaagagcactaaaaattttaaaaaaagaatatggaaatgaaaatcctaaattaattaaactcagaataaatttagggcttatatttttatttcaagaaaaggatgaatatgctgaaataatgattaaaaatgcacttataaccgctgaaaaaaattatggccggaacagttcaaaacttagcccaattttatatttattaggaacactctattctaaaaatcacttatatcataaagcagaaatcgaattggaaaaagctcttgtaataatcgaaaaaaaatcagttccttcatttaaagattatgtgaaaattttaataaaacttggagatgtttacagtaaacaggaaaaatatatcaaagctgaagaaatttttaacaaggcatatactaagttacaaaatagatattccgaagaacatcccaaaatggctgaattatttatcacacttgccacacataatatttgtaaaaaaaattatgaggtggcattaaattatttaggctctgttccacaaaattgttga

SEQ ID NO: 14012 - protein, 182 aa, Unknown
  Obtained from environmental sample
  misc_feature (1)..(182): Xaa is any amino acid
MLAENYIKRALKILKKEYGNENPKLIKLRINLGLIFLFQEKDEYAEIMIKNALITAEKNYGRNSSKLSPILYLLGTLYSKNHLYHKAEIELEKALVIIEKKSVPSFKDYVKILIKLGDVYSKQEKYIKAEEIFNKAYTKLQNRYSEEHPKMAELFITLATHNICKKNYEVALNYLGSVPQNC

SEQ ID NO: 14013 - DNA, 426 bp, Unknown
  Obtained from environmental sample
  misc_feature (1)..(426): n is a, c, g, or t
ttgaggctgaagaaccccggattattttccagggattcatacaaggcaaagtttatccactgtcaggacttttgtcagctgatcaagcccgataataagcagtataataaaaagagaaagcactttttcctactgcccctcaatgttcattgtttttaccacaagaagacaacgctcacacaattgtggatgctccgcctccgtaccgacaaaggtatcacgcgtccagcaacgttcacatttgtctccctttgcagcatgcacagccacagcaagttcgggaatatcctctcccgtttgaaaggtgagttcaggatgatctttttgatctttacaaactgtaagaacagaaacaatacacacatcctttacctggtctgcacttgcctgaatgaaatcttcccaatcaccacttacgtccaatag

SEQ ID NO: 14014 - protein, 141 aa, Unknown
  Obtained from environmental sample
  misc_feature (1)..(141): Xaa is any amino acid
MRLKNPGLFSRDSYKAKFIHCQDFCQLIKPDNKQYNKKRKHFFLLPLNVHCFYHKKTTLTQLWMLRLRTDKGITRPATFTFVSLCSMHSHSKFGNILSRLKGEFRMIFLIFTNCKNRNNTHILYLVCTCLNEIFPITTYVQ

SEQ ID NO: 14015 - DNA, 657 bp, Unknown
  Obtained from environmental sample
  misc_feature (1)..(657): n is a, c, g, or t
ttggacccgcattccggactggctgcagaaaaaggggtatcccgggtcgtgggaaagatcggaagcactgtggaaggggttgtgatgcgggaaaattgtccggtcatgatcgttaatccgtcaattcagacacaaaccgctgaatttaaaaaaatcgtggtgggcatcgatttttcagtatcctgtgaatgcgcgctgtcgtttgccgtgcaactatcgaaaaaatccggcggtaaaattttcccctatcatatgattcccgtggttccgtatcccaaatatacccgtgccgattacgatgcggacctggcagtatcaaagcagcggctcaaagaattctgcggtaattttttaaatggtgtcccccatgcatataatatctggggcggtgcgctgccccatcaggaaatcataaaatgtgccgaaaaaaacaaagcagacatgattgtcataggatctcacacaaaagaaacaaatggaaaatggtatgctggcagtgtggttgaacgaacgggctttcgatcaaactgtccggtcattgtcgtcactgatctggatgcgctgctgttatgggatgtggatacattgtcaaaagcagaaatcggaaaggaaaaagatcgtctgattcatgtgttcagcaaaaagaaaagcaggtga

SEQ ID NO: 14016 - protein, 218 aa, Unknown
  Obtained from environmental sample
  DOMAIN (48)...(183): Universal stress protein family
  misc_feature (1)..(218): Xaa is any amino acid
MDPHSGLAAEKGVSRVVGKIGSTVEGVVMRENCPVMIVNPSIQTQTAEFKKIVVGIDFSVSCECALSFAVQLSKKSGGKIFPYHMIPVVPYPKYTRADYDADLAVSKQRLKEFCGNFLNGVPHAYNIWGGALPHQEIIKCAEKNKADMIVIGSHTKETNGKWYAGSVVERTGFRSNCPVIVVTDLDALLLWDVDTLSKAEIGKEKDRLIHVFSKKKSR

SEQ ID NO: 14017 - DNA, 675 bp, Unknown
  Obtained from environmental sample
  misc_feature (1)..(675): n is a, c, g, or t
ttgttttatcaattgcatgttgttgttgaggataaagtagaagaaaaaatagtagaaaaatcaacgataaaagaagagaaggttgaagagaaagtggagttggttgatgaaatggttgaagaaaaagcaacaacgaagcaagttgaagaagaaaaaccaaaagaacctacaaaaatagatgcgttagaacaacaattaagagctgcagcaattaatagttatattttactggaaacggaagaagacaaacaaaaatcgagtacttcggaacaaccggttattgaaaaagaggaaactaaaactaatcaacccacttttgatgttgattcaccacattctttttctgaatggttatcacattttaagggcgatgttccagttgataatgatgctaaaaccaccacttctaacatcgataaatttgatttaattaataagtttattcaagaagatcctaaaattcaacctaaaaagacagaattttactctccaataaacatggcaagactgagtgtggcagataattctgatatggtaagcgagacgctagcccttatccacgttgatcagggacattatcagaaggctatagaaatgtatgaaaaattaagtttgaaatatccaaaaaaaaggagttattttgcaacccaaattaaaaacttaaaacaaaaataa

SEQ ID NO: 14018 - protein, 224 aa, Unknown
  Obtained from environmental sample
  misc_feature (1)..(224): Xaa is any amino acid
MFYQLHVVVEDKVEEKIVEKSTIKEEKVEEKVELVDEMVEEKATTKQVEEEKPKEPTKIDALEQQLRAAAINSYILLETEEDKQKSSTSEQPVIEKEETKTNQPTFDVDSPHSFSEWLSHFKGDVPVDNDAKTTTSNIDKFDLINKFIQEDPKIQPKKTEFYSPINMARLSVADNSDMVSETLALIHVDQGHYQKAIEMYEKLSLKYPKKRSYFATQIKNLKQK

SEQ ID NO: 14019 - DNA, 528 bp, Unknown
  Obtained from environmental sample
  misc_feature (1)..(528): n is a, c, g, or t
atgaaaaactatattcttcaagatgaaaatgctgtttattttgagtgtggatatagttgtgataatcttattttcttaaacattagtggtgataaatatttcatcactgatgctagatatgagatagaggcaaaactatttgctaaaaattgcgaagtagttgtaacaaatgatttagtaaaagcaacgcgaaaaatactaaaaaaatccaaaatcaaaaaaatctcatttgatccaaatgattttaaacttcttacatataactctttaaaagacaacttagatatgaagtttgttcaaaagccaaatttttcaaaattgaaacgaattatcaaaacagatgatgagataaaacttcttaaaaaagctatgagtttaggaagagaaggttttgagaggttttcttcttatattcaaaaagagggtttaggaaaaagtgaaaaatatctcttttttaaagctaaagagtttatgagtaatacaggagagttcgaccttagttttgatccaatgtccgagccgatctga

SEQ ID NO: 14020 - protein, 175 aa, Unknown
  Obtained from environmental sample
  misc_feature (1)..(175): Xaa is any amino acid
MKNYILQDENAVYFECGYSCDNLIFLNISGDKYFITDARYEIEAKLFAKNCEVVVTNDLVKATRKILKKSKIKKISFDPNDFKLLTYNSLKDNLDMKFVQKPNFSKLKRIIKTDDEIKLLKKAMSLGREGFERFSSYIQKEGLGKSEKYLFFKAKEFMSNTGEFDLSFDPMSEPI

SEQ ID NO: 14021 - DNA, 795 bp, Unknown
  Obtained from environmental sample
  misc_feature (1)..(795): n is a, c, g, or t
ttggtttatcatattttctccatcatacctggcaaaccgtttttacactttttanctgccttaggagctttatcagctgtattattgttagtttttaaagacaccattttgggttttgtagcaagcatacaagtaagtgtaaacgatacggtagaaattggcgattggatttctatggaaaaatatggtgctgatggagatgtttatgaaatcaatctttctactgtgaaagtcaggaattttgataatactattactactattcctacttattatttgatntctgattcttttaaaaactggcgaggaatgagcatttctggtggaagaagaattaaaagagcagttattattaaatctactagtataaaattcttaacgaatgaagaaataaccaagtttaaagaaattcagttagttacagattatatagaccacaggcaggttgatataaataagcataacgaacagaataatattgataaaacggtattgattaatggccgaaacatgaccaattttggtttgtttagaaaatatgtagatgcttatttacatgaacaccctgcaattaacaaagaaatgatgataatgactcgtcaattggaaccaactccaacaggaattcctttagaggtgtatgcctttagtaaggataaagcttgggcaaattacgagcatattatggcagatatttttgatcatattttggcggcagttccttatttccatttagaagtatttgagtatcctacaggaaaggattttgttgatataatggagaagaaaaaataa

SEQ ID NO: 14022 - protein, 264 aa, Unknown
  Obtained from environmental sample
  DOMAIN (1)...(248): Mechanosensitive ion channel
  misc_feature (1)..(264): Xaa is any amino acid
MVYHIFSIIPGKPFLHFLXALGALSAVLLLVFKDTILGFVASIQVSVNDTVEIGDWISMEKYGADGDVYEINLSTVKVRNFDNTITTIPTYYLXSDSFKNWRGMSISGGRRIKRAVIIKSTSIKFLTNEEITKFKEIQLVTDYIDHRQVDINKHNEQNNIDKTVLINGRNMTNFGLFRKYVDAYLHEHPAINKEMMIMTRQLEPTPTGIPLEVYAFSKDKAWANYEHIMADIFDHILAAVPYFHLEVFEYPTGKDFVDIMEKKK

SEQ ID NO: 14023 - DNA, 963 bp, Unknown
  Obtained from environmental sample
  misc_feature (1)..(963): n is a, c, g, or t
atgcaatccctctctttctttttagattttagaaaatcggacatacgtgctttagcttcaagtcaaaccatttttaatctctctgaaaaattattgatacttgatgaaaaatataatctatctaacttaagtataaatgaaatttcagattacaaggatgtatctggactatatcaaaagtacaataaatatcttaataattttttaaaagagtatatgtacacagatgctatgattatagataatgagcatggacatatacttttttctgcaaactttgaacaatatattggtaaaaatcttaactctgggaaatttattaatagtgaaatggcacaagtttggaaaaaagtgttagatacaaatgagactcattttagtgatatgcactcacccactctctatatcgatgaacctgttatgcttcttgcaacgcctatcttcaaaaataaaaagatgatctcggttttaatgttaaaactgcctagcactcttataaactcaattctgcactatagagccagtgaagtaaaaagctgtgagacgtatgcagtgggaagagatcatctacttagaagtgacagttttttaaaaaaagagttaactgtaaaaaactcttttaatgatcataaaaactgctgtatactcactgaaaatatagacaaagcactcaagggtgaaagcggagtcagtgttagtaaagattacagaggtgtagatgtaatatctgcctactctccatttatttttgataacatcacttggggtgttatcacagagatggataagatagaggtcacaaaagagttagaagatatcgaaaaaagcttctatatctgggccgtagtaattgcacttattatatttattatcggcttctttgtaattagaaccgttataaaacgatctgttataaaccctttggtggcactctatcaaaaagcgaaaggattgaagatataa

SEQ ID NO: 14024 - protein, 320 aa, Unknown
  Obtained from environmental sample
  misc_feature (1)..(320): Xaa is any amino acid
MQSLSFFLDFRKSDIRALASSQTIFNLSEKLLILDEKYNLSNLSINEISDYKDVSGLYQKYNKYLNNFLKEYMYTDAMIIDNEHGHILFSANFEQYIGKNLNSGKFINSEMAQVWKKVLDTNETHFSDMHSPTLYIDEPVMLLATPIFKNKKMISVLMLKLPSTLINSILHYRASEVKSCETYAVGRDHLLRSDSFLKKELTVKNSFNDHKNCCILTENIDKALKGESGVSVSKDYRGVDVISAYSPFIFDNITWGVITEMDKIEVTKELEDIEKSFYIWAVVIALIIFIIGFFVIRTVIKRSVINPLVALYQKAKGLKI

SEQ ID NO: 14025 - DNA, 678 bp, Unknown
  Obtained from environmental sample
  misc_feature (1)..(678): n is a, c, g, or t
atgataaacatagcaatggtagaagatgatgctgagttagcagaagttttaacccaatatttaagtaaatttaatataaaagtgacaaactacgaagagccatttttggctttaagtagtttgaaaataaataaatttgatttaataattttagatttaactcttcctggaatggatggattagatgtttgtaaagatataatggcaaatcatgacataccaataattatctcaagtgctagaagtgatattacagacaaagttactgctttacaactaggggctgatgattatttaccaaaaccttataacccaagagaacttgaagttagaattaaaacaattctgcgaagatacaatgctagttcaaaaacagaagaaaaaccacaaaaagtgttcatttttgatgaagagaaaaaagagattcgaaaagatgataagtttataagattgacagcagcagaatatgaggtattgtctcttttgattaaaagagaaggttttgttgtctcaagagatgacatttttgaaaatagtaatttactaaatagtgattatgacaatattggttcccttgcagttattataaatagaattagacataaaattgaagataacccaaaaacaccgtcgtatttgcatacaataagaggaatggggtataaatttttacaatga

SEQ ID NO: 14026 - protein, 225 aa, Unknown
  Obtained from environmental sample
  DOMAIN (146)...(223): Transcriptional regulatory protein, C terminal
  misc_feature (1)..(225): Xaa is any amino acid
MINIAMVEDDAELAEVLTQYLSKFNIKVTNYEEPFLALSSLKINKFDLIILDLTLPGMDGLDVCKDIMANHDIPIIISSARSDITDKVTALQLGADDYLPKPYNPRELEVRIKTILRRYNASSKTEEKPQKVFIFDEEKKEIRKDDKFIRLTAAEYEVLSLLIKREGFVVSRDDIFENSNLLNSDYDNIGSLAVIINRIRHKIEDNPKTPSYLHTIRGMGYKFLQ

SEQ ID NO: 14027 - DNA, 540 bp, Unknown
  Obtained from environmental sample
  misc_feature (1)..(540): n is a, c, g, or t
ttggaaaacagtgatgaaaatgctgaaaaaatgagaagagtatttacacgtttagaattacttattagtgagtttacccaaatagaagagcttatatcttccactaaaaatatagtaaaaaacaactactttttagatgatattatagacaatgcagaagatatgcttatgctagaagatgatgtaattatctcagagtatgaaaacaaaaaaataaatgtgaattttaaacttttttgtgtagctataaaaaaccttatagataatgcaataaaatactcagatgataaaaaagtaaccataaaaaccaatgataaaagtgaaataatatttgaaaatagtggaaagggcttagcttatcctttagaagactattttgaaccattctttgcaaatgaaaataaaaataaaaacagctttggacttggactttatatagtaaattcaattcttaaagcaaatgattatgtactaaaatatgagtacaaagatgagataaatatatttactattgtaaagcttgaaaagaaggataagtaa

SEQ ID NO: 14028 - protein, 179 aa, Unknown
  Obtained from environmental sample
  DOMAIN (74)...(176): Histidine kinase-, DNA gyrase B-, and HSP90-like ATPase
  misc_feature (1)..(179): Xaa is any amino acid
MENSDENAEKMRRVFTRLELLISEFTQIEELISSTKNIVKNNYFLDDIIDNAEDMLMLEDDVIISEYENKKINVNFKLFCVAIKNLIDNAIKYSDDKKVTIKTNDKSEIIFENSGKGLAYPLEDYFEPFFANENKNKNSFGLGLYIVNSILKANDYVLKYEYKDEINIFTIVKLEKKDK

SEQ ID NO: 14029 - DNA, 714 bp, Unknown
  Obtained from environmental sample
  misc_feature (1)..(714): n is a, c, g, or t
gtgggatcagattcggctcgaggtcaagaacggattgaaaacattattcatcatttacaatttgaagaagttaaaaaagcacttatagattggaaaaatgctcctgaacaagatttaattcaaggagctattattgttgccaaataccaatatcctgatattgatgaggaattaattcataaaaccattaatcaactaaaacaagatacttggttagagttaaatgaaaaccttactgcattagaacaaataaatgtattaaatagaattttttttgaaattcatggctttcatggcaacactaaaaacattaattctcctaaaaattcttttataaataatgtagtagaatccaaatcaggcaaccctattacgttggggattttgtatatttctgtatgtaaattgctaaacatccctatttatggcgtaaatgttccagcacattttgttttggcttattccgaaaagcctaacgatatattattctacatcaatttatttaacaaaggaactatctttagcaaatacgatattgataattttctagctcaattaaaattaagtccaaaagcgagttattatattccttgcgacaaccttaccatcatacaacgcttagtccaacacctagtatttacttacgataatttgggttatttggacaaaaaacaagagttggaagaattgtatagtatattaaagggagaataa

SEQ ID NO: 14030 - protein, 237 aa, Unknown
  Obtained from environmental sample
  misc_feature (1)..(237): Xaa is any amino acid
MGSDSARGQERIENIIHHLQFEEVKKALIDWKNAPEQDLIQGAIIVAKYQYPDIDEELIHKTINQLKQDTWLELNENLTALEQINVLNRIFFEIHGFHGNTKNINSPKNSFINNVVESKSGNPITLGILYISVCKLLNIPIYGVNVPAHFVLAYSEKPNDILFYINLFNKGTIFSKYDIDNFLAQLKLSPKASYYIPCDNLTIIQRLVQHLVFTYDNLGYLDKKQELEELYSILKGE

SEQ ID NO: 14031 - DNA, 1014 bp, Unknown
  Obtained from environmental sample
  misc_feature (1)..(1014): n is a, c, g, or t
atgcgtttattcaactgtgcacaagttattacatgggcaacaataatcacccctctactactagtggcaataggcagtccggtggaggcaaaagctgaaatacttgaaaaccgcatacctatcaataagtcaatgcttaccaacgagaccaaaaagagtaatcctgaaatcctctttgacgaacaagagatcaccggcaaaaacgcaccgcccatggggcatatgcgactctccaccaattcatggggctcatacgtaaagggaagcatccctaccttctacattaatttaggatccgagcgcgacgtctcttccatatggctctacgacggcaaaggaggcaaagctgattttatagtatcctttggcacccctgggaattggaaggagttatttcgcgatgactgcattggctttaatatatggaaaaaacatcctgccaaagtaaaaacacagtaccttcgttttacaaaagctggggtcaaagcaaacattggagagattgttatttatgagaaaccaggcgccgcctactctaaaaccccacaagtaaaaaaagaggaactaccttgggatttagcgcctgaagtaatagctgatgccaaaactattaaagctgcaattgcagcgcgaaggcttgtcgatgctggagagatctttggcaaactaccactcatcgatgagataaacctcggggacccaatggatgtcaaaagccacgacatgcaggagtaccctaaaggagccagcaaaattgaaaccatatttggcgaagcttgccgcgtgttgcccaatgagggaggtaaaaaatatatttcccttcgtattggtaaaaacaaaggacttcaagcaggtaaatgttaccctcttaccatcgactancctgaagataaaccacgcaccatgtacataaccaacgtaaggcatacgggcacccgaggaataagactggaacactgtaggagacgtcttttttactataccnnatacatctcgaatcatcacatgcactag

SEQ ID NO: 14032 - protein, 337 aa, Unknown
  Obtained from environmental sample
  misc_feature (1)..(337): Xaa is any amino acid
MRLFNCAQVITWATIITPLLLVAIGSPVEAKAEILENRIPINKSMLTNETKKSNPEILFDEQEITGKNAPPMGHMRLSTNSWGSYVKGSIPTFYINLGSERDVSSIWLYDGKGGKADFIVSFGTPGNWKELFRDDCIGFNIWKKHPAKVKTQYLRFTKAGVKANIGEIVIYEKPGAAYSKTPQVKKEELPWDLAPEVIADAKTIKAAIAARRLVDAGEIFGKLPLIDEINLGDPMDVKSHDMQEYPKGASKIETIFGEACRVLPNEGGKKYISLRIGKNKGLQAGKCYPLTIDXPEDKPRTMYITNVRHTGTRGIRLEHCRRRLFYYTXYISNHHMH

SEQ ID NO: 14033 - DNA, 369 bp, Unknown
  Obtained from environmental sample
  misc_feature (1)..(369): n is a, c, g, or t
atgaaatttgtttatccagaatttctttatgccctttttgcaatagccatccctattgtaattcacctatttaattttcggaagtttaaaaaaatctacttctccaacgttcagtttttaaaagaagtaacgcaagaaacccaatctaaatctaaactaaaacacttattaattcttatcagcagaattttagcgataagcttcttagtctttgcttttgctccaccttacatcccaacaacagcggaatacctctccaaaaaacaagtagttggcatatacatagacaactccatttgcatggaaagtactggagctttaggctccttgctcgatgaactaaactccatgctgccgagtgggttataa

SEQ ID NO: 14034 - protein, 122 aa, Unknown
  Obtained from environmental sample
  DOMAIN (17)...(78): Protein of unknown function (DUF1550)
  misc_feature (1)..(122): Xaa is any amino acid
MKFVYPEFLYALFAIAIPIVIHLFNFRKFKKIYFSNVQFLKEVTQETQSKSKLKHLLILISRILAISFLVFAFAPPYIPTTAEYLSKKQVVGIYIDNSICMESTGALGSLLDELNSMLPSGL

SEQ ID NO: 14035 - DNA, 804 bp, Unknown
  Obtained from environmental sample
  misc_feature (1)..(804): n is a, c, g, or t
atggggtttggagatatcgtancccagattcaaccactcaagaagttttatgatgctgagcaatatcaccaagattatttaactaaaaatccaaatggatattgtcctaatcatagtacgggtgtaaagtttgaaaaacaaaatgatgataaaaaaagagatacaattgttccaatagggggtaaagagatagtggtaattgaagctgaagtattttgcccctattgtgaaaagtttaaagaagaggtaagtagctcttataaaggaactttacctttacgaacagtatatagttctcaactaaaaggttttgatattaagacaaaactagatgcaacaccaactatactttttattgaaaatggaaaagagatttttgcacatagaggttttttaaatgaagatgagttttacaaagctttgggtgtttttaaattaggaaaaaactcagaaagttacagtgtagcatttaacaaagatacagatagtagattttgtaagcaatatgatatctttaaaaatacccctgatggagtttttgtggataagctctctggagatatactttttgacactaaagatagatttaattcaggaactggatggttgagtttttataaagcagtggatggttcaactatagaaaaagaggataatagttatggtatgaatagaattgaagtgttagctaaaaaaagtggaatacatttaggacatgtatttccaagagatgatggaaaaagaagattttgtatcaatgctacagtattagaatttatcccaagggaaaaattaaaaaagtag

SEQ ID NO: 14036 - protein, 267 aa, Unknown
  Obtained from environmental sample
  DOMAIN (141)...(262): SelR domain
  misc_feature (1)..(267): Xaa is any amino acid
MGFGDIVXQIQPLKKFYDAEQYHQDYLTKNPNGYCPNHSTGVKFEKQNDDKKRDTIVPIGGKEIVVIEAEVFCPYCEKFKEEVSSSYKGTLPLRTVYSSQLKGFDIKTKLDATPTILFIENGKEIFAHRGFLNEDEFYKALGVFKLGKNSESYSVAFNKDTDSRFCKQYDIFKNTPDGVFVDKLSGDILFDTKDRFNSGTGWLSFYKAVDGSTIEKEDNSYGMNRIEVLAKKSGIHLGHVFPRDDGKRRFCINATVLEFIPREKLKK

SEQ ID NO: 14037 - DNA, 693 bp, Unknown
  Obtained from environmental sample
  misc_feature (1)..(693): n is a, c, g, or t
atgaagataaaatgtattattgttgatgacgaacctatctcaagagaaattctgaaaagttatgtttcagaatgtgattctcttgatctaatcatgtcttgtaagaatggttttgaggcacttgaaatagttagtaaagaagaaattgaattgatttttttagatgttaatatgccgaaattatcaggtttaaatttctataaatctttaaaaaatccgccattggttattttcacaacagcttatccagagtatgctgttgaagggtttgaagttaatgcgattgattatttgttaaaaccattttcatttgaacgatttttaaaatcaataaataaggcattagaaattatcgatcaaaaaaacatttcggaccaaaatacttatgttgttctcaaatcagataaaaaactgtatcggataaaaattaaagaattaatttttcttgaagcaatgggtgattatgttaaaatattttattcaaatcaatcgatcaccgtacatgagactttccaaaatatactgggtaaacttaacgagtctaatctatatagagtccataaatcatttgccatatcattggataaatttgatcatattgaaggaaatataataaaaattggaaataaatctattcctatcggtcaaacatatcgctctgcatttttaaatgtaataaattctacaaggtaa

SEQ ID NO: 14038 - protein, 230 aa, Unknown
  Obtained from environmental sample
  DOMAIN (136)...(227): LytTr DNA-binding domain
  misc_feature (1)..(230): Xaa is any amino acid
MKIKCIIVDDEPISREILKSYVSECDSLDLIMSCKNGFEALEIVSKEEIELIFLDVNMPKLSGLNFYKSLKNPPLVIFTTAYPEYAVEGFEVNAIDYLLKPFSFERFLKSINKALEIIDQKNISDQNTYVVLKSDKKLYRIKIKELIFLEAMGDYVKIFYSNQSITVHETFQNILGKLNESNLYRVHKSFAISLDKFDHIEGNIIKIGNKSIPIGQTYRSAFLNVINSTR

SEQ ID NO: 14039 - DNA, 933 bp, Unknown
  Obtained from environmental sample
  misc_feature (1)..(933): n is a, c, g, or t
atgacaacagagatactaaatgagcaaaaaaaagagatagaagctaatagtgaaaaattaagatatgattggatttcacccttaaatatctctacggcatacactaaaagtgataccaataaaaatttcatatctgatacttctataagtctgagtcaagatgtttttaggtcaggaggtattttttataagattgattatgctgatattaaactcaaaaatagtctgacttcattagcttcacaaaatacatctctatatgaggaactttttataggtttactaaaacttaaaaaactaaatttaacattagaacaggctcattatgcttttttaaactccgaaatagaggtttttttaaagactcagcagtttaaaaccggtgatgtagatattactgaactgaatagggcgttaagagagaaaaatagtctcttaaaaacagaactaactgccaaacaagatatagttgagcgcaaaatagaactaaaaaagctgacagatatggagctgagcagtatatctattcctagttttgagttaatttcaaaagatgagtatgaaaaatcaaactacaatatctctattgctgacttaaatactgaagtatctgataaagagtataaaatcacaaaatcgaactatcttccaaagattagtgtaaatggaggctatgggtatctaaataatccaaatgtaaacttttcagatacttattataatgttggagcgattttaagtataccactagagtataactataactcaactctgcaagagagtaaatctatatacatgagaaaaaagttagagataccagagacgaaaatagatgagttgacactgtatgatgcgggtatgagtaagataaaaaattatgaagatcantatagagtttacacagagaatattcagctctataaaaaattatag

SEQ ID NO: 14040 - protein, 310 aa, Unknown
  Obtained from environmental sample
  misc_feature (1)..(310): Xaa is any amino acid
MTTEILNEQKKEIEANSEKLRYDWISPLNISTAYTKSDTNKNFISDTSISLSQDVFRSGGIFYKIDYADIKLKNSLTSLASQNTSLYEELFIGLLKLKKLNLTLEQAHYAFLNSEIEVFLKTQQFKTGDVDITELNRALREKNSLLKTELTAKQDIVERKIELKKLTDMELSSISIPSFELISKDEYEKSNYNISIADLNTEVSDKEYKITKSNYLPKISVNGGYGYLNNPNVNFSDTYYNVGAILSIPLEYNYNSTLQESKSIYMRKKLEIPETKIDELTLYDAGMSKIKNYEDXYRVYTENIQLYKKL

SEQ ID NO: 14041 - DNA, 516 bp, Unknown
  Obtained from environmental sample
  misc_feature (1)..(516): n is a, c, g, or t
atggaaaataagaattctgtttatattgcaatgactattgatggttttattgctgacaaaaaaggctcagtttcgttcttagacaagtataatgaatcaagcgaagattatggttattcagaattctcttcatctgttgatactgttgttatgggaaataatacgtataagcagtttgccggtgaaaaagagtttattggtgcttacaaagatatgattaaatatgtttttacagaaactcctggtaagccaaaagatgattttatttttacgaatgaagacgttacagaattttctaaacgacttaaaggtcatacttggttaatgggaggagcatatctcataaatagatttttagagaaaggtcttattgatgaacttattattgcagttatgcctgaaattattggcagcggaatacgtctatttgctgagattgagtttagtcagagttacaaacttcttagttctaaaaactatcctgatggtgtcgtaatgcttcattactctaaataa

SEQ ID NO: 14042 - protein, 171 aa, Unknown
  Obtained from environmental sample
  DOMAIN (7)...(166): RibD C-terminal domain
  misc_feature (1)..(171): Xaa is any amino acid
MENKNSVYIAMTIDGFIADKKGSVSFLDKYNESSEDYGYSEFSSSVDTVVMGNNTYKQFAGEKEFIGAYKDMIKYVFTETPGKPKDDFIFTNEDVTEFSKRLKGHTWLMGGAYLINRFLEKGLIDELIIAVMPEIIGSGIRLFAEIEFSQSYKLLSSKNYPDGVVMLHYSK

SEQ ID NO: 14043 - DNA, 792 bp, Unknown
  Obtained from environmental sample
  misc_feature (1)..(792): n is a, c, g, or t
ttggagagaggagaaatattaagcaatgttgttcttgagaatattcttgagcaacaactgcataaaatcaattcctacgagtacaaaggaagtgtctataaattctcacaaggaaatgtacatgatgccatttatactttaaagaatttacccgatgaaggtttagtgaaaacatctgaaaagatatttgatctaattaacttaggtaagagctttgaggaaaatgtgcatggagacaaaaagagttttaccatccaatatattgattgggaaaactttgacaacaatgtatttcacattactgatgaattcgttgtacaaggattaaccgaaacaaggaggccagatttagtcttgtttattaatggaattcctttcgttgtaattgagaacaaacgcagagataaaaaggattcaaccaaagaagccatttcacaattcatcagaaatcagaaaaaagaagatggtattccaacgctttttcaatttgcacaattattaattgcaacacaacctaatgaggtgatgtatggcacaaccaatactcctgctaaattttggggattatggaaagagcaaaataatattgaaaaagaggtgcagaaaatactgaattcaactatcaatgggcaaagtagtcaagacaggttaccaacagaacaagacagaatgttatattgcttatgtaggcctgaacgtgtattggaattaacctataagtttttagtctttgatggcaaggtgaaaaaagtagctcgataccaacaatactttgctgtaaaaatgcattaa

SEQ ID NO: 14044 - protein, 263 aa, Unknown
  Obtained from environmental sample
  DOMAIN (1)...(186): Type I restriction enzyme R protein N terminus (HSDR_N)
  misc_feature (1)..(263): Xaa is any amino acid
MERGEILSNVVLENILEQQLHKINSYEYKGSVYKFSQGNVHDAIYTLKNLPDEGLVKTSEKIFDLINLGKSFEENVHGDKKSFTIQYIDWENFDNNVFHITDEFVVQGLTETRRPDLVLFINGIPFVVIENKRRDKKDSTKEAISQFIRNQKKEDGIPTLFQFAQLLIATQPNEVMYGTTNTPAKFWGLWKEQNNIEKEVQKILNSTINGQSSQDRLPTEQDRMLYCLCRPERVLELTYKFLVFDGKVKKVARYQQYFAVKMH

SEQ ID NO: 14045 - DNA, 408 bp, Unknown
  Obtained from environmental sample
  misc_feature (1)..(408): n is a, c, g, or t
atggcaaagaaagttagtttttctataaaaccctatgttgtgaaaaaacttatcacttgttataaggatcaaagtattaatgatgcttgttctttgatggctaaaaatgatataggaacaattataattatcgaacgaaaaaataaaaagaaatgtctgggtatatttactgaaagtgatctcgtgaaaaaagttatttctaaaaaaatatcacttgatgaaattttagaaaaagtaatgtctaaaaaaatagttactgctaatatggattcttcagatgcttttgttagttatttaatgactaaaaacaaagttaagaaactaattattttgaaagacagtaaactttgcggtataattactcagtctgatatgatgaaattactttcacaagaatggttgaagtaa

SEQ ID NO: 14046 - protein, 135 aa, Unknown
  Obtained from environmental sample
  DOMAIN (78)...(130): CBS domain
  misc_feature (1)..(135): Xaa is any amino acid
MAKKVSFSIKPYVVKKLITCYKDQSINDACSLMAKNDIGTIIIIERKNKKKCLGIFTESDLVKKVISKKISLDEILEKVMSKKIVTANMDSSDAFVSYLMTKNKVKKLIILKDSKLCGIITQSDMMKLLSQEWLK

SEQ ID NO: 14047 - DNA, 933 bp, Unknown
  Obtained from environmental sample
  misc_feature (1)..(933): n is a, c, g, or t
atgcgaagaaaggcatgggattctgatggaataccacaaatgctacctgaccataaaataagacaaaatactaatgattatgtttatgtatatgacaggggtattgaaggacatactgatgtagatgaaattattaagtttgttacagatgatagtcctaaatctaaaataacaggaaataacaataaacaaattgattatttaccaactaagaaatttaaaatttctgttgataaggaacttgttttagctaacggcactgtttctaaagataaggctgatagaattctggataatgtagaatggagcatagaagctaacggaatctataaaaaagaccttattattttagatatattagctgctaacgactggaaaagacctatttattttgctattactactggtgatgacgcttatttaggtttaacagattattttcaaattgaaggattagcctatagattagtaccttataaagcacaaagttttgacggacaaacaggagaggtaaatacagaagcaatgtatgaaaatttgatgactgaatttgaatggggaggaatgaacaagtcagaaatttatatggatgaaaacaacagaagaatgtgtatgaatttccgtaataattttgctcgtttagcaggcgattatatcagacaagggaaaaaagaaaaagcattagaagtattagataaatgcttggaagtgattcctcataaaaatgttccttataaccaatttatggtttctattgcagaacattattatagattagaagcatacgataaggcaaacgaaattgtaagaatcctacttgatatttatgaagatgactttaattattatatgtctttaaaaagaaaatacagaaaaatctgtgagcgtgaagaaagggttacaaagtacattcttggtcaattggaaatgtaa

SEQ ID NO: 14048 - protein, 310 aa, Unknown
  Obtained from environmental sample
  misc_feature (1)..(310): Xaa is any amino acid
MRRKAWDSDGIPQMLPDHKIRQNTNDYVYVYDRGIEGHTDVDEIIKFVTDDSPKSKITGNNNKQIDYLPTKKFKISVDKELVLANGTVSKDKADRILDNVEWSIEANGIYKKDLIILDILAANDWKRPIYFAITTGDDAYLGLTDYFQIEGLAYRLVPYKAQSFDGQTGEVNTEAMYENLMTEFEWGGMNKSEIYMDENNRRMCMNFRNNFARLAGDYIRQGKKEKALEVLDKCLEVIPHKNVPYNQFMVSIAEHYYRLEAYDKANEIVRILLDIYEDDFNYYMSLKRKYRKICEREERVTKYILGQLEM

SEQ ID NO: 14049 - DNA, 780 bp, Unknown
  Obtained from environmental sample
  misc_feature (1)..(780): n is a, c, g, or t
ttgaccgttgaatatttgaataataacgaaaatgtaatcagacagttcgctttgtactcattttcaccaaataattcagtggatatcctgttagataaatgggctttttataatcatgtaaaaagatataggacgatttcaattcctgaatctatagtcccatctgaagaattggggaatattgatggatctttctttccttgcgtttgtaagccaataaaaagtttttggaacaaaaatacaaaaatagaaaaagttcaatttttctcagataaaattcattttatgaattattttaatggcaataatgtagatgttcgggatatggataagatcatactacagaaatatgtagatggtcctgatacaaacatcgttttttgtgctatgcatatcaatgatggtgatgtttcgtctgtaataaccggtcgtaaaatttttcaatatcctttgggctttggcattgcctctgcgtgcattacagaacatctcccagaaatagaaaaaattacgaaaaaaattcttgtagggttgggttattcagggcctgcagaagctgagtttaaatgggatgacttgaaaaacgaatttcaggtgattgagataaacccaagatcatggtttaataattctttgtctgaagctgcgggacaagatattatctatgatacatactgcttcgcaattggggataaaaataagaagataaatgaatttataaagaaagagataatttggattgacgaagttagctttgtcggttcagtttacaggagctga

SEQ ID NO: 14050 - protein, 259 aa, Unknown
  Obtained from environmental sample
  misc_feature (1)..(259): Xaa is any amino acid
MTVEYLNNNENVIRQFALYSFSPNNSVDILLDKWAFYNHVKRYRTISIPESIVPSEELGNIDGSFFPCVCKPIKSFWNKNTKIEKVQFFSDKIHFMNYFNGNNVDVRDMDKIILQKYVDGPDTNIVFCAMHINDGDVSSVITGRKIFQYPLGFGIASACITEHLPEIEKITKKILVGLGYSGPAEAEFKWDDLKNEFQVIEINPRSWFNNSLSEAAGQDIIYDTYCFAIGDKNKKINEFIKKEIIWIDEVSFVGSVYRS

SEQ ID NO: 14051 - DNA, 666 bp, Unknown
  Obtained from environmental sample
  misc_feature (1)..(666): n is a, c, g, or t
ttgcgtaaaattacccatgaccttaatgacgaaaaaatagaccacctaaaaagtgtgtataaaaatgagataactactttaaataatgattttaattttattaaagagatgaataagggtagtgagtttatggatgaagaaaaaataaaaagagtccataatatagcaaaaaaacagattattatgcaccataaaaaacaaaacctacttacagaaaatgaagtatataatctcacaattaaaaaaggtactctaacacaagaggaacgatttgttattaataatcatgcgaaacttagtattgatattttaaactctctcccctttccaaaaaagcttaaaaatgttcccactattgcaggtggtcatcatgaaaaaataggtggaggaggatatccttttggtttaaaaggggatgaaataagttttgaagcaagaattattgctgttgctgatatatttgaggcactcacagcctctgatagaccttacaaagaaccaaacactttaaatcaatctattagaatactctcatttatggtaaaagatggtgaattagataaagatttggtaaaattctttcttgataataacttacatctagactatgcaaaagacaaccttttagaacatcaaattgatgaagtaacagtaactatagactag

SEQ ID NO: 14052 - protein, 221 aa, Unknown
  Obtained from environmental sample
  DOMAIN (30)...(157): HD domain
  misc_feature (1)..(221): Xaa is any amino acid
MRKITHDLNDEKIDHLKSVYKNEITTLNNDFNFIKEMNKGSEFMDEEKIKRVHNIAKKQIIMHHKKQNLLTENEVYNLTIKKGTLTQEERFVINNHAKLSIDILNSLPFPKKLKNVPTIAGGHHEKIGGGGYPFGLKGDEISFEARIIAVADIFEALTASDRPYKEPNTLNQSIRILSFMVKDGELDKDLVKFFLDNNLHLDYAKDNLLEHQIDEVTVTID

SEQ ID NO: 14053 - DNA, 672 bp, Unknown
  Obtained from environmental sample
  misc_feature (1)..(672): n is a, c, g, or t
gtgtcagaaatttctttagctatagcaaatgctataaatgaagataaagatggtatttataaagataagtattttgataaagaccaattaaaagagattgatgtagctgcatggatgcatgatgttggtaaaatcacaacaccagatcatgtagttgataaagcaacaaaacttgaaaccatttacgatagaattgaaactatagaggtaaagtttgagttacttaaaagggaaaaagagattgagcttttgcgtaaaataaaccatgaacctaatgacgaaaaaatagaccacctaaaaagtgtgtataaaaatgagataactactttaaataatgattttaaatttattaaagagatgaataagggtagtgagtttatggatgaagaaaaaataaaaagagtccataatatagcaaaaaaacagattattatgcaccataaaaaacaaaacctacttacagaaaatgaagtatataatctcacaattaaaaaaggtactctaacacaagaggaacgatttgttattaataatcatgcgaaacttagtattgatattttaaactctctcccctttccaaaaaagcttaaaaatgttcccactattgcaggtggtcatcatgaaaaaataggtggaggaggatatccttttggtttaaaggggatgaaataa

SEQ ID NO: 14054 - protein, 223 aa, Unknown
  Obtained from environmental sample
  misc_feature (1)..(223): Xaa is any amino acid
MSEISLAIANAINEDKDGIYKDKYFDKDQLKEIDVAAWMHDVGKITTPDHVVDKATKLETIYDRIETIEVKFELLKREKEIELLRKINHEPNDEKIDHLKSVYKNEITTLNNDFKFIKEMNKGSEFMDEEKIKRVHNIAKKQIIMHHKKQNLLTENEVYNLTIKKGTLTQEERFVINNHAKLSIDILNSLPFPKKLKNVPTIAGGHHEKIGGGGYPFGLKGMK

SEQ ID NO: 14055 - DNA, 504 bp, Unknown
  Obtained from environmental sample
  misc_feature (1)..(504): n is a, c, g, or t
atgaaatctattaagcttatagcaataagtgaagtgattatattagtcactaattttatatcatttagtttttttatgaatcttcagattgcatttttgagtagtctatttattatattgggttcttcttatgcctataaaaagatggtcaatatacaagttgcatctgatatggttgaagacaaaagagacatcctctatgatatagaagatccgcatgaactctatgaagaaaattctataaactatgctcctgttgaagaattagacctcaaagcgatagtaaaagaagagaagaaaaagattaaaacttttagtcttgagagtatgaaacatggagctagaggtagttcttctatttttagacttgttccgtatgtattcctagttttaggctttatagcactggaaaacaatggactacttgatattactgtttatctaccgtctttgcttgtagggataattgttgggtctgtgagtggcaaagagttgttttcttaa

SEQ ID NO: 14056 - protein, 167 aa, Unknown
  Obtained from environmental sample
  misc_feature (1)..(167): Xaa is any amino acid
MKSIKLIAISEVIILVTNFISFSFFMNLQIAFLSSLFIILGSSYAYKKMVNIQVASDMVEDKRDILYDIEDPHELYEENSINYAPVEELDLKAIVKEEKKKIKTFSLESMKHGARGSSSIFRLVPYVFLVLGFIALENNGLLDITVYLPSLLVGIIVGSVSGKELFS

SEQ ID NO: 14057 - DNA, 630 bp, Unknown
  Obtained from environmental sample
  misc_feature (1)..(630): n is a, c, g, or t
atgattaaagtaaaacctaaacctagactattaatatttattaccgaagattggtattattggagccataggcgttgtattgcgcttgctgcaaaagatgcaggttatgaagtgtttttaataacacgagttcataaattaggtgataagattcttaatgatggaattaacctaataccaatttctttaagacgaaaagaaaagaatccatttcgtgaattatactcttttttagagttaataaaaatatatagagatataaaaccgtcaattgtgcatcatgttacaataaagcctgttatttacgggactattatttccaatatactgggtataaaatcaatagtaaatgctttagctggattaggtcacctctttactactagaaatttcaagttacgaatattaaaaataatactaattagagtttttaaacttatatttataaaaacaaattcaaaaatgatatttcaaaatcatgatgatatggcatactttgttaataataagatattgaataagcaaaatatttcattaataagaggtgctggcgttgacgaaaatatttttcagtatgttaaagaatacgatgatacaaagactctattacttgcaggtagactattatga

SEQ ID NO: 14058 - protein, 209 aa, Unknown
  Obtained from environmental sample
  misc_feature (1)..(209): Xaa is any amino acid
MIKVKPKPRLLIFITEDWYYWSHRRCIALAAKDAGYEVFLITRVHKLGDKILNDGINLIPISLRRKEKNPFRELYSFLELIKIYRDIKPSIVHHVTIKPVIYGTIISNILGIKSIVNALAGLGHLFTTRNFKLRILKIILIRVFKLIFIKTNSKMIFQNHDDMAYFVNNKILNKQNISLIRGAGVDENIFQYVKEYDDTKTLLLAGRLL

SEQ ID NO: 14059 - DNA, 300 bp, Unknown
  Obtained from environmental sample
  misc_feature (1)..(300): n is a, c, g, or t
gtgaatgctattaaatatgcaataaacaatgaaatgccatctggtatttataatattactgataattgtatttatgtccttgatgatgttcttaatgctgtaagaaaacaagagggtgaaaaaattatcttaaatttacctaaattatttgtaaacacaatttttcaaattatgataaagcttattaaaaataatgaaaaaataaaaagtagacattggaaatttatgggtaagaatatttattcaactaaaaaattaggttgtactggttttgatgctcatccacacttgttagattaa

SEQ ID NO: 14060 - protein, 99 aa, Unknown
  Obtained from environmental sample
  misc_feature (1)..(99): Xaa is any amino acid
MNAIKYAINNEMPSGIYNITDNCIYVLDDVLNAVRKQEGEKIILNLPKLFVNTIFQIMIKLIKNNEKIKSRHWKFMGKNIYSTKKLGCTGFDAHPHLLD

SEQ ID NO: 14061 - DNA, 624 bp, Unknown
  Obtained from environmental sample
  misc_feature (1)..(624): n is a, c, g, or t
ttgatacctcaaggtataaatactgataggttttgtccaactgtaaataatataccaaaatcaccattgcatattggatttgtcgggaggttagaggaacgaaaaggtattgattttatatggaaagtaatggaagctatagggccaaatagcggaattgtatttcatttcttaggatctatacattgggctatacaaaaagaaattgaacaaaaatttgaacagtataaagaattttctatataccacccaccaatctcgcaatctgaaatgccatcattctatcaatctttacatgctttgctattaccttcgcggtttgaaaattttggtctcgcatacgtagaggcaatggcatgtgagcttgttgtttttgcaggtgtgcagggaggaggctcagaaataataaaagatggagaaacaggtttcttagttgatccagataaagatgttgggattgtagtaaatagattgcttaaaatgagtatcgatatggaaagttttacaaaagttgggaaaaaagcaaggcaggatgtatgtaaacttttttctcttcaaaaatgttctaaagataaagttattttttataaaaaaaaattagatacatttaaaggttgcaattaa

SEQ ID NO: 14062 - protein, 207 aa, Unknown
  Obtained from environmental sample
  DOMAIN (9)...(178): Glycosyl transferases group 1
  misc_feature (1)..(207): Xaa is any amino acid
MIPQGINTDRFCPTVNNIPKSPLHIGFVGRLEERKGIDFIWKVMEAIGPNSGIVFHFLGSIHWAIQKEIEQKFEQYKEFSIYHPPISQSEMPSFYQSLHALLLPSRFENFGLAYVEAMACELVVFAGVQGGGSEIIKDGETGFLVDPDKDVGIVVNRLLKMSIDMESFTKVGKKARQDVCKLFSLQKCSKDKVIFYKKKLDTFKGCN

SEQ ID NO: 14063 - DNA, 717 bp, Unknown
  Obtained from environmental sample
  misc_feature (1)..(717): n is a, c, g, or t
atgtctgtaacattattaattgtagctatgaatgaagaagaaggaatgaaggcaattatgccacaaatagatacaactctatttgagcagattctagttttagatggtcaatctaaagatgacactgtgaaatattcaaaagagatgggttatgacgtctacgtacaaaaagagaaaggtcttaacaacgcatatcgagaggtatggccactgattcgaggtgactttgtactaacgttttctccagatggtaattgtcttactcaagatttagtaaaattgatcaataaagctaaagaaggttatgacatggtcataggctctcgctactatggcggagctaaaagtgatgatgatgattatattactgcttttggaaattggttatttacgggtactataaattttctttttaaaggtaactatactgatgctatgaccatctatagaatttatagaactgatctatttaatcaattagagttaaataaagagtcaacatacaaactctatgagcaattatattttacaaaaattggagtagaaccaattttatctgcaagatttgcaaaagagaaattgaaatcagcagatattctttctattgaacctgcaagaatatatggtgaaagaaaattacagattattagatggggacttgcttatatgacgcagattatatttgagaaatttaaacctaaattattgaagaaatga

SEQ ID NO: 14064 - protein, 238 aa, Unknown
  Obtained from environmental sample
  DOMAIN (4)...(161): Glycosyl transferase
  misc_feature (1)..(238): Xaa is any amino acid
MSVTLLIVAMNEEEGMKAIMPQIDTTLFEQILVLDGQSKDDTVKYSKEMGYDVYVQKEKGLNNAYREVWPLIRGDFVLTFSPDGNCLTQDLVKLINKAKEGYDMVIGSRYYGGAKSDDDDYITAFGNWLFTGTINFLFKGNYTDAMTIYRIYRTDLFNQLELNKESTYKLYEQLYFTKIGVEPILSARFAKEKLKSADILSIEPARIYGERKLQIIRWGLAYMTQIIFEKFKPKLLKK

SEQ ID NO: 14065 - DNA, 906 bp, Unknown
  Obtained from environmental sample
  misc_feature (1)..(906): n is a, c, g, or t
ttgcgatatggattctctgcccttatagatttatacaaatcaagttcgtcttatgttgacgaaaattcggaagagtggaaaaagaaaacagataaagaaaaaaaacatactaaattaaaatcagcgaatttattcatccttgctgatcaatttgaagaattttttacaaattcagagaattttacagatggaaaaccaagttcagacgcatatacaactgttaacttactattagaaacagcaaaaattgctttgcgagacaatttaccaatctatgtaatttgtacaatgagatctgactttattagtcagagtgttgcatttaaaggtttgccagaaacaataggttttagccaattttttgttcctcgattaaacagaaaagaattacaacaagttatcgaagaaccagcaacactttcaggcggaaaactcaccaaacgactaaaagagctattaataaacgaattaaacgacgggtttgatcaacttcccctactccaacatactttgaaacaattatgggaaattgcagacaacggcgaagaagaaatagatttactccatctggcaaaacttggtggaataaaccaaaaatttttaccagaagaagataaaaaaagatttatttcttggagagtaacatcaaataatttacgaaaaaaacattttgacaatccatcagccaacaatgtgctgaatgctcacgcaaattttttgtacgacacagctttcgattatttacaaataaatctgattgggcagataaaatattactcccgaaaatgcagaaatgaaaataaaatttcttttcaatccctagtaaaaattgataaaggcagacctgtaaaaagccaaatgactttccgggaatttacgaacataataaaaccacccaaatattaa

SEQ ID NO: 14066 - protein, 301 aa, Unknown
  Obtained from environmental sample
  misc_feature (1)..(301): Xaa is any amino acid
MRYGFSALIDLYKSSSSYVDENSEEWKKKTDKEKKHTKLKSANLFILADQFEEFFTNSENFTDGKPSSDAYTTVNLLLETAKIALRDNLPIYVICTMRSDFISQSVAFKGLPETIGFSQFFVPRLNRKELQQVIEEPATLSGGKLTKRLKELLINELNDGFDQLPLLQHTLKQLWEIADNGEEEIDLLHLAKLGGINQKFLPEEDKKRFISWRVTSNNLRKKHFDNPSANNVLNAHANFLYDTAFDYLQINLIGQIKYYSRKCRNENKISFQSLVKIDKGRPVKSQMTFREFTNIIKPPKY

SEQ ID NO: 14067 - DNA, 732 bp, Unknown
  Obtained from environmental sample
  misc_feature (1)..(732): n is a, c, g, or t
ttgttgaagaataccattttaaaagattgtattctaaatgataagtgctcatacatagataattatgagcaaagtacacactacaaaataatagatagatgttcaatcactctctgtgaaaaacttgtagagagtggctggagacgctttggtaagatgttttttcgccctgtatgtgaaacttgccaagagtgtcaaagcctaaaaatagatgttaaaaatttccaattttcaaaatcaaaaaaacgaattattaaaaaaaataatcatcttcgaattatgatcagacgacccaccatgacagtttatcatcttgatctctttaaaagatatcatgatttcaaacaagaagttagaggttgggagaagcaaaaaagcagtgcccaaaattaccatgcctcttttgtacaaggtcatgaagagtttggttatgagatactgtactttgatgaaaataaacttattgcagttgatttggtagatattttaccaaatggcatctcatctatctacttctatcatgaccctgattatatgaaaaactctcttggtcattactcactttatagacagataatgctagcaaaagagagaaatctagattggatctatttgggttattatgtagagggatgccaaagtttagagtataaaaaagattatatacctcttttgaaattagatggcagacctgatatgcatgaaagttttaaatggagtctaaaattgtaa

SEQ ID NO: 14068 - protein, 243 aa, Unknown
  Obtained from environmental sample
  DOMAIN (5)...(91): Arginine-tRNA-protein transferase, N terminus
  misc_feature (1)..(243): Xaa is any amino acid
MLKNTILKDCILNDKCSYIDNYEQSTHYKIIDRCSITLCEKLVESGWRRFGKMFFRPVCETCQECQSLKIDVKNFQFSKSKKRIIKKNNHLRIMIRRPTMTVYHLDLFKRYHDFKQEVRGWEKQKSSAQNYHASFVQGHEEFGYEILYFDENKLIAVDLVDILPNGISSIYFYHDPDYMKNSLGHYSLYRQIMLAKERNLDWIYLGYYVEGCQSLEYKKDYIPLLKLDGRPDMHESFKWSLKL

SEQ ID NO: 14069 - DNA, 666 bp, Unknown
  Obtained from environmental sample
  misc_feature (1)..(666): n is a, c, g, or t
atgactaataatttatctatcgtaattttggctgcaggaaaaggtagtcgcatgaaatccacaaaagctaaagtgttacacaatattagtggtagacctatgctttatcatattataaaagagtctctgaaacttagtgatgatgtaaatattgttgtatctcatcaaaaagagagtgtaatagatcaaattggtgcgctgtttaataatataaattttattactcaagatattgaaaattacccaggtaccggaggtgcgctcaaaaatcttaaagtaaaacatgctgatgtacttgttttaaatggggacatgccacttattactgcagaatctttaaaggggtttttaaataattctagtgatattacaatgagtatttttgatcttgaaaatcctagcggttacggacgtgtagctataaataataatcaagtagattatattgttgaagagaaagacgcttctatagatgagctaaatatctcaactgtaaatgctggaatttactgtttcaaaagctccttattagaaaaatatatacctcttttaaaaaacagtaatgctcaaaatgagtactatttaacagatcttatagctatggcaaaaaatgactcactaagtataactcctcttttggttgatgaagagtattttaaggcgtaa

SEQ ID NO: 14070 - protein, 221 aa, Unknown
  Obtained from environmental sample
  DOMAIN (8)...(208): Nucleotidyl transferase
  misc_feature (1)..(221): Xaa is any amino acid
MTNNLSIVILAAGKGSRMKSTKAKVLHNISGRPMLYHIIKESLKLSDDVNIVVSHQKESVIDQIGALFNNINFITQDIENYPGTGGALKNLKVKHADVLVLNGDMPLITAESLKGFLNNSSDITMSIFDLENPSGYGRVAINNNQVDYIVEEKDASIDELNISTVNAGIYCFKSSLLEKYIPLLKNSNAQNEYYLTDLIAMAKNDSLSITPLLVDEEYFKA

SEQ ID NO: 14071 - DNA, 660 bp, Unknown
  Obtained from environmental sample
  misc_feature (1)..(660): n is a, c, g, or t
ttgatcagatcggctcgagagtgtttgattagattgatagatgaaagtggcagtattattagtccttttaagtttttgactattgcaaaaaaaagtaggttatataataaattaacaaaaattatgattcaaaaaagttgtcaatattttgagcatattgattgtgatttttcagttaatttatcagttgaagatatgttagatcaggatatcgtagaatacattacagatcaaattaaaagatacaatgtttcaaagaagattatttttgaaatcttagaatcagaaggtatcgaaaactatgaagagatatcttcttttatagaagagatgaaaagtcttggatgtaagattgctatagatgattttggttctggatactctaattttgagcatcttcttaagttaaatattgactatattaaaatagatggttcacttataaaaaatcttgatgatgatgttaattcacaggtagttgttgaaactattgttgattttgcaacaaaactaaatattctaacagtagctgaatttgtacataacaaagagattagtaaaaaagtaaaagagctaaatgtagatcgtactcaaggattttttcttgcagagcctcaaaaagagcttacaagagatcaattaagatctctgcataactaa

SEQ ID NO: 14072 - protein, 219 aa, Unknown
  Obtained from environmental sample
  DOMAIN (2)...(205): EAL domain
  misc_feature (1)..(219): Xaa is any amino acid
MIRSARECLIRLIDESGSIISPFKFLTIAKKSRLYNKLTKIMIQKSCQYFEHIDCDFSVNLSVEDMLDQDIVEYITDQIKRYNVSKKIIFEILESEGIENYEEISSFIEEMKSLGCKIAIDDFGSGYSNFEHLLKLNIDYIKIDGSLIKNLDDDVNSQVVVETIVDFATKLNILTVAEFVHNKEISKKVKELNVDRTQGFFLAEPQKELTRDQLRSLHN

SEQ ID NO: 14073 - DNA, 579 bp, Unknown
  Obtained from environmental sample
  misc_feature (1)..(579): n is a, c, g, or t
gtgataggaaatataaagttagcaaatcttccaaaagtcacaaaaaaattagaaaaaccaaatggtataactataactgctggaagtacccacaaaggtgaagaggaacttatcttaaactcttgggataaaagtatgggaaaacttatcgttgtcccacgacatccagagagatttgatgaggtgtatagattaatagagacaaggtataaaaacagtgacatatcctatcatcgatattcacaaaatgaggatttctctagtgatattattctcattgatgctatgggacagcttaataatatctatgctataagcgatgtggtaattttaggtggtggttttatcaaaagtgcagggggacataatcctatagagcctgctttttttggtacaatactcataagtggaaaaatgatatttaatcaaaagtcactgtttgattgtgttaatgattattatttaatagaaaatgaagagttacaaactactcttaaaaatataaaagatttgaaaaaatcaagtttacaaaaagtaggttcgattgaacccataatccaagagattaaaaaaggatag

SEQ ID NO: 14074 - protein, 192 aa, Unknown
  Obtained from environmental sample
  misc_feature (1)..(192): Xaa is any amino acid
MIGNIKLANLPKVTKKLEKPNGITITAGSTHKGEEELILNSWDKSMGKLIVVPRHPERFDEVYRLIETRYKNSDISYHRYSQNEDFSSDIILIDAMGQLNNIYAISDVVILGGGFIKSAGGHNPIEPAFFGTILISGKMIFNQKSLFDCVNDYYLIENEELQTTLKNIKDLKKSSLQKVGSIEPIIQEIKKG

SEQ ID NO: 14075 - DNA, 393 bp, Unknown
  Obtained from environmental sample
  misc_feature (1)..(393): n is a, c, g, or t
ttgggagaatatatgagaaaatgtctgctgataattatcttcctgattttattgggttgctctgccaatgatattccgaaatatgattatattaaaatttccggtgagcaaatttcaaatgagctaaagctggatgtagtagatttcctgaaacaggcagcaattacatcatctagatttatagatgatcctgattatacaatcacagctcataaaccaaatggctacgatgattattacagcgtgtatttagataaaatgttggtttatcccgacgatagttttcatgcttcctttgacaatctatcacaaaaaaagagtaagtgttatcaaattactgaagaaaatttatggattttcaataaactaaataaattcacgggcaaggagtaa

SEQ ID NO: 14076 - protein, 130 aa, Unknown
  Obtained from environmental sample
  misc_feature (1)..(130): Xaa is any amino acid
MGEYMRKCLLIIIFLILLGCSANDIPKYDYIKISGEQISNELKLDVVDFLKQAAITSSRFIDDPDYTITAHKPNGYDDYYSVYLDKMLVYPDDSFHASFDNLSQKKSKCYQITEENLWIFNKLNKFTGKE

SEQ ID NO: 14077 - DNA, 372 bp, Unknown
  Obtained from environmental sample
  misc_feature (1)..(372): n is a, c, g, or t
ttgatattggacaataagatgaaaaaagttctctcaattctgatgctgttgaccctcattgttctgtttgtgctgacctggtattgcagccgcaagaccgagcagttttttatggatcaaatcactgctctcaatcaagcggcaccagcgctgattaaggttgatctgcagaattatcaacgtaaactcttttcttcaaccgcgcggacagccttccatctccagggtaaggatgaggtcacttttaatctcaatcatcacattcgtcattttatctggggagtcaagatcataaccgtgcttgaagataactcagaactgacagattcaatcaaaacaacagttccccttgagaaatctcagccgatctga

SEQ ID NO: 14078 - protein, 123 aa, Unknown
  Obtained from environmental sample
  misc_feature (1)..(123): Xaa is any amino acid
MILDNKMKKVLSILMLLTLIVLFVLTWYCSRKTEQFFMDQITALNQAAPALIKVDLQNYQRKLFSSTARTAFHLQGKDEVTFNLNHHIRHFIWGVKIITVLEDNSELTDSIKTTVPLEKSQPI

SEQ ID NO: 14079 - DNA, 384 bp, Unknown
  Obtained from environmental sample
  misc_feature (1)..(384): n is a, c, g, or t
atgtttatgaaaaatgaaaacaattatttgaatcgtaggaattttctcagcaagtcaatatctgtatgcgcattatcatgcataggaatgtgctccccttcagtattatcagcaacagattttaatagtcaaccccaatatggggatcataaatttgatggtaaatcaaataaagaatttactcataaacaattgataaagcatgaatatcgaaaaatggtggactttatcaaaattatgcaaaaaaacatgaacgaggaagagattattgatatactaaaaaaatattcagttgaaataggaacaggtgctggtaattatcnaggtaggtcttcaccagataatagttttgaatccttcactaaatacttccgcccccactag

SEQ ID NO: 14080 - protein, 127 aa, Unknown
  Obtained from environmental sample
  misc_feature (1)..(127): Xaa is any amino acid
MFMKNENNYLNRRNFLSKSISVCALSCIGMCSPSVLSATDFNSQPQYGDHKFDGKSNKEFTHKQLIKHEYRKMVDFIKIMQKNMNEEEIIDILKKYSVEIGTGAGNYXGRSSPDNSFESFTKYFRPH

SEQ ID NO: 14081 - DNA, 327 bp, Unknown
  Obtained from environmental sample
  misc_feature (1)..(327): n is a, c, g, or t
atgacttacttatttttagccattgccataggtttaattactgctgcgagtaaaggaagttgggacgagtttattgtgttaaacggaattattttaggcatcacttatttattagaaagtaatctattaatgagaaatgaatcctctaaaattattagttacaacaatatggatttgattaaaccagattcacgtaaagagctaattgctgatttagagactaaaaccggaatgaaaatcaacagaatcaatataaaagaatttgatttagctaaaaatcgtgttcaaattgaggttttttactttgataaactaaacaaacattaa

SEQ ID NO: 14082 - protein, 108 aa, Unknown
  Obtained from environmental sample
  SIGNAL (1)...(18)
  misc_feature (1)..(108): Xaa is any amino acid
MTYLFLAIAIGLITAASKGSWDEFIVLNGIILGITYLLESNLLMRNESSKIISYNNMDLIKPDSRKELIADLETKTGMKINRINIKEFDLAKNRVQIEVFYFDKLNKH

SEQ ID NO: 14083 - DNA, 876 bp, Unknown
  Obtained from environmental sample
  misc_feature (1)..(876): n is a, c, g, or t
atggctcggatcaacaggaagatgctagataaattcaaaactgccaagtggatagaccgtaaaaatgaagataaagctgatacatatcaaaatgctttggagttactggtaaatccaggtgactacaatgatggcattttggagaagatctatcagaaagcagataatcgctcaaaaaatcaaacaatcattctggattacagtggcttaagaagacttcttgttccgcttatagttatccttttatttacatccttacttgtgttgttcaaacatgaaaatattatgagatcttgggaatttttctccttaaaaagcctgccggaagagcagcataaacagatagttgaacttattcctggtgatatcgatataattagaaacgatcaggtaaaaatagaaataatagatcctgaactggaaatagagcatagcattctatttcgcagagataaaatctggcgtgaaaagcagatggtagataatagctatattttcaggaatcttgattattctgtagagtattatgttaagaatcagtatgcacaatcagatacctttcgaatcaatgtttttgatctgccttctatcgaacgaatcgatcttctctatgattatccaggttatactggcttagaaaaaaagtttttgtctgatgttaatggtaatgtgaaagcattgaaaggaactaaggtaactatcaatatcgctgcaaataatgatttggaatcggcagtaattgtctattctgatggcgaattacttaagatgcaacgaacaggtaagaaatcttttaagacatcctttatcttggatganagcggatcctatcactttaatttaatcgattttttagggaataatcccgcaaattag

SEQ ID NO: 14084 - protein, 291 aa, Unknown
  Obtained from environmental sample
  misc_feature (1)..(291): Xaa is any amino acid
MARINRKMLDKFKTAKWIDRKNEDKADTYQNALELLVNPGDYNDGILEKIYQKADNRSKNQTIILDYSGLRRLLVPLIVILLFTSLLVLFKHENIMRSWEFFSLKSLPEEQHKQIVELIPGDIDIIRNDQVKIEIIDPELEIEHSILFRRDKIWREKQMVDNSYIFRNLDYSVEYYVKNQYAQSDTFRINVFDLPSIERIDLLYDYPGYTGLEKKFLSDVNGNVKALKGTKVTINIAANNDLESAVIVYSDGELLKMQRTGKKSFKTSFILDXSGSYHFNLIDFLGNNPAN

SEQ ID NO: 14085 - DNA, 522 bp, Unknown
  Obtained from environmental sample
  misc_feature (1)..(522): n is a, c, g, or t
ttgaagctttgggcatttaaaaacaatatggataacgaaatatctccatattttagctacaaacctagtgacctttttatgtttgatccaaaatctccaaataaatcatttgcaactcctagaagttggaaatttgtggatgatatactcaaatcaaaggtaactgaaaaactacttgaaaatgtaataagtggagcaattggaattgaaactgcacaagagtttttaaactacacaaaagtaatggatgaacttccagacatagatgagatactaataggtaatgaagtagagatacctacaaaaaattctgcactttatgccctttgtattggaattgtatatgcattaaaagataatttttctacacaaaatcttacaaatgtgttaaatttctctcttaaacttgatggagaatttacaattttgttaattcgtgatatgcaaaaagatggaatagatgtggaaagtagcccagcttggagaggctgggtagacgagcataggtttttagtaagctaa

SEQ ID NO: 14086 - protein, 173 aa, Unknown
  Obtained from environmental sample
  misc_feature (1)..(173): Xaa is any amino acid
MKLWAFKNNMDNEISPYFSYKPSDLFMFDPKSPNKSFATPRSWKFVDDILKSKVTEKLLENVISGAIGIETAQEFLNYTKVMDELPDIDEILIGNEVEIPTKNSALYALCIGIVYALKDNFSTQNLTNVLNFSLKLDGEFTILLIRDMQKDGIDVESSPAWRGWVDEHRFLVS

SEQ ID NO: 14087 - DNA, 639 bp, Unknown
  Obtained from environmental sample
  misc_feature (1)..(639): n is a, c, g, or t
ttggaagttttaaggggtaaggatgaaaataaagatcagtcttattttttgtggaagcttaatcaagaacagcttaagtctattttgttacctcttggtgattttaaaaaagaagaggtaaaaaaaatagcaaaacagattgatttgtcggcaattataagtaaagagtctcaagatctttgttttgttgaaaggacgataggcgatttcttaaaagagaagttgaaaaacaagcctggtaaaataattgatttagatggcaacgttatagggacgcatgacggtctatggttttatactataggacaaagaaaaggtataaacctttcaggtgggccattttatgtccttgagagaaacctaagaaagaactatttaatcgtaacgaagaacgaaaaagatttacaaaaaaaagagattgagctaaaagatattaattggatatctggaaaagaacctgtttcaccgataagaataaaagttcaaattaggtatggttctcaagctttttctgctattttgtctaaaaacgataaatgtttattaagctttaaaattaagcagaaggcaatttcgcctggacagtcagcagttttttatgagggtcaaaagcttctaggcggaggaattatttgttaa

SEQ ID NO: 14088 - protein, 212 aa, Unknown
  Obtained from environmental sample
  DOMAIN (1)...(211): tRNA methyl transferase
  misc_feature (1)..(212): Xaa is any amino acid
MEVLRGKDENKDQSYFLWKLNQEQLKSILLPLGDFKKEEVKKIAKQIDLSAIISKESQDLCFVERTIGDFLKEKLKNKPGKIIDLDGNVIGTHDGLWFYTIGQRKGINLSGGPFYVLERNLRKNYLIVTKNEKDLQKKEIELKDINWISGKEPVSPIRIKVQIRYGSQAFSAILSKNDKCLLSFKIKQKAISPGQSAVFYEGQKLLGGGIIC

SEQ ID NO: 14089 - DNA, 516 bp, Unknown
  Obtained from environmental sample
  misc_feature (1)..(516): n is a, c, g, or t
gtgaaaagaatgttcagggttttaaataattttcaatttaagttaaaattgtacttatgtccttttgctgacattcaaaaagaaatccttttaaatattcctgcaaaacttagagttattctttataagagaatgatgttgagaattgctgataagattggggaaaaagataaaatagagacgattattacgggagaaaatgtggggcaagttgcttctcaaaccttagaaaatattcaggtaattcaatctgtaacgagcaagttaattttaagaccattgatatgtcaagataaaaacgaaataatagaaaaggcaatagatgtaggaacttttaatctttcgattcttccatatcaggattgttgtactaggtttgttcctcgtcatccagcgactaaagctagattgaaagacgtagagaacgcagagaaagagttaagcataaaagatttggtggagcagtctgttaaaggtgcagaaacgattaattttaaatttgtaaaagatgaataa

SEQ ID NO: 14090 - protein, 171 aa, Unknown
  Obtained from environmental sample
  DOMAIN (1)...(149): Thiamine biosynthesis protein (ThiI)
  misc_feature (1)..(171): Xaa is any amino acid
MKRMFRVLNNFQFKLKLYLCPFADIQKEILLNIPAKLRVILYKRMMLRIADKIGEKDKIETIITGENVGQVASQTLENIQVIQSVTSKLILRPLICQDKNEIIEKAIDVGTFNLSILPYQDCCTRFVPRHPATKARLKDVENAEKELSIKDLVEQSVKGAETINFKFVKDE

SEQ ID NO: 14091 - DNA, 795 bp, Unknown
  Obtained from environmental sample
  misc_feature (1)..(795): n is a, c, g, or t
atgaatcatataggtgcagatgtaaactttataaaaaaatatgaaaatgagtttggatacgatgatgaaaataataagctctacaaacagtacgaacttttgacaaattttagaagcaaaaataatcttgtagagtattcaaacagttttatatcaacagtgacaaatcgatataaagagcatccactccatgcttattctcaagataacggtatactcaaagtaattactcacaaatctgctaacctgatttcgcctactgttgagcttattaaaaagtatggaactcatagcaatatcgcaatattagtctttacaaatgatgaagtcatgcagatttactcacaacttcaagagttagggataaacacaaaattcataatagagagagaaaaatttactttaaaaaacattactgaggttgttgaatttgacaaaacattaagcagatgcctaaacggtgaaacatcttatagtgatgaagattttgagaaatcactacaactcattgagacaaaatttaaaaactctaaaaatttaaaacttttgcagatgattatagataagtttttaaaagagaatcaggtctattatgtatctcaatggctagcttatttggatgagataaaactagaagagtttgaaaattacaacaaaagtgtaactgtttcaaccatacataaatctaaaggcatggagtttgatacggtactacttttggtaaacaaaacaccaaaaagtgacgaagagaaaagattatactatgtcggcatgacaagagcaaaaatgagctaa

SEQ ID NO: 14092 - protein, 264 aa, Unknown
  Obtained from environmental sample
  misc_feature (1)..(264): Xaa is any amino acid
MNHIGADVNFIKKYENEFGYDDENNKLYKQYELLTNFRSKNNLVEYSNSFISTVTNRYKEHPLHAYSQDNGILKVITHKSANLISPTVELIKKYGTHSNIAILVFTNDEVMQIYSQLQELGINTKFIIEREKFTLKNITEVVEFDKTLSRCLNGETSYSDEDFEKSLQLIETKFKNSKNLKLLQMIIDKFLKENQVYYVSQWLAYLDEIKLEEFENYNKSVTVSTIHKSKGMEFDTVLLLVNKTPKSDEEKRLYYVGMTRAKMS

SEQ ID NO: 14093 - DNA, 846 bp, Unknown
  Obtained from environmental sample
  misc_feature (1)..(846): n is a, c, g, or t
ttggttgatgagctaagcgtaaaacatctgaaaagtaaaataaaagagagtgtaattttaaatcatgacgactttcgtacagatcactctatagaagttgtatctccaataatatttaatgataaattgctagcttacgctagaacaaaaatcgaccacaaatactgggcattatcccttgaagagatcaagtttgagatatttacttacacgactattgccatgatattaacgattttatttgcttattttagtgcaaatcgattaacaaaacatctctacaatctgatagaggtaacaaagagagtaaaagatggtgagaaaaatataagggctattgaagttggcgtaggtgaaattagtatactagctcatgaatttaatgatatgctgcactctcaagaggcaaatgaaaaaagtctgaaagagtctcagcatcagctagagcttgatataaaaaagagaaaaaaagctgaaagaacaattaccgatttaaataaaaatctagaacaaacagtccatacacgaacaagagagcttattgttgaaaaagagagagctgaaaaagcaaataaagcaaaaagtatatttttagcaaatatgagccacgaactgcgtacccctctaaatgctattttaggattttcacaaataatgtcaaacgacactaaaattacacaatcacaaaaagagaatctgaatatcattaactacagcggtgagcatctgttatctttaataaatgacatactagatatgtcaaaaatagaagccggaagagtagagcttgaattttcaaaatttgatcttctgcagatgctgcaggatatatctctcatgatntaa

SEQ ID NO: 14094 - protein, 281 aa, Unknown
  Obtained from environmental sample
  DOMAIN (67)...(136): HAMP domain
  misc_feature (1)..(281): Xaa is any amino acid
MVDELSVKHLKSKIKESVILNHDDFRTDHSIEVVSPIIFNDKLLAYARTKIDHKYWALSLEEIKFEIFTYTTIAMILTILFAYFSANRLTKHLYNLIEVTKRVKDGEKNIRAIEVGVGEISILAHEFNDMLHSQEANEKSLKESQHQLELDIKKRKKAERTITDLNKNLEQTVHTRTRELIVEKERAEKANKAKSIFLANMSHELRTPLNAILGFSQIMSNDTKITQSQKENLNIINYSGEHLLSLINDILDMSKIEAGRVELEFSKFDLLQMLQDISLMX

SEQ ID NO: 14095 - DNA, 762 bp, Unknown
  Obtained from environmental sample
  misc_feature (1)..(762): n is a, c, g, or t
atgggtgattttattttattttttgaaaaacatttttataaagatagtattttaagaggtgctatgcttactatttcacttctacttatagtgtttatcataacttttacttttgattattttattgacaatgtttttattctagcttttttagcctcttttgggatagcttcaaagatgttgtatgagagtgtcaaagacattattcaaaatcctcaaaatataaaatacctcgtaagccgagatactcaaaacctatctcaaagtgatataaataaagcagccatagaaacttatagtgaaaatctaagcgatgctgttatagcacctttgttttatctcttattttttgggattgttggtttatttatctacaaagctattaatacccttgattctatggtgggatatagaaatccaagatatgaaaagtttggcaaaataagtgcgatactagatgatatagtcaattatatcccatcaagaattacagctattataatatctaccctattacttagtaaaaaagcactgttacattttagtaaatatggaaaacttcacgaaagtccaaatgcaggataccctatatctgctatggcactaagcctaggtttaaaacttggtggggatacttcttattttggagttataaaacataagccttactttggagatggtaaaaaaattatagaaaacagtgacataaaaaaatcacttgattttcaaataagactagatatctttcttatgtttaaataa

SEQ ID NO: 14096 - protein, 253 aa, Unknown
  Obtained from environmental sample
  DOMAIN (1)...(253): CobD/Cbib protein
  misc_feature (1)..(253): Xaa is any amino acid
MGDFILFFEKHFYKDSILRGAMLTISLLLIVFIITFTFDYFIDNVFILAFLASFGIASKMLYESVKDIIQNPQNIKYLVSRDTQNLSQSDINKAAIETYSENLSDAVIAPLFYLLFFGIVGLFIYKAINTLDSMVGYRNPRYEKFGKISAILDDIVNYIPSRITAIIISTLLLSKKALLHFSKYGKLHESPNAGYPISAMALSLGLKLGGDTSYFGVIKHKPYFGDGKKIIENSDIKKSLDFQIRLDIFLMFK

SEQ ID NO: 14097 - DNA, 327 bp, Unknown
  Obtained from environmental sample
  misc_feature (1)..(327): n is a, c, g, or t
gtgcttaaaactactataaaaggttctgatctgatatttagatttggaggagaggagttcttagttatcttatatgatatatccaaagataatgcaaataaaatagctcaaaatattcgtatcacattttctaaaaaaagttttacaacatcaagtaaaaatattcaaaaaacactcagtataggtttatcgtcttttcctactgatgcagacaacccttggcaagcgattaaatttgccgacattgcactatatgaagcaaaaaacagcggacgtaataaagttgttatgtttgaaccatctttaaatcaaaatgaagagtattag

SEQ ID NO: 14098 - protein, 108 aa, Unknown
  Obtained from environmental sample
  DOMAIN (2)...(94): GGDEF domain
  misc_feature (1)..(108): Xaa is any amino acid
MLKTTIKGSDLIFRFGGEEFLVILYDISKDNANKIAQNIRITFSKKSFTTSSKNIQKTLSIGLSSFPTDADNPWQAIKFADIALYEAKNSGRNKVVMFEPSLNQNEEY

SEQ ID NO: 14099 - DNA, 642 bp, Unknown
  Obtained from environmental sample
  misc_feature (1)..(642): n is a, c, g, or t
atgcacgacgtaacggagatagtaaatcttaatgatgagatagaagcaacacaaaaagaggttgtcctcactatgggtgcaattggtgagacacgttcaaaagagacaggtctacatgtaaaaagagttgcagagtattcataccttttagcaaaacttgcaggtctaagtgaagaaaaagcaaatcttttaaaacaggcttctcctatgcatgatattggaaaagtcggtattccagatggtatattgaataaaccgggaaaattgactgaagaggagtttgaaattatgaaaactcacagtcaaatgggttatgagatgctaaagcattcaaaaagagacatcttaaaaacagcagcaaccatagcatatacacatcatgaaaaatataacggaacagggtatccaaatcaacttatgggagaggatattccaatagagggaagaattacagctttagcggatgtgtttgatgcactaggacatgatagatgctataaaaaagcttgggagttagatgctatattagaacttttcaataaagagagcggtaagcattttgatccaaaattgattcaactttttaatgaaaatctagaacagtttctagagattagagatagtatgagggatgatttttag

SEQ ID NO: 14100 - protein, 213 aa, Unknown
  Obtained from environmental sample
  DOMAIN (36)...(160): HD domain
  misc_feature (1)..(213): Xaa is any amino acid
MHDVTEIVNLNDEIEATQKEVVLTMGAIGETRSKETGLHVKRVAEYSYLLAKLAGLSEEKANLLKQASPMHDIGKVGIPDGILNKPGKLTEEEFEIMKTHSQMGYEMLKHSKRDILKTAATIAYTHHEKYNGTGYPNQLMGEDIPIEGRITALADVFDALGHDRCYKKAWELDAILELFNKESGKHFDPKLIQLFNENLEQFLEIRDSMRDDF

SEQ ID NO: 14101 - DNA, 831 bp, Unknown
  Obtained from environmental sample
  misc_feature (1)..(831): n is a, c, g, or t
atgaattcagaccttgcgaatgaccttggaaatttagtttctagatctgttgcgatggtagaaaaatattttgatggtgttgttacgaatgattataaaaatacagagcatgacgcagatattgaaaaagtagcaaatgagctgtttaaaaaagttgatttgcatatggatgaacttaatatcccagaagcaatttcagaagtatgggcgttaatcggaaagtcgaataagtatattgatttaacaatgccttggattctagcgaaagataaagcaaacaacgaaacattaagcagtgttatgtatcacttgattgaaaatatccgtattgttgccgttttcttacaagcgtttttaccatcgacagctgaaaaaatctttgtgaatatcggtgtaacggatgaggctctaaaaacaatcgacagtgtaaaagctttcggcggtattaaacgtgttaaagtcataaaacaagaccctatcttcccaagaatcgatatcaaaaaagagttggaagatttagataagctaagcgatggtcgtgatattaaaaagaataagagcaagccagctaagaaacaagaaaaagtagttgaaaagaaaaaagagattacattcgatgagtttatgaatgttgaatttaagactggtttggtattggaatgcgaagaagttccaaagagcgataagcttctcgtttcaaaagttaaaattggcgacgaggtaagacaaatcgtttcaggcattaaaacatggtataagcctgatgaaatggttgggaaaaccngttgttgtggtgacgaacctaaaatctgcaaaaattcgtggcgttga

SEQ ID NO: 14102 - protein, 276 aa, Unknown
  Obtained from environmental sample
  DOMAIN (213)...(276): Putative tRNA binding domain
  misc_feature (1)..(276): Xaa is any amino acid
MNSDLANDLGNLVSRSVAMVEKYFDGVVTNDYKNTEHDADIEKVANELFKKVDLHMDELNIPEAISEVWALIGKSNKYIDLTMPWILAKDKANNETLSSVMYHLIENIRIVAVFLQAFLPSTAEKIFVNIGVTDEALKTIDSVKAFGGIKRVKVIKQDPIFPRIDIKKELEDLDKLSDGRDIKKNKSKPAKKQEKVVEKKKEITFDEFMNVEFKTGLVLECEEVPKSDKLLVSKVKIGDEVRQIVSGIKTWYKPDEMVGKTXCCGDEPKICKNSWR

SEQ ID NO: 14103 - DNA, 369 bp, Unknown
  Obtained from environmental sample
  misc_feature (1)..(369): n is a, c, g, or t
atgatgacttgtaatgtaatttctccacacttattttggtggaaaaaattaagaaccaatttagcatttacttttataatgtctattgtagtaaatatagggatgtggtttgaaagatttgtgattattgtaacttcagttcacagagattatttaccatcaagttggtctatgttctacccaacttgggtggatataggaatctttatagggacactaggattatttagtgtattctatttattgttcttaagatatttccctgtattagcacttaatgaattgaaaacaattttaaaatcttcaggagagaaatacaaaaacatgtctgatgaagactttaaaaaattacacccagtaaaaaaataa

SEQ ID NO: 14104 - protein, 122 aa, Unknown
  Obtained from environmental sample
  misc_feature (1)..(122): Xaa is any amino acid
MMTCNVISPHLFWWKKLRTNLAFTFIMSIVVNIGMWFERFVIIVTSVHRDYLPSSWSMFYPTWVDIGIFIGTLGLFSVFYLLFLRYFPVLALNELKTILKSSGEKYKNMSDEDFKKLHPVKK

SEQ ID NO: 14105 - DNA, 747 bp, Unknown
  Obtained from environmental sample
  misc_feature (1)..(747): n is a, c, g, or t
ttgattgtagaagcagatagaactgattttaaagaacctgatgagtcattaatgggtgaagaggttgttcttctagatatgggactaatggaaacttcaaaatttttacaagaaactcctaaaccaaaaaatataagaaccactaaacctagtgcttttgggaatcaaccaagaggtattaaaagagggaagaaaaagaaaaagtacaaaaaagcagttgaagaggtagagattactgaagtaacaataccagaagagtgtagagtttacgaatttgctgaaaaaataggtaaaactgctggtgatgtaataggtaaacttttcatgcttggtatgatggttacaaaaaatgactttttaggaaatgatgagatagagatacttggtgaagagtacggtattgatattactattaaagatgaactagaagatgtaaactatgttgaagattatcatgatgatgaagtagatacatcaaactatgtttcaagacctcctgttgtaacaattatgggacatgttgatcatggtaaaacttcacttttagataaaattagaagtagtagagtagcagctggtgaagcaggtggaattacacaacatatcagtgcatatactataaataaaaatggccaagatatcacttttgtagatactccaggacatgaagcatttagtgcaatgagagtaagaggagctagtgttactgatgttattattttagtagttgcagcagatgatgggtaa

SEQ ID NO: 14106 - protein, 248 aa, Unknown
  Obtained from environmental sample
  DOMAIN (163)...(248): Elongation factor Tu GTP binding domain
  misc_feature (1)..(248): Xaa is any amino acid
MIVEADRTDFKEPDESLMGEEVVLLDMGLMETSKFLQETPKPKNIRTTKPSAFGNQPRGIKRGKKKKKYKKAVEEVEITEVTIPEECRVYEFAEKIGKTAGDVIGKLFMLGMMVTKNDFLGNDEIEILGEEYGIDITIKDELEDVNYVEDYHDDEVDTSNYVSRPPVVTIMGHVDHGKTSLLDKIRSSRVAAGEAGGITQHISAYTINKNGQDITFVDTPGHEAFSAMRVRGASVTDVIILVVAADDG

SEQ ID NO: 14107 - DNA, 504 bp, Unknown
  Obtained from environmental sample
  misc_feature (1)..(504): n is a, c, g, or t
gtggatgcggatacggtaaaagatattaaggaaaggcagaagcaaattaatgatgaaatcaatcgggttcgcaaagttgtgatgaagcctgtttcagccgttaataagtatctggaggatcatcattccagccccattgacaacggtattcatcttgatcagctgcttaagcgcagcgagctggattatgaactggtaaatgcctttgcgcctgcagatgcgcttttagatacccgggtggtccggcaggtggaaattgaagtaaaatatgaaggttatatactaaagcagttaaaggaaattgaaaagttcaacgaccttgaaaataaaaaaattccggaaaattttgattttattgcgttgcacggattgtccaatgaattaaaggaaaaattatcagcaatccgtccgttgtcgttaggacaggcatcccggattgacggaatgacgccggtggctctttctgttttgatgatcgggctaaaagccaggcccggtaagtaa

SEQ ID NO: 14108 - protein, 167 aa, Unknown
  Obtained from environmental sample
  misc_feature (1)..(167): Xaa is any amino acid
MDADTVKDIKERQKQINDEINRVRKVVMKPVSAVNKYLEDHHSSPIDNGIHLDQLLKRSELDYELVNAFAPADALLDTRVVRQVEIEVKYEGYILKQLKEIEKFNDLENKKIPENFDFIALHGLSNELKEKLSAIRPLSLGQASRIDGMTPVALSVLMIGLKARPGK

SEQ ID NO: 14109 - DNA, 882 bp, Unknown
  Obtained from environmental sample
  misc_feature (1)..(882): n is a, c, g, or t
atgactattcatagagaaggagagattcattatcaagaattttcaaaaggaaaatatgaaaaacctcttgaagttataggaactacaaaaaaaactggtactactattgaatttcaacctgatgatagtatatttgaagttattgaatattcttttgaaatattatcaaaaagatttagagaagtagcatatttgaatccatttattactattaatttagaagataaaagatcaaataaaaaagaaacttatcattttgaaggtggaattaaacaatttgttgaagatactaataaatcaaaagcaattacagatgcaatctcttttagtgcaaaagaagatggtgttgaagtagatattgctttaatgtataatgatacttatgtaggaaatacaaaatcatttgttaataatattaatacaatggatggtggtacacacgaagctgggtttaaagatggacttacaagaagtataagaaaatatttaaaagagaatgcaaatgcaagagacaaagatgcaaaacttgatggaaatgatgtaagagaaggtttagtatctgttgtaagtgttagagttccagaaccacaatttgaaggacaaacaaaaggaaaactaggaagtagttatgtaaaacctatttgtcaaaaacttacttatgaagcattaaataaatattttgaagaaaatccagcacaagcaaaacttgtaatggaaaaatctttaatggcagctcgaggtagagaggcagctaaaaaaagcagagaactttacagaaaacagatacatgtctgtgggacactaccagtaaactgcaactgtcaaacaaagaccagaaatgcagaatattctagtggaagggatctgctggagatctgctaa

SEQ ID NO: 14110 - protein, 293 aa, Unknown
  Obtained from environmental sample
  DOMAIN (89)...(257): DNA gyrase B
  misc_feature (1)..(293): Xaa is any amino acid
MTIHREGEIHYQEFSKGKYEKPLEVIGTTKKTGTTIEFQPDDSIFEVIEYSFEILSKRFREVAYLNPFITINLEDKRSNKKETYHFEGGIKQFVEDTNKSKAITDAISFSAKEDGVEVDIALMYNDTYVGNTKSFVNNINTMDGGTHEAGFKDGLTRSIRKYLKENANARDKDAKLDGNDVREGLVSVVSVRVPEPQFEGQTKGKLGSSYVKPICQKLTYEALNKYFEENPAQAKLVMEKSLMAARGREAAKKSRELYRKQIHVCGTLPVNCNCQTKTRNAEYSSGRDLLEIC

SEQ ID NO: 14111 - DNA, 426 bp, Unknown
  Obtained from environmental sample
  misc_feature (1)..(426): n is a, c, g, or t
gtgttgttgctggagtcagcttatggatttggtatgagagatggtcaaggttgtagagatgattttccaaacgattacaaaagaggtatgctgtttaattcccacaaaagttctaatagtatgtatagtttgatgtcaactatttcagagttagatcttacaagagcacaaagagttgagataagaaaagttatgtttgatttaagagaaaaaaacattgaaacaatggaagataaaaaaactttgacactcatatttacaaaagatggtaagtttaacaaagaagattttataaacaatagagttcaattttctaagcagatgattaaagtacaagctagtatgattgagaaaatactcaatattttagatgaagagcaaaaaaagacagtagttagtaaattatctttacaaaaggataaataa

SEQ ID NO: 14112 - protein, 141 aa, Unknown
  Obtained from environmental sample
  misc_feature (1)..(141): Xaa is any amino acid
MLLLESAYGFGMRDGQGCRDDFPNDYKRGMLFNSHKSSNSMYSLMSTISELDLTRAQRVEIRKVMFDLREKNIETMEDKKTLTLIFTKDGKFNKEDFINNRVQFSKQMIKVQASMIEKILNILDEEQKKTVVSKLSLQKDK

SEQ ID NO: 14113 - DNA, 453 bp, Unknown
  Obtained from environmental sample
  misc_feature (1)..(453): n is a, c, g, or t
atgttaacaaaatataaatcaagtgcaattattttgcacttggttcaaggcttaatgattgtatttctattagtaactggaacattcgtattatcagaaataccaaatacaatagaaaaatttggttcatttaaaatacatatgatactgggattaatagttttagttttaactattattagaattataaatattattaaacatccaaagctagaaccattaaaagtaagttcatttagagaaaaattgattaagtttaatcatatatcaatatatatagtacttattttggttggattaagtggtatattattgtccaaagtttcagggcttggtgaaatgatattttttggcatggatggtgaaatatataatagttttaaagattataatatgggaatagcacatggtattcttaccaaggtattattatttttaattgcatgcatatag

SEQ ID NO: 14114 - protein, 150 aa, Unknown
  Obtained from environmental sample
  DOMAIN (2)...(148): Cytochrome b561 family
  misc_feature (1)..(150): Xaa is any amino acid
MLTKYKSSAIILHLVQGLMIVFLLVTGTFVLSEIPNTIEKFGSFKIHMILGLIVLVLTIIRIINIIKHPKLEPLKVSSFREKLIKFNHISIYIVLILVGLSGILLSKVSGLGEMIFFGMDGEIYNSFKDYNMGIAHGILTKVLLFLIACI

SEQ ID NO: 14115 - DNA, 864 bp, Unknown
  Obtained from environmental sample
  misc_feature (1)..(864): n is a, c, g, or t
ttgttggggattttaaaaaaaatggaaaatatgattnttattcctgggagtatttttagttttacttatctcttcaaattttttatatataagagtaaaaaaatctttaaatccattttctttaatgcaaataaaatacattattttagaagatggagatttactcctcttcaattagactctagctatgacgagataaaacagatgattagttcttataataaatcaataggaaaaataaaatatattttagaaactagagagatgttcaataaaatatttatgcatgagatgaaaatgccaattgcaaaagggatgttttatctaaaacaagagccttctaaatatacacatgataaattcaatatcttactaaatagattgaataatgaactagatgaattttcagtaattgagagtttaatcgtatatcaaaataatatagaactaatacctcataatacccataatattttaaccttagctattgaaaaagttggcatggaaaacaaaaataatatattaatagaaaattgtgataattttgaaatacaaggtgataaagagttatggatattatgttttaaaaatttaattgacaatgctttaaaatatgcagatgataaaaaattaattataaaatgctcaaagaatagtatctcatttattaatattggtgataaactaccagttgatttatcccaagatctaaagaattggaaaatagataaaaatcaaagacataaaagttctacgggatatggttttggattatttattataaaaaatattattgcattaaatggttatgctttagaatatagttatagtgatagtagtattgaattaaagattataagatga

SEQ ID NO: 14116 - protein, 287 aa, Unknown
  Obtained from environmental sample
  misc_feature (1)..(287): Xaa is any amino acid
MLGILKKMENMIXIPGSIFSFTYLFKFFIYKSKKIFKSIFFNANKIHYFRRWRFTPLQLDSSYDEIKQMISSYNKSIGKIKYILETREMFNKIFMHEMKMPIAKGMFYLKQEPSKYTHDKFNILLNRLNNELDEFSVIESLIVYQNNIELIPHNTHNILTLAIEKVGMENKNNILIENCDNFEIQGDKELWILCFKNLIDNALKYADDKKLIIKCSKNSISFINIGDKLPVDLSQDLKNWKIDKNQRHKSSTGYGFGLFIIKNIIALNGYALEYSYSDSSIELKIIR

SEQ ID NO: 14117 - DNA, 597 bp, Unknown
  Obtained from environmental sample
  misc_feature (1)..(597): n is a, c, g, or t
ttgttgggtggacctggtacttgtggcttgctagccattagaaaaagtttaattaatgaaaaagaatccccaacttttgcaggtgggggaacagttgcgtttgtttcaaaagatgaacatatctttaatagtgatatagagataagagaagatgcaggaacacctgctattttacaactcataaaagcctcttttgcatatcaattaagagatgagatagggataaaaagaattcaagaaagaaaagaagaactctttaaagtattaaaagatggattagccatgttaaaggggtacaccatctatggacaaaatgaaaatcacagaagtgttgggattttggctattaattttcatggtgttaccccgtatgaattatgtgaaaaattatcacaaaagtttggaatacaaacgagagcaggatgcagttgtgctggtccttatggtcacgacctatttggtattaataaaaaaaataaaacagatgaaaaaccaagctggttaagaataagtgtaaattacacacatagtatagaaagtattgaatacttactttttgcactgaaagaatcaataaaagaattaaaggaaaaataa

SEQ ID NO: 14118 - protein, 198 aa, Unknown
  Obtained from environmental sample
  misc_feature (1)..(198): Xaa is any amino acid
MLGGPGTCGLLAIRKSLINEKESPTFAGGGTVAFVSKDEHIFNSDIEIREDAGTPAILQLIKASFAYQLRDEIGIKRIQERKEELFKVLKDGLAMLKGYTIYGQNENHRSVGILAINFHGVTPYELCEKLSQKFGIQTRAGCSCAGPYGHDLFGINKKNKTDEKPSWLRISVNYTHSIESIEYLLFALKESIKELKEK

SEQ ID NO: 14119 - DNA, 444 bp, Unknown
  Obtained from environmental sample
  misc_feature (1)..(444): n is a, c, g, or t
atgggcgataagattgagaccaaagattctctcgatgtagaaaactccccgagcctaaagagctggggggaacgccccaaattacccaaaaacaatatcatcatagaatgtggctggggccgactactcttcgcacatacatttgcaaaaagcgaaacactagcaaaaacccttatagaagaagctaataataaaagagatttggccctttacgtgcgagagcctcaaatcgtcatatcccatgatccacaaaatcttttcgtctccccgtcctatattttccgcctgacgctagataattatcagccacttaagaaaaagaagtccggcttttccatccgcatgctcgacaccaaaactgatatagaaggcgtaaaccgaatctatcgctctcgtcatatggtagaaatcagccccggaattcctaaaaaaatcatacaataa

SEQ ID NO: 14120 - protein, 147 aa, Unknown
  Obtained from environmental sample
  misc_feature (1)..(147): Xaa is any amino acid
MGDKIETKDSLDVENSPSLKSWGERPKLPKNNIIIECGWGRLLFAHTFAKSETLAKTLIEEANNKRDLALYVREPQIVISHDPQNLFVSPSYIFRLTLDNYQPLKKKKSGFSIRMLDTKTDIEGVNRIYRSRHMVEISPGIPKKIIQ

SEQ ID NO: 14121 - DNA, 798 bp, Unknown
  Obtained from environmental sample
  misc_feature (1)..(798): n is a, c, g, or t
atggacaggcaaaggaccgtgcgcattcttaaaaacgcaggattgtctgtccctgatcagcatttagttttaagcttgcggaaaccaaacattcatggaaaacacaaaagcatcattgttaagcctaagaaacgcttgcacggctttggatcaaccgttgacgtcaaaaccaaagaagatctccaaaaagcgattaaagcctccaagaaaatccatccagacattcttttagaagaaatgatggagggtcaggaaatgcgtgtcatcatgatcaacttcaaggtagcggcggctggagtgcgaaagccccctatcatcgttggtaatggcgagcacacaattctacagcttgttaaaaaacaaagccgccgccgcgagcaagccacacaaggtgagaacactattcccgttgataaaatcctcaccgaaacagttcaaagcgcaggttatgagcttgatgacgtcctacccaaaggcaaagagctgcaagtgcgcaacaccacaaagcaacgttacggtggtaccttccacaatattacaaacgagatgcacccagaccttataaatgcagccaggcgcgccgcgatagcactcgatatccctgtagttgggctagattttattgtcaaagatccttcggaagccgaatacatcattattgaagcaatggagcgcccctatctggttggctatgaccagcaacccatagccgagcgtttcatcgacttcctcttccctcaaagtattgctagagaacctaataatattgaagaaaagaccgataaaaaggccaaataa

SEQ ID NO: 14122 - protein, 265 aa, Unknown
  Obtained from environmental sample
  misc_feature (1)..(265): Xaa is any amino acid
MDRQRTVRILKNAGLSVPDQHLVLSLRKPNIHGKHKSIIVKPKKRLHGFGSTVDVKTKEDLQKAIKASKKIHPDILLEEMMEGQEMRVIMINFKVAAAGVRKPPIIVGNGEHTILQLVKKQSRRREQATQGENTIPVDKILTETVQSAGYELDDVLPKGKELQVRNTTKQRYGGTFHNITNEMHPDLINAARRAAIALDIPVVGLDFIVKDPSEAEYIIIEAMERPYLVGYDQQPIAERFIDFLFPQSIAREPNNIEEKTDKKAK

SEQ ID NO: 14123 - DNA, 504 bp, Unknown
  Obtained from environmental sample
  misc_feature (1)..(504): n is a, c, g, or t
atgggattcccttctgacattgaaatagcacaaaatactaagctaaaacatattacagcaatttcttcttacttaaatataaatgaagatgatattgaaatgtatggaaaatataaagctaaacttcctttaagccttattcgtcaggaaaatattgataaaagcaatttaattttagttactgcccttacacccactcctgccggagaaggaaaaacaactacctctatcggtttaaccgaaggacttaataaaattggaaagaaaactaccgtagttttaagggaaccttctttaggtcctgtttttggaattaaaggtggagctgccggtggaggttatgctcaagtagttcctatggaagatattaacctgcattttacaggagatttttctgctatagaaaaagccaataaccttttatcagctttaatagataacaacattcaaaataaaaccaataatttaaatatagaccctagaaccattgttggaaaagagtaa

SEQ ID NO: 14124 - protein, 167 aa, Unknown
  Obtained from environmental sample
  misc_feature (1)..(167): Xaa is any amino acid
MGFPSDIEIAQNTKLKHITAISSYLNINEDDIEMYGKYKAKLPLSLIRQENIDKSNLILVTALTPTPAGEGKTTTSIGLTEGLNKIGKKTTVVLREPSLGPVFGIKGGAAGGGYAQVVPMEDINLHFTGDFSAIEKANNLLSALIDNNIQNKTNNLNIDPRTIVGKE

SEQ ID NO: 14125 - DNA, 456 bp, Unknown
  Obtained from environmental sample
  misc_feature (1)..(456): n is a, c, g, or t
ttggagtccgacagactcctaggaaatgaatataatacacataatgaagtttatggagcagtccaatatttaccgtatttttttaagaatactgttataacaactaattttgatagtgtattaaagagatgctatgacttgaaaggagagtctttttctgatgttttattaggtgcagatgcagatgaattgggaagattaatagctagtaatgaaaaaatactagtaaaacttcatgggaaagcaactagtggaaaaaatagaattttaacggaagatgagtataatgaacattactttgatacagatagtttaaaaaaagctattgatactatttgttctaattcattactttttttaggatgtagtttaagttcagatagaactataaaaactatggttganattgtaaaagaaaaaggacacgaaaaggtccaagacattatgcttttatag

SEQ ID NO: 14126 - protein, 151 aa, Unknown
  Obtained from environmental sample
  misc_feature (1)..(151): Xaa is any amino acid
MESDRLLGNEYNTHNEVYGAVQYLPYFFKNTVITTNFDSVLKRCYDLKGESFSDVLLGADADELGRLIASNEKILVKLHGKATSGKNRILTEDEYNEHYFDTDSLKKAIDTICSNSLLFLGCSLSSDRTIKTMVXIVKEKGHEKVQDIMLL

SEQ ID NO: 14127 - DNA, 510 bp, Unknown
  Obtained from environmental sample
  misc_feature (1)..(510): n is a, c, g, or t
ttgtctgccatttgcaacgtaactctacatccaggggcaaatatggttatctcagtaaaaaatgcaatatctggtattggtacaactgaaaaaattgcatcatcgctttacaaatgggttactggcaatcgtggtttcaaaagaacggtagcaatagaactaagagagaacattgaacttattcgcttgtacgtcgaaactggcgcagatccaaaagaattaatccccaaaataaatgacactgcattcagaaatgcactctctgaaggtttcaattttaattcgctaaaaaattcgaaaattgacataaaaagcacaaaagacatccctcaattacagaaatataataactgggaaacacagcgtgtctttgaaaacgtataccaaaaggtggcaacaattaagcatgctgtggcaataaaaaagagcaagaaacctgttcgcattggtgtaaggctgcaaaatatcttcaaactcatggttatgctggctatccacattggagactaa

SEQ ID NO: 14128 - protein, 169 aa, Unknown
  Obtained from environmental sample
  misc_feature (1)..(169): Xaa is any amino acid
MSAICNVTLHPGANMVISVKNAISGIGTTEKIASSLYKWVTGNRGFKRTVAIELRENIELIRLYVETGADPKELIPKINDTAFRNALSEGFNFNSLKNSKIDIKSTKDIPQLQKYNNWETQRVFENVYQKVATIKHAVAIKKSKKPVRIGVRLQNIFKLMVMLAIHIGD

SEQ ID NO: 14129 - DNA, 615 bp, Unknown
  Obtained from environmental sample
  misc_feature (1)..(615): n is a, c, g, or t
atgcttttagctaaatctttgcctaaagctactgttatagttagtgaagatagagtagaagccatcttaaaagtaaaagatcttggttgcaaattagtttttttagatgatggattttcaaaataccaaataaacaagtttgatatactgttacgacctaaaaaagaaccagaaaatatcttttgccttccaagtggtggatatagagagcctaaaatgatgtatgcaactgcaaatatggttttaaaagaaggtgttgattttaatagagttgtaaagtttaaaaaagatggaaaagttctagaaagcttaccttctaatatagtaatattaaccgcaatctcaaaggcaaaaagacttttagattttgttccaaagccctgcgaacttgtctcttttcctgaccattatagttttactaaattagatatagaggtagttgaaaaatcatataaagattttactattttaactacagcaaaagattttgtaaaattagaaaagttcaatattaaaagtcttgttttgatggacttggaaatagaatttaataaagatattgatttttcaaatttagaaaattaccttaaaatgtataaaataaaaaatgactaa

SEQ ID NO: 14130 - protein, 204 aa, Unknown
  Obtained from environmental sample
  DOMAIN (1)...(197): Tetraacyldisaccharide-1-P 4'-kinase
  misc_feature (1)..(204): Xaa is any amino acid
MLLAKSLPKATVIVSEDRVEAILKVKDLGCKLVFLDDGFSKYQINKFDILLRPKKEPENIFCLPSGGYREPKMMYATANMVLKEGVDFNRVVKFKKDGKVLESLPSNIVILTAISKAKRLLDFVPKPCELVSFPDHYSFTKLDIEVVEKSYKDFTILTTAKDFVKLEKFNIKSLVLMDLEIEFNKDIDFSNLENYLKMYKIKND

SEQ ID NO: 14131 - DNA, 318 bp, Unknown
  Obtained from environmental sample
  misc_feature (1)..(318): n is a, c, g, or t
atggcagtttttttagataatgtattaaaagcgatacataattcagttgtagaagcacaaaagatctcagagcaacagcatatgagagcattaggaaggtatttctatctcaacaaagataaagatactatggaaaaagagggtattagtattgaagatttgggaatgcctaaaaatgtggatataaaactcccttttgttgtagatagtaaggtaaattaccatgatgtagaaattccattaattgcacttaatcctccaagttcaatcaaaataaaaaatatgaaagtaagtttgaagctaaactcacaggtgtag

SEQ ID NO: 14132 - protein, 105 aa, Unknown
  Obtained from environmental sample
  misc_feature (1)..(105): Xaa is any amino acid
MAVFLDNVLKAIHNSVVEAQKISEQQHMRALGRYFYLNKDKDTMEKEGISIEDLGMPKNVDIKLPFVVDSKVNYHDVEIPLIALNPPSSIKIKNMKVSLKLNSQV

SEQ ID NO: 14133 - DNA, 489 bp, Unknown
  Obtained from environmental sample
  misc_feature (1)..(489): n is a, c, g, or t
gtgaataatttaataaaactaattctacttattactctttcttttagttctcttttatcaaatgataatgggaaatcaaaagagatctatctctcttatgaaaaatacccaaatagagtattcactggtcaaaaatttgatattcaattaagctctatcattttaaaagatcccacatcatacgataaaattataactacctttacaactgaagagagtattgatattttaactacagatgttgtatgggaagagattaaatcaaatagatatacaactactatttcatataaagtatacgacaaagagtttattttacccagaattacacttgcacttattaaaaatggtcaaattattgattatatatctgttgagtccccaaaaatagaatatgaaaaaatagcaataaatcaaaaaacttttttcaaatataattgcaaaaaatctacaagtgcacactgtaaaaacaaaacaatatacaaataa

SEQ ID NO: 14134 - protein, 162 aa, Unknown
  Obtained from environmental sample
  SIGNAL (1)...(20)
  misc_feature (1)..(162): Xaa is any amino acid
MNNLIKLILLITLSFSSLLSNDNGKSKEIYLSYEKYPNRVFTGQKFDIQLSSIILKDPTSYDKIITTFTTEESIDILTTDVVWEEIKSNRYTTTISYKVYDKEFILPRITLALIKNGQIIDYISVESPKIEYEKIAINQKTFFKYNCKKSTSAHCKNKTIYK

SEQ ID NO: 14135 - DNA, 1134 bp, Unknown
  Obtained from environmental sample
  misc_feature (1)..(1134): n is a, c, g, or t
ttgatggctcggatgtgtttatgttttaagtttgatgatgaactcaatcttatctataaaaatcttataagtgattctcaaaaggtgatattgttagaaaattctcaagtaattgcgacaaacagtaaaaactttgcctcattgggtagcacattgcaattaaaaaataaattatcatatcatctttataaaaaacatgtaggtatttgtgcaaaaacaaagggttatcaaggttacagtgggctgagttggagaagtgtggtttttcatccatttgtcttagatcaaaaaatagagaacactttagaagatagtgctcttagcggtgagcttttaactaaagatcttaaagagattgtagataaagctaactatatcgttgaagatttggcagatgttattataaacggagagttaattgctgcaaaacaaaaagcttatgtgctaactcctattttagataatttaagaattattagtgcaaatcttttaaatacaatcgaaaactcagtaataaatttagagagtgcaattaaagattctctgatttatgatgtaaaagcagcttctcatttagctatagatattatggataggaatctttatgagagagcaaatgattcaagatggtgggcacttacacctgcttttcaagaagagcttatcaaagaagaaccaaataagagtaagttaaatgagatacttgtttacattaatgatctttacactgtttatacaaatttgtttatctataacacaaaaggtgagattatagcttcatcaaaagatagatcaataatcggaacaaatgtcacttctgattatgttaagaaactctttcaaataagagtactcaaaactattttgtcagtcagtttgagcagacacctctgtatgatgatagagctacatacatatatagtgcaacaattaaaatcagaatcgacaagttggcggtattggtgttgttttgatggtgaagtggagttaaaactatgttgnatgatagttttccagagcagaaatggcttgcagttttacaaacagcaaggagtgtatctcatcccacatcaaataagagctctgaaaataattggatggaatttgaaaactgacccctctttagattattcg

SEQ ID NO: 14136 - protein, 378 aa, Unknown
  Obtained from environmental sample
  misc_feature (1)..(378): Xaa is any amino acid
MMARMCLCFKFDDELNLIYKNLISDSQKVILLENSQVIATNSKNFASLGSTLQLKNKLSYHLYKKHVGICAKTKGYQGYSGLSWRSVVFHPFVLDQKIENTLEDSALSGELLTKDLKEIVDKANYIVEDLADVIINGELIAAKQKAYVLTPILDNLRIISANLLNTIENSVINLESAIKDSLIYDVKAASHLAIDIMDRNLYERANDSRWWALTPAFQEELIKEEPNKSKLNEILVYINDLYTVYTNLFIYNTKGEIIASSKDRSIIGTNVTSDYVKKLFQIRVLKTILSVSLSRHLCMMIELHTYIVQQLKSESTSWRYWCCFDGEVELKLCXMIVFQSRNGLQFYKQQGVYLIPHQIRALKIIGWNLKTDPSLDYS

SEQ ID NO: 14137 - DNA, 810 bp, Unknown
  Obtained from environmental sample
  misc_feature (1)..(810): n is a, c, g, or t
gtgattccttacatagctcatgatgaagccatcaaattgcgaaaatatgaaggtaaaaaaatcaaaattgaaatcaagcaaaaagtagagaaacgaaaggcaaagaatatcgttgtagatattccaggcaaaggattcgacgaaaatttgaccatcgcctgtggacattacgatacagttgcacacagtgtcggtgcttctgataacagtggaggaactgttacacttcttaaaatactggaatatttctcaaagaatcaaccacagcgtgatctgcgaattgccttcttcagtggggaagagttggggcttcttggtagtcaggcttttgtgaaaaaacatctggaagagatcaaggacagggtgaaactggttgtgaatatcgatgtctccggagatacgatcggcagtgatcatttcaatgtgatcggtagcaaagagctactgggttacactgatggaattaccaaggaaatcggcatggtctttaaggctggtctggatatttttagcagtgacagcatgcccttcacaccttacgaagtcccatctgttaacgttttccgagctggtggaaaagctactaccatgattcatacaccagctgattccgtgaaaaatgtaggaccaaaaggttatgatacaaccatcaaagcttcaataaatcttctggatcgtattctgaatgcaaaagtttatcctgtgaaaaaagagatagataaaagtttgcgagaaaaaatcgagaaatacctatttaacatgagttacgaaaaacctgaactggaatggacaccgaaatacgaaaagtaa

SEQ ID NO: 14138 - protein, 269 aa, Unknown
  Obtained from environmental sample
  DOMAIN (51)...(117): Peptidase family M20/M25/M40
  misc_feature (1)..(269): Xaa is any amino acid
MIPYIAHDEAIKLRKYEGKKIKIEIKQKVEKRKAKNIVVDIPGKGFDENLTIACGHYDTVAHSVGASDNSGGTVTLLKILEYFSKNQPQRDLRIAFFSGEELGLLGSQAFVKKHLEEIKDRVKLVVNIDVSGDTIGSDHFNVIGSKELLGYTDGITKEIGMVFKAGLDIFSSDSMPFTPYEVPSVNVFRAGGKATTMIHTPADSVKNVGPKGYDTTIKASINLLDRILNAKVYPVKKEIDKSLREKIEKYLFNMSYEKPELEWTPKYEK

SEQ ID NO: 14139 - DNA, 972 bp, Unknown
  Obtained from environmental sample
  misc_feature (1)..(972): n is a, c, g, or t
atgacagatcggctgagtatgatatatagaggatttgatgaacgtattactgacagtgtaacagatactctaaatcgtaagaatatattagaacttttttcacatgagcttaaaaaaagagaaaattatacagttgcactgatatctattgataatataaacagtataaatgaagagtatggatttataaatggtgataatattttaaaagatgtatcaaattatatctctaaattttttcttgataagttgtataagagagttccaatagggcatataaaaggcggagattttttagttggatttgatacaaaaaaagatgatgttaaagctttaatagatatgttgaatttaaaattagattcaattgaagtaaattcaatagagatatatacatctagcagtgtggttgattcaaactattcaaatgatataaaccatattttaaatagattgtatgaattaaagaaaaatagacgtatagacagtgtaaaagatgaagagttaatcaatccaaatgagttagagacacttgttataaaagcgataaaaagtagaaatatctctatcaaatttcaaaaaattgaaaataacggtgaaaatatattagaagcatctgtaaaacttttagatgatagtggcaattacatacatcaaaaagagtttataggtgtaatcaatagattaggtatgagtaaagattttgatatggttatacttgagctattagtgaatatattaaatagatatggtgatataacgctatctatcaaattttctacaatatctattcgtcacaaagagttttatgataggttaatatctcttgtatctgataaaagtgatttatctaaaagattaattttttatattagtggaaaagattactacagagatataaaaagatttaattcacacctaaataattacagaagattgggcataaaaatagtacttgataattttgggtaa

SEQ ID NO: 14140 - protein, 323 aa, Unknown
  Obtained from environmental sample
  DOMAIN (13)...(162): GGDEF domain
  misc_feature (1)..(323): Xaa is any amino acid
MTDRLSMIYRGFDERITDSVTDTLNRKNILELFSHELKKRENYTVALISIDNINSINEEYGFINGDNILKDVSNYISKFFLDKLYKRVPIGHIKGGDFLVGFDTKKDDVKALIDMLNLKLDSIEVNSIEIYTSSSVVDSNYSNDINHILNRLYELKKNRRIDSVKDEELINPNELETLVIKAIKSRNISIKFQKIENNGENILEASVKLLDDSGNYIHQKEFIGVINRLGMSKDFDMVILELLVNILNRYGDITLSIKFSTISIRHKEFYDRLISLVSDKSDLSKRLIFYISGKDYYRDIKRFNSHLNNYRRLGIKIVLDNFG

SEQ ID NO: 14141 - DNA, 975 bp, Unknown
  Obtained from environmental sample
  misc_feature (1)..(975): n is a, c, g, or t
gtgaacattgtggggggtatgataaaccctgatgaatttttaatatttaaacctactttgaaaaataatgtttcaaccatactcaaaaaagagcttggaagtaaaaagcttaagatgatctactcgaaaaatggcggtagtgaaaatatcgagagtacaaaagaggagagagaaactttctcattaagtgatgaagatatttttacacttgcatccgccgcactaaagatagagacacactactctgagcttgcagatgaataccgtgccatggatatagagtgggcaaaagatggagagacgagtgaaatatttattttgcagtcacgaccagaaacaattcactcaaagaagagtactcaagaaaacaatattaaacaatataaactttcaactgaacaaaaaactcttatcaccaaaggtgtagccataggagataaaataggttctggaaaagtaagaatcatcaactctccatcagagtttcactttttttgtgatggtgaagtcttagtcgcagatattaccgatcctgattgggaacctatcatgaaacgcgcatctgcacttattacaaacagaggtggaagaacttgtcatgctgccatagtagcacgagaaataggagttcctgcagtagttggaacttcaaacgctatgcagattttaagtgatggaaaaagagttacggtaagttgtgcagagggcgaagagggatttgtctatgagggtgagttaaaatttgaaatagaagagataacatttgacacaacaaaaaagactaaaacaaaactgatgatgaatgtggcaaatccacaaaaagcatttacctttaacaaacttccaaatgacgnagtangcttggctcgcatggagtttatcatcactaactatattaaagcccaccctatgggcttagtaaatatgcataagagtttgaaagtaaaaaattctgatcagatcaaaaaatcatga

SEQ ID NO: 14142 - protein, 324 aa, Unknown
  Obtained from environmental sample
  DOMAIN (146)...(239): PEP-utilising enzyme, mobile domain
  misc_feature (1)..(324): Xaa is any amino acid
MNIVGGMINPDEFLIFKPTLKNNVSTILKKELGSKKLKMIYSKNGGSENIESTKEERETFSLSDEDIFTLASAALKIETHYSELADEYRAMDIEWAKDGETSEIFILQSRPETIHSKKSTQENNIKQYKLSTEQKTLITKGVAIGDKIGSGKVRIINSPSEFHFFCDGEVLVADITDPDWEPIMKRASALITNRGGRTCHAAIVAREIGVPAVVGTSNAMQILSDGKRVTVSCAEGEEGFVYEGELKFEIEEITFDTTKKTKTKLMMNVANPQKAFTFNKLPNDXVXLARMEFIITNYIKAHPMGLVNMHKSLKVKNSDQIKKS

SEQ ID NO: 14143 - DNA, 306 bp, Unknown
  Obtained from environmental sample
  misc_feature (1)..(306): n is a, c, g, or t
atgaatttactgtatatcattaccactctttgcctgattatttcctttattaaaagcagagagaaaacaaaaaaagcacttaaaaaagctttaaaaaaattcgaaaaaataatcccccttttcctgatcatgataataacaatatcggttgttctttattttctttcagacaaggtcctggtaaacattcttgacaacaacaatacagcactctctgtgataatggcttccattctcggctctgtatcatttatgcctggattcattacatatccgttgtgcgggatacttcttaataaggggtaa

SEQ ID NO: 14144 - protein, 101 aa, Unknown
  Obtained from environmental sample
  misc_feature (1)..(101): Xaa is any amino acid
MNLLYIITTLCLIISFIKSREKTKKALKKALKKFEKIIPLFLIMIITISVVLYFLSDKVLVNILDNNNTALSVIMASILGSVSFMPGFITYPLCGILLNKG

SEQ ID NO: 14145 - DNA, 507 bp, Unknown
  Obtained from environmental sample
  misc_feature (1)..(507): n is a, c, g, or t
atgattaccgatataaaagcaaataagccagcaccaattgcaattagtaaagaactaaaatcgtataaacacggaactgagcttgggcttacaatcgaacacttaatacaagggaaatcgataataatcaaggaattttataacgacggcatgtcccttcttcaggaaatacacaaatatctaaagctaaaactacctaataaatcttttaaggagcagcaagagtatcgctcagcatacgctaaactttcgaatcgagttttattagaagttgtcgatcaagaactatgtgcaaagaaatcccctggcattggttggttagaagtattttaccccgaaaacgatcatttccttttgactttcccgcaagtacaaggattgaatagcgcatggcaatggtacaaaaatgggatttcgataccggtattgcgtaacaaaatacatccatattacggaacatatttccctacccgttttgagcatttaaaacttttgatagttggctga

SEQ ID NO: 14146 - protein, 168 aa, Unknown
  Obtained from environmental sample
  misc_feature (1)..(168): Xaa is any amino acid
MITDIKANKPAPIAISKELKSYKHGTELGLTIEHLIQGKSIIIKEFYNDGMSLLQEIHKYLKLKLPNKSFKEQQEYRSAYAKLSNRVLLEVVDQELCAKKSPGIGWLEVFYPENDHFLLTFPQVQGLNSAWQWYKNGISIPVLRNKIHPYYGTYFPTRFEHLKLLIVG

SEQ ID NO: 14147 - DNA, 645 bp, Unknown
  Obtained from environmental sample
  misc_feature (1)..(645): n is a, c, g, or t
atgcatcctaaggtaagtataattattccatgttataatagtgaaagtacactagaagaaaccttacaatctgttttagatcaaagttatgataattgggaagctattatggtgaatgatggctcactagataatttagaagtgattgctttacaatgggtagaacaggataatagatttaagtactttaaaaaagaaaacggtggtttaggtagtgctagaaattttggtattggaaaagcatctggtacgtatattctacctttggattctgataataaggtcagacctggatttttgaaaagcgccattcatattatggataatcaaaaagatattgatgtcgttcatggtaatgctctgtattttggtgaaaaatctggaatatggcaagttgaatcttataattatgaaaaaattctaattaaaaattttattgatgcttgtgctgtttttagaaaaaaaatatgggaacaagttggaggctatgatattaaaatgccttatcaaggaaatgaagattgngaattttggattgctttaggtcagttaaatactaagttttgtcatattaatgacgttacctttgattatagggttacaaaagaatctatgattcatacattctcaaaagaaatgttttga

SEQ ID NO: 14148 - protein, 214 aa, Unknown
  Obtained from environmental sample
  DOMAIN (6)...(161): Glycosyl transferase
  misc_feature (1)..(214): Xaa is any amino acid
MHPKVSIIIPCYNSESTLEETLQSVLDQSYDNWEAIMVNDGSLDNLEVIALQWVEQDNRFKYFKKENGGLGSARNFGIGKASGTYILPLDSDNKVRPGFLKSAIHIMDNQKDIDVVHGNALYFGEKSGIWQVESYNYEKILIKNFIDACAVFRKKIWEQVGGYDIKMPYQGNEDXEFWIALGQLNTKFCHINDVTFDYRVTKESMIHTFSKEMF

SEQ ID NO: 14149 - DNA, 594 bp, Unknown
  Obtained from environmental sample
  misc_feature (1)..(594): n is a, c, g, or t
ttggttgatatttatttaaaaacaaggatgaaagatatgactcaatttgctaatgccatggtggttttcaagcttttgcctaagaccaattgtaaaaaatgtaatgaaacaacctgtttggcttttgcttcaaaggtgttcttagggcaaaaaaaaataaatcaatgtccgtttataggttctgatataatagataaatatcagaatcagcctcacaaagagactcttgtggagaaacagcaacaggcgataataaagaagatgaaacaaaagattgcagcctgcgacctgaaggatgttgccgatcggacagggggtatttatgccgatagaaaattgacactaaggattatgggaaaaccattttccattgatcacaacggagatttgttttcaaatattcatatcaatccatgggttgtttcaaatattctgagatatgttttaactttgcagggtgtaccattgacccaaaaatgggtgtctttcagagagcttgaaagaggccgggagcaaaatgaactgtttgttcaacgtcggaagtaccatttaagaaaattgcagacaggtatattgatttttttgaagaattga

SEQ ID NO: 14150 - protein, 197 aa, Unknown
  Obtained from environmental sample
  DOMAIN (25)...(59): Putative Fe-S cluster
  misc_feature (1)..(197): Xaa is any amino acid
MVDIYLKTRMKDMTQFANAMVVFKLLPKTNCKKCNETTCLAFASKVFLGQKKINQCPFIGSDIIDKYQNQPHKETLVEKQQQAIIKKMKQKIAACDLKDVADRTGGIYADRKLTLRIMGKPFSIDHNGDLFSNIHINPWVVSNILRYVLTLQGVPLTQKWVSFRELERGREQNELFVQRRKYHLRKLQTGILIFLKN

SEQ ID NO: 14151 - DNA, 669 bp, Unknown
  Obtained from environmental sample
  misc_feature (1)..(669): n is a, c, g, or t
atgcaaaaaaaaagcagtcatgctggtttgcttgaaatggcttctgcgataaataaatatcatcgaataagggggcactatccgaataaacttatagacctttaccctgaattcatccgggataatcctnttatttcacactttaaatggaaatactccacagaaaacaaaagttatctgttgcaaaagaatgtggagggtaaacaaagcttctcctcaatagggcctaacctgaaattaaaaacaggaacccataaaaatcggattgtttctactaacgcccctcaaaataaacaacttttaaaaaaaacagacattcctaaacacccaaaaataaaacctgatatcaacaaaaacgtgacactcgatgaattgaaaagggtggtatcatcaaaaaaagtaaaaccggttcaagatctgagaataaataagaagaagaaaaaagcttccaagccaaaacaatccttgagcaattttaaaaaagagttgggtaaagatgaaaaattcctgctttcatttgatgataatcgtttctacatttggaaaggcaaagatggctttatcggatttagtgacactcaatatccggatgaaaaagaattttctatataccgggacaaaggttggtttgcttacactgattaccagaattccagtattatagattag

SEQ ID NO: 14152 - protein, 222 aa, Unknown
  Obtained from environmental sample
  misc_feature (1)..(222): Xaa is any amino acid
MQKKSSHAGLLEMASAINKYHRIRGHYPNKLIDLYPEFIRDNPXISHFKWKYSTENKSYLLQKNVEGKQSFSSIGPNLKLKTGTHKNRIVSTNAPQNKQLLKKTDIPKHPKIKPDINKNVTLDELKRVVSSKKVKPVQDLRINKKKKKASKPKQSLSNFKKELGKDEKFLLSFDDNRFYIWKGKDGFIGFSDTQYPDEKEFSIYRDKGWFAYTDYQNSSIID

SEQ ID NO: 14153 - DNA, 681 bp, Unknown
  Obtained from environmental sample
  misc_feature (1)..(681): n is a, c, g, or t
atgtcatatcaaagaaaattaaaagggttatatatcatcactgatgataaatcaacaccatcaaataatgttttagaaaaagtagaattagcattacaaggaggggcttcaattgtacaacttagagataaaattagtagtgatacagttttagaacaaattgtcttaagaattcaaaaattgtgtaaagagtatgaggcactttttgtactcaacgacaaaatagaactagcaataaaacttcaatgcgatggacttcatattggaaaatctgaccataaaaatcttgaaaatatacgaaaaaggtttcatggtattattggtgtttcttgttatggtgatatcttattggcaaaatattgtgaactaatgggggctgattatgtagcatttggttcattttataattctcctactaaacctgattcaaatattgtacccctaaaagtacttcaagaggcaaaagaaaaaattactatccctatatgtgcaataggtggtataaatactcaaaatttagatgaagtaatgagttataaaccggatatggtaagtgtgataagtgatatatggaatagtgataatattacagaaacaatcaaaagatatacagactactttttaaaaggaaaatcccatgacaatataaaaatagcactaggagtggtttttaaatcctga

SEQ ID NO: 14154 - protein, 226 aa, Unknown
  Obtained from environmental sample
  DOMAIN (7)...(204): Thiamine monophosphate synthase/TENI
  misc_feature (1)..(226): Xaa is any amino acid
MSYQRKLKGLYIITDDKSTPSNNVLEKVELALQGGASIVQLRDKISSDTVLEQIVLRIQKLCKEYEALFVLNDKIELAIKLQCDGLHIGKSDHKNLENIRKRFHGIIGVSCYGDILLAKYCELMGADYVAFGSFYNSPTKPDSNIVPLKVLQEAKEKITIPICAIGGINTQNLDEVMSYKPDMVSVISDIWNSDNITETIKRYTDYFLKGKSHDNIKIALGVVFKS

SEQ ID NO: 14155 - DNA, 501 bp, Unknown
  Obtained from environmental sample
  misc_feature (1)..(501): n is a, c, g, or t
atgaactcaaagatacaaattaaattagcaccgaattccggtttttgttttggtgtgaaacgtgctatttcattggcacaggaagcagcagagagtggtaaacacatagttacactgggacctattatccataatcctcaggctgtacagaggcttagagaaaaaggtgtgaatgatatcagcagtatctcagaagttgttgatgaaactgttatcattcgttctcatggagtagaaaaaggtgtcttggatttgctgaaagagaaagacatcgagataattgatgcaacatgtccttttgtggcaaaagcgcaggaactggcaaggttcttgagccaggaaggatatcctgtagttatcatgggaaatgaagatcatcctgaagtgaaagcaatttgcagtaatatatcaggcaagtattttgtgcttgataaagaactggttttgccagaacgatattacccaaaattaggtttgatatcccagacgactaagagttga

SEQ ID NO: 14156 - protein, 166 aa, Unknown
  Obtained from environmental sample
  DOMAIN (7)...(165): LytB protein
  misc_feature (1)..(166): Xaa is any amino acid
MNSKIQIKLAPNSGFCFGVKRAISLAQEAAESGKHIVTLGPIIHNPQAVQRLREKGVNDISSISEVVDETVIIRSHGVEKGVLDLLKEKDIEIIDATCPFVAKAQELARFLSQEGYPVVIMGNEDHPEVKAICSNISGKYFVLDKELVLPERYYPKLGLISQTTKS

SEQ ID NO: 14157 - DNA, 381 bp, Unknown
  Obtained from environmental sample
  misc_feature (1)..(381): n is a, c, g, or t
atggcaaaaatctttgggaaagtaaaagcaatcccagtcagacgcggtagaatagacaggcgtgctttgaaagaagtggaaaaaggacgggaattaggtgaaagtatagttatttttcctgaaggcacgcgcaaatcagcgaaagtaaaagcaggaaccggtaagtttgctttggaaatgaaaaaggacatcttaccgatatttattgaaaactcagatgatatcaaaggatgcatttttggaaaaaagataatacgtatcactgtaggtgaatatatcaaagcagaaagttttcaggatatggaacacactaaagaaaattatcagatattagctaacgatgtaatgaagaagatcaatgaactcaaagatacaaattaa

SEQ ID NO: 14158 - protein, 126 aa, Unknown
  Obtained from environmental sample
  misc_feature (1)..(126): Xaa is any amino acid
MAKIFGKVKAIPVRRGRIDRRALKEVEKGRELGESIVIFPEGTRKSAKVKAGTGKFALEMKKDILPIFIENSDDIKGCIFGKKIIRITVGEYIKAESFQDMEHTKENYQILANDVMKKINELKDTN

SEQ ID NO: 14159 - DNA, 414 bp, Unknown
  Obtained from environmental sample
  misc_feature (1)..(414): n is a, c, g, or t
gtgaaaaagaagtttactttctttcgagagaaaattaaggagtcgattgaaattacaaatgatccaaaagagcaaattaaaaactttgttttaacaagattgaacgcttataaaagacttgttaatttcaataatacaatgaaagataatatttttttgcatntggattttgttgaacaaatgaggagtaattaccaagtgtacgaaatagaacttgttaaaaagattcttaaagagggtgttaaatctggtgagtttgtaattgaagataaagaaattgcatctcttggtattgtaacagcattaaaagggttccaagttcagtttttggaggcttctttgcataacgaagatactgaagctaaactcgacaacttattgggtattctattttatggtataataaagagatag

SEQ ID NO: 14160 - protein, 137 aa, Unknown
  Obtained from environmental sample
  misc_feature (1)..(137): Xaa is any amino acid
MKKKFTFFREKIKESIEITNDPKEQIKNFVLTRLNAYKRLVNFNNTMKDNIFLHXDFVEQMRSNYQVYEIELVKKILKEGVKSGEFVIEDKEIASLGIVTALKGFQVQFLEASLHNEDTEAKLDNLLGILFYGIIKR

SEQ ID NO: 14161 - DNA, 543 bp, Unknown
  Obtained from environmental sample
  misc_feature (1)..(543): n is a, c, g, or t
atgagtggagttaaaactgttggggatgtgactcttcttataaacaacaaaaaagacatctcaacacagggtgatgttctttttacaaactatggggtttcaggttttgctatcttagacatttcacaaagagcaagtgtagctttgatggagtatgcaaaagtagatatctctataaacctacttccatcttttaacgctcaaaaactatcaactcacataagcaacttggcgaaggctatacctaacttctcagttcttgatgttttaactggattagttcctctaaaaatagcacagggactacttcaaagtttagagattccactaattactagcgctaaagaaattcacacaaaactaagcaaaaagatagctaatcagatgctaaattggcgttttgaagttacagatactcatggttttcgtcatgctgaagtaagtggtggaggagtagatacaacggagattaatcccaaaacaatgggatctttaaaaccaaaaaacctttacttttgtggaaaagtttctagatgtttttag

SEQ ID NO: 14162 - protein, 180 aa, Unknown
  Obtained from environmental sample
  DOMAIN (2)...(174): HI0933-like protein
  misc_feature (1)..(180): Xaa is any amino acid
MSGVKTVGDVTLLINNKKDISTQGDVLFTNYGVSGFAILDISQRASVALMEYAKVDISINLLPSFNAQKLSTHISNLAKAIPNFSVLDVLTGLVPLKIAQGLLQSLEIPLITSAKEIHTKLSKKIANQMLNWRFEVTDTHGFRHAEVSGGGVDTTEINPKTMGSLKPKNLYFCGKVSRCF

SEQ ID NO: 14163 - DNA, 306 bp, Unknown
  Obtained from environmental sample
  misc_feature (1)..(306): n is a, c, g, or t
atgaaatggcaaatcatatattacaattcaaaactcgaaaaagaaactttgaatttaccagacggcctattggcaaggtacttaggactcactgacttattactcgagtttggctcaaaccttggtttgccgcatacaaaacccatgggaaaaggtctttttgaattacgggtaaagagcacggaaggaatagcgagagtttttttctgcacaaaagttggcaaaaaaatcatcatgcttcactcttttattaaaaagtctcaaaaaaccccaaaagagaactcaaaattgcccaaaacagaatga

SEQ ID NO: 14164 - protein, 101 aa, Unknown
  Obtained from environmental sample
  misc_feature (1)..(101): Xaa is any amino acid
MKWQIIYYNSKLEKETLNLPDGLLARYLGLTDLLLEFGSNLGLPHTKPMGKGLFELRVKSTEGIARVFFCTKVGKKIIMLHSFIKKSQKTPKENSKLPKTE

SEQ ID NO: 14165 - DNA, 468 bp, Unknown
  Obtained from environmental sample
  misc_feature (1)..(468): n is a, c, g, or t
gtgtctgtaatttacaataaattaaatcactactggctgtggaaagaggtctctgcaaagttaaatgtctctaatccggcatatcagtactggaaaaatacaaataatattaagctaaataataaatacgtatttgtacaaaagaacacacttcctgaaaaatacagttatattgaaccacatcttagtgatctatctggttttttacctgtaggttatgcatcagatagactccatataaatgcacatgtatttagttatgaaaagatgaaactctataatagttttgagtataaatatattgaaaatataaaatttgtgaatataaaacgtttttttaaagagtatgggattaatgtaaaaaaagatagtttatatcatcttggtaaaatctcacaactagagattacaccagactgcacattccataaaattgtagacgattatggaattgtagtatacgattaa

SEQ ID NO: 14166 - protein, 155 aa, Unknown
  Obtained from environmental sample
  misc_feature (1)..(155): Xaa is any amino acid
MSVIYNKLNHYWLWKEVSAKLNVSNPAYQYWKNTNNIKLNNKYVFVQKNTLPEKYSYIEPHLSDLSGFLPVGYASDRLHINAHVFSYEKMKLYNSFEYKYIENIKFVNIKRFFKEYGINVKKDSLYHLGKISQLEITPDCTFHKIVDDYGIVVYD

SEQ ID NO: 14167 - DNA, 669 bp, Unknown
  Obtained from environmental sample
  misc_feature (1)..(669): n is a, c, g, or t
atgttttgggataaatatctcagtaaaaataaacctgatgcaataatcggtgatcttgaaagaattcctgctcaaacctgccaggttgtagcaaaaaaattcaatattccttactatatttataatttttcgttacccctatcagaccgtttttatttaagaattcctgatcaggagtattatcttcctaggctacaaaaatattggaaagaaaataaagataagaaattgtccttgaaacaatatgaaagagcaaaatcttatcttgataatgaaagaaaaaagaaaattggtcattcggtaataaaaaacaaacctataatcaatcttcaaaaaataaaatttttattttgggctatctatgtagtatactttgtagaaaaaaacaaaaacccatatatgaatgtaattagaggaataaaaaattatttcaagagaggatataggtatatggttgcaaaacatctttataaaaaacctaagtttaatgaaaaaataatattttttcctttacatacaactagtgatgctgcaatacttcttggagctcctcattttaagaatcaagagtttttaatagagtcgatatcaaattcattaccagcaaattatacactttatgtaaaagaacatcctttgttgcctggggatttgaatatacttcattaa

SEQ ID NO: 14168 - protein, 222 aa, Unknown
  Obtained from environmental sample
  misc_feature (1)..(222): Xaa is any amino acid
MFWDKYLSKNKPDAIIGDLERIPAQTCQVVAKKFNIPYYIYNFSLPLSDRFYLRIPDQEYYLPRLQKYWKENKDKKLSLKQYERAKSYLDNERKKKIGHSVIKNKPIINLQKIKFLFWAIYVVYFVEKNKNPYMNVIRGIKNYFKRGYRYMVAKHLYKKPKFNEKIIFFPLHTTSDAAILLGAPHFKNQEFLIESISNSLPANYTLYVKEHPLLPGDLNILH

SEQ ID NO: 14169 - DNA, 792 bp, Unknown
  Obtained from environmental sample
  misc_feature (1)..(792): n is a, c, g, or t
atggctgagatctttcggtatagttttaaagagagcaatctatccaattataaacccagctttagagcccccttttatccctggattcaaatagtcagcgtcattctcttttcagttttcatatatgatatgggctcacaggcagttgaaataagcctcggttttatcgttgtctgctcagctctttatcttttttacggcagaaaatacaacaccggagaatacgctcttttgcatttacttaaaaatattgctgataaaagactgacagaaaatattcttgaggatgaactaagagagattgttatacaccgagatgaaattgaacaagataattttgacagacttattcaaaaggctgatattctggatcttgaagggccaatggattatgaacgcctcatttcaattgcagggcctaaaatagctcgctgtattgaagttgatgaggacaaagttatcaaaagatttttgcaaaagcagaaggagtttaatacagcaataacacaattccttgcaattccacatataatagttaatgataatgatgagatgtttctttttgttgtaagatgcaaacatggtataaaatttactgattcccatgatcatgtcaaggctgttttcctttttggaggaagtatggccaaaagagaacttcattttaaaaccctagcttcaatagcttctctggttgaacaaaaggagtttgaaaaaaaatggattgcatcagaaaatacaactgaacttaaaaacttcatgctctacagtgagcgaaacaggatacattaa

SEQ ID NO: 14170 - protein, 263 aa, Unknown
  Obtained from environmental sample
  misc_feature (1)..(263): Xaa is any amino acid
MAEIFRYSFKESNLSNYKPSFRAPFYPWIQIVSVILFSVFIYDMGSQAVEISLGFIVVCSALYLFYGRKYNTGEYALLHLLKNIADKRLTENILEDELREIVIHRDEIEQDNFDRLIQKADILDLEGPMDYERLISIAGPKIARCIEVDEDKVIKRFLQKQKEFNTAITQFLAIPHIIVNDNDEMFLFVVRCKHGIKFTDSHDHVKAVFLFGGSMAKRELHFKTLASIASLVEQKEFEKKWIASENTTELKNFMLYSERNRIH

SEQ ID NO: 14171 - DNA, 486 bp, Unknown
  Obtained from environmental sample
  misc_feature (1)..(486): n is a, c, g, or t
atgcctcttaacatgaaaaatacctttatcagtcgtccttccaactctgcattgtcctatgcaaccggaacattcaagggtgaatatgtcccaacatggaaatttacagaaattactgctggatgcggagcactgaaatccactgcacgagatatgatcaaatatttagcctttcagataaacgggcctgatgcaaaaagggccagcctttatcttgcagctcaaaaaagtcatgtatgtactgatattcaggtaggaccgaatatttttatgtgcctgggatggcatattttaaaaataaaaaagatacaaaacagcaaacctgggattgaaaaaattgtctggcacaatggacaaacctacggtttcagaagttttgcgggatttgtaaaaaaggataagatgggtgttgttattctgtgcaattcaggtagtgttgatattaacagcttagggtttagcatactttgcgaaaaaatcagataa

SEQ ID NO: 14172 - protein, 161 aa, Unknown
  Obtained from environmental sample
  misc_feature (1)..(161): Xaa is any amino acid
MPLNMKNTFISRPSNSALSYATGTFKGEYVPTWKFTEITAGCGALKSTARDMIKYLAFQINGPDAKRASLYLAAQKSHVCTDIQVGPNIFMCLGWHILKIKKIQNSKPGIEKIVWHNGQTYGFRSFAGFVKKDKMGVVILCNSGSVDINSLGFSILCEKIR

SEQ ID NO: 14173 - DNA, 534 bp, Unknown
  Obtained from environmental sample
  misc_feature (1)..(534): n is a, c, g, or t
atgaatataaaaattggagaaaacgagaaaaagaatgtatcaatccccctgcttctcccttacactcttaatccgggaaaacaggaaattgagtttaaacttgatttttcagacagcaacagggcttttcctgaaaatgctgttgtttctgttattctcaaaaaatcatttacagattttataaaggatataaatatagtttttaaatctttattcattattatgataattgcagttctcgcaggattttttttcatattttttagttcctttgttcatgtctctgtccgtgattcatataaagtaataaagaaagactttgaggttatggtcagtgataaatcgctcagaccgcttgcatttaaggttttaggacagaatgacgtcaggataggaagcagaaatatacataattttaatgctaaatctgtaaaaactattggtggtggaaaatcatcatatcttatatttctttataaaagttccatcccatatagcagaaatctatctcagcgaangaaaatattatcttaa

SEQ ID NO: 14174 - protein, 177 aa, Unknown
  Obtained from environmental sample
  misc_feature (1)..(177): Xaa is any amino acid
MNIKIGENEKKNVSIPLLLPYTLNPGKQEIEFKLDFSDSNRAFPENAVVSVILKKSFTDFIKDINIVFKSLFIIMIIAVLAGFFFIFFSSFVHVSVRDSYKVIKKDFEVMVSDKSLRPLAFKVLGQNDVRIGSRNIHNFNAKSVKTIGGGKSSYLIFLYKSSIPYSRNLSQRXKILS

SEQ ID NO: 14175 - DNA, 534 bp, Unknown
  Obtained from environmental sample
  misc_feature (1)..(534): n is a, c, g, or t
atgctatccaagagaaggagatggctaaagcttatgcatagtgttgtcgttgttgcattaagctcacctctgattataggagtttatgaaaatgaagctcttattgaagagataaagagtgatgggaaatcttcagaacttttgccgtcactttttagagaacttttacaaaagtatgatattgaaaatttaatatatgcaaaaggtcctggaagttttatggccataaaagtaagctatatatttttaaaaactttatcgattgtaaaaaaaataaattttttagcaacagatgctttctattttaatgataattcacctataaaagcgattggtaagttatgttttgtaaaaaataaagatacaatatcaacagaagtttttaaagagattccatattgcgaattttctttaccaaaaaaactattcttaaaagattttaatatagacacatcgccgcaatatattataggtgcagtgttaaggggaaaatataagtgctcattaatgtaccagccaccagtgcaaatttag

SEQ ID NO: 14176 - protein, 177 aa, Unknown
  Obtained from environmental sample
  DOMAIN (33)...(108): Glycoprotease family
  misc_feature (1)..(177): Xaa is any amino acid
MLSKRRRWLKLMHSVVVVALSSPLIIGVYENEALIEEIKSDGKSSELLPSLFRELLQKYDIENLIYAKGPGSFMAIKVSYIFLKTLSIVKKINFLATDAFYFNDNSPIKAIGKLCFVKNKDTISTEVFKEIPYCEFSLPKKLFLKDFNIDTSPQYIIGAVLRGKYKCSLMYQPPVQI

SEQ ID NO: 14177 - DNA, 1083 bp, Unknown
  Obtained from environmental sample
  misc_feature (1)..(1083): n is a, c, g, or t
gtgatggaagcagccacccaggagtacgggactatcatgcgttattccgataccatcggaatagatttcatctatgtcgccaagcaaatctcttatcgggacaagcctgtcattttgcgtctgtcggtctctcttgacaaggtgatgaaggatttttatgacctttggtaccgtcttgccattgtctttaccgcttttgtcatcatcggtttgcttatcgctttgaagatcagcaaaaagatccgtcatgaccttttgcagatcacggaatatctgcgtgaagtctctgacaagaattacaaggcgatcgtcaaacctgagtacttttcagagtttctctacattgcacttacgcttaaaaacctggcaaaaaagctcaacaaccgggacaaacaaaaacgcaaatacaccgcgcgtctgaggcttatcaacaaacagaggaatgatgtcctctcagctatctcacatgagtttaaaaatcccatcgcctccatacaagggtatgccgagacgcttctggatgatcctaacgccgatacgaaaatacgtcagcggtttttagagaagatcatgcaaaacggcaaaaagatctccactatgcttgaccgcatagctctgtcggtaaaacttgagaacaatgatctcaagaccaagccaagcaccttcgaccttgccgaacttgtccaggacgtcatcatgaacctcagcaagaagtacaaagacagggagatctccttctcaggagaggcctataccatcacagcggacaagaccatgatcgagaccgtcatcatcaacctcatcgacaatgcgatgaaatactcgcaagaagacgtcaccgtttctatcatggacaacaagcttatggtgatcgataagggaaatggtatcgcagagaaagaactcaacaagatcgcttctagttttatcgcgtacaaaaaaacacatggaacaactcgatgggttctgggtcttgccatccggacatacgtcttaagactgcatgattcaaacctgcctataaaccgcaaaaagggggagggctccacctcccctttgaccctagacccattcagaaatagt

SEQ ID NO: 14178 - protein, 361 aa, Unknown
  Obtained from environmental sample
  DOMAIN (255)...(358): Histidine kinase-, DNA gyrase B-, and HSP90-like ATPase
  misc_feature (1)..(361): Xaa is any amino acid
MMEAATQEYGTIMRYSDTIGIDFIYVAKQISYRDKPVILRLSVSLDKVMKDFYDLWYRLAIVFTAFVIIGLLIALKISKKIRHDLLQITEYLREVSDKNYKAIVKPEYFSEFLYIALTLKNLAKKLNNRDKQKRKYTARLRLINKQRNDVLSAISHEFKNPIASIQGYAETLLDDPNADTKIRQRFLEKIMQNGKKISTMLDRIALSVKLENNDLKTKPSTFDLAELVQDVIMNLSKKYKDREISFSGEAYTITADKTMIETVIINLIDNAMKYSQEDVTVSIMDNKLMVIDKGNGIAEKELNKIASSFIAYKKTHGTTRWVLGLAIRTYVLRLHDSNLPINRKKGEGSTSPLTLDPFRNS

SEQ ID NO: 14179 - DNA, 615 bp, Unknown
  Obtained from environmental sample
  misc_feature (1)..(615): n is a, c, g, or t
atgccttttttgatgcccatcatgctctttgaccgtttcaacgggggagatattatcatgagcacccatactatcgaggagcttgcgaacagctcggaaaagatagacgcctatttgaaaatgggttctatcaactatacaatacttgaagattttatccgcttgtatcacatcgatgaagaacggatcaactatatcgacagagatcagatagatatctcgaccttgaaaaactcncaaaccaagaagcatgtccttatcgtcacttacgttccctataacaatgcattgaaaagaaacggcttcaaagagattctctctacaaaaaaaggcctggaccttctggtcatcgatgctctctatacgacaaaagaaaatttttacaaacacaagcaacagtacatacaggtaaagacctttgtcgatgatgccctcatagtactctcaaaagaccccaaagagttttacacaaccataaaaccctacatggaagatttgagctatgaggagttcctcgcctccttagatgacatcgtctggataaataccaccatagatgaagatctgagagagcgcatgcgggcagcatcatttccgaccaaagaccttctatga

SEQ ID NO: 14180 - protein, 204 aa, Unknown
  Obtained from environmental sample
  misc_feature (1)..(204): Xaa is any amino acid
MPFLMPIMLFDRFNGGDIIMSTHTIEELANSSEKIDAYLKMGSINYTILEDFIRLYHIDEERINYIDRDQIDISTLKNSQTKKHVLIVTYVPYNNALKRNGFKEILSTKKGLDLLVIDALYTTKENFYKHKQQYIQVKTFVDDALIVLSKDPKEFYTTIKPYMEDLSYEEFLASLDDIVWINTTIDEDLRERMRAASFPTKDLL

SEQ ID NO: 14181 - DNA, 360 bp, Unknown
  Obtained from environmental sample
  misc_feature (1)..(360): n is a, c, g, or t
ttggatataattggaggtgtagaaatgaatcttaataaacttttacaaacacaagaggaaatcggcaaaattgaagaaaacacattgaaagttaaaaataatttaaaaattttaattagaacacctaaggaatttaaagatgtgcagaattatgcagattttttaattcatggtgactcaattttcatttcgttttcagatgttgaaatagaagtaaaacaaagaatatttgactacttaaatggtgttagttatattattgacgcgactgtggaaaaagtaagtgaagatatgactctctatatacctaatacagctaatgtaagtaaagaaaacaaaaaacgtttatggcttaaataa

SEQ ID NO: 14182 - protein, 119 aa, Unknown
  Obtained from environmental sample
  DOMAIN (33)...(111): Protein of unknown function (DUF552)
  misc_feature (1)..(119): Xaa is any amino acid
MDIIGGVEMNLNKLLQTQEEIGKIEENTLKVKNNLKILIRTPKEFKDVQNYADFLIHGDSIFISFSDVEIEVKQRIFDYLNGVSYIIDATVEKVSEDMTLYIPNTANVSKENKKRLWLK

SEQ ID NO: 14183 - DNA, 891 bp, Unknown
  Obtained from environmental sample
  misc_feature (1)..(891): n is a, c, g, or t
atgagatcttatcttaggaaaagagatactaatataatttatagaatatatatcaacatccctaatttatataaaaataaaatagaaaatatttttgaaaatgtagatgacttaataatgaaaaatagttatcaggatgctgtagactttgcattaaatatattatctgtaaacttaatgaaaaaaagatgggaatatagttatgaaaattttagttttaatattaaatatttatcagaaaatatcctttatgttaaatattttggtagtgctaattatgatgaaaccgctttttatgttgaaaaattattaaaaatcattaaaaacagaaaaagattagtaattattcaagatgttaaagagttaaatcataatacttttaaatcaagaactcttcttattaaaacttttggaaatgattctagaattataggttcaatatatattggaacatctgaattacaaaaatttaaattaaaaacagcaagtttatatccaaaaactcctcctcttggaattactgattcatatgaagatgcaatagataaagctaataaattattagaaaaaaaatataaagataataaaaaagatgagaaaatattaaaaaataaagatagtaaaatattaaattatctattttatcaaaaaaataaaaaatttgtaaaaaaaataaataaatatcttgtcttcatagattggcataatattatagaaaaagagaaaaaagaggaaaaagagataaattggagtaataatccttttaatattttatttagttcattttcagtaatgatatcagatataaaagagcttattcaaagttttaatactaaacaaaaagaactactacatactcaaaatgagttaaagaagataaaaaattattag

SEQ ID NO: 14184 - protein, 296 aa, Unknown
  Obtained from environmental sample
  misc_feature (1)..(296): Xaa is any amino acid
MRSYLRKRDTNIIYRIYINIPNLYKNKIENIFENVDDLIMKNSYQDAVDFALNILSVNLMKKRWEYSYENFSFNIKYLSENILYVKYFGSANYDETAFYVEKLLKIIKNRKRLVIIQDVKELNHNTFKSRTLLIKTFGNDSRIIGSIYIGTSELQKFKLKTASLYPKTPPLGITDSYEDAIDKANKLLEKKYKDNKKDEKILKNKDSKILNYLFYQKNKKFVKKINKYLVFIDWHNIIEKEKKEEKEINWSNNPFNILFSSFSVMISDIKELIQSFNTKQKELLHTQNELKKIKNY

SEQ ID NO: 14185 - DNA, 678 bp, Unknown
  Obtained from environmental sample
  misc_feature (1)..(678): n is a, c, g, or t
gtggtggggtttatgaatatattagaggcttgtcgttattttggtgtaaaaaacttatcttatgcttcatcatcttcagtatatggattaaataaatcacaaccttttaaaacaacagatattacagatacaccagcaagtttatatgctgccacaaaaaaatcaaatgaattaatggctcatacctattctcatctttataatattgcaactacaggattacgattttttacagtttatggtccatggggaagacccgatatggcacctatgctttttagtgatgcaattttaaataatagggctataaaagtatttaatcaaggagagatgagtcgtgattttacatatatagatgatataataagtggaatagtgaaagtaatagataatccaccattgaagctatgtacaccttttaagatttataatattggaaataattcacctgtaaaattgctagattttataaaaactcttgaaaaatatttaggtaaagatactcaaaaagaatttttacctatgcaagatggagatgttgtttcaacatacgcggatgtaacagaacttattgatgattttaattataaacctagtacatctttaagtgttggaattaaaaaatttgtgaaatggtataaagacttctatggtcagaaaggaaatagtatacaatga

SEQ ID NO: 14186 - protein, 225 aa, Unknown
  Obtained from environmental sample
  DOMAIN (1)...(217): NAD dependent epimerase/dehydratase family
  misc_feature (1)..(225): Xaa is any amino acid
MVGFMNILEACRYFGVKNLSYASSSSVYGLNKSQPFKTTDITDTPASLYAATKKSNELMAHTYSHLYNIATTGLRFFTVYGPWGRPDMAPMLFSDAILNNRAIKVFNQGEMSRDFTYIDDIISGIVKVIDNPPLKLCTPFKIYNIGNNSPVKLLDFIKTLEKYLGKDTQKEFLPMQDGDVVSTYADVTELIDDFNYKPSTSLSVGIKKFVKWYKDFYGQKGNSIQ

SEQ ID NO: 14187 - DNA, 762 bp, Unknown
  Obtained from environmental sample
  misc_feature (1)..(762): n is a, c, g, or t
atgcagatgggagattgtaatttgttaaataaaataaatattgaagatattaaaaatatagcactagaagctggtattgaaataatgaaaatttataaaaaagattttcaagtagaatataaagatgataaatcaccactaacagaagcagataaggtttcaaataaaattatttgtagtagtttacaaaaactttatccaaatataccagttcttagtgaagagaataaagaggtattatataaggatagaaaagattgggagtattattggtgtatagatccaattgatggaacgaaagagtttattaaaaaaaatgatgagtttacaataaatatagcgttaatacataatgagacaccaatattgggagttgtatatgcacctgcaattgatgatatgtatagtgcaaaaaaaggtgaaggggcttttttaaataatcaaaaattacctttaaaagtaaatgataatccagaagataaactttttgttgtagcaagtaaatcacacttatctgttgaaacacaagagtttatagataattttgattcaaaagagattgaacaagtttcaaaaggaagttcattaaaactatgtatggttgctgagggaagtgcggatatatatccaagacttgctccaacaatggagtgggatacagcagcggcagatactattgttcgtgaatctggaaagatgacctatcaatatcattcaaaatttaatattgaaaatttaacattagaaaagcctatcatttaa

SEQ ID NO: 14188 - protein, 253 aa, Unknown
  Obtained from environmental sample
  DOMAIN (13)...(253): Inositol monophosphatase family
  misc_feature (1)..(253): Xaa is any amino acid
MQMGDCNLLNKINIEDIKNIALEAGIEIMKIYKKDFQVEYKDDKSPLTEADKVSNKIICSSLQKLYPNIPVLSEENKEVLYKDRKDWEYYWCIDPIDGTKEFIKKNDEFTINIALIHNETPILGVVYAPAIDDMYSAKKGEGAFLNNQKLPLKVNDNPEDKLFVVASKSHLSVETQEFIDNFDSKEIEQVSKGSSLKLCMVAEGSADIYPRLAPTMEWDTAAADTIVRESGKMTYQYHSKFNIENLTLEKPII

SEQ ID NO: 14189 - DNA, 759 bp, Unknown
  Obtained from environmental sample
  misc_feature (1)..(759): n is a, c, g, or t
atggttcaaaaaggagaggctgtgggtgttattgctgctcagtcaattggagagcctggtactcagcttactttacgtacattccaccaaggaggtactgcatcaaatattgctgcaacatctaaaattgaagttcaatttgatggtgttcttgaaattgaagagttacgtagtgtagaatataagaatactgatggtaagaagtaccaaatcgtaattggtcgttctgctgaaatgaaattacttgatcctgaaacaggagtaatccttgcttcaggtaatataccatatgctgctaatctttatgtgaagaatggtgctaaggttaaaaaaggagatgttatttccgattgggatccttacaatgctgttattctttgtgaagtatcaggtagtattgcattcgaaaatattattgaaggtattagttacagagttgagtctgatgagcaaactggttattttgaaaaagtaatagttgactcaaggattaaaaatcaaaatcctgtaattaagatccttgctaaagatggtacagttacaagttcatatgacatacctgttggatcacatattcttgttgaagaaggtaagaatattaaatctggagacatcctcgttaaaattcctcgtgcctttggtaagtctggtgatatcaccggtggtttgccacgtgtaactgagttgtttgaggcacgtaatccttcaaaacctgcagtttgtagtgagattgatggtgttgtaagcttcggaacctaa

SEQ ID NO: 14190 - protein, 252 aa, Unknown
  Obtained from environmental sample
  misc_feature (1)..(252): Xaa is any amino acid
MVQKGEAVGVIAAQSIGEPGTQLTLRTFHQGGTASNIAATSKIEVQFDGVLEIEELRSVEYKNTDGKKYQIVIGRSAEMKLLDPETGVILASGNIPYAANLYVKNGAKVKKGDVISDWDPYNAVILCEVSGSIAFENIIEGISYRVESDEQTGYFEKVIVDSRIKNQNPVIKILAKDGTVTSSYDIPVGSHILVEEGKNIKSGDILVKIPRAFGKSGDITGGLPRVTELFEARNPSKPAVCSEIDGVVSFGT

SEQ ID NO: 14191 - DNA, 846 bp, Unknown
  Obtained from environmental sample
  misc_feature (1)..(846): n is a, c, g, or t
gtgacaggtaaaaatgcagagatcttactatccaaacaaatacgtgaaatatatgaaaaaataagggctgaactacacaagggaaatgagtgggccggtgagtttcagaataagaaaaaaaacggggaattatattgggtatctgccactatttcccaggtgaaaggcatcaagggtgaaacctcaaatttcgttgttgtgatggaagacattacagaacggaaacactccgaacaaatacaaaatgtgctattcaatatttccaatgccgttgtcacaacaagggatactgacgagttaataaaaaatatccgaaaacaacttgggagattatttgatgttagcaatttttattttgcactgtacgattcagaatcagatcatatcaatatcccctatttttctaatgagaaagatagtatagattttcctgccggtaaaacacttatagcacatgtaatccggaccaaaaccccttttcttggcaaacgaaatgacatcgataaattggtgcaatcaggactaattagttcgacaggagaaaaggcaaaagtttggatgggcataccaattattggcagggatggagtattaggtgttttagctatgcaaagctatgcaaacgaaaatgcatattgtgaaaaggatcttcaacttatggaatttatctcacatcagatgagtatttccctggaaaggataaaacatgagatggacctgaagaaagcattgaagaaagcacaggagtcggatcgaataaaatctgcatttctgaataatatgtcacatgaattgcgcactccactcaatgcagtgatcgggttttcaagtctaatcaatccctga

SEQ ID NO: 14192 - protein, 281 aa, Unknown
  Obtained from environmental sample
  DOMAIN (32)...(74): PAC motif
  misc_feature (1)..(281): Xaa is any amino acid
MTGKNAEILLSKQIREIYEKIRAELHKGNEWAGEFQNKKKNGELYWVSATISQVKGIKGETSNFVVVMEDITERKHSEQIQNVLFNISNAVVTTRDTDELIKNIRKQLGRLFDVSNFYFALYDSESDHINIPYFSNEKDSIDFPAGKTLIAHVIRTKTPFLGKRNDIDKLVQSGLISSTGEKAKVWMGIPIIGRDGVLGVLAMQSYANENAYCEKDLQLMEFISHQMSISLERIKHEMDLKKALKKAQESDRIKSAFLNNMSHELRTPLNAVIGFSSLINP

SEQ ID NO: 14193 - DNA, 882 bp, Unknown
  Obtained from environmental sample
  misc_feature (1)..(882): n is a, c, g, or t
atgctgttccaggaactttctaattatgttcgtccgaataaatacggcaaagattctgtcgacttttcaagtccagtagctgtcaggttactaaataaagctttattaagtcattactacgacgtgaaatactggggctttcccgatgagaatttatgtccacccatacctggaagagctgattatattcattacatggcagatttgatatcagaaaataattttgggaatattcccccaggagataaaatcacttgtcttgatattggtgttggggcgagttgtatttatcctataattggagttacagagtatgattggaacttcatagggtctgacattgatccaaaatcaattgaatcagcaaagaagattatagccgagaatccaacgcttcaaggcaagattaatttaaaattacaggaaagtaaaaaggattttttctacgggatagttgataaggaagagaaagtggatttgtccatctgtaaccctccctttcattcttcactggaagatgctcaaaaaggaacgcgaagaaaggttaaaaacctcacaggtgtaaactcaaaaaaaccacagcaaaattttgcaggaatcagcagtgaattaatctatgaaggaggcgaacataaatttattcacgagatgattaaagagagtagaaaattctctaaaaattgtttttggttctccactctagtgtctaaaaagtcaaatcttaaaggaatctataaagccttagaaaaaatagaggcgcttcaagtcaaaaccatacctatgggaacaggtaacaagtcgagtcatgctgtagcttggacctttctttctaaacctgaacagaaagaatggcaagaaacaaaatggcngagccgattctga

SEQ ID NO: 14194 - protein, 293 aa, Unknown
  Obtained from environmental sample
  DOMAIN (5)...(277): Protein of unknown function (DUF890)
  misc_feature (1)..(293): Xaa is any amino acid
MLFQELSNYVRPNKYGKDSVDFSSPVAVRLLNKALLSHYYDVKYWGFPDENLCPPIPGRADYIHYMADLISENNFGNIPPGDKITCLDIGVGASCIYPIIGVTEYDWNFIGSDIDPKSIESAKKIIAENPTLQGKINLKLQESKKDFFYGIVDKEEKVDLSICNPPFHSSLEDAQKGTRRKVKNLTGVNSKKPQQNFAGISSELIYEGGEHKFIHEMIKESRKFSKNCFWFSTLVSKKSNLKGIYKALEKIEALQVKTIPMGTGNKSSHAVAWTFLSKPEQKEWQETKWXSRF

SEQ ID NO: 14195 - DNA, 351 bp, Unknown
  Obtained from environmental sample
  misc_feature (1)..(351): n is a, c, g, or t
ttgccagaaaatcaaaagattgcattaattaaccaattaacaaatccttggatgattaatttcataagacttcaccctgcaatctatttggagaaaataagttgtcctattcttgcaattaatggcagtaaagatgtacaagttccctcaaaggaaaatttagaaataattgaaaagatttttaagaaatctgaaaataccaatgtgggaataaaagaacttgaaagcttaaatcacttatttcaagaatgtgaaacaggtgctattagtgaatatgcaacaatagaacaaacaatctcaccgattgtattagaagaaatcacaaattggatattgaaacagattaagtaa

SEQ ID NO: 14196 - protein, 116 aa, Unknown
  Obtained from environmental sample
  misc_feature (1)..(116): Xaa is any amino acid
MPENQKIALINQLTNPWMINFIRLHPAIYLEKISCPILAINGSKDVQVPSKENLEIIEKIFKKSENTNVGIKELESLNHLFQECETGAISEYATIEQTISPIVLEEITNWILKQIK

SEQ ID NO: 14197 - DNA, 588 bp, Unknown
  Obtained from environmental sample
  misc_feature (1)..(588): n is a, c, g, or t
gtgaaaaaaataacactaattctatttgcaatttttacagcattgtcaatgtccggtcaaagtattgcatgtcaatggaatggagtattaaaggttcaaggaatacaattaagaatagttttcaatataacccaaacagataaaggttatagttcaacaatggacagccctgaccaaggatcaaaaggaatccctgtaacttctacaagctatgaaaactcaattttaaaacttgaaatatcaaatgcaggtattcaatacgaaggaactttggataaggagaatgcttttgttggaacttttaaacaaggtgggcaatcttttccattggttttaactaagacaaaagttgaaaaagaaaaagttatcagaccacaagaaccaaccaaaccctatccgtactattcagaagtagttaaatttaaaaatacaaaagataaaattgtattagcaggaactttaaccttacctaaacaaaatggtaagtttccggctgttattttaataagtggaagtggtccacaaaacagagatgaagaattattagaccataaatccttttcttgttttagcggaatacttaactaa

SEQ ID NO: 14198 - protein, 195 aa, Unknown
  Obtained from environmental sample
  SIGNAL (1)...(18)
  misc_feature (1)..(195): Xaa is any amino acid
MKKITLILFAIFTALSMSGQSIACQWNGVLKVQGIQLRIVFNITQTDKGYSSTMDSPDQGSKGIPVTSTSYENSILKLEISNAGIQYEGTLDKENAFVGTFKQGGQSFPLVLTKTKVEKEKVIRPQEPTKPYPYYSEVVKFKNTKDKIVLAGTLTLPKQNGKFPAVILISGSGPQNRDEELLDHKSFSCFSGILN

SEQ ID NO: 14199 - DNA, 417 bp, Unknown
  Obtained from environmental sample
  misc_feature (1)..(417): n is a, c, g, or t
ttgcaacttatgtgcaatgccagagaagtaaaaatcaacgactttaacgaaaggaacatcttcgatctgccgctcaaacaatttgccagcacctactccacaggtatgaagaaaaaattagccttgttggccattctacttcaaaacaatgatatatatattttggatgaaccctttaatggtatagatattcaaagcaacattctgataatggagattatttctcaacttaaagagctgggaaaaatcgtaattctttcttcacatattttttctaccctcaatgaatcctgcgatttgcttcatcatttaaaagcaggaaaaatatatcatagcgtctcaaaaaatgaattcaacaccattgaagctgaaataaaaagcgacacactacataagcagatcagcaaacttcagtaa

SEQ ID NO: 14200 - protein, 138 aa, Unknown
  Obtained from environmental sample
  DOMAIN (1)...(107): ABC transporter
  misc_feature (1)..(138): Xaa is any amino acid
MQLMCNAREVKINDFNERNIFDLPLKQFASTYSTGMKKKLALLAILLQNNDIYILDEPFNGIDIQSNILIMEIISQLKELGKIVILSSHIFSTLNESCDLLHHLKAGKIYHSVSKNEFNTIEAEIKSDTLHKQISKLQ

SEQ ID NO: 14201 - DNA, 477 bp, Unknown
  Obtained from environmental sample
  misc_feature (1)..(477): n is a, c, g, or t
ttgacattgggttttaaaagtgttagaaatatgaataaaaaaatgaaatatatatttattttttttattatctcttatgttatggtaaatgcaaatacacaaatagataaggcggtaaatagtcaaatattatttgaaaaacaaaaagaacaatatcaaaagatagaggaaaatagcaataaaaagatacttttttatgatacaaaaaaaccacaaattattgataaaacaggggaagaatgtattaaaataaaagaaataaaagaagatactattacattactctctctagaagaaaaaaataaaatttttcaagtttatgaaggaacttgtcgaacactcactgaacttaataatttaacaaaagaattaacaactttatatattgataaaggatatgttacttcgcaggtatattttgagcctcaaaatatggataaaggtattctaaaaattattnaatggagggaaaaataa

SEQ ID NO: 14202 - protein, 158 aa, Unknown
  Obtained from environmental sample
  misc_feature (1)..(158): Xaa is any amino acid
MTLGFKSVRNMNKKMKYIFIFFIISYVMVNANTQIDKAVNSQILFEKQKEQYQKIEENSNKKILFYDTKKPQIIDKTGEECIKIKEIKEDTITLLSLEEKNKIFQVYEGTCRTLTELNNLTKELTTLYIDKGYVTSQVYFEPQNMDKGILKIIXWREK

SEQ ID NO: 14203 - DNA, 324 bp, Unknown
  Obtained from environmental sample
  misc_feature (1)..(324): n is a, c, g, or t
ttgaatgctcattattttcactcttgtgcattaaaaatagcaaatttatacaatgacttaagaattgtaaaagaaataaatgatgaaaaagaaaaagaaaatagagtaaatcaaatatctgagcaatataaggaagttttaggttcgtatgaaaaccatgattcactagatactgaaatgtttaaatctaaaaatttagattactatgagttatcaatatggtttaaagtattaattaatataaaatactacttcttaataaaatttaaatatcattttataatgacttttcctcctattttatttatgtttttaattaaatag

SEQ ID NO: 14204 - protein, 107 aa, Unknown
  Obtained from environmental sample
  misc_feature (1)..(107): Xaa is any amino acid
MNAHYFHSCALKIANLYNDLRIVKEINDEKEKENRVNQISEQYKEVLGSYENHDSLDTEMFKSKNLDYYELSIWFKVLINIKYYFLIKFKYHFIMTFPPILFMFLIK

SEQ ID NO: 14205 - DNA, 909 bp, Unknown
  Obtained from environmental sample
  misc_feature (1)..(909): n is a, c, g, or t
ttgtatccagatttctcaaagagagtaaccgtgaaacctcttccgggattcgacggagaacttctgcaggaagatgatattaaaaaaatccaggataagtttgtcatttcagcaaagatagctcatgatgcaggtgctgatggtatcgacttcaaagtctgccatggataccttggttctcagctaaccagaccctacaatgataggaagtggaaatacggcggttccttcgaaaacaggacaagattcgcttatgaatgttatgaacgaattatgaaagagatcaatgatcctgattttatcgtgggttcaaaagtctcaatctgggaaggatttcccggcggacaaggaagtgcagggtcggactctcctataatggatatttctgaatctctcgaactctgtaagggacttgaggctcgcggtgctaagtttattctggtatctgcgggatccccctcaatcacactggctctttcacaacccgacagaagtatcccaagagatgtgtatacgcactttaccttccaaaaagcagtaaatgatgttgttaaacccgaaacagctgtaattggatcagcctactctgttctgaacaatgggaacaacaagctggtaacaagaaagaaagaagaaaatacgcttgtctattggggaaaccgtaatgtacgtgagggtgtttgtgatgtaatcgctattggtcgtcagtctttagcagacagtcatatccccagaaaacttattgaaggcagagaagatgagattaaatggtgcacatcctgtgacaactgcattgaattcctcatccgccagcagaatgtcggctgtgcaacccgtgacaaagagtatactctggctttaaaagctatttcggattctgaaggcgctttgaaacaaaaaaggacctaa

SEQ ID NO: 14206 - protein, 302 aa, Unknown
  Obtained from environmental sample
  DOMAIN (2)...(254): NADH:flavin oxidoreductase / NADH oxidase family
  misc_feature (1)..(302): Xaa is any amino acid
MYPDFSKRVTVKPLPGFDGELLQEDDIKKIQDKFVISAKIAHDAGADGIDFKVCHGYLGSQLTRPYNDRKWKYGGSFENRTRFAYECYERIMKEINDPDFIVGSKVSIWEGFPGGQGSAGSDSPIMDISESLELCKGLEARGAKFILVSAGSPSITLALSQPDRSIPRDVYTHFTFQKAVNDVVKPETAVIGSAYSVLNNGNNKLVTRKKEENTLVYWGNRNVREGVCDVIAIGRQSLADSHIPRKLIEGREDEIKWCTSCDNCIEFLIRQQNVGCATRDKEYTLALKAISDSEGALKQKRT

SEQ ID NO: 14207 - DNA, 558 bp, Unknown
  Obtained from environmental sample
  misc_feature (1)..(558): n is a, c, g, or t
ttgacagcaccttttgataaagcaaatatccaagaaattgttaaaaaagcgaattcatcggtaggatctttctattctcttttcaaatccaaaaacaacctgttagaatgtttacttgatcgctaccaggattggttaattgagatagttcaagaatacaataaagaagatcttccaaaggatatggcaagtcgtgcttcacttttcatcaaagaatacattagagttaatcaacaagaaagcggaatgttacgagcacgttatatttacaatgttacaaaattggaatcaattcctgagaatagattacaaaagaatcaacagtatctacaagagatagaatgtatatttgaaccatgtatgcacgaaataaaccaccccaatcctaagaaagctcttacttttatcctaaccttacttgatatctttattgaagaaaaaataatctttggagaagttactaataaaaacacagctgcactaagtcatcaagaattgcacgaagagtgcttacgtctttttttaagctatttagaagtcaattatgataaggagtaa

SEQ ID NO: 14208 - protein, 185 aa, Unknown
  Obtained from environmental sample
  misc_feature (1)..(185): Xaa is any amino acid
MTAPFDKANIQEIVKKANSSVGSFYSLFKSKNNLLECLLDRYQDWLIEIVQEYNKEDLPKDMASRASLFIKEYIRVNQQESGMLRARYIYNVTKLESIPENRLQKNQQYLQEIECIFEPCMHEINHPNPKKALTFILTLLDIFIEEKIIFGEVTNKNTAALSHQELHEECLRLFLSYLEVNYDKE

SEQ ID NO: 14209 - DNA, 843 bp, Unknown
  Obtained from environmental sample
  misc_feature (1)..(843): n is a, c, g, or t
ttgagtgtgaaagtagacggtgtagattcatatatagacaccctatcaaattctataaaaggtcttggtgaaaaatggctagaattcatgatagtacacaatgatggcgtaccaactagttatgttactaagttacacgatcctagcaagaactatgataaggatcctgatatactaaaacactattcatataaagttgataatttaaagcctgaggaaacagatgcaatagtaaaatctttgaatcaaaataaaaatttgaatgctaaagaagataatactggagtagagtttagagtactattatctgaatctgactatccattactattccaaggagctatggttaacgatactgatacagaatatagctatgccaatttaattactgctgcgcgaaattacaatgcttctggcatggaaacacctcgagaacttataatacaagaaaaacaagcaaatggattaccagctaaatctcatagcatagatatgtctatatatgaaggtgcaaataacattgaagacgcactaaaacatttgaatgaacaacttgataaaaattggaatgaaaattatccaccaactgaaaatttacgatattcaggattaaaaaatcactatactgccatatccacagatgaagatgggattattataaaagtagaagaaccaaaaaacttttctattagaaaaagagaaagagagctgataatatctggaaactttgaaatgccacaagaaaaaggatctatagcaatagcaaaactttacaagcaaagtcctatacaaggtgtcctagaactcgtaggtgaaaaagaatcttttggaagtacacaatga

SEQ ID NO: 14210 - protein, 280 aa, Unknown
  Obtained from environmental sample
  misc_feature (1)..(280): Xaa is any amino acid
MSVKVDGVDSYIDTLSNSIKGLGEKWLEFMIVHNDGVPTSYVTKLHDPSKNYDKDPDILKHYSYKVDNLKPEETDAIVKSLNQNKNLNAKEDNTGVEFRVLLSESDYPLLFQGAMVNDTDTEYSYANLITAARNYNASGMETPRELIIQEKQANGLPAKSHSIDMSIYEGANNIEDALKHLNEQLDKNWNENYPPTENLRYSGLKNHYTAISTDEDGIIIKVEEPKNFSIRKRERELIISGNFEMPQEKGSIAIAKLYKQSPIQGVLELVGEKESFGSTQ

SEQ ID NO: 14211 - DNA, 759 bp, Unknown
  Obtained from environmental sample
  misc_feature (1)..(759): n is a, c, g, or t
ttgtcgtcgcttaatatttcaaaaagagaaaaagagtatctgccttgtggaaatgagaagataaaaggctcaatcttatttaatagaaatgcccactttgatcctcaaaaagtaatgcttcaaacaaaagaatttttacaaaaagagggtgtagagtttatattaaatgaaaaaatctcagatataaaatttgaaaacagaaaagtaaaatcagtaagttctgcaactaatacctacaaagcagaaaacttcgtactctctactgggtatcaaacactcttggctgatattagaaagaaaagtttactgatgactcctgcaaagggttatagtataactttttctatgccccaagaactcaaaccaaaaacatcaacactatttagtgatttgtttatagttatgactcctagacgccatagtgtaagacttacatcaaaattagaactaggctcaacaaatccaagtatagtaaaagcacaaattgaaagtattaaatcaaattttgagaaatacacagttccctttgagatgaaagagataaaagagtggacaggctttagaccactcactccaaatgatatgccacttcttggtcgagatgaagagtacaaaaacctagtatatgctatgggattaggttggcttggtatgacatttgctccaagtgttggaaaaatagtaagaaaaatgattacaaaagatttagataacaaagatagcgatgatattttattattctcaggtttgtatcaataa

SEQ ID NO: 14212 - protein, 252 aa, Unknown
  Obtained from environmental sample
  misc_feature (1)..(252): Xaa is any amino acid
MSSLNISKREKEYLPCGNEKIKGSILFNRNAHFDPQKVMLQTKEFLQKEGVEFILNEKISDIKFENRKVKSVSSATNTYKAENFVLSTGYQTLLADIRKKSLLMTPAKGYSITFSMPQELKPKTSTLFSDLFIVMTPRRHSVRLTSKLELGSTNPSIVKAQIESIKSNFEKYTVPFEMKEIKEWTGFRPLTPNDMPLLGRDEEYKNLVYAMGLGWLGMTFAPSVGKIVRKMITKDLDNKDSDDILLFSGLYQ

SEQ ID NO: 14213 - DNA, 921 bp, Unknown
  Obtained from environmental sample
  misc_feature (1)..(921): n is a, c, g, or t
gtgggcttacacataataaaggtatgtgtgggaactgcatgccatgtaaaaggagccatgttagtttacgatgcctttaagcgacaccttaaactgaaaaccaatcagaacaccgatgaagaaggcatctttaccctcgaaaaagtagcctgcctgggttgttgcaccattgccccggttgttcagattgacgacattacctacggccatgttagcaccgaaaaagttcccgagattattgatgatttttttaatgaaggaaaaaaagggtcgcagcgggcagcaaaaaagtccaatcaaaacctacccattcaaggggaaattcgcattgggcttggatcatgttgcattgccagtgggagttcagatgtaaaagatgagctagaaaaaaccatcagtcaatctgggattcatgtagatgtaaaacacgtgggatgtgtgggcatttgcaaccaggtacccttaatggaaatccataaacccgatgaaacacctaccttttacgccaaaataaaacctgaagaggtcagagatgttgtaaacaaacacttcaaagcagcaagtcctttacaaaggatgaaaaataaaatgttttcgatgcttgaaaacgtggtgcttaatgaagttccccgcacagtaaaccgctacgatctggacgaggaaaatactccggtttctgattttttagcgggtcaggtaaacattgccaccgaacaccgtggacaccttaaaccttcagaccttgaagagtaccgcaagttaggcggtttttcggcggtagaaaaatgcctaacagaatattcgcaagaagaagtgatccaaattatcataaaatcaagtttacgcggaaccgggtggtgcagggttttcaaccgggtcaaaaaatggcaattgggttcccaatgtttgaaggcaaaataa

SEQ ID NO: 14214 - protein, 306 aa, Unknown
  Obtained from environmental sample
  DOMAIN (1)...(84): Respiratory-chain NADH dehydrogenase 24 Kd subunit
  misc_feature (1)..(306): Xaa is any amino acid
MGLHIIKVCVGTACHVKGAMLVYDAFKRHLKLKTNQNTDEEGIFTLEKVACLGCCTIAPVVQIDDITYGHVSTEKVPEIIDDFFNEGKKGSQRAAKKSNQNLPIQGEIRIGLGSCCIASGSSDVKDELEKTISQSGIHVDVKHVGCVGICNQVPLMEIHKPDETPTFYAKIKPEEVRDVVNKHFKAASPLQRMKNKMFSMLENVVLNEVPRTVNRYDLDEENTPVSDFLAGQVNIATEHRGHLKPSDLEEYRKLGGFSAVEKCLTEYSQEEVIQIIIKSSLRGTGWCRVFNRVKKWQLGSQCLKAK

SEQ ID NO: 14215 - DNA, 1035 bp, Unknown
  Obtained from environmental sample
  misc_feature (1)..(1035): n is a, c, g, or t
atgccggaatgtgatggagtcgatttgaaccgtggcatgttgaagttatatagtttaatattactacttgtattgccacttgtcttaagtgctcaaaatagtttcgaatttgaccttatccaaaaaggtaaactagacaaaaatactcttcttgttgtcggtggcatccaaggtgatgaacctggtggatttgtgtcagcatctttgctcgcaactcattatgaaataacaaaaggttctatctggatagttccaaacctaaacttttatagcatcatcaaaagaagcagaggtccatatggtgacatgaacagaaagttcgcgaagctttctaagaaagatcctgaatatggagctgttgagagaatcaagagctatattaaagatgaaaatgtaaaacttgtagttaatctgcatgatggtagcggtttttacagagaaaagtatgaagatagtatgcactcacctaacagatggggacagtgctctattgtagatcaaacaaatatagatgttcctctgtatggaaatctaaaagatatttcatctgaagttgtaaagcacgtaaataaacatcttatcaaaaacgaagatgtttaccatgttcacaacactaaaacgaaagagggtgataaagagatggaaaaatctcttacatactttgctatcaacgaaggaaaagcagcttttggtaatgaagctagtaaaaatcttccgacacataaaagagtttactatcatcttctagctttagaaaaatatatggatatcatgggcatagagtttaaaagaaagtttactctaaaccccagtggtgtttataaagctataaataacgatattagcatctctttatatgatggcaaaattaaacttccctcttctcaaattagagatatagtaaagtactttcctattaagaaagatggtgtgctggattttaaagcaagtaatccactttctactattatcaaaaaaaaacaacacttatattattccgtatgccaaccgaagactttccagactaaaagctga

SEQ ID NO: 14216 - protein, 344 aa, Unknown
  Obtained from environmental sample
  DOMAIN (16)...(256): Zinc carboxypeptidase
  misc_feature (1)..(344): Xaa is any amino acid
MPECDGVDLNRGMLKLYSLILLLVLPLVLSAQNSFEFDLIQKGKLDKNTLLVVGGIQGDEPGGFVSASLLATHYEITKGSIWIVPNLNFYSIIKRSRGPYGDMNRKFAKLSKKDPEYGAVERIKSYIKDENVKLVVNLHDGSGFYREKYEDSMHSPNRWGQCSIVDQTNIDVPLYGNLKDISSEVVKHVNKHLIKNEDVYHVHNTKTKEGDKEMEKSLTYFAINEGKAAFGNEASKNLPTHKRVYYHLLALEKYMDIMGIEFKRKFTLNPSGVYKAINNDISISLYDGKIKLPSSQIRDIVKYFPIKKDGVLDFKASNPLSTIIKKKQHLYYSVCQPKTFQTKS

SEQ ID NO: 14217 - DNA, 402 bp, Unknown
  Obtained from environmental sample
  misc_feature (1)..(402): n is a, c, g, or t
gtgctggattttaaagcaagtaatccacttcttactattatcaaaaaaaacaacacttatattattcagtatggcaacagaagactttcaagactaaaagctgattatctagactatgatgctgacgcccaaagtgtaaaacttcaagtagatggaaaacttcaagatgttaagtttggctctcttgtaaatgtaaaagataactttttagtccaagagaataagtatcgtgtaaatgtaataggatatgcaaataaaagcaaaaaagagacaggtataaaaatacaaaatgtacaaataccaaaacgcttttctcttgataaaaaaggaactatttacagagtagaatactacaatgataaaaagtttgccggtatggtattggttaaatttagaacttaa

SEQ ID NO: 14218 - protein, 133 aa, Unknown
  Obtained from environmental sample
  misc_feature (1)..(133): Xaa is any amino acid
MLDFKASNPLLTIIKKNNTYIIQYGNRRLSRLKADYLDYDADAQSVKLQVDGKLQDVKFGSLVNVKDNFLVQENKYRVNVIGYANKSKKETGIKIQNVQIPKRFSLDKKGTIYRVEYYNDKKFAGMVLVKFRT

SEQ ID NO: 14219 - DNA, 366 bp, Unknown
  Obtained from environmental sample
  misc_feature (1)..(366): n is a, c, g, or t
atgatgaatttatacagtgaggaaatcatgaagtggagctataaaacagagcattttagtctgaagaaagaggggttactgggcagtgcctttttagacgaagctgaaattgaaatttcgttaaatgaatttggcaaagttggttgggagttggtttcgtttatggaagtaagtgatggtgttattgctattttcaaacaaccgcttagtaatggcttgtctcaagcgatacaagaggaaccgaaagacaaagaatcgttcattgtcccagtagcgtcagcgtcacaagagtcttttgaaaaacaggaaaccaatgccggtacagatcgaagcgatgaggacattggggacataaaaatattttaa

SEQ ID NO: 14220 - protein, 121 aa, Unknown
  Obtained from environmental sample
  misc_feature (1)..(121): Xaa is any amino acid
MMNLYSEEIMKWSYKTEHFSLKKEGLLGSAFLDEAEIEISLNEFGKVGWELVSFMEVSDGVIAIFKQPLSNGLSQAIQEEPKDKESFIVPVASASQESFEKQETNAGTDRSDEDIGDIKIF

SEQ ID NO: 14221 - DNA, 477 bp, Unknown
  Obtained from environmental sample
  misc_feature (1)..(477): n is a, c, g, or t
atgaaaaaaacagaaaaaacaaatacaagtaatcttatcgatagaacatttaaaaaactaagcaatttagataaaattttagaaaataaaattgataaaatcttattacaacttattaatatattaaaatatgtttttatcataacaatgatgttataccttttcatctgtattatgagtttatcacataagatgatatcactgacaattactcagggtgcattggattttcaatcaataaaaatgattttaacagatggcttatttaccttaattgttatagctattgtgaaaacattatttattaaaaatggatatgattatgccttgacttttttagagattggatttgtttgttgtatacgaaagctaaatcttttagatgcagcaccagaagaagctatgatgactctaactttagggttacatcagccgtatttttgtcctaatagtctatattccttatataaaaattaa

SEQ ID NO: 14222 - protein, 158 aa, Unknown
  Obtained from environmental sample
  misc_feature (1)..(158): Xaa is any amino acid
MKKTEKTNTSNLIDRTFKKLSNLDKILENKIDKILLQLINILKYVFIITMMLYLFICIMSLSHKMISLTITQGALDFQSIKMILTDGLFTLIVIAIVKTLFIKNGYDYALTFLEIGFVCCIRKLNLLDAAPEEAMMTLTLGLHQPYFCPNSLYSLYKN

SEQ ID NO: 14223 - DNA, 309 bp, Unknown; identical to SEQ ID NO: 10627
  Obtained from environmental sample
  misc_feature (1)..(309): n is a, c, g, or t

SEQ ID NO: 14224 - protein, 102 aa, Unknown; identical to SEQ ID NO: 10628
  Obtained from environmental sample
  misc_feature (1)..(102): Xaa is any amino acid

SEQ ID NO: 14225 - DNA, 711 bp, Unknown
  Obtained from environmental sample
  misc_feature (1)..(711): n is a, c, g, or t
atgatgaaaaatttatctaaagaggatccccttcaaaatcgttcttatcaattagataagtttattcttgatagagcaagtggtaaagaagatgaaaaattaattgagtttataagaggttttaacagtttatgtaaaaaagagattctaaatgaaaaagatgcatttttacttatacgaacattttatttatttagaaatagttctatatcaaatgattaccataaagaatttgcaataaactttgatgatagtaaggtatatagctttatacatttagttgcatctcatcatgagtataaagatgaaaataaaaaagctataaaatacttttataagcaactaaaagaggcagttcttttttatgtaaataaaaatgcaccaacactttctaaacataacttagtttccatatcgacaacaaatggtataactatggcagtaccagtggaaatagaagcaaatatgtcaaagataaaaaatgtaacttcaaagtcaggaactagcttccctctttttctaaaaataaattcagaagagattccaacaatagatatcacactaagtattcaaaatatgatagatcaaatacttaatggatatcgtcctaataagcatgaccgaaatactattgttatatttgatgaactggttcaaaatatacttgctaaagcagtacattctaaggaaaattgttttattgtcggataa

SEQ ID NO: 14226 - protein, 236 aa, Unknown
  Obtained from environmental sample
  misc_feature (1)..(236): Xaa is any amino acid
MMKNLSKEDPLQNRSYQLDKFILDRASGKEDEKLIEFIRGFNSLCKKEILNEKDAFLLIRTFYLFRNSSISNDYHKEFAINFDDSKVYSFIHLVASHHEYKDENKKAIKYFYKQLKEAVLFYVNKNAPTLSKHNLVSISTTNGITMAVPVEIEANMSKIKNVTSKSGTSFPLFLKINSEEIPTIDITLSIQNMIDQILNGYRPNKHDRNTIVIFDELVQNILAKAVHSKENCFIVG

SEQ ID NO: 14227 - DNA, 492 bp, Unknown
  Obtained from environmental sample
  misc_feature (1)..(492): n is a, c, g, or t
atgataaaacatatccaaaatcacaagttttttaaaactattctagatacaataacaactgctcgtgcaaaacaaaaagatggaacgatcaacgaaactataaaacaaagtgcctcttttaaagccaatcgaagagtagaaacactaaagcaattatcagctagacacaacaatcttggcaattttataaatgctatgatattaggtggtggagagatgagtgagggtggtggtgttaacctactctcagttcatgctagtaaaggtttagaatttaatgaggtttatgtggttgatttgatggatgggagatttccaaaccgaactttgatgagtaagggtggaagtttagaggaagaaaggcgacttttttatgttgcggtaacacgagcaaaggatattttatatttaagttatgcaacttacgatagaataaagaaattagattttatacatagtccttttttagtggaagctggacttgtacaatag

SEQ ID NO: 14228 - protein, 163 aa, Unknown
  Obtained from environmental sample
  misc_feature (1)..(163): Xaa is any amino acid
MIKHIQNHKFFKTILDTITTARAKQKDGTINETIKQSASFKANRRVETLKQLSARHNNLGNFINAMILGGGEMSEGGGVNLLSVHASKGLEFNEVYVVDLMDGRFPNRTLMSKGGSLEEERRLFYVAVTRAKDILYLSYATYDRIKKLDFIHSPFLVEAGLVQ

SEQ ID NO: 14229 - DNA, 342 bp, Unknown
  Obtained from environmental sample
  misc_feature (1)..(342): n is a, c, g, or t
gtgttaaatatttttaaaactagattatttgattttattgtagttattttattattagctatgggtgtaatagtatttattgtatcaaatactattacacaaaataaaatagagatcataaaaaaagaaaaatataatatctattcaaaaaatatatatgatgagataagtatattgatgaaacataaaaaaaacttaacactggctattgcattatctttatcacaaaatgaaaatattatcaaagctttaaaaaacaatgatactgaactagtacaattaaaagaattttcaaaattactaaaaaaagcgataaaactcaataattcatggttcaaataa

SEQ ID NO: 14230 - protein, 113 aa, Unknown
  Obtained from environmental sample
  misc_feature (1)..(113): Xaa is any amino acid
MLNIFKTRLFDFIVVILLLAMGVIVFIVSNTITQNKIEIIKKEKYNIYSKNIYDEISILMKHKKNLTLAIALSLSQNENIIKALKNNDTELVQLKEFSKLLKKAIKLNNSWFK

SEQ ID NO: 14231 - DNA, 885 bp, Unknown
  Obtained from environmental sample
  misc_feature (1)..(885): n is a, c, g, or t
ttggatcagattcggctcgcaggtattggtgatgataaacaacaacgacatgataaaattagtgagtttgatagatatcaaatatatttgaattacaatattaagcattataaactactacaaagccatgactatatacttgatgagattatagatttttttcataacaattttgtaatatcttttccatacccttctgttataaaaaatatgaaaaagatggttagttttattcaaaacgaagatagattcttacatgtagacaaaataacaaaagaaaatatttttgaaaacaaaaaattattattaattagtgctggaccatccttagacaattatatagatacaatagaaaagtatcaaaataaatttattatagtttgtgtagatgttattttaaaaaagcttgaaaaacacaatattattccagatatagttttttctattgatccatctcctagatgtgctgattatctaagaactgaggatccagagtatttaaatgagagtgttatcatacttttatcgcaacagcatgaggatgttatggaccttttaagagagagaaagcttaactattatttcagtcagtttgcatcaatggtacaggagataggatttttaggaagtgtaccaaatgtaggtacctttacatttcaaactatggtttactttggtgcaaaagagttatatttaataggaaatgatgctgctttcaatcaagaaacaggctcaaggtatagtaaagatagctcatattctaaaatagaagatacagatatagaagtattagaagaaaattctatttcaagaaaagatacaattgaagtagaaggtaacttacgagatatggtgaaaacaaacagagagttactcgaattttaa

SEQ ID NO: 14232 - protein, 294 aa, Unknown
  Obtained from environmental sample
  DOMAIN (83)...(237): Protein of unknown function DUF115
  misc_feature (1)..(294): Xaa is any amino acid
MDQIRLAGIGDDKQQRHDKISEFDRYQIYLNYNIKHYKLLQSHDYILDEIIDFFHNNFVISFPYPSVIKNMKKMVSFIQNEDRFLHVDKITKENIFENKKLLLISAGPSLDNYIDTIEKYQNKFIIVCVDVILKKLEKHNIIPDIVFSIDPSPRCADYLRTEDPEYLNESVIILLSQQHEDVMDLLRERKLNYYFSQFASMVQEIGFLGSVPNVGTFTFQTMVYFGAKELYLIGNDAAFNQETGSRYSKDSSYSKIEDTDIEVLEENSISRKDTIEVEGNLRDMVKTNRELLEF

SEQ ID NO: 14233 - DNA, 627 bp, Unknown
  Obtained from environmental sample
  misc_feature (1)..(627): n is a, c, g, or t
atgccccgggtgaaaaggcgttcgaaccaagatgaggaaaatcttttgatagtttttagaggagttagcagatactattcaaaagagtatcaaaaagcttttgagtgggaatgtgaagctttaaaaaaagtaagagatgagagggggcttacaaatgtcaaaatatgctttccttttgtaagaacacctgttgagggtcaaaaagttatcaaaattatgaataaaaaaggactggtacaaggtaaaaattcacttgaaatttacgcaatgtgtgaaataccaagtaatgtaatctttgcagatgagttcctaaaagtatttgatggttatagtataggttccaatgatttaacacaattaactttaggagttgatagagatagtgctttaatagcgcatatctttgatgagagaaataaagctgtaacaagaatgatagcgatggtgatagagcagtgtaaaaaacaaaataaatatatcggtatttgtggacaagcaccatcagattatccagagattacaagatttttagttgagaatggtatagactctatctctttaaatcctgattcactcttaaaaatgagacaagttgtagttgaacttgaaaactctaagaactcttaa

SEQ ID NO: 14234 - protein, 208 aa, Unknown
  Obtained from environmental sample
  DOMAIN (2)...(204): PEP-utilising enzyme, TIM barrel domain
  misc_feature (1)..(208): Xaa is any amino acid
MPRVKRRSNQDEENLLIVFRGVSRYYSKEYQKAFEWECEALKKVRDERGLTNVKICFPFVRTPVEGQKVIKIMNKKGLVQGKNSLEIYAMCEIPSNVIFADEFLKVFDGYSIGSNDLTQLTLGVDRDSALIAHIFDERNKAVTRMIAMVIEQCKKQNKYIGICGQAPSDYPEITRFLVENGIDSISLNPDSLLKMRQVVVELENSKNS

SEQ ID NO: 14235 - DNA, 507 bp, Unknown
  Obtained from environmental sample
  misc_feature (1)..(507): n is a, c, g, or t
atgattgttatcaataacttcatctatggtcttacaaattcacaaacaagtcctacaacacctcaaggtatgtggactgtatctcaaaaagctggtaatattgacccaacttttgatgcttgtaaattagctatcgcttctggtgcttcatttgtagcaagagagactatgcttgatcctaaaaaattagagagaactttagtaaaaggttttgaacatagaggatttagtttctttgatgttatgtctaactgtcatattaaccttggtagaaaaaataaaatgcaatcagctatggaaaacctagactggattgattctattactactccattaagtaaatatgaaaaattaactcctgaagaacaattaaatatgttcccaacaggtgtgttaaaacatgatactgaggttagagaatactgtgatatgtacgaagatattaaagctgtacaacaaggtaaaagaaaagttatcactcaagatgactttgagaaaaagatataa

SEQ ID NO: 14236 - protein, 168 aa, Unknown
  Obtained from environmental sample
  DOMAIN (1)...(88): Thiamine pyrophosphate enzyme, C-terminal TPP binding domain
  misc_feature (1)..(168): Xaa is any amino acid
MIVINNFIYGLTNSQTSPTTPQGMWTVSQKAGNIDPTFDACKLAIASGASFVARETMLDPKKLERTLVKGFEHRGFSFFDVMSNCHINLGRKNKMQSAMENLDWIDSITTPLSKYEKLTPEEQLNMFPTGVLKHDTEVREYCDMYEDIKAVQQGKRKVITQDDFEKKI

SEQ ID NO: 14237 - DNA, 930 bp, Unknown
  Obtained from environmental sample
  misc_feature (1)..(930): n is a, c, g, or t
ttggaaaagagccagggggaccatttgctattttttcgtggaaaaaatatctggactttcgggggaagggaaaataaaaaaaaaagggattttaaaatggctttttttcggattataaaaaacagtttttgtgccgatccctttttgattgaaaagtatgtttcaacctttctttttttcgaggaatttgagtataaaaaacaaaaagggcgtattatggtttcggaaatttttgagggcaagggtggagctatttttgcctcagaagctaaggtggcgcttgatcatgataatcatatttcctatccttttgtattttcctatgacggtgaaatattcatgcttcccgagacctcaagtgaaaaagaaattgcgctttatcgagcgactgactttcctttggaatggaaaaaggaaaaagttttgatcagcaattttgctggcattgatgcaacgttgcattttgcagataataggtggtggattttttgttcagatgataaacttggttgtaacgagaacctttgtattttttacgccgaggacttatttggaaaatggaaggcgcataaacaaaacccagtaaagtcagatattcgaagttctcgtatggcaggacctttgtttttttggaaaaaacaattaattagaccagctcagaattgtgaaggaacctatggaaaagaaattatactaaacaagatcaaaagtctttcaattgaaaatttcaaggaaaaatcaatctctacgtttgcaacaaatgagaaatcagaatacaaagaaggaatgcatacaatttctgcgagtgaaaaattcgtggtaattgatgcaaaaaaattcctagggattagaagatttctagatccttggaattcgaaaagaaaagcacttagaaacaaaataagacaagtgtttcaaaaaaatgtctaa

SEQ ID NO: 14238 - protein, 309 aa, Unknown
  Obtained from environmental sample
  misc_feature (1)..(309): Xaa is any amino acid
MEKSQGDHLLFFRGKNIWTFGGRENKKKRDFKMAFFRIIKNSFCADPFLIEKYVSTFLFFEEFEYKKQKGRIMVSEIFEGKGGAIFASEAKVALDHDNHISYPFVFSYDGEIFMLPETSSEKEIALYRATDFPLEWKKEKVLISNFAGIDATLHFADNRWWIFCSDDKLGCNENLCIFYAEDLFGKWKAHKQNPVKSDIRSSRMAGPLFFWKKQLIRPAQNCEGTYGKEIILNKIKSLSIENFKEKSISTFATNEKSEYKEGMHTISASEKFVVIDAKKFLGIRRFLDPWNSKRKALRNKIRQVFQKNV

SEQ ID NO: 14239 - DNA, 774 bp, Unknown
  Obtained from environmental sample
  misc_feature (1)..(774): n is a, c, g, or t
atggaaaaaaatacaattgtaatagaagataatagatactattctctaagattaattggttctaaagatgctaataaaattttagtatatgggtatgatataacacaaataaagaaaaatgaacaacagttaagagaacaatcaaaacttgcagctcttggggagatgataggaaatattgctcatcaatggagacaaccattatctgttatatcaacagcagcaacaggaatgaagatacaaaaggagtttaatcttttaaaagacgatgattttaattcagcttgtgacatgatagatgagtatgctcagtatctgtcaaaaacaattgatgattttagggattttataaaaggggatacaaaaaatgttcgctttaatttaaaagaggagatagaatcttttttgaaattagttgagtctgatataaaaacatatcatattgaggttataaatagttgtgaagataatattataatcaatggtcatccaaatgaattaaaacaatgttttataaatatctttaataatgcaaaagatgcatttttacaaaattctcatcttgaagagagatatttttttataacactaaaaaaagacaagaatcaggttacaatctccttttgtgacaatgctggcgggataccaaaggatgtattacctaaaatatttgaaccatattttaccacaaaacataaatttcaaggtacaggtcttggacttcatatgacatatagtttaattgttgaggngtatgaatggaaaatattctag

SEQ ID NO: 14240 - protein, 257 aa, Unknown
  Obtained from environmental sample
  DOMAIN (52)...(122): His Kinase A (phosphoacceptor) domain
  misc_feature (1)..(257): Xaa is any amino acid
MEKNTIVIEDNRYYSLRLIGSKDANKILVYGYDITQIKKNEQQLREQSKLAALGEMIGNIAHQWRQPLSVISTAATGMKIQKEFNLLKDDDFNSACDMIDEYAQYLSKTIDDFRDFIKGDTKNVRFNLKEEIESFLKLVESDIKTYHIEVINSCEDNIIINGHPNELKQCFINIFNNAKDAFLQNSHLEERYFFITLKKDKNQVTISFCDNAGGIPKDVLPKIFEPYFTTKHKFQGTGLGLHMTYSLIVEXYEWKIF

SEQ ID NO: 14241 - DNA, 801 bp, Unknown
  Obtained from environmental sample
  misc_feature (1)..(801): n is a, c, g, or t
ttgggagatatcgttacccagatttcaaccacttcagaaagttttaggatgctgagcaatatcaccaagattattttaactaaaaatccaaatggatatggtcctaatcatagtacgggtgtaaagtttgaaaaacaaaatgatgataaaaanagagatacattgtttccaatagggggtaaagagatagtggtaattgaagctgaagtattttgcccctattgtgaaaagtttaaagaagaggtaagtagctcttataaaggaactttacctttacgaacagtatatagttctcaactaaaaggttttgatattaagacaaaactagatgcaacaccaactatactttttattgaaaatggaaaagagatttttgcacatagaggttttttaaatgaagatgagttttacaaagctttgggtgtttttaaattaggaaaaaactcagaaagttacagtgtagcatttaacaaagatacagatagtagattttgtaagcaatatgatatctttaaaaatacccctgatggagtttttgtggataagctctctggagatatactttttgacactaaagatagatttaattcaggaactggatggttgagtttttataaagcagtggatggttcaactatagaaaaagaggataatagttatggtatgaatagaattgaagtgttagctaaaaaaagtggaatacatttaggacatgtatttccaagagatgatggaaaaagaagattttgtatcaatgctacagtattagaatttatcccaagggaaaaattaaaaaagtag

SEQ ID NO: 14242 - protein, 266 aa, Unknown
  Obtained from environmental sample
  DOMAIN (140)...(261): SelR domain
  misc_feature (1)..(266): Xaa is any amino acid
MGDIVTQISTTSESFRMLSNITKIILTKNPNGYGPNHSTGVKFEKQNDDKXRDTLFPIGGKEIVVIEAEVFCPYCEKFKEEVSSSYKGTLPLRTVYSSQLKGFDIKTKLDATPTILFIENGKEIFAHRGFLNEDEFYKALGVFKLGKNSESYSVAFNKDTDSRFCKQYDIFKNTPDGVFVDKLSGDILFDTKDRFNSGTGWLSFYKAVDGSTIEKEDNSYGMNRIEVLAKKSGIHLGHVFPRDDGKRRFCINATVLEFIPREKLKK

SEQ ID NO: 14243 - DNA, 813 bp, Unknown
  Obtained from environmental sample
  misc_feature (1)..(813): n is a, c, g, or t
atgttttacaggaagtcaaaaattttaaatattgcactattactcctactatttaaggtatgggtttctcagaaaattagtaccgcagatataactaaaattggtaaagtttactatctgaagaattctgacaaaatattctcaggtacagctaccagtgtttattctggagataagcttaagtctgaagtaaattacacaaatggaaagattaatggcaaatggactgaatggtatgaaaatggtcaaaagaaacagataaaacattacagctataacaaaccgacaggaatttggcaaagctggttcgagaatggaactaaaaagtttgaaattaatttcatagctccaaatggtacggaaacacactggtatgacaacgggaatattcacctaaaaggacaatttaagaactttgaaaaagatagtacttggatttggtatcataagaatggagatattaagcttcaaggagattataacgaagggcttaaaacaggtagttggaattgcttttatgataacaaacaaaaaaaatacacccatttctactcaaatgatttagctgcaggaaaatggttggaatggcacgacaatggctatatcaaaaaacaagaaacttataaaatgggatatagagttggtagaagaatagaatggaatgaaaatagcaatatcataaaactcgaaacatatcaagatggcagacttgtagatagtaaagaacttgaagaaggaaaacttactactaccaagaaaaataacagaaagaaagaagaaggattttatagaagtggcagaataattaaatag

SEQ ID NO: 14244 - protein, 270 aa, Unknown
  Obtained from environmental sample
  misc_feature (1)..(270): Xaa is any amino acid
MFYRKSKILNIALLLLLFKVWVSQKISTADITKIGKVYYLKNSDKIFSGTATSVYSGDKLKSEVNYTNGKINGKWTEWYENGQKKQIKHYSYNKPTGIWQSWFENGTKKFEINFIAPNGTETHWYDNGNIHLKGQFKNFEKDSTWIWYHKNGDIKLQGDYNEGLKTGSWNCFYDNKQKKYTHFYSNDLAAGKWLEWHDNGYIKKQETYKMGYRVGRRIEWNENSNIIKLETYQDGRLVDSKELEEGKLTTTKKNNRKKEEGFYRSGRIIK

SEQ ID NO: 14245 - DNA, 519 bp, Unknown
  Obtained from environmental sample
  misc_feature (1)..(519): n is a, c, g, or t
atgaaggagggcgaataccttaatacaatatatcctctgggcaatcaattcaatgctattgatagtggaaatgtgttgcttattggtggtggatgtggcgtagctcctcttttataccttgccagagactttaaagaaaaaggtttaagcccaacaatactaattggaacaagatctaaaaaagatattttgttacatgatgagtataagaaatatggaaatgtattctttacaactgaagatgactcacaaggcgagaaaggttatgttactcagcattcaatatttaaagatattgtttctcaatttaaaaaaatatacacctgtggtcccgaccaaatgatgaaagctgttgctaagattgcaaaagaaaaaggtattgattgtgaggtttcattagaaaatacaatggcatgtggaattggtgcatgtctttgttgtgttacagaaacaattcatggcaatttatgcacttgtacagatggtccaatatttaacacaaaagaactaaaatggtaa

SEQ ID NO: 14246 - protein, 172 aa, Unknown
  Obtained from environmental sample
  DOMAIN (22)...(121): Oxidoreductase NAD-binding domain
  misc_feature (1)..(172): Xaa is any amino acid
MKEGEYLNTIYPLGNQFNAIDSGNVLLIGGGCGVAPLLYLARDFKEKGLSPTILIGTRSKKDILLHDEYKKYGNVFFTTEDDSQGEKGYVTQHSIFKDIVSQFKKIYTCGPDQMMKAVAKIAKEKGIDCEVSLENTMACGIGACLCCVTETIHGNLCTCTDGPIFNTKELKW

SEQ ID NO: 14247 - DNA, 456 bp, Unknown
  Obtained from environmental sample
  misc_feature (1)..(456): n is a, c, g, or t
atggtaaatttaaaagtaaacatagcagaccttagtctaaagaatcctgtaatgactgcttctggtacttttgggtatggaccagaattcgaagattttattgatattaataaacttggtgggattttagtgaaaggaactacactcaacccaagagagggcaatccttatccaagaatggcagaaacaccatctggtatgcttaatgctgttggtttgcaaaataaaggtgtaaaatatttcgcggaaaagatatatccaactattaaacattatngatacaatattattgtaaatgtttcgggttctcagataagagaatatattaaaactgccgaagtaataaatgaactagataaaatacccagcatagaactcaacatatcttgttctaatgtaaaaagaaggcgaatgggcttttggtacaagctggtcctttgcccagaaaatttttga

SEQ ID NO: 14248 - protein, 151 aa, Unknown
  Obtained from environmental sample
  DOMAIN (3)...(151): Dihydroorotate dehydrogenase
  misc_feature (1)..(151): Xaa is any amino acid
MVNLKVNIADLSLKNPVMTASGTFGYGPEFEDFIDINKLGGILVKGTTLNPREGNPYPRMAETPSGMLNAVGLQNKGVKYFAEKIYPTIKHYXYNIIVNVSGSQIREYIKTAEVINELDKIPSIELNISCSNVKRRRMGFWYKLVLCPENF

SEQ ID NO: 14249 - DNA, 609 bp, Unknown
  Obtained from environmental sample
  misc_feature (1)..(609): n is a, c, g, or t
atgacaaacaaagatgaaaaaaaactattattatctatcaagataattccacttattattgttacagctcttgctactgtagggataattgttgctttatatataaacaatataaattttaataacgaaataaaaagtgttaaagaactctatttaaaacaagaaaaagaaactttaaaacaagaaattttaaaaataagaaagaatatctttagtgaaaaacaattaactaaagaacaactcaaagaaaatataaaagaaaaagtttatatggcatacagtatcactacaaatatctataacaaatacaaagatacaaaaagtaaaaatgagataaaagagatgattaaaaatgctcttgttaatattagattcaatgatggaagaggttatttcttcatctattctatggactatgaatgtatattattacccttatctagacagttggagggaacaagtttttataactttaaagatggtaaaggtatgtatcttacaagagagatcatcaaacaacttaaagaacaaaaagaggggtttttaacttggtggtatcataaaccagacgatatggtaaaacaatatgaaaagataggttttcaataa

SEQ ID NO: 14250 - protein, 202 aa, Unknown
  Obtained from environmental sample
  misc_feature (1)..(202): Xaa is any amino acid
MTNKDEKKLLLSIKIIPLIIVTALATVGIIVALYINNINFNNEIKSVKELYLKQEKETLKQEILKIRKNIFSEKQLTKEQLKENIKEKVYMAYSITTNIYNKYKDTKSKNEIKEMIKNALVNIRFNDGRGYFFIYSMDYECILLPLSRQLEGTSFYNFKDGKGMYLTREIIKQLKEQKEGFLTWWYHKPDDMVKQYEKIGFQ

SEQ ID NO: 14251 - DNA, 594 bp, Unknown
  Obtained from environmental sample
  misc_feature (1)..(594): n is a, c, g, or t
atgatgtacacaggttatagagggaaaacccccggggattatcgaatatgtcttgcatcctcgcgggatcttaaaaactggaaacggcatgggattgtactggatgagtcaaataaagatgcttctctattcccggaaaaaataaatggaagattctgtatgcttcacagaagagatcctgatatctggattgcttattcctctgatttaaagaactggacagaccatactagggtaatgaacccaaatccaaataatgagtgggaatcaaaaaaaattggaatatcaggaccgcctgttaaaaccaaagatggatggctgttattctatcatggtgtaagtcatgatggggtatattcccagggaatagcacttctggacatttccgacccttcaaaggtgcttaacagacagagcgaaccaattcttgaaccggaactggattgggaaaaagaaggttgtgttccaaatgttgttttctcctgtggtcaaattgaaaccggggacagcatccttgtctactatgcaggtgcagatacagtgatgggaatagcggaacttaaaaagaaagacattatttttgataaaatataa

SEQ ID NO: 14252 - protein, 197 aa, Unknown
  Obtained from environmental sample
  DOMAIN (1)...(190): Domain of unknown function (DUF377)
  misc_feature (1)..(197): Xaa is any amino acid
MMYTGYRGKTPGDYRICLASSRDLKNWKRHGIVLDESNKDASLFPEKINGRFCMLHRRDPDIWIAYSSDLKNWTDHTRVMNPNPNNEWESKKIGISGPPVKTKDGWLLFYHGVSHDGVYSQGIALLDISDPSKVLNRQSEPILEPELDWEKEGCVPNVVFSCGQIETGDSILVYYAGADTVMGIAELKKKDIIFDKI

SEQ ID NO: 14253 - DNA, 780 bp, Unknown
  Obtained from environmental sample
  misc_feature (1)..(780): n is a, c, g, or t
atgaaatcacgaaacattttactagagattgggtctttagactggtctgctatcaaccctgatatctttggctctatgatacaagcagttgtaaaagatgaatatcgtggcgacatgggtatgcactatacatctgtgccaaacatcatgaaggttatgcaaccactatttttagatgagctttatgaagagtttgaaaaagcaaaaggcaatactaaaaagttaaacttactgcatctaagacttcaaaatttaaaaatatttgatccagcttgtgggtctggtaactttttgattatcgcatataaagagcttagaaaattggaaatgttgatttttaaagagggtggactgttaatttctccaagtataaaactaacacagttttacgggatagaactagatgactttgctcatgaggttgcgatactttccctttggttggctgaacaccagatgaacgtactgtttaaaaaagagtttggaacggttcctcctgccttaccacttcaagatggtggtaatattgttcaaggtaatgctacaaggttagactgggaagaggtttgtcctaaagtggatggggatgagatttatatacttggcaatcctccatataaaggtttttctcagcaggaagtaagtcaaaaagatgatataaaatctgttctaggccaagcaagtaagttagattacatatcatgctgngttataaaaggtagtaagtatatagaaaatactaatatatctttggcatttgttaccactnatttcaattag

SEQ ID NO: 14254 - protein, 259 aa, Unknown
  Obtained from environmental sample
  misc_feature (1)..(259): Xaa is any amino acid
MKSRNILLEIGSLDWSAINPDIFGSMIQAVVKDEYRGDMGMHYTSVPNIMKVMQPLFLDELYEEFEKAKGNTKKLNLLHLRLQNLKIFDPACGSGNFLIIAYKELRKLEMLIFKEGGLLISPSIKLTQFYGIELDDFAHEVAILSLWLAEHQMNVLFKKEFGTVPPALPLQDGGNIVQGNATRLDWEEVCPKVDGDEIYILGNPPYKGFSQQEVSQKDDIKSVLGQASKLDYISCXVIKGSKYIENTNISLAFVTTXFN

SEQ ID NO: 14255 - DNA, 861 bp, Unknown
  Obtained from environmental sample
  misc_feature (1)..(861): n is a, c, g, or t
atgccagaagatgaagctaaatttactaaagtaactaataactactacgagcaattaaacgggtatgagtttctaaagtctctcggtatagggtatcacttttatcaaggtagatatacaagtgctattaaagagatactagatactgacaaaaaaactatactgcatattcctaatgtaaatgctggtgaatctactaaagataagtataaagaagttggaactattttagatatcatcggcactgttgaagagactacggatgatggagtgataatagttaaaagacatgaagatggaaagcttttaaaagttgcagaccttgtaaacgatgataaaaaagagagagataagttagcaacatatttacgaaatatgacgagtgtagatgatatggatttgattatcgcattaggaatggcaaaagagggttttgattggccatattgtgaacatgcactgactgttggatatagaagctcactgacagaaatcatacagattataggacgagctacaagagatagtaacaataaaaatcatgcacaatttacaaaccttatagctcaaccagatgcacaaaatgatgaagtgaaagtatctgtaaataacatgcttaaagccataactgcatcattacttatggaacaagtattagcccctagttttaagtttaaagctaaatttgatagtggtttagatccaaaaacaagaggggaaatagctagtcgtatgggtataaaagagccaagtagaaaaagaattggtgatattatagaaagtgatctaaatgatataaaagcagcgatactacaagatgaaaagatgccacaaatgtctcggaaatctcagccgatctga

SEQ ID NO: 14256 - protein, 286 aa, Unknown
  Obtained from environmental sample
  misc_feature (1)..(286): Xaa is any amino acid
MPEDEAKFTKVTNNYYEQLNGYEFLKSLGIGYHFYQGRYTSAIKEILDTDKKTILHIPNVNAGESTKDKYKEVGTILDIIGTVEETTDDGVIIVKRHEDGKLLKVADLVNDDKKERDKLATYLRNMTSVDDMDLIIALGMAKEGFDWPYCEHALTVGYRSSLTEIIQIIGRATRDSNNKNHAQFTNLIAQPDAQNDEVKVSVNNMLKAITASLLMEQVLAPSFKFKAKFDSGLDPKTRGEIASRMGIKEPSRKRIGDIIESDLNDIKAAILQDEKMPQMSRKSQPI

SEQ ID NO: 14257 - DNA, 996 bp, Unknown
  Obtained from environmental sample
  misc_feature (1)..(996): n is a, c, g, or t
ttgaaagaggactcgattgatgaggagtttcacatagcaacattagcaagaactcttaaccgatggggctttgaattcggtaagggcactcgatcgcaacatttaaaagaaaaggatcacgtaattgccgcgcggcagcggtaccttcgcaaaatgagaggcaaccgatcaccaggaaaagggtttgggattgaaacaattcgccctgaagtttacttggatgaatcatatgtcaacaaaaatcacagtaatgattttatttggtattccggcgaagatggtccttgggttcagaagccaacaggaaaaggcgagcgtcttattattctcaatgctgtaacttcttccggatgggtccatggtgccaaacttgtctttaaaagcacaagaaagacaggggattatcatgggcagatgaattctgatttgtttaaaagatggtttgtagaaatgcttcttccgggtattcccaaaaattctcttataattatggataatgcctcctaccataataccctttcagaatattcaccgccgacgccacaatgttcaaagcaaaaaattaaggaatggcttgaacaaaataaaatctacagccgtgatgactgcctgaaacttgaattagttgaaatcttgaagaaaattgcgcccgaaccaatctatgcaattgatgaaattgcacgtatccatgggcatgaagtacttagaacaccaccgtatcaccctgaattgcaaccgatagaaatttgttggggtgtactaaaaaatcatgtagccagaaaatgtgattttacaatgaaatatctaattgaacagctcgattcaggctttagcaaggtcactgcaaatacatgctcgaaaattatggcgaaagtaaggaaagtgaagacgaattttggaacagaagatttgaaaatggatgcagaaaaaattaaaaatacaccatccattcctctggcaaagactataaaaggcatgggttttcatccgaaaccc

SEQ ID NO: 14258 - protein, 332 aa, Unknown
  Obtained from environmental sample
  misc_feature (1)..(332): Xaa is any amino acid
MKEDSIDEEFHIATLARTLNRWGFEFGKGTRSQHLKEKDHVIAARQRYLRKMRGNRSPGKGFGIETIRPEVYLDESYVNKNHSNDFIWYSGEDGPWVQKPTGKGERLIILNAVTSSGWVHGAKLVFKSTRKTGDYHGQMNSDLFKRWFVEMLLPGIPKNSLIIMDNASYHNTLSEYSPPTPQCSKQKIKEWLEQNKIYSRDDCLKLELVEILKKIAPEPIYAIDEIARIHGHEVLRTPPYHPELQPIEICWGVLKNHVARKCDFTMKYLIEQLDSGFSKVTANTCSKIMAKVRKVKTNFGTEDLKMDAEKIKNTPSIPLAKTIKGMGFHPKP

SEQ ID NO: 14259 - DNA, 471 bp, Unknown
  Obtained from environmental sample
  misc_feature (1)..(471): n is a, c, g, or t
gtgaaatacggcatttgtagtttaagtgtagtcccgggaagagctgaaccatcagacaaaagtgagatggtaacacagctcctctttggtgaagttttttctatttatgaagaaaagcgtaaaggttggaaaaaaataaaaactgcttacgataactacgaatgttggattgatgaaaaacaagttactgaaatttctgaagaagaatatgaagctttaaatgaagctcaaccaattgtttcaggagatttgttaagcatcgtaaaaaacaaaattaccaaccagctcactcctattgttattggaagtacactcccaaatttcaacaataaaaaggttcatttttctgatattgaatttgattatgatggaagtgaacttttaccatcaacaccaaaaaaagaacttattgccgaccatgtattgctatttttaaatgcacctatttatggggaggctgagccgatctga

SEQ ID NO: 14260 - protein, 156 aa, Unknown
  Obtained from environmental sample
  misc_feature (1)..(156): Xaa is any amino acid
MKYGICSLSVVPGRAEPSDKSEMVTQLLFGEVFSIYEEKRKGWKKIKTAYDNYECWIDEKQVTEISEEEYEALNEAQPIVSGDLLSIVKNKITNQLTPIVIGSTLPNFNNKKVHFSDIEFDYDGSELLPSTPKKELIADHVLLFLNAPIYGEAEPI

SEQ ID NO: 14261 - DNA, 861 bp, Unknown
  Obtained from environmental sample
  misc_feature (1)..(861): n is a, c, g, or t
atgagaccaggtgagcctgtaacaaaagaagctgctagagaatttatcaagaaattattctttgatccagaaagatatgatttaacaaaagtgggaagaatgaaaatgaaccacaaacttgatgtacaagttcctgaatatgtaacagtacttacacatgaagatattattaaaactgttaaatacttaattaaagttaaggcaggacatggtcatgtggatgatagagatcacttaggaaacagaagaattagatcaattggtgagttattatcaaatgaacttcatgctggtttaattaagatgcaaaaagcaattagagataaaatgactacattaagtggtacattagaagatttaatgccacatgatttaattaactctaaaatgatcacttcaacaattacagagttttttacatctggtcagttatctcaatttatggatcaaacaaatccattatcagaagttactcataaaagaagactttctgcacttggtgagggtggtttagtaaaagagagagctggatttgaagtaagagatgttcacccaactcattatggtagaatttgtccagttgaaactccagagggtcaaaatattggtcttattaatacattatcaactttctctaaagttaatgagttaggttttattgaaacaccatacaaaaaagttattgatggattagtaactgatgagattcaatatttcacagcaacacaagaagagggtaaagtaattgctccaggtttcaacaaattaacaaaagatgggaaaatagctgaagtactaacagaagccagattagatggtgaaaatatgcttatcgaatctgctaaagttgaagcttattga

SEQ ID NO: 14262 - protein, 286 aa, Unknown
  Obtained from environmental sample
  DOMAIN (143)...(215): RNA polymerase Rpb2, domain 3
  misc_feature (1)..(286): Xaa is any amino acid
MRPGEPVTKEAAREFIKKLFFDPERYDLTKVGRMKMNHKLDVQVPEYVTVLTHEDIIKTVKYLIKVKAGHGHVDDRDHLGNRRIRSIGELLSNELHAGLIKMQKAIRDKMTTLSGTLEDLMPHDLINSKMITSTITEFFTSGQLSQFMDQTNPLSEVTHKRRLSALGEGGLVKERAGFEVRDVHPTHYGRICPVETPEGQNIGLINTLSTFSKVNELGFIETPYKKVIDGLVTDEIQYFTATQEEGKVIAPGFNKLTKDGKIAEVLTEARLDGENMLIESAKVEAY

SEQ ID NO: 14263 - DNA, 1011 bp, Unknown
  Obtained from environmental sample
  misc_feature (1)..(1011): n is a, c, g, or t
ttgttgcaaactctttttaagcaatcccctctagttttagttacacaaaaaaatattaaaacacctgctgatttaaaagggaaaaagattatgggattacttgatagtagccataaacaagttgttttaacaatgttagataaatttaatatgacagcggatgatttccaaaatattccaagaaagtttagtattgaaagttttaaaaataaaaaagtggatgcattaagtgtttttaccactaatgaaatttatacattagataaactagggattcaatataatattttagatccagctgcatttggaacaaagttttatgacttaaatctttttacaacaaaaagtgaacttaaaaataaccctaaaagaattgagagttttagagaagcttctattaaaggttgggagtatgcactaaaacacaaagaagagctggtagatattattttaaaaaaatacaatactcagaacaaaacaaaggaggcattactttttgaatcaaagcagatagaatatctaatgttaacacatatttatccaataggaagtattgatttagatcgagtccaaatgatagcagatagttttgcacaatctttacttatccctaaagagtcaaaaaagaatcttgagtcttttatctataaagcagaaaaaagtatttttttattaacaaaagagcaaagaaaatacctaaaagataaaaaacaaattaaaatgtgtgtagacccaaactggatgcctttagaaaaaatagaagatggaaaacatatagggttagcagcggacattatggatttggtctcaaaaagaatagataccccaatacagttagtacctacgcaaagctggtctcaaactcttaatagtgtaaaaagtagaaaatgtgatatcttggcacttgcagaaaaaactccctcaagagaaaactactttaactttacaacccttaatataaaagtcccttttaataattcgctacaaaaaaaggggcaacttttttattag

SEQ ID NO: 14264 - protein, 336 aa, Unknown
  Obtained from environmental sample
  misc_feature (1)..(336): Xaa is any amino acid
MLQTLFKQSPLVLVTQKNIKTPADLKGKKIMGLLDSSHKQVVLTMLDKFNMTADDFQNIPRKFSIESFKNKKVDALSVFTTNEIYTLDKLGIQYNILDPAAFGTKFYDLNLFTTKSELKNNPKRIESFREASIKGWEYALKHKEELVDIILKKYNTQNKTKEALLFESKQIEYLMLTHIYPIGSIDLDRVQMIADSFAQSLLIPKESKKNLESFIYKAEKSIFLLTKEQRKYLKDKKQIKMCVDPNWMPLEKIEDGKHIGLAADIMDLVSKRIDTPIQLVPTQSWSQTLNSVKSRKCDILALAEKTPSRENYFNFTTLNIKVPFNNSLQKKGQLFY

SEQ ID NO: 14265 - DNA, 465 bp, Unknown; identical to SEQ ID NO: 7019
  Obtained from environmental sample
  misc_feature (1)..(465): n is a, c, g, or t

SEQ ID NO: 14266 - protein, 154 aa, Unknown; identical to SEQ ID NO: 7020
  Obtained from environmental sample
  misc_feature (1)..(154): Xaa is any amino acid

SEQ ID NO: 14267 - DNA, 531 bp, Unknown
  Obtained from environmental sample
  misc_feature (1)..(531): n is a, c, g, or t
atgagtaacaaatctgtgatttcaacactaataataagcatattctttacagcttgtacggatcaaaaagaagcaaataatcaaaactttacaaatgcacttaacgaatatgttaaaactggtaaacaccaattaaattgttttcatgttggttataattttcccttaattaaaaatacatttaatgaaaaatctattgaaaaatcaaaacaacaaggttttttagttgaatcaaaagcacaagttgcaaatacactactaacacaaatcaaaggttccaatccatacggaataggttggagaccgccaaaagaacaagaagaaaaaaaatacactgaaaaaactgtttacaatctgaatagtaaagcaaaaaaatattacaaagatggttatgtatgtttaggaaaagcaaaaataaatgaagtaataagttttactgaattaataacaataagctcatataaattaacaaatgtaaaattctcatatactattgaagatcttccaaattggggtaaacatagaggataa

SEQ ID NO: 14268 - protein, 176 aa, Unknown
  Obtained from environmental sample
  SIGNAL (1)...(20)
  misc_feature (1)..(176): Xaa is any amino acid
MSNKSVISTLIISIFFTACTDQKEANNQNFTNALNEYVKTGKHQLNCFHVGYNFPLIKNTFNEKSIEKSKQQGFLVESKAQVANTLLTQIKGSNPYGIGWRPPKEQEEKKYTEKTVYNLNSKAKKYYKDGYVCLGKAKINEVISFTELITISSYKLTNVKFSYTIEDLPNWGKHRG

SEQ ID NO: 14269 - DNA, 879 bp, Unknown
  Obtained from environmental sample
  misc_feature (1)..(879): n is a, c, g, or t
ttgcgcaaacccactggtggcatttacatcccgggaaggcttttctgtttttatttaccatttttgggtgttaattgcatgattcgcaagaaacgccttaaagtacttacatacttttttgtgcttatcaacgtggttttaatttctcaaggattatttgaatcttcaaaaaccggctcattttggcttaagcccaaactacttaatgactcatccaattccatttcattttcaaaagaaaaagacaatgttgtttttataattgttgatatgtttcatggttggtatatgaaaaagatactggaggaaaaccctgatttgaaagatgtattcggcgggtttgtgtggtatccaaacacgctttctatatcattcatcacaagctcatccattgctccaattttgggtggttttgattataccatcgataagctgaataaagataaaacccataccatggaaagtaaaatcacggatgtttccgaagcttttttacataaaataaaatccaagggatacaattttaccggcaacaaatttatttactcaaaaattgacaagaatagattcgatactttccttcccgaatggcatgatgactggaatcaatggaacggagatttaaatattggtgtgcctagagaattgggatacaccatactttgggaaaatgcgactttttatagcgccccactatttttaaaacctttggtatataataatggccgttggatgcataaaaccattgaaccaaatgagaatacaacccaggcaaaacattataattttttaaggttacttccctttatttccaatgccgaaagtgataagcccaactttattatctgcattccatggcatcgcctcgagccgatctga

SEQ ID NO: 14270 - protein, 292 aa, Unknown
  Obtained from environmental sample
  misc_feature (1)..(292): Xaa is any amino acid
MRKPTGGIYIPGRLFCFYLPFLGVNCMIRKKRLKVLTYFFVLINVVLISQGLFESSKTGSFWLKPKLLNDSSNSISFSKEKDNVVFIIVDMFHGWYMKKILEENPDLKDVFGGFVWYPNTLSISFITSSSIAPILGGFDYTIDKLNKDKTHTMESKITDVSEAFLHKIKSKGYNFTGNKFIYSKIDKNRFDTFLPEWHDDWNQWNGDLNIGVPRELGYTILWENATFYSAPLFLKPLVYNNGRWMHKTIEPNENTTQAKHYNFLRLLPFISNAESDKPNFIICIPWHRLEPI

SEQ ID NO: 14271 - DNA, 372 bp, Unknown
  Obtained from environmental sample
  misc_feature (1)..(372): n is a, c, g, or t
atgacagaagaaaaatttatacatgatagccagactgttttaaagtttattcaatgctactgtgatggtgagcattctaaaaataaaagaaacagaaattctatcgaacttaactacaataataaaaacttgaacgaagtaatacacttcaacttgtgtgaaaagtgtgaagagactcttcactactcatacgtcaaacttcaagcatgcccgcatgatgaaaaaccaagctgtaggcaatgtccaaaaccatgctatgataaaccagaatggaaacatttagcaaaaatcatgagatacagtggtctaagactcggtatcattaaaataagaaaaaagatttttgataggtttattaagaagagtgcttaa

SEQ ID NO: 14272 - protein, 123 aa, Unknown
  Obtained from environmental sample
  misc_feature (1)..(123): Xaa is any amino acid
MTEEKFIHDSQTVLKFIQCYCDGEHSKNKRNRNSIELNYNNKNLNEVIHFNLCEKCEETLHYSYVKLQACPHDEKPSCRQCPKPCYDKPEWKHLAKIMRYSGLRLGIIKIRKKIFDRFIKKSA

SEQ ID NO: 14273 - DNA, 474 bp, Unknown
  Obtained from environmental sample
  misc_feature (1)..(474): n is a, c, g, or t
atgaataaagttaataatagtactatattaagccataaagagcaaatcttaaaaataattaaaaatagacaaactgatgctatctttacttataaagtgtttcgtttaatcgaaaataaaaatgcacttaggtctgttatgtctagatttgaaaaagatggaacgattgtaaagcttgaagatggagttttttacagaccaaagcagatatgttttgtaaaacaatcagttaaagagtccaacattagcaaaacactctttgtacatgatcatttttggtcagtagggaataagcgtaaagttagtatagaccagctcatagaagcttatgttcttcatccaaacagtgacgacatctacactatatataaactctttggctataagcgagtaagagttattttagaaaaagtgtataaaaaacttacatttaatgatgatggagttatccgtaaacacccagttataaactag

SEQ ID NO: 14274 - protein, 157 aa, Unknown
  Obtained from environmental sample
  misc_feature (1)..(157): Xaa is any amino acid
MNKVNNSTILSHKEQILKIIKNRQTDAIFTYKVFRLIENKNALRSVMSRFEKDGTIVKLEDGVFYRPKQICFVKQSVKESNISKTLFVHDHFWSVGNKRKVSIDQLIEAYVLHPNSDDIYTIYKLFGYKRVRVILEKVYKKLTFNDDGVIRKHPVIN

SEQ ID NO: 14275 - DNA, 864 bp, Unknown
  Obtained from environmental sample
  misc_feature (1)..(864): n is a, c, g, or t
atgcactctcctataataactatagaagcaagtagtagtgtgcatgatatgataagtattatgaaaaaaaatcatataagaagggtagttgcatataataaaagtttaaatatgtatcacattcttaattcaaaagatttaatcagtaacttaaaaggaaattatactcagtttttagaatcaaaaatatttgatacaagagatacttttaattctctctctgaatctattattgagttaatagatatggatgatgagcaaataatttattggaccaactctattactaaagatacttttcaaataaatattgatgataatattacccaaattataccaaaagagatttgggagaaactattttctcaacttttagacaataaagaaatattagaaacaataatcattgacaacaaatattttcaactcaaagggcactatgggacaattttagacaataaaataataaaactttttttatatgatataacagatattacacttctaaatcaaaaactacaactccaaaatgagattcaaagaaaacttctttttgatcaacaaaaaatggtacagatgggtgagatgattagcaatattgcccatcaatggagacaaccactaagtacaatctctgttgctgctagtggtatgcaatttaaaaaagattatggtattttagaagatgatgaatttagtggttttacttcaaatatcattaacaatgttgagtatctttcaaagaccatagatacctttagaaaatttttaaaaagaggaaaaaagagtttcaaagagggttatcttaggaagataggattccaaaattccccttacctatttggaaagttaccctcctttaaa

SEQ ID NO: 14276 - protein, 288 aa, Unknown
  Obtained from environmental sample
  DOMAIN (192)...(262): His Kinase A (phosphoacceptor) domain
  misc_feature (1)..(288): Xaa is any amino acid
MHSPIITIEASSSVHDMISIMKKNHIRRVVAYNKSLNMYHILNSKDLISNLKGNYTQFLESKIFDTRDTFNSLSESIIELIDMDDEQIIYWTNSITKDTFQINIDDNITQIIPKEIWEKLFSQLLDNKEILETIIIDNKYFQLKGHYGTILDNKIIKLFLYDITDITLLNQKLQLQNEIQRKLLFDQQKMVQMGEMISNIAHQWRQPLSTISVAASGMQFKKDYGILEDDEFSGFTSNIINNVEYLSKTIDTFRKFLKRGKKSFKEGYLRKIGFQNSPYLFGKLPSFK

SEQ ID NO: 14277 - DNA, 840 bp, Unknown
  Obtained from environmental sample
  misc_feature (1)..(840): n is a, c, g, or t
ttgaaaaggattgatggctcgganacaattaactcttctcaggttcaagctacagataaaagtgtttttgaagttatggagaagaccatttttgaatttatgaatagtcgaaaatggaccaaccacatttatcagccaaatgaaagaattgaatgctctatcttaattaatgtaaatgagatggtttctgctacagaatttaaagctactattcaaattcaatctaggagaccaatttttaatacttcttacaatagtaccttgctcaaccatattgataaagaatttgattttaggtttaatgagtttgataatttacaatattctgaaaattcgcatatttctaaccttacttctgtattggctttttatgcttacattattattggtttagattatgattcttttgaattaaaaggcgggactccttatttgttacaagcacaaaaaattgtttctaacgctcagggagctggagagccaggttggaaagcttttgaaaacaacaccaataggtattggatagtgcaagatttattacacccaactcacgaatcattaagacaatgctattacgattaccaccgcttaggttttgatgaaatggctaaagatgtagcaaaaggtagagcaaaagtattagagagcttaaaacttttagacaatgtctataaagccaaaccaggagcttttcatttgcaagttttctttaattccaaagccgatgaaattgtaaacctctttaaagacggacttgcaaatgagaaaaacgaggtaattaccctcctcgacaaaataaaccccatgaatgggagtaaatataaagagattaggaagtaa

SEQ ID NO: 14278 - protein, 279 aa, Unknown
  Obtained from environmental sample
  misc_feature (1)..(279): Xaa is any amino acid
MKRIDGSXTINSSQVQATDKSVFEVMEKTIFEFMNSRKWTNHIYQPNERIECSILINVNEMVSATEFKATIQIQSRRPIFNTSYNSTLLNHIDKEFDFRFNEFDNLQYSENSHISNLTSVLAFYAYIIIGLDYDSFELKGGTPYLLQAQKIVSNAQGAGEPGWKAFENNTNRYWIVQDLLHPTHESLRQCYYDYHRLGFDEMAKDVAKGRAKVLESLKLLDNVYKAKPGAFHLQVFFNSKADEIVNLFKDGLANEKNEVITLLDKINPMNGSKYKEIRK

SEQ ID NO: 14279 - DNA, 921 bp, Unknown
  Obtained from environmental sample
  misc_feature (1)..(921): n is a, c, g, or t
atgattttttggggattaggaattactgaaaatattgatggtagttatgcagttatgtctatagtaaatctagctcttatgactggaaatattggaaaaataggcgctggacttatgcctttaagaggtcaaaataatgttcaaggaacctgtgatatgggatgtcttccttactatggtcctgattatacaaagccaaaagaggatggacttaaaactccagaccttatggatgatatgcttgaagataaaataaaagcaatggtagttatgggagaagatacagctcatatacatccaaatttaaataaagtcaacaaagctttagaaaacttagaacttcttatcactcaagatttatttatgaacgaaatagcaaaaaagtcagatatagtctttggtgtaaaatcagcttatgaaaaaactggtgtatatgtaaatgctatgagaagattacatttatctcaaccactagttgaaaataacttaccagatgattggcaagttttaagagatattgaaaataaaatcaaaggtgagttcctctttaaatcaagcgaagatgtgtgggagcaagtaagagttgaagctccatatagatatggaggtgcaagttatcacaaactaatgaaacatagaagtaaagggatgcaatggccagtcgctaaagatgatacacctattttacatcttgaaaaattcaatacaccagatggtcttggaacttttaaatacaatggttaccaacttcgtggtcaaataaaaaagttaatagagggtgaaaagttcgatacattttatctaacaacaggtagaaatctaatccattantacaattcagcgcaaacaaaagagagtccaaaactctatgaaaaacatagtgaagatactattttagcctgtatagaagatagagattaa

SEQ ID NO: 14280 - protein, 306 aa, Unknown
  Obtained from environmental sample
  misc_feature (1)..(306): Xaa is any amino acid
MIFWGLGITENIDGSYAVMSIVNLALMTGNIGKIGAGLMPLRGQNNVQGTCDMGCLPYYGPDYTKPKEDGLKTPDLMDDMLEDKIKAMVVMGEDTAHIHPNLNKVNKALENLELLITQDLFMNEIAKKSDIVFGVKSAYEKTGVYVNAMRRLHLSQPLVENNLPDDWQVLRDIENKIKGEFLFKSSEDVWEQVRVEAPYRYGGASYHKLMKHRSKGMQWPVAKDDTPILHLEKFNTPDGLGTFKYNGYQLRGQIKKLIEGEKFDTFYLTTGRNLIHXYNSAQTKESPKLYEKHSEDTILACIEDRD

SEQ ID NO: 14281 - DNA, 693 bp, Unknown
  Obtained from environmental sample
  misc_feature (1)..(693): n is a, c, g, or t
atgaatacaataaaacaattaactcaaaatatccaagagttagaaaacatgaaaaaatatcccaaagagatattttatataggtaacttagaacttctaaaaagagaaaaagtttctatagtaggaagtcgtcgtcccacaccctatacaaaacaatacacaaatgatattgcaaaaaaactatcacaaaataatattgtcatagtgagtggagctgctatgggtgttgatgctattgcacatacatctgcaggggctaaaagtacaataggggtagctggtaatggactagatatccgatatccaataataaacaataagcttatccaagatatagaacaaaaaggtttaatgctcagtcaattcaaaccagaaactccctcaattcattacaatttcccaatccgcaatgaattagtagtagctttaggagatatacttattgttactcaagcagatgtagacagtggtaccatgagaagtgttgagtatgctttaaagatggggaaagagatttttgtattacctcatagagtaggagagagtgaaggaacaaataaacttcttataaacaatcaagcaaaagctatctatgatgtagatgaatttatcaatagtatctgtgcttgtactgatgactatggagttgaagatgatttttttattatatggaaaaccaatcctaacctatga

SEQ ID NO: 14282 - protein, 230 aa, Unknown
  Obtained from environmental sample
  DOMAIN (3)...(198): SMF family
  misc_feature (1)..(230): Xaa is any amino acid
MNTIKQLTQNIQELENMKKYPKEIFYIGNLELLKREKVSIVGSRRPTPYTKQYTNDIAKKLSQNNIVIVSGAAMGVDAIAHTSAGAKSTIGVAGNGLDIRYPIINNKLIQDIEQKGLMLSQFKPETPSIHYNFPIRNELVVALGDILIVTQADVDSGTMRSVEYALKMGKEIFVLPHRVGESEGTNKLLINNQAKAIYDVDEFINSICACTDDYGVEDDFFIIWKTNPNL

SEQ ID NO: 14283 - DNA, 888 bp, Unknown
  Obtained from environmental sample
  misc_feature (1)..(888): n is a, c, g, or t
atggctgttaaaattatagaggttacagaaaccaaacactttaaagattttgtaaatgttcagtttgaaatttacaaaggcaataatttttgggttccaccaatcaaaaaagatgaagttaaagctattcaaagtgcttataaccctgctttcagattttgtaaagctaagttntgggtcgcttataaagacaataaatgtgttggaagaattggagccattattaatgaacaatacaacgaaaaaactggcgaaaaagcaggacgctttactcgattagaattttttaatgatgaagaagtagttaaaaacttacttcaaactgctgaagaatggcttaaatctgaaggaatgactaaagtgttaggtccattaggttttactaacctcgatcaccaaggaatgttggtagaaggtttcgaccatttaccatcagcagcatcggaataccatttgccatactataaagattatatggaaaagttgggctaccaaaaagaaattgattggatagaattccgtttatttttagaaggtattcctgataaagccaaaagagtagccgaagtaataaaaaccagaaaccagcttacagttaaaagctttacaaaaacaagtgaattacaaccttttgctgtaaaactttttgagattttaaatgaagcgtttaaggatttgtttagcgtggtacatctcgatagagaaatgataaattactatgttaagcgttatttaatgatgcttaatcctcaatttgtaaaattaattttcgataaagatgaccaattagtcgcttttattattggcttaccatctttgtcagaaggcttacaaaaagccaacggaaaaatttttccgtttggtggtaccaatcccgagccgatctga

SEQ ID NO: 14284 - protein, 295 aa, Unknown
  Obtained from environmental sample
  misc_feature (1)..(295): Xaa is any amino acid
MAVKIIEVTETKHFKDFVNVQFEIYKGNNFWVPPIKKDEVKAIQSAYNPAFRFCKAKXWVAYKDNKCVGRIGAIINEQYNEKTGEKAGRFTRLEFFNDEEVVKNLLQTAEEWLKSEGMTKVLGPLGFTNLDHQGMLVEGFDHLPSAASEYHLPYYKDYMEKLGYQKEIDWIEFRLFLEGIPDKAKRVAEVIKTRNQLTVKSFTKTSELQPFAVKLFEILNEAFKDLFSVVHLDREMINYYVKRYLMMLNPQFVKLIFDKDDQLVAFIIGLPSLSEGLQKANGKIFPFGGTNPEPI

SEQ ID NO: 14285 - DNA, 513 bp, Unknown
  Obtained from environmental sample
  misc_feature (1)..(513): n is a, c, g, or t
atgattaaaaaattcatgatagtaactattgcttatcttaatatatatgcaatgtatccagtaacagatattacaagttatcaatatttaataagtggtattaagcaatatactcaaatgattaatggtattactcaacaaatacaatcacttggaggtattcgtagttcaattgaagatttaaaagagggacttaactctgcaaaatcagaattgacagggtctttaaaatcattggaaaatgcaaggaataatttaaaagacacagttgataatacagaaataaaaagtttatttgatatgaatgctgcacgaaaaagtgcaactgggactggtatagcttatggtgatatatcaaaagtattttctgatgcttttaaaaaagcagatgatggactcataaaattatttggtggtgaatcaaaggctgaagagtttttgtcgaaacaatatacaataaataaagctctcaatgaaaatactattggaagagtttttaaaagctatgaatag

SEQ ID NO: 14286 - protein, 170 aa, Unknown
  Obtained from environmental sample
  misc_feature (1)..(170): Xaa is any amino acid
MIKKFMIVTIAYLNIYAMYPVTDITSYQYLISGIKQYTQMINGITQQIQSLGGIRSSIEDLKEGLNSAKSELTGSLKSLENARNNLKDTVDNTEIKSLFDMNAARKSATGTGIAYGDISKVFSDAFKKADDGLIKLFGGESKAEEFLSKQYTINKALNENTIGRVFKSYE

SEQ ID NO: 14287 - DNA, 846 bp, Unknown
  Obtained from environmental sample
  misc_feature (1)..(846): n is a, c, g, or t
ttgaaggtgttggtgtcaatgggtaaaaatgatcctaaagatcatctgaattgtggggcttgtggatatgaatcgtgtgaagaacatgctgtggctattgttcagggattggcagagaacgaaatgtgcttgccacatacaattgagaaactacataattctgtaaatgagttagcagttacaaacgataaattaagttcaatacaacaggcattaaagcaatcggagaaaatggcaagtatggggcagttatcagcaggaatagctcatgaattaaataacccactaggtgttgttattatgtatgccaatatcttgctcgaagattcatcaatagattctcaaatttataaggatttgaaattaattgtagatcaaacaaataggtgtaagaagattgttggaggcttattgaattttgctagaaaaaatcaagtaaacacaagtaaacttaatattattaaatttgcagagcaaagtgttcaagctgttgtaatccctaaagaaattgaaataagtattagctcggagaatttaaatgatccttatgcaatgttcgatcatgagcaaatgacacaagttcttacaaatcttataaaaaatgctatagatgcaatgcctacaggaggttctgttaacatagtattggaaggagatcaaaacaatatatttgttatcgtaaaagataccggagttggaattgatcaagaatctttagataaaatatttgaacctttttataccacaaagagtattggtatgggaacaggtttgggattagctactgcatatggaatagtaaaaatgcataaggggaaaatactgtacaatctaataatgatatag

SEQ ID NO: 14288 - protein, 281 aa, Unknown
  Obtained from environmental sample
  DOMAIN (15)...(46): Putative Fe-S cluster
  misc_feature (1)..(281): Xaa is any amino acid
MKVLVSMGKNDPKDHLNCGACGYESCEEHAVAIVQGLAENEMCLPHTIEKLHNSVNELAVTNDKLSSIQQALKQSEKMASMGQLSAGIAHELNNPLGVVIMYANILLEDSSIDSQIYKDLKLIVDQTNRCKKIVGGLLNFARKNQVNTSKLNIIKFAEQSVQAVVIPKEIEISISSENLNDPYAMFDHEQMTQVLTNLIKNAIDAMPTGGSVNIVLEGDQNNIFVIVKDTGVGIDQESLDKIFEPFYTTKSIGMGTGLGLATAYGIVKMHKGKILYNLIMI

SEQ ID NO: 14289 - DNA, 381 bp, Unknown
  Obtained from environmental sample
  misc_feature (1)..(381): n is a, c, g, or t
atgaattttaaaataaaatttgtaatttttagtgaagatcaaaaaaagtttataaaagatgataatgagtatattttcgagttagatgaagagtttgaagagagttatacaactttagaaaaaaatgataaaaatatctacaatttttttaaaaatgagaagagtttcttaaaatggctaaaagaggaagtttatccagattatgaatctgcagagataggaatatcatttatagatgatattagctatttgcgtttttggttctttaaagttgagagtggtgatgctcattacgaatattttatggactattttagtatattttatgatgatctatatgattcaagagccggtataggtgaggagatagtgaaaaactaa

SEQ ID NO: 14290 - protein, 126 aa, Unknown
  Obtained from environmental sample
  misc_feature (1)..(126): Xaa is any amino acid
MNFKIKFVIFSEDQKKFIKDDNEYIFELDEEFEESYTTLEKNDKNIYNFFKNEKSFLKWLKEEVYPDYESAEIGISFIDDISYLRFWFFKVESGDAHYEYFMDYFSIFYDDLYDSRAGIGEEIVKN

SEQ ID NO: 14291 - DNA, 693 bp, Unknown
  Obtained from environmental sample
  misc_feature (1)..(693): n is a, c, g, or t
atgaaaatccctatatgggaccacaggaagggcaaaagcccaaatgcaaacgtgaaccccttcataaagaagagagtccagtcacacaatccagacatcatctgcattaccgaaggcgatcccgcaatgtgggaagagtttggccatatcataacggcagaagaggactacggttatccgattaaagctgggcgtcgcaaggccttcttaatctctaaaaagccttggagcaatgtagatacccgagggagtgataagctcccctcaggacgctttattcgaggcacaacacagggaattgatgttgtcggtgtctgtatcccttggagttttgctcatgtgaaggggggacataagaatagatctccctgggaagaccattcgctctatcttgatgggcttaaggatatcttaccagaactacctacttctgcagtggtaatgggagatttcaatcagcggataccacgaaagtatgcaaccattgcgatgtacgagaaactacaacagacctttaaaggatttgatatacatactaacggactacttcagcccatcaataaatactcaatagatcacttctattcaaaaagggagtttcgagttactggtgtaacgacgattgataatttccaagatggtgtgaaattgtctgatcattttggtgttgttgttgagggggagtctaaataa

SEQ ID NO: 14292 - protein, 230 aa, Unknown
  Obtained from environmental sample
  misc_feature (1)..(230): Xaa is any amino acid
MKIPIWDHRKGKSPNANVNPFIKKRVQSHNPDIICITEGDPAMWEEFGHIITAEEDYGYPIKAGRRKAFLISKKPWSNVDTRGSDKLPSGRFIRGTTQGIDVVGVCIPWSFAHVKGGHKNRSPWEDHSLYLDGLKDILPELPTSAVVMGDFNQRIPRKYATIAMYEKLQQTFKGFDIHTNGLLQPINKYSIDHFYSKREFRVTGVTTIDNFQDGVKLSDHFGVVVEGESK

SEQ ID NO: 14293 - DNA, 600 bp, Unknown
  Obtained from environmental sample
  misc_feature (1)..(600): n is a, c, g, or t
atgtttacagcattatcaaaaaaatttaatgtggttatgatagcagttttatttgttattggtgcggttagtttaaatggtgcagttttaaaaatagataaaagccactctgaagttggtttttctataaaacaccttatgattacaaatgtaaatggtgacttttcagactatgatgcagatattatatacgatgtagaaagtaaaaaatttgaaaaattcaatgcttcagttatgacagcaagtattgatactggcattgaaaaaagagacaaccatttacgaagtgttgatttttttgaggtagaaaaatacccaaaaatgacttttactatgagttcctatactactgatggaacggaaggtgtccttagtggagatttaacaatccacggtgttacaaaaaaagtaacttttgaagttgaaaacaatggaatgataaaagatccatggggaaatacaagaactgcttttacacttgaaacaaaaatcaatagaaaagattttggtcttaattggaacaaagctttagaggcaggtggtgtacttgttggtgataaagtaaaaattacaatagaaattgaggctatagtacaataa

SEQ ID NO: 14294 - protein, 199 aa, Unknown
  Obtained from environmental sample
  DOMAIN (27)...(199): YceI like family
  misc_feature (1)..(199): Xaa is any amino acid
MFTALSKKFNVVMIAVLFVIGAVSLNGAVLKIDKSHSEVGFSIKHLMITNVNGDFSDYDADIIYDVESKKFEKFNASVMTASIDTGIEKRDNHLRSVDFFEVEKYPKMTFTMSSYTTDGTEGVLSGDLTIHGVTKKVTFEVENNGMIKDPWGNTRTAFTLETKINRKDFGLNWNKALEAGGVLVGDKVKITIEIEAIVQ

SEQ ID NO: 14295 - DNA, 780 bp, Unknown
  Obtained from environmental sample
  misc_feature (1)..(780): n is a, c, g, or t
ttgaaaaataagaaatnctggaaaaattttactggtaatatcaatgatttagaagagatagcatctcttgatactatgagtgaagtgattttatggattttagataaagcacaaaaagtatttacagaagttgatgagagctttagagagtatgattatagccgtggtttaaatagattgaatcactttttagtagcagagttatcaaatgtatatattgatgtatgtaaagataaaatgtattgtgatggaaaagattcaacaacaagagttgcaagtgtaagtgctatggcaatgattgcaaaagctttcataactactttagcaccggttttaacatacacaatggatgagttgattcaacacgcaccaaaagttatcactgatggtgtgacatctatttttgatatgaaaaaatattatttacctgaagttaaaataaatcttaatgaaatacatttattagaagcaaaaagtaaatttgcagaaataaaagataaacttaacaaagagaaagttataaaatcaactttagagttagttatctatacaaatagtgaagatgtattagcaatggatagtactctagctgaagactggtttgttgtgagtaaaataatttcagataaacaagaagataatttaggttattttgaagttgatggaaaagcttttgaagtatataaagcaagtgaacacaaatgtcctagatgttggaagtttagagcatcaactgaagaggctttatgtggaagatgtgacggggttgtaaactcttaa

SEQ ID NO: 14296 - protein, 259 aa, Unknown
  Obtained from environmental sample
  DOMAIN (232)...(256): Zinc finger found in FPG and IleRS
  misc_feature (1)..(259): Xaa is any amino acid
MKNKKXWKNFTGNINDLEEIASLDTMSEVILWILDKAQKVFTEVDESFREYDYSRGLNRLNHFLVAELSNVYIDVCKDKMYCDGKDSTTRVASVSAMAMIAKAFITTLAPVLTYTMDELIQHAPKVITDGVTSIFDMKKYYLPEVKINLNEIHLLEAKSKFAEIKDKLNKEKVIKSTLELVIYTNSEDVLAMDSTLAEDWFVVSKIISDKQEDNLGYFEVDGKAFEVYKASEHKCPRCWKFRASTEEALCGRCDGVVNS

SEQ ID NO: 14297 - DNA, 840 bp, Unknown
  Obtained from environmental sample
  misc_feature (1)..(840): n is a, c, g, or t
gtgagcacggcaatcgggggcaaaaatgtcgtcgtgagtcgaggtccggatgcaccatggagtacggtggacattacggttggcaagaaagctttcggagtgagcatcgacggtcagagttgtgttgtacaggatgtcacgctgttgcccattaagaagataacgttttatggctaccgagttaagtttgaaattgatgacataacggtcactccattagaggaaaaaccggtgaaattgatagagaaacccgtttttttcgcatccttcgacaacacgcttgatgctattgacgcagatggtaaaaccatttctcctgtaaagccagctggctatagatttttacctggtgtttccggcaagggtttttcttgcggacagaaccttatccgcattggcctcaagtatgcaccgaagcagtggaaagtcactgcagaagaggagtttttaggggcgaacagcgctgttgacgtttttgttcctaatttgaaagattttgagtttgaggctaccttccagagacttggcaatgttccgtgccaagaccaccattttaacttcggaatctcttctgcaggaggtaactcatttggtatccacgtgcgcgataattcctggatttataagataaacaaaccaggcgaaaaacacaagtcgttcaaggcggatcatactgtaaaagacaacttggatgaaaaacctattcattttaaattggttcgcaaagataacttgctaacactttatctcgatggcaaaagctacgacctaggtgaggctgatttgggcgatgtgagttctttaagttttcaacggctatggtgtgaaatacaagattga

SEQ ID NO: 14298 - protein, 279 aa, Unknown
  Obtained from environmental sample
  misc_feature (1)..(279): Xaa is any amino acid
MSTAIGGKNVVVSRGPDAPWSTVDITVGKKAFGVSIDGQSCVVQDVTLLPIKKITFYGYRVKFEIDDITVTPLEEKPVKLIEKPVFFASFDNTLDAIDADGKTISPVKPAGYRFLPGVSGKGFSCGQNLIRIGLKYAPKQWKVTAEEEFLGANSAVDVFVPNLKDFEFEATFQRLGNVPCQDHHFNFGISSAGGNSFGIHVRDNSWIYKINKPGEKHKSFKADHTVKDNLDEKPIHFKLVRKDNLLTLYLDGKSYDLGEADLGDVSSLSFQRLWCEIQD

SEQ ID NO: 14299 - DNA, 414 bp, Unknown
  Obtained from environmental sample
  misc_feature (1)..(414): n is a, c, g, or t
atgaaaagtatcgatagaattgatattacccaaaaacgacctatcccaattggtgcaaaagttgcaattcttctagctgtgatttttggaatctggcttcgttcaacctggataaaacagcaaccttatactttacgcatctataatatccacgcaactgaagttacttccagcagcatcgaggtaaaatttgatgtttctaaccctaatgatatcgagattaataagaatattttgataagagcctacactgccaaaggtgaaatcatttcggatcgtatcacaaaaattgtagctttacctaaatctaagcaaactcacctgaaaatgttgaacatcctcaatgttccgatcaaagatatttctgatgttgcaaatattactgtagaaatctacataccatcagtattctaa

SEQ ID NO: 14300 - protein, 137 aa, Unknown
  Obtained from environmental sample
  misc_feature (1)..(137): Xaa is any amino acid
MKSIDRIDITQKRPIPIGAKVAILLAVIFGIWLRSTWIKQQPYTLRIYNIHATEVTSSSIEVKFDVSNPNDIEINKNILIRAYTAKGEIISDRITKIVALPKSKQTHLKMLNILNVPIKDISDVANITVEIYIPSVF

SEQ ID NO: 14301 - DNA, 984 bp, Unknown
  Obtained from environmental sample
  misc_feature (1)..(984): n is a, c, g, or t
atgattttaaaacctgaagatatgacagagaataaaccttacgatcagttgatgcttgagttgaaagagagggcaaaagaactcaactgcctttaccaggtgcaggaattattgatagatccaaataacagtactaaggatatttgtgaaggcctcgttgatgtaattccaccgggctggcaataccctgatatctgtaaagtaaaaatcaatttgcagggtaacagttatcaatctgaaggatttttggaaacggaatggatgcagaaatccgtcattaaggtgcaaaatgaaaccgttggtgaaatccgggtttattatctggaagaaacacccgaactggatgaaggcacctttttgaaagaagaacgtaagttgatcgataccatcgccgaaaggttgggactacaccttttacattttcaactgaaatccgttttcgaggaaaataaacttcccgataaggaaaagaaaagcgaatggacggttattcttgatatgctgcggcaaaccaatcccaagttcctcatcaggttatcccgaaagatggttaattatttatgttggacggggattaaggaagcggaaccattactgggaaagtttagtccgactttgaataatggcgatgacgcattagatgaaaacaggcctttcaagcgccgttctgatagtgacttgtatgaggtgagttatgcaatatttgagctggcaggaaaacaccttagtgaaggtaaaatactcgatagcattcaaaaatggaccaaagaagaccgttcaggctttttgtcgcaggttctggaaaatatgggttcttccctgctgnatatcagcaatgccattgaacgatatcaccaccctggaccacacatgctggaactgtcagaaccccgagaaaaaagtttacgggtagcattgatcaggcggttattaactggaccatctggctattttctatttgcaaacgcttgccgaattcgatag

SEQ ID NO: 14302 - protein, 327 aa, Unknown
  Obtained from environmental sample
  misc_feature (1)..(327): Xaa is any amino acid
MILKPEDMTENKPYDQLMLELKERAKELNCLYQVQELLIDPNNSTKDICEGLVDVIPPGWQYPDICKVKINLQGNSYQSEGFLETEWMQKSVIKVQNETVGEIRVYYLEETPELDEGTFLKEERKLIDTIAERLGLHLLHFQLKSVFEENKLPDKEKKSEWTVILDMLRQTNPKFLIRLSRKMVNYLCWTGIKEAEPLLGKFSPTLNNGDDALDENRPFKRRSDSDLYEVSYAIFELAGKHLSEGKILDSIQKWTKEDRSGFLSQVLENMGSSLLXISNAIERYHHPGPHMLELSEPREKSLRVALIRRLLTGPSGYFLFANACRIR

SEQ ID NO: 14303 - DNA, 339 bp, Unknown
  Obtained from environmental sample
  misc_feature (1)..(339): n is a, c, g, or t
atgcatattgacattacaccagaagtgatagtaactcaactagatttaggtcacggagaggcaacactaaaccaaaccaaaacagctataaacaatacaaaagattttgataaattctcaaaacatattataagtttaaatgataaattaaaacatatgcaaggatatattgccctttcaaatagtgcaccgtatttcaaaataaaatgtgataatatagaaagtgatgagatattaaaagaatttatagatgagcttaaccactggagtgataaatatgatgtagaactaaaaaaagttgacaataaagatgtttattatatcttaggaaaaaactaa

SEQ ID NO: 14304 - protein, 112 aa, Unknown
  Obtained from environmental sample
  misc_feature (1)..(112): Xaa is any amino acid
MHIDITPEVIVTQLDLGHGEATLNQTKTAINNTKDFDKFSKHIISLNDKLKHMQGYIALSNSAPYFKIKCDNIESDEILKEFIDELNHWSDKYDVELKKVDNKDVYYILGKN

SEQ ID NO: 14305 - DNA, 495 bp, Unknown
  Obtained from environmental sample
  misc_feature (1)..(495): n is a, c, g, or t
atgtgtcatctacagagtgctctccttatgcagtggtattctaaaataaatatgaaagatgcaaagtttttagctcctcttgtacttatgatggaatcaggtaagttgattcttgcaaatgaggtagtcaagagtgattactcagatatatttagaaaatcctttatagagtgtgaaaatatagaagagtttgaaaaagacctcatagaaaacacatcatactacatatgtgcaatactctttgagcattggaatcttgaacctatctatgtagagattttaaaagagctagattttcacaatgagtgtcatagaaatattcaaaagtttaaagagatcatagaagtaatcagaacagcaatcaatttaaaagagatactaacagaagagtctattaaaaaagcgtctaaaattgtatggagtatgaatttaagtgttgatgattttgaaaaagtggcaaatagaatcagagaagcatatataaatgcttcttaa

SEQ ID NO: 14306 - protein, 164 aa, Unknown
  Obtained from environmental sample
  misc_feature (1)..(164): Xaa is any amino acid
MCHLQSALLMQWYSKINMKDAKFLAPLVLMMESGKLILANEVVKSDYSDIFRKSFIECENIEEFEKDLIENTSYYICAILFEHWNLEPIYVEILKELDFHNECHRNIQKFKEIIEVIRTAINLKEILTEESIKKASKIVWSMNLSVDDFEKVANRIREAYINAS

SEQ ID NO: 14307 - DNA, 687 bp, Unknown; identical to SEQ ID NO: 9967
  Obtained from environmental sample
  misc_feature (1)..(687): n is a, c, g, or t

SEQ ID NO: 14308 - protein, 228 aa, Unknown; identical to SEQ ID NO: 9968
  Obtained from environmental sample
  misc_feature (1)..(228): Xaa is any amino acid

SEQ ID NO: 14309 - DNA, 693 bp, Unknown
  Obtained from environmental sample
  misc_feature (1)..(693): n is a, c, g, or t
atgacaaagcgtgtagagataaatgacaacattgaagagatagactccataaaagaggtatttaactctatgttagactccatagagtatcaattttactacgatactttaacaggattggaaaatagaagaaaattaacagagagattagagtctcgtataaactcatttttaatgatcataaatatcgactcttttcaagagataaatgatctttacggtgaggaagtcggagataatattcttaaagagtttgctctctttttacgagaaatcacacctcctaatggcttactatacagactgcactcagatgaatttgcccatctgtgtcaaagcaacatggagcttgatgattttaaattatttgcctcgctaataagtgaaaaaatctcaaataaaatttttaatgttgatacaaaagcagagatcagacttcgcgctaccatcgggatctcttatggttcagagctactgcttgctaatgcagatatcgcactaaaaattgctaaaaaaagtaaaaaagattatttagtctacgataatacaatggcaatggcaaaagagtatgagaaaaattttgattggactaaacgtctgcaaaaagcgatagaagagaataacatcgtacctgtatttcaacctattgtccgtattgagacaaaagaagttgtaagtatgaatcacttatga

SEQ ID NO: 14310 - protein, 230 aa, Unknown
  Obtained from environmental sample
  DOMAIN (28)...(177): GGDEF domain
  misc_feature (1)..(230): Xaa is any amino acid
MTKRVEINDNIEEIDSIKEVFNSMLDSIEYQFYYDTLTGLENRRKLTERLESRINSFLMIINIDSFQEINDLYGEEVGDNILKEFALFLREITPPNGLLYRLHSDEFAHLCQSNMELDDFKLFASLISEKISNKIFNVDTKAEIRLRATIGISYGSELLLANADIALKIAKKSKKDYLVYDNTMAMAKEYEKNFDWTKRLQKAIEENNIVPVFQPIVRIETKEVVSMNHL

SEQ ID NO: 14311 - DNA, 423 bp, Unknown
  Obtained from environmental sample
  misc_feature (1)..(423): n is a, c, g, or t
atgatgtcggcgcttttgcagcgaccagacacggcacgtgcgcgaccgtcatcactcctgaataacgacaccgaatacaagagtgttttctcggagaaaatactgcctcctgtattcttgaatgttattaagttcatgaagcgcatcgaagatctcatgaaagagatgtacccgggcagagatggccgaaaaatcatcaacaacactaagtactatgtacttatgctagcggcgaacaaattcgctgctgactccaagaacatggttaaatcgctggagactataaatatagatggcatcaaagaatccgagctaaaaaaagtaatccggtctgtcgaaaaagactacaatgatcttggtggtacggaccagatctcgaagggtcccgaactactcaaagccgtcaaaatccgcattgtttaa

SEQ ID NO: 14312 - protein, 140 aa, Unknown
  Obtained from environmental sample
  misc_feature (1)..(140): Xaa is any amino acid
MMSALLQRPDTARARPSSLLNNDTEYKSVFSEKILPPVFLNVIKFMKRIEDLMKEMYPGRDGRKIINNTKYYVLMLAANKFAADSKNMVKSLETINIDGIKESELKKVIRSVEKDYNDLGGTDQISKGPELLKAVKIRIV

SEQ ID NO: 14313 - DNA, 609 bp, Unknown
  Obtained from environmental sample
  misc_feature (1)..(609): n is a, c, g, or t
ttgaagagcttgggtgaaaaaaatattgaggtagtgggaaatataaagttagcaaatcttccaaaaattacaaaagagttagaaaaaccaaatggtataattataactgcaggaagtacccactttagcgaagaggaacttatcttaaactcttgggataaaagtatgggaaaacttatagttgtcccacgacatccagagagatttgatgaggtgtataatttaatagaaacagagtataaaaatagtgatgtaacctatcatcgatattctcaaaaagaggatctctctagtgatattgttttagttgatgctatgggacagcttaataatatctatgctataagtgatgtggtaattttaggtggtggttttattaaaagcgcagggggacataatccaattgagcctgctttttttggtacaatactcataagtggaaaaactatttttaatcaaaaatcactttttgagtgtgtaaatgattattatttaatagaaaatgaagagttacaaaccactcttgaaaatataaaagatttaaaaaaatcaagtttacaaaaagtaggttcaatagaacccataatccaagagattaaaaaaggataa

SEQ ID NO: 14314 - protein, 202 aa, Unknown
  Obtained from environmental sample
  misc_feature (1)..(202): Xaa is any amino acid
MKSLGEKNIEVVGNIKLANLPKITKELEKPNGIIITAGSTHFSEEELILNSWDKSMGKLIVVPRHPERFDEVYNLIETEYKNSDVTYHRYSQKEDLSSDIVLVDAMGQLNNIYAISDVVILGGGFIKSAGGHNPIEPAFFGTILISGKTIFNQKSLFECVNDYYLIENEELQTTLENIKDLKKSSLQKVGSIEPIIQEIKKG

SEQ ID NO: 14315 - DNA, 693 bp, Unknown
  Obtained from environmental sample
  misc_feature (1)..(693): n is a, c, g, or t
gtgtctgaaagcttgaaaaaagatacttatgagcattttgatacggaccgagatattcaagtaattcctaattttattcataatttggatgaaaaaactccttttgacttagagaaaagaagaaaatatgctgctgataacgaacgtatcatttgtcatgtttcgaactttagaccagtaaaaagagtagaggatgttgtacgtgtttttcataaaataaatcaagaagttccatcgagattactactaataggggatggtcctgagcgatataatgttgaactcttgtgccgtgaacttggaagttgtgaccgtgttatgaccgttgggaaaatcagaaacgcagctgatttgatgaagttgtcagatttgtttttactcccatctcaaacggaaagctttggtctggctgctctagaagcaatggctgttggagtgccagtaataagctcaaacacgggtggaattcctgaagttaatgaacatggttactctgggtttatgtctaatgttggagatattgatgacatggcttcaaacggaatagctttattgaaagatgaagaaaaacttaaattatttaaacaacaagctagaaagcaagcagaaaagttttgcattaccaaagtacttcctcaatatgaagagctatatgaaagcgtagttgctaatcataagaagttaattgtttaa

SEQ ID NO: 14316 - protein, 230 aa, Unknown
  Obtained from environmental sample
  DOMAIN (36)...(201): Glycosyl transferases group 1
  misc_feature (1)..(230): Xaa is any amino acid
MSESLKKDTYEHFDTDRDIQVIPNFIHNLDEKTPFDLEKRRKYAADNERIICHVSNFRPVKRVEDVVRVFHKINQEVPSRLLLIGDGPERYNVELLCRELGSCDRVMTVGKIRNAADLMKLSDLFLLPSQTESFGLAALEAMAVGVPVISSNTGGIPEVNEHGYSGFMSNVGDIDDMASNGIALLKDEEKLKLFKQQARKQAEKFCITKVLPQYEELYESVVANHKKLIV

SEQ ID NO: 14317 - DNA, 345 bp, Unknown
  Obtained from environmental sample
  misc_feature (1)..(345): n is a, c, g, or t
atggtcagatcggctcggtcattctccttactaacgacaatccacaacaaatacacatctctcggagtgttaacatcaggtttgtgtggtaatgaggttgttgtatctactactgactttcaaactaaaaacaaactatccatattcccaaatccatcatctgattacttgtttatctcaaatcttaaaaaagaggcacattacaccatacggaatgtgttaggaaaatcattcctccatgggtatgtttcagataaatccaaaattgatattggtaatttaatatctggaatctattttcttcaatttgacaatggaatatcgatgaagttcatcaaaaaataa

SEQ ID NO: 14318 - protein, 114 aa, Unknown
  Obtained from environmental sample
  misc_feature (1)..(114): Xaa is any amino acid
MVRSARSFSLLTTIHNKYTSLGVLTSGLCGNEVVVSTTDFQTKNKLSIFPNPSSDYLFISNLKKEAHYTIRNVLGKSFLHGYVSDKSKIDIGNLISGIYFLQFDNGISMKFIKK

SEQ ID NO: 14319 - DNA, 366 bp, Unknown
  Obtained from environmental sample
  misc_feature (1)..(366): n is a, c, g, or t
atgctcatgaagaagggctatgatattgttcaatatgatccattctttgctcctgatcaaaatatattgaataatatgtatgattatatctttagttgcgaggtgtttgaacattttcataaacccaaaatggaaatagatagccttacatcgttattaaaagctaatggaatgttgcttattatgacaatgttatatgatgaccagattgatttcaatacgtggaattatcgaaacgactctacacatgtttttatatatagaaaagaaacgatcgaatatattgcgaatgaaaagaaacttgaaatagttattttaacagatagatttatagcgttaagaaaaactggctacacgggctcataa

SEQ ID NO: 14320 - protein, 121 aa, Unknown
  Obtained from environmental sample
  misc_feature (1)..(121): Xaa is any amino acid
MLMKKGYDIVQYDPFFAPDQNILNNMYDYIFSCEVFEHFHKPKMEIDSLTSLLKANGMLLIMTMLYDDQIDFNTWNYRNDSTHVFIYRKETIEYIANEKKLEIVILTDRFIALRKTGYTGS

SEQ ID NO: 14321 - DNA, 441 bp, Unknown
  Obtained from environmental sample
  misc_feature (1)..(441): n is a, c, g, or t
ttgttgaacaacattaaaaataaaaattcaaattattacaatattcttgcaaatctgtatcgcaatatttcaacggagaaatcaatagaattatatgcagaagcagcaaaaatagagcagcataaaaaaaacaaagcgaaatactaccataatattgcatcattaatttatgaacaaaatcagaatgaaaagtttgaaatagctattgaatattgtaataaagcattagagtgtaatagaaattttgattattcaaagaaactaattttattcttaacagcatttcacgaacaagaaagccaggtaatgactaaaatcaatatcttaattgaaaaattcggatacaataagggaaaaatgcatcggaaaataataaatgaactgaaaaaatattctgaaacagaaagcaaagtagaactgttgaaaaaagaactaaaatga

SEQ ID NO: 14322 - protein, 146 aa, Unknown
  Obtained from environmental sample
  misc_feature (1)..(146): Xaa is any amino acid
MLNNIKNKNSNYYNILANLYRNISTEKSIELYAEAAKIEQHKKNKAKYYHNIASLIYEQNQNEKFEIAIEYCNKALECNRNFDYSKKLILFLTAFHEQESQVMTKINILIEKFGYNKGKMHRKIINELKKYSETESKVELLKKELK

SEQ ID NO: 14323 - DNA, 723 bp, Unknown
  Obtained from environmental sample
  misc_feature (1)..(723): n is a, c, g, or t
atgaatttaaactcacttagcacaaaaatcagagttgtttttatatttactctagctctatttttggcagtttttatcttttacacacaatttgaaaaacatcagattcatgctaaagcaggcagtaaccatgaaaagttaacgcactattttatggtaaacaggttacaaaaaaatgaagtaatagagtatatgaaaactcttgggtttactccagtgagagatccatttattgtttttgattatggtgagcatgtatattcaaacagaggattagagactatattttatcaagatagttactaccttcatgctatggctccacattttagattgctctttaaagatgctacaaattatgagaaaaattattttacctatttactatttgttttgattttcatcttgataataatgatctatttttggttaataaagagtctcaaaccgcttgaagatttaaaaaataagatatctaaatttgcaaaaggtgattttgagatagattgctccagtgataaaaaagatgagattgcagatgtggcaaatgagtttgatagtgcagtaaaaaaaatctctcttcttctaaaatcaagacagctttttttacgtactgttatgcatgagcttaaaactccaatcgctaaagggagaatcgtcagtgagctgatagatcaggagatacaaaaaaagcggatgataaccatttttgaaaaactttga

SEQ ID NO: 14324 - protein, 240 aa, Unknown
  Obtained from environmental sample
  DOMAIN (126)...(194): HAMP domain
  misc_feature (1)..(240): Xaa is any amino acid
MNLNSLSTKIRVVFIFTLALFLAVFIFYTQFEKHQIHAKAGSNHEKLTHYFMVNRLQKNEVIEYMKTLGFTPVRDPFIVFDYGEHVYSNRGLETIFYQDSYYLHAMAPHFRLLFKDATNYEKNYFTYLLFVLIFILIIMIYFWLIKSLKPLEDLKNKISKFAKGDFEIDCSSDKKDEIADVANEFDSAVKKISLLLKSRQLFLRTVMHELKTPIAKGRIVSELIDQEIQKKRMITIFEKL

SEQ ID NO: 14325 - DNA, 621 bp, Unknown
  Obtained from environmental sample
  misc_feature (1)..(621): n is a, c, g, or t
atgaaacattacatattaaaacaaatagcccattatataggcaactttacaactataaatcatattaaaagagtagaaaataatataataaaaattgaattcaatgatagaaaaacagtttattttgatctaacaaaaggaaattcttcagtttttatgaaaaacaataaagatataaacaagaaaatttttacagctccttttgatgttgtattacaaaaaaggtttaataactcgaaagtagaaaaggtatatttaagagatgatgataaagtattaaatatagtgacaaaaagcaaatcttcttataaagaacagaccactattttacagttagagtttacaggtaaaaatacaaatataattattcttgatacagaagatattgttttggaagctttacgacacatcgatgaatggacatcaacaagaattgtaaaagtgggacataagttaaaaaatcttgaaaaaccagattttacatatgagattaatagtattgagaatatagaagagtatttatttggtatttttgctcanaaaacactaaaagagttggaaaatactaaaaatcaaaaaattgctcagcttcaaaaacagattaaaaaaattaaaaaatag

SEQ ID NO: 14326 - protein, 206 aa, Unknown
  Obtained from environmental sample
  misc_feature (1)..(206): Xaa is any amino acid
MKHYILKQIAHYIGNFTTINHIKRVENNIIKIEFNDRKTVYFDLTKGNSSVFMKNNKDINKKIFTAPFDVVLQKRFNNSKVEKVYLRDDDKVLNIVTKSKSSYKEQTTILQLEFTGKNTNIIILDTEDIVLEALRHIDEWTSTRIVKVGHKLKNLEKPDFTYEINSIENIEEYLFGIFAXKTLKELENTKNQKIAQLQKQIKKIKK

SEQ ID NO: 14327 - DNA, 303 bp, Unknown; identical to SEQ ID NO: 12311
  Obtained from environmental sample
  misc_feature (1)..(303): n is a, c, g, or t

SEQ ID NO: 14328 - protein, 100 aa, Unknown; identical to SEQ ID NO: 12312
  Obtained from environmental sample
  misc_feature (1)..(100): Xaa is any amino acid

SEQ ID NO: 14329 - DNA, 468 bp, Unknown
  Obtained from environmental sample
  misc_feature (1)..(468): n is a, c, g, or t
gtgtctgatttatatatcaaacatcataaacaaatctttgatggttcttttaacagcgctttattagaatatgacaaagcccacgagtgttcacaagctgtagaggtactcaaaaatatctcgtatagatatatttatacacacaagcaggtacaagctttagagataaaaggatattctatcatacaagggttatttgatatttatgagccgcttttaaaacttaatactgaagaatttgaatcactattagctgataaaagagtagattgtgctatttgtcaaaatttactctacagattatcaaaaaaacatcttgtagcctataaaaaaagtgtaagtggtatcagtgatactgagaactataaacttttagagtggtattatagagcaagacttttatgtgactatattagtggtatgacagatgattatgctttatttgaacatcaatctctgtctgcgtaa

SEQ ID NO: 14330 - protein, 155 aa, Unknown
  Obtained from environmental sample
  misc_feature (1)..(155): Xaa is any amino acid
MSDLYIKHHKQIFDGSFNSALLEYDKAHECSQAVEVLKNISYRYIYTHKQVQALEIKGYSIIQGLFDIYEPLLKLNTEEFESLLADKRVDCAICQNLLYRLSKKHLVAYKKSVSGISDTENYKLLEWYYRARLLCDYISGMTDDYALFEHQSLSA

SEQ ID NO: 14331 - DNA, 888 bp, Unknown
  Obtained from environmental sample
  misc_feature (1)..(888): n is a, c, g, or t
ttgtctgattctcatatctttaaagagggagatattttagttgctgatacaactgatccagattgggaacctttgatgaaaaaagcatcagcagttataacaaacaaaggtggacgaacttgccatgcagctattgttgcaagggagataggtgttcctgctatagtgggttgtatcaatgctacaaagctattaaaagatggagacaaagtgacagttagctgtgctggtggagaaaatggttatgtatataagggtattttaaagtatgagattcaaaagatagatattgataatttacaagaacctaaaacaaaactgtttatgaatgtaggtgatccacataaagctttcctgtttgcaaaacttccaaatcaaggggttggattggctagaatggaatttattatcaataacttcataaaagcacatccaatggcactttttgatatctacaatggaaaaaaagtagaagatgaaaaagagataaaaaattttataaaagggtataaagacccaaaaagtttttttatagagaaactagcccaagggatagggatgattggggctgctttttatccaaagcctgtgattgtacgaaccagtgattttaaatcaaatgaatacaaaaatatgcccggtggaaaagcgtacgaacaagatgaagaaaatcctatgataggttttagaggagctagcagatactattncaaagagtatcaaaaagcttttgagtgggaatgtgaagctttaaaaaaagtaagagatgagatggggcttacaaatgtcaaaataatgcttccttttgtaagaacacctgttgagggtcaaaaagttatcaaaattatgaataaaaaaagactggtacaaggtaaaaatttcacttga

SEQ ID NO: 14332 - protein, 295 aa, Unknown
  Obtained from environmental sample
  DOMAIN (89)...(294): PEP-utilising enzyme, TIM barrel domain
  misc_feature (1)..(295): Xaa is any amino acid
MSDSHIFKEGDILVADTTDPDWEPLMKKASAVITNKGGRTCHAAIVAREIGVPAIVGCINATKLLKDGDKVTVSCAGGENGYVYKGILKYEIQKIDIDNLQEPKTKLFMNVGDPHKAFLFAKLPNQGVGLARMEFIINNFIKAHPMALFDIYNGKKVEDEKEIKNFIKGYKDPKSFFIEKLAQGIGMIGAAFYPKPVIVRTSDFKSNEYKNMPGGKAYEQDEENPMIGFRGASRYYXKEYQKAFEWECEALKKVRDEMGLTNVKIMLPFVRTPVEGQKVIKIMNKKRLVQGKNFT

SEQ ID NO: 14333 - DNA, 474 bp, Unknown
  Obtained from environmental sample
  misc_feature (1)..(474): n is a, c, g, or t
ttggatatggatgaaagattagtagagtggtctcattatatggatgtagtgtatagcccttatgtggatgcaaaagagataccaagtgatattgatctattattgtgnaaaggagctttaagtacagaccatgatattaaaatcataaaagagattagaaaaaactctaaattgatnttagcttgnggtgattgtgcagttactggaaatatatcggctatgaaaaatctttttggaacagaagctgttttagaaaaaggatattttgatttagcagatataaataaaggtaagtatccaagtgaagttgtaccaacacttttagataaagtaataccattaaatgaagctattgatgttgattattttgtccctggttgtccaactccagcagatgcgatttatgaagttataaaagcgattattgaaaacaaagagataaaaattagtgattatacaaggtttggcaagtaa

SEQ ID NO: 14334 - protein, 157 aa, Unknown
  Obtained from environmental sample
  DOMAIN (14)...(142): NADH ubiquinone oxidoreductase, 20 Kd subunit
  misc_feature (1)..(157): Xaa is any amino acid
MDMDERLVEWSHYMDVVYSPYVDAKEIPSDIDLLLXKGALSTDHDIKIIKEIRKNSKLXLAXGDCAVTGNISAMKNLFGTEAVLEKGYFDLADINKGKYPSEVVPTLLDKVIPLNEAIDVDYFVPGCPTPADAIYEVIKAIIENKEIKISDYTRFGK

SEQ ID NO: 14335 - DNA, 834 bp, Unknown
  Obtained from environmental sample
  misc_feature (1)..(834): n is a, c, g, or t
atggtatatgttttatcaaaattggccacaactgtggccaaattagaaaatgaaaaagggcaacaagctgttgcccttttagacaatgaaaatacgaaacaagttgtttctcaattgacacaaatcccatggggacataatagagccataatctcaaaatgtaaagatacccaagaagcacttttttatgtaaacaaaaccatagaaaatggttggagtagaagtgtcttagtacaccaaatagagagtgacctatatacaagaagtggcaaagctatatcaaactttgaagtaactttgccaaaagaacaatcagacttagcccatgaacttataaaagacccatataactttgactttttaactctaagtgaaaatttcaaagagaaagaactcgaatcgggcttattggaacatatcacaagttttttattagaacttggaagtggatttgcttttgttggaaaacaaaaaaatcttaaagtcggtcaaaaagatttttacattgacttgcttttctatcatataagaatgcattgttatgttgtagttgagctaaaaactgttgattttgaaccagagtttgcagggaaactaaacttttatattaaagccattgatgaacagataaaaacaaaagaggataaacctactattggtatattattatgtaagagtaaagataaggttgtagtagaatatagcttgagtgatatacataaaccaatgggaatatctcagtatcatttaactcatatagtaccagaagagttaaagggaagtttgccatctattgaagatattgaagctgagttaacagaaaaggatagttga

SEQ ID NO: 14336 - protein, 277 aa, Unknown
  Obtained from environmental sample
  DOMAIN (6)...(265): Protein of unknown function (DUF1016)
  misc_feature (1)..(277): Xaa is any amino acid
MVYVLSKLATTVAKLENEKGQQAVALLDNENTKQVVSQLTQIPWGHNRAIISKCKDTQEALFYVNKTIENGWSRSVLVHQIESDLYTRSGKAISNFEVTLPKEQSDLAHELIKDPYNFDFLTLSENFKEKELESGLLEHITSFLLELGSGFAFVGKQKNLKVGQKDFYIDLLFYHIRMHCYVVVELKTVDFEPEFAGKLNFYIKAIDEQIKTKEDKPTIGILLCKSKDKVVVEYSLSDIHKPMGISQYHLTHIVPEELKGSLPSIEDIEAELTEKDS

SEQ ID NO: 14337 - DNA, 690 bp, Unknown
  Obtained from environmental sample
  misc_feature (1)..(690): n is a, c, g, or t
atgactagtttttcatcatatcaatttactatacagctttgcgatataaatgatagagcattaaatgatttgagttttggagagcaacaattactattcattcttaatcagttatattcattcaaaaatagtcaaattactggtatagaaagtattgtagataaaggacaagaatatgaaatagagagtagtaaaaatattgatagtaatatagttcttttagatgagattgatattagttggcatccaaattggcagaaaagaatggttaattatatttgtgactttttaaaacttattccagaaaaaacttttcatcttatttttgctacatactccccattcatcctttcagatttaccaaaacaaaatgtaatattcttagaaaaatacaaaaaagatgaggatgaaaatcaaaaagagggcaattgtaaagtagtaaacccagatataaatcaaacctttggagcaaatatccatactcttttatctcacggtttttttatggaaaatgggcttatgggtgcgtttgcgaaagataaaataaatacaattatagagtttcataaagaggttgaagaaaataaagagaatgaaataaaaaaagatgaattaaaactaaaatatgaaactatagaagataatcaaaaaacaaaaaaagataattttttggaatatacaaatcaataa

SEQ ID NO: 14338 - protein, 229 aa, Unknown
  Obtained from environmental sample
  misc_feature (1)..(229): Xaa is any amino acid
MTSFSSYQFTIQLCDINDRALNDLSFGEQQLLFILNQLYSFKNSQITGIESIVDKGQEYEIESSKNIDSNIVLLDEIDISWHPNWQKRMVNYICDFLKLIPEKTFHLIFATYSPFILSDLPKQNVIFLEKYKKDEDENQKEGNCKVVNPDINQTFGANIHTLLSHGFFMENGLMGAFAKDKINTIIEFHKEVEENKENEIKKDELKLKYETIEDNQKTKKDNFLEYTNQ

SEQ ID NO: 14339 - DNA, 699 bp, Unknown
  Obtained from environmental sample
  misc_feature (1)..(699): n is a, c, g, or t
ttggccaaaatagcgaaagacgatatttgtggttttattctaaaatcaaagtccccaacttgtggtatggagagagttaaagtatatcaagccaaaaatgctccaagtataaaagagggtgtgggactttttgcaaaacgaataaaagagctttacccttacttacctgttgaagaagagggtagattaaatgatgcttggctaaaagaaaactttttaatgcaaatatttgcctataaagatttacatgagttgctaaaaaaagatataaaattaaatgacttagttgagtttcatacttcatataaatatctaatttatgcaaaatcacaagagttttataaagagttagggaatattgttgcaaatcatgataaaaagcctttatcagagattttagatgaatataaactgagttttttacaagctattagtcaaaaaagcactatcaataaaacttacaatgtcttgcttcatatctttggttattttaaaaagcatatatcaaaagaagaaaaagagttattacttataaccatggatgaatataaagatggtatagttcctttgataacaatagttaagatgtttaaaatctatattagtaaacatgatatagaatatctaaaaaaacaaaagtttttaaatccataccctgcagagttagcgctaaggtctgatttaaaagcaaataaatag

SEQ ID NO: 14340 - protein, 232 aa, Unknown
  Obtained from environmental sample
  misc_feature (1)..(232): Xaa is any amino acid
MAKIAKDDICGFILKSKSPTCGMERVKVYQAKNAPSIKEGVGLFAKRIKELYPYLPVEEEGRLNDAWLKENFLMQIFAYKDLHELLKKDIKLNDLVEFHTSYKYLIYAKSQEFYKELGNIVANHDKKPLSEILDEYKLSFLQAISQKSTINKTYNVLLHIFGYFKKHISKEEKELLLITMDEYKDGIVPLITIVKMFKIYISKHDIEYLKKQKFLNPYPAELALRSDLKANK

SEQ ID NO: 14341 - DNA, 726 bp, Unknown
  Obtained from environmental sample
  misc_feature (1)..(726): n is a, c, g, or t
atgagtgaaactgagcttggtattaagtcaagtaactttgaatttgattacggttttgaaagtgacggagtatatatagaccaactccacgcgttaatgcatatttatactactctggggatggatgaaaaatataattgtaactttacagtctatcatcgtcctccaaaatttatgcaaagagagagcggtaagattatactactaagtatagcctctcttgtattggcatttatgtatcctgtaacgtattgggttctaacatatgctcaaattcttcaatatgatcttttaagtacagagtatacagagttgcataatattaaaataacaagacaagcaactataaaaaacagggaagcagataaagctaaagttataactttacttaatcaagagaaaaaagattatgcagagaaaaaagctactctaataaaaattcacgatgtaaaagttaattacccaatgaaagctaagcttttatctgccttaacaaaagatttgaatacatttaatattaatgttgattcgctatcttacaaagaggatgaaaagtcaaaaacattcacactgaatctcatttcaaaaaaagataagaaaatcacggagatgatagaatatttaactaaaacacatgatggtgtgtttgacttttcactagaacatatagaatttaaagaaaaagacaaaaagtactttagtgagctaaaagtgagtatattatga

SEQ ID NO: 14342 - protein, 241 aa, Unknown
  Obtained from environmental sample
  misc_feature (1)..(241): Xaa is any amino acid
MSETELGIKSSNFEFDYGFESDGVYIDQLHALMHIYTTLGMDEKYNCNFTVYHRPPKFMQRESGKIILLSIASLVLAFMYPVTYWVLTYAQILQYDLLSTEYTELHNIKITRQATIKNREADKAKVITLLNQEKKDYAEKKATLIKIHDVKVNYPMKAKLLSALTKDLNTFNINVDSLSYKEDEKSKTFTLNLISKKDKKITEMIEYLTKTHDGVFDFSLEHIEFKEKDKKYFSELKVSIL

SEQ ID NO: 14343 - DNA, 726 bp, Unknown
  Obtained from environmental sample
  misc_feature (1)..(726): n is a, c, g, or t
atgtcaggtgatattgcaatttcaaggatagaaaaagagcaacatctatattctgctagacctcgagaaatcacattaatttctcatgctggagtacctttattagaaaaagaaattatagattttttaaaatcaaacaaggttatggttgtagtagatgaggcacatagaattaaaaatgcaaatggaatttggggtaatagtgtagttgaaatttcaaaagaagcaacatcaagaatcatattaacaggaacacctgtaccaaatggatatgaagatatattcaatttatacagatttttatacccttttaaatataaagatattttacaaatacattatgatcaactaaaagagatgacaaagaattcactctcttttgaagatgaaagggtaaaaacttttattcaaaatatttcaccatattttataagaattaagaaaaaagatttaaaagatagattacctttaactactactgaaaatattttagaagttgagatggatgactaccagaaagagatttatgaatttatagaagacaaatacattaaaacatttcaacataattcatctgggacaattcaagatgtactgaataaagcaaaactaatacgtttacgccaagcttcaactaacccatctttacttattaagcccataaaagactcattagaattttatgaagaaagtaatggatcaaatgatagtttttacagaatataa

SEQ ID NO: 14344 - protein, 241 aa, Unknown
  Obtained from environmental sample
  DOMAIN (7)...(217): SNF2 family N-terminal domain
  misc_feature (1)..(241): Xaa is any amino acid
MSGDIAISRIEKEQHLYSARPREITLISHAGVPLLEKEIIDFLKSNKVMVVVDEAHRIKNANGIWGNSVVEISKEATSRIILTGTPVPNGYEDIFNLYRFLYPFKYKDILQIHYDQLKEMTKNSLSFEDERVKTFIQNISPYFIRIKKKDLKDRLPLTTTENILEVEMDDYQKEIYEFIEDKYIKTFQHNSSGTIQDVLNKAKLIRLRQASTNPSLLIKPIKDSLEFYEESNGSNDSFYRI

SEQ ID NO: 14345 - DNA, 657 bp, Unknown
  Obtained from environmental sample
  misc_feature (1)..(657): n is a, c, g, or t
atgaaagtaaaaataagtcaattcatccttaagtcgttcggatggaaatttataggagaaattccaacagtaaaaaaagcagtcgtaattgctgcaccacatacatcaaattgggattttatttggggaaaattggctttcgtcgctcataatatcaacacaacagttcttatgaagaaagaatttttctttttcccttttggagcaatttttcgatctatgggtgttatggctattgataggagtaagaaaagcaatttgactgatcagttggcagaggaatttgcgaagagagatgagctttatctttcactttcgccagagggaactagaagtagacgccctgtatggaaaagaggtttttattttatcgcattaaaagcgaatgtgccaattctattaggcgatttgaattatgaaactaaaacattaagctttatcgaaaccttttatccaacaggagatgttgaggctgatatggcttatatcanatcaaaatataaggatgctaagtctaagtttcccaagccttttttctattggagattaaatcaatttttaaacgataaacgttggtttctatttatgacaatggtttgnttaagttttttgttttattccccccttagttttgaattaaaaatggggttttgttaa

SEQ ID NO: 14346 - protein, 218 aa, Unknown
  Obtained from environmental sample
  DOMAIN (14)...(138): Acyltransferase
  misc_feature (1)..(218): Xaa is any amino acid
MKVKISQFILKSFGWKFIGEIPTVKKAVVIAAPHTSNWDFIWGKLAFVAHNINTTVLMKKEFFFFPFGAIFRSMGVMAIDRSKKSNLTDQLAEEFAKRDELYLSLSPEGTRSRRPVWKRGFYFIALKANVPILLGDLNYETKTLSFIETFYPTGDVEADMAYIXSKYKDAKSKFPKPFFYWRLNQFLNDKRWFLFMTMVXLSFLFYSPLSFELKMGFC

SEQ ID NO: 14347 - DNA, 372 bp, Unknown
  Obtained from environmental sample
  misc_feature (1)..(372): n is a, c, g, or t
atgggtggaatacttagaattgaaagtaaggtaaaagagggtacacaaatatattttgatattgagttaagagaaataaaacaagaggattacattaacgagaaagggttagaaaaaacaaagaaaaaaatagagtttaatttgtataataagagagagacaatagtttttgaaaaagagaaagagttacttgaacaattagaagaggcagtattgagaaaaagaccaaatgtggtatatcctattattgatgaattagataaatataatttacaaatactaagtagtgtagattttaagaatataaaaacatatattaagagatatatgtttcatgaagcaagcgagatactaaataaatatgaaaaataa

SEQ ID NO: 14348 - protein, 123 aa, Unknown
  Obtained from environmental sample
  misc_feature (1)..(123): Xaa is any amino acid
MGGILRIESKVKEGTQIYFDIELREIKQEDYINEKGLEKTKKKIEFNLYNKRETIVFEKEKELLEQLEEAVLRKRPNVVYPIIDELDKYNLQILSSVDFKNIKTYIKRYMFHEASEILNKYEK

SEQ ID NO: 14349 - DNA, 429 bp, Unknown
  Obtained from environmental sample
  misc_feature (1)..(429): n is a, c, g, or t
atgaaaaataaaaaatccccaacaatattaattgtagatgacaatgaaattaatatagatatattattaggtgccttaaataaatatgatattattgctgcacttagtggacaagaagcattagatattgttaaaaaagagaaagtagacttaatactactagatatcatgatgccctctttagatggatatgaagtttgtagaatattaaaaaatagtgataagtactcaaatatcccaattatatttcttacagctaaaaatgaaacggatgatattaaaaaaggttttgagtacggggcgattgattatattngtaaaccctttcatccctcagagntagacatacgactcaatactcatttagaactccttagttacaaaaataatttagagcaaaaagttgccaccgccatagaagaaaaataa

SEQ ID NO: 14350 - protein, 142 aa, Unknown
  Obtained from environmental sample
  DOMAIN (7)...(126): Response regulator receiver domain
  misc_feature (1)..(142): Xaa is any amino acid
MKNKKSPTILIVDDNEINIDILLGALNKYDIIAALSGQEALDIVKKEKVDLILLDIMMPSLDGYEVCRILKNSDKYSNIPIIFLTAKNETDDIKKGFEYGAIDYIXKPFHPSEXDIRLNTHLELLSYKNNLEQKVATAIEEK

SEQ ID NO: 14351 - DNA, 684 bp, Unknown
  Obtained from environmental sample
  misc_feature (1)..(684): n is a, c, g, or t
gtggtcagaatcggctcgagcaaagtgaacggaaaattagatttaaaaaatatctatgataatgcaaatagcaaatataaattgttgtataaaaatcaatttatttgtttctcacctgaaagtttttgtacaattgatgaaaacaaaatctacacctatccaatgaaaggtacaatagatgccaatataaaaaatgcaaaagagttaattctaaaagatccaaaagaattagctgaacatacaatggttgttgatctattacgaaatgatctatcaatcgtttcaaaaaaagtaaaagttgaaaaatttcgatattgtgaaaaaataaaagcaggggagaaagaactttttcaaataagttcaaaaatatctggtgaactagaaaatagttggcaagatagagtaggagatattatcacctctttattgccagcaggaagcatcacagggactccaaagaaaaaaacaatacaaatcatagctgaagtggaaaaatacgaaagaggctactttacaggcgtttttggagtatttgatggaaaatctttagatagtgccgtgatgatacgatttattgagaaacaaaatggtaaatacatttataaaagtggtggagggataacttgtgatagtgatcctcaaaaagagtatcaagagatgttagataaggtatatatcccatga

SEQ ID NO: 14352 - protein, 227 aa, Unknown
  Obtained from environmental sample
  DOMAIN (11)...(226): chorismate binding enzyme
  misc_feature (1)..(227): Xaa is any amino acid
MVRIGSSKVNGKLDLKNIYDNANSKYKLLYKNQFICFSPESFCTIDENKIYTYPMKGTIDANIKNAKELILKDPKELAEHTMVVDLLRNDLSIVSKKVKVEKFRYCEKIKAGEKELFQISSKISGELENSWQDRVGDIITSLLPAGSITGTPKKKTIQIIAEVEKYERGYFTGVFGVFDGKSLDSAVMIRFIEKQNGKYIYKSGGGITCDSDPQKEYQEMLDKVYIP

SEQ ID NO: 14353 - DNA, 903 bp, Unknown
  Obtained from environmental sample
  misc_feature (1)..(903): n is a, c, g, or t
gtgggatggtatgtttttgcatacgttactcaaggtacacaacaaatcgaagtgtttggtatttcattacctgctttacctgttgctgtatgggtaatgttacctcttgtaatattatatatgccangtgttgttcatatgtcattttactcaatgctttcaggttttaaacttcgtaagtatgataaagactatgagaaagtaatagatgcaatagctgatgcttacttagcaaaagatgatagaaattatatatataaaacttcaaggtatcaacttttaggttctatcatagataatacaactctattcccaagtcaggttttaactgatggtactcaaaacgaaaagttagatactgttttaaagataattcaggatataaagaacggagaagttgtagaacttaaaaagtactcacttaaacctgaaaatgaattagtaatccaaaatgatagaaaccgttataaaaaaggtgatatcactgctgaaaatattttaagtcatgttgataatcatgatgatagtttagtaaaagaagcttatgcagatttagttaaaactgctccattggctaaaatagagcaacataaatcttttttaactaaaggttcactgtttgatattttagctagaatcaatgcagatgaaaatactttagaaatttcaaatgaagcgttaatttcccttcttagtgttttagatttagatgcaaaagatcttattaaagtttccagtactctttcaactactatgattccggaacagagaatgaaattatttgaaacactaagtgaaaaacgagaggatgcagttgaagcttatatgtttacactttttgatttagaaatacttgctcctgctaatgaattgttagagaatacacaagatgacgagtattaa

SEQ ID NO: 14354 - protein, 300 aa, Unknown
  Obtained from environmental sample
  misc_feature (1)..(300): Xaa is any amino acid
MGWYVFAYVTQGTQQIEVFGISLPALPVAVWVMLPLVILYMPXVVHMSFYSMLSGFKLRKYDKDYEKVIDAIADAYLAKDDRNYIYKTSRYQLLGSIIDNTTLFPSQVLTDGTQNEKLDTVLKIIQDIKNGEVVELKKYSLKPENELVIQNDRNRYKKGDITAENILSHVDNHDDSLVKEAYADLVKTAPLAKIEQHKSFLTKGSLFDILARINADENTLEISNEALISLLSVLDLDAKDLIKVSSTLSTTMIPEQRMKLFETLSEKREDAVEAYMFTLFDLEILAPANELLENTQDDEY

SEQ ID NO: 14355 - DNA, 711 bp, Unknown
  Obtained from environmental sample
  misc_feature (1)..(711): n is a, c, g, or t
atgaaacaatacggattaataggaaaaacgctatcacattcattttctaaaaaatattttgaagagaagtttaaaagagaaaacattgatgcagtatatgaaaattttgagttgaatgatattagtcaagtagaagaacttttttcagcactacccaacctttgtggactaaacgtaaccattccttataaagaacaaattataccatatttagatgaagtggatgaacaagcccaaaaaattggagcggttaatactatatatatagataagaaaacgggaaaaaagaaagggtataataccgattattatggtttcaagcaatcactaaaaccattcttagaaaaccaacatcaacgagcattaattttaggaacaggcggagcatcaaaatcagtagcttatgttttgaatgaattaggaattattaccgcctttgtttccagaaaccctaatacggaaaatcagttgagttatgatgatttgaatgaaaacctaatgcaatcttttttactaatagtaaacactactccgctaggaacttttccaaatgtggaagaaaaaccaccaattaattatgatttcattacagcaaatcatttattgtacgatttggtttataaccctgtagaaaccgcttttttaaaagaaggaaaaaaaagaggagcattaaccattaatggagaacaaatgctccaactacaagcctga

SEQ ID NO: 14356 - protein, 236 aa, Unknown
  Obtained from environmental sample
  DOMAIN (24)...(236): Shikimate / quinate 5-dehydrogenase
  misc_feature (1)..(236): Xaa is any amino acid
MKQYGLIGKTLSHSFSKKYFEEKFKRENIDAVYENFELNDISQVEELFSALPNLCGLNVTIPYKEQIIPYLDEVDEQAQKIGAVNTIYIDKKTGKKKGYNTDYYGFKQSLKPFLENQHQRALILGTGGASKSVAYVLNELGIITAFVSRNPNTENQLSYDDLNENLMQSFLLIVNTTPLGTFPNVEEKPPINYDFITANHLLYDLVYNPVETAFLKEGKKRGALTINGEQMLQLQA

SEQ ID NO: 14357 - DNA, 852 bp, Unknown
  Obtained from environmental sample
  misc_feature (1)..(852): n is a, c, g, or t
atgttatctaaaaatgaaaaagcaaaaagaacgttatatcttgagagagctaaagaaatgatagcacatcatggagatttaaacctcttagatccaaatggagaaactatactatttcatgctgtaagacttatggatatggaacttattaactttcttcttacttatggaattgacccaaatatacaagacgcaacaggaaaaccagctttagagtatgctatctattatggtcttgaagaaattgatttaattttattacttataaatcatggagcaaatccaaaactaaaaaataaacatggaaaatgtatctatgaagtactcaatgatattattcttcatcagtatggaacaaaaactattgatgaaaaagatgtggttgcaaaaatagaaaaaaatggacaatatatagaaattgttaaaaaacttcttgagattaataactctgctgagcatgtggaaaaaattgattatcttgattcaacaggtgatcccctgttcttcaaacctttaatttacgaccactttatactttttaaagtctatatcaagtttggttttaatattcatgcaaaaaataaagcaaatcataatatcttttttgaatatgttttaaaagtatttgaaaaaaatgacaactcgttaaaagcctgtgaaaactttcaacacaacctaaccaatctcattagtagtaaaatagataaaaattatcaagatgctttagggtggactattttacataaagttgtgggaacagcttgtgatgaaaaactttttgatatattaacaaaagttgtcccttttgactacacaatagttgataaatttagggagaagcgttatacataa

SEQ ID NO: 14358 - protein, 283 aa, Unknown
  Obtained from environmental sample
  DOMAIN (33)...(65): Ankyrin repeat
  misc_feature (1)..(283): Xaa is any amino acid
MLSKNEKAKRTLYLERAKEMIAHHGDLNLLDPNGETILFHAVRLMDMELINFLLTYGIDPNIQDATGKPALEYAIYYGLEEIDLILLLINHGANPKLKNKHGKCIYEVLNDIILHQYGTKTIDEKDVVAKIEKNGQYIEIVKKLLEINNSAEHVEKIDYLDSTGDPLFFKPLIYDHFILFKVYIKFGFNIHAKNKANHNIFFEYVLKVFEKNDNSLKACENFQHNLTNLISSKIDKNYQDALGWTILHKVVGTACDEKLFDILTKVVPFDYTIVDKFREKRYT

SEQ ID NO: 14359 - DNA, 357 bp, Unknown
  Obtained from environmental sample
  misc_feature (1)..(357): n is a, c, g, or t
ttgataaaattaggggagaaggcgttataccataatgcggttttggggaaaataagaaaaaatattattaaaaaaattgcaactcactcaaaagagagtatcaatatagaagacaattataatatcctaccaatggtttatgctgctcttttaggaaataaagagattgtattagaatttttaaggttaggttcttttattcattctaagaaaaaaatagaagcaaaagcgattaaaaaatttagccctatgctaaaaaacttagaaaaattaacacaagatgtagaagatttatctgacttgaaaaacttgaaaactgttgctgaccaagtaaaaaaagactttggtgttctttaa

SEQ ID NO: 14360 - protein, 118 aa, Unknown
  Obtained from environmental sample
  misc_feature (1)..(118): Xaa is any amino acid
MIKLGEKALYHNAVLGKIRKNIIKKIATHSKESINIEDNYNILPMVYAALLGNKEIVLEFLRLGSFIHSKKKIEAKAIKKFSPMLKNLEKLTQDVEDLSDLKNLKTVADQVKKDFGVL

SEQ ID NO: 14361 - DNA, 633 bp, Unknown
  Obtained from environmental sample
  misc_feature (1)..(633): n is a, c, g, or t
atgattcttttaggaaaaccttggagtcaagtatggaggaaaaaattcgctcaaattaaatatgccattgaaaacaacaaagagatatcgttttcaattccaaaatacaatactaattatattgtagtacggtataaaattataaatcttgaattttattggtactttttaggttatgaaaagagtaataccagtggcactaaaagcaatatagtaaaaacatatactataaaattaattaaagagttaaccgttagagatgaggaagatacttatgatttttcaaatgctgaaaaaaggttagttcacgctatgaacgctttttttagcattacaggagaagcaaaaataattgaagtattaataattgattggtttattccatatattaaaagagctaaatattttagtgggtggaggccgacaggagctatagatactattgataatcaagattattacgtatacgaaatagagtctactcataaaaaattcttagatgtaataccaactatcttaatgtatacaccaaaaatacttataagagacaatgatgatataactaaagaaatatttagtcatttagagcaatttgctaatttacataacaaaatcatctctgaaaaaacttaa

SEQ ID NO: 14362 - protein, 210 aa, Unknown
  Obtained from environmental sample
  misc_feature (1)..(210): Xaa is any amino acid
MILLGKPWSQVWRKKFAQIKYAIENNKEISFSIPKYNTNYIVVRYKIINLEFYWYFLGYEKSNTSGTKSNIVKTYTIKLIKELTVRDEEDTYDFSNAEKRLVHAMNAFFSITGEAKIIEVLIIDWFIPYIKRAKYFSGWRPTGAIDTIDNQDYYVYEIESTHKKFLDVIPTILMYTPKILIRDNDDITKEIFSHLEQFANLHNKIISEKT

SEQ ID NO: 14363 - DNA, 990 bp, Unknown
  Obtained from environmental sample
  misc_feature (1)..(990): n is a, c, g, or t
gtggatagatttccgatttgtgaaaaatatatcggttcggtaattccttatacagataattacgtttcagccctaaatgcagcagttttttctgacggctcatttgtttacattccaaaaggagtaagatgtcctgttgaattatcaacttattttaggataaatgcagcaaatactggtcaatttgaacgtactttaattattgctgacgaagacagctatgttagttatcttgaaggttgtacagctcctcaacgtgatgaaaatcaatttcacgcagcggttgttgaacttgtggcaatgaaaaatgcagaaatcaaatattcaactgttcaaaactggtatccaggtaataaagaaggaaaaggagggatttacaattttgttgtaaaacgcggaatgtgtaaaggtgataattcaaaaatttattggacacaagttgaaactggctctgctgtaacttggaaatatccaagtacaattttgcgtggcgataattcaataagtgaattttattctgttgctgttacaaataattttcaacaagctgatactggttcaaaaatgattcacattggtaaaaacaccaaaagcagaattgtttcaaaaggaatttcaatcggtcaaagtcaaaatagttatcggggattggtggatattaaaaaaactgccgaaaacgccagaaatcacacacaatgtgattcattattaattggcgataagtgcggtgctcacacgtttccttatgttcaagttgataatcacactgcaactttagaacacgaagctacgacaactaaaatcggtgaagaccaaattttctattgtcaacaacgcgggattagacccaagaaaaagctgttgcaccttattgtaaacgggtttttgctccgcgaagttatggcaaaaattaccaaatgggaantttgcagcagaaggcaaaaaaaaattactttgaaaattaacacttcgaaagggaagcgtttggaa

SEQ ID NO: 14364 - protein, 330 aa, Unknown
  Obtained from environmental sample
  DOMAIN (54)...(295): Uncharacterized protein family (UPF0051)
  misc_feature (1)..(330): Xaa is any amino acid
MDRFPICEKYIGSVIPYTDNYVSALNAAVFSDGSFVYIPKGVRCPVELSTYFRINAANTGQFERTLIIADEDSYVSYLEGCTAPQRDENQFHAAVVELVAMKNAEIKYSTVQNWYPGNKEGKGGIYNFVVKRGMCKGDNSKIYWTQVETGSAVTWKYPSTILRGDNSISEFYSVAVTNNFQQADTGSKMIHIGKNTKSRIVSKGISIGQSQNSYRGLVDIKKTAENARNHTQCDSLLIGDKCGAHTFPYVQVDNHTATLEHEATTTKIGEDQIFYCQQRGIRPKKKLLHLIVNGFLLREVMAKITKWEXCSRRQKKITLKINTSKGKRLE

SEQ ID NO: 14365 - DNA, 363 bp, Unknown
  Obtained from environmental sample
  misc_feature (1)..(363): n is a, c, g, or t
atggttgaaaatgtgcttaaaaataagagttttcaatttgcaataaaaattgtaaaattatctaaattcttaaaagaagataaaaaagagtacattttgagtaaacaaattattcgatcaggtacagctgttggagtcttggtaagagaagcagaatacgctgaaagcaaattggattttattcataaattgaatatagctttaaaagaagctaatgaaacggaatattggattgatttattatttgagggagaatatataaatgaaaaaactaaaaatattttgattttagataataaagaattattgaaattattgatatcaataataaaaaaaacaaaaactaatttaaaaaagaagtaa

SEQ ID NO: 14366 - protein, 120 aa, Unknown
  Obtained from environmental sample
  misc_feature (1)..(120): Xaa is any amino acid
MVENVLKNKSFQFAIKIVKLSKFLKEDKKEYILSKQIIRSGTAVGVLVREAEYAESKLDFIHKLNIALKEANETEYWIDLLFEGEYINEKTKNILILDNKELLKLLISIIKKTKTNLKKK

SEQ ID NO: 14367 - DNA, 720 bp, Unknown
  Obtained from environmental sample
  misc_feature (1)..(720): n is a, c, g, or t
atgatgaaacaagcactagacaaaaaatgcaaaaacttgacaatactttttattgaggattatattccgttacaaaaaaaaatagcatctgttttaagtgattattttgaaaatgttgaaatagcttcagatggaaaagaaggtattgaaaagtataaaaagatttatgaaaaaaatggaaagttttatgatattgtcataacagattatgaaatgccaaaaattaatggtattgaattaatcaaaacagttaaaaagttaaatgataaacaaatttttattgttatatctgcgcatcaaaattctgaatatcttatagaatatataaatcttggaattgagtattttattccaaaaccaattggtccagataatttattaaatattttggataaagtaagtgacaaatttatatttaaaaataatgaactattttatctaaatgattctcttatatgggataaaaagaataaattattattttacaataatgaatcattaaaactatctaaatacgatctgttattatttgagatacttgtagatagttacggttcactttgcaatatagatagaatattaagccatttttatataaataatgaagatattcaacaagaaaatatacgaaacatggttgttcgtttacgaaagaaaataccaaaagttacaattgaaagtatttatgcaatgggatataagttagtttctagcatttga

SEQ ID NO: 14368 - protein, 239 aa, Unknown
  Obtained from environmental sample
  DOMAIN (164)...(235): Transcriptional regulatory protein, C terminal
  misc_feature (1)..(239): Xaa is any amino acid
MMKQALDKKCKNLTILFIEDYIPLQKKIASVLSDYFENVEIASDGKEGIEKYKKIYEKNGKFYDIVITDYEMPKINGIELIKTVKKLNDKQIFIVISAHQNSEYLIEYINLGIEYFIPKPIGPDNLLNILDKVSDKFIFKNNELFYLNDSLIWDKKNKLLFYNNESLKLSKYDLLLFEILVDSYGSLCNIDRILSHFYINNEDIQQENIRNMVVRLRKKIPKVTIESIYAMGYKLVSSI

SEQ ID NO: 14369 - DNA, 327 bp, Unknown
  Obtained from environmental sample
  misc_feature (1)..(327): n is a, c, g, or t
ttgaaaaaatatataataattttttgtatctttagtgggtttttatatggttcagttttaaattatgaactgtacaaaaaagaaaatagtgatggaaatactttattagtaattggtggaattcatggtgatgaaccaggtggctattttgcgccatctgtattggtgcaaaactatactatcaaaaaaggatcactatggatagttccaaatcttaactttgatagtatagttagaactaggcgtggtatctatggagatatgaatagaaaatttaatagtgtaaaaaaaagcgataaagactataacactatcccaaagtattaa

SEQ ID NO: 14370 - protein, 108 aa, Unknown
  Obtained from environmental sample
  SIGNAL (1)...(17)
  misc_feature (1)..(108): Xaa is any amino acid
MKKYIIIFCIFSGFLYGSVLNYELYKKENSDGNTLLVIGGIHGDEPGGYFAPSVLVQNYTIKKGSLWIVPNLNFDSIVRTRRGIYGDMNRKFNSVKKSDKDYNTIPKY

SEQ ID NO: 14371 - DNA, 390 bp, Unknown
  Obtained from environmental sample
  misc_feature (1)..(390): n is a, c, g, or t
atgaaagtaatactgacagacgattcacaattaattctcgacagactgaacgagatgttatctgtttttaaagaggtagaaattgtaggttcttttaaaaacggaacagaaactctggaagctataaaaactttaaatcccgatttggtaatcatcgatatcaatatgccgggattaactggcttacaggttttaggggcggtgaaaaaggaaacccataatgcaaaattcattgtgcttacattttatgcatctaattattataggctagaagccttaaaattgggtgctgattattttttctcgaaggttgacgattttgaaaaagtagcggaggtggtgagtaatatgctgatgcaggagaataattattcagtaaatgcaatatga

SEQ ID NO: 14372 - protein, 129 aa, Unknown
  Obtained from environmental sample
  DOMAIN (1)...(122): Response regulator receiver domain
  misc_feature (1)..(129): Xaa is any amino acid
MKVILTDDSQLILDRLNEMLSVFKEVEIVGSFKNGTETLEAIKTLNPDLVIIDINMPGLTGLQVLGAVKKETHNAKFIVLTFYASNYYRLEALKLGADYFFSKVDDFEKVAEVVSNMLMQENNYSVNAI

SEQ ID NO: 14373 - DNA, 711 bp, Unknown
  Obtained from environmental sample
  misc_feature (1)..(711): n is a, c, g, or t
atgattgaggatttaaaaaagctatatctacggtttaattatactgatgaaaaaggttttattttcaatgcgccaactttaaaaaaaggagaacatatatcaattggctttgataataagaaaagacaattcaatgttcattttactgatgatactattaatgaacctggtgcaaaaaggagaaattacatctttacaatttctgcattccgttttttcctttttttaaagcgttttgagatattttacaatcaaactattattaatcttttattcacttcaaaaaccaaccttggtaaattaaagaaaaataaattaattataaatacttttattacttctgatgaagctgaagataagctcattcacaaaaagaagaatggtaaatattggaaatttagagataacttcgattttgataatatcttagaaaattacaaatatattgaagagtctgatttatcaaaaaatagctttcatttcgcctataagtttaagaataataatttatcattacaaggtattatatataagtttgagaacttaaatggcatatattttattccaatcaaaaaatggaatcgttttatgaggtacatggctattgccatgtataattatttcaacacttatccaacagaggaaactctaactttcagacaattaatgtacgaacgacttaaacatccttatttaaataagaaagaataa

SEQ ID NO: 14374 - protein, 236 aa, Unknown
  Obtained from environmental sample
  misc_feature (1)..(236): Xaa is any amino acid
MIEDLKKLYLRFNYTDEKGFIFNAPTLKKGEHISIGFDNKKRQFNVHFTDDTINEPGAKRRNYIFTISAFRFFLFLKRFEIFYNQTIINLLFTSKTNLGKLKKNKLIINTFITSDEAEDKLIHKKKNGKYWKFRDNFDFDNILENYKYIEESDLSKNSFHFAYKFKNNNLSLQGIIYKFENLNGIYFIPIKKWNRFMRYMAIAMYNYFNTYPTEETLTFRQLMYERLKHPYLNKKE

SEQ ID NO: 14375 - DNA, 333 bp, Unknown
  Obtained from environmental sample
  misc_feature (1)..(333): n is a, c, g, or t
gtgagagaagcaaatacaaaaagaattattgcagaagaaaacagcgaaacaatgcttgtacctgcttccgttatgaagtttgttaccacagcaaccgcattagacatattaggcgaagacttcaagtttgaaacanagcttgcatatagtggaaacattgacagcttaggcattttacatggaaacatctacattatggntggntgcnacccccacttttggcacatggagatatggaaacgcattttccccaaatttcaatttatgaaaaattcttttaaaacaatcgttttccatgggaatcaaaagccttttcggggaaaaattttttag

SEQ ID NO: 14376 - protein, 110 aa, Unknown
  Obtained from environmental sample
  misc_feature (1)..(110): Xaa is any amino acid
MREANTKRIIAEENSETMLVPASVMKFVTTATALDILGEDFKFETXLAYSGNIDSLGILHGNIYIMXGCXPHFWHMEIWKRIFPKFQFMKNSFKTIVFHGNQKPFRGKIF

SEQ ID NO: 14377 - DNA, 837 bp, Unknown
  Obtained from environmental sample
  misc_feature (1)..(837): n is a, c, g, or t
atggtagttgtaggttttaaagagggaaaagagatagataaaggttccatccctcttagtcaaaaaaatgagatggttcgttcaaatgatccctatttacaccaacatagtagaattatttctagattggtacattttgttcagtctgttaccaatgaagtggttgagaaaaatgaaaagctagaagtggcaaataaacaattatcacaccttcttgatgagagaaaagatcttctcaaagagatacagcatagagtaaaaaataattttcactctattcttggggttctttctttagaaaagatgaaaaataaagaggtaaactctcaatatgatgaagctataaatcgtatagttacaatgtctcaaattcatcaagagttatatcagtcttcaaatataggttatgtagatacgaaggagtatctcttatcaattattcaaaaggtttcctctatttttagtagtattgaacttcaaacaaatattgaaaaccatcaagtggactttaacacagccaccgttttaggaactctaatcaatgagcttataacaaactcttttaaacataatatcgaacaaatctcattaacaattaccataacatttcaaaaggtcaatgataaatatctctttatatactgtgacgatggaaaaggttttgatcctttctatgcacaaaagggtttaggtcttagcttaataacaaagttttgcaataaacttcaagatgtaaattttaactataagagtgagataaagggagtttgcttcaaactaaagttttactcccaaatccaaagaattacccactccccaaaaatgagtagcaattag

SEQ ID NO: 14378 - protein, 278 aa, Unknown
  Obtained from environmental sample
  DOMAIN (171)...(265): Histidine kinase-, DNA gyrase B-, and HSP90-like ATPase
  misc_feature (1)..(278): Xaa is any amino acid
MVVVGFKEGKEIDKGSIPLSQKNEMVRSNDPYLHQHSRIISRLVHFVQSVTNEVVEKNEKLEVANKQLSHLLDERKDLLKEIQHRVKNNFHSILGVLSLEKMKNKEVNSQYDEAINRIVTMSQIHQELYQSSNIGYVDTKEYLLSIIQKVSSIFSSIELQTNIENHQVDFNTATVLGTLINELITNSFKHNIEQISLTITITFQKVNDKYLFIYCDDGKGFDPFYAQKGLGLSLITKFCNKLQDVNFNYKSEIKGVCFKLKFYSQIQRITHSPKMSSN

SEQ ID NO: 14379 - DNA, 333 bp, Unknown
  Obtained from environmental sample
  misc_feature (1)..(333): n is a, c, g, or t
atgtttagtatatttcctataaagggtactataagtgatatagatggattttattgtaacggtataagcgcaggtcttaaaacaaacaataaactagatatgggatttatttatagtgatagtttatgtgaagttgaagcggtatttacccaaaacaattttaaagcagcaccattacgacactatatgcaatatgataaaaattttaaaacaaattttgtgcttattaattctaaaaatgcaaatgctatgactggagaacagggtattaaagatatcaatgaactcttttcatcaataaaagaaaaatttccttctatgaaaacccaatag

SEQ ID NO: 14380 - protein, 110 aa, Unknown
  Obtained from environmental sample
  misc_feature (1)..(110): Xaa is any amino acid
MFSIFPIKGTISDIDGFYCNGISAGLKTNNKLDMGFIYSDSLCEVEAVFTQNNFKAAPLRHYMQYDKNFKTNFVLINSKNANAMTGEQGIKDINELFSSIKEKFPSMKTQ

SEQ ID NO: 14381 - DNA, 300 bp, Unknown
  Obtained from environmental sample
  misc_feature (1)..(300): n is a, c, g, or t
gtggaaagcaatgtttacttcctcagggactggctcttttgcaagttcagccaaagctatggaagctgccagtttcatttcttcgttaatttcggttgcccggacatccatggcgcccctaaaaataaatgggaaaccaaggacattgttaatttggttgggaaaatccgatcttcccgttcccataataatatcatccctaacggaaaaagcttcattaggaaggatctcaggaactgggtttgccaaagcaaaaataattgggttttttgccattttggccagatactccttctttaa

SEQ ID NO: 14382 - protein, 99 aa, Unknown
  Obtained from environmental sample
  misc_feature (1)..(99): Xaa is any amino acid
MESNVYFLRDWLFCKFSQSYGSCQFHFFVNFGCPDIHGAPKNKWETKDIVNLVGKIRSSRSHNNIIPNGKSFIRKDLRNWVCQSKNNWVFCHFGQILLL

SEQ ID NO: 14383 - DNA, 771 bp, Unknown
  Obtained from environmental sample
  misc_feature (1)..(771): n is a, c, g, or t
ttgaataaaatattatgccataaattaggagttaagaatacaaaaatcattctcccaaaatctgacttattactaaaaatagtaacttttgtaccaaaagaacatgccgaaaaagtaagagaatctatatttgaagcaggagccgggcatattggcaactacgacaattgcagctacaatatagaaggtgttggaacttttagagctggcaaaaacacaaacgcttttattggagaaaaaggaaaaaatcatattgaaaatgaaataagaatcgaaactattttccctacctttttacaaagtaaagtaatttcagccctaaaaaattcacatccttacgaagaggttgcttacgatatttatcctttggcaaacaaatttgataaatttggtgcaggattaattggagaattagataacgaaattgacgaaattgattttttagaattaataaaacaaaaattggaaataaaagctattaaacattcaaatttattaaatcgaaaggtaaaaaaagttgccatttgcagcggtgctggtcattttttaattgataaatcatttgcagaaaaagcagatattttcatttcatcagaattcaaatataatcactttatagaagctcaaaatagaatactaattgttgatgcaggacactatgaaactgaaatttttataaaaaatcttttttatgaatatataacaaaaaaatttactaattttgcagtcaaattttcacagaatttttcaaatcctgtcaattacttgtaa

SEQ ID NO: 14384 - protein, 256 aa, Unknown
  Obtained from environmental sample
  DOMAIN (91)...(248): NIF3 (NGG1p interacting factor 3)
  misc_feature (1)..(256): Xaa is any amino acid
MNKILCHKLGVKNTKIILPKSDLLLKIVTFVPKEHAEKVRESIFEAGAGHIGNYDNCSYNIEGVGTFRAGKNTNAFIGEKGKNHIENEIRIETIFPTFLQSKVISALKNSHPYEEVAYDIYPLANKFDKFGAGLIGELDNEIDEIDFLELIKQKLEIKAIKHSNLLNRKVKKVAICSGAGHFLIDKSFAEKADIFISSEFKYNHFIEAQNRILIVDAGHYETEIFIKNLFYEYITKKFTNFAVKFSQNFSNPVNYL

SEQ ID NO: 14385 - DNA, 402 bp, Unknown
  Obtained from environmental sample
  misc_feature (1)..(402): n is a, c, g, or t
ttgaatattgctcaacatctatctacgcatgacattaagccttcttatcagaggattaaaatttatgagtatttgtatgagaaaatgaaccaccctaccgtagatgtaatttacaaaaacttggtaggagaaatccctactttatctaaaacaactgtgtataataccttaaaattatttattgataaaggtattacatcaacagtaactattgaagataatcaagtaagatatgatgctataatggatgctcatggtcattttaaatgtacctcatgcggagcaatatatgatattaagtatgattttaaagatgtagccatgaacgagctaaaaggttttgaagtaaaagaaacccaagttcatgtaaaaggaaaatgtaatcaatgtttaaccaaataa

SEQ ID NO: 14386 - protein, 133 aa, Unknown
  Obtained from environmental sample
  DOMAIN (9)...(124): Ferric uptake regulator family
  misc_feature (1)..(133): Xaa is any amino acid
MNIAQHLSTHDIKPSYQRIKIYEYLYEKMNHPTVDVIYKNLVGEIPTLSKTTVYNTLKLFIDKGITSTVTIEDNQVRYDAIMDAHGHFKCTSCGAIYDIKYDFKDVAMNELKGFEVKETQVHVKGKCNQCLTK

SEQ ID NO: 14387 - DNA, 828 bp, Unknown
  Obtained from environmental sample
  misc_feature (1)..(828): n is a, c, g, or t
gtggattcaaatcgtaaagatgaaatcttaggcccctacatctttaacaaaacggtgaaaattttaaatcaaaacctgctgttaaattcttacctcgaaaacactaataaattttttgcaaaaggaccttttaatattattaataaacgattgcgatacacaatattttttgacttaaaacccaatatcattataagcaggtttccgtttttcaaatatttcaagtggctaattatactctgtaataaaacaatagttaaaggcattaattacatcaatacgaaacaatcaaaaaaagcaacaaatcatctaacctatgagtatatcaatgaattagatgatataacatggacgcttctaagtgaaatatgtcaacatgattttacagtaaaatcaaaaaactatgtcaattggcttatagataattctcaatacacccaaacacctattcctcataaatttaagttttcttactctacaacaggatatagcgaaaacatttattcctatacgcttaaagtaattgaaaataatacggtaataggatttatatcgtatgttttaaatggaattgaatttaatcttaaatattttatttgtaaagataatacgtatgaagaaaaatgtgtggcggccttactagaacatttttttaagtctaaagcaagttatatcataacagatgattctaaattagtggcgcgaataaaagaccaatacaagcctgttttcacctaccaaattgagaaaaagaccatagcacataaaaatatggatttaaattttgaagacatcatagtaacggatagagacggtaggtttcattaa

SEQ ID NO: 14388 - protein, 275 aa, Unknown
  Obtained from environmental sample
  misc_feature (1)..(275): Xaa is any amino acid
MDSNRKDEILGPYIFNKTVKILNQNLLLNSYLENTNKFFAKGPFNIINKRLRYTIFFDLKPNIIISRFPFFKYFKWLIILCNKTIVKGINYINTKQSKKATNHLTYEYINELDDITWTLLSEICQHDFTVKSKNYVNWLIDNSQYTQTPIPHKFKFSYSTTGYSENIYSYTLKVIENNTVIGFISYVLNGIEFNLKYFICKDNTYEEKCVAALLEHFFKSKASYIITDDSKLVARIKDQYKPVFTYQIEKKTIAHKNMDLNFEDIIVTDRDGRFH

SEQ ID NO: 14389 - DNA, 990 bp, Unknown
  Obtained from environmental sample
  misc_feature (1)..(990): n is a, c, g, or t
atgcctttaggttccacaggtggtttaggacattttcatgcctctttaatactgggaaatcatataagactatttcctggtttatactctcaaactaccactcaagatatggaaaatatgttttgtaccattgaaaaggagagtattacggggatgcttttaacacctgggttgatactgagaatattacaaaatcataaaaaaagatttgaagttgtgggaaaaaatctaaactatctcttggcaaatgttacccccatgtcaagagagtcaataattgaacttctagagctactgccaaatcttagattctgtacatattacggttcaactgaagccagtagaagtattgttaatgtttgtagagagaacagaggttatgaggattttacgggtaaagctacctctaatgtcgagataaagataaataatccaaacaaagatggtgagggtgaaatttttataaaaggtccaaatgtcatgaaaggttatctaaatagaggtgatgacggattttgtgatggatggtttaaaagcgatgatattggtaaaattgatgaaaatggatttattcaaatattgggaaggctcaaagatactataagtatagatggattaaaaatgtttcctacagagttggaaaatattttaatttcatatcctaaaatcaaggacgtaggtgtttgcagcattttagataagagaacctataatcagattggcttggcagtagttgctgaagagaaggctaataaagaagagcttacaaaagagatttataaaatcttaaaaataaaatacaaactaaatgaaacagatttatatagctacaaaatcccaaataaaatctattttcaagagagtattccaagaacagatctaggtaaagtaagaagagatgatctagctccgctactatttaaaaataatccgcccttccatatatccaaggaaaaattatgggaacaggagtataaaaaatttttatag

SEQ ID NO: 14390 - protein, 329 aa, Unknown
  Obtained from environmental sample
  misc_feature (1)..(329): Xaa is any amino acid
MPLGSTGGLGHFHASLILGNHIRLFPGLYSQTTTQDMENMFCTIEKESITGMLLTPGLILRILQNHKKRFEVVGKNLNYLLANVTPMSRESIIELLELLPNLRFCTYYGSTEASRSIVNVCRENRGYEDFTGKATSNVEIKINNPNKDGEGEIFIKGPNVMKGYLNRGDDGFCDGWFKSDDIGKIDENGFIQILGRLKDTISIDGLKMFPTELENILISYPKIKDVGVCSILDKRTYNQIGLAVVAEEKANKEELTKEIYKILKIKYKLNETDLYSYKIPNKIYFQESIPRTDLGKVRRDDLAPLLFKNNPPFHISKEKLWEQEYKKFL

SEQ ID NO: 14391 - DNA, 816 bp, Unknown
  Obtained from environmental sample
  misc_feature (1)..(816): n is a, c, g, or t
atgcatgaaaagatcctgtttcgccatgatatagagacgaagctgcaccacgctatacagaacaatgagcttcgtatacgctatcagcccaagatagatgttgacaccaacacggtcattggagcggaagcacttctaaggtggaagcacaaagaactgggcaagatctctccttctgtcttcattcctatagccgaagagagcagccttatcaaccagataggcaagtgggtcatcaaaaatgtatgccgtgacatcgcgcgtatcaagcacgactttgacaatgatcttagcatcagtatcaatatctcatcttcgcagatattacatcagaaccttcccgagcttatacaagagaaccttgacgtctacgatctcactgccgagtctatagaacttgagtttaccgaaaacatgctgatcaagcaggggcgcaaaggccagcaggtacttgaccgcttaaacaagatgggggttaaactctccattgatgactttggtacaggatactcctctttgaactatctcaagaccctgcctattcatgcactcaagatcgacaagtccttcatctgcgatacgcctagacatgaagcagactgtgctattgcaaagagtattatctctctggcaagcaaccttaaccttgatgtggttgccgaaggggtcgaaacagctgaacagctcacatttttaaaagagaacggatgctctgtcatccaaggcttctatttttcaaagccgcttgatatcaatgcttttacggcttatctaaacgcaccttcactgaaaaaaaagcagacgattttaagctga

SEQ ID NO: 14392 - protein, 271 aa, Unknown
  Obtained from environmental sample
  DOMAIN (7)...(248): EAL domain
  misc_feature (1)..(271): Xaa is any amino acid
MHEKILFRHDIETKLHHAIQNNELRIRYQPKIDVDTNTVIGAEALLRWKHKELGKISPSVFIPIAEESSLINQIGKWVIKNVCRDIARIKHDFDNDLSISINISSSQILHQNLPELIQENLDVYDLTAESIELEFTENMLIKQGRKGQQVLDRLNKMGVKLSIDDFGTGYSSLNYLKTLPIHALKIDKSFICDTPRHEADCAIAKSIISLASNLNLDVVAEGVETAEQLTFLKENGCSVIQGFYFSKPLDINAFTAYLNAPSLKKKQTILS

SEQ ID NO: 14393 - DNA, 891 bp, Unknown
  Obtained from environmental sample
  misc_feature (1)..(891): n is a, c, g, or t
ttgcaagagcgctataaagcatcaaaaagccgtctggtaaagatcatcctggagatctcgactttgcgttttatcctttttggtgtgatgatcggtatcaataagatcgtcagtgccctcatgcagcgcgatgtcgatgccttcttaagcttctttgagcgggctgcacataacgatcaggtcatcaactacaagcaaatattcttcaaagagttcaggaccatggtgatgtatgccaatgagatgcttgagaccatcatgcagcagaagatatccctctcccagttaaacatctctttggagcaaaaagtacagcagaagacccaggccctgcaagacaattatgaagagctgaaaaaggaacaacagttctcccagcacctcctggactctcaaaaacgttttttacgccatgcagtccatgagacgaacacgcccttaagtgttatcgtgaccaatatcgatcttttcacaatgaaacacggaaaagacaagcagctctccaagatcgatgccgctgtgaagaacatctttaatatctatgatgacctgagctatcttgtcaaaaaagatcaggtcgagtatccgcgcagcgttatcaatctcaacacctaccttcaaagccgaaaagagttttttgaagaggtcgctgaacagtcccgcctctccttcgtcttcgcaccttgcgaaggagagcactatatctacttcaatgagaccaagcttcagcgtatcatcgacaacaacatcactaatgcgatcaagtacactctgccctccgaacagatacatatacagacctatctcaagggtatgcatatccattttgagatatacagccgttccaagaagatagaagatatcaacaaagtcttgaacctactaccgtga

SEQ ID NO: 14394 - protein, 296 aa, Unknown
  Obtained from environmental sample
  DOMAIN (131)...(193): His Kinase A (phosphoacceptor) domain
  misc_feature (1)..(296): Xaa is any amino acid
MQERYKASKSRLVKIILEISTLRFILFGVMIGINKIVSALMQRDVDAFLSFFERAAHNDQVINYKQIFFKEFRTMVMYANEMLETIMQQKISLSQLNISLEQKVQQKTQALQDNYEELKKEQQFSQHLLDSQKRFLRHAVHETNTPLSVIVTNIDLFTMKHGKDKQLSKIDAAVKNIFNIYDDLSYLVKKDQVEYPRSVINLNTYLQSRKEFFEEVAEQSRLSFVFAPCEGEHYIYFNETKLQRIIDNNITNAIKYTLPSEQIHIQTYLKGMHIHFEIYSRSKKIEDINKVLNLLP

SEQ ID NO: 14395 - DNA, 438 bp, Unknown
  Obtained from environmental sample
  misc_feature (1)..(438): n is a, c, g, or t
atgacaacaaatgaagataacctaaaaaaaataatttcccatgccaaagagtatggttttgtatttccatcaagtgaaatttatgatggacttagtgctgtgtacgattacggacaattaggtgctgaattaaaaaagaatattaaagatttttggtggaaatctatggtgcaaatgcatgaaaatattgtaggtatagatgccgctatttttatgcatcctgaaacttggaaagcttctgggcacgttgatgcgtttaacgacccattgattgacaataaagattccaaaaaaagataccgtgccgatgtgttaattgaagaatacattgaaaaaattcgtttaaaaaacgaaaaaagaagtagaaaaaggcaaaaaacgtttttgcagatagctttgacgaaatacaaattagagctaccaatccaaatattttaa

SEQ ID NO: 14396 - protein, 145 aa, Unknown
  Obtained from environmental sample
  DOMAIN (33)...(142): tRNA synthetase class II core domain (G, H, P, S and T)
  misc_feature (1)..(145): Xaa is any amino acid
MTTNEDNLKKIISHAKEYGFVFPSSEIYDGLSAVYDYGQLGAELKKNIKDFWWKSMVQMHENIVGIDAAIFMHPETWKASGHVDAFNDPLIDNKDSKKRYRADVLIEEYIEKIRLKNEKRSRKRQKTFLQIALTKYKLELPIQIF

SEQ ID NO: 14397 - DNA, 630 bp, Unknown
  Obtained from environmental sample
  misc_feature (1)..(630): n is a, c, g, or t
ttgatgaaaaaaactatcgtttttcatgatcatgttaaattagctcattacgctaatgctgcttgcgatattgaatttaatttcccaatgggatttaaagaattagaaggaattcactctcgtacagattttgatttaaagcaacacgaaaaacattcaggtaaaaaattgcaatatttcgatcctgaaatcaaccaaaattacgtgccttatgtagtagagacttctattggtttagacagaacatttttggcaatactttcttcggcttataaagaagaaaaattagaagacggttcggaaagaacagtattaaaacttccagcatttttagctccatacaaagcagctgttttgcctttggtaaagaaagatggcctacctgaaaaagcacgtgaaataatggacttattaaaacacgattacaattgccaatatgatgaaaaagattctgttggtaagcgttatagaagacaagatgcgattggaacaccgttttgtattacagttgaccacgaatctcttgaagataacaaagtaaccattagagatagagacactatgcagcaagaacgtgtagctatttcagaagtggaaaatattatcagaaagaagctgactagaaaatag

SEQ ID NO: 14398 - protein, 209 aa, Unknown
  Obtained from environmental sample
  DOMAIN (115)...(205): Anticodon binding domain
  misc_feature (1)..(209): Xaa is any amino acid
MMKKTIVFHDHVKLAHYANAACDIEFNFPMGFKELEGIHSRTDFDLKQHEKHSGKKLQYFDPEINQNYVPYVVETSIGLDRTFLAILSSAYKEEKLEDGSERTVLKLPAFLAPYKAAVLPLVKKDGLPEKAREIMDLLKHDYNCQYDEKDSVGKRYRRQDAIGTPFCITVDHESLEDNKVTIRDRDTMQQERVAISEVENIIRKKLTRK

SEQ ID NO: 14399 - DNA, 312 bp, Unknown
  Obtained from environmental sample
  misc_feature (1)..(312): n is a, c, g, or t
ttgctggacctgattccaaacgacaccatttcgggccgtatcgccaaggacgtctttgaaatcatgatcgaaactggggataacccggataagatcgtcgaagaaaaaggtctgaagcagatcaccgataccggtgcgattgaaaccgcgattgacgaagtcattgcggccaacccggacaaagttcaggaaatccgcgatggcaaggatcgtatgctgggctggttcgtgggccaggtcatgaaatccacgggtggtaaagccaacccgggcatggtcaacaaaatgctccgcgacaaaatcctcggctga

SEQ ID NO: 14400 - protein, 103 aa, Unknown
  Obtained from environmental sample
  DOMAIN (1)...(101): GatB/Yqey domain
  misc_feature (1)..(103): Xaa is any amino acid
MLDLIPNDTISGRIAKDVFEIMIETGDNPDKIVEEKGLKQITDTGAIETAIDEVIAANPDKVQEIRDGKDRMLGWFVGQVMKSTGGKANPGMVNKMLRDKILG

SEQ ID NO: 14401 - DNA, 339 bp, Unknown
  Obtained from environmental sample
  misc_feature (1)..(339): n is a, c, g, or t
ttgctttttggaagaggtacgactgcaagaacaagaccagtaaaattattgtttatattaaatgatataattttaactggacttaaagaagatacactaaaaaaagctaaagagtatgttcacaaaaatattattgaagatttaaatactattgagtttacagtaaaaatagaaaaaatatatattgactattttatgcactctaaagctattgatagacttgaagatgaagatatcactatggataaactttatgaatctaatagaggtggttatagagttataaatagtaaaataaatgaaatctcaaaaaatattattgagatattgaaaggttaa

SEQ ID NO: 14402 - protein, 112 aa, Unknown
  Obtained from environmental sample
  misc_feature (1)..(112): Xaa is any amino acid
MLFGRGTTARTRPVKLLFILNDIILTGLKEDTLKKAKEYVHKNIIEDLNTIEFTVKIEKIYIDYFMHSKAIDRLEDEDITMDKLYESNRGGYRVINSKINEISKNIIEILKG

SEQ ID NO: 14403 - DNA, 558 bp, Unknown
  Obtained from environmental sample
  misc_feature (1)..(558): n is a, c, g, or t
atgattattgacatgaatggacttactgcaaatatatctcaaataacagaacatttaggagttgcagcagatgaagatattaatattataatagataatttctcatattgtaaaaagtcaaatatagaatatgtccaggaactgaaaagattagttaaacttttaagaccttttgaaaagaataaaataaaaaatcatacaattattgctcgagtagatcaaacaatattattggatgttaaaagaaatatagatatctataaaaatctaaaaatggataagtcaaaactcattagagcagctttaaaatactttttagataaaaggtactacatactatcagataatcaaataaaatatgctagagagcttatgaagttaaataatgatgtagcaaatattacaaatgatgttaataggattgcttttgaattaaattgcgctcatgaggttgaaaagattgaaattatagaaacagttgaacagttaaataatatattacatgatgttcaccacatagttataaaactatatgatgaaagtaagaagtttaattaa

SEQ ID NO: 14404 - protein, 185 aa, Unknown
  Obtained from environmental sample
  misc_feature (1)..(185): Xaa is any amino acid
MIIDMNGLTANISQITEHLGVAADEDINIIIDNFSYCKKSNIEYVQELKRLVKLLRPFEKNKIKNHTIIARVDQTILLDVKRNIDIYKNLKMDKSKLIRAALKYFLDKRYYILSDNQIKYARELMKLNNDVANITNDVNRIAFELNCAHEVEKIEIIETVEQLNNILHDVHHIVIKLYDESKKFN

SEQ ID NO: 14405 - DNA, 609 bp, Unknown
  Obtained from environmental sample
  misc_feature (1)..(609): n is a, c, g, or t
atgaatgacattgataaaaaacctttaccaatagattcatgtagtatcgttagcattcctatagcaaacataatgccaaaacttcttgagcaaattcaaactaatgatatactcaatcataaattatttacttgtgaatttttaagctcaactacaaataatattttagtaactcttatctatcacaaaaaattagatgagttatggtcaaatgaagctaaaaaactacaagagaaacttaatatcaaaattatagggagaagtagaaaacaaaaagttattttaagtgatgattttatagatgagacacttataataaacaatgaaaagttttacttccgttatagtgagggtggttttactcaaccaaatcaaaatgttaattcacaaatgatttcatgggttttagataatattgatgcggatgatgacttgtgtgagttgtattgtggtggtggaaatttcactattcaattatcaaaaaaatttaacaaagtgttagcaactgagattagtaaaacttctataaaatctgcaaaaacaaactgcaaactaantaatattactaatatagaatttattagaatgtcaagtgaggaattttgttga

SEQ ID NO: 14406 - protein, 202 aa, Unknown
  Obtained from environmental sample
  DOMAIN (1)...(202): tRNA (Uracil-5-)-methyltransferase
  misc_feature (1)..(202): Xaa is any amino acid
MNDIDKKPLPIDSCSIVSIPIANIMPKLLEQIQTNDILNHKLFTCEFLSSTTNNILVTLIYHKKLDELWSNEAKKLQEKLNIKIIGRSRKQKVILSDDFIDETLIINNEKFYFRYSEGGFTQPNQNVNSQMISWVLDNIDADDDLCELYCGGGNFTIQLSKKFNKVLATEISKTSIKSAKTNCKLXNITNIEFIRMSSEEFC

SEQ ID NO: 14407 - DNA, 486 bp, Unknown
  Obtained from environmental sample
  misc_feature (1)..(486): n is a, c, g, or t
ttggcttacaacgaaactgattcagttgagctaaaatttaaacactatctaaatattcgtcaggatgatgttgatttgtttgacaaatttgtttggttaggtatttttgaaaatactaaaataggtatgaaagatgctactccagcacaaattcttcaacatattttagaacaaaaattatcactttctccaaacgataaagatatgattgtgatgtggcacaggttcttgtttaaacaagatggtaaatttaaagaaattcactcttctatggtagtgaaaggagatgaccaaacctatacagctatggcaaaaacagtcggacttcctgtggcaatagcaacaaaaatgatattaaataaagtaattacaactccaggggttcatgtaccaattttgaaagaaatatatgaaccaattttaaatgaattagaaaattatggaattcactttcaagaaaaagaagtaaatccacgtttttattaa

SEQ ID NO: 14408 - protein, 161 aa, Unknown
  Obtained from environmental sample
  misc_feature (1)..(161): Xaa is any amino acid
MAYNETDSVELKFKHYLNIRQDDVDLFDKFVWLGIFENTKIGMKDATPAQILQHILEQKLSLSPNDKDMIVMWHRFLFKQDGKFKEIHSSMVVKGDDQTYTAMAKTVGLPVAIATKMILNKVITTPGVHVPILKEIYEPILNELENYGIHFQEKEVNPRFY

SEQ ID NO: 14409 - DNA, 360 bp, Unknown
  Obtained from environmental sample
  misc_feature (1)..(360): n is a, c, g, or t
ttgtattatgattcaattgtgaaaatagttaaggataatagaaatatatctgatagagaagatcttctcaaggaattcaatagtaagttcaataaatttagattagagttgattaaatatctttccactgtcaaaccaccttgggtggaaggagagcaacaacgagagtatttgaataagattccgaattatgggtataacttccttttggaaatacttgacccagaagatatagattataaagtagataacacgatgggacttaattttaattataccaacactttacaatcattgaaaaaagtatttatgttcagaggtagttaccaattaaatcatattcatgggaatatagattaa

SEQ ID NO: 14410 - protein, 119 aa, Unknown
  Obtained from environmental sample
  misc_feature (1)..(119): Xaa is any amino acid
MYYDSIVKIVKDNRNISDREDLLKEFNSKFNKFRLELIKYLSTVKPPWVEGEQQREYLNKIPNYGYNFLLEILDPEDIDYKVDNTMGLNFNYTNTLQSLKKVFMFRGSYQLNHIHGNID

SEQ ID NO: 14411 - DNA, 456 bp, Unknown
  Obtained from environmental sample
  misc_feature (1)..(456): n is a, c, g, or t
atggctgtcattaaaagaaaaaatgatagagctattatgatttttaatcctccatcaaacttacaattgggttttggttacaatatagttgtaaatagtattgatttatataatggattaaaagagattaaaaaaatatcagatattcaaaagttaaactctatagagaattattctaactattatatagatgctaatactattaatctttttgatataaaaaatcaaaataatattataaaaaatctaactggggtatatcaaaaaggttatttgtattttaaaaaaggaactaaagaggaaaaaataaaactctacttttacaaagagttacaaagaccaaaggacggtgaaaaaatcaccataacctccggtcacttaagtatatataaatcaaaaattcaaattgttttatatagtaaaaaagactttattaagcatgtccaagaaatttaa

SEQ ID NO: 14412 - protein, 151 aa, Unknown
  Obtained from environmental sample
  misc_feature (1)..(151): Xaa is any amino acid
MAVIKRKNDRAIMIFNPPSNLQLGFGYNIVVNSIDLYNGLKEIKKISDIQKLNSIENYSNYYIDANTINLFDIKNQNNIIKNLTGVYQKGYLYFKKGTKEEKIKLYFYKELQRPKDGEKITITSGHLSIYKSKIQIVLYSKKDFIKHVQEI

SEQ ID NO: 14413 - DNA, 315 bp, Unknown
  Obtained from environmental sample
  misc_feature (1)..(315): n is a, c, g, or t
atgaataccagagaaggagagttcgcgtatcatatagatcttgatattccaggagttaaaaaagaggatataaaggttgatattgaagataatattctgaaaatatctggtgagagaaattttaaaaatgaggtaaaagaggaagattactataaagttgagacttcatttggcaagtttcagagaaatttcacactgcctgagaatgtagatgtagaaaacatcggagcatcagctgaagatggtgtgctggagattgtcctgccaaaaattgctcaaaaagaaaaagaggtgaaaaaaatagagattaaatag

SEQ ID NO: 14414 - protein, 104 aa, Unknown
  Obtained from environmental sample
  DOMAIN (2)...(104): Hsp20/alpha crystallin family
  misc_feature (1)..(104): Xaa is any amino acid
MNTREGEFAYHIDLDIPGVKKEDIKVDIEDNILKISGERNFKNEVKEEDYYKVETSFGKFQRNFTLPENVDVENIGASAEDGVLEIVLPKIAQKEKEVKKIEIK

SEQ ID NO: 14415 - DNA, 825 bp, Unknown
  Obtained from environmental sample
  misc_feature (1)..(825): n is a, c, g, or t
ttgcttgataatggttacgctcaaaaacttaataattcattagtccttaattatgaccaaattattgaattagatgaagacgaacaatctctacttggtctacctgagagatatccattttcaataattattaaatccgatgggacattaaatgaaaatgctttcaaatttaattggcaattcgctaaacatgaatatggtggtcagttagtatttcaaagagtaggctgcttgttgctattcaacaaacaaccaatatatgttctttgtgatgaggattataaaatttgtgaagcgctagatgaatttaactctctaccagaatcagataaaaactttacatcaaacctattctccttcgctgacataaaagaattgagtttgaattctgctgttattcttgatcaatacttaatccaagagaatgtctttaagaccgacaatctagtattagatgtaaaaattgaaaggaacaaagttcaagttaccccaaagatatctgaagaacacgaaatcaatgaaatatttgtaactaaatttgatagagaaagagatggtaaaaacctctacaatattcagaaaggatctgagcgaacgagaataatcgttgatgatgcacagaagaaagaatttcagaaaataaaggatgtaaataagctaagccaagatgaaataattgagataantaataacccgactgaatactttgaccaagacaatattgatatagaagaatttagtaaaagagtaaaagaaattggacattataccacaaagttctatccttttattacccatataaatcagaatgggtacccggcataa

SEQ ID NO: 14416 - protein, 274 aa, Unknown
  Obtained from environmental sample
  misc_feature (1)..(274): Xaa is any amino acid
MLDNGYAQKLNNSLVLNYDQIIELDEDEQSLLGLPERYPFSIIIKSDGTLNENAFKFNWQFAKHEYGGQLVFQRVGCLLLFNKQPIYVLCDEDYKICEALDEFNSLPESDKNFTSNLFSFADIKELSLNSAVILDQYLIQENVFKTDNLVLDVKIERNKVQVTPKISEEHEINEIFVTKFDRERDGKNLYNIQKGSERTRIIVDDAQKKEFQKIKDVNKLSQDEIIEIXNNPTEYFDQDNIDIEEFSKRVKEIGHYTTKFYPFITHINQNGYPA

SEQ ID NO: 14417 - DNA, 402 bp, Unknown
  Obtained from environmental sample
  misc_feature (1)..(402): n is a, c, g, or t
atgggttttaagcaaataataaaaaaaaataaattaattttaaatgcatattttttaattcaaggatataaatctttcattaattttaaaccacttgtgttatttaaacaatatgcttggtttataggtcagtataaagaattcaaaaaactaaaggctaatggtaaattttctaaaatagaatggtatccttgtttacttgataatatttcttgcactcctcttgagccaacatacttctttcaagatacttgggcagcaaaacaaattttcaggcttaagccaaaacatcattatgatattggaagttcagctaaaacgattgggatattatcacagtttgttccaactacaatggtcgatattagaccaatagaattagaacttgaaaatctgttttaa

SEQ ID NO: 14418 - protein, 133 aa, Unknown
  Obtained from environmental sample
  misc_feature (1)..(133): Xaa is any amino acid
MGFKQIIKKNKLILNAYFLIQGYKSFINFKPLVLFKQYAWFIGQYKEFKKLKANGKFSKIEWYPCLLDNISCTPLEPTYFFQDTWAAKQIFRLKPKHHYDIGSSAKTIGILSQFVPTTMVDIRPIELELENLF

SEQ ID NO: 14419 - DNA, 573 bp, Unknown
  Obtained from environmental sample
  misc_feature (1)..(573): n is a, c, g, or t
ttggatgctattcgtgaaattgttctaaatatgattgttcatagagattatagagatagtagtgacagcgttataaaaatatttgatgatagaattgaattttttaatccaggttctctatatgataatttaaccgtagagcagcttctgacaaacaattatatatctaaaactagaaataagctagtagctcttatgtttaaagagtgcgggataatagaaaaatacggctctggtattcgtagaataataacacactgcattgaccatggcatcatagaaccaaagtttgaagagatacaaaaaggctttatggtcactatgtataatcaaaaggcaaatgtcggagtaaatgtcggagtaaatgtcggagtaaatgtcggagtaaatgtcggagtaaatgatctgtatatctttataaaaaagcatcaacctgttagagtaagttcaattaaagaggaatttaataaggtaaccacaagaactattgagcggtggataaaaagacttaaagaagaaaataaaattgaatatcgaggatcttccaaaactggtgggtattttgaaaaatag

SEQ ID NO: 14420 - protein, 190 aa, Unknown
  Obtained from environmental sample
  misc_feature (1)..(190): Xaa is any amino acid
MDAIREIVLNMIVHRDYRDSSDSVIKIFDDRIEFFNPGSLYDNLTVEQLLTNNYISKTRNKLVALMFKECGIIEKYGSGIRRIITHCIDHGIIEPKFEEIQKGFMVTMYNQKANVGVNVGVNVGVNVGVNVGVNDLYIFIKKHQPVRVSSIKEEFNKVTTRTIERWIKRLKEENKIEYRGSSKTGGYFEK

SEQ ID NO: 14421 - DNA, 627 bp, Unknown
  Obtained from environmental sample
  misc_feature (1)..(627): n is a, c, g, or t
atgataacggtaaagatgatgaatagtataagctttatatcaaataggggtgtgaagcctataattgttctaattacactaactattatttttagtataatttcagatttttttggaggtttgttttttttaataactcttttttctctttatgtttttagagatacaaaaagatatatatttgaaaatagtgatagtgttttatcacctattgatggaaaagtaattgccattgatagggttgatgataaggtaaaagtatattgtaaagtgtctctttgggataatcatacagtaagagcaccatttagtggtgaagttaaagttaaaaaatatcataaaggtttaaatttagatcctaatacagtaaaagcaaaaactttaaatgaacagattagctataagtttatttcagacaataaaaaagagtatttaaaattaaagttaataagtggtttttttaatattggtattgaaaaaactgagaacaaaactcttttacaaggagatgctatatcattttttatagatggcattgctgtaattactgtaagtaaagagagtaatctattagttcaaataggggataaaatatcttctggacaatctattctatataaaaaataa

SEQ ID NO: 14422 - protein, 208 aa, Unknown
  Obtained from environmental sample
  DOMAIN (45)...(206): Phosphatidylserine decarboxylase
  misc_feature (1)..(208): Xaa is any amino acid
MITVKMMNSISFISNRGVKPIIVLITLTIIFSIISDFFGGLFFLITLFSLYVFRDTKRYIFENSDSVLSPIDGKVIAIDRVDDKVKVYCKVSLWDNHTVRAPFSGEVKVKKYHKGLNLDPNTVKAKTLNEQISYKFISDNKKEYLKLKLISGFFNIGIEKTENKTLLQGDAISFFIDGIAVITVSKESNLLVQIGDKISSGQSILYKK

SEQ ID NO: 14423 - DNA, 576 bp, Unknown
  Obtained from environmental sample
  misc_feature (1)..(576): n is a, c, g, or t
atgatcgctgagggatgctttggattnaatactgttgctattgctaataacaaagaaatactagtacgaggtacaaatataatgaaagggtattataaagatgaagaagcaagcaaagaagcagtagacagtaaggattggttgcatacgggggatcttggttttatagatagagatggttttatatctattattggacgagcaaaagatgtcattgtcttatcaactggtaagaatatttttccagaggcaatagaaaatatattaaatgaaagtagatatattagccagagtatggtttatggtgataatcaaaaacatatttcagccttgatagtgccaaattttgagcaactaaaaaaatggtgcgctaaacataatttaaaatttgatcttgatgatcagcgtataaatgatttttacgaagataagttaaaccagagattaaaagatcatgccaaagtggaacaaataaataattttaaattattatctgaagaatttagtcaggaaaatggatttttaacacctaccttgaagttgaagagatataagatattaagtttacatttataa

SEQ ID NO: 14424 - protein, 191 aa, Unknown
  Obtained from environmental sample
  misc_feature (1)..(191): Xaa is any amino acid
MIAEGCFGXNTVAIANNKEILVRGTNIMKGYYKDEEASKEAVDSKDWLHTGDLGFIDRDGFISIIGRAKDVIVLSTGKNIFPEAIENILNESRYISQSMVYGDNQKHISALIVPNFEQLKKWCAKHNLKFDLDDQRINDFYEDKLNQRLKDHAKVEQINNFKLLSEEFSQENGFLTPTLKLKRYKILSLHL

SEQ ID NO: 14425 - DNA, 342 bp, Unknown
  Obtained from environmental sample
  misc_feature (1)..(342): n is a, c, g, or t
atgtcagaaaataaatataaatcagaagttgaagccatagatgactttgttaaaagatacgatattttaaaacaagaaatcggaaaagtaattgttggacaagatgaggtgattaaaagtgtattaatttctatttttagtagaggtcattgtttgttggtgggtgtgccagggttggcaaaaacattacttataaacactttggcagatgcattagggttaagttttacagaatacaattactcccgattaatgccatcagaacatatgggttcggaaatcttaaatgaaaccaagaattttaaattattaaagaaccttatttgccaaccatatttttag

SEQ ID NO: 14426 - protein, 113 aa, Unknown
  Obtained from environmental sample
  misc_feature (1)..(113): Xaa is any amino acid
MSENKYKSEVEAIDDFVKRYDILKQEIGKVIVGQDEVIKSVLISIFSRGHCLLVGVPGLAKTLLINTLADALGLSFTEYNYSRLMPSEHMGSEILNETKNFKLLKNLICQPYF

SEQ ID NO: 14427 - DNA, 300 bp, Unknown
  Obtained from environmental sample
  misc_feature (1)..(300): n is a, c, g, or t
atgttagaagtttttcatgtatctaaaaagtttgataaaactgaagtactaaaaaatataaatatatccatgcaacaaggtgagatcatctccttgnntagtaaaaagcggagcggaaaaagtactatattaaaatatatagctgggtttgaaagagctgatagcggctcttgtatctataacaaaaaaacaatttttagccgggatgttttttgtgaacccaagaataggcatatttggttttcgaatttcaaaactatgccactcctcccaccatcttataattgcaaaaaaatatag

SEQ ID NO: 14428 - protein, 99 aa, Unknown
  Obtained from environmental sample
  misc_feature (1)..(99): Xaa is any amino acid
MLEVFHVSKKFDKTEVLKNINISMQQGEIISLXSKKRSGKSTILKYIAGFERADSGSCIYNKKTIFSRDVFCEPKNRHIWFSNFKTMPLLPPSYNCKKI

SEQ ID NO: 14429 - DNA, 483 bp, Unknown
  Obtained from environmental sample
  misc_feature (1)..(483): n is a, c, g, or t
ttggaaaacattgactgtcctaatgacagcgagattttcaagttccaatatggagacgcctgtcaaattccattttcggataaattctttcacatagcacactccaattctgtgattgaacatgttggaaatatggaagacatgttaaaattctcgaaagaaactcagagaattgcaaaatcatattatgttcagactcccaatttttggtttccttttgaaccacattttatgtttccatttttccattggctacccaagcctcttaggattaaaatgattcaaaatttcaatctcggacacatcgaaaagtcaaataatttaatcgatgctattattaaaatagaaagcgcaaacttactcacgtcaaaagaaattaaaaatttattcacggacggaaaacaaatcagagaaaaagtatttggaattacaaagtcaattacagcgataagaaaagaagatgaaaattgcaattgcagttaa

SEQ ID NO: 14430 - protein, 160 aa, Unknown
  Obtained from environmental sample
  misc_feature (1)..(160): Xaa is any amino acid
MENIDCPNDSEIFKFQYGDACQIPFSDKFFHIAHSNSVIEHVGNMEDMLKFSKETQRIAKSYYVQTPNFWFPFEPHFMFPFFHWLPKPLRIKMIQNFNLGHIEKSNNLIDAIIKIESANLLTSKEIKNLFTDGKQIREKVFGITKSITAIRKEDENCNCS

SEQ ID NO: 14431 - DNA, 366 bp, Unknown
  Obtained from environmental sample
  misc_feature (1)..(366): n is a, c, g, or t
atgccaattaacgatcaatacattcaaataaaagacgctaaggttcacaatctcaagaacgtttctataaatattaaacgcgataagttcgttgttattactggtgtttcgggatctggtaaatcttctttagccttcgatactatttatgccgaaggacaaagaagatatgttgagagtttatcatcttatgcaagacaatttttaggtaaaattataaaactgatgttgaatttattaaagtattcctccgctatagcaatgaaacaaaagttaatacagaaatccaagattctcggtggtacttcaccgaagtttaccactatcttaaactttattttggtccgaaaggaaaaacccttctct

SEQ ID NO: 14432 - protein, 122 aa, Unknown
  Obtained from environmental sample
  misc_feature (1)..(122): Xaa is any amino acid
MPINDQYIQIKDAKVHNLKNVSINIKRDKFVVITGVSGSGKSSLAFDTIYAEGQRRYVESLSSYARQFLGKIIKLMLNLLKYSSAIAMKQKLIQKSKILGGTSPKFTTILNFILVRKEKPFS

SEQ ID NO: 14433 - DNA, 558 bp, Unknown
  Obtained from environmental sample
  misc_feature (1)..(558): n is a, c, g, or t
atgataattgaagactctaatgttcttatgcaatcaaaagttgaatctcaagagatacactactcttcaaatgaagtggttgagataaaatatgactttctctcaatagttgaagaaaatggatataaagctagagtagctacggaacaacttctaagcactgattttagatcctataaatcaaaagttcaaaaaacaatctacaattacaaaaatcaaatgtgttcaaaagagcaaatgaataagcaaattatcgaaaatattatagataggttttttaatagtgataaagatattttcaaatatccacaaaaagatttaaacaatgaacaaaatctcaaaaatacttctataacaatagaaacaaaagaggaatactacaaaaaacaaactgtagacttctctacctctttagagatacaaacgccaaataaaaactatagtatgaatttagaggttgctttttcaaaagagctttatgaggcacatagtatggaattacaattttggaattcaaacctaaaagatccctttggtatgaactatggtgaagaatag

SEQ ID NO: 14434 - protein, 185 aa, Unknown
  Obtained from environmental sample
  misc_feature (1)..(185): Xaa is any amino acid
MIIEDSNVLMQSKVESQEIHYSSNEVVEIKYDFLSIVEENGYKARVATEQLLSTDFRSYKSKVQKTIYNYKNQMCSKEQMNKQIIENIIDRFFNSDKDIFKYPQKDLNNEQNLKNTSITIETKEEYYKKQTVDFSTSLEIQTPNKNYSMNLEVAFSKELYEAHSMELQFWNSNLKDPFGMNYGEE

SEQ ID NO: 14435 - DNA, 663 bp, Unknown
  Obtained from environmental sample
  misc_feature (1)..(663): n is a, c, g, or t
atgcataaaccaaataagtttggagatgatttaacagagataagatatacttttaaatatgctaatgagatgaaaaaaagtatttttgggtttgaacaggggcgttctactcatgcttttcgatatacttttccttttatccataacaatcaacatatgggtgctatagatatctctttatcatctgaatctattcaggaaaaattacaagatataaataatatccattcccattttttagtagataaaaagatatttcataaaaaagtttgggaaagtagtaatcttatgaacaggtatattcaaagtattgaacataaagattatatgtttacattaaataaatttcataacaaagaaagattattgaatagtaaaaagagaataatatttcctttaaaagatgaaataaataaaaaaatagagttaaaacaaccctttgctgtatataaacaatatacaaataatgtaaatgtagttacttttttaccaattgataatgtacgagaagagaaagctgtagcttatttggtatcttatgataaagatccatatatttatgatatatatagaagttattctattataaatatagtattatttgtaggtttggcaacactattttactttatctatagaaatttaaatttaaaaaagagctag

SEQ ID NO: 14436 - protein, 220 aa, Unknown
  Obtained from environmental sample
  misc_feature (1)..(220): Xaa is any amino acid
MHKPNKFGDDLTEIRYTFKYANEMKKSIFGFEQGRSTHAFRYTFPFIHNNQHMGAIDISLSSESIQEKLQDINNIHSHFLVDKKIFHKKVWESSNLMNRYIQSIEHKDYMFTLNKFHNKERLLNSKKRIIFPLKDEINKKIELKQPFAVYKQYTNNVNVVTFLPIDNVREEKAVAYLVSYDKDPYIYDIYRSYSIINIVLFVGLATLFYFIYRNLNLKKS

SEQ ID NO: 14437 - DNA, 489 bp, Unknown
  Obtained from environmental sample
  misc_feature (1)..(489): n is a, c, g, or t
atgaaaacactatatattataaggcatgcaaaatctagctggaaagatattgctttagatgactttgatagacctttaagtcaaagaggtagagatgatgcattactaatggcaaataagttagtagagttaaacattttcccagacttaattatctcaagcccttcaaaaagaacaaaatgcacaataaacattatagctccacaattgggttatgaaaaagatattgtatatgacgataaaatttatgaatcanatatgacaaatttaaaaaagatagtgaagaatctcgataataaaaataattcagtatttctttttgggcataatcctggtttaaatatgttagcagaagatttatgcggatttataaaaaatattgcaacgacaggtatattgattataaattttgaatgtaactcttggagtgaagtatcaaatctcaatagtaatttaagtgattatatttatcccaaaaaatataaataa

SEQ ID NO: 14438 - protein, 162 aa, Unknown
  Obtained from environmental sample
  DOMAIN (2)...(146): Phosphoglycerate mutase family
  misc_feature (1)..(162): Xaa is any amino acid
MKTLYIIRHAKSSWKDIALDDFDRPLSQRGRDDALLMANKLVELNIFPDLIISSPSKRTKCTINIIAPQLGYEKDIVYDDKIYESXMTNLKKIVKNLDNKNNSVFLFGHNPGLNMLAEDLCGFIKNIATTGILIINFECNSWSEVSNLNSNLSDYIYPKKYK

SEQ ID NO: 14439 - DNA, 495 bp, Unknown
  Obtained from environmental sample
  misc_feature (1)..(495): n is a, c, g, or t
gtgtctatcaagtgctttatgatgcagtggtacgcaaaggttgatcttagacatgctcagttcttagctcctttagctcttgtaatggaagccggaaaattaatacttgtcagagaaatagaatctagcgactatattcaagagtttaaagaaggtctaaatgagtgtagttgtattgaagagtatgaacattctttacttgatactacctcatattatattagtggtctactttttgaacattggaaccttgaaccattatatgtagaaatgttaaaaggtttagactttaaacaaaagacaggctttaaaatggagtattatatagatactcttcacattgtgaggactgctgttaatgtaaaaaatatattaacggatacctctattgaaaaagcatgtttgttcgtagaagatatgaacttagatgttgatcattttagaaatgtagcaaaaagaataaaagagacccatgaacgatctagaaaatattaa

SEQ ID NO: 14440 - protein, 164 aa, Unknown
  Obtained from environmental sample
  misc_feature (1)..(164): Xaa is any amino acid
MSIKCFMMQWYAKVDLRHAQFLAPLALVMEAGKLILVREIESSDYIQEFKEGLNECSCIEEYEHSLLDTTSYYISGLLFEHWNLEPLYVEMLKGLDFKQKTGFKMEYYIDTLHIVRTAVNVKNILTDTSIEKACLFVEDMNLDVDHFRNVAKRIKETHERSRKY

SEQ ID NO: 14441 - DNA, 486 bp, Unknown
  Obtained from environmental sample
  misc_feature (1)..(486): n is a, c, g, or t
atgaacgatctagaaaatattaatacaccttgttatatttgttatgagaaacttttagaaaacaatctaaaagtactagatttcgtgcaaaaagagagcggtgcaaagattattttagctcttaagggtttcgccatgtggagtacatttcctcaggttagagagtatttgcaaggttgtactgcaagtgggcttcacgaggcaaagttagcatatgaaaagtttggtaaagaagttcatacatattcgcctgcatacaaagatgaagatatagatgaaatagcaagaatatctgaacatgtagtttttaactctccaaatcaactttttaagtactctcaaagagttaaagagattaatccagatgtcagtatctctcttcgtataatcctgaacactctgcatctccaaaagagatatacaacccgtgtggcatctacagtcgtttgggaaacacactcgcaacttttgacgaggaagtcttaa

SEQ ID NO: 14442 - protein, 161 aa, Unknown
  Obtained from environmental sample
  misc_feature (1)..(161): Xaa is any amino acid
MNDLENINTPCYICYEKLLENNLKVLDFVQKESGAKIILALKGFAMWSTFPQVREYLQGCTASGLHEAKLAYEKFGKEVHTYSPAYKDEDIDEIARISEHVVFNSPNQLFKYSQRVKEINPDVSISLRIILNTLHLQKRYTTRVASTVVWETHSQLLTRKS

SEQ ID NO: 14443 - DNA, 573 bp, Unknown
  Obtained from environmental sample
  misc_feature (1)..(573): n is a, c, g, or t
ttgcaagagaagttttttaagtactttaaaggtcttaaatacatcaatttgggtggtggtcatcacataacaaaaaagggttatgatattgaaaaactcattagaatcatcaaagagtttaaagcaaaatacgatgtagaagtttacttagaaccgggtgaagcagtaggttgggaaacaggaatcttggtctctacagttttagatattgtagacaacggaatgaaaatagcaatacttgatacttccgcagaagcacatatgcctgatacattggcgatgccttatcgtgcaaatgttagagattcaggtaaagagagagaaaaagagtttacttaccgttttggcggtaatacatgtctagcaggggatatcatgggtaattattcctttgataaagccttaaagattggagataaagtaatttttgaagaccaaattcactatacttttgttaaaaatactacattcaatggaataaaacttccatcgttgatgatacaaagaaaagatggacgtctagaaatgataaaagagtttggatatgaagaatataaaaatagactttcttga

SEQ ID NO: 14444 - protein, 190 aa, Unknown
  Obtained from environmental sample
  DOMAIN (62)...(169): Pyridoxal-dependent decarboxylase, C-terminal sheet domain
  misc_feature (1)..(190): Xaa is any amino acid
MQEKFFKYFKGLKYINLGGGHHITKKGYDIEKLIRIIKEFKAKYDVEVYLEPGEAVGWETGILVSTVLDIVDNGMKIAILDTSAEAHMPDTLAMPYRANVRDSGKEREKEFTYRFGGNTCLAGDIMGNYSFDKALKIGDKVIFEDQIHYTFVKNTTFNGIKLPSLMIQRKDGRLEMIKEFGYEEYKNRLS

SEQ ID NO: 14445 - DNA, 717 bp, Unknown
  Obtained from environmental sample
  misc_feature (1)..(717): n is a, c, g, or t
ttgctttggttaagtaaaagcagtaattttaaaaaatctaaagccataagaggcggaattccaatctgttggccttggtttggtgaacataaaaccgataaaacacttcctaatcatggctttgccagaattactacatgggattatatcagcactcaagaactaaatgatgaggtgagcgtggtaactcttatactcaaaagttcaaaagatagcttgacactgtttccttacttatttgaattaactttagagattgttatctctaataagctaaaagtttcactaaaaactaaaaacgttgatacaaaaccctttagaatttcacaagcacttcatagctaccttttgatagatgatatagagaatgtaagtgtagatgggctggataataaagagtactataacaaagtagataacagttataacaacactcaaacagataaactgagcttcactcaagagacagatagaatatatcaaaatatcaccactccactcacgctaacacagaaaaatagagaaataactatcttctcagaaggctcagagagtgtcgttatttggaatccatggagagagttggcacataagatgagtgaccttagtagttactcagattttctctgtatcgagagtgcaaatgtacttcaagacgagcgtaaaattgaaccaaatgagactcatactcttagtgcaatttttacancagggtag

SEQ ID NO: 14446 - protein, 238 aa, Unknown
  Obtained from environmental sample
  DOMAIN (1)...(236): Aldose 1-epimerase
  misc_feature (1)..(238): Xaa is any amino acid
MLWLSKSSNFKKSKAIRGGIPICWPWFGEHKTDKTLPNHGFARITTWDYISTQELNDEVSVVTLILKSSKDSLTLFPYLFELTLEIVISNKLKVSLKTKNVDTKPFRISQALHSYLLIDDIENVSVDGLDNKEYYNKVDNSYNNTQTDKLSFTQETDRIYQNITTPLTLTQKNREITIFSEGSESVVIWNPWRELAHKMSDLSSYSDFLCIESANVLQDERKIEPNETHTLSAIFTXG

SEQ ID NO: 14447 - DNA, 597 bp, Unknown
  Obtained from environmental sample
  misc_feature (1)..(597): n is a, c, g, or t
atgcaaaaccagagagttgatgaaattgtcttacagattaaaaatctagaagatgaactgatagagacgctaaaagagaaagagagtgagtttttctataaaatagaaaatgagaagattaaatttgaaaaaagagtcatagctgagggtcgatcaaaaattatcagctcaattaaatatttgtcatctttttctgttttagcaatcttaacaatcccttttatttgggccatgattataccgattatgtttgctgatattttagtaaccatctaccaaagcatctgttttcccatctacaaaataccaaaagtcaaacgaagtgaatatgttattttggatagatataacctattttatctagatcaagttgagaagacaaactgcctatattgtgaatattttaatggtgttattgcatatgtaagagaggtagctgcgagaacagagcagttttggtgtcctataaaacactctaaacctctaaaagacaaacactccagatatgataacttttttgattttggagactaccttaaatacagagatgagttagagaaaaaaagatctaattttaaagatttgcaagaagagtag

SEQ ID NO: 14448 - protein, 198 aa, Unknown
  Obtained from environmental sample
  misc_feature (1)..(198): Xaa is any amino acid
MQNQRVDEIVLQIKNLEDELIETLKEKESEFFYKIENEKIKFEKRVIAEGRSKIISSIKYLSSFSVLAILTIPFIWAMIIPIMFADILVTIYQSICFPIYKIPKVKRSEYVILDRYNLFYLDQVEKTNCLYCEYFNGVIAYVREVAARTEQFWCPIKHSKPLKDKHSRYDNFFDFGDYLKYRDELEKKRSNFKDLQEE

SEQ ID NO: 14449 - DNA, 972 bp, Unknown
  Obtained from environmental sample
  misc_feature (1)..(972): n is a, c, g, or t
atggctgaggatattatggggaaaccagggaaggaaatgattggcgttttaggtgtacttaaagagatttacaggctctttatctttgaactctacagtaaagaaaataacgaaataacctggaataatcctcagtggtcaattctttatcctgtctctgtatcattccaaaatggaattccttatcagatatcctatcttgatgacaatcagcaatcttttacagatgattgcaatagatgtttttttcagtcagtggaagatattaatcttcttcctgtcctaaaggaattctccaaagatcttgttgtcacaagaaatggagcgaatgtaaaagttacaggccctgcgaaccttgtagatacgccaacaatgacagaagcagaagcattcaagattgcccaatatgtttattatactgcaaagggaagcattttaagaaaaggttcaaggggaaaacaaccttttgaaatcaaggtggcctttaatttcagccccctgataattgattcccaacaggatttagcccattatttaataacagtttcctttactgtaaagggattggctttgcctctgtgggcggccaaagcccggaagcaatttctttttaatcttgaaactcttataaaatggaaagatgttactccagaggagaatgttgctccaagtgttgaaacggttcccacgaacattgatgctgatgaagtcaaagaagttgtagatagtaaaaagagttgtcagttgtggcgtctggacaggacaacagtgaatgactttcttacagaagtcggcatgcccgttgatggccgcatagataatttgccaacaaggaaagagattcttcaggcagctaaagatgaatctggaaagaaaacgttaaagttttcagataaacgggctgcactggcaaaagggcacgaatatattcacgatggctttttcgtgagagactatggaactcactgttaa

SEQ ID NO: 14450 - protein, 323 aa, Unknown
  Obtained from environmental sample
  misc_feature (1)..(323): Xaa is any amino acid
MAEDIMGKPGKEMIGVLGVLKEIYRLFIFELYSKENNEITWNNPQWSILYPVSVSFQNGIPYQISYLDDNQQSFTDDCNRCFFQSVEDINLLPVLKEFSKDLVVTRNGANVKVTGPANLVDTPTMTEAEAFKIAQYVYYTAKGSILRKGSRGKQPFEIKVAFNFSPLIIDSQQDLAHYLITVSFTVKGLALPLWAAKARKQFLFNLETLIKWKDVTPEENVAPSVETVPTNIDADEVKEVVDSKKSCQLWRLDRTTVNDFLTEVGMPVDGRIDNLPTRKEILQAAKDESGKKTLKFSDKRAALAKGHEYIHDGFFVRDYGTHC

SEQ ID NO: 14451 - DNA, 408 bp, Unknown
  Obtained from environmental sample
  misc_feature (1)..(408): n is a, c, g, or t
atgttagatttaatcaaaaaaatgactctttttcatgaatattatgaacaatggattctcatctataaagaaggagccgtgagaaaagttacaatgaacaaatatcatcaaacagaactttggctaaagaagttaatccctaaattacgaatttgtgatttaacacgtagaacataccaacaattacttaatgattacgcagaatttcatgaaagacaaacaacaatggattttcatcatcaacttaaagctgcaattttagatgctgttgatgaaggactaattgaaagagatccaactcgtanagctgtaataaaagggaaaataccaaataaaaaaaaaccaaaattcctcaatcaatttgaacttcaaatgttactagcanatcttaatttaaatcagaaataa

SEQ ID NO: 14452 - protein, 135 aa, Unknown
  Obtained from environmental sample
  misc_feature (1)..(135): Xaa is any amino acid
MLDLIKKMTLFHEYYEQWILIYKEGAVRKVTMNKYHQTELWLKKLIPKLRICDLTRRTYQQLLNDYAEFHERQTTMDFHHQLKAAILDAVDEGLIERDPTRXAVIKGKIPNKKKPKFLNQFELQMLLAXLNLNQK

SEQ ID NO: 14453 - DNA, 741 bp, Unknown
  Obtained from environmental sample
  misc_feature (1)..(741): n is a, c, g, or t
ttgctccttaaaaaatttttacggtctattttattgcaaggtaaattccttcattattgggtaccactcatttgggatacccattttgttctatccaagccaggcaattcgagcaaaccacatattccattgcgaaattattactctgggttaacacgctatattttaaatataaaaattgaggcaagaattcataaaggccataaagagattagaatagtgttcttcatttctaatcatcaatcaaatcttgatatcttcttcgtaggccctgctctacctaaaagaacagtctcccttggaaaacagtcccttgtttgggttcctatttttggccttatgtattggctttcaggaaatattcttattaatcgtggcaaccgaaagaaagcatggcaggtgatggaaggcgtggcccgtacaatcaaagaagacaattgcaatgtttggataatgccagagggtacaagatctaaggggcgtgggcttcttccatttaagaaaggtccatttgttgtagcaataaaaggacaagttccaatataccccgttgttttttcaaggtatgaagactcatttgatctggaaaaacttaagcctggaaaagtaatcttagaagcgctagagccaatttcaactaagggcctaacggtaagtgatattgataaacttatggccgatacaagggaaaagatgctcggccatattaataagttatcgcaagaattaaaaactaattag

SEQ ID NO: 14454 - protein, 246 aa, Unknown
  Obtained from environmental sample
  DOMAIN (57)...(187): Acyltransferase
  misc_feature (1)..(246): Xaa is any amino acid
MLLKKFLRSILLQGKFLHYWVPLIWDTHFVLSKPGNSSKPHIPLRNYYSGLTRYILNIKIEARIHKGHKEIRIVFFISNHQSNLDIFFVGPALPKRTVSLGKQSLVWVPIFGLMYWLSGNILINRGNRKKAWQVMEGVARTIKEDNCNVWIMPEGTRSKGRGLLPFKKGPFVVAIKGQVPIYPVVFSRYEDSFDLEKLKPGKVILEALEPISTKGLTVSDIDKLMADTREKMLGHINKLSQELKTN

SEQ ID NO: 14455 - DNA, 540 bp, Unknown
  Obtained from environmental sample
  misc_feature (1)..(540): n is a, c, g, or t
atggcggggattagaaatcgcctaaaggacgactttgaagataagtcagttttaaatctttatagctacactggtgcctactctttatttgcccttaaaaatggtgcaaaagatgtaacgagtgttgacctatcaagtaaatatcttgaatggttagatgagaaccttgctcttaatgaaatgcatggaaatacttctctttgtctatcgacaattaaagcgttagaaaagtttaaggccgaaggagcgaaatttgatttaatcatttgtgatccaccaagtgcctcaagtgatggtaaaaaagtttcaaaagccattgatgcttataaagatatgattcccttatttgatatgattttaaataaaggtggtaaggcccatatctttttaaatactcactcaattactcgtaagaagtttgaaacaaagattaaagaatatattggtaagagaaaaataagcattacaggctccctcaagncttgtgatgactgtccatctnctaanagctttatcgagggagactacctcagggcctaa

SEQ ID NO: 14456 - protein, 179 aa, Unknown
  Obtained from environmental sample
  misc_feature (1)..(179): Xaa is any amino acid
MAGIRNRLKDDFEDKSVLNLYSYTGAYSLFALKNGAKDVTSVDLSSKYLEWLDENLALNEMHGNTSLCLSTIKALEKFKAEGAKFDLIICDPPSASSDGKKVSKAIDAYKDMIPLFDMILNKGGKAHIFLNTHSITRKKFETKIKEYIGKRKISITGSLKXCDDCPSXXSFIEGDYLRA

SEQ ID NO: 14457 - DNA, 1032 bp, Unknown
  Obtained from environmental sample
  misc_feature (1)..(1032): n is a, c, g, or t
gtgagggtatttctagcgtctcccggtgatcttcagaaggaacgccatttgacgaaagaaattgtccgcgaaattaataaacaagtcgcagctcatttaggctttagagtggagttaatgggttgggaagagaccctttcgacctgtggtaggccacaagaaatcatcaacaaagaattggatctttgtgagcttttcattgggataatgtggaaaaaatggggaacacctccttccacaggaaattcctattcttctgggtttgaggaggaatatgatcgttcgttttctcggtggaaacgatctgaaaaaccagaaatggcaatgttttttaaagtaattgccagggatctgcttgatgatccaggcaatgatctgaaaaaagttattgcattccgtgacagtttaattgcggaaaaacagatcctttttaaggattttcaagatgaggtagatttccaaaagtatgttcgtgaaaagatcaccgattatctttggcagttaaaggacactgatattctgaaagagaaagcagctagatcgcagccccccaaacacggcagccccaaagacaaaaaaacagatcctgtaaagagcccattttcagaggaagggcatacgtttttaattaattttttgaagaagacagaatctgaagagagtgaaaaagatattacaccttttgaggtagctaggtttcgtcttttatcaagtgcaatttcaaaaaatggaaatcaggaaccctttcttggtgttcatgacgccaatataatttttgaaaatagaaatatcaaacttggtcgttcagagttctcacgattaattgattgtggtcttaaaaatatcaaaaatgagaacatccctctatggtattgggacaaaaattacaaaggggctatgggcaaaggttatattgcctttcaaacgtttctcgtctgttggccaaaaatgaaaggggtcccatttggtgccctaaagggcgatgacaataaattggggcaaaatttttttcccaaaggggaaaaaatttga

SEQ ID NO: 14458 - protein, 343 aa, Unknown
  Obtained from environmental sample
  misc_feature (1)..(343): Xaa is any amino acid
MRVFLASPGDLQKERHLTKEIVREINKQVAAHLGFRVELMGWEETLSTCGRPQEIINKELDLCELFIGIMWKKWGTPPSTGNSYSSGFEEEYDRSFSRWKRSEKPEMAMFFKVIARDLLDDPGNDLKKVIAFRDSLIAEKQILFKDFQDEVDFQKYVREKITDYLWQLKDTDILKEKAARSQPPKHGSPKDKKTDPVKSPFSEEGHTFLINFLKKTESEESEKDITPFEVARFRLLSSAISKNGNQEPFLGVHDANIIFENRNIKLGRSEFSRLIDCGLKNIKNENIPLWYWDKNYKGAMGKGYIAFQTFLVCWPKMKGVPFGALKGDDNKLGQNFFPKGEKI

SEQ ID NO: 14459 - DNA, 831 bp, Unknown
  Obtained from environmental sample
  misc_feature (1)..(831): n is a, c, g, or t
atgcaaattccacattatgatacagcaatgatttatttaaacaaagcattaaaaattaatcagaaaaatggaaataaaacaggagcattaattaacctttctaatattggcaatgtacattctaaaaaagaagaacatgccgaggcattagagtatcatttcgaagcattagaaatagctactagtttagggttaaaaaactttattgcaactggcaaaggaaatgttggaggtatttatttaagcctgtataaaaatagtaattctcccagtcaaaatgtaatagataatgctcaagaatatttagaggatgctattgctttatgcgatgaaattaattacaaagctcctaaaattggttttttggaaagtttaattgaagtttttgttattcaaaaaaattataagaaagcgtatgaactgacgaatgaaaaaacagctatcaatgattcgttacattcatcatcagttaaagaacaacttactaaattagaaattcaacgagagatagatttaaaagataaagaccttcttataaagaataaagagttggaaatacaatcgttaaacaatcagaaaaagtcgttgttttattcttttgctattattgttttaataattgtgttgtttgtggcatttagccattatagaaaaaaagagaaaaaacaccacgaagttatttcggaaataaaacaaattcagtcgcacgaaattagaggaccaatagcaactattttaggcttattaaagttgctaaaagataaagacagaacagataaatctatagaggaaattattgatggaaagaggagcaaccatactccacgataa

SEQ ID NO: 14460 - protein, 276 aa, Unknown
  Obtained from environmental sample
  misc_feature (1)..(276): Xaa is any amino acid
MQIPHYDTAMIYLNKALKINQKNGNKTGALINLSNIGNVHSKKEEHAEALEYHFEALEIATSLGLKNFIATGKGNVGGIYLSLYKNSNSPSQNVIDNAQEYLEDAIALCDEINYKAPKIGFLESLIEVFVIQKNYKKAYELTNEKTAINDSLHSSSVKEQLTKLEIQREIDLKDKDLLIKNKELEIQSLNNQKKSLFYSFAIIVLIIVLFVAFSHYRKKEKKHHEVISEIKQIQSHEIRGPIATILGLLKLLKDKDRTDKSIEEIIDGKRSNHTPR

SEQ ID NO: 14461 - DNA, 558 bp, Unknown
  Obtained from environmental sample
  misc_feature (1)..(558): n is a, c, g, or t
atgggaaaagtaaatatagttgaaaaagatggaaaaagatatattgatgaggaagaagtttggtgtgagtatgaatgtgtaagtaattggagtattttgatctttttcatattgctaataatatcaataataggtattaaatattattttttagaaaataatatgttggatttcaaagcttatataggtttatcatttatgttggttctttggattagttggttttcaaaagattttaaaactttattaaacaaaggtgcatatatcacacaaaaaaatattgtgactttttcaggtattaaaatacctttagaggatgtttattatagatggggccgaggaatagaatggggaacatctggttttgaaatatttaataatcagcaaatgtatatttcatgtttaaataatgctagtgaaaattttacaaaattaatttctacattagagagtatatctggtaggagtatattgaaaaataatcattatagagtagacccatatgcggtaaaaattaaactaattcaaaaaggagaaaacaatggcagagcaaattaa

SEQ ID NO: 14462 - protein, 185 aa, Unknown
  Obtained from environmental sample
  misc_feature (1)..(185): Xaa is any amino acid
MGKVNIVEKDGKRYIDEEEVWCEYECVSNWSILIFFILLIISIIGIKYYFLENNMLDFKAYIGLSFMLVLWISWFSKDFKTLLNKGAYITQKNIVTFSGIKIPLEDVYYRWGRGIEWGTSGFEIFNNQQMYISCLNNASENFTKLISTLESISGRSILKNNHYRVDPYAVKIKLIQKGENNGRAN

SEQ ID NO: 14463 - DNA, 804 bp, Unknown
  Obtained from environmental sample
  misc_feature (1)..(804): n is a, c, g, or t
atgatggctcgggagagaaataacacaagttacaaatattttaagaacaataattttacaatatggagaagcaagatgaagaatttcattaaaggaattataaaagtaaaacataaacaatttctattaatacttatttcaaaaattaaattatttttttataaaaaagatataggaaataatacatacatggataaaacagtgaatgcatttggttggaaacatataagaattggttctaatacacttattggagagcagacttggcttaatattaatggtagagtaagtaatcataaacatatacaaataggcaactattgttaccttggaagaaggaacttattggcatcaagtaaagaacttataataagtgattatgtaatgacgagcaatgactgtaagtttttgggaagtaatcatgtttataacaaccctttggaaccttatattgccacaggtactatggatgatgatgtattgaaaataggagttaatgtttggattggtgctggtgcaatagtacttggagctgtaactgtagggcatggttccattataggggcaggcagtgttgttactaaagatattccaccttttagtatagctgttggaaatccttgtaaggttgttaaaagatttaattttaaaataaatagatgggaaaaagtagctgattttgataaaaatctagaaatactgatgataaatgaagaagaatatttagaaatattaaaaaaaaataagccaactattaatatgccattaatggcagcaacatcaaaatacggagacatngtatga

SEQ ID NO: 14464 - protein, 267 aa, Unknown
  Obtained from environmental sample
  misc_feature (1)..(267): Xaa is any amino acid
MMARERNNTSYKYFKNNNFTIWRSKMKNFIKGIIKVKHKQFLLILISKIKLFFYKKDIGNNTYMDKTVNAFGWKHIRIGSNTLIGEQTWLNINGRVSNHKHIQIGNYCYLGRRNLLASSKELIISDYVMTSNDCKFLGSNHVYNNPLEPYIATGTMDDDVLKIGVNVWIGAGAIVLGAVTVGHGSIIGAGSVVTKDIPPFSIAVGNPCKVVKRFNFKINRWEKVADFDKNLEILMINEEEYLEILKKNKPTINMPLMAATSKYGDXV

SEQ ID NO: 14465 - DNA, 630 bp, Unknown
  Obtained from environmental sample
  misc_feature (1)..(630): n is a, c, g, or t
ttggaagtacttgaatatataagactttataatccaagtgcacatttaatttatccgtcaagtccagcagttcaaggtgaatgtccagatgctccaatacaggaagtttacataggaaaacctgcctcaccttatggctaccataaaaagataacagaagatttatgtagaagttattcagataaatatgatataaaagtgtcaataattagacttttttctgtttatgggaatggactcaaaaaacaattactatgggatgcttacaagaaaattataaatgcaaaaaaagaagttgtattttggggtactggcgaagaaacaagagattttatacatgtaaatgatgttttatcgataattgaaaaacttttagaaagtgatgataagtttctgatacttaatggtggaacaggtcaaaaacatactataaaaaatgttgtagagatgattcgagagcttagcaacccaaaaataaatataggatttaataatcaagtaaatataggaaatcctgtatactattgggcagatttagaaaagttgaaacagtataattttgaagctgatataaaacttgaagatggaataaaaagttttataacttgggcaaagaacgaaaatgattaa

SEQ ID NO: 14466 - protein, 209 aa, Unknown
  Obtained from environmental sample
  DOMAIN (2)...(208): NAD dependent epimerase/dehydratase family
  misc_feature (1)..(209): Xaa is any amino acid
MEVLEYIRLYNPSAHLIYPSSPAVQGECPDAPIQEVYIGKPASPYGYHKKITEDLCRSYSDKYDIKVSIIRLFSVYGNGLKKQLLWDAYKKIINAKKEVVFWGTGEETRDFIHVNDVLSIIEKLLESDDKFLILNGGTGQKHTIKNVVEMIRELSNPKINIGFNNQVNIGNPVYYWADLEKLKQYNFEADIKLEDGIKSFITWAKNEND

SEQ ID NO: 14467 - DNA, 333 bp, Unknown
  Obtained from environmental sample
  misc_feature (1)..(333): n is a, c, g, or t
atgaaaaaattaaataatataattttatatactttttttgtatcattatttttctcaaacttacacggtgttgatgggaagactacagaatcacaaccacaaatactatttgaacacgaaaatttaaaagaagcacaaaatagaagagagttgttaataaaatttaatacagctgttttatatcttgagcaagaagagtatgttcatgctattaagctttttaaacaatcatcacaaatactcaaaattccctcttatttgaataaaggtattgctttttataaattagggtccattaataatgccttatttatatttaagaaaaatttatga

SEQ ID NO: 14468 - protein, 110 aa, Unknown
  Obtained from environmental sample
  misc_feature (1)..(110): Xaa is any amino acid
MKKLNNIILYTFFVSLFFSNLHGVDGKTTESQPQILFEHENLKEAQNRRELLIKFNTAVLYLEQEEYVHAIKLFKQSSQILKIPSYLNKGIAFYKLGSINNALFIFKKNL

SEQ ID NO: 14469 - DNA, 849 bp, Unknown
  Obtained from environmental sample
  misc_feature (1)..(849): n is a, c, g, or t
ttgtcacatgatagaaaattggattttgtttactattttgcaccatttatatttgaagattatgatagtatgggaataaatgaagcaagaggttttataataaaaaatgaaaatagtatatctgaattaaacatgatgatacaatataatgcagattttttagaagttattaaattagatccaattcaaagaacatataaactacaaaaaatgatagatgaaaagtatgatacaaaagcttacgagtattataatttagctttaacatatgctcaaatatatgattataataatgcatataaatattttaaaaaagcatatagtttagatcatggaaataagctgtattctattatgacatttattacttctaaaaagttaagtttaaatgaagataaagtattttgggaaatattagtaagaaatatacaatcaaataaaggaagttttaattattttgcaaaatatatttataaaatatttgaaaatccagaacaagtattagatgaaaaaacattaagctttaaacaaaaaaaatcaatattttttcgagcattatattttatagataatatagagaaaaatggaattatgaaaacagaaccgctacttgtagagttttcaaaagatccgctagtatatcttttaagtttaatagcaaaagataaagatgaaaatgagtatatttatatttcaagaattcaagatgaattacctaaagtttataataatacatttttaaaaggaagtctagttattacagacttttatttagatactttaaaagcattaggactttttgattatacagattatgatataccaaatcacaatgaaccaagctattaa

SEQ ID NO: 14470 - protein, 282 aa, Unknown
  Obtained from environmental sample
  misc_feature (1)..(282): Xaa is any amino acid
MSHDRKLDFVYYFAPFIFEDYDSMGINEARGFIIKNENSISELNMMIQYNADFLEVIKLDPIQRTYKLQKMIDEKYDTKAYEYYNLALTYAQIYDYNNAYKYFKKAYSLDHGNKLYSIMTFITSKKLSLNEDKVFWEILVRNIQSNKGSFNYFAKYIYKIFENPEQVLDEKTLSFKQKKSIFFRALYFIDNIEKNGIMKTEPLLVEFSKDPLVYLLSLIAKDKDENEYIYISRIQDELPKVYNNTFLKGSLVITDFYLDTLKALGLFDYTDYDIPNHNEPSY

SEQ ID NO: 14471 - DNA, 630 bp, Unknown
  Obtained from environmental sample
  misc_feature (1)..(630): n is a, c, g, or t
atgtaccgaaagtacttgtttaatatcagtaatttagtaaatgttggcaaaaacactttagaagtaattttctacccttcggaacaatacagcattgtagattcaataaactatgagattcctttaccagacaatcgtgccttcaaacgtaaagcaccatatcatagtggttgggattgggctccaaagtttgaaacatttggcttatggcgaaatgtagaattggtaagttggaagtctcaccgaattacagatgtttatattaacacagatagtatttcttgtgataatgcttttttaacttgtagtattaatatagaatctgaaacaaaaggcaataccgaaatatctatttcggacaatcaaaattcgttttgcgaaataactaaaaggatagaattacaaataggtaagaataatattacaatcccaattattataaaaaacccaaaactttggtcttgtaacggtaaaggagaatctttcctctacaattttaaaatcacaagcaaaaaagacaatttttataacgataaaacaatatctactggaataagaactgtaaaattaatttcagaaactgatacaataggagaaagtttctattttcaattactcgagccgatctga

SEQ ID NO: 14472 - protein, 209 aa, Unknown
  Obtained from environmental sample
  misc_feature (1)..(209): Xaa is any amino acid
MYRKYLFNISNLVNVGKNTLEVIFYPSEQYSIVDSINYEIPLPDNRAFKRKAPYHSGWDWAPKFETFGLWRNVELVSWKSHRITDVYINTDSISCDNAFLTCSINIESETKGNTEISISDNQNSFCEITKRIELQIGKNNITIPIIIKNPKLWSCNGKGESFLYNFKITSKKDNFYNDKTISTGIRTVKLISETDTIGESFYFQLLEPI

SEQ ID NO: 14473 - DNA, 591 bp, Unknown
  Obtained from environmental sample
  misc_feature (1)..(591): n is a, c, g, or t
ttgaggccgtcaagcaaatcactgtgtatcgacatgaataatatgagtatctcttatctagattcaaaaaaaattaaagtgtggaagaagtatagcctcagaattttacggtgcatacttccaattgtcgttctatatttcgttatcaaagaaattgacctcactcagctcaagcagaattttgaaaaaactaattcgggtctctttttccttgctctctctctcgcgccacttcttactgttattggtacattccgatggcaagcactcttaaaattgagtcataaacgcaaaataccattaagttttctttttcaacattattggacaggattagcgttgggtttttttgtacctgcatcactcggatgggatgcctatcggatttttatcagcggcagccgttttggaaactatacgataaatattngcatttatgtcgtagaaaagctcgcagcactggtgacatgcatgtccattatcgtcatcacttacccccctaaccaccatagttgtgcactcgaaaatccgaaaaatcttttattttgcaaacttcttctatgccggattctttggttaatcttgggataa

SEQ ID NO: 14474 - protein, 196 aa, Unknown
  Obtained from environmental sample
  misc_feature (1)..(196): Xaa is any amino acid
MRPSSKSLCIDMNNMSISYLDSKKIKVWKKYSLRILRCILPIVVLYFVIKEIDLTQLKQNFEKTNSGLFFLALSLAPLLTVIGTFRWQALLKLSHKRKIPLSFLFQHYWTGLALGFFVPASLGWDAYRIFISGSRFGNYTINIXIYVVEKLAALVTCMSIIVITYPPNHHSCALENPKNLLFCKLLLCRILWLILG

SEQ ID NO: 14475 - DNA, 588 bp, Unknown
  Obtained from environmental sample
  misc_feature (1)..(588): n is a, c, g, or t
ttggctgcaattgattgtacagggcacggggttccaggtgcatttatgagtatgattggaagcagattactaaacgaaattattaatgaaaaaatatatgaaacaaatgaaattcttgaagaattgaacttaagaataagaaaatcattaaatcaggaaatgaaccaaaatcaagatggtatggatgtttgtttgtgcagaattgataaaaacaatagctatactaaagtgaaatttaccggtgcaaaaagacctttaattatttacaataaatttaaaaagaaactatcaataattaaaggcgatagaaaaactattggtggagattattatcaaaacctaagattttcagaaaaagaaataacacttaaaaagggagatacaatatatttaacaagcgatggttatacagaccaaattgataataacagaaaaaaaatcgggcacagacgatttcaaaaactcatttcagacatttcggaaaaatcactaatagaccaaaagcaaatacttgaaaatgaattaaatgaatatcgtagtaaagaagagcaaattgatgatattacaataattggtgttcaaatttga

SEQ ID NO: 14476 - protein, 195 aa, Unknown
  Obtained from environmental sample
  DOMAIN (1)...(195): Stage II sporulation protein E (SpoIIE)
  misc_feature (1)..(195): Xaa is any amino acid
MAAIDCTGHGVPGAFMSMIGSRLLNEIINEKIYETNEILEELNLRIRKSLNQEMNQNQDGMDVCLCRIDKNNSYTKVKFTGAKRPLIIYNKFKKKLSIIKGDRKTIGGDYYQNLRFSEKEITLKKGDTIYLTSDGYTDQIDNNRKKIGHRRFQKLISDISEKSLIDQKQILENELNEYRSKEEQIDDITIIGVQI

SEQ ID NO: 14477 - DNA, 732 bp, Unknown
  Obtained from environmental sample
  misc_feature (1)..(732): n is a, c, g, or t
atgatttatgtatttgcccagagcggtgtggacaaaatgctcaaaaacaaagagatcgataccatggtgatttcccacgatcacattgatcattatttcggtatcgagagcaccctgaaacatcagcctgatatcaagatgtattttccctccacagccatgaaaaaaagctttgatcttttaaagggtgctgatttttccaagacccctggatgccctaaaaatgcatatccccatacgggcgagcttatcgtcaccaagacggacgagttttataagctccaggatggtgccggcgttgtcttttttgacgcccctgcaaccctccaggtccggggtgagaatgtcatgtattttaaagtaaaagataaagggtatgtcactgtgacaggttgctgtcatcccggaatcctgacccttattaattatgcgcgccgtaatttcaaagatggaaagaataattatggatgctatggcggactgcatatttccccctttgaaaactgggatcccaagatggatgatatcattgccggagttcagcaatacaatatggaaaaaatcgcctgcaaccattgcacaggctggatctgggctgaaaaagcggtcaaggccggacttcccattgtgaaaggcactgacaaattccggacctacaaaaaagtagggacccttgcaaaggcaaatacctcaaacatttatacgggcaacggagacacagtcgtcttttaa

SEQ ID NO: 14478 - protein, 243 aa, Unknown
  Obtained from environmental sample
  misc_feature (1)..(243): Xaa is any amino acid
MIYVFAQSGVDKMLKNKEIDTMVISHDHIDHYFGIESTLKHQPDIKMYFPSTAMKKSFDLLKGADFSKTPGCPKNAYPHTGELIVTKTDEFYKLQDGAGVVFFDAPATLQVRGENVMYFKVKDKGYVTVTGCCHPGILTLINYARRNFKDGKNNYGCYGGLHISPFENWDPKMDDIIAGVQQYNMEKIACNHCTGWIWAEKAVKAGLPIVKGTDKFRTYKKVGTLAKANTSNIYTGNGDTVVF

SEQ ID NO: 14479 - DNA, 747 bp, Unknown
  Obtained from environmental sample
  misc_feature (1)..(747): n is a, c, g, or t
atgaaaacatctactttcacaaaattattcaaaggtatcacgctatcggttttagttctaggactaacaacaagttcattatatgcagagactaaaaaagattttaaagttgcatggagtatttatgcaggttggatgccttgggatattatagcttctgaaaaaatcatagacaaatgggcacataaatatggtatcaatattgaggttgtccaaatcaatgactatatagaatcaattaaccaatttagttctggtaaatttgatggttgtacaatggcaaatacagatgcattaggaatccctgctgctggtggtgttgattctacagctttaatcattggtgacttttcaaatggtaacgatgttgttatctctaaagatgcaaaatcaatcaaagatttaaaaggtaaaaatgtaaatttagttgaactttctatctctcattatctattagctagaggtttagagttaaatggtatgtctgaaaaagatttaacagttgtaaatacaagtgatgctgatattgtttctgcatatactacaccacaagttacaaatgtagttacatggaaaccacaggtgagtgaaatacttgctatgccaaaagccaacaatatttttaatagttcagatatccctggtggaattaatagatttaagggtggtaatacccaaactcttaaagataatccagcatttggaaagcttataaccagggcctggaaaaaaaagaagagtttatga

SEQ ID NO: 14480 - protein, 248 aa, Unknown
  Obtained from environmental sample
  misc_feature (1)..(248): Xaa is any amino acid
MKTSTFTKLFKGITLSVLVLGLTTSSLYAETKKDFKVAWSIYAGWMPWDIIASEKIIDKWAHKYGINIEVVQINDYIESINQFSSGKFDGCTMANTDALGIPAAGGVDSTALIIGDFSNGNDVVISKDAKSIKDLKGKNVNLVELSISHYLLARGLELNGMSEKDLTVVNTSDADIVSAYTTPQVTNVVTWKPQVSEILAMPKANNIFNSSDIPGGINRFKGGNTQTLKDNPAFGKLITRAWKKKKSL

SEQ ID NO: 14481 - DNA, 843 bp, Unknown
  Obtained from environmental sample
  misc_feature (1)..(843): n is a, c, g, or t
atgaaaaactatattcttcaagatgaaaatgctgtttattttgagtgtggatatagttgtgataatcttattttcttaaacattagtggtgataaatatttcatcactgatgctagatatgagatagaggcaaaactatttgctaaaaattgcgaagtagttgtaacaaatgatttagtaaaagcaacgcgaaaaatactaaaaaaatcaaaaatcaaaaaaatctcatttgatccaaatgattttaaacttcttacatataactctttaaaagacaacttagatatgaagtttgttcaaaagccaaatttttcaaaattgaaacgaattatcaaaacagatgatgagataaaacttcttaaaaaagctatgagtttaggaagagaaggttttgagaggttttcttcttatattcaaaaagagggtttaggaaaaagtgaaaaatatctcttttttaaagctaaagagtttatgagtaatacaggagagttcgaccttagttttgatccaattgttgcaataaatgaaaatagtgctaaacctcatgctcttcctacggataaaatacttctcagagatgatttacttttagtggacgctgggataaagtaccaaagatattgcagcgatagaacttgtacttcagcagtgaataaaagtttaacatttcatagaaaacaaaaatttaaaacaaagttagaacaaaaagtgtatgatgtagttttaaaagcacaacaaatagcaattagtaaagcaagagctggtatgaaagctagtcaaatagataaactcactcgtaatattatagaaaaagcagggtatggaaaaatattttgtccatag

SEQ ID NO: 14482 - protein, 280 aa, Unknown
  Obtained from environmental sample
  DOMAIN (118)...(280): metallopeptidase family M24
  misc_feature (1)..(280): Xaa is any amino acid
MKNYILQDENAVYFECGYSCDNLIFLNISGDKYFITDARYEIEAKLFAKNCEVVVTNDLVKATRKILKKSKIKKISFDPNDFKLLTYNSLKDNLDMKFVQKPNFSKLKRIIKTDDEIKLLKKAMSLGREGFERFSSYIQKEGLGKSEKYLFFKAKEFMSNTGEFDLSFDPIVAINENSAKPHALPTDKILLRDDLLLVDAGIKYQRYCSDRTCTSAVNKSLTFHRKQKFKTKLEQKVYDVVLKAQQIAISKARAGMKASQIDKLTRNIIEKAGYGKIFCP

SEQ ID NO: 14483 - DNA, 654 bp, Unknown
  Obtained from environmental sample
  misc_feature (1)..(654): n is a, c, g, or t
atgagtttagaaagagaaggttttgagaggttttcttcttatattcaaaaagagggtttaggaaaaagtgaaaaatatctcttttttaaagctaaagagtttatgagtaatacaggagagttcgaccttagttntgatccaattgttgcaataaatgaaaatagtgctaaacctcatgctcttcctacggataaaatacttctcagagatgatttacttttagtggacgctgggataaagtaccaaagatattgcagcgatagaacttgtacttcagcagtgaataaaagtttaacatttcatagaaaacaaaaatttaaaacaaagttagaacaaaaagtgtatgatgtagttttaaaagcacaacaaatagcaattagtaaagcaagagctggtatgaaagctagtcaaatagataaactcactcgtaatattatagaaaaagcagggtatggaaaatattttgtccatagtactggtcatggagtagggttagatatccatgaatatccaacaattaatagtagaaatgatgttattatagaaaataatatggtttttacaattgaaccaggtatctatcttggtgagcaatttggtgtgagaattgaagatacagttgttatgaaaaatggtcgtgcagagatcctctaa

SEQ ID NO: 14484 - protein, 217 aa, Unknown
  Obtained from environmental sample
  DOMAIN (5)...(217): metallopeptidase family M24
  misc_feature (1)..(217): Xaa is any amino acid
MSLEREGFERFSSYIQKEGLGKSEKYLFFKAKEFMSNTGEFDLSXDPIVAINENSAKPHALPTDKILLRDDLLLVDAGIKYQRYCSDRTCTSAVNKSLTFHRKQKFKTKLEQKVYDVVLKAQQIAISKARAGMKASQIDKLTRNIIEKAGYGKYFVHSTGHGVGLDIHEYPTINSRNDVIIENNMVFTIEPGIYLGEQFGVRIEDTVVMKNGRAEIL

SEQ ID NO: 14485 - DNA, 783 bp, Unknown
  Obtained from environmental sample
  misc_feature (1)..(783): n is a, c, g, or t
gtgagtgtagaggaagcaaaagcaacagcacaagatagaaactataagcaaatagcagatgtatatgagaaatatgaaaactatttagagcaaaacaatcttgtggattttgatgatttattactcctaacatataagatacttcaaaaaaaccctcaactatcaaaagatacaagtgatagatataaatatattatggtagatgagtatcaagataccaacgagttacaatataaacttttaaaacaactttgtagtgaacacaataatatttgtgtagttggagatgatgatcagtctatatatggttggagaggtgcaactattaaaaatatccttacatttagtgatacttttaatgatacactagttataaaactagaagaaaattatcgttcaactcataaaatactttttcatgcaaatgctttaatagaacacaatagagacagactagggaaaaagcttgtagggactagagaagagggtaactctataaaaatttacgaatcaaacgatgaaaatgatgaaacaagaaaaatcgttgatgatattaaaaaacttatcgaacaaggtgaatcagcaaaagatattgcagtcttatttagggtaaatgctttaagtagggcgttagaagaggggctcaatagatcaaatatcaactataaactagtgngtggtttaaagttctatgaaagagctgaaatcaaagatttaatagcatattttagagttattacaaatgcaaatgancacttctctataaaaagaattatcaaataa

SEQ ID NO: 14486 - protein, 260 aa, Unknown
  Obtained from environmental sample
  DOMAIN (1)...(260): UvrD/REP helicase
  misc_feature (1)..(260): Xaa is any amino acid
MSVEEAKATAQDRNYKQIADVYEKYENYLEQNNLVDFDDLLLLTYKILQKNPQLSKDTSDRYKYIMVDEYQDTNELQYKLLKQLCSEHNNICVVGDDDQSIYGWRGATIKNILTFSDTFNDTLVIKLEENYRSTHKILFHANALIEHNRDRLGKKLVGTREEGNSIKIYESNDENDETRKIVDDIKKLIEQGESAKDIAVLFRVNALSRALEEGLNRSNINYKLVXGLKFYERAEIKDLIAYFRVITNANXHFSIKRIIK

SEQ ID NO: 14487 - DNA, 903 bp, Unknown
  Obtained from environmental sample
  misc_feature (1)..(903): n is a, c, g, or t
atgcagcgttcaaattccaagatgtttaaatgcaactcttactctcgctcaaaagtttacaatgctccttttgatgttcttttggcaaaacgatttaaccgtgcaaatattttgggtgtagaacttataaatgatgacaagattctgaggtttaaaacttctatcagttcagcatataaagaagaaataacacttttacagttcgaatttaccggcaagtatacaaatgtaatcattctagatgaaaacgagattgtccttgaagctctgcgtcatgttgatttgttctcttcttttcgcgaggtaagagttggacaaaaactattaaatgtaccgactgcacctttcgttgcaaaagagtatcccatagatgatgtagaagtatttttgaacgaagaatactcaaaagatgttcaagcaaagctcttttcacttaaaaaacaaaagctctctcttttaaataagaaactaaaaaagttagagaaattatataactcacttgaagatgaaaaaaaactagaagctacggtgcaaaagtgtcagcatcatggaaacttagttttagcaaatattcataatatcaagccctatcaaaaaaatatagagttaaatgattatgatggaactccaactaaaatagagtttcataaagagttttcaagctcttcgcaaatggcgaattctttgtttacaagaagtaaaaaagcaaaacagaaagttttgcatctacacatagaaaaagaatcacttagctctaaaatagagcatataaaactatttatgtccgcagtagaagatgcaaaagacantagcaaaattacacttttgtttccaaaacaactccaagctaagaagataaaacaaaatgattctatagaaacctttttgggtagagggctataa

SEQ ID NO: 14488 - protein, 300 aa, Unknown
  Obtained from environmental sample
  DOMAIN (1)...(291): Fibronectin-binding protein A N-terminus (FbpA)
  misc_feature (1)..(300): Xaa is any amino acid
MQRSNSKMFKCNSYSRSKVYNAPFDVLLAKRFNRANILGVELINDDKILRFKTSISSAYKEEITLLQFEFTGKYTNVIILDENEIVLEALRHVDLFSSFREVRVGQKLLNVPTAPFVAKEYPIDDVEVFLNEEYSKDVQAKLFSLKKQKLSLLNKKLKKLEKLYNSLEDEKKLEATVQKCQHHGNLVLANIHNIKPYQKNIELNDYDGTPTKIEFHKEFSSSSQMANSLFTRSKKAKQKVLHLHIEKESLSSKIEHIKLFMSAVEDAKDXSKITLLFPKQLQAKKIKQNDSIETFLGRGL

SEQ ID NO: 14489 - DNA, 915 bp, Unknown
  Obtained from environmental sample
  misc_feature (1)..(915): n is a, c, g, or t
atggatactctgacatatacgacaatggataaacacggaaatccactcaaagctgatgtagatgagtttggtgataatacattaggctctaagtcctcaaaagaggataaaaaaatctacctaagagatcaagaaaatagtgagattgttcaaacaacaagagagatcataaaaaagtatcagagtgaagactttcaagttctattagctggaactgccaccataaatgacacaattaaaaaatctatgaaaagtgatatgcaaaaatttgttaaactggtacttttaattattgctatatttttatttcttctatttaaaaggctcagcggcgttattttacctctttttacagttatcttagccataatttctacaatatcactgatggcgatattctcttctcctatcacggtagtaacacaaatacttccatcttttttactagctattaccattggagcgagtgtacatcttcttgccattttttacaaagattatgatttttcaaaagataaaaaagcctcactcaaatatgcacttggacacagtggcttggcaatcgtcatgacatcacttacaacagcagcaggtctttggtcattctcattttctgagttggcacctgttgctgatcttggtaaatttgcaagtagtggtattttactctctttaatgtttactcttattctacttcctgcgcttatcgcaacactgaacatcaaacctaaagatattaaaatagatgctaaaagcagttctcaagaacatactattatggataaaaattttgctaaaaattgcttatatcagtgttacatatcaaaaaattataatgggtatcagggctattattatcccccaaatccattaataccgctttcccagcctaagttttcacataaaacccattaa

SEQ ID NO: 14490 - protein, 304 aa, Unknown
  Obtained from environmental sample
  DOMAIN (35)...(133): MMPL family
  misc_feature (1)..(304): Xaa is any amino acid
MDTLTYTTMDKHGNPLKADVDEFGDNTLGSKSSKEDKKIYLRDQENSEIVQTTREIIKKYQSEDFQVLLAGTATINDTIKKSMKSDMQKFVKLVLLIIAIFLFLLFKRLSGVILPLFTVILAIISTISLMAIFSSPITVVTQILPSFLLAITIGASVHLLAIFYKDYDFSKDKKASLKYALGHSGLAIVMTSLTTAAGLWSFSFSELAPVADLGKFASSGILLSLMFTLILLPALIATLNIKPKDIKIDAKSSSQEHTIMDKNFAKNCLYQCYISKNYNGYQGYYYPPNPLIPLSQPKFSHKTH

SEQ ID NO: 14491 - DNA, 753 bp, Unknown
  Obtained from environmental sample
  misc_feature (1)..(753): n is a, c, g, or t
gtgttaagcaaccatggcaatatggagtttatagataatgatgtaatgaaacatgctgttggaaatacaagatttatgaatgtactcaaagccttattaaaatattataaacgagagttagactttttagactctgaaggaaatccaattttctttaaacctctcctttatgataatattcctctttttaaactttatttaaaagcaggagttgatcttcaactccttaacaatgatgggaataatcttttttttgaatatgtactccatgcttttcaaaatgacaatgatgatatagattttgagacaggcttaagcatgttagtaagcgcaaaagttgaccataattttcaagataaaactggatggacagttataagtaaaattgttgctcaaacaccatgtaacagaaacctttttaaagcacttctaaaaagagtacgctttaattataaaatagttgataaacttggtcgtactgtaatacatagtgcagtttggtcaaataacttagaagtgataaaattaattaatcatattgatagtgatataaaaaacacccctgaccattatgggatacttcctagtatatatgcagcacttattggaaataaaaaagttttattatattttattgagttaaaatcaaaaatcaaaactcatcgtgccattttcacagcagcaatcaaaaagttctctccattattaaaaaatatagaaaaatttaagtctgaagctgtaaacacagaatga

SEQ ID NO: 14492 - protein, 250 aa, Unknown
  Obtained from environmental sample
  misc_feature (1)..(250): Xaa is any amino acid
MLSNHGNMEFIDNDVMKHAVGNTRFMNVLKALLKYYKRELDFLDSEGNPIFFKPLLYDNIPLFKLYLKAGVDLQLLNNDGNNLFFEYVLHAFQNDNDDIDFETGLSMLVSAKVDHNFQDKTGWTVISKIVAQTPCNRNLFKALLKRVRFNYKIVDKLGRTVIHSAVWSNNLEVIKLINHIDSDIKNTPDHYGILPSIYAALIGNKKVLLYFIELKSKIKTHRAIFTAAIKKFSPLLKNIEKFKSEAVNTE

SEQ ID NO: 14493 - DNA, 438 bp, Unknown
  Obtained from environmental sample
  misc_feature (1)..(438): n is a, c, g, or t
atgacagattggctcgagaaattacattatcttcagaatctaatccatgaattgggtatcgaaaaaagtgtaagattttgtggatacatcaaaagggaagaagttttcgaggaaatggataaaaatgatttctttattatgccaagcgtaaatgaaacatttggattagtatatcttgaagcaatggcaagaggattaattgttgtcggtatgaaaaattggggaatagatggtattattagtgacgaagaaaatggatttttatgcgaagatgataagcaagaaagtataacacaaaagattgatcaagtctttagtttgactatcgtagaacgtcaaaaaatcatcaataattccttgaaaacggttaaagagtatactgataagaaagctgcagatagctatttaaattggatatcagctttagtccaaaaatga

SEQ ID NO: 14494 - protein, 145 aa, Unknown
  Obtained from environmental sample
  DOMAIN (2)...(122): Glycosyl transferases group 1
  misc_feature (1)..(145): Xaa is any amino acid
MTDWLEKLHYLQNLIHELGIEKSVRFCGYIKREEVFEEMDKNDFFIMPSVNETFGLVYLEAMARGLIVVGMKNWGIDGIISDEENGFLCEDDKQESITQKIDQVFSLTIVERQKIINNSLKTVKEYTDKKAADSYLNWISALVQK

SEQ ID NO: 14495 - DNA, 633 bp, Unknown
  Obtained from environmental sample
  misc_feature (1)..(633): n is a, c, g, or t
atgatcgcaaaggacccggcaatgtctgcaggtattctaagattggtaaactcttcttttttcggactaataaaagaggaaaatgacccggttcgtgcaactgtcttacttggagagaaaatcgtaaaaggactcgtcttacatatttcttttttttcagtgtttaaagaaaaattaagatacgaaaatttttccattgataatttatcagaacactcattgaaggttgctgaatattcaagaaagatgatcatttatgagggatttgaaaaaagcatatcagaaaaagctttcacagcaggacttttacatgatattgggatacttattttagtcatgatggagaaaaaatattcccagatctatccccatggagacaccaacgatatagatctgttcagtgaggaatataaactctttcgcgtttcacacgctgaaataggtgcataccttctggatctctggggaatttcaagtgaaatagttcaaacaattgctttccatcataaaccggaaaaaatattaaacaaagagttattcaatattgtaagtgccgttcacacagcagatatgattgataattttaatttaacacattattcgaataagagggataagaaaaatgaaaagtag

SEQ ID NO: 14496 - protein, 210 aa, Unknown
  Obtained from environmental sample
  DOMAIN (69)...(189): HD domain
  misc_feature (1)..(210): Xaa is any amino acid
MIAKDPAMSAGILRLVNSSFFGLIKEENDPVRATVLLGEKIVKGLVLHISFFSVFKEKLRYENFSIDNLSEHSLKVAEYSRKMIIYEGFEKSISEKAFTAGLLHDIGILILVMMEKKYSQIYPHGDTNDIDLFSEEYKLFRVSHAEIGAYLLDLWGISSEIVQTIAFHHKPEKILNKELFNIVSAVHTADMIDNFNLTHYSNKRDKKNEK

SEQ ID NO: 14497 - DNA, 846 bp, Unknown
  Obtained from environmental sample
  misc_feature (1)..(846): n is a, c, g, or t
atgagcgctcagtctcaacttatacagtccgaaaagctggcaggaattggccaactagctgcaggaattgcgcatgaaataaatactccgattcaatatattggatcgaatatcgagtttctcatagatgcttttaaagatgtagactcgattttagaattaatggacaaactacatacaatatcagataataaaaaaataaatgggctcatccaagaaattaaagaggaagtcgcaaatgcggatattacatatctaagagctgaaatccctgaagcactcaagcaatcaaatgaaggtgttgctcatataagtaaaacagtacaggcaatgaaacattttgttcatccgggccagaaagacaagagatattatgacataaattctttaataaaaaacaccatcaatatttcaaaaaatgaatggaaatattctgctgaccttgaatttaaatctgaagataaacttcctgaagtttattgcctgggtcatgagattggacaggttattttaaatttaatcataaatggtgcatattccataaaagagaaaaataaagagaatgccggtaaaaagggcctgattattatcaatgtcaggaacatggataaatttatcgaaattcgtgtcagtgacacaggcaagggaatacccgaagaaaacagaacccggatatttgagccattctttaccaccaaaccacccgggtcaggtactggtcagggattatccatggtttatacaattattgtgacaggccataatggtactgtagaatttaagactgaaatgtccaagggcaccaccttcattatacagctgccggtaaataaggtaaaagcatga

SEQ ID NO: 14498 - protein, 281 aa, Unknown
  Obtained from environmental sample
  DOMAIN (161)...(277): Histidine kinase-, DNA gyrase B-, and HSP90-like ATPase
  misc_feature (1)..(281): Xaa is any amino acid
MSAQSQLIQSEKLAGIGQLAAGIAHEINTPIQYIGSNIEFLIDAFKDVDSILELMDKLHTISDNKKINGLIQEIKEEVANADITYLRAEIPEALKQSNEGVAHISKTVQAMKHFVHPGQKDKRYYDINSLIKNTINISKNEWKYSADLEFKSEDKLPEVYCLGHEIGQVILNLIINGAYSIKEKNKENAGKKGLIIINVRNMDKFIEIRVSDTGKGIPEENRTRIFEPFFTTKPPGSGTGQGLSMVYTIIVTGHNGTVEFKTEMSKGTTFIIQLPVNKVKA

SEQ ID NO: 14499 - DNA, 441 bp, Unknown
  Obtained from environmental sample
  misc_feature (1)..(441): n is a, c, g, or t
atgaaaaaaacaatacttgtaattttagacggatggggagttggaaataactctaaatctgatgctatttcaaatgcaaaaacaccatatattgataatttacacaaagaatacccaaattctcaacttcttacaagcggtgaaaatgttggtttgcccgatggaattatgggaaactcagaagttggacacatgaatattggtgctggaagaataatttttcaagatctcgtacgaataaacaaagatgttagaacaggagaaattgcaaaaaacaaggctctaacagaagcttttgaatatgcgaaatcgaacaataaagcggttcattttatgggtcttgtgtctgatggaggtgtacattctatgaataagcatttgtataaaatgtgtgatttaacaaaagattacggacttgaaaagtatatatccacgccctaa

SEQ ID NO: 14500 - protein, 146 aa, Unknown
  Obtained from environmental sample
  DOMAIN (1)...(146): BPG-independent PGAM N-terminus (iPGM_N)
  misc_feature (1)..(146): Xaa is any amino acid
MKKTILVILDGWGVGNNSKSDAISNAKTPYIDNLHKEYPNSQLLTSGENVGLPDGIMGNSEVGHMNIGAGRIIFQDLVRINKDVRTGEIAKNKALTEAFEYAKSNNKAVHFMGLVSDGGVHSMNKHLYKMCDLTKDYGLEKYISTP

SEQ ID NO: 14501 - DNA, 906 bp, Unknown
  Obtained from environmental sample
  misc_feature (1)..(906): n is a, c, g, or t
atgggtcttgtgtctgatggaggtgtacattctatgattaagcatttgtataaaatgtgtgatttaacaaaagattacggacttgaaaaagtatatatccacgccctaacagacggacgcgacacggatcctaaaagtggaattggattcatcaaagaactactcaaccacatcgaaagttcaaacgttgaaattgccacaataacaggtcgttactatacaatggatagagacaaacgctgggaacgtgtgaaagttggttacgatgcaatgacacaaggaattggtcataaaacaacagaattagtttctgctataactgcttcgtaccatcttgatattactgatgaatttattaaaccaataataaatattgacaaaaataatcaaccagtaggtactattcaagaaggtgatgtttttattgcaatcaactatcgcacagatagattacgccaaatgataactgctcttacccaagaaaacctaagtgaatttggaatgaaaacgattcctttacattgtgtcacaatgactcgttatgatgataaatttaaaggactgcacattgcttatgataaaccaaatgtacagaatactttgggtgaaataattgcaaaaaaaggtctacatcaattaagaattgctgaaactgaaaaatatgctcacgttacttttttcttctcaggaggaagagaattaccttacgaaaatgaagatagaggacttgtaaattcgccaaaagtagcaacctacgatttacaaccagaaatgagtgctttggcagtgaaagataaagttgtagatgctctaaacagcaataaatacgattttatttgtttgaattttgcaaatggagatatggttggacatactggaatttatgatgcaattctaaaagcttaa

SEQ ID NO: 14502 - protein, 301 aa, Unknown
  Obtained from environmental sample
  DOMAIN (1)...(247): BPG-independent PGAM N-terminus (iPGM_N)
  misc_feature (1)..(301): Xaa is any amino acid
MGLVSDGGVHSMIKHLYKMCDLTKDYGLEKVYIHALTDGRDTDPKSGIGFIKELLNHIESSNVEIATITGRYYTMDRDKRWERVKVGYDAMTQGIGHKTTELVSAITASYHLDITDEFIKPIINIDKNNQPVGTIQEGDVFIAINYRTDRLRQMITALTQENLSEFGMKTIPLHCVTMTRYDDKFKGLHIAYDKPNVQNTLGEIIAKKGLHQLRIAETEKYAHVTFFFSGGRELPYENEDRGLVNSPKVATYDLQPEMSALAVKDKVVDALNSNKYDFICLNFANGDMVGHTGIYDAILKA

SEQ ID NO: 14503 - DNA, 441 bp, Unknown
  Obtained from environmental sample
  misc_feature (1)..(441): n is a, c, g, or t
ttgaactattttacccagaatggtagatggccagaagcaaatgatgggtttgaaacatttgcagatattgaggagagtggttatgctagtgctttaggtgtacacttttcaattttaattttatatgcaacaatgcaagaggactacaaaacttttgagatagtaaaaaaatcgatgcaatactatgtagagtatatcaacaaatatccatcatattttccaaatgcaacactagcttcaatcttttataatttagaacctgtatttatcaaagcaaacaaaaagaagcttgaaaagttctctagtgaagatttcaactatccctttgtatataaaaaagtgtatgatagtgatgagtatttagcatgtaagataagtagctgttttagttactctatagatattcaaaaaattatacaagatatagatagtttaaagtaa

SEQ ID NO: 14504 - protein, 146 aa, Unknown
  Obtained from environmental sample
  misc_feature (1)..(146): Xaa is any amino acid
MNYFTQNGRWPEANDGFETFADIEESGYASALGVHFSILILYATMQEDYKTFEIVKKSMQYYVEYINKYPSYFPNATLASIFYNLEPVFIKANKKKLEKFSSEDFNYPFVYKKVYDSDEYLACKISSCFSYSIDIQKIIQDIDSLK

SEQ ID NO: 14505 - DNA, 843 bp, Unknown
  Obtained from environmental sample
  misc_feature (1)..(843): n is a, c, g, or t
ttgatcagattcggctcgagctcttctagtattttatatttttttaggaatactatggcaaatcaactacaaaatgaaacttccccttatctattacaacacaaagacaatccagtagattggtatccttggaacgatgttgcttttgaaaaagctaaaaaagagaataaacttatctttctctccataggttatagcacttgtcactggtgtcatgtgatggcacatgaatcttttgaggatgaagaggtggcgaaaattttaaataaagactttatctctattaaaatagatagggaacaatttcctcatatcgatggtttttatcaaaaagtgtatagagtgatgaataaaaaaggtggtggttggccacttactattgtgatgacgcctaatatggagccatttttttcggcaacctatgtaccaaaatatgcaggatatggctcaagaggacttatggaagtattaagagagattgcagtttatgataaagacaaactacaagagcaagggaaacatatacttgaagttgtaaataatgaagagaatgttactttatcaaatgcaacttttgatgataagttatcacacaatatagtaaaccaatttcaaagtagttatgacaaaaaatacaaagggtttggtacacatccaaagtttccacagtttacaaatcttatattacttttaaaactctatgaaatcaacggtgataaagaggctttaactatggctgtagattctttaaaagctatggcaagaggtgggatttttgatcaaatagagggggctttttatcgatatagtgtagatcaaaagtggacaataccacatttttga

SEQ ID NO: 14506 - protein, 280 aa, Unknown
  Obtained from environmental sample
  SIGNAL (1)...(20)
  DOMAIN (19)...(91): Protein of unknown function, DUF255
  misc_feature (1)..(280): Xaa is any amino acid
MIRFGSSSSSILYFFRNTMANQLQNETSPYLLQHKDNPVDWYPWNDVAFEKAKKENKLIFLSIGYSTCHWCHVMAHESFEDEEVAKILNKDFISIKIDREQFPHIDGFYQKVYRVMNKKGGGWPLTIVMTPNMEPFFSATYVPKYAGYGSRGLMEVLREIAVYDKDKLQEQGKHILEVVNNEENVTLSNATFDDKLSHNIVNQFQSSYDKKYKGFGTHPKFPQFTNLILLLKLYEINGDKEALTMAVDSLKAMARGGIFDQIEGAFYRYSVDQKWTIPHF

SEQ ID NO: 14507 - DNA, 693 bp, Unknown
  Obtained from environmental sample
  misc_feature (1)..(693): n is a, c, g, or t
atgatttcatatactgggctcaagaaatcaatgaaatttaaaatgttggatttctcatatgatactaatgtagtatacaaatcaataaatatgaaatttgaaaaaggtaagaaatacttaataattggcccaagtggtggtggaaaatcaacaatgctacgattacttaggaagtactttgatcccctagaaggagaaatcctaatagatggggaaaatctatcagatataaagaaaatagactacttctcaacaatagcaaacgttgaacaacaaacattcttatttgaagatacctttttaaataacttagccttatataaagactatacaaatgaagaagtatgggacgcagttaatagagcgggactgcatgattttgtttcatcgcacgaagatggtctaaatagaatgatccttgataatggaaagaatatatccggtggagaacgaagtagagtagcgatagccagagcactacttaacaaagttgatattctattcttagatgaagcttttgcttcattagatagaaaactgacagttgagatagaaaatagtattttagcacttaaagatataacaattatcaatgttagccatgtgattattgaagaaaataagggcatgtatgatgaagttgtattaatacataataactcaacaactttaatagaacctgaatttaactaa

SEQ ID NO: 14508 - protein, 230 aa, Unknown
  Obtained from environmental sample
  DOMAIN (36)...(220): ABC transporter
  misc_feature (1)..(230): Xaa is any amino acid
MISYTGLKKSMKFKMLDFSYDTNVVYKSINMKFEKGKKYLIIGPSGGGKSTMLRLLRKYFDPLEGEILIDGENLSDIKKIDYFSTIANVEQQTFLFEDTFLNNLALYKDYTNEEVWDAVNRAGLHDFVSSHEDGLNRMILDNGKNISGGERSRVAIARALLNKVDILFLDEAFASLDRKLTVEIENSILALKDITIINVSHVIIEENKGMYDEVVLIHNNSTTLIEPEFN

SEQ ID NO: 14509 - DNA, 339 bp, Unknown
  Obtained from environmental sample
  misc_feature (1)..(339): n is a, c, g, or t
ttgctcatgaaggccgacatagtattgataagaaatggttttcctataaaatccataatgtggtcaagtgataaaaacgagtatcatgctaaattatcagaaatagtatttgcaccagaacctcgattggaattagctaatatggttaataaaattggtgaatcaggtcatggattagcaaataaaaagatagtagaaactgctgtaaattggataaaaaacaacaaagcaaaaattgaaggttattctgatactaaatctgaattttctcagatttaccttataactgttgaccagctaaaggaatgctataaacaggcagacccattgaataaataa

SEQ ID NO: 14510 - protein, 112 aa, Unknown
  Obtained from environmental sample
  misc_feature (1)..(112): Xaa is any amino acid
MLMKADIVLIRNGFPIKSIMWSSDKNEYHAKLSEIVFAPEPRLELANMVNKIGESGHGLANKKIVETAVNWIKNNKAKIEGYSDTKSEFSQIYLITVDQLKECYKQADPLNK

SEQ ID NO: 14511 - DNA, 945 bp, Unknown
  Obtained from environmental sample
  misc_feature (1)..(945): n is a, c, g, or t
ttgacttcaaatatgcaatatcttcaagaatatgttgaagatacatttatcaatcttgaggattataggtttgatgatttagaacatagacaaaaatatgcaaatataacttatgagacactagatcagatgattatccctatggctgatgatggaaaagagccaacaggctctatgggtgatgatactccgttggcatgtttttcaacatcaaatagaaactttacagatttctttagacaaaagtttgcacaagtaacaaatccaccaattgatccatatagagaaaaaattgtaatgtctttaaatactggacttggtcatgcgtataatattttagaagagagtgaacataatacaaaaagattaaaagcagttagcccaattttaatgaaagaaaaatttgatgttatgatgagatttggtgataatcaagatccattatatgatgaagattttcaaaataaaacttttagtacaacatttacaactaacttagaagtagcattacaaaaactgtatgctgaagtaaaagaagctgtggtaaatgaaaatgttagtatagttatcttagatgacagaactgtatcaaaagagtctaaagttattccaatggctatggcagttggatatataaatcacaaattacaaaatgacaaaatcagaagtaccgtttcaatagtagcagttacaagtgaagtgtatgaccctcatagtgctgctgtgttaattgcatttggtgtggcagttatctatccatatatgatgtatgcatctatagtatcctattatgagagaaaaaacatctcatcttatgaattacaaaagaaactaaaacatagtatgaaagctattggttcagggctactaaaaattatgtcaaaaatggggattgctacaattgctaagtatagaactcgtcataatttgaaattattggtttaa

SEQ ID NO: 14512 - protein, 314 aa, Unknown
  Obtained from environmental sample
  DOMAIN (27)...(307): Glutamate synthase central domain
  misc_feature (1)..(314): Xaa is any amino acid
MTSNMQYLQEYVEDTFINLEDYRFDDLEHRQKYANITYETLDQMIIPMADDGKEPTGSMGDDTPLACFSTSNRNFTDFFRQKFAQVTNPPIDPYREKIVMSLNTGLGHAYNILEESEHNTKRLKAVSPILMKEKFDVMMRFGDNQDPLYDEDFQNKTFSTTFTTNLEVALQKLYAEVKEAVVNENVSIVILDDRTVSKESKVIPMAMAVGYINHKLQNDKIRSTVSIVAVTSEVYDPHSAAVLIAFGVAVIYPYMMYASIVSYYERKNISSYELQKKLKHSMKAIGSGLLKIMSKMGIATIAKYRTRHNLKLLV

SEQ ID NO: 14513 - DNA, 564 bp, Unknown
  Obtained from environmental sample
  misc_feature (1)..(564): n is a, c, g, or t
ttgaatatgttttttggaaattttctaagaagaatggttttcgttgtccttgtgtcaacacaattgctatctcttatcggggtacactttctctttctaaaatataaacagaacgctataagaaatgatattaaaactcaaatcaagaggggtgtttctgaagaggatcttgtattttttaaattttccaagaatgaccctgaattcataaaccttaattggacgaaaccagataaggagtttaggtataataatgaaatgtatgatgttgttcggagtaagataagtgacacgaccattgagtacagttgtatccatgatgtcaaagagagtggcttatttaaaaatttagacgacctggctagtaagcaccctgataacaaaaacattaaaaaccttttgctcatattatcacaatttcagtttattaataactattcgatcattaagcctcattttatgagagcagagagtaaaaggcttactattacctcgataacatttttttacaattctctttccattgaaccaatagctcctcctccaaagtctcaatgcttttaa

SEQ ID NO: 14514 - protein, 187 aa, Unknown
  Obtained from environmental sample
  misc_feature (1)..(187): Xaa is any amino acid
MNMFFGNFLRRMVFVVLVSTQLLSLIGVHFLFLKYKQNAIRNDIKTQIKRGVSEEDLVFFKFSKNDPEFINLNWTKPDKEFRYNNEMYDVVRSKISDTTIEYSCIHDVKESGLFKNLDDLASKHPDNKNIKNLLLILSQFQFINNYSIIKPHFMRAESKRLTITSITFFYNSLSIEPIAPPPKSQCF

SEQ ID NO: 14515 - DNA, 891 bp, Unknown
  Obtained from environmental sample
  misc_feature (1)..(891): n is a, c, g, or t
atgagagctgccgatgaaattattgatattgtccgggaagctggaacatgggaggaaaatgtagtttttagcggaaattttaatgaattgctgaaaaaagacaacaccttaacagccaactaccttaataaaacgcttgaaattcctgttcctgaaaaacgtaggaaatggaaaaacaaaattgtagttgaaggagctaaagaaaacaaccttaaaaacattactaccgcttttccattaggtgttattactgctgttacaggagtaagtggttcaggaaaatctaccttaataaaaaactgtttattaccacaattaaatcgatacttaaacggttattctgataagaacactaaaattcaaggtatttctggcgacattaatttaattaacgcagtagaatatgtcaaccaaaaccctattggaaaatcttctcgatccaaccctgttacttacattaaagcgtatgatgaaataagaaacttattttctaatcatccgctatctaaaaatagagggtacaaaccttctcatttttcttttaatgttgatggcggaagatgtgaaacctgtaaaggcgaaggagaaattaccgtagaaatgcaatttatggccgacatccatctaaaatgtaatgaatgtaaaggaaaacgttttaaacaagagttgttggatgtaaaaattggcgacaaacacattagcaacattcttgatttaacgatagatgaaggcattgctttttttgagcaactacctaaagaccaaggcaaaaagattgcagaaaaacttagtcctttacaagaagttggtttaggctatgtacatttaggacaatcttctaatacgcttagtggtggtgaagctcaacgtgtaaaattagctggattttaa

SEQ ID NO: 14516 - protein, 296 aa, Unknown
  Obtained from environmental sample
  misc_feature (1)..(296): Xaa is any amino acid
MRAADEIIDIVREAGTWEENVVFSGNFNELLKKDNTLTANYLNKTLEIPVPEKRRKWKNKIVVEGAKENNLKNITTAFPLGVITAVTGVSGSGKSTLIKNCLLPQLNRYLNGYSDKNTKIQGISGDINLINAVEYVNQNPIGKSSRSNPVTYIKAYDEIRNLFSNHPLSKNRGYKPSHFSFNVDGGRCETCKGEGEITVEMQFMADIHLKCNECKGKRFKQELLDVKIGDKHISNILDLTIDEGIAFFEQLPKDQGKKIAEKLSPLQEVGLGYVHLGQSSNTLSGGEAQRVKLAGF

SEQ ID NO: 14517 - DNA, 876 bp, Unknown
  Obtained from environmental sample
  misc_feature (1)..(876): n is a, c, g, or t
ttgctttatgccagaattggcaagaccttctcccctgtttcaggcaaagaagtaaaaaaacacaccttaaaagatgtagtaaattttattacccaacagcctgagggcgaaaaaattattttactttcaaaaattgagtttaaggacaaaaaaaatacagacaaaacactttcttccttattacaacgaggtttttcaaggatttggcttaataacgaaatgctaagaattgataaaaatcaagaaataaaaatcgatgtcaataacacttatttaataatagaccgttttgttgcttccgcagatgatgaggaacaacttagtagaatttacgatagtgtcgaaactgcattttttgaaggcaaacatgaatgtcaggtacttacttacaacaatgaacaacccgttattacccattttagcaacaagtttgaaatggacggaataagctttgaagaaccttctgttcatttttttagtttcaacaacccttttggtgcttgtaaaaaatgcgaaggatacggaagtattattggtattgatgaaaatttagttgttcctgatggtagtttgtctgtttatcaagatgctgtagtttgctggaaaggagaaaaaatgcaaaaatggaaagaacattttattttaaatgctgcaaaactcaagtttcctatccataaaccttatgatgagcttacgccagaacaaaaagaccttttatggaatggaagtccttattttgaaggaataaatgattttttcaaaatggtagaaagcaacagctacaaaattcaataccgtggttttgctagcaagatattgaaggaaaaactacttggtcccgatggtaaaggtactcgccctaagaaaagacgctaa

SEQ ID NO: 14518 - protein, 291 aa, Unknown
  Obtained from environmental sample
  misc_feature (1)..(291): Xaa is any amino acid
MLYARIGKTFSPVSGKEVKKHTLKDVVNFITQQPEGEKIILLSKIEFKDKKNTDKTLSSLLQRGFSRIWLNNEMLRIDKNQEIKIDVNNTYLIIDRFVASADDEEQLSRIYDSVETAFFEGKHECQVLTYNNEQPVITHFSNKFEMDGISFEEPSVHFFSFNNPFGACKKCEGYGSIIGIDENLVVPDGSLSVYQDAVVCWKGEKMQKWKEHFILNAAKLKFPIHKPYDELTPEQKDLLWNGSPYFEGINDFFKMVESNSYKIQYRGFASKILKEKLLGPDGKGTRPKKRR

SEQ ID NO: 14519 - DNA, 882 bp, Unknown
  Obtained from environmental sample
  misc_feature (1)..(882): n is a, c, g, or t
atggaaaagactttaaaagctgatttttcgatgattttaaaagcagaaaatattaaagatattattacgaaggaacatctagcgaagtattttcataagtgtatgatagataataatttttatatgtcaaataaaattcacgataaaaaattatttaatccagaaatagcaaaatatttacaaaataatattcaatcagagttaaataataataaaagttttgcaaaagctatgcaccttaatggggagacaaaaatagctgtgtttttaccacttttagatataaaaaaaaataatgttggatatatattttcaattagagatgatagttctgtgcattcgcttttcattagtcaattagtaaagtttattatcgcatttattgttattcttattttagtttatttttactttttaaatagacaaaaaacaaatttaatagaacaactgcaagaagctattgatcaaacaactttggtatcaaaaacagatacaaaagggaatataacttatgtaaatgaagcttttgtgaaaatatcaggatttacaaaagatgaacttataggacaaccacataagatagtaagagacccatctacttctagagaagtttttagagatatgtggaaaacaatatttgcaaaaaaaccatggaaaggaacaataactaatcgtactaaagatggtgaacaatatacagttgatgcaacaataatacctatactaaatgtttctaataaaatagttgaatttgtagctataagacatgacattagtgaattagaaaagtataaagagatactaaaagatccacttgaggatacaagtaaatcattaaaagaaaatttaattattcggctcaatatgaggagccaccattaa

SEQ ID NO: 14520 - protein, 293 aa, Unknown
  Obtained from environmental sample
  DOMAIN (148)...(210): PAS domain
  misc_feature (1)..(293): Xaa is any amino acid
MEKTLKADFSMILKAENIKDIITKEHLAKYFHKCMIDNNFYMSNKIHDKKLFNPEIAKYLQNNIQSELNNNKSFAKAMHLNGETKIAVFLPLLDIKKNNVGYIFSIRDDSSVHSLFISQLVKFIIAFIVILILVYFYFLNRQKTNLIEQLQEAIDQTTLVSKTDTKGNITYVNEAFVKISGFTKDELIGQPHKIVRDPSTSREVFRDMWKTIFAKKPWKGTITNRTKDGEQYTVDATIIPILNVSNKIVEFVAIRHDISELEKYKEILKDPLEDTSKSLKENLIIRLNMRSHH

SEQ ID NO: 14521 - DNA, 360 bp, Unknown
  Obtained from environmental sample
  misc_feature (1)..(360): n is a, c, g, or t
atgactttagaagataaaataaaaaagaaaaacattaaattaacaactgcaagaatcgctcttattgagatatttaaaaatgcaaaacaacctttaagttatgaagatataaaacttcatatatctatggataaagcaactttttatagaaatatttcgctctttgaagaggaggggataataaactcttttgaatcaaatgacaaaaaaagatattttgaactcaaactcaaacctcatgcccattttgtatgtatagagtgcaataaggttgagtgtttagaagatttagatatcactcttgatggatatcttataaataatgtaatagttaacggcaagtgtaaaacctgtttttag

SEQ ID NO: 14522 - protein, 119 aa, Unknown
  Obtained from environmental sample
  DOMAIN (9)...(114): Ferric uptake regulator family
  misc_feature (1)..(119): Xaa is any amino acid
MTLEDKIKKKNIKLTTARIALIEIFKNAKQPLSYEDIKLHISMDKATFYRNISLFEEEGIINSFESNDKKRYFELKLKPHAHFVCIECNKVECLEDLDITLDGYLINNVIVNGKCKTCF

SEQ ID NO: 14523 - DNA, 399 bp, Unknown
  Obtained from environmental sample
  misc_feature (1)..(399): n is a, c, g, or t
atgccattaattcatcttatatatcgtaaatctaacacagcttttcacagcatagaaaatgtttttaacaccttattaccttatttaaaggtacaaaaaactgaacttccatatactagctcaggaattttaaatagatggcggaatattagtttttcaaagaaattaaactcaaaattacttcatatcacaggacatgaccattatttaattttaggtttactccgaaaaaaaaccatacttactattcatgatattgaaatacttaaaagaagctctggaataaaaaaatttttattaaaaaagttatggtttgattggccaataaaatatgctacttgtattactaccatttctgaatttcaaaaaatgctcgagccaattctgatcccatggtaa

SEQ ID NO: 14524 - protein, 132 aa, Unknown
  Obtained from environmental sample
  misc_feature (1)..(132): Xaa is any amino acid
MPLIHLIYRKSNTAFHSIENVFNTLLPYLKVQKTELPYTSSGILNRWRNISFSKKLNSKLLHITGHDHYLILGLLRKKTILTIHDIEILKRSSGIKKFLLKKLWFDWPIKYATCITTISEFQKMLEPILIPW

SEQ ID NO: 14525 - DNA, 546 bp, Unknown
  Obtained from environmental sample
  misc_feature (1)..(546): n is a, c, g, or t
atgaaaaagagtattttagacaggtatgacaagagtgaaaatggcgagtttatagtaaatatctctacaaaaaagatagaagacctctatgacaactttgacaacacttcatcttttttaaaaaaagatctaaatcaagagttggtgaattacgttattgagagtgttagagagatcggaaatgagccatttgtgttaaagttctattttaaagagagcatagatgagagctacaaaaagaagataatagagagtatatttaacttctttgaatatcttcaggagttagaggataaaaagaaagaagagcagataaaaaactcttttatatttataatcttaggttttttatttgtcactctttctcttgctattggcaaagatgaagatatgttcagtgaggttttagcagagggcatcatggtagcaggatgggtttctctttgggaagctgtggcgatctttttaattaagtggtttccacttgctaaaaagataaaactgtttaaaaaaatatcgattgcaaaagtagagtttgcgcagtaa

SEQ ID NO: 14526 - protein, 181 aa, Unknown
  Obtained from environmental sample
  misc_feature (1)..(181): Xaa is any amino acid
MKKSILDRYDKSENGEFIVNISTKKIEDLYDNFDNTSSFLKKDLNQELVNYVIESVREIGNEPFVLKFYFKESIDESYKKKIIESIFNFFEYLQELEDKKKEEQIKNSFIFIILGFLFVTLSLAIGKDEDMFSEVLAEGIMVAGWVSLWEAVAIFLIKWFPLAKKIKLFKKISIAKVEFAQ

SEQ ID NO: 14527 - DNA, 342 bp, Unknown
  Obtained from environmental sample
  misc_feature (1)..(342): n is a, c, g, or t
ttggaaacctcatttcatccaatgtggcaaaaaaaagttataacttttttattaaaaggaatggaacgggtaaagaaaattaaaaaactacatattattataaattcacactcaccttttatattatcagacctgccaaaagagagtgtaatatttttaaaaaaagatgagctaactggttattgtaaaaatgtaagtgatacagaaaatataaacccattcggagcaaatatccacactctgctctctcatggcttttttatgaaagatggacttatgggagagtttgcgaaagagaagatagataaagcgataaaatatctgaatcagaaatctttttaa

SEQ ID NO: 14528 - protein, 113 aa, Unknown
  Obtained from environmental sample
  misc_feature (1)..(113): Xaa is any amino acid
METSFHPMWQKKVITFLLKGMERVKKIKKLHIIINSHSPFILSDLPKESVIFLKKDELTGYCKNVSDTENINPFGANIHTLLSHGFFMKDGLMGEFAKEKIDKAIKYLNQKSF

SEQ ID NO: 14529 - DNA, 699 bp, Unknown
  Obtained from environmental sample
  misc_feature (1)..(699): n is a, c, g, or t
ttggatttgaaaaaaaatatcnaacatncnagaggcaaagggaaaaatcatgttatgttagaaagctttggagataatttatccgaaattaaaaactatacttttagtgataagaacagacctactacatatcacataaaatattgttacaataatcctgagggaaaaccacatacaaaagttttaaaaatcaaagtaaaccctctagatagtccgaatttgtttaatctaaattcttatagtgtatttactaataatgcattaaattctatcggtttaggaaaaactatccaggatataatctctcaaataaacgaactttcaattgaaaaatattcactaataattgcattaagttttagaccactaattgaattatcttctaaagaagtatttatgaaaaaatcaatcgctttagttagtagtcttgaagataaactgattactatattcaatgaaggaagaaagcttgagaaagtagagttagctgaaaagtgtaaaatatacaatatcccttacatggagtttaaaaactttctcaacgcttttagtgatgataatctaaaaattcagtctagtaaacttaatttaatgactcacaattcatcagattggttcgacaaggataccacttatgatattgggaataaatttgttacgaattttatacttttgtgtgatatgcttaaaaattcataa

SEQ ID NO: 14530 - protein, 232 aa, Unknown
  Obtained from environmental sample
  misc_feature (1)..(232): Xaa is any amino acid
MDLKKNIXHXRGKGKNHVMLESFGDNLSEIKNYTFSDKNRPTTYHIKYCYNNPEGKPHTKVLKIKVNPLDSPNLFNLNSYSVFTNNALNSIGLGKTIQDIISQINELSIEKYSLIIALSFRPLIELSSKEVFMKKSIALVSSLEDKLITIFNEGRKLEKVELAEKCKIYNIPYMEFKNFLNAFSDDNLKIQSSKLNLMTHNSSDWFDKDTTYDIGNKFVTNFILLCDMLKNS

SEQ ID NO: 14531 - DNA, 753 bp, Unknown
  Obtained from environmental sample
  misc_feature (1)..(753): n is a, c, g, or t
atgaactcagaaacacttcaaaggctcagcgatgtaaaagcacttcgagaacgccagtttttagaagactcttctcctactgctcaccctattaagcctgataaatatatagagataaataacttctacacatcaactatttatgaaaagggtgctgaggtgattcgtatgattcatacaatgctagggagtcaaaagtatagagaagcaacagatttatattttgagacatttgatggtcaagctgttacaacagaggactttttatgggctatgaaccagtctggaacttttgatcttgagcagtttaaactatggtactcacaagagagaacacctgagcttattgttgatgagaggtatgataaagagagtaacagctactctctaacacttactcaaaaaattccaaatgcagtcaatggctctaagcaacaggcttactactaccctctaaaatttgcacttttggatgaaaatggaaaagagatagatctgcataaaaatatgttaattataagcaaagagagtgagacttttgagtttaaaaatatagcctcaaaaccgactctttccataaacagaaatttcagtgctcctataaaagttcttcatgaaagtgatgatcagtttttaatgatgcatgacagtgacggatttatcaggtatgagtcagctcaaaagtatgcacttaaaaccataaaaaatatcatttcaggcgaagaggttgatgaaaattatctggtgcattga

SEQ ID NO: 14532 - protein, 250 aa, Unknown
  Obtained from environmental sample
  misc_feature (1)..(250): Xaa is any amino acid
MNSETLQRLSDVKALRERQFLEDSSPTAHPIKPDKYIEINNFYTSTIYEKGAEVIRMIHTMLGSQKYREATDLYFETFDGQAVTTEDFLWAMNQSGTFDLEQFKLWYSQERTPELIVDERYDKESNSYSLTLTQKIPNAVNGSKQQAYYYPLKFALLDENGKEIDLHKNMLIISKESETFEFKNIASKPTLSINRNFSAPIKVLHESDDQFLMMHDSDGFIRYESAQKYALKTIKNIISGEEVDENYLVH

SEQ ID NO: 14533 - DNA, 513 bp, Unknown
  Obtained from environmental sample
  misc_feature (1)..(513): n is a, c, g, or t
atggataaagtttgggcagcaaaatcaggattaggttggatcggaaaaaacactaatctcattacaaaggaatttggctcgtttgtttttattggcgagttaattattgatttggaactagaatacgataaggctataaaagattattgtggaaattgcaccaaatgtattgatgcttgccctacaaatgcattaaacccatatcaattggatgcgcgaaagtgtatttcttatttaacaattgagaaaaaaggtgatttgcctgaaaatatgaaaggattatggactgattggatttttggttgtgatatttgtcaggatgtttgtccatggaactcaaagctggagtttcataatgaaagagcctttgatatttcagatgaaataagaaatcttaagaaagaagatttggaaattttagataaaccaagttttaaaaagctttttaaaaactctcctgttgaacgaactaaatttgaaggattgaaaaggaatattaagtttttaacttga

SEQ ID NO: 14534 - protein, 170 aa, Unknown
  Obtained from environmental sample
  DOMAIN (43)...(66): 4Fe-4S binding domain
  misc_feature (1)..(170): Xaa is any amino acid
MDKVWAAKSGLGWIGKNTNLITKEFGSFVFIGELIIDLELEYDKAIKDYCGNCTKCIDACPTNALNPYQLDARKCISYLTIEKKGDLPENMKGLWTDWIFGCDICQDVCPWNSKLEFHNERAFDISDEIRNLKKEDLEILDKPSFKKLFKNSPVERTKFEGLKRNIKFLT

SEQ ID NO: 14535 - DNA, 339 bp, Unknown
  Obtained from environmental sample
  misc_feature (1)..(339): n is a, c, g, or t
atgttaccagccgatgttgaaaattatcttagagaaataaatcgagtattaaaaaatcagggaatctgctttaccacatttttcattataaatcaagaatccgaaaaacacttaaaacgtaataaggattttaaattttcatttgacaaaggggactatagattaatgaatgataaagtgccggaagcaaatgtggcttttaaatatgactatttgcaaagggagttacttaaatctggacttaaaataaaatctgaacattttggttattggagaggaagaccaaaatcaagttctttaaattttcaagatattttaatattagaaaagtcaagttaa

SEQ ID NO: 14536 - protein, 112 aa, Unknown
  Obtained from environmental sample
  misc_feature (1)..(112): Xaa is any amino acid
MLPADVENYLREINRVLKNQGICFTTFFIINQESEKHLKRNKDFKFSFDKGDYRLMNDKVPEANVAFKYDYLQRELLKSGLKIKSEHFGYWRGRPKSSSLNFQDILILEKSS

SEQ ID NO: 14537 - DNA, 663 bp, Unknown
  Obtained from environmental sample
  misc_feature (1)..(663): n is a, c, g, or t
ttgcaccttaattattctattttttcaaagatcatgtttataaacttaagaaagatttattattttctatctcctaaattaagattaaaagtccgaagaatattctatttaccaattgatacatttaatagtattagatctaataaaaaagaactattacctccaaaagggatgatctttaccggatcgggagattttacaaaacaaggtgaaatgttcttaaaatattttattgatttaggaaatttaaaaccaaatcatagtgtgctagatataggcagcggtattggaagaatggcaattccattaactaaatacttatcagaaaaagggaaatacgaaggatttgatatcgttgaaaaaggagttaaatggtgcaaaagaaagataacaccagaattcccaaatttcaactttaattatttaaaccttaagaatagtttatataacctaagtacagataaggaagcatcgcttttaaaattcccatataatgataattattttgattttatatttctaacatcggtttttacgcatatgttaccagccgatgttgaaaattatcttagagaaataaatcgagtattaaaaaaatcaggaatctgctttaccacatttttcattataaatcaagaatccgaaaaaacacttaaaacgtaa

SEQ ID NO: 14538 - protein, 220 aa, Unknown
  Obtained from environmental sample
  misc_feature (1)..(220): Xaa is any amino acid
MHLNYSIFSKIMFINLRKIYYFLSPKLRLKVRRIFYLPIDTFNSIRSNKKELLPPKGMIFTGSGDFTKQGEMFLKYFIDLGNLKPNHSVLDIGSGIGRMAIPLTKYLSEKGKYEGFDIVEKGVKWCKRKITPEFPNFNFNYLNLKNSLYNLSTDKEASLLKFPYNDNYFDFIFLTSVFTHMLPADVENYLREINRVLKKSGICFTTFFIINQESEKTLKT

SEQ ID NO: 14539 - DNA, 324 bp, Unknown
  Obtained from environmental sample
  misc_feature (1)..(324): n is a, c, g, or t
ttgctacaaaaagcaaaaaatcttttaaattattgtgatgttttaattgttgagggtgctggtggattaatggtaccaattgagaaaaactattttatgattgatttgattaaagagtttcacaaacaattaaatgcaaaaacgatacttatatctcctagtaacttggggagtattaacgatactatgctttctcaaactctattaaagaattataatataaattatgaatggtatattaacctttataaagataaagagagttttaaaactgtcactttgcctttttataaagagtatttcaatcaaataaattatttgtaa

SEQ ID NO: 14540 - protein, 107 aa, Unknown
  Obtained from environmental sample
  misc_feature (1)..(107): Xaa is any amino acid
MLQKAKNLLNYCDVLIVEGAGGLMVPIEKNYFMIDLIKEFHKQLNAKTILISPSNLGSINDTMLSQTLLKNYNINYEWYINLYKDKESFKTVTLPFYKEYFNQINYL

SEQ ID NO: 14541 - DNA, 501 bp, Unknown
  Obtained from environmental sample
  misc_feature (1)..(501): n is a, c, g, or t
atgactgaaataataaaatttatttacaatcaccctctgaacaagcgaagaaaacttatttcaatatgtacttttattaaatggcaaatagtaagtagaatttggaataattcttttatatttaactggattgatgattcaaaacttatactttctaaaggtatgacaggagctacaggaaacctttatgtaggactaatggaatatcgagatatgagctttttgttacactgtttacaaaaggaagatttattttatgatgtaggagcgaatgtaggtgtttataccgttcttgcatcaaaaatttgtggagtaaagacgattagtattgaaccacttcctaatacatataataagttaatagataatataaatataaatagattagaaaatgtaatagcacaaaatataggattatcttctgaaaagtcaaaattgtattttactaatgataaagacactatgaattgtgttacagatgaagaaaatctttgtctgtaa

SEQ ID NO: 14542 - protein, 166 aa, Unknown
  Obtained from environmental sample
  misc_feature (1)..(166): Xaa is any amino acid
MTEIIKFIYNHPLNKRRKLISICTFIKWQIVSRIWNNSFIFNWIDDSKLILSKGMTGATGNLYVGLMEYRDMSFLLHCLQKEDLFYDVGANVGVYTVLASKICGVKTISIEPLPNTYNKLIDNININRLENVIAQNIGLSSEKSKLYFTNDKDTMNCVTDEENLCL

SEQ ID NO: 14543 - DNA, 789 bp, Unknown
  Obtained from environmental sample
  misc_feature (1)..(789): n is a, c, g, or t
atgaaaacagtacctatagttgtttttacatatagacgaaatattgatgaactgcttactagtttattatctaatgatttgtctaagaaaagtaatctttatattttttcagatggttacaaaaataatatcgataaaaaagatgtgttattagttagaaaaaatttaaaattaattaacggatttcacagtatagaaattatagagtccgaaacaaataaaggattggcgaagtcggttattgatggtgtaacagaaattttgaataaatatgaaaaagtgatagtattagaagatgatttgattgtatcaaacaattttttaacttatatgaatgaagctttaaatttttataaatacgaagaaaatatttggtcaatatcaggatatactccctgtttagattatttaaataactatgaaaaagatatttttttagcttttcgagctaattcatggggttgggctacttggaaaaatagatgggaaaaaatagactgggatattaaagattgggatagtttcaaaaaagattctatattaattgataagtttaatcgtggtggtgatgatttattcaaaatgctagaagtacaaatgttaggtaaaatagactcttgggcgataagatggtgttataatcagtttaaatataattcttttactatttatccgacaaaatctagagttgttaatattggatttgatagtatgggtacacataactcagatggatcagaacgatgggatacgcaaatttcaaatgaaaaaattaatctgaaacagtag

SEQ ID NO: 14544 - protein, 262 aa, Unknown
  Obtained from environmental sample
  misc_feature (1)..(262): Xaa is any amino acid
MKTVPIVVFTYRRNIDELLTSLLSNDLSKKSNLYIFSDGYKNNIDKKDVLLVRKNLKLINGFHSIEIIESETNKGLAKSVIDGVTEILNKYEKVIVLEDDLIVSNNFLTYMNEALNFYKYEENIWSISGYTPCLDYLNNYEKDIFLAFRANSWGWATWKNRWEKIDWDIKDWDSFKKDSILIDKFNRGGDDLFKMLEVQMLGKIDSWAIRWCYNQFKYNSFTIYPTKSRVVNIGFDSMGTHNSDGSERWDTQISNEKINLKQ

SEQ ID NO: 14545 - DNA, 750 bp, Unknown
  Obtained from environmental sample
  misc_feature (1)..(750): n is a, c, g, or t
atgaacaaaacagcattaattaccggagtcaccgggtttgttggttcgcatctggcacgacgactaataaaggacggttgggaactgcatgccatcgtgcggaatgtgtcgaaatatgacttaattcaggatatcaaagattccgtccattttcatgtttatgacggaaccattgaatccatgcagacaattttggatagatctaaaccggaaatcgttttccatctggcatctctttttctttcccaacataagccggaagaaatcgcatccctaatacaaagtaacatcacttttggatcacatcttgctgaagcggccgttgccaataactgcctggaattcatcaatactgggacatcatggcaacattatgaaaatcaagactacaaccctgtcaatctctatgctgcgaccaaacaagcttttgaagacattctcaaatattacgctgagacacatgagcttaaggtcatcaccctcaaactgttcgacacctacgggcctgatgatccgcggcaaaaaatgatgaatttattgaagagggctgctgaaaccggcgagacattggatatgtcacctggggagcaattgattgatctggtgcatgtagatgatgtggtggaagctttttgcgtggcgcaggcgttgattggtcagatgaaagggaaaggattgaaaatctatggngtgacttcccggaagccgttatccctgaaggnaaaattgtgtatgttagaaaataaataa

SEQ ID NO: 14546 - protein, 249 aa, Unknown
  Obtained from environmental sample
  DOMAIN (5)...(249): NAD dependent epimerase/dehydratase family
  misc_feature (1)..(249): Xaa is any amino acid
MNKTALITGVTGFVGSHLARRLIKDGWELHAIVRNVSKYDLIQDIKDSVHFHVYDGTIESMQTILDRSKPEIVFHLASLFLSQHKPEEIASLIQSNITFGSHLAEAAVANNCLEFINTGTSWQHYENQDYNPVNLYAATKQAFEDILKYYAETHELKVITLKLFDTYGPDDPRQKMMNLLKRAAETGETLDMSPGEQLIDLVHVDDVVEAFCVAQALIGQMKGKGLKIYGVTSRKPLSLKXKLCMLENK

SEQ ID NO: 14547 - DNA, 666 bp, Unknown
  Obtained from environmental sample
  misc_feature (1)..(666): n is a, c, g, or t
atggagacaccattatctgttatatcaacagcagcaacaggaatgaagatacaaaaggagtttaatcttttaaaagacgatgattttaattcagcttgtgacatgatagatgagtatgctcagtatctgtcaaaaacaattgatgattttagggattttataaaaggggatacaaaaaatgttcgctttaatttaaaagaggagatagaatcttttttgaaattagttgagtctgatataaaaacatatcatattgaggttataaatagttgtgaagataatattataatcaatggtcatccaaatgaattaaaacaatgttttataaatatctttaataatgcaaaagatgcatttttacaaaattctcatcttgaagagagatatttttttataacactaaaaaaagacaagaatcaggttacaatctccttttgtgacaatgctggcgggataccaaaggatgtattacctaaaatatttgaaccatattttaccacaaaacataaatttcaaggtacaggtcttggacttcatatgacatatagtttaattgttgagggtatgaatggaaatattctagtgaataataaaagctttacatacaaagagcaaaaatatagtggtgcagaatttacaataacacttcctattaatcaattataa

SEQ ID NO: 14548 - protein, 221 aa, Unknown
  Obtained from environmental sample
  DOMAIN (99)...(219): Histidine kinase-, DNA gyrase B-, and HSP90-like ATPase
  misc_feature (1)..(221): Xaa is any amino acid
METPLSVISTAATGMKIQKEFNLLKDDDFNSACDMIDEYAQYLSKTIDDFRDFIKGDTKNVRFNLKEEIESFLKLVESDIKTYHIEVINSCEDNIIINGHPNELKQCFINIFNNAKDAFLQNSHLEERYFFITLKKDKNQVTISFCDNAGGIPKDVLPKIFEPYFTTKHKFQGTGLGLHMTYSLIVEGMNGNILVNNKSFTYKEQKYSGAEFTITLPINQL

SEQ ID NO: 14549 - DNA, 876 bp, Unknown
  Obtained from environmental sample
  misc_feature (1)..(876): n is a, c, g, or t
gtgatatttcaaggtggaattttaggaaaccatacattaggttttgagtattgtagtctttcaacagatatgttgaaaaaatttaacaatacaatacaacatgctgaggtgaagtttgtttgtggatattttgcaacatcgtggaaacagtcatcacaatatacagaagatatatggtaccaagcttacaaagatggtttggcaataggtgattggtttcatactagttgtgcagcagctgggattgtacaaagtatgtttatgcgtggggttgattttgagactatttcagagaaaatagaagagtttagggtagttcttaaaaatataggtttagaggagcaatggggtgcaatacaaagtgtaaagcaagctatattgaatctacaagaaaaaactttatctccactttattttgatagtaaaaattttaatgaaacagattatgtacaaagtttagaaaaatacaattcaaaacattttgcacattattattttataaataaacttatcacattatatatacatcaagagtatcaagaggcttttaaagtatcaaatttaggaaaaagttttgcaagttcttcaaaagggatgttacataatactgaacaccttttttatgaggctttaacattagcacagctttataaagatgaggggttggtaaatcgtattaaatacaaaactgtaatatatcaaacaattcagaaattcaaaaaatactcttctgattgttctgaaaactttatagtaagaaaatacatattacaaggggaattatctagggttaataataattttaatgaagctataaattttatgaacaggcaaatagtagtgcccagatatatttacaaacaaatttacaaataa

SEQ ID NO: 14550 - protein, 291 aa, Unknown
  Obtained from environmental sample
  misc_feature (1)..(291): Xaa is any amino acid
MIFQGGILGNHTLGFEYCSLSTDMLKKFNNTIQHAEVKFVCGYFATSWKQSSQYTEDIWYQAYKDGLAIGDWFHTSCAAAGIVQSMFMRGVDFETISEKIEEFRVVLKNIGLEEQWGAIQSVKQAILNLQEKTLSPLYFDSKNFNETDYVQSLEKYNSKHFAHYYFINKLITLYIHQEYQEAFKVSNLGKSFASSSKGMLHNTEHLFYEALTLAQLYKDEGLVNRIKYKTVIYQTIQKFKKYSSDCSENFIVRKYILQGELSRVNNNFNEAINFMNRQIVVPRYIYKQIYK

SEQ ID NO: 14551 - DNA, 540 bp, Unknown
  Obtained from environmental sample
  misc_feature (1)..(540): n is a, c, g, or t
atgataataacaatatctggagaactaggttctggaaaaagcacggttgcaaaattgttggctgaacaactaaacttaaaacattattctactggagatctaatgagaagaatagcaaaagaaaaaggaataacttttcaaaaattaacagaacttgcagaaaatgatgttgaagttgataaagaaatagatttatacactaaaaaattggcagaaactgaaaaagattttgttatagactcgagaatggcgtttcattttattaagaattccctaaatatatatatggttattgatgaagttgtaggcgcccaaagaatattgttggctaaaagaaacgaagaacattataaaaatttagatgaagcaatagactatttggcaaaaagaaaaaattcagaaattgaacgatacaataagttatatggtataaattgccatgatctaacaaaagaacactatgatttgattatagatacaacaactttattgccggaaatggtggttaaagaaataattgaatttgtggaaaatttttaa

SEQ ID NO: 14552 - protein, 179 aa, Unknown
  Obtained from environmental sample
  DOMAIN (1)...(177): Shikimate kinase
  misc_feature (1)..(179): Xaa is any amino acid
MIITISGELGSGKSTVAKLLAEQLNLKHYSTGDLMRRIAKEKGITFQKLTELAENDVEVDKEIDLYTKKLAETEKDFVIDSRMAFHFIKNSLNIYMVIDEVVGAQRILLAKRNEEHYKNLDEAIDYLAKRKNSEIERYNKLYGINCHDLTKEHYDLIIDTTTLLPEMVVKEIIEFVENF

SEQ ID NO: 14553 - DNA, 348 bp, Unknown
  Obtained from environmental sample
  misc_feature (1)..(348): n is a, c, g, or t
ttgatggacgaacataacagcatcattccagatgaccagaaaaaattagaagctctgcccggcgttggtagaaaaactgcaaacgtcgtacgtaatactgcttttggtcacccgactatggctgtcgatacacacatctttcgtgtatccaatcgcacaaaaattgcacccggaaagaatgtactggaagttgaaaaaaaattagttaaatttattcctgatgaatttatggtagatgcgcatcactggttaattttactgggccgttacacctgcatcgctcgaaaaccacgttgcggctcttgcctgatagaagatctatgtgagtacaaagataaaactgattaa

SEQ ID NO: 14554 - protein, 115 aa, Unknown
  Obtained from environmental sample
  DOMAIN (4)...(33): Helix-hairpin-helix motif
  misc_feature (1)..(115): Xaa is any amino acid
MMDEHNSIIPDDQKKLEALPGVGRKTANVVRNTAFGHPTMAVDTHIFRVSNRTKIAPGKNVLEVEKKLVKFIPDEFMVDAHHWLILLGRYTCIARKPRCGSCLIEDLCEYKDKTD

SEQ ID NO: 14555 - DNA, 870 bp, Unknown
  Obtained from environmental sample
  misc_feature (1)..(870): n is a, c, g, or t
gtgctattcttcggccctacagggtcaggcaaagagcttttgcccacgccatccatgcccacgggcctagaaaggataatccttttgtctgtgtcaattgtgccgccattccaaaggaaattgctggaatcagagcttttcggatatgaagatggtgcgtttaccggcgcacgaaaaaaaggtaaaataggtaaaatccaaatggccgacaccggaactttgtttctggatgaaatcggagatcttcccttaagcgcccaggcaaaacttttgcgggttgtggaaaacaaaaatgtagaacgtcttggcagttcaaaattaaccaaagtcaactttcgtcttatctgtgccaccaatagagaccttgcgaccatgatgaaagaacatcgattcagggatgatctgtattaccgtattaatattctgaccatcaccgttccacctcttaaaaaccgggccgatgatattccccttattgtttcatccatactttgttccaggaaaaaagatgagattaaaatatcggatacagtcatgacaattttgagagaatatgactggcctggaaatataagggaacttcggggagtaatcgaacgggccgtgaccatctgtgaaaacaagaccattgaagtgcaccacctgcctttggaaattattcatttcaatcccggaaaaacattgagagactcccaaagtattcttttcctggcccaggagatggcctcccatgaaaaactcctcattgagcaggccctcttgtataccaaagggaaaaaaaataaagccgctcaactgctgggtatttccagaacctcattttacgaaaaaagcagacttcacggaattaacagcctgtctgacaactaa

SEQ ID NO: 14556 - protein, 289 aa, Unknown
  Obtained from environmental sample
  DOMAIN (241)...(281): Bacterial regulatory protein, Fis family
  misc_feature (1)..(289): Xaa is any amino acid
MLFFGPTGSGKELLPTPSMPTGLERIILLSVSIVPPFQRKLLESELFGYEDGAFTGARKKGKIGKIQMADTGTLFLDEIGDLPLSAQAKLLRVVENKNVERLGSSKLTKVNFRLICATNRDLATMMKEHRFRDDLYYRINILTITVPPLKNRADDIPLIVSSILCSRKKDEIKISDTVMTILREYDWPGNIRELRGVIERAVTICENKTIEVHHLPLEIIHFNPGKTLRDSQSILFLAQEMASHEKLLIEQALLYTKGKKNKAAQLLGISRTSFYEKSRLHGINSLSDN

SEQ ID NO: 14557 - DNA, 582 bp, Unknown
  Obtained from environmental sample
  misc_feature (1)..(582): n is a, c, g, or t
atgataaaattggtttttgctacaaataacgaaaataaaattaaagaaataaatgctttattaaccaactccattaaattattaagtttaaaagatattggttgtcacgaagacatccctgaaactgctgacactattgagggaaatgctattttgaaagcagaatatgtttataaaaaatacggctataattgttttgctgatgatactggactggaaattaaatcactatatggtgagccaggagttttctctgcaaggtatgctggtgaagaaaaaaatgccgataaaaacatggataaagtgctccaaaaattagcactttatacagatagaactgctcagtttaaaacagttgttgcattaatgattaatggcgaaataactacttttgagggaattgttgaaggtgaaattacaagtaaaaaaaatggggaagatggttttggttacgatcctatttttaaaccaaacggcttcaaaattacttttgcagaaatgccattgtctgaaaaaaataaaattagccatagaggtcgtgctgtaaaaaaactaattgatttcttgaattcaacaaaataa

SEQ ID NO: 14558 - protein, 193 aa, Unknown
  Obtained from environmental sample
  DOMAIN (4)...(189): Ham1 family
  misc_feature (1)..(193): Xaa is any amino acid
MIKLVFATNNENKIKEINALLTNSIKLLSLKDIGCHEDIPETADTIEGNAILKAEYVYKKYGYNCFADDTGLEIKSLYGEPGVFSARYAGEEKNADKNMDKVLQKLALYTDRTAQFKTVVALMINGEITTFEGIVEGEITSKKNGEDGFGYDPIFKPNGFKITFAEMPLSEKNKISHRGRAVKKLIDFLNSTK

SEQ ID NO: 14559 - DNA, 684 bp, Unknown
  Obtained from environmental sample
  misc_feature (1)..(684): n is a, c, g, or t
gtgcaaaatccatttgcaggaacaggtgttggtttctgtacatttgaggtgaccattaatggagatgttactacagacgaggtaaactctagtgcattcgaaattgattttactgcatttcaattaaaagttggagatcctgttattgtgaaaattaaacataaagatgattgtaaaccgaaagtattaaaccctgaggtgcttaaacctaaaagtacatttgaaattgttaatatgaatgttactaaagatggtagttttgaatggacaacttcaaatgaaacaggaaaattaacttttgttgttgagcaatttagatggaacaaatggattaaagtaggagaagttgatggcgttggaacatctacagaaaataaatatgaatttaaaattgagcctcattctggtgaaaataaatttagagttaagcaaatagattactctggtaaaccaagatattctcaggctgcacgttatgtttctactaaaggtgaaattacttttagtccaattaaagtaaaagacataatcacttttactgatgagacattgtttgaagtttatgatagctatgctaatatcgttaaaaaaggatatggaaattctattgatgttactaatcttaaaaaaggaatttattatttaaattatgataacaagagtgagacttttgtgaagaaataa

SEQ ID NO: 14560 - protein, 227 aa, Unknown
  Obtained from environmental sample
  misc_feature (1)..(227): Xaa is any amino acid
MQNPFAGTGVGFCTFEVTINGDVTTDEVNSSAFEIDFTAFQLKVGDPVIVKIKHKDDCKPKVLNPEVLKPKSTFEIVNMNVTKDGSFEWTTSNETGKLTFVVEQFRWNKWIKVGEVDGVGTSTENKYEFKIEPHSGENKFRVKQIDYSGKPRYSQAARYVSTKGEITFSPIKVKDIITFTDETLFEVYDSYANIVKKGYGNSIDVTNLKKGIYYLNYDNKSETFVKK

SEQ ID NO: 14561 - DNA, 453 bp, Unknown
  Obtained from environmental sample
  misc_feature (1)..(453): n is a, c, g, or t
atgttaaacaatagacaaataagtgaacactttgaggttcaagtaaatactttatacaattggcaaaaacataagccaaaactgtataaatatctacaaaatgctgattataataaacagagaaatgatgagataaatattcttcttagtgagtattctacttcaatacaaaaagagtttttaattggtgaaattgaatatctcatacaatctcctattaaacttgtatcgatggatgaagtaaaaaactttcaaaaaatatttatagaaaaagagtactctcatatccctacaagtagcgataaaattctttctatttatgataaaatctcaggattaaatattatagaaaaatatattttatataaaaaagtacataaaattagagaaaacaacaatagaacagatgaagatataaaactattctttcaagaatttatcagtaactcttga

SEQ ID NO: 14562 - protein, 150 aa, Unknown
  Obtained from environmental sample
  misc_feature (1)..(150): Xaa is any amino acid
MLNNRQISEHFEVQVNTLYNWQKHKPKLYKYLQNADYNKQRNDEINILLSEYSTSIQKEFLIGEIEYLIQSPIKLVSMDEVKNFQKIFIEKEYSHIPTSSDKILSIYDKISGLNIIEKYILYKKVHKIRENNNRTDEDIKLFFQEFISNS

SEQ ID NO: 14563 - DNA, 366 bp, Unknown
  Obtained from environmental sample
  misc_feature (1)..(366): n is a, c, g, or t
gtgattatgggacgtaaaacttttgaatcattaggtaaaccactacccaaccgaactaccataattattagtcgagataaaaattatcatgtagatggatgcattacagtaaattcaatcacagaggcaataaaagctgctcaaaatgatgaaaacccatacattcttggaggtgcagaaatttataaacaatctatggatgttgtagattttttagaccttacattagttcatcatacatttgatgcagatgtatttttccctgaaattgataaaaatatctggagagaaacttttagagaaaaccataccaaagatgaaaagaacaaatttaattttagctttataaagtacgaacgaatttaa

SEQ ID NO: 14564 - protein, 121 aa, Unknown
  Obtained from environmental sample
  DOMAIN (1)...(120): Dihydrofolate reductase
  misc_feature (1)..(121): Xaa is any amino acid
MIMGRKTFESLGKPLPNRTTIIISRDKNYHVDGCITVNSITEAIKAAQNDENPYILGGAEIYKQSMDVVDFLDLTLVHHTFDADVFFPEIDKNIWRETFRENHTKDEKNKFNFSFIKYERI

SEQ ID NO: 14565 - DNA, 393 bp, Unknown
  Obtained from environmental sample
  misc_feature (1)..(393): n is a, c, g, or t
ttgttttattttctttgcactttaaagatgaaaatagttagaactacatatttatctctgggcagcaacctcggcaataaacaaaaatatctgcaaattgctgtagagaaaatcaatgaaaaaattggtcatgtaaccaaggtctcttctatttataaaacaaaatccttgggatttgaaggtgatgatttttttaatatttgtattgaggtttctacaaatctaaatcctgaaagtttaattaaaagagttcttcaaatagaaacatctttgggaagggagcggttgaacacttcaaattaccacaatagaaatattgatattgatatcttactttttgatgatgatgttattttttacaatgactcgagccgaattttgtcccatggttaa

SEQ ID NO: 14566 - protein, 130 aa, Unknown
  Obtained from environmental sample
  DOMAIN (17)...(127): 7,8-dihydro-6-hydroxymethylpterin-pyrophosphokinase (HPPK)
  misc_feature (1)..(130): Xaa is any amino acid
MFYFLCTLKMKIVRTTYLSLGSNLGNKQKYLQIAVEKINEKIGHVTKVSSIYKTKSLGFEGDDFFNICIEVSTNLNPESLIKRVLQIETSLGRERLNTSNYHNRNIDIDILLFDDDVIFYNDSSRILSHG

SEQ ID NO: 14567 - DNA, 561 bp, Unknown
  Obtained from environmental sample
  misc_feature (1)..(561): n is a, c, g, or t
ttgtcgctggctgtaatatatttattaaggtttactatggaaaaaatttatgtagcgaaacttggtaaaacagttggcttaaaagggcaacaaaaacttcacattgattcagactttcctgaacaattcaaaaaagatgcaaaatttataacagataaaaaacaagaactaactatagagtcatataatgatacaaatagtgtagtcaagtttatcggtatcgatactatagaagatgcaaaaaaattaacaaatagacaactttttacctcaatggaagatacaaaagagctttgtcaactaaaagacaaagagtatttttggtttgatatgatgaattgtgaaattatagaagaggatgtagttttagggaaagttgtggatatacaaagaatgcctttatcagattatcttttaattgatactgcaaaagagcttattgacaaaaaactttcaaatcaatttttaataccatatcttgatgattatataattaatgttgatataaataacaaaaaaataactacaaaaaatagttacctcatattagaaaatagctag

SEQ ID NO: 14568 - protein, 186 aa, Unknown
  Obtained from environmental sample
  DOMAIN (103)...(183): PRC-barrel domain
  misc_feature (1)..(186): Xaa is any amino acid
MSLAVIYLLRFTMEKIYVAKLGKTVGLKGQQKLHIDSDFPEQFKKDAKFITDKKQELTIESYNDTNSVVKFIGIDTIEDAKKLTNRQLFTSMEDTKELCQLKDKEYFWFDMMNCEIIEEDVVLGKVVDIQRMPLSDYLLIDTAKELIDKKLSNQFLIPYLDDYIINVDINNKKITTKNSYLILENS

SEQ ID NO: 14569 - DNA, 1089 bp, Unknown
  Obtained from environmental sample
  misc_feature (1)..(1089): n is a, c, g, or t
ttgcacgttgaggaaaaaacattctttcctatttgtttaaaggatttattagatttaagccaaaatttgattgtaattcaaaaaggattagttttggaggaagtctactttcaaattgttttgttttggggaaatcaccaaatggcaaaagtactactaaaatatggtgctgatgttaatagtgtagacaattatggaagaattgttttatatgatgctttagcctatggagaccaaggttttttaagatatttattatctcttgataaactaaatattacccatattgatgaagagggtaattctttaatgcaatatcctgaagttacaaaaaatgattccattgcaaaagatatacttgtagctgggatagattcaactatcacgaaaaaagatgaagagtcatttctatataaaactatgttgagagatgacaaagattctcaatctgtttttgatgtagctctagagcataaagcaaatgtgaatgaaagagctcttaatggaaacactcttttagtagagcttatctatatagcttcaatgttacctaaaaatgaaaaagcaaaaagagcgttatatcttgagagagctaaagaaatgatagcacatcatggagatttaaacctcttagacccaaatggggaaactatactatttcatgctgtaagacttatggatagggaacttattaactttcttcttacttatggaattgatccaaatatacaagactctacaggaaaaccagccttagagtatgccatctattatggtcttgaagaaattgatttaattttattacttataaatcatggagcaaatccaaaactaaaaaataaacatggaaaatgtatatatgaagttctcaatgatattattcttcatcagtatggaacaaaaatcattgatgaaaaagatgtggttgcaaaaatagaaagaaatggacaatatatagagatagttaaaaaacttcttgagattaataactctgctgaacatgtggaaaaaattaactatcttgattcaacaggtgacccgctgttcttcaaacctttaatttatgaccactttctcagccgaatctga

SEQ ID NO: 14570 - protein, 362 aa, Unknown
  Obtained from environmental sample
  DOMAIN (214)...(246): Ankyrin repeat
  misc_feature (1)..(362): Xaa is any amino acid
MHVEEKTFFPICLKDLLDLSQNLIVIQKGLVLEEVYFQIVLFWGNHQMAKVLLKYGADVNSVDNYGRIVLYDALAYGDQGFLRYLLSLDKLNITHIDEEGNSLMQYPEVTKNDSIAKDILVAGIDSTITKKDEESFLYKTMLRDDKDSQSVFDVALEHKANVNERALNGNTLLVELIYIASMLPKNEKAKRALYLERAKEMIAHHGDLNLLDPNGETILFHAVRLMDRELINFLLTYGIDPNIQDSTGKPALEYAIYYGLEEIDLILLLINHGANPKLKNKHGKCIYEVLNDIILHQYGTKIIDEKDVVAKIERNGQYIEIVKKLLEINNSAEHVEKINYLDSTGDPLFFKPLIYDHFLSRI

SEQ ID NO: 14571 - DNA, 537 bp, Unknown
  Obtained from environmental sample
  misc_feature (1)..(537): n is a, c, g, or t
atgggtatctggtttgatataaaccttgatggaaatacagagcattttcacgcaccagttttagggagttttaatgctataaatctaacctcagtgatacttatggcaaaaaaacttggtatgagtgtagatgatattaaagtggcattacataatcttaaaccagtagaacacagacttcacctaagtaaggcaggaggaaaacttatccttgatgatagttttaatggaaatcttgaaggtatgttagaagctatagaaatctcttctactcatgaagggagaaaagttattgttacaccagggctagttgagtcaaacatggaatcaaatgtagaactagctcacgctatagagaaagtatttgatttagtgattatcacaggaagtttaaatgcaaaactttttgataaagttatcaaacatacaaaaccaatcatccttgaagataagtctaagatgcaagaagtattagcaaatgaaacacatataggtgatctgatactttttgcaaatgatgcaccaaactttatataa

SEQ ID NO: 14572 - protein, 178 aa, Unknown
  Obtained from environmental sample
  DOMAIN (56)...(139): Mur ligase family, glutamate ligase domain
  misc_feature (1)..(178): Xaa is any amino acid
MGIWFDINLDGNTEHFHAPVLGSFNAINLTSVILMAKKLGMSVDDIKVALHNLKPVEHRLHLSKAGGKLILDDSFNGNLEGMLEAIEISSTHEGRKVIVTPGLVESNMESNVELAHAIEKVFDLVIITGSLNAKLFDKVIKHTKPIILEDKSKMQEVLANETHIGDLILFANDAPNFI

SEQ ID NO: 14573 - DNA, 666 bp, Unknown
  Obtained from environmental sample
  misc_feature (1)..(666): n is a, c, g, or t
atgctgcgatggtttatattattgattagcgtcatcgtgtgtttgaacgtgaatgctactatcaatctgacgtcattaagtgaaaagggcatagataagtggcaccctaaagtgttttccggtaaatcaatttactccatcgttgagtataaagggcgtttggcactaaaggcacttagtcataatgccgcgtcaggattagtgttagaacgccaaattgatcttatggtaacgccttacctcaactggagttggctcgtcgaaaagcaactgctgcagttaaatgagcgcagtaaaaaaggcgacgactttgttgctcgaatttatgtggttattgatggtggttttatggtgtggaataccaaatcattaaactacgtttggtcgagtaatcaagatcagggcttggtttgggacaacgcttttgctggctcaagtgttaaaatgctctctattagaggtaaggaagcgcagaagggcagatggtatccacaaaagcgcaatgtataccaagacttgattgaaacctttggtgataaaggcagtgataccgctaatcgtaaagcctatcaatacatcgatatcatcgcgataatgaccgacacagataacagtggtaaacaagctgaatcttattatgcagacatcatatttagtgaagaatag

SEQ ID NO: 14574 - protein, 221 aa, Unknown
  Obtained from environmental sample
  SIGNAL (1)...(19)
  misc_feature (1)..(221): Xaa is any amino acid
MLRWFILLISVIVCLNVNATINLTSLSEKGIDKWHPKVFSGKSIYSIVEYKGRLALKALSHNAASGLVLERQIDLMVTPYLNWSWLVEKQLLQLNERSKKGDDFVARIYVVIDGGFMVWNTKSLNYVWSSNQDQGLVWDNAFAGSSVKMLSIRGKEAQKGRWYPQKRNVYQDLIETFGDKGSDTANRKAYQYIDIIAIMTDTDNSGKQAESYYADIIFSEE

SEQ ID NO: 14575 - DNA, 648 bp, Unknown
  Obtained from environmental sample
  misc_feature (1)..(648): n is a, c, g, or t
atgcaaaaagttgcaaaaaaagaacctgtaacaccaaaggttattgagtttccaaatcatattcttacaaataaccatctattacaagatgtttatatgctatttgatatagttccttatgatgctgttttaaaagatttagagataacacaaaatagttcaacttatgtttgtatgttcacatcacaaagccaatcatttgaagatatgaggataaaacttctaaatctttacaaagattcaaaaatacttttaaaacatgaaaataaatctattctaaatattattcttgaaaatgaaaattttctaaccccaaataaaaaaatgcaatataaacaatatggtgattctgaatttatatctattggtcaatcaacagactatattaataaacttcttatagatcaatcaacaataaagttttctaataaagaggagaaagagtatttaacttataaatttgctataaaatctatagcaaaaacacctaaagatttttttagttttgtagaaaagctgaatcaacaaaaactttctataaccttagagtatccaatcgtatttagtaaaactaatgacggaattgagataaagtataatttatctgttcatcaaaaaaataaagagcaactacaacttagtaaataa

SEQ ID NO: 14576 - protein, 215 aa, Unknown
  Obtained from environmental sample
  misc_feature (1)..(215): Xaa is any amino acid
MQKVAKKEPVTPKVIEFPNHILTNNHLLQDVYMLFDIVPYDAVLKDLEITQNSSTYVCMFTSQSQSFEDMRIKLLNLYKDSKILLKHENKSILNIILENENFLTPNKKMQYKQYGDSEFISIGQSTDYINKLLIDQSTIKFSNKEEKEYLTYKFAIKSIAKTPKDFFSFVEKLNQQKLSITLEYPIVFSKTNDGIEIKYNLSVHQKNKEQLQLSK

SEQ ID NO: 14577 - DNA, 678 bp, Unknown
  Obtained from environmental sample
  misc_feature (1)..(678): n is a, c, g, or t
atgcttgaaaatagttatgaatcacttcttacagctcaccagctcaatgataagtgtgagtggtttttgatgcaatttacaaaaggagcaggacttagtgaacttctaggtatgcaaatgcagagttataaaaatggatataatattgtaaaaccacttttagaacacacaaaacaatctctcaaagagtaccttcttactaacaactataagttttttgaagatataagtaatagggatgaaaaatacaaaagaaattattttagacataactttagtgataaacttcttgaacaatatcaaagtgggatatctcatagttttgaatatttggaaaaagattttcactctttatttgataactttacaaaacaggtttttgagcagttgacaatctatgaatacaataaagatttaaatattgctatgagaattattgataaagatttaaaaataagaggtataatcatatcaaaagctacaagagatgaaatagtgcaaaaaaaagaagttgttatttcacacaaaattgcagtagctatagttgatgaaaaaatatatatagcaccatatcttaaaaacactatgacaaaagagtttaaagagagatgcagagtaaataaaattcctaataatataagaggatatctctctactttagataattttatttactaa

SEQ ID NO: 14578 - protein, 225 aa, Unknown
  Obtained from environmental sample
  DOMAIN (1)...(110): PP-loop family
  misc_feature (1)..(225): Xaa is any amino acid
MLENSYESLLTAHQLNDKCEWFLMQFTKGAGLSELLGMQMQSYKNGYNIVKPLLEHTKQSLKEYLLTNNYKFFEDISNRDEKYKRNYFRHNFSDKLLEQYQSGISHSFEYLEKDFHSLFDNFTKQVFEQLTIYEYNKDLNIAMRIIDKDLKIRGIIISKATRDEIVQKKEVVISHKIAVAIVDEKIYIAPYLKNTMTKEFKERCRVNKIPNNIRGYLSTLDNFIY

SEQ ID NO: 14579 - DNA, 414 bp, Unknown
  Obtained from environmental sample
  misc_feature (1)..(414): n is a, c, g, or t
atgatatttgcaaaaattgattacattaatttattaccatttcacgtatattttaagaagaatattaaaccatcaaaaatcaaagcaatagtaaactcaaaaaaatcttaccctgctgatataaatgtaaagtttaaaaatagaaaagttgatgcagcctttatctcttctataaaatcaagaggacaaaagtctttagattttggaattatagggaaaaaagagattttatctgttctttgtattcctggtgtttataaagaagattttgaatcatctacttctaatgtattagctaagattttaaaatgcgaaggtaaagtcttaattggagataaggcttttaaatattatgcaagccatgataaagatagttttgttgaccttggaaaacttttggacaaaaaaggataa

SEQ ID NO: 14580 - protein, 137 aa, Unknown
  Obtained from environmental sample
  misc_feature (1)..(137): Xaa is any amino acid
MIFAKIDYINLLPFHVYFKKNIKPSKIKAIVNSKKSYPADINVKFKNRKVDAAFISSIKSRGQKSLDFGIIGKKEILSVLCIPGVYKEDFESSTSNVLAKILKCEGKVLIGDKAFKYYASHDKDSFVDLGKLLDKKG

SEQ ID NO: 14581 - DNA, 567 bp, Unknown
  Obtained from environmental sample
  misc_feature (1)..(567): n is a, c, g, or t
ttggttacagatagaggtatcattcaaaagccatatatagataactttttaaaaaataaagaagtaagttatggtgatataggtgtaaggttaaaacaaagcagcacaaacgtgattgttgcatcaacagatccattttttacaaataatcaatttgttgtaggtgatcaaatattaaaaataaatggaaaaaatattgagagtagttcactattaatgcaaaagatactcttttctactcaaggaaaaagtattgtttttaatataaaaagagcaaataaaataaaaaaaataaaaataaaagttggtaatcgatatggtggtggtttgattagtgatacttttttagagcgtcatggactgttttttgataacgaacttttaataaaagagtcagattcaagtagacgtttagggttatcagtatcagataaacttgttagcgttaatttgaaaaatgtaagctcatatagcgatatcagagaagttcttagtggagcaaaggaagaagttaaacttctgtttgaacgagatggttttatgttttttattattttaaaaatataa

SEQ ID NO: 14582 - protein, 188 aa, Unknown
  Obtained from environmental sample
  misc_feature (1)..(188): Xaa is any amino acid
MVTDRGIIQKPYIDNFLKNKEVSYGDIGVRLKQSSTNVIVASTDPFFTNNQFVVGDQILKINGKNIESSSLLMQKILFSTQGKSIVFNIKRANKIKKIKIKVGNRYGGGLISDTFLERHGLFFDNELLIKESDSSRRLGLSVSDKLVSVNLKNVSSYSDIREVLSGAKEEVKLLFERDGFMFFIILKI

SEQ ID NO: 14583 - DNA, 351 bp, Unknown
  Obtained from environmental sample
  misc_feature (1)..(351): n is a, c, g, or t
ttgtctttatttaaagcagctttaatccctaaatataaagataagagaaatatagcaaccatactaataacattaatagtaagtgttattgggattcgattgagtatttcatcctttacattcataccactactaaaagagataccaaaatctaacattgttatgtttacaatccaagagaaaaactgtacatataaaggcttatccagtccatatatctctttaagatgtactatagactcttctgtaatattaggatttaaatctcctgatgcaaagaaactattaggtgctaagtttatagcaataaatgagataagagagataataaaaagcatcactataatgtaa

SEQ ID NO: 14584 - protein, 116 aa, Unknown
  Obtained from environmental sample
  misc_feature (1)..(116): Xaa is any amino acid
MSLFKAALIPKYKDKRNIATILITLIVSVIGIRLSISSFTFIPLLKEIPKSNIVMFTIQEKNCTYKGLSSPYISLRCTIDSSVILGFKSPDAKKLLGAKFIAINEIREIIKSITIM

SEQ ID NO: 14585 - DNA, 513 bp, Unknown
  Obtained from environmental sample
  misc_feature (1)..(513): n is a, c, g, or t
ttgcgtttttttttcgggttccacctccaaaaaaattcccctcccttctcacaggttttgggggttcttaaaataaaaagggggcccaattcccttgtacatgctggggatttggggttaaaagaaaatttggttttttttaaaaaactctgttttaattatgtaagtgtttttggaacaatgactttattctcactaattactcaaataattttatataaatcaagagccttactatttaaaataaaaaaggtcacttttaaacttatgcatataccaaactatctcactcctgatagtgatgtagtaatatttggtcacacacacaactttgaacaacaatatacaaataacactttatttataaatccaggggaagtttgtgccagaaataaaaacttaacggagtgtgtacttttagagataaaagaggataaatatataatagagtataattacaaaaaacctgaatctaatacttgggaaacaaaagtttatgaatatgaaaaataa

SEQ ID NO: 14586 - protein, 170 aa, Unknown
  Obtained from environmental sample
  misc_feature (1)..(170): Xaa is any amino acid
MRFFFGFHLQKNSPPFSQVLGVLKIKRGPNSLVHAGDLGLKENLVFFKKLCFNYVSVFGTMTLFSLITQIILYKSRALLFKIKKVTFKLMHIPNYLTPDSDVVIFGHTHNFEQQYTNNTLFINPGEVCARNKNLTECVLLEIKEDKYIIEYNYKKPESNTWETKVYEYEK

SEQ ID NO: 14587 - DNA, 597 bp, Unknown
  Obtained from environmental sample
  misc_feature (1)..(597): n is a, c, g, or t
atgacgattaaatatgcaggtccaagaccagaaatttcacatcatggaatacaatttaaagatggtaaagaggacaaatatgtatatcttattattgctatacagatattaaaagctatagataaagattatgaagagaaaaagtcttatagttacgatacaaaaacaaaaagatttacagatgctgagttgttagatattatgaatacatatgaaccaaatcttaaagagacagttatgcaagaagagattagatatgaagaacatttgcaagaagagatagctcatgtaaaacaaagaaaagacttaaaagagattgagagagatacttggatagaaaatttaaatataatgcagcaatatagaatacaaagagccgttaataaaatctattatatacactgtgttgctgatattgcaaaagttataaaaagagaaaaaataaaagagatagacacccctttttatgaaaagtattggcatgtgttacaaactattcaaggtactttaagtgagggtagagactctgtagggagtgatttaaaagttgaaaatacttctgagggtatgatagctaaaatgtttgttaattattga

SEQ ID NO: 14588 - protein, 198 aa, Unknown
  Obtained from environmental sample
  misc_feature (1)..(198): Xaa is any amino acid
MTIKYAGPRPEISHHGIQFKDGKEDKYVYLIIAIQILKAIDKDYEEKKSYSYDTKTKRFTDAELLDIMNTYEPNLKETVMQEEIRYEEHLQEEIAHVKQRKDLKEIERDTWIENLNIMQQYRIQRAVNKIYYIHCVADIAKVIKREKIKEIDTPFYEKYWHVLQTIQGTLSEGRDSVGSDLKVENTSEGMIAKMFVNY

SEQ ID NO: 14589 - DNA, 390 bp, Unknown
  Obtained from environmental sample
  misc_feature (1)..(390): n is a, c, g, or t
ttgaaaaaatcatgtatagaagagttagattttataactgctgtccctattcctcccaatccttccgagcttattttaagcaataagtttaaagaagtattgactgaactaaaggaaaaatacgatatcgtattaattgataatccacccataggtattgtatctgacggcgtcaatgttttggcaatggctgatcttcctatatatgtttttaaagcaaattattctaaaagatattttgtaaataagttgaaagaaataacagaattagacgaaattaaaaaactatcggttattctcaatagtgtgaaaatgagcaaatcaagatatggttatggatactacgaggaggatgcgaagagaagtattttcaaacgaaataatacttag

SEQ ID NO: 14590 - protein, 129 aa, Unknown
  Obtained from environmental sample
  misc_feature (1)..(129): Xaa is any amino acid
MKKSCIEELDFITAVPIPPNPSELILSNKFKEVLTELKEKYDIVLIDNPPIGIVSDGVNVLAMADLPIYVFKANYSKRYFVNKLKEITELDEIKKLSVILNSVKMSKSRYGYGYYEEDAKRSIFKRNNT

SEQ ID NO: 14591 - DNA, 972 bp, Unknown
  Obtained from environmental sample
  misc_feature (1)..(972): n is a, c, g, or t
atgatcagatcggctcgaggcttagaagttcttccagttgatattcaggctaaaacaattcaaataagctatagaaatacaaatgccaatttagcccaagacattacaaaagccattggtgatgccttttttgaatatgatgaaaaatatacaaaagagagtgctgaaaatattttaagtttcatctcccttcagttagactctctgagaaaagaactgactgcttcgaaagatagtatcatgtattttcagagaaaagagaacttaccagacccagagaatttaggtgaatcaatcgctacaaagttggaaaaataccgtttcgacaaatttgaattacaagatgaactgaacaccttagaaatgatttcgttgaaacttaagcaatcacctgaaagcttagatgtttataaattaattccagagcttattggtaagtcatttgagggcagtttaaatcttcaggtaaaagaacttcatgagttgttagaaaccaaggaagatttactctataaagtgactcctgaaaatgacatgatcaagaaaattgaaactagaattgataatagaattcaaaatattaataagataattattgttttgaaggataggttgaaagaaaagattaaagtggttaatactgaaattgcaaaattggagaattcctactatgaacttcctgaaaaggaaatggaattgtcgaggttaaaaaacattcaaaatttgaatgaaaaatattatactcttttaactgaaaagcaagtactttactcaatttcaaatgctggttatgcatcgagtaataaaattttaaataatgcctctatttctaacactcccaattcacctcaaaagagctttgattatggtgcggcaatatttatgtcacttgcaattggagttggattgntggtccttaggaatgtaacatttaatgagataaatcagttgccggaacttcaaaaatattaa

SEQ ID NO: 14592 - protein, 323 aa, Unknown
  Obtained from environmental sample
  misc_feature (1)..(323): Xaa is any amino acid
MIRSARGLEVLPVDIQAKTIQISYRNTNANLAQDITKAIGDAFFEYDEKYTKESAENILSFISLQLDSLRKELTASKDSIMYFQRKENLPDPENLGESIATKLEKYRFDKFELQDELNTLEMISLKLKQSPESLDVYKLIPELIGKSFEGSLNLQVKELHELLETKEDLLYKVTPENDMIKKIETRIDNRIQNINKIIIVLKDRLKEKIKVVNTEIAKLENSYYELPEKEMELSRLKNIQNLNEKYYTLLTEKQVLYSISNAGYASSNKILNNASISNTPNSPQKSFDYGAAIFMSLAIGVGLXVLRNVTFNEINQLPELQKY

SEQ ID NO: 14593 - DNA, 558 bp, Unknown
  Obtained from environmental sample
  misc_feature (1)..(558): n is a, c, g, or t
ttgaaaaataaaatttacctcgattatatttggagtattgttgatgtgccaaattttgaaaaaattgccggttttcacaccagggttgtccatcaacttcgaattgcagataccattattttgaataaaattgatttggctccgcaaaatgttgaaacaataagtaacaaggtggctaaaataaatccgatggctaaaattgttgaagcaacttattgtgaaaccgattttgaaaagagaaaagtaccatttaaaatattagctgaagggaaaccaggtattcgcccacaaatagaatcgttgataattaaaactacaaaaacaatttctttcgagtaccttgaactttttataaaagaaataaaaaacgactttattcgtatgaaaggttatgtaaatatcgaaggacacaaaaaagtgatgctgcagggtagttatgaaaattatcgttttttcgaggtcgacaattttatatccccaactgaaattgttggaattggtaatttaacggatgctgaaagatatgtgaaactgtatgaaagtttttgcttaaaatag

SEQ ID NO: 14594 - protein, 185 aa, Unknown
  Obtained from environmental sample
  misc_feature (1)..(185): Xaa is any amino acid
MKNKIYLDYIWSIVDVPNFEKIAGFHTRVVHQLRIADTIILNKIDLAPQNVETISNKVAKINPMAKIVEATYCETDFEKRKVPFKILAEGKPGIRPQIESLIIKTTKTISFEYLELFIKEIKNDFIRMKGYVNIEGHKKVMLQGSYENYRFFEVDNFISPTEIVGIGNLTDAERYVKLYESFCLK

SEQ ID NO: 14595 - DNA, 690 bp, Unknown
  Obtained from environmental sample
  misc_feature (1)..(690): n is a, c, g, or t
gtgtttttaagcgttgcaaaaggtgaaaattatgccaccatagcatctttacctattacctcttatatgataagtaaatatggattacaagatttacaaatagcaggatatttgaatattaaatatgatttatcaattgcagttagagatgataatgaacaattattaaagatattaaataaagctttacagcaaataccaaaagagaaatacaagcagttttttaataattggacctcattggtggtggagcaaaagtcagattacacatttttttataaaattatagctcttgttgttgttttattgtttgttgcaggatatttaaactataaactcaattcaaaggtaaatgaaaaaacaaaagagttgaaaaatcttaatgaacatctagaagaaaaagttttacagcgaacaaaagagttacaaatagaaaaagaaaaagctgaaaatagcacaaaagcaaaatcagaatttttagcaaatatgtcccatgagataagaacacctatgaatagtatattaggtatgagctatttagctttagaatctcaagattttgcaaaacaaaaaaaatatatacaaaatatagataattctgcaaaaacacttttaaatataattaatgatattttagactttagtaaaatagaagctgggaaattagatattgaatatgtccgattttga

SEQ ID NO: 14596 - protein, 229 aa, Unknown
  Obtained from environmental sample
  DOMAIN (155)...(220): His Kinase A (phosphoacceptor) domain
  misc_feature (1)..(229): Xaa is any amino acid
MFLSVAKGENYATIASLPITSYMISKYGLQDLQIAGYLNIKYDLSIAVRDDNEQLLKILNKALQQIPKEKYKQFFNNWTSLVVEQKSDYTFFYKIIALVVVLLFVAGYLNYKLNSKVNEKTKELKNLNEHLEEKVLQRTKELQIEKEKAENSTKAKSEFLANMSHEIRTPMNSILGMSYLALESQDFAKQKKYIQNIDNSAKTLLNIINDILDFSKIEAGKLDIEYVRF

SEQ ID NO: 14597 - DNA, 378 bp, Unknown
  Obtained from environmental sample
  misc_feature (1)..(378): n is a, c, g, or t
ttggggaaaataattgaaaagttagaaactacaacgattacaatgtggctatctaaactctatgaacagcatagtaaaataataggtgaattggaacaattagatatttttgatgaagcaattattaaatctaaagggataataactaaagagaagcgaaaagagttatttgaaaagcttaaagaggttttgcacacaaaacgacctaaaaatattgaaaaggtactactggaaatagaccagtatcagattaatattgaggaagaaaataatttgaatatgataaaagaatatacagaaaaatttgattttcaaaaggctttggattgtttgtcattgtatgaagaaaactatttaaatcataaaaaaggaaaataa

SEQ ID NO: 14598 - protein, 125 aa, Unknown
  Obtained from environmental sample
  misc_feature (1)..(125): Xaa is any amino acid
MGKIIEKLETTTITMWLSKLYEQHSKIIGELEQLDIFDEAIIKSKGIITKEKRKELFEKLKEVLHTKRPKNIEKVLLEIDQYQINIEEENNLNMIKEYTEKFDFQKALDCLSLYEENYLNHKKGK

SEQ ID NO: 14599 - DNA, 837 bp, Unknown
  Obtained from environmental sample
  misc_feature (1)..(837): n is a, c, g, or t
ttgtttggcaaaggtatttattataatcctataaaatctcataaaatgcatactgaaaaagtaatagatcatatcgtaaattggctaaaagaatacgctattaatgctaaaatgaatggttttatcgtaggcgttagtggcggaattgactctgctgttacctctacactttgcgctaaaactggactacgaactctttgtgtagaaatgccaatacaccaagcacaaagtcaagttacacgtgccgaagaacatattgaacagcttaaaaaacaattcccgaatgttacatcggttcgaacagatttaacctccgtttttgaagagtttaaagcgcaagctccctttacagaagacgatacttttttagacctatcacttgcaaacaccagagcgcgtttacgaatgaccactctatattattttgcaggactacacaaatacctcgttgccggaacaggtaataaggtggaagattttggagttgggttttacactaagtacggagatggcggtgtagatataagtccgatcgccgatttaatgaaaagcgaagtgtatgcagttgcaaaaacacttaaggttccgcattcaattcaaatcgctgctccaacagacggattatttggagatagtcgtaccgacgaagatcaaattggagctagctatgatgagctagaatgggcgatgaaaatgaaagaaaataataaagaaatttccgactttaaagggcgtgaaagaagagtttttgaaatattcacaaaactgaacaaagccaaccaacataaaatgaatccaattccagtgtgtgaaatccccaatcatttaagagattaa

SEQ ID NO: 14600 - protein, 278 aa, Unknown
  Obtained from environmental sample
  DOMAIN (70)...(271): NAD synthase
  misc_feature (1)..(278): Xaa is any amino acid
MFGKGIYYNPIKSHKMHTEKVIDHIVNWLKEYAINAKMNGFIVGVSGGIDSAVTSTLCAKTGLRTLCVEMPIHQAQSQVTRAEEHIEQLKKQFPNVTSVRTDLTSVFEEFKAQAPFTEDDTFLDLSLANTRARLRMTTLYYFAGLHKYLVAGTGNKVEDFGVGFYTKYGDGGVDISPIADLMKSEVYAVAKTLKVPHSIQIAAPTDGLFGDSRTDEDQIGASYDELEWAMKMKENNKEISDFKGRERRVFEIFTKLNKANQHKMNPIPVCEIPNHLRD

SEQ ID NO: 14601 - DNA, 846 bp, Unknown
  Obtained from environmental sample
  misc_feature (1)..(846): n is a, c, g, or t
atgggattatgtaaattttgtaatgaaaatgaggctataaaaaattctcatataataccttcttttatatttaagtggattaaggatacctcggctacagggaaattaagagaatcaaaaactcctaataaaagattgcaagatggaataaaaaaagatttattatgtgaaatttgtgaagaaaagtttagtaaattggaatcatactttaagaatgagtttttttcaaaaactgctacttatagggaaatatcaaattctattattttatcagataaatcccttttttgtttgtattcaattttttggagagtcttggcaatgataaaatattaccctcaagaagattcagacttaattgaaaaagataaaaaactaatggatactcatttaagcatcctgaaggattctattatcaagagagatgtaagttcgaaagaaaaaatcaatatagtttattgttctctcgataatagaaatgaatcaaacactcttccgaaaagtataacaccttttttctatgaaaggggtgtctctcaaggtccatacattttagagaacccgtatcgatttatgattatcgtgactataccatttagtatatttacgtacactcttactagtttagaaaatattaaagactggaaaaacactaagtactctgcatctttttctcttaaatcaattccagagataccccaagaacttatagactatattttaaataggagtgatgactttgaaaaaggaaaattatcaatgaatcaagaggcattaaaaaaatctattgaaaaaaatttaaaaaaagaagactgcggaagttataaaacttttagaaataantaa

SEQ ID NO: 14602 - protein, 281 aa, Unknown
  Obtained from environmental sample
  misc_feature (1)..(281): Xaa is any amino acid
MGLCKFCNENEAIKNSHIIPSFIFKWIKDTSATGKLRESKTPNKRLQDGIKKDLLCEICEEKFSKLESYFKNEFFSKTATYREISNSIILSDKSLFCLYSIFWRVLAMIKYYPQEDSDLIEKDKKLMDTHLSILKDSIIKRDVSSKEKINIVYCSLDNRNESNTLPKSITPFFYERGVSQGPYILENPYRFMIIVTIPFSIFTYTLTSLENIKDWKNTKYSASFSLKSIPEIPQELIDYILNRSDDFEKGKLSMNQEALKKSIEKNLKKEDCGSYKTFRNX

SEQ ID NO: 14603 - DNA, 795 bp, Unknown
  Obtained from environmental sample
  misc_feature (1)..(795): n is a, c, g, or t
atgaacaaagaaactcaatctaatgtagtagtttataatgatggagaattggaactaaatatttcaattaagaatgaaacagtatggctcaatagaaatcaaatatctgaactttttggaagagatataaaaactataggaaaacatataggtaatgtttttaaagataaagaattagaacaaaaatcaactgtcgcaaattttgcgacagttcaacttgaaggggaaagagaggtaacaagagaaattgaatactacaatttagatgtgataatctctgttggatatcgagtaaagtctcaaaaaggagttcgatttagacaatgggcaacatcagtgctcaaaaactacattcaacatggttatacaatcaatggagacaaaattaccaatgaaagatttgtatctttggaaaatgaagtaaattttctcaaatcaaaagttgcatatatctcaaattcattggaaaataattctcttacacaaacacaagggatatttttcgatggacaaatttatgatgcctatgcttttatcaatgatttactcaaaagtgttaaaaatgaagtaatactaatagataactatatagatgaaacagtttttacactctttagtaaatatccaaatttaaaagtcaaaatctacacacaaagtataaataaacaactaaaactcgactatcaaaaatataattcacaatataaaaatatagaactcaaagaatataaaaactcacacgatagatttcttatacttaatagtaaggagatatatcatctcgagccgatctga

SEQ ID NO: 14604 - protein, 264 aa, Unknown
  Obtained from environmental sample
  misc_feature (1)..(264): Xaa is any amino acid
MNKETQSNVVVYNDGELELNISIKNETVWLNRNQISELFGRDIKTIGKHIGNVFKDKELEQKSTVANFATVQLEGEREVTREIEYYNLDVIISVGYRVKSQKGVRFRQWATSVLKNYIQHGYTINGDKITNERFVSLENEVNFLKSKVAYISNSLENNSLTQTQGIFFDGQIYDAYAFINDLLKSVKNEVILIDNYIDETVFTLFSKYPNLKVKIYTQSINKQLKLDYQKYNSQYKNIELKEYKNSHDRFLILNSKEIYHLEPI

SEQ ID NO: 14605 - DNA, 795 bp, Unknown
  Obtained from environmental sample
  misc_feature (1)..(795): n is a, c, g, or t
atgtgntataaagcaaaaaaacagccagtagtagttgtctctccaatttttcaacactcacctagtgttttaatagcattaaaaagtagtggaataagttcaccctatgaattaaataagaagaatatgattttttatccaaatgatactgatggtttttcaattttagcgatgttaaaaaagctaaatattaaacctaatattattcgaaaaagagagaaaaatgactatttaaagcttataaataaagaggtagatctcacccctgcttatttgagtaatgaaccattttattttcaagaaagaaatataggaattaatattataaacccaatgaattatggttttgatttatatggtgatatgttgtttaccaatcaaaatgaggtagagaaacatcctttgcgagtaaaacgatttaaagaagcaactttaaaaggatggaagtatgctttaaataataaagaagagattattcaattgattcacaaaaagtataataaaactaaatcaattgaacatttgagatttgaagcaaatgcaattgaacaacttatattaaaagatactatccctttgggaactattgataggggaagaatacaatatacttataatttatatgaagaatatggactttcaaaagataaatttgagatacaagattttatttttgaagagtatgtaaataatcaccactccatagatttaacaaaagaggaaaaagaatatttaaaaaacaacccaatattaaaagtcaaaatttatcctcattccccctatatccagcgataa

SEQ ID NO: 14606 - protein, 264 aa, Unknown
  Obtained from environmental sample
  misc_feature (1)..(264): Xaa is any amino acid
MXYKAKKQPVVVVSPIFQHSPSVLIALKSSGISSPYELNKKNMIFYPNDTDGFSILAMLKKLNIKPNIIRKREKNDYLKLINKEVDLTPAYLSNEPFYFQERNIGINIINPMNYGFDLYGDMLFTNQNEVEKHPLRVKRFKEATLKGWKYALNNKEEIIQLIHKKYNKTKSIEHLRFEANAIEQLILKDTIPLGTIDRGRIQYTYNLYEEYGLSKDKFEIQDFIFEEYVNNHHSIDLTKEEKEYLKNNPILKVKIYPHSPYIQR

SEQ ID NO: 14607 - DNA, 783 bp, Unknown
  Obtained from environmental sample
  misc_feature (1)..(783): n is a, c, g, or t
atggacacaatgagtgtattgtatgaacttaatggtattgaacagtattatgatgataaaaaagttcttagtattgatagcttaaaattagaagaaaatcaaattattggttttttgggaccaaatggtagtggtaaatctacattactttcactactttcttttggtgacaaaccaacaaaaggtgatatactttttaacggtattgataataaaaaactggatctagaaactaaacaaagtatagttatggtgcctcaagacccatatcttctcaaaagaacagtttttgataatattgcatatggattaaggattcgcaatatgtctgataatattgaaaaaaaagtttatgaagcactagagcaagttggacttgatagttcatttgcaaaaagaaaatggagtcaactctcaggtggagaagcacaaagggtagctttagcttcaagactcgttcttaaaccaaaagttttaattttagatgaacctacttctggggtagatacaaattctgttcaacttataaaagaagcaatactcctagcaaagaaaaaatataatacaacaatatttatctcaagtcatgaccataactggttaaataatatttgtgataaaaaaatagcactttttcaaggtgaattagtcgagagtggaagtgtaaatctcctttttgcaccgtgggaaaaagatataaatggaaatcttgtaaaacgatttattgatggacaagagttaacaatccctaatagtgctggtaaaaaaaaggatcagttgtga

SEQ ID NO: 14608 - protein, 260 aa, Unknown
  Obtained from environmental sample
  DOMAIN (33)...(214): ABC transporter
  misc_feature (1)..(260): Xaa is any amino acid
MDTMSVLYELNGIEQYYDDKKVLSIDSLKLEENQIIGFLGPNGSGKSTLLSLLSFGDKPTKGDILFNGIDNKKLDLETKQSIVMVPQDPYLLKRTVFDNIAYGLRIRNMSDNIEKKVYEALEQVGLDSSFAKRKWSQLSGGEAQRVALASRLVLKPKVLILDEPTSGVDTNSVQLIKEAILLAKKKYNTTIFISSHDHNWLNNICDKKIALFQGELVESGSVNLLFAPWEKDINGNLVKRFIDGQELTIPNSAGKKKDQL

SEQ ID NO: 14609 - DNA, 753 bp, Unknown
  Obtained from environmental sample
  misc_feature (1)..(753): n is a, c, g, or t
atggacattaatttaagtggctctctagatgggatagaaacagcaaacattatctataacacatacgatattccaattatctttctaacagcatattcagataattcaacactggaaagagcaaaaacgaccaatccttttggctatatcctaaagccatttagtgtcagagaacttcatgcatcaatcaatctagctttctacaaatatgagatgggaaagaaattagcatccagcgagaagaagtatagaagccttttcgaaacatctcaagccggaattctgatctcaacatttccggagggtaagataattgattctaatcaaagaattaaggtaatgtttggatatgatagtgatgagatttttaacggtctactctttactgatatttacggctcgggggatgatttaagctggctgcaggaagagttattagataaacaaaaagtagaacagtatgaggtaaatcttaagctaaaagatgaatcaatagcttggttcgaatgctcatcctggataagagaagatggtaaatttctggatacaattttcatagacatcactgagagaaagaagattgaagagaaacttagacaaactcagaagatggaggccatcggtcaaattgctgcaggcattgctcatgagataaatacacctcttgcagttatctcaactcgactcgaaattctaaaagaagagatccagcgttcaacctgtaagaatggggtagctcagatgaaatcataa

SEQ ID NO: 14610 - protein, 250 aa, Unknown
  Obtained from environmental sample
  misc_feature (1)..(250): Xaa is any amino acid
MDINLSGSLDGIETANIIYNTYDIPIIFLTAYSDNSTLERAKTTNPFGYILKPFSVRELHASINLAFYKYEMGKKLASSEKKYRSLFETSQAGILISTFPEGKIIDSNQRIKVMFGYDSDEIFNGLLFTDIYGSGDDLSWLQEELLDKQKVEQYEVNLKLKDESIAWFECSSWIREDGKFLDTIFIDITERKKIEEKLRQTQKMEAIGQIAAGIAHEINTPLAVISTRLEILKEEIQRSTCKNGVAQMKS

SEQ ID NO: 14611 - DNA, 906 bp, Unknown
  Obtained from environmental sample
  misc_feature (1)..(906): n is a, c, g, or t
ttgatggccgggatcagagttacctatgcaatgatttttgacacaaatggtaaagttctagcacttacaaacaaaaaacacctcaataaatatcttggggatgagataagcctcttaccattaaaatcaaaacctatcacaactatactcattaataattcaaatatgatagatattgctgttcctattttgcgacaaacacaacatataggatgggcaagagttgctttatctttaaaaagcaatactcaaattctaaataaaatatctttaaatggtttgttttataccacattagcaattattttagggataataattgcttacatactctcaataagtttgacaaaaaatctttataaattaatctcgattgcaaaacaaataaccaatggaaagagagatattgaagttgacactaaaaggatagatgagattggctcactttctaaagaaattaactctatgttagaaaaaataaaagaaaatgaacaagaattaagattactcaataaaaaccttgaagagaaagtaacagaaaaaactataaaacttgaaaaacaaaacagagagttagaggaaagtgaccatgaactccaagttcttaatgcaaacctagaacaaagagtaaaagaggaagttgaaaaaaatatacaaacccaaaaacaactctttaaatctgaaaaaatggcatcaatgggtgaaatgataggaaatattgctcatcaatggagacaacccctttctataatatctactggtgctacagggatgaagatgaaaaaaactttcaataccctagatgataagttttttgaagaaacttgtgatcttataaatgataatgcacaatacctctcccaaactattgatgattttagaaattttattaaggtgatagggtaa

SEQ ID NO: 14612 - protein, 301 aa, Unknown
  Obtained from environmental sample
  DOMAIN (93)...(162): HAMP domain
  misc_feature (1)..(301): Xaa is any amino acid
MMAGIRVTYAMIFDTNGKVLALTNKKHLNKYLGDEISLLPLKSKPITTILINNSNMIDIAVPILRQTQHIGWARVALSLKSNTQILNKISLNGLFYTTLAIILGIIIAYILSISLTKNLYKLISIAKQITNGKRDIEVDTKRIDEIGSLSKEINSMLEKIKENEQELRLLNKNLEEKVTEKTIKLEKQNRELEESDHELQVLNANLEQRVKEEVEKNIQTQKQLFKSEKMASMGEMIGNIAHQWRQPLSIISTGATGMKMKKTFNTLDDKFFEETCDLINDNAQYLSQTIDDFRNFIKVIG

SEQ ID NO: 14613 - DNA, 477 bp, Unknown
  Obtained from environmental sample
  misc_feature (1)..(477): n is a, c, g, or t
gtgcttattttgactaactacagtaaacctcacttaacttatcaggaacaagtcgaccttttaaagaagagaaatctaattgtaactaatgaagcttatgctttggaaaaattaaaacatattagttattatagattaagtgcatattttttacctttttgtatttctaaaaatcaatttattacgggtactagatttgaagatattattgagctttatcattttgataaagagcttagaatattaacttttagcgtgatagaaaagatagagatatttttaagaacttcaatagcttataatttttcaaaaaatcatgaagtatttgcatataataataaacaaaatttttgttgtaaagaaaaagattttatctggttaaataatgatattcaaaaagaaaacagtcgttcaaaagaaactttttgtaaacattttaaagaaaattacacaggtgatcatttgccatttggatga

SEQ ID NO: 14614 - protein, 158 aa, Unknown
  Obtained from environmental sample
  misc_feature (1)..(158): Xaa is any amino acid
MLILTNYSKPHLTYQEQVDLLKKRNLIVTNEAYALEKLKHISYYRLSAYFLPFCISKNQFITGTRFEDIIELYHFDKELRILTFSVIEKIEIFLRTSIAYNFSKNHEVFAYNNKQNFCCKEKDFIWLNNDIQKENSRSKETFCKHFKENYTGDHLPFG

SEQ ID NO: 14615 - DNA, 411 bp, Unknown
  Obtained from environmental sample
  misc_feature (1)..(411): n is a, c, g, or t
ttgccaatttggatgatagtagaaatcatctcttttgggtcactatcaaaactttatacaatgctccgccctgaaacagaaagagagattttaaatggtataaagttaccatcatttgtatttaaaaattggcttcatgttttttcgtatgtacgaaatatatcagctcaccatagtcgactttggaatagacagtttgttataaaagcaaaaataccaaaacacaaaaaagagttcaaaggtctgatgaatgataaatactatacatttgcagttatgacacactatgttttaactgctattaatgatacttttgattttaaagatgagttgaaaagtttgtttgagaaatatcctaatattgataaaaaggctatgggttttgcggatgacagtaaaggttacttatga

SEQ ID NO: 14616 - protein, 136 aa, Unknown
  Obtained from environmental sample
  misc_feature (1)..(136): Xaa is any amino acid
MPIWMIVEIISFGSLSKLYTMLRPETEREILNGIKLPSFVFKNWLHVFSYVRNISAHHSRLWNRQFVIKAKIPKHKKEFKGLMNDKYYTFAVMTHYVLTAINDTFDFKDELKSLFEKYPNIDKKAMGFADDSKGYL

SEQ ID NO: 14617 - DNA, 624 bp, Unknown
  Obtained from environmental sample
  misc_feature (1)..(624): n is a, c, g, or t
ttggttcttaagattcaaaggatattcataaaaagtaaatcaaataagaagcagatattagcaacaattatagttgttttcagtataactttttttctatttttttatcaatcataccgacatgccaaactggcatttgaagagatagataatatatttgatacaaatataaatagtctttttgaagaagtagatactaaaatgctcaaaaaaaatttaattgagagatcagatatattactctctattctcgaaaaagataactttttagatttggttgaacaaaatagaagagctgaattaatttcactgttagaaccagagtataatctgctaaaagagcagcttcctgacttccatattttacatatacatgacataaacggaacatcaattttaagaatgcatgcaaaagagatgtatggagacaacttaaaagcattcagatcacatataaaagagatagttacatatcccaaaaagagcactttttatgaaagtggcaaacatggactttactatagatatatcactccgcctataaataaagatcgactagaaggtttttttaaaactgggaatacgccctactgtcaaaatcaaataaaaaaaaaaagtttttga

SEQ ID NO: 14618 - protein, 207 aa, Unknown
  Obtained from environmental sample
  misc_feature (1)..(207): Xaa is any amino acid
MVLKIQRIFIKSKSNKKQILATIIVVFSITFFLFFYQSYRHAKLAFEEIDNIFDTNINSLFEEVDTKMLKKNLIERSDILLSILEKDNFLDLVEQNRRAELISLLEPEYNLLKEQLPDFHILHIHDINGTSILRMHAKEMYGDNLKAFRSHIKEIVTYPKKSTFYESGKHGLYYRYITPPINKDRLEGFFKTGNTPYCQNQIKKKSF

SEQ ID NO: 14619 - DNA, 684 bp, Unknown
  Obtained from environmental sample
  misc_feature (1)..(684): n is a, c, g, or t
atgctctatatagagccaaagaaaatggaagagacagatatgaaatttcttaaaaaagcagttatcttgaaaaagatatttaaattacaaaatatagttattttcctaattacgttatctttggcttttattatatttttagaatttacatccgagagagagcagttcataaatgaaaaaatttatgatcttcaacttcagtatagcgataaaattttttcaaacaagagatattcagaagcactatttgatgaaattttagaaaatcatgaaattacctcaatcattgatagtgcaaatagcaatatagaaaaaaatttaaacagagataaactatacaatctactaaaagaaaaatatgagagaatgaaagctaaaggggtgctacagtttcattttcatttagccaatggagatagctttttaagatttcataaacttgaaaagtatgatgatagtctgctttctagagatagcataagagaggtcatagatactaaaaaaccagtttatggttttgaagtcggaaaatattttgaaggtttcagatacgtatatccgttatttaacaacttaggtagatacataggaagcgtagagtcgtcaatgagcgtaaaatctattatgaatcaaatgagtaactcattagatgcccaatatttcatgatctcgagccgattctga

SEQ ID NO: 14620 - protein, 227 aa, Unknown
  Obtained from environmental sample
  misc_feature (1)..(227): Xaa is any amino acid
MLYIEPKKMEETDMKFLKKAVILKKIFKLQNIVIFLITLSLAFIIFLEFTSEREQFINEKIYDLQLQYSDKIFSNKRYSEALFDEILENHEITSIIDSANSNIEKNLNRDKLYNLLKEKYERMKAKGVLQFHFHLANGDSFLRFHKLEKYDDSLLSRDSIREVIDTKKPVYGFEVGKYFEGFRYVYPLFNNLGRYIGSVESSMSVKSIMNQMSNSLDAQYFMISSRF

SEQ ID NO: 14621 - DNA, 384 bp, Unknown
  Obtained from environmental sample
  misc_feature (1)..(384): n is a, c, g, or t
ttgggaggatttcccggcaaaaagggttggagttatttctttcccgcttcatttgcaaaactccattatggatttggactcgtcaaccttctccaggtaaattttaaaagggctcccagatataaccaaaattttgatatttccagtttggttattggcccccttaaacctataaatgatacttacggtcatcatgtcgaagatttagtattgataaactttctgatgcagtcagctcaacaattagaagaagatgactttattgcaagatggggtgagaaggagtttattatagtancggtagattctcccctgaatgagctgattttattggtaaaaaactacaaaataaaatctctaaaatattatttgagcctgttataa

SEQ ID NO: 14622 - protein, 127 aa, Unknown
  Obtained from environmental sample
  misc_feature (1)..(127): Xaa is any amino acid
MGGFPGKKGWSYFFPASFAKLHYGFGLVNLLQVNFKRAPRYNQNFDISSLVIGPLKPINDTYGHHVEDLVLINFLMQSAQQLEEDDFIARWGEKEFIIVXVDSPLNELILLVKNYKIKSLKYYLSLL

SEQ ID NO: 14623 - DNA, 789 bp, Unknown
  Obtained from environmental sample
  misc_feature (1)..(789): n is a, c, g, or t
gtgcctcaaaaaaaaaataaaaatccacatcttatgaactttaattatattttacctttagtagcagtatcaacatcaattacaatgctatcttgcggaggtggagatggaaaaggaaaaacagaagttaatatcgatcctgtagttatcagccacgagttatcagatgctcagatgcttaacccaattaattattctgatgcaggtgccggctatattttatcgaatatattttactcattattagaaattgattttaacaccttagagttagttcctgtagttgctgaaagcagaccagaaattgaagagacagaagatgggggaatgcttattacctataaaattagacctgaggctaaatgggataatggcgaacaaatcactgctaaagatgttgaatttgcattaaaagtgataaaaaatcctaaagttgacaacctaaacaacaaaccttattttgaatttattgaagacatgaaattttatgaggatgaccctcttaaatttacatttatttgcaaagatgtttatattcttgcggaagttcaaagtggtgatattgatttaatgccaagacacatttatgaccctaagggtttaatggatgaattcactataaaacaacttgcagaaaatgcacctgaattagctacgaatcctaaaattgtagagtttgctaaagattttaactcagaaaaataccaaagagaccctcagttcattcaaggttgtggcccatatttgttaaaagagntggcaaactggacaaaaattagttattactaa

SEQ ID NO: 14624 - protein, 262 aa, Unknown
  Obtained from environmental sample
  misc_feature (1)..(262): Xaa is any amino acid
MPQKKNKNPHLMNFNYILPLVAVSTSITMLSCGGGDGKGKTEVNIDPVVISHELSDAQMLNPINYSDAGAGYILSNIFYSLLEIDFNTLELVPVVAESRPEIEETEDGGMLITYKIRPEAKWDNGEQITAKDVEFALKVIKNPKVDNLNNKPYFEFIEDMKFYEDDPLKFTFICKDVYILAEVQSGDIDLMPRHIYDPKGLMDEFTIKQLAENAPELATNPKIVEFAKDFNSEKYQRDPQFIQGCGPYLLKEXANWTKISYY

SEQ ID NO: 14625 - DNA, 588 bp, Unknown
  Obtained from environmental sample
  misc_feature (1)..(588): n is a, c, g, or t
ttgaaagttagtataataatcgcagtatataaagatatagaatcattagacttgatgattcgggcattgaaaaaacagacttataaaaactttgaagttatagtttcagaagataataactcaacccagatgaaagaatatgtagagtctatacaagacttggatgttaaacatacatttcaagaagattcaggtgttagaaaatcaaggtctcaaaacaatggcatattaaaagctagtggtgagtatcttatatttttagatggagatattattccatactctacttttgtacaagggcatgttgatttggctcaaaaagatagagtcttagctggaagaagagtaaacttgaacgcagagcttactaagaagtttagagagaaaaaattatcgtcatatacattagaaaagttttattttttacttggatttggcttgatgtttgacagaaatgcaaggtttgagcaaggagtacatatagatgcaaactcttttatatataaaaactttatggcaaaaagaaaacgaaatacaagtctcattggttgtaacttttcctgttataaagaagcaatggtagattaa

SEQ ID NO: 14626 - protein, 195 aa, Unknown
  Obtained from environmental sample
  DOMAIN (4)...(155): Glycosyl transferase
  misc_feature (1)..(195): Xaa is any amino acid
MKVSIIIAVYKDIESLDLMIRALKKQTYKNFEVIVSEDNNSTQMKEYVESIQDLDVKHTFQEDSGVRKSRSQNNGILKASGEYLIFLDGDIIPYSTFVQGHVDLAQKDRVLAGRRVNLNAELTKKFREKKLSSYTLEKFYFLLGFGLMFDRNARFEQGVHIDANSFIYKNFMAKRKRNTSLIGCNFSCYKEAMVD

SEQ ID NO: 14627 - DNA, 546 bp, Unknown
  Obtained from environmental sample
  misc_feature (1)..(546): n is a, c, g, or t
atgatggctcgggagcagactgaagagacgatcgatactgacggatggcttcatacgggtgatctcgcgcagatagatgaggaggggtacatcacgctgatctcgcgtaagaaagagctcttcaagacctccaacgggaaatatgtctctgccattgctatggagcaaaagatcaccgcgaacaaatggatcgattatgctgttgtcatcgcagacaacagaccttttgtctctgctttgatctttatggatgagacccttttgcaggcttttgcccaaagaaaaaaactcagtgaaataggtttcgaagagatcgttcaccatcgtcgtatacaggggatcgtcatgaacctcataaaaaaggttaaccaaaaacttaatcattgggagcagatacaaaagtattatattgtcagtgacaaggtgagtatcgaatccggtattttaacaccttcgatgaaggtgtcgcgtcaaaaagcagaagagctgtacaagagtgagatagaagatttttacagtacacatgaagctaaggagagatcatga

SEQ ID NO: 14628 - protein, 181 aa, Unknown
  Obtained from environmental sample
  misc_feature (1)..(181): Xaa is any amino acid
MMAREQTEETIDTDGWLHTGDLAQIDEEGYITLISRKKELFKTSNGKYVSAIAMEQKITANKWIDYAVVIADNRPFVSALIFMDETLLQAFAQRKKLSEIGFEEIVHHRRIQGIVMNLIKKVNQKLNHWEQIQKYYIVSDKVSIESGILTPSMKVSRQKAEELYKSEIEDFYSTHEAKERS

SEQ ID NO: 14629 - DNA, 342 bp, Unknown
  Obtained from environmental sample
  misc_feature (1)..(342): n is a, c, g, or t
ttgttcccaaacatttttacttccaggcggttcattccgtatattgctatccatgaattcgaagcgctccttttttcagatcccggaaaattggcatcgaagctacaaattggtgttaatgaaattgaacaggctctcgaagaatgtggtgaacctgaagcaatcaataatgactggaaaacggccccatcaaaacgtctggcccgttggtcgaaaaatgaaaaataccacaaaatcacgtcaggaattgtattggcggaagagattggaatcaacagaatgcggaaaaagtgtcctcaattccacgactggctctgccgcattgaaaaccttattccatga

SEQ ID NO: 14630 - protein, 113 aa, Unknown
  Obtained from environmental sample
  misc_feature (1)..(113): Xaa is any amino acid
MFPNIFTSRRFIPYIAIHEFEALLFSDPGKLASKLQIGVNEIEQALEECGEPEAINNDWKTAPSKRLARWSKNEKYHKITSGIVLAEEIGINRMRKKCPQFHDWLCRIENLIP

SEQ ID NO: 14631 - DNA, 942 bp, Unknown
  Obtained from environmental sample
  misc_feature (1)..(942): n is a, c, g, or t
atggataaattaggtttaatgggttggtcgaatggtgccatacttacaacctggatgactttgaaatatcctgacatgtttaaagttgccgctcccggagccggagatgtaaactggacctccgattatggaacctgtcgttttggagtaaccttcgaccaatattactttggtggagcaccgtgggatgacttgaatggaaagcaatacaaccaatggtatatcgacaactctcctatattcgagattgaaaaaataaaaaccccaaccattatttttcatggtagcgaagatcgctccgtacctcgtgatcagggttgggaatattttagaggattgcaacaagttggtcaaaccccggtgaaatttttatggtttccgggacaacctcacggtttgcaaaaaatttctcatcaaacgcgaaaaatgaccgaagaaattaaatggttcgataaatacttgtttaatacactaaataagaacaatgacgcatttaagaaaaacagtcctttggcatcagctataaaaattgcaaaagcttcgaaagttgatgggaaatttggcattttaaaaaactcagagaccctcattcccgaaatggtaagtttaggaaaagataccatcagcattagtcagtttgaattaacaaacgctcaatttaccgaatttgaaaacaatttcaaataccttgcaactaaagcaaattaccctgncattggtttaacgaatcaacaaataagtggatacatcacttggatcaataatttaactggcaacacttatcgtcttccaaataaaactgaagccataaaactacataaactggccaatgaaaaagcaaataagggaaacacccttaattactgggctggatacacaataaccagagatgatgcagataacctgacaaaaaagttgactgctgaaaagattctcttttga

SEQ ID NO: 14632 - protein, 313 aa, Unknown
  Obtained from environmental sample
  DOMAIN (1)...(157): Prolyl oligopeptidase family
  misc_feature (1)..(313): Xaa is any amino acid
MDKLGLMGWSNGAILTTWMTLKYPDMFKVAAPGAGDVNWTSDYGTCRFGVTFDQYYFGGAPWDDLNGKQYNQWYIDNSPIFEIEKIKTPTIIFHGSEDRSVPRDQGWEYFRGLQQVGQTPVKFLWFPGQPHGLQKISHQTRKMTEEIKWFDKYLFNTLNKNNDAFKKNSPLASAIKIAKASKVDGKFGILKNSETLIPEMVSLGKDTISISQFELTNAQFTEFENNFKYLATKANYPXIGLTNQQISGYITWINNLTGNTYRLPNKTEAIKLHKLANEKANKGNTLNYWAGYTITRDDADNLTKKLTAEKILF

SEQ ID NO: 14633 - DNA, 573 bp, Unknown
  Obtained from environmental sample
  misc_feature (1)..(573): n is a, c, g, or t
atgtggtcaatgtcttcaagtttgtccatatcattctatggagttatcagattttggaaaaggacatggtgttggaactctttttatagatgcaataaaagaggatgttatgcctgtgaggcagtaccttgtgtattggcctgtcctagtggtgctttggaccatgatacagaaaaagcaactgatattaaaatgggaatagcagttttagaacataaaagaacttgtttagctgttagaaatgaacctgtacccgcaggttatgataataagatgaaagagttcataaaaaatcaaacaaatataacagaatatgaaaagaaagtattagaaaaatttgatggttatgaagggaaaccttgtacattgtgtgcagatatgtgtcctatgccaaaccctcttacagcaattgcaatggttagaaataaagcagggataaacaagccagagatttatgatggttgtacaggatgtggtgtatgtcaagaagtttgtcctactgcacaaccatctattatcattaaaccacgattatcttatgaagattattatattaaagggatgagaatatga

SEQ ID NO: 14634 - protein, 190 aa, Unknown
  Obtained from environmental sample
  DOMAIN (148)...(171): 4Fe-4S binding domain
  misc_feature (1)..(190): Xaa is any amino acid
MWSMSSSLSISFYGVIRFWKRTWCWNSFYRCNKRGCYACEAVPCVLACPSGALDHDTEKATDIKMGIAVLEHKRTCLAVRNEPVPAGYDNKMKEFIKNQTNITEYEKKVLEKFDGYEGKPCTLCADMCPMPNPLTAIAMVRNKAGINKPEIYDGCTGCGVCQEVCPTAQPSIIIKPRLSYEDYYIKGMRI

SEQ ID NO: 14635 - DNA, 1137 bp, Unknown
  Obtained from environmental sample
  misc_feature (1)..(1137): n is a, c, g, or t
gtgatcggaaaagacttcgatcttctgtggtgtgaagaagaagatatgaatgtccaatgccaggctatactgggtgaactcaaacaaaacggttcctggcagggagaggtctataaacgccataagaacggccatacctttcctgcccacctcagtgtcatagagggcgaaaaatccaaagacagcaaacattacatctctatcttttatgacataacctatcgaaaacagagtgaaaagaagctctttcagttagcccattttgacaccttgaccggtctgtccaaccgccatgcctttatgcatcggctcaaagaaagtatagactccgcctcacgttacaaacagaagatggctgttttgtttatggacctcgacggcttcaaagccatcaatgaccaatacggacataatacgggagatgaagtcctcatcacaactgcggcacgtctgaagaaaaatataagacagtcagatatcgtcgcacgtatgggaggggatgagtttactgtcatcgttgaaaatgtcaaagacacccgatccttaagtctacttgcacaaaagatgatagacgccgtatcccaagagataaagatgcaagactccgtgctgcgcgttacgacaagcatagggatcagtatctatccggatgacgcactggatcttgaaagcgtgctcagacatgccgataatgctatgtacaaagccaaagagctggggaagaacaacctgcagttcttcaccaaagagctcaatatcgattctgtcaaacagatgatctttgagatggaactgcgccatgccctggagaaaaacgagtttcacatcaactatcagccctactacaaacatacgacaaatcagcttacgggttttgaagcttttatcctttgggaaaaatgcacctacgggagaggtcccgctgataagttccttcccatcgccggcccaaaaggagctgaaatatcccaaaccttccctggaaccttggaaaagcccttgtctcccaaatcaaaaattggcaccaaagaattggaacagctccttcaacctttccctggaacctgcccaaaaaaatatcttgggatcccgccgaacttaaccggaaaaattcaaaaaatttcgggccgcccatga

SEQ ID NO: 14636 - protein, 378 aa, Unknown
  Obtained from environmental sample
  DOMAIN (82)...(243): GGDEF domain
  misc_feature (1)..(378): Xaa is any amino acid
MIGKDFDLLWCEEEDMNVQCQAILGELKQNGSWQGEVYKRHKNGHTFPAHLSVIEGEKSKDSKHYISIFYDITYRKQSEKKLFQLAHFDTLTGLSNRHAFMHRLKESIDSASRYKQKMAVLFMDLDGFKAINDQYGHNTGDEVLITTAARLKKNIRQSDIVARMGGDEFTVIVENVKDTRSLSLLAQKMIDAVSQEIKMQDSVLRVTTSIGISIYPDDALDLESVLRHADNAMYKAKELGKNNLQFFTKELNIDSVKQMIFEMELRHALEKNEFHINYQPYYKHTTNQLTGFEAFILWEKCTYGRGPADKFLPIAGPKGAEISQTFPGTLEKPLSPKSKIGTKELEQLLQPFPGTCPKKYLGIPPNLTGKIQKISGRP

SEQ ID NO: 14637 - DNA, 912 bp, Unknown
  Obtained from environmental sample
  misc_feature (1)..(912): n is a, c, g, or t
ttggtcagattcggctcgagtgtaggtgatagtttagaattagctaaaaaatctatggaggcacctacggaaaacattatcttttgtggcgtaggatttatggggcaaagtgtgaaagtattagcacctcaaaaaagagtacttatgcctaaaatcgcatgctgtgctatggcgaagatgattgatgtagattattacaatatgaatttaaaaatattaaatgatgcaggaatagcaaatgatgatattttaccaataacatatattaactctagtgctgaagtaaaagctgaagttggaaaaatgggtggatatgtttgtacaagttcaaatgcctataaaattatcaacaaaggattagaaagtggcaaaaaaatattctttgttccagatagatgtttagggcaaaactttgcaaaacagattggattaaaatcagcagttgtaggaattgatgatattgaagatgtaaaaaatgcggatatcatttgttttaatggtttttgctcagttcatcaactttttacccctgaagatgtagatttttatagagaaaaatatccagatattttagtagctgttcatccagaatgtgatccatcagttgttgaaaaagctgactttgtggggagtacttctcaacttataaaatatataactgaagagattcctgttgatcaaaaagttgtggtaggaactgagtttaatatggttaatcgtttaagagaaaaaaatactttcgtattaagttctacaaaaccagagtgtccaactatgaatgaaacaactttggaagatttacataatacattactctcaataaaaaataaaacttatgaaaatgagataacaatcagtgaagatgtagctaaatatgcaaaaataccattaaatagaatggttgaggtttaa

SEQ ID NO: 14638 - protein, 303 aa, Unknown
  Obtained from environmental sample
  DOMAIN (1)...(303): Quinolinate synthetase A protein
  misc_feature (1)..(303): Xaa is any amino acid
MVRFGSSVGDSLELAKKSMEAPTENIIFCGVGFMGQSVKVLAPQKRVLMPKIACCAMAKMIDVDYYNMNLKILNDAGIANDDILPITYINSSAEVKAEVGKMGGYVCTSSNAYKIINKGLESGKKIFFVPDRCLGQNFAKQIGLKSAVVGIDDIEDVKNADIICFNGFCSVHQLFTPEDVDFYREKYPDILVAVHPECDPSVVEKADFVGSTSQLIKYITEEIPVDQKVVVGTEFNMVNRLREKNTFVLSSTKPECPTMNETTLEDLHNTLLSIKNKTYENEITISEDVAKYAKIPLNRMVEV

SEQ ID NO: 14639 - DNA, 549 bp, Unknown
  Obtained from environmental sample
  misc_feature (1)..(549): n is a, c, g, or t
atgggtttgaaaaataaaatatcaccaaataatttatattaccttacaacaacagttattggttgggttgatgtctttacacgaactatctacagagatattgtgattgatagtttgaagtattgtcaaaaagaaaaaggactaactttgtatgcttggagcttaatgtcaaatcatttacattggatagcatcagcagaagaaggatttaatttgtctgatattattcgagatttcaaaaaatatacgagtaagaaaatcataaatgaaatactaacaaatccaaaagaaagcagaaaagaatggatgttggcaatttttaaagaagcattaaacgataatcctaaaaataaatattataagttttggcaagatggaaatgaagcaaaagaactaattactaacaattttattgatcaaaaagtgaattacatacataataatcctgtaaaagcagaaatagttaaacatccagaagattatatttacagttcagcttcaaattatgctgacgaaggtggtttattggatgttgtcgttataaaatga

SEQ ID NO: 14640 - protein, 182 aa, Unknown
  Obtained from environmental sample
  misc_feature (1)..(182): Xaa is any amino acid
MGLKNKISPNNLYYLTTTVIGWVDVFTRTIYRDIVIDSLKYCQKEKGLTLYAWSLMSNHLHWIASAEEGFNLSDIIRDFKKYTSKKIINEILTNPKESRKEWMLAIFKEALNDNPKNKYYKFWQDGNEAKELITNNFIDQKVNYIHNNPVKAEIVKHPEDYIYSSASNYADEGGLLDVVVIK

SEQ ID NO: 14641 - DNA, 546 bp, Unknown
  Obtained from environmental sample
  misc_feature (1)..(546): n is a, c, g, or t
atgcggcaaggctttgatgaacatggccatcgtgacatggaaattatttcatatgttattgaaggtacattgaagcacgaagatagcacgggcaatagttataaagttcccgcgggtgaaatacagcgtatgagcgccggacgtggagtaatgcattcagagtttaatgcttcaaagcaagataaagttaagtttttacaaatatggatccagcctaatatcaccggcattaaaccgagttaccagcaaaaaagtattcgccaaaaaggtaagttaacgacattagttgacccacaaggtaaaaacaatgctttatcaattaaccaagatgctcgcttatcacgtttaatattgaaaagtggcgaggattttacttttaataccgaacaacgcattggttatttacatattattaaaggtcgattaaaaacagacagtgaacaattttctgctggtgatggctttgctgttgagccagaacaaaagctcaaggtaatagctgactctgcaattgaagcactatggtttgacttaccagatgtttga

SEQ ID NO: 14642 - protein, 181 aa, Unknown
  Obtained from environmental sample
  DOMAIN (2)...(70): Pirin
  misc_feature (1)..(181): Xaa is any amino acid
MRQGFDEHGHRDMEIISYVIEGTLKHEDSTGNSYKVPAGEIQRMSAGRGVMHSEFNASKQDKVKFLQIWIQPNITGIKPSYQQKSIRQKGKLTTLVDPQGKNNALSINQDARLSRLILKSGEDFTFNTEQRIGYLHIIKGRLKTDSEQFSAGDGFAVEPEQKLKVIADSAIEALWFDLPDV

SEQ ID NO: 14643 - DNA, 837 bp, Unknown
  Obtained from environmental sample
  misc_feature (1)..(837): n is a, c, g, or t
gtgagaaattcattgagcaaaataaaatctcatagacaagacctaacatttgaacaattaaaaatatactatgaagaaaaaggtttaaaactaaatgataagtttgcatcaaacctagaactactaacagaagatggtgactataattatgtagcatatcttatggcagataccaatggtacatcgataaaagtagcaaaatatagtggacgcaataaaatcgatttaattgaaaacaatgagtatggatactgttcacttataaaatccacaaataaagtactagaaaaactagaagtagaaaataaaacagcagctctcatcacatctactacaagaaaagaacagccactttggaataaagtagcgttaagagaagctgttataaatgcaattgtacacaatgactatactactcaaaacccacctgtttttgagatatttgatgataggatagagataacatcagcaggaggtttatccactattaaaaaagaggatgaattttttgatggatactctaaaccaaataatagagagattatgcgaatatataaagatcttgaactagtagaacacttaggttcaggactcaatcgtattttatctgtttatggaaaagcaagctttactataaaacaaaactatatgagaaatatcttttttaaaaatcagaatcctatagctgtcggagtaaatgtcggagtaaatgagatacttgaatacattaagttacatcaaccaattaaagctaatcaaatagcagaaaatttttcaaagtgtacncaaaagaancatagaaaggatggtttcaaggaccttaaaaacccaggataa

SEQ ID NO: 14644 - protein, 278 aa, Unknown
  Obtained from environmental sample
  misc_feature (1)..(278): Xaa is any amino acid
MRNSLSKIKSHRQDLTFEQLKIYYEEKGLKLNDKFASNLELLTEDGDYNYVAYLMADTNGTSIKVAKYSGRNKIDLIENNEYGYCSLIKSTNKVLEKLEVENKTAALITSTTRKEQPLWNKVALREAVINAIVHNDYTTQNPPVFEIFDDRIEITSAGGLSTIKKEDEFFDGYSKPNNREIMRIYKDLELVEHLGSGLNRILSVYGKASFTIKQNYMRNIFFKNQNPIAVGVNVGVNEILEYIKLHQPIKANQIAENFSKCTQKXHRKDGFKDLKNPG

SEQ ID NO: 14645 - DNA, 900 bp, Unknown
  Obtained from environmental sample
  misc_feature (1)..(900): n is a, c, g, or t
ttggaaattgattcgctttcgggacgaatttttttaaaaaagtggcccttaaaaggaaaaaaattggaggttgttgtttattgggggctgggcctttccactttaaagttcctggaaataatagggcttttgttacttgaccagggtaaaaccgaagttttattccaaaaagtttcttttgcccggagcagccaaaatcattttttcagcaatggtcagaaaaatataatcggggttcccgatgccgtaatttttgaaggtcctttagcaggaggtcacctaggctttaaaatgcatgaagtgaatgaacctaaaatttctttgtcatccattatcgaagagattattccaatcataaaattttatgaacttaaatttgacaaggaaattcctgtaattgcaggaggtggtgtttatactggtcaggatgtttatgatattatgaaagttggagccaaaggagtaaagatgggaacccgatttgttacaacttatgaatgtgatgtgtctgataattttaagcaggtttatctttcaagtacatcaaatgatatcacaactattaatagtcctgttggtttgcccggacgtgttattagtaatgactttgttaaacaaattcaggcaggaaaacaaaagccggttaattgtccttggaagtgtttgaagacttgtgattataaaaaagttcaattctgcatagcagatgctttatttaatgcggcaaaaggaaattttagtgggggctttgcttttgcaggaaccaatgcttatcgtgcagaaaaaataattacagtaaaagaaaccattgatcagattaaagaagaattttttcaagaagagcatcatacggaggctgacaaattatttagatgttgtggctacctttacggaaggtga

SEQ ID NO: 14646 - protein, 299 aa, Unknown
  Obtained from environmental sample
  DOMAIN (15)...(276): 2-nitropropane dioxygenase
  misc_feature (1)..(299): Xaa is any amino acid
MEIDSLSGRIFLKKWPLKGKKLEVVVYWGLGLSTLKFLEIIGLLLLDQGKTEVLFQKVSFARSSQNHFFSNGQKNIIGVPDAVIFEGPLAGGHLGFKMHEVNEPKISLSSIIEEIIPIIKFYELKFDKEIPVIAGGGVYTGQDVYDIMKVGAKGVKMGTRFVTTYECDVSDNFKQVYLSSTSNDITTINSPVGLPGRVISNDFVKQIQAGKQKPVNCPWKCLKTCDYKKVQFCIADALFNAAKGNFSGGFAFAGTNAYRAEKIITVKETIDQIKEEFFQEEHHTEADKLFRCCGYLYGR

SEQ ID NO: 14647 - DNA, 456 bp, Unknown
  Obtained from environmental sample
  misc_feature (1)..(456): n is a, c, g, or t
ttgaaaataggatttataggggatattgtaggaagaccaggtagaaaaataattaaacataatttagaaaatttaagatctcaatataacattgatgttgttattgctaatggagaaaatgcaagccatggatttggattaacagttaaaaatgccaatgagttgtttaattgtggaattgatgttattacaggaggaaatcactcttgggataaaaagaaagatattcttgctttgttggaaactaagccagttttacgaccagataattatccaaaagatgttccaggcactggagtattaaaactagatataaatggtaaaatattagctataataaatttgatgggattgtatactatgccacaggttcttaatccctttacccatattttagagatagtagaaagtttagaacaagagggtattaagcatatttttatgactcagccataa

SEQ ID NO: 14648 - protein, 151 aa, Unknown
  Obtained from environmental sample
  misc_feature (1)..(151): Xaa is any amino acid
MKIGFIGDIVGRPGRKIIKHNLENLRSQYNIDVVIANGENASHGFGLTVKNANELFNCGIDVITGGNHSWDKKKDILALLETKPVLRPDNYPKDVPGTGVLKLDINGKILAIINLMGLYTMPQVLNPFTHILEIVESLEQEGIKHIFMTQP

SEQ ID NO: 14649 - DNA, 390 bp, Unknown
  Obtained from environmental sample
  misc_feature (1)..(390): n is a, c, g, or t
gtggagaaatttgatatttatacagataaaaataaatttttttttaattcaaaagtacaaaaacaaagaattgancaagtttggatagtgataattaaaaatgccttagatcaactcatctatattgatgattttgataatagaaaattatcaattgatattaacaatatagagaaccatgtagttgtacagtttaaagataatggtggtggaattaagaaagatattttagaaaatatattcgaaccttttgtaagttttaaagaacatggtggaattggggttggtttaaacattgcaaaaaaaattatagaagatcaagatggagagatttcagcatacaatgaagataatggtgctgtttttgaggtaaaattaaaactatattaa

SEQ ID NO: 14650 - protein, 129 aa, Unknown
  Obtained from environmental sample
  DOMAIN (19)...(129): Histidine kinase-, DNA gyrase B-, and HSP90-like ATPase
  misc_feature (1)..(129): Xaa is any amino acid
MEKFDIYTDKNKFFFNSKVQKQRIXQVWIVIIKNALDQLIYIDDFDNRKLSIDINNIENHVVVQFKDNGGGIKKDILENIFEPFVSFKEHGGIGVGLNIAKKIIEDQDGEISAYNEDNGAVFEVKLKLY

SEQ ID NO: 14651 - DNA, 693 bp, Unknown
  Obtained from environmental sample
  misc_feature (1)..(693): n is a, c, g, or t
atgctcggcggcgctcaaacaggaacaggaaagactgcggccttcgcccttcctgttcttcataacctgagtgagaaaaaccgaaaattagggactttacgaacccttgttatcacccctacccgagaactcgctgatcaggtttgcgatagttttatagcatatgggaaattcctaaacctcaaatcgataaaaatcttcggcggtgtaaaaatgaatccgcagatatcaaatctcaaggcaggtacagatattgtagtagcaacccccggccgcctgcttgatcatatagaacagaaaacaattgatctgtcaaatattgagatactcattctcgatgaagccgacagaatgcttgatatgggatttatcaaagatattaaaaagattgttaatgctctgccttctacccgtcaaaatctattattctcagcgacctacaccaaggatatcaaggagctctcttcagatcttctgaaagatcctatttttattgaggtatcaaaacgaaacactgctgcggagaaggtagatcagctgatctaccgcattgaaaagggccagaaaagacatctacttgctcatctcataaaagaagaatcatggtatcaggtgcttatatttgtcaggacccgccatggtgctaacagattagcgcgacaactagataaggatgggaattcctggctttaa

SEQ ID NO: 14652 - protein, 230 aa, Unknown
  Obtained from environmental sample
  DOMAIN (1)...(154): DEAD/DEAH box helicase
  misc_feature (1)..(230): Xaa is any amino acid
MLGGAQTGTGKTAAFALPVLHNLSEKNRKLGTLRTLVITPTRELADQVCDSFIAYGKFLNLKSIKIFGGVKMNPQISNLKAGTDIVVATPGRLLDHIEQKTIDLSNIEILILDEADRMLDMGFIKDIKKIVNALPSTRQNLLFSATYTKDIKELSSDLLKDPIFIEVSKRNTAAEKVDQLIYRIEKGQKRHLLAHLIKEESWYQVLIFVRTRHGANRLARQLDKDGNSWL

SEQ ID NO: 14653 - DNA, 894 bp, Unknown
  Obtained from environmental sample
  misc_feature (1)..(894): n is a, c, g, or t
atggctcagggttatgaccacttggcattagtctataagaaattaggtaattgggaaaaagcggctgagtttttgtttaagattaaagcaatttatgaaaatgattataaagataatctccataagaaaattacagagtatgatacacttcttgcaaccgagaaaaaggaatttgaaacgaaacagattctggaaagaaatgctcgacttgcttcaattggggtaatggctgccgggataactcacgagataaaccaacctcttaatgcgattaaactatgtgccgatggagttctattctggttaggaaaaaatccggagagtgtgccagattcggttaaggagcaacttgaacatatttcaaccggagcagaccgaattaataatataattcgtcatatgcgctctttctggagaacaccggaaagcagagcacaaagcagttgccagctgaatgatgccgtgaactcggcctttaacctcatacgacagcaaatattctcccatggggttcacctgcaaatgaaacttgcaactgatttaaaatctgtgaaagcagaacaggttcaccttgagcaaattattataaacctggttgttaactcgattcatgcgatggattcttctcatagcaagaaaaaaaatattgaaattaaaacatggctagatcagacttcaaacctggtgattctggaaattacagatagcggtcctggtctcccagataaagatctgcaaaatatctacagtccattctacagccggaaatccccggaaaaaggcatggggcttggcttagcaataattaagcaatatgtagatgatatgaaaggcacgatccgccatgaaaacaccgagacaggcttgcgcgttagggtggagttgccggtataa

SEQ ID NO: 14654 - protein, 297 aa, Unknown
  Obtained from environmental sample
  DOMAIN (72)...(143): His Kinase A (phosphoacceptor) domain
  misc_feature (1)..(297): Xaa is any amino acid
MAQGYDHLALVYKKLGNWEKAAEFLFKIKAIYENDYKDNLHKKITEYDTLLATEKKEFETKQILERNARLASIGVMAAGITHEINQPLNAIKLCADGVLFWLGKNPESVPDSVKEQLEHISTGADRINNIIRHMRSFWRTPESRAQSSCQLNDAVNSAFNLIRQQIFSHGVHLQMKLATDLKSVKAEQVHLEQIIINLVVNSIHAMDSSHSKKKNIEIKTWLDQTSNLVILEITDSGPGLPDKDLQNIYSPFYSRKSPEKGMGLGLAIIKQYVDDMKGTIRHENTETGLRVRVELPV

SEQ ID NO: 14655 - DNA, 324 bp, Unknown
  Obtained from environmental sample
  misc_feature (1)..(324): n is a, c, g, or t
atggctcaggctgttgcaattagcattgcgttcttcagcgtacttttgtcgcttttactttttaattgcgagaatttttgcccaataaatacacctatacctgcagaaacaagaatagcgatgaaaagaatgatggtgtcgttcatagttgaaaatggaaatttatcaaagataatttataaaacggaaactaaagttgaaaatgaaatcgaaatacggaaatattcaatttattttgtcactctaaagcttcctgtcttttcatcaaaaacaattaaatccttagggaaaagagtttcaaatataccttcagaaattaattga

SEQ ID NO: 14656 - protein, 107 aa, Unknown
  Obtained from environmental sample
  SIGNAL (1)...(22)
  misc_feature (1)..(107): Xaa is any amino acid
MAQAVAISIAFFSVLLSLLLFNCENFCPINTPIPAETRIAMKRMMVSFIVENGNLSKIIYKTETKVENEIEIRKYSIYFVTLKLPVFSSKTIKSLGKRVSNIPSEIN

SEQ ID NO: 14657 - DNA, 714 bp, Unknown
  Obtained from environmental sample
  misc_feature (1)..(714): n is a, c, g, or t
ttgcttcaaatattaattttgaattgcaaaaaggtcagctatcgggttttagttggagccaatggtatggggaaatctacattattacgcacgctcattcaggtgcaaccagaattatcaggatccatttcactcaatggcaagattcttaaaacaacatcgactttagagctcgcaaaacaactaagtattgtattaaccgaacctttaatctcaaaaaacctatccgtgtttgagcttgtggctttgggcagacatccttacactaactggattggaaatctaaccgaagcagatattaccattataaataagtccttagatctaattaaaatagccgatttaaaggataaaaaatgttacgaattaagtgatggacagcttcaaaaagtaatgattgctcgtgccttagcgcaagataccgatgttattgttttagatgagcctacctctcatctcgatatgtatcataaagcgtatatcttaaaactgctgcagagattaacgaaagacactggtaaaaccatattgttttcttcacatgaaattgatttagcaattcaattatgcgacaccatgattgtaatgcaaaaggaaaaggtcgtctgtaatcagccctgtcaattaatttctgaaggtatatttgaaactcttttccctaaggatttaattgtttttgatgaaaagacaggaagctttagagtgacaaaataa

SEQ ID NO: 14658 - protein, 237 aa, Unknown
  Obtained from environmental sample
  DOMAIN (16)...(199): ABC transporter
  misc_feature (1)..(237): Xaa is any amino acid
MLQILILNCKKVSYRVLVGANGMGKSTLLRTLIQVQPELSGSISLNGKILKTTSTLELAKQLSIVLTEPLISKNLSVFELVALGRHPYTNWIGNLTEADITIINKSLDLIKIADLKDKKCYELSDGQLQKVMIARALAQDTDVIVLDEPTSHLDMYHKAYILKLLQRLTKDTGKTILFSSHEIDLAIQLCDTMIVMQKEKVVCNQPCQLISEGIFETLFPKDLIVFDEKTGSFRVTK

SEQ ID NO: 14659 - DNA, 651 bp, Unknown
  Obtained from environmental sample
  misc_feature (1)..(651): n is a, c, g, or t
ttgaagtatataaaatttaatggcaataaaatttctaaattatctttaggaactgtgcaatttggtattgactatggtatagcaaataataatggtaaacctactcaaaacattgtaaatgaaatattgaattacgtctattctaaaggtattaattgttttgataccgcacagggctatggaaatagtgaagaagttatcggaaaatatttaaaaacaatagaatatgataatattaatgtagtttcaaaagtagattcaaaagagttaatgctaaaagaaattaattttatggattcaataaaaaactcaataagtaaactagaagtggatttcttatttgctttgttaatgcataatagtaatcttatgaatcagtggagtgatgaattttcaaagaaagtaaggctactaaaagaaaaaaaaatgataaagtatttcggagtatcaatatatacaaataatgaatttgatttggcacttaataatgaagatattgatattatccaagtgccatttaatgtatttgatcaaagagcattacacaatagatggtttaaaaaagcaaaagataaaaataaattaatttttattagaagtatatatcttcagggattgttacttatggatacaaataaaataccagaatag

SEQ ID NO: 14660 - protein, 216 aa, Unknown
  Obtained from environmental sample
  misc_feature (1)..(216): Xaa is any amino acid
MKYIKFNGNKISKLSLGTVQFGIDYGIANNNGKPTQNIVNEILNYVYSKGINCFDTAQGYGNSEEVIGKYLKTIEYDNINVVSKVDSKELMLKEINFMDSIKNSISKLEVDFLFALLMHNSNLMNQWSDEFSKKVRLLKEKKMIKYFGVSIYTNNEFDLALNNEDIDIIQVPFNVFDQRALHNRWFKKAKDKNKLIFIRSIYLQGLLLMDTNKIPE

SEQ ID NO: 14661 - DNA, 519 bp, Unknown
  Obtained from environmental sample
  misc_feature (1)..(519): n is a, c, g, or t
atgtgcgcgatatttggtattttagggaaatatgattcaaacagtgcaaaatatgcactatctaaaatggctcatcgtggacctgattactgtggaatcatagagagtgagaatctctttttttcacatctgcgcctctctattttagatcattcacacactgcacatcaacctctgaaaaatggtacggcaattctctcatttaatggtgagatatataactttaaagagttaaaagaggagctctcttatgagtcactaagcagtggagacagtgaagttatattagcagcatataaaaagtggggagttaattttgtaaaacatcttcgaggcatgtttgctatagccatagtagataacaacaccctatatctgtttcgggatcgtgcagggaaaaagcctcttttttactatagagatcaagaaaaatttatattctcatctgagataaaagcgataaaaccttttttaaaaaatngtgaagatgaatgnaagatgcacttcttagttatttaa

SEQ ID NO: 14662 - protein, 172 aa, Unknown
  Obtained from environmental sample
  DOMAIN (2)...(101): Glutamine amidotransferases class-II
  misc_feature (1)..(172): Xaa is any amino acid
MCAIFGILGKYDSNSAKYALSKMAHRGPDYCGIIESENLFFSHLRLSILDHSHTAHQPLKNGTAILSFNGEIYNFKELKEELSYESLSSGDSEVILAAYKKWGVNFVKHLRGMFAIAIVDNNTLYLFRDRAGKKPLFYYRDQEKFIFSSEIKAIKPFLKNXEDEXKMHFLVI

SEQ ID NO: 14663 - DNA, 390 bp, Unknown
  Obtained from environmental sample
  misc_feature (1)..(390): n is a, c, g, or t
ttgcaagatggtacaactttcccaaaaaactatatcggattggatattcaccacaaaatggtagagattgcaaaaaaagagacacgttgcgatatttttcagtgtgatatcttaaaagatccacttccaattgctgattactatctctgtagtggtggtatgaatattttaacaaggtntgagacatacacatttattcaacgtgcttatgaacactcaaacagaggttttatatttaatcttttaagaggggaagatgagtctgaaacatataactattttctacctaaagatataaaaaaattggctgatcagctaaatgcagagtatgaaatagtagagggctatatgcccttagacttcagtgttgcattttacaaaaaaggctaa

SEQ ID NO: 14664 - protein, 129 aa, Unknown
  Obtained from environmental sample
  misc_feature (1)..(129): Xaa is any amino acid
MQDGTTFPKNYIGLDIHHKMVEIAKKETRCDIFQCDILKDPLPIADYYLCSGGMNILTRXETYTFIQRAYEHSNRGFIFNLLRGEDESETYNYFLPKDIKKLADQLNAEYEIVEGYMPLDFSVAFYKKG

SEQ ID NO: 14665 - DNA, 564 bp, Unknown
  Obtained from environmental sample
  misc_feature (1)..(564): n is a, c, g, or t
atgcatgagcttaaacacccgatagcgaaggggactatagctactcagatgctaaaaacagataaacaaagagacaggtttagttctatttttggacgacttgagttacttgttgaagagtttgctttaatcgaagaagtaacaagcataaatgataagagtgattttaaagagtatagacttgtcgatatcatagatggagctattgatatggctatggttgaaaggagcagtgtaactatcaacgtaaatgcaagcaataaattaacagcgaattatagactttatacaactgcgattaaaaatatgattgacaatggtataaaatactctccagatgctcatatgaagattttaatcaaaaatgacgagttgtgtttcgagagcaagggagattgtattgcacaacctcttcaatactatatagaaccttttacaaaagaaaacccgtcaaaaaacagttttggtttaggtttatacctggttgattctatactaaaagttcatggacaagttttagcacatgagtatgacaatggagtgaatcgttttatctttgcataa

SEQ ID NO: 14666 - protein, 187 aa, Unknown
  Obtained from environmental sample
  misc_feature (1)..(187): Xaa is any amino acid
MHELKHPIAKGTIATQMLKTDKQRDRFSSIFGRLELLVEEFALIEEVTSINDKSDFKEYRLVDIIDGAIDMAMVERSSVTINVNASNKLTANYRLYTTAIKNMIDNGIKYSPDAHMKILIKNDELCFESKGDCIAQPLQYYIEPFTKENPSKNSFGLGLYLVDSILKVHGQVLAHEYDNGVNRFIFA

SEQ ID NO: 14667 - DNA, 669 bp, Unknown
  Obtained from environmental sample
  misc_feature (1)..(669): n is a, c, g, or t
ttgcatatgaaaaaaatattaatgatagaagatgacttagaacttgcagagatactaactgagtatcttgagcagtttgagtttgaggttattacagaagatgacccttttaaagcagtaagtatattaaaattagaaccatttgatttagtgattttagatttgactcttccgggtatggatgggttggaagtatgtgaagctattcgtgaaagacaagatattcctataattatatcttcagcaagaagtgatgtaacagacaaagtaaaagcacttgaacttggtgcggatgattatcttcctaaaccatatgacccaagagagttagaagcaagaatccactcagtccttagaagatatgaagcgaaatcagaagcaaaagaagagtctaaaagtgactttaaatgtgataactcttctatgatgattacatatagaagtagaaacatagacctaacaaatgcagaatttggaatacttgcatatatgattgcaaaacaggggcttgtagtatctagagaagatttgattcataatgttaatgcaatcaatgaagattcatctaacaagagtatagatgttatggtgggtagaatcagaaataaacttggcgataaaactcttatagagtcggttcgcggtgttggatataagttacttaagtaa

SEQ ID NO: 14668 - protein, 222 aa, Unknown
  Obtained from environmental sample
  DOMAIN (148)...(220): Transcriptional regulatory protein, C terminal
  misc_feature (1)..(222): Xaa is any amino acid
MHMKKILMIEDDLELAEILTEYLEQFEFEVITEDDPFKAVSILKLEPFDLVILDLTLPGMDGLEVCEAIRERQDIPIIISSARSDVTDKVKALELGADDYLPKPYDPRELEARIHSVLRRYEAKSEAKEESKSDFKCDNSSMMITYRSRNIDLTNAEFGILAYMIAKQGLVVSREDLIHNVNAINEDSSNKSIDVMVGRIRNKLGDKTLIESVRGVGYKLLK

SEQ ID NO: 14669 - DNA, 789 bp, Unknown
  Obtained from environmental sample
  misc_feature (1)..(789): n is a, c, g, or t
atgaaaagagacagattagtcataacaatatctgatgtagataagtcgcgctcatataatgttaataaaattataaagaaaattattttatggataattttggtaacattagggatagtaagtttaagtttttttacaatatcacaattagcaacaagtgtaaatgacctttcaaaagagagagatgcattgacaaaagagaatagtttgtatagtgatcaaattgaagcaaaagtgacacaaatacaagagttaggtgatgaactacaaaaaatagaagatattattggtataaatgttgatgatacaacagacttaatacaaagagcaaccttggcaaagttaacttctgctgaaaaaagttatatgttacaaacaataccaaataaatgtccattagaagtgtgtacaacaacttcaaagtttggatggagaacaaatcctgttacaaatgaaaaacaataccataaaggtatagatttaagagctgccagaagaactcctgtacatgtaacagcagatggggttataagatatgtagaagataaaaataaaggtacttttggtagagttattatcgtatctcataactttggatttgaaactgtatatggacacttacgatttngtgatgtgaaagtgggagatgttgtaaaaaaagggcaagtgatnaggcgaagtgaaaatagtggaagaagtaatggaccacatttacactatgaaagttatcatggcaataaagttttaaaatccaaaacttttatagatggggatatgaaaaactattga

SEQ ID NO: 14670 - protein, 262 aa, Unknown
  Obtained from environmental sample
  DOMAIN (154)...(251): Peptidase family M23
  misc_feature (1)..(262): Xaa is any amino acid
MKRDRLVITISDVDKSRSYNVNKIIKKIILWIILVTLGIVSLSFFTISQLATSVNDLSKERDALTKENSLYSDQIEAKVTQIQELGDELQKIEDIIGINVDDTTDLIQRATLAKLTSAEKSYMLQTIPNKCPLEVCTTTSKFGWRTNPVTNEKQYHKGIDLRAARRTPVHVTADGVIRYVEDKNKGTFGRVIIVSHNFGFETVYGHLRFXDVKVGDVVKKGQVXRRSENSGRSNGPHLHYESYHGNKVLKSKTFIDGDMKNY

SEQ ID NO: 14671 - DNA, 561 bp, Unknown
  Obtained from environmental sample
  misc_feature (1)..(561): n is a, c, g, or t
ttggataaagcacttccattgtatgaaaaatcattaaaaataacagaagatattttagggttaaatcatccagttactgcaggcagttataataatttagcggctttgtatcaatataaaaaagagtttaataaagctcttcctctatatgaaaaatctttaaagatacgtgaagaagtgttaggtctcatccatccagatactgccactagttataataatttagcggctctctattacgatgaaataattcttgataaagcactgcatttgtacaaaaaatctttaaaaatcaaagaagaagttttaggttttaatcatccatcaacagcaactacttatggaaatataggatttctgtataaagatataaaaaattgtactcaatctaattattactttacaaaagcaaaagagatttatgaaaaatttgatcatttgcaatataaagttttagaactagataaagaattaaaacagataacaaaaaaacaaaaacaagaaaaaaaagcaaaagcaaatcaaaaaggtagattttgtaaagagtatgtagaggtttaa

SEQ ID NO: 14672 - protein, 186 aa, Unknown
  Obtained from environmental sample
  DOMAIN (27)...(60): TPR Domain
  misc_feature (1)..(186): Xaa is any amino acid
MDKALPLYEKSLKITEDILGLNHPVTAGSYNNLAALYQYKKEFNKALPLYEKSLKIREEVLGLIHPDTATSYNNLAALYYDEIILDKALHLYKKSLKIKEEVLGFNHPSTATTYGNIGFLYKDIKNCTQSNYYFTKAKEIYEKFDHLQYKVLELDKELKQITKKQKQEKKAKANQKGRFCKEYVEV

SEQ ID NO: 14673 - DNA, 639 bp, Unknown
  Obtained from environmental sample
  misc_feature (1)..(639): n is a, c, g, or t
atgatctcaaaaggttttgaacaaataggtattaagtatctagatataaaactagatgcattgcctgcaagctttagcagatacaaaatcatccacatcgctgaccttcacatctctaaaagagtcaaaaactcacaaataatctctcttatagatcaaataaactccatagaatctgacatcgtagttataacgggcgatctgatagacgctcccatcatgcagataaaagagaaacttcaactcttcacaaaactaaacaagccactatatttcgtaagtggaaaccatgagcttctctatgcaaaaaacagcgtagatgcactctgcaaaattatagatgccataaatctagataactcaaaaatagagatagcaaaagataatgagtccataactctcatgggctttagtgacagatacagcagactctttggcaaaaagagagagataaatcacctctttaaagataattcaccaacaaccattctactagcccaccaaccaaaagatataaacatcgcacaaaaacataacatctctctacaactaagcggacacacccacgcagggcagataagaacttttgattttttagtacgcatcgcccagccatatatttacggacttaaaaagtaa

SEQ ID NO: 14674 - protein, 212 aa, Unknown
  Obtained from environmental sample
  DOMAIN (28)...(191): Calcineurin-like phosphoesterase
  misc_feature (1)..(212): Xaa is any amino acid
MISKGFEQIGIKYLDIKLDALPASFSRYKIIHIADLHISKRVKNSQIISLIDQINSIESDIVVITGDLIDAPIMQIKEKLQLFTKLNKPLYFVSGNHELLYAKNSVDALCKIIDAINLDNSKIEIAKDNESITLMGFSDRYSRLFGKKREINHLFKDNSPTTILLAHQPKDINIAQKHNISLQLSGHTHAGQIRTFDFLVRIAQPYIYGLKK

SEQ ID NO: 14675 - DNA, 711 bp, Unknown
  Obtained from environmental sample
  misc_feature (1)..(711): n is a, c, g, or t
atgctagaagtccatgacttggttaagacgattaaaaataagcatattttttctccattaaagaaaattcttaaaaatatctcttttaaacttcacgaaggtaaagtaacggccattattggcaaaaatggtgccggtaaaagcactgtcattaaagtgatacttggctttacttcggttgattctggcagtgtgaacattcgcgaaaatacaacaattggttatttgccagagaacccatattattatgattatttaacgatgcgtgagttgatgtggttttcggcgcgtagttttgggatgaaaaaatctgattttaaggcaagggttatggttgtcgctgaaaaagtagatatggtgaatgagctagaccagcgcctgagaactttttctaaagggatgactcaacgggccgggatagcggctgccattgtgcacgaccccgatctattgatttttgatgagcccatgagtggtttagaccctgtcgggcgaaaaatggtttttgatttaattaccgagttacgccaatgcggtaaaactgttttgtttttgtcacatgttcttagcgatgtcgaacgcctttgcgatgaagtgtatattatgcatgcaagtgaagtttgcccgcatctaaccagcgcacaactaaaaattgccccaaatgaagtggagattattgttcaacgtcccctactatggaacattacttag

SEQ ID NO: 14676 - protein, 236 aa, Unknown
  Obtained from environmental sample
  DOMAIN (34)...(205): ABC transporter
  misc_feature (1)..(236): Xaa is any amino acid
MLEVHDLVKTIKNKHIFSPLKKILKNISFKLHEGKVTAIIGKNGAGKSTVIKVILGFTSVDSGSVNIRENTTIGYLPENPYYYDYLTMRELMWFSARSFGMKKSDFKARVMVVAEKVDMVNELDQRLRTFSKGMTQRAGIAAAIVHDPDLLIFDEPMSGLDPVGRKMVFDLITELRQCGKTVLFLSHVLSDVERLCDEVYIMHASEVCPHLTSAQLKIAPNEVEIIVQRPLLWNIT

SEQ ID NO: 14677 - DNA, 579 bp, Unknown
  Obtained from environmental sample
  misc_feature (1)..(579): n is a, c, g, or t
atgatagagggtcagggaacaaaaacatccaatatctgtaaaaaaatgatgtactctaaccctgaactacttcacaacattcttaaaaaagttactgaagttgttaaactctacatggaaaaacagattcaagcaggtattgacgtagttcaaatatttgatagttgggctgctgccattgagcctggaaaatatgatgagttctcatggaaatatatggttgaaatcgctgagtacttaaaagagaaatatccacatattcctgtcattatgtttcctaaagggatccctgcatttttagataaggtgtatggaaactttgatgtatttggagttgattggagtactcctatgtccctggctaaagagaaactaggtgacaaatatgtacttcaaggcaacatggagccatgtcgtctctactcgaaagaggctactacgaaatgtgtagaagttattcaagagacaatgggcggcaaacgtcatatctttaatttaggtcatggaatacttcctgatgtacctgtagaaaatgccatacacttcgtaaacgaatgtcacagagtaagtgaaaaataa

SEQ ID NO: 14678 - protein, 192 aa, Unknown
  Obtained from environmental sample
  DOMAIN (1)...(189): Uroporphyrinogen decarboxylase (URO-D)
  misc_feature (1)..(192): Xaa is any amino acid
MIEGQGTKTSNICKKMMYSNPELLHNILKKVTEVVKLYMEKQIQAGIDVVQIFDSWAAAIEPGKYDEFSWKYMVEIAEYLKEKYPHIPVIMFPKGIPAFLDKVYGNFDVFGVDWSTPMSLAKEKLGDKYVLQGNMEPCRLYSKEATTKCVEVIQETMGGKRHIFNLGHGILPDVPVENAIHFVNECHRVSEK

SEQ ID NO: 14679 - DNA, 522 bp, Unknown
  Obtained from environmental sample
  misc_feature (1)..(522): n is a, c, g, or t
ttgatattgagtaattggtttgatcctaataaaagcttttttaaattgcctgtggtttatttgactattattattactataatagttgctgtggttgtttctttttttatatataaatattccaatttgtatttcaagatcaattatgttgggtttaataatgttttagaatattttagagtcccaatttcaattcttgcaatgctaatacctattgttgctgtttttgctgctaatcatcgttctgaacagactagagagcagattaaaatatcatctgagcaaaataactttgttaattactataagcatcttgaagagtttttaaagtatttcaaggagcatactactaaagacgtaaagtttaagagccacaaccgattgcacagcgttttattcccattagcgaagaaaggtaagtatcatattgaaggttcaataataataagaataacaagtgcaattgatgatgtttatcatcttttgcaaatgttaaataatgaagaaaatagaatttnataa

SEQ ID NO: 14680 - protein, 173 aa, Unknown
  Obtained from environmental sample
  misc_feature (1)..(173): Xaa is any amino acid
MILSNWFDPNKSFFKLPVVYLTIIITIIVAVVVSFFIYKYSNLYFKINYVGFNNVLEYFRVPISILAMLIPIVAVFAANHRSEQTREQIKISSEQNNFVNYYKHLEEFLKYFKEHTTKDVKFKSHNRLHSVLFPLAKKGKYHIEGSIIIRITSAIDDVYHLLQMLNNEENRIX

SEQ ID NO: 14681 - DNA, 582 bp, Unknown
  Obtained from environmental sample
  misc_feature (1)..(582): n is a, c, g, or t
atgaaaaagagcttttttgtattttttgtagttatttttattatttcttgtaaaaatacaacaaaaaatataatagaaaacacagatgaaaatcaagtaaaaacggatcaaaatattgaagaaaataataatataatcaatcacgaaaaagaatatttgaccattattggaaatcaaatttgggtgcgttcagaaccaacatcaggagatgttgttatgaaacttgatgacggtacaaaatgtcttttaattgaaaaaggagaacaaaaaacaattaaaggaataacagatttttggtataaaattgaatatgaaggagaaattggatgggtttttggttcacaaacgtctttaattcaaaatgtttcaaaaaaaaatgatcaagttgacgaagtagaggtgtttttatctgagtttttacagacaatcaaaaacaaagaatttgaaaatttacattctttttttgtagatgatagtttcttagaattatataatcctggcgtatttatttatgttgtaaaagaaccatataaagaatccaaattattcgctgaatttggaattaaaggcttcgtcttttga

SEQ ID NO: 14682 - protein, 193 aa, Unknown
  Obtained from environmental sample
  misc_feature (1)..(193): Xaa is any amino acid
MKKSFFVFFVVIFIISCKNTTKNIIENTDENQVKTDQNIEENNNIINHEKEYLTIIGNQIWVRSEPTSGDVVMKLDDGTKCLLIEKGEQKTIKGITDFWYKIEYEGEIGWVFGSQTSLIQNVSKKNDQVDEVEVFLSEFLQTIKNKEFENLHSFFVDDSFLELYNPGVFIYVVKEPYKESKLFAEFGIKGFVF

SEQ ID NO: 14683 - DNA, 390 bp, Unknown
  Obtained from environmental sample
  misc_feature (1)..(390): n is a, c, g, or t
atgccaaaatttttaagaaatacttttactattgtacttatattttttactatacttcttgcaagtatgcctgtaaatatttcattggaccaacttcttaaaatagagaaaaagtatggtgtaaaagcaaaaaagagagttctgttatgggatcaaatgcttcaaagtgcaaaaggtaaaaataccttagaaaaacttaaaatagtaaatgacttttttaatcaaataacttataaaagagatagtgtacattggaaacaaaatgactattgggcttcaccttttgagtttttaggaactggtgctggggattgtgaagattatgctattgcgaaatattttgcactaagacaacttgggattcctgatgaaaaacttaaaataacctat

SEQ ID NO: 14684 - protein, 130 aa, Unknown
  Obtained from environmental sample
  misc_feature (1)..(130): Xaa is any amino acid
MPKFLRNTFTIVLIFFTILLASMPVNISLDQLLKIEKKYGVKAKKRVLLWDQMLQSAKGKNTLEKLKIVNDFFNQITYKRDSVHWKQNDYWASPFEFLGTGAGDCEDYAIAKYFALRQLGIPDEKLKITY

SEQ ID NO: 14685 - DNA, 315 bp, Unknown
  Obtained from environmental sample
  misc_feature (1)..(315): n is a, c, g, or t
ttggatgagacaattggtcgatcaattatgattatagatgaaaatctttttggtgtaactgtagaattaaatttaaagtataaaaagcctatccgattagatgaagaactcaaggttattggtaggataacaaaaaattctagccggatttttgaaggctcaggagaaataatactacaaaatggagatgttgcagtaattgcacatgggaaatacatgaaaatatccatgactaaaatgactgaatttgatgcagaaaaagaggaatgggaagtatcattattagatacagatcccgtaaaaataaatatctaa

SEQ ID NO: 14686 - protein, 104 aa, Unknown
  Obtained from environmental sample
  misc_feature (1)..(104): Xaa is any amino acid
MDETIGRSIMIIDENLFGVTVELNLKYKKPIRLDEELKVIGRITKNSSRIFEGSGEIILQNGDVAVIAHGKYMKISMTKMTEFDAEKEEWEVSLLDTDPVKINI

SEQ ID NO: 14687 - DNA, 450 bp, Unknown
  Obtained from environmental sample
  misc_feature (1)..(450): n is a, c, g, or t
gtgagaagtaaaatggaatatcaggttaagaaaaagcaacagaactgtaaaaattgtcttgtttgtggattgaaaaataaatttggacttaaggcttcattttatgaattagagaataatgaattggttgctatatttaaaccccttgaagagcatcaaagttatccaggacaattacatggaggaattgcaggagcaatattggatgagacaattggtcgatcaattatgattatagatgaaaatctttttggtgtaactgtagaattaaatttaaagtataaaaagcctatcccattagatgaagaactncaggttattggtaggataacaaaaaattctagccggatttttgaaggctcaggagaaataatactacaaaatggagatgttgcagtaattgcacatgggaaatacatgaaaatatccatgactaaaatgactgaattt

SEQ ID NO: 14688 - protein, 150 aa, Unknown
  Obtained from environmental sample
  DOMAIN (56)...(133): Thioesterase superfamily
  misc_feature (1)..(150): Xaa is any amino acid
MRSKMEYQVKKKQQNCKNCLVCGLKNKFGLKASFYELENNELVAIFKPLEEHQSYPGQLHGGIAGAILDETIGRSIMIIDENLFGVTVELNLKYKKPIPLDEELQVIGRITKNSSRIFEGSGEIILQNGDVAVIAHGKYMKISMTKMTEF

SEQ ID NO: 14689 - DNA, 687 bp, Unknown
  Obtained from environmental sample
  misc_feature (1)..(687): n is a, c, g, or t
gtgtattcatgggaatatcgaaataccatgctcaataagtatttttatattcacgacaaagccatatattgggtagatgggcgtattgttcggcttgagattgccattgatataactgaaaaaaaacgcgcagagactcgacttgcagaagaaaaagagcgtttgatagtgacaatgcagagcattggagacggtgttattaccaccgactttgccggcaatattgttctgcttaataaggtggctgaagaaattagcggctggaagacagaagaagcagctggaatgcctctggaacaggtgtttcaggttgttgacaatcaaacccgcaaaaagcgtgtgcttcctgttgacgaaattattaccggtggccggataacgggtctggaaaaccatatagtcttaattgcaaagaaaggagcaacaaagagtattgcgtacagcggtagcccaattcgcgacactaacggagaggtcatcggtgctgttcttgtttttcgtgatgttacagaacaactgaagacagaaaaagaactcttaaaaattaaaaaattagaatctgttggccttcttgctggtggtattgcccacgattttaataatattcttacagccattctcggcaatataaatttagtttcattggatactggcctcagtgatcaggcaaagggcccttcttcttga

SEQ ID NO: 14690 - protein, 228 aa, Unknown
  Obtained from environmental sample
  DOMAIN (53)...(115): PAS domain
  misc_feature (1)..(228): Xaa is any amino acid
MYSWEYRNTMLNKYFYIHDKAIYWVDGRIVRLEIAIDITEKKRAETRLAEEKERLIVTMQSIGDGVITTDFAGNIVLLNKVAEEISGWKTEEAAGMPLEQVFQVVDNQTRKKRVLPVDEIITGGRITGLENHIVLIAKKGATKSIAYSGSPIRDTNGEVIGAVLVFRDVTEQLKTEKELLKIKKLESVGLLAGGIAHDFNNILTAILGNINLVSLDTGLSDQAKGPSS

SEQ ID NO: 14691 - DNA, 345 bp, Unknown
  Obtained from environmental sample
  misc_feature (1)..(345): n is a, c, g, or t
ttgcattacctatctcataataatggatttactcaagtcgcattaacagaatatttaaatttagataagtcatccgtaacatcacaacttaataatcttgagaagaatgggtatatatacagatccgtntcacctgaagatgctagaatacgaacgatcaatatcactgataaagcaaaagagatttttggctcgttgatgaatgttttttcatcgtggactgatatattactaacgaactttagtgaaaaagaaaaggaagatatttttctattattgaataaaatgcatgaaaattcacaaactaaaattaatgagctcaagctagatgaaaagaagaaatag

SEQ ID NO: 14692 - protein, 114 aa, Unknown
  Obtained from environmental sample
  DOMAIN (1)...(96): MarR family
  misc_feature (1)..(114): Xaa is any amino acid
MHYLSHNNGFTQVALTEYLNLDKSSVTSQLNNLEKNGYIYRSVSPEDARIRTINITDKAKEIFGSLMNVFSSWTDILLTNFSEKEKEDIFLLLNKMHENSQTKINELKLDEKKK

SEQ ID NO: 14693 - DNA, 918 bp, Unknown
  Obtained from environmental sample
  misc_feature (1)..(918): n is a, c, g, or t
atggccgggaatatatctgaacaaggtgaagtgtctattcgtggggatattatagatatttgtcctccacatgaagagtatggatatagaatcagtttatttgatacagagattgaatctatacgaaaatttgatgtggaaaatcaaaagtcatttaaagaggagttggaaaactttactatatcggcttcttttttagctttagatgaacaaaagctagaagttttaaatgagaaaatagaaaacagtaacattgatgtatttcaaaaagatatacactcactaggattttggtttttagataatgatgcaacttattatacggagaagctaaaaagtgttattacaaaagaagccttagctgaggtagaagaagcatatatctttgaagaaaaaagggtagagaaagaaaaattacttaccacgccacctttaaatgaagatgatacttataaaaaaattgatgtagcaaatattaaagagtttttacaatttcatgctggaaaaaaagttacaataatctcttcaactgaggggaagattcgctcccatgaattagatatcacagataaaaatatcaactataagatagattatcaagttatcaatctagtgagtgatgatgaggttatcatctctttaaataaagaggttaaaaagaaacgaaaaaagaagccaaaaatcgtacttgatgagttgcaaaaagatgattttgtagtgcatgaaattcatggtattgggcagtttaaagggattgaacctgttactgttatgggtgcaactagagattttgtggttgttcaatatgctggggatgatagacttttaatacctgttgaaaatataggaattattgatagatatttagcagatagtggtagtattgctacagttgataaactaggtaaaggaattttg

SEQ ID NO: 14694 - protein, 306 aa, Unknown
  Obtained from environmental sample
  DOMAIN (232)...(306): CarD-like/TRCF domain
  misc_feature (1)..(306): Xaa is any amino acid
MAGNISEQGEVSIRGDIIDICPPHEEYGYRISLFDTEIESIRKFDVENQKSFKEELENFTISASFLALDEQKLEVLNEKIENSNIDVFQKDIHSLGFWFLDNDATYYTEKLKSVITKEALAEVEEAYIFEEKRVEKEKLLTTPPLNEDDTYKKIDVANIKEFLQFHAGKKVTIISSTEGKIRSHELDITDKNINYKIDYQVINLVSDDEVIISLNKEVKKKRKKKPKIVLDELQKDDFVVHEIHGIGQFKGIEPVTVMGATRDFVVVQYAGDDRLLIPVENIGIIDRYLADSGSIATVDKLGKGIL

SEQ ID NO: 14695 - DNA, 831 bp, Unknown
  Obtained from environmental sample
  misc_feature (1)..(831): n is a, c, g, or t
atgggtgacatcacaggtgattcactagagttagcaaagagaaccatggaagatgagagtgagtttgtagttttttgcggtgtaggatttatgggagagagtgtaaaagttttaagcccaaaaaaaagagttttaatgcctcgcattgcatgttgtgccatggctaagatgatagatggtaaatattatgatgactctatatctatattaaaaaaagctggtattgagaaagagaatatactgccaataacttacattaactcatctgcagaagtaaaagcaaaagttggcgagatgggtggtatggtgtgtacaagttctaatgcaaaatttattattgagcgtgcgctaaaagagggtaaaaagatactttttgtccccgatagatgtttaggacaaaatattgcaaatcaaatgggacttaaatcttgtgtaattggtgatggcagtgatcctaaagagtctgatattatctgttatgacggtttttgttcggttcatcagcttttttcagtagaagatatcaacttttatagaaaaaaataccctgaaattttagtagcagtacatcctgagtgtgatccttcagtgtgtgacgctgcagattttgttggttcaacatcacagctgattaaatatataaaagagttaccacttgagcaaaaagttgtggtaggaactgaatttaatatggttgatcgtcttcgtgagaaaaatacatatattctctcatctacaaaaacggagtgtccgactatgaatgagaccacacttcaagatctatatttgtgttttaaatctatggaagataataaacctataatgagatag

SEQ ID NO: 14696 - protein, 276 aa, Unknown
  Obtained from environmental sample
  DOMAIN (2)...(275): Quinolinate synthetase A protein
  misc_feature (1)..(276): Xaa is any amino acid
MGDITGDSLELAKRTMEDESEFVVFCGVGFMGESVKVLSPKKRVLMPRIACCAMAKMIDGKYYDDSISILKKAGIEKENILPITYINSSAEVKAKVGEMGGMVCTSSNAKFIIERALKEGKKILFVPDRCLGQNIANQMGLKSCVIGDGSDPKESDIICYDGFCSVHQLFSVEDINFYRKKYPEILVAVHPECDPSVCDAADFVGSTSQLIKYIKELPLEQKVVVGTEFNMVDRLREKNTYILSSTKTECPTMNETTLQDLYLCFKSMEDNKPIMR

SEQ ID NO: 14697 - DNA, 525 bp, Unknown
  Obtained from environmental sample
  misc_feature (1)..(525): n is a, c, g, or t
atgacagatacaattaaagtatttaatgcaaatgaaaataatttaaaaaatgtaaatttagagattccaaaaaacaaacttatagtctttacagggcttagtgggagtggaaaatctacattagcttttgatactctttatgcagaaggtcaaagaagatatatagaatctttgagtgcctatgccagacaatttttaggaaaaattggaaagccagatgttgaaagaatagaggggcttacacctgctattgcaattgaccaaaaaacaacatcaaaaaatccacgaagtacagtgggaactatcactgaaatctacgattatttacgattattatatgcaagagttgggaaacaacattgtcataaatgtggagagccaatctctcaaatgagtagttcagatgttataaatcaagttttaaaattgccagaaaactctaagatagtgatattagcaccacttatcaatagaaaaaaaggtacatttgctgatctatttgaatctttacgagcaaaaggatag

SEQ ID NO: 14698 - protein, 174 aa, Unknown
  Obtained from environmental sample
  misc_feature (1)..(174): Xaa is any amino acid
MTDTIKVFNANENNLKNVNLEIPKNKLIVFTGLSGSGKSTLAFDTLYAEGQRRYIESLSAYARQFLGKIGKPDVERIEGLTPAIAIDQKTTSKNPRSTVGTITEIYDYLRLLYARVGKQHCHKCGEPISQMSSSDVINQVLKLPENSKIVILAPLINRKKGTFADLFESLRAKG

SEQ ID NO: 14699 - DNA, 804 bp, Unknown
  Obtained from environmental sample
  misc_feature (1)..(804): n is a, c, g, or t
atgcacggtggtggtggaaaaccaaaaccaaaaggatatatacctacacaaaaggtttatatttcaactcttgaaaataaaagtgtgactccaaaaaatatagagtttttttactatgatataaaacaaaataaaaaagatattatcaaaaatagttcaagaggaaaagaaacatatagttttgaagtgccaaataatggatactataatctttttgcagtagcacaaagtacaaaagatgataaaaaattttacaatgtagcaaaactagagtatcttcaagggaaacatggtattgaagatatttatgatgaagaacttaaaaaaaatcttgaacaaaacctgactaaaattgacttaataagaataaaaaacgaagatgaaaatagctttttttataaatttaaaatgggtgaaactttaaaatttcaagcaatatttgatcaaaaacccttagcaaatacaaaaatacatatcaaactccaaagtggttgggaaaaaacttcaattacaaatgataaaggtgaagtagaatttacaattataagagattatttcccctcttggaataagtttgaaaaacgatttaaacaagatttattaataactttagaatataatactgctcatacaaaatatacgctgacataccctgcatctttttacccaaatggaagtgactacaaatcatacgcttatgcattgctactaataactcttacacttcttgtatctggtatagttatctatagatttagagaaaatagaactgcacctttttcagaggtaaagttcaatgagtaa

SEQ ID NO: 14700 - protein, 267 aa, Unknown
  Obtained from environmental sample
  misc_feature (1)..(267): Xaa is any amino acid
MHGGGGKPKPKGYIPTQKVYISTLENKSVTPKNIEFFYYDIKQNKKDIIKNSSRGKETYSFEVPNNGYYNLFAVAQSTKDDKKFYNVAKLEYLQGKHGIEDIYDEELKKNLEQNLTKIDLIRIKNEDENSFFYKFKMGETLKFQAIFDQKPLANTKIHIKLQSGWEKTSITNDKGEVEFTIIRDYFPSWNKFEKRFKQDLLITLEYNTAHTKYTLTYPASFYPNGSDYKSYAYALLLITLTLLVSGIVIYRFRENRTAPFSEVKFNE

SEQ ID NO: 14701 - DNA, 921 bp, Unknown
  Obtained from environmental sample
  misc_feature (1)..(921): n is a, c, g, or t
atggccgggatcgaacaactattttatactaaattagtagaaattgtcataaaagatgttcttgaaataaacccaaatgcaacaatggttataaagtcaacggtacccgtaggttatacaaaaattgcaaatgaaaaatttaacactacaaatattattttttctccagaatttttaagagagggtagtgcactacatgacaacttatatccaagtagaatcatagtaggtgagaagagcgagagagcaaaggtatttgcaaatcttttagttcaaggtgcaaaaaaagagaagatagatgtactttttacggactcaacagaagcagaagctgtaaaactgttttcaaatacatatctagctttgagagtatcatacttcaatgagttagatagttatgctctctcacatggattaaactcaaaagatatcatagaaggtgtaggactagatcctagaatagggacacactataataatccaagttttggatatggtggatattgtttaccaaaagatacaaaacagctaagagctaactataaagatgtaccgagtaacatcattggtgctatagtagatagtaactccacgagaaaagattttatttcagatagtgttattaaaatggctcaaatgataaatcaagatcataacccgtcaaacaccacaataggtatatataggctagttatgaaatcaggaagtgataactttagagcaagtgctattcaaggcattatgaaaagaatcaaagcaaaaggtatagaggtagttatctatgagccagccatgaaagaagatgagtttttcaattcaaaggttatcaaaaatcttgaagagtttaaaagtctgagtgatggtatcatagcaaatagatttgagactattttagaagaatgtgaagaaaaagtatatact

SEQ ID NO: 14702 - protein, 307 aa, Unknown
  Obtained from environmental sample
  DOMAIN (1)...(95): UDP-glucose/GDP-mannose dehydrogenase family, NAD binding domain
  misc_feature (1)..(307): Xaa is any amino acid
MAGIEQLFYTKLVEIVIKDVLEINPNATMVIKSTVPVGYTKIANEKFNTTNIIFSPEFLREGSALHDNLYPSRIIVGEKSERAKVFANLLVQGAKKEKIDVLFTDSTEAEAVKLFSNTYLALRVSYFNELDSYALSHGLNSKDIIEGVGLDPRIGTHYNNPSFGYGGYCLPKDTKQLRANYKDVPSNIIGAIVDSNSTRKDFISDSVIKMAQMINQDHNPSNTTIGIYRLVMKSGSDNFRASAIQGIMKRIKAKGIEVVIYEPAMKEDEFFNSKVIKNLEEFKSLSDGIIANRFETILEECEEKVYT

SEQ ID NO: 14703 - DNA, 675 bp, Unknown
  Obtained from environmental sample
  misc_feature (1)..(675): n is a, c, g, or t
ttgctacgactcaaaaaagaggagaataatgctcttgatgagtttaaaagtgcagagtttgctattgtgagattagaatctgagataaatgaaactttgcataaaatccaagagacaaaactctctttctcttcaaaagcaaaacaagaactcaacgaagcaatagctgaatacaaaagaacagtaagcaacgcaaaagctttagaagaccaagtaacaagaactatagtaaaagccccaagagatggtgtagttcaaagactttttgtccacactattgggggtgtagtaaaaccaggagatgacctcatcgagatagttccatcaaatgaaaaacttctagtaaacgcaaagataaaaccctctgatattgcatttatctacccatcacaaaaagctatagtgaaattttcagcgtatgatttctctatctatggaggtttagagggggaagttataagtattagtcctgatactattaaagataaagatgaaaatacttactatatagtaagaatccaaacacaaaaaagtaaactagaacaatcaaaagatatgaaaatcatcccaggtatgactgctcaagtggatatcttaactggtaaaaaaagtatcttaagttatatcttaaagccaattttgaaaacaaagcaatatgcttttggagatagataa

SEQ ID NO: 14704 - protein, 224 aa, Unknown
  Obtained from environmental sample
  misc_feature (1)..(224): Xaa is any amino acid
MLRLKKEENNALDEFKSAEFAIVRLESEINETLHKIQETKLSFSSKAKQELNEAIAEYKRTVSNAKALEDQVTRTIVKAPRDGVVQRLFVHTIGGVVKPGDDLIEIVPSNEKLLVNAKIKPSDIAFIYPSQKAIVKFSAYDFSIYGGLEGEVISISPDTIKDKDENTYYIVRIQTQKSKLEQSKDMKIIPGMTAQVDILTGKKSILSYILKPILKTKQYAFGDR

SEQ ID NO: 14705 - DNA, 882 bp, Unknown
  Obtained from environmental sample
  misc_feature (1)..(882): n is a, c, g, or t
atgggtggactcatagctattattatcctatcttcaagaactgtagcacctttaggacaagctgcttcacttattactaattatgaagatgcaaaaacatcttatgaagctattgactctattatcactcgtccagttgagagaccaaaagccaaagaatttataagaagagagaatattattggaaatatagagtttagaaatgtcacttttacctatcctgatactcaaatagctgtattaaatgatgtgagttttactataaacaaaggtgaaaaagtagctattttaggaagaatcggttcaggaaaaagtactattgcaaaactattactaaaactttatgagcctcaaagtggttctattttaatagatggcattgatataaaacaactagacccagcagatttaagaaaaagtataggatatatacctcaagagattcatctttttcaaggtactataaaagaaaatattttgaataactatagatactacacagatgaagagatgttagaagtttctaaaattggtggggttgatgagtttgtaaagacccatcctcttggctatgagatgcctataggggaaagaggtgttggactctcgggaggacaaaaacaaacagtaggaattgctagggcattgctatcagatgcaaacaccttactttttgatgagcctacaaatgctatggatcaaactacggaaacaaatacaataaataaattaaaaccagtaattgaagataaaacattatttctcgtaactcaaaaaatgagtactttagagttatgtaatagaattatcgttttttatcaaagtgttaaaatcatggatggacccaaagatgagattataaaacagttggcttcaaaatga

SEQ ID NO: 14706 - protein, 293 aa, Unknown
  Obtained from environmental sample
  SIGNAL (1)...(21)
  DOMAIN (91)...(275): ABC transporter
  misc_feature (1)..(293): Xaa is any amino acid
MGGLIAIIILSSRTVAPLGQAASLITNYEDAKTSYEAIDSIITRPVERPKAKEFIRRENIIGNIEFRNVTFTYPDTQIAVLNDVSFTINKGEKVAILGRIGSGKSTIAKLLLKLYEPQSGSILIDGIDIKQLDPADLRKSIGYIPQEIHLFQGTIKENILNNYRYYTDEEMLEVSKIGGVDEFVKTHPLGYEMPIGERGVGLSGGQKQTVGIARALLSDANTLLFDEPTNAMDQTTETNTINKLKPVIEDKTLFLVTQKMSTLELCNRIIVFYQSVKIMDGPKDEIIKQLASK

SEQ ID NO: 14707 - DNA, 339 bp, Unknown
  Obtained from environmental sample
  misc_feature (1)..(339): n is a, c, g, or t
atgttaaaaaaatcattgataattgtttttattgggtttatctctctatacggaactgtatttagtaaaaaagcaacggttacaccaaagttgttacagcaagaaaatggtaaccaatggtgtccagtttcaggggagaaaattgaggatttttataaaacatcatatacagcaaaactccaaatgaatgggaataataggcaatactgtagtatacgatgtttagttatggatatggatgagtatggtatagatttaaatagtgttcaagttttagatgtgatttctcaaaaatatattcaagcacaagatgcctatttttgtgtaagaagtgaagta

SEQ ID NO: 14708 - protein, 113 aa, Unknown
  Obtained from environmental sample
  misc_feature (1)..(113): Xaa is any amino acid
MLKKSLIIVFIGFISLYGTVFSKKATVTPKLLQQENGNQWCPVSGEKIEDFYKTSYTAKLQMNGNNRQYCSIRCLVMDMDEYGIDLNSVQVLDVISQKYIQAQDAYFCVRSEV

SEQ ID NO: 14709 - DNA, 312 bp, Unknown
  Obtained from environmental sample
  misc_feature (1)..(312): n is a, c, g, or t
atgcttaataaattgaagactatgctgccatacaacagtaggatcttcagtaccatggattatcagcagctttccttcaaggtttccaactttattaagaagattagccttttcatatccctcaggattttcctgtggagtatccatataacgttcgccatacattatctcataataactccaatcgattaccggaccacctgcaactcctaccttgaaaacatctggattatcaagcatcatgctgatggtcataaaaccaccataactccagccatcaacaccaattctatctgcatcaacaaacgatag

SEQ ID NO: 14710 - protein, 103 aa, Unknown
  Obtained from environmental sample
  misc_feature (1)..(103): Xaa is any amino acid
MLNKLKTMLPYNSRIFSTMDYQQLSFKVSNFIKKISLFISLRIFLWSIHITFAIHYLIITPIDYRTTCNSYLENIWIIKHHADGHKTTITPAINTNSICINKR

SEQ ID NO: 14711 - DNA, 828 bp, Unknown
  Obtained from environmental sample
  misc_feature (1)..(828): n is a, c, g, or t
gtgctaaatattgaaatcaataactttgcagttactttcactcctgtcgatcctctctattttggttctcaggatatagtttttgaattatctgatggtcaggcatccacctatgataccttaactgtaattgttcagtatgttaataatcctcctcaatgggctggccctgtttcaattagtttggatgaagatttcggtagctttgatctgggattggttaatgacctattcactgatgcagaccccatagaatataccaatcttgcttttttgatctcttcctttgatgatgaactcttctcagctgaaattaatccacagcaacatctaattctttcatctttagataattccttcggaaacggtaatatttgtatcactgcaacagataatgacagtaatggcaatcctgctcaaacaactcattacctgccaatcagcgtgaatcctgttaatgatttaccaaccttcagtaatcttcctgaattctatgaaatcggtgctcatgggtttgtaagaatcgatctggaaaataatatcaatgatattgatgatcagaatctgataattacaatagattctccaaatggatttgttaacattgaacctgaaactggctatccttatcgtttcattctcaatgctgccaatttagcagatgttactgatttcattacattgaatctttccgatggtcatggtgaaattgtctcaactcanattgaagtatatgtttcctattcccaggctcccatcatccagcaacctatacctaatttgacttttagcgaagaatttcaattgcagaatactcttacattgacc

SEQ ID NO: 14712 - protein, 276 aa, Unknown
  Obtained from environmental sample
  misc_feature (1)..(276): Xaa is any amino acid
MLNIEINNFAVTFTPVDPLYFGSQDIVFELSDGQASTYDTLTVIVQYVNNPPQWAGPVSISLDEDFGSFDLGLVNDLFTDADPIEYTNLAFLISSFDDELFSAEINPQQHLILSSLDNSFGNGNICITATDNDSNGNPAQTTHYLPISVNPVNDLPTFSNLPEFYEIGAHGFVRIDLENNINDIDDQNLIITIDSPNGFVNIEPETGYPYRFILNAANLADVTDFITLNLSDGHGEIVSTXIEVYVSYSQAPIIQQPIPNLTFSEEFQLQNTLTLT

SEQ ID NO: 14713 - DNA, 507 bp, Unknown
  Obtained from environmental sample
  misc_feature (1)..(507): n is a, c, g, or t
atggccaaaaccaaaacaacatttttctgccagagttgtggcaaccaatcaagtaaatggctgggtaagtgctcatcttgtggcgaatggaatacttacgttgaagaaattgtgagtaagcctgttgataagcacgatcagtataagcaagctaaacacaaaagtattccgaaacccgtaaatgaaattgtttcagaaaaggaagaccggatagatatgcagtctgccgagttgaaccgggtactgggtggtggcctggtttcgggttctatcattttgatcggtggtgaaccaggtataggaaaatcaacattgttgctgcaagtggcattgaacatgaaagggcatcgcatcctatatgtttcgggtgaagaaagcagtcagcaattgaaaatgcgtgccgatcgtttgggaatccaaaatgcagaatgttatattttaaacgagacatttacaggagaaatattcaggcatattggcgaactccaacccgaccttgtgtcatga

SEQ ID NO: 14714 - protein, 168 aa, Unknown
  Obtained from environmental sample
  misc_feature (1)..(168): Xaa is any amino acid
MAKTKTTFFCQSCGNQSSKWLGKCSSCGEWNTYVEEIVSKPVDKHDQYKQAKHKSIPKPVNEIVSEKEDRIDMQSAELNRVLGGGLVSGSIILIGGEPGIGKSTLLLQVALNMKGHRILYVSGEESSQQLKMRADRLGIQNAECYILNETFTGEIFRHIGELQPDLVS

SEQ ID NO: 14715 - DNA, 315 bp, Unknown
  Obtained from environmental sample
  misc_feature (1)..(315): n is a, c, g, or t
atgaatcccatagaaaaagcccgatttgaagagatggctaaaatatctaaagctctgtcacacgcgactagactatatattgtggacaagttgaatgaaaaagagtattgcctgaaagaacttacgaagatgattggggcggataattccactgtttctaaacacctttcagtcttaaaaaatgtggggattatctccgatgaaaaacggggtaattgtgtttattttaaactggaatgtccctgtgtgctcaacatttttagctgcgcggtaaacgtgatagattctaataccaaaagacaaaatgagctctcg

SEQ ID NO: 14716 - protein, 105 aa, Unknown
  Obtained from environmental sample
  DOMAIN (16)...(94): Bacterial regulatory protein, arsR family
  misc_feature (1)..(105): Xaa is any amino acid
MNPIEKARFEEMAKISKALSHATRLYIVDKLNEKEYCLKELTKMIGADNSTVSKHLSVLKNVGIISDEKRGNCVYFKLECPCVLNIFSCAVNVIDSNTKRQNELS

SEQ ID NO: 14717 - DNA, 840 bp, Unknown
  Obtained from environmental sample
  misc_feature (1)..(840): n is a, c, g, or t
atgggaacttataattctcgttttacagaaggattagaggctttagatattacttcagctaaatccgtggaaaaaacttttgattgtttcaggcctgatattgttgtgctttcttcagctttaactgcggtagattattgcgaagaaaatcctgaaaaggctaaccgcattaatgtagaaggtgttagaaacgtagtaaatatgtgtagggaattcggggcaaagccggtttatttatctacagaatatgtttttgacggagaaaacgggccctatactgaaaccgataaggttaaccctataaatgcatatggtttaagtaagctggaaggggaaaatatagtttcttctttaagcgaatatttaattatcagaagcactgtaatttatcagtacgacaaaaattctttaaattttattatgcagcttttaacaaaacttccaaaaggcgaaataattaaggttcctgtagaccaatattcaaatcctacttatgctccagatttagcaaaagccatttatttattaattaaaaaaaggttaagcggtatttataatgttgtgggttcggaccgcttaaatagatatgactttgcagtaaaagcatgcgaaattttagggttcaacaaaaacttaatagagcaggtttttacaaaggattttggttcaaaagccatgcgtcccttaaatgcaggcctaattacagaaaaacttactaatgatactgggcatattccgcttagtgttgaaaatggtttaaaagaaattaaaaaacaattagacaaggcccgctgtatgaaaaagatagctgttttgcctgcctatnatgcagcttctacc

SEQ ID NO: 14718 - protein, 280 aa, Unknown
  Obtained from environmental sample
  DOMAIN (1)...(263): NAD dependent epimerase/dehydratase family
  misc_feature (1)..(280): Xaa is any amino acid
MGTYNSRFTEGLEALDITSAKSVEKTFDCFRPDIVVLSSALTAVDYCEENPEKANRINVEGVRNVVNMCREFGAKPVYLSTEYVFDGENGPYTETDKVNPINAYGLSKLEGENIVSSLSEYLIIRSTVIYQYDKNSLNFIMQLLTKLPKGEIIKVPVDQYSNPTYAPDLAKAIYLLIKKRLSGIYNVVGSDRLNRYDFAVKACEILGFNKNLIEQVFTKDFGSKAMRPLNAGLITEKLTNDTGHIPLSVENGLKEIKKQLDKARCMKKIAVLPAYXAAST

SEQ ID NO: 14719 - DNA, 426 bp, Unknown
  Obtained from environmental sample
  misc_feature (1)..(426): n is a, c, g, or t
atgacaatctcaattaatctacaagttaaatcacaatacatagaacaatacaaaaatggttacccacttatttcccaagagagtatagaaaatcttgaaaatatagaagagggaacaatcgtaaatcttcttgattcccataaaaaatttatcgccaaagggtattttggtaaacaaaacaaaggttttggatgggttttatcaaataaaaaagatgaaaactttgataaagagttttttgtaaataaaataaaatcagccatagaatatagaaaagagttttttgatgatactcaaactaccgcatttagagtatttaatggccctggtgatggagtaggtggtttaactatagattatttcgatggatattatcttcttacttggtatagtcttggtatttatactttaaagatgccatcatag

SEQ ID NO: 14720 - protein, 141 aa, Unknown
  Obtained from environmental sample
  misc_feature (1)..(141): Xaa is any amino acid
MTISINLQVKSQYIEQYKNGYPLISQESIENLENIEEGTIVNLLDSHKKFIAKGYFGKQNKGFGWVLSNKKDENFDKEFFVNKIKSAIEYRKEFFDDTQTTAFRVFNGPGDGVGGLTIDYFDGYYLLTWYSLGIYTLKMPS

SEQ ID NO: 14721 - DNA, 507 bp, Unknown
  Obtained from environmental sample
  misc_feature (1)..(507): n is a, c, g, or t
atgatttttaaagatatcccaaaagatactaaaatactcgaagttggtacaaatattgggaatcaactcttccatttacaatctcaagggtttactaacttatatggtattgagatacaagatagagctataaactatgcaaaacatagaactgacaatcttaatattatcaaaggtgatgcacttgacattccatttaaagatggtttttttgatgttgtctttacacatggtgttttgattcatatttctccagataatatcaaacaagcactcaaagagatttatcgagtaagcaatcaatatatttggggactagaatactatgctgatacatatacagacttagaataccatggacaaaaaaacatcatgtggaagactaacttttgtaagctatatcttgatacatttacatccctaaagcttatcaaagaaaaaaaatataagtatactagtgaaaaccatctagaagatcagatgtttcttctaaaaaaagataattaa

SEQ ID NO: 14722 - protein, 168 aa, Unknown
  Obtained from environmental sample
  misc_feature (1)..(168): Xaa is any amino acid
MIFKDIPKDTKILEVGTNIGNQLFHLQSQGFTNLYGIEIQDRAINYAKHRTDNLNIIKGDALDIPFKDGFFDVVFTHGVLIHISPDNIKQALKEIYRVSNQYIWGLEYYADTYTDLEYHGQKNIMWKTNFCKLYLDTFTSLKLIKEKKYKYTSENHLEDQMFLLKKDN

SEQ ID NO: 14723 - DNA, 369 bp, Unknown
  Obtained from environmental sample
  misc_feature (1)..(369): n is a, c, g, or t
atgaatgactttgataaacttactgaaaagttaaaatttttaatttcaaaaaaagattttatagcgtatattacactattccaaacagcacttaaaaatgccccaactgaagaatatataaataatttatttttattattttttaaattagaatttgagcataagatatatcttaatgcaggaaatgaggcagaatataaaaagctattacaactaattagagaagttttactccatttactaagtttaggtattgtaccgaaccgtgaatatctatatttatatgttttctttaaaagattttcttttgaagaggatcaaagaattacagaactgttaaacttcttcaaagaggacattgtaaaattt

SEQ ID NO: 14724 - protein, 123 aa, Unknown
  Obtained from environmental sample
  misc_feature (1)..(123): Xaa is any amino acid
MNDFDKLTEKLKFLISKKDFIAYITLFQTALKNAPTEEYINNLFLLFFKLEFEHKIYLNAGNEAEYKKLLQLIREVLLHLLSLGIVPNREYLYLYVFFKRFSFEEDQRITELLNFFKEDIVKF

SEQ ID NO: 14725 - DNA, 483 bp, Unknown
  Obtained from environmental sample
  misc_feature (1)..(483): n is a, c, g, or t
atggataaacgtacgattggaatgtggctttacacaaatagcggtggagcaaaaataggtaaaaaaatcattaaaaagttgaaagacagagatattgaaactattgataatatcaatcttagagatgcgattgcatacaacaaagatatcatctgtaatgatattaaacttaatgagttagacctatttttctcatataatgcgggtgagcagacactttatcaaatgtttctctatcgtgcgttaaaccgtgctatacctatgatcaacaattacgaagccttctctttaacagaagataaatttcaaacctcttatctactaagacaacatggcataaatactgccgaatatgaactttgtcacagagataacagtgctcatcttaaaaaaattatcaaacagtgggataagatggtatataaaccaactgatggttggggtggagtcggacttacaaaaatagagaacgaagcaagttag

SEQ ID NO: 14726 - protein, 160 aa, Unknown
  Obtained from environmental sample
  misc_feature (1)..(160): Xaa is any amino acid
MDKRTIGMWLYTNSGGAKIGKKIIKKLKDRDIETIDNINLRDAIAYNKDIICNDIKLNELDLFFSYNAGEQTLYQMFLYRALNRAIPMINNYEAFSLTEDKFQTSYLLRQHGINTAEYELCHRDNSAHLKKIIKQWDKMVYKPTDGWGGVGLTKIENEAS

SEQ ID NO: 14727 - DNA, 840 bp, Unknown
  Obtained from environmental sample
  misc_feature (1)..(840): n is a, c, g, or t
atgtattggttatttaaagacaaagtagttggagcaaacgaatattatgaatctactgtgaataaatcacctctttcaggaggggtttcaggtataaaagtaattgatgattatactatagaaattaatttgaattactcttttgcaggatttttaaatatattaagtcatatttcttgttctgtattcccaaaagaagcttttgatatgtacggcttagatatgagaattcattgtgtaggaacaggtccttttagagttaagaaaattaaagaatctgaaacagtaatcttagaaagaaatcctgactattggggtgttgattcttacggaaatcaattaccttacttagatggaattaagttttctttcatcaaagagaaaaaagctgaattattagaattcagaaaaggtaatttggatatggtttttagattaccattagaaatgataaaagaagttgttggagagctagaagaagctaaaaaaggtggtaataagccttacgttatgcaagttgttccagcaatgagtgttttttacttaggattacaacaccaacttcctccgtttaacaatattgatgtaagaaaagcttttaattatgctattgacagagaatcaattgtgacttacactttacaaggagaaggaagagctggattaaacggtattgtacctccatttaaagggtatgattacgaaaatgtaaaaggttacgattacgatcctcaaaaagctaaagaacacatggcaaaagcaggatatccaaatggtaaaggttttcctgaaataactttacaaattaccccagggggtggagacagaaacgttcaagtt

SEQ ID NO: 14728 - protein, 280 aa, Unknown
  Obtained from environmental sample
  DOMAIN (36)...(143): Bacterial extracellular solute-binding proteins, family 5 Middle
  misc_feature (1)..(280): Xaa is any amino acid
MYWLFKDKVVGANEYYESTVNKSPLSGGVSGIKVIDDYTIEINLNYSFAGFLNILSHISCSVFPKEAFDMYGLDMRIHCVGTGPFRVKKIKESETVILERNPDYWGVDSYGNQLPYLDGIKFSFIKEKKAELLEFRKGNLDMVFRLPLEMIKEVVGELEEAKKGGNKPYVMQVVPAMSVFYLGLQHQLPPFNNIDVRKAFNYAIDRESIVTYTLQGEGRAGLNGIVPPFKGYDYENVKGYDYDPQKAKEHMAKAGYPNGKGFPEITLQITPGGGDRNVQV

SEQ ID NO: 14729 - DNA, 798 bp, Unknown
  Obtained from environmental sample
  misc_feature (1)..(798): n is a, c, g, or t
atgaatagtagtgagttaactacatttattaaatctttaaactaccctaatttaacaaaaacattaggtgaattgaaattaataagttcaatatcaattaaaaattcagtacctaatatagaactttccactacaagtaatgagtcgttcttaacagttaaaacactactagaagataaattgtctaatatattcaatagtttgaatattataaaaaaacccactttgcaaaaagataagaactatggggatactgcaaaaccaaataatcgtgcaccgtatgcaaaaaatattattgccataacaagtggaaaaggtggtgttggtaaaagtacagttagtgttaatacctcaattgcactagtgcaaagaggatacaaagtaggacttttagatgcagatatatatggtccaaatatagcaagattaacagctacagaaaatgaaaaattaaaatggaatgataataataagatggttccggctgaaaattttggactgaaaatcatgagtgtagctcacacgactcctaagatggatacacctcttgtatggagaagctcggtagctatatctgcactcatgcaatttttagaagatgtagagtggggagagttagactttttagttattgacatgccaccaggtaccggtgatgtccaacttacgatggcacaagagttaccccttagtgcagcattattggttactacaccacaaacaatctctacggatgatgtcagccgcgcagttatgatgtttaaagatataaatgtaccaatggctggaatcgtagaa

SEQ ID NO: 14730 - protein, 266 aa, Unknown
  Obtained from environmental sample
  DOMAIN (99)...(266): CobQ/CobB/MinD/ParA nucleotide binding domain
  misc_feature (1)..(266): Xaa is any amino acid
MNSSELTTFIKSLNYPNLTKTLGELKLISSISIKNSVPNIELSTTSNESFLTVKTLLEDKLSNIFNSLNIIKKPTLQKDKNYGDTAKPNNRAPYAKNIIAITSGKGGVGKSTVSVNTSIALVQRGYKVGLLDADIYGPNIARLTATENEKLKWNDNNKMVPAENFGLKIMSVAHTTPKMDTPLVWRSSVAISALMQFLEDVEWGELDFLVIDMPPGTGDVQLTMAQELPLSAALLVTTPQTISTDDVSRAVMMFKDINVPMAGIVE

SEQ ID NO: 14731 - DNA, 660 bp, Unknown
  Obtained from environmental sample
  misc_feature (1)..(660): n is a, c, g, or t
atgattttcgatgcaagaaatcatgctaaagctaacaatgcgtatacggatgaaattaaaaaagaaactgaaaagttgattataaatttagaagaagattatcatgctaccatcgaaaatattggacaaaaatatttacaattaatcctcgaaaagaaaatagattttttttcgaatcaagatagcagaaacgaattttcatactacttaactacacaatatatgagaacaaaacaaataagaaatagtgtagctaggtcagttggagataaaaataaagttgatattacaaagatttggcctattctatctcatatctttgctactaatatgggacatagtcttgcctcttcaaaagattataaaatcaaattattagaaaataagagcaaaaatagttttataacaggtgatcaacctgttataaatacttttgcatataataaaaaaactgatgaacaagtagatgaattagaattttactatccaatctcaccagaacttgctattttaataacccagaacgatgaacttgatactactcaaattatttcagacattaacgaaataaatcattataatgaaatgatttttaaatctagtgaagaacaaatatatgctagttcagaacaagaccttgaaggttatgagtatgtataa

SEQ ID NO: 14732 - protein, 219 aa, Unknown
  Obtained from environmental sample
  misc_feature (1)..(219): Xaa is any amino acid
MIFDARNHAKANNAYTDEIKKETEKLIINLEEDYHATIENIGQKYLQLILEKKIDFFSNQDSRNEFSYYLTTQYMRTKQIRNSVARSVGDKNKVDITKIWPILSHIFATNMGHSLASSKDYKIKLLENKSKNSFITGDQPVINTFAYNKKTDEQVDELEFYYPISPELAILITQNDELDTTQIISDINEINHYNEMIFKSSEEQIYASSEQDLEGYEYV

SEQ ID NO: 14733 - DNA, 828 bp, Unknown
  Obtained from environmental sample
  misc_feature (1)..(828): n is a, c, g, or t
ttgaaatataaaaaatttattttaatattcttaatatctattttaataattatgatttgtttgtcagttgtaaattttattgtagatcctttatatacattcaaggctacaaataatattgatatcaaacaaaaagattttaacgaaagagttcaaaaaacgaattatctcaaatttataaattcagattttgattctttattgcttggaagtagtcgtgcgacatatattaatacaaaaagtctgcatgataaagtttttaactttgctgttaacgcaatatctgttgacgaatatgataatataatacaaaattttattcaaataacaggcaatatccctaaaaaaatttatataggtgttgatcctttttctttcggtagtgtacaaaatgttcaggtcaaaaaagctttaaaaaacacagaagatatattttatccttataaaagtttaatttctctggatatatttacagtgtcattaaagaatctcgtgtttacatataaattcaatcgaaatatgtatgacagaaaacaaaggttttatgataaaaacatgctaaaaggtattcaagttaaaaataatatttcaaacgaacgatatattttagcttcacaaggatacattttaaaaatacaaaataatattaatttaaaagttcttcaaaatctaaaaaaaaagtatagaaaaagtaaatttgtaatttttacaatgcccgttcataatgtgatatataaagatataaaagatcaaaaaaattattctttatggcttgaaagtttggttgaaatttttggtaaagtttatcacttcatgtatgaaaaatga

SEQ ID NO: 14734 - protein, 275 aa, Unknown
  Obtained from environmental sample
  misc_feature (1)..(275): Xaa is any amino acid
MKYKKFILIFLISILIIMICLSVVNFIVDPLYTFKATNNIDIKQKDFNERVQKTNYLKFINSDFDSLLLGSSRATYINTKSLHDKVFNFAVNAISVDEYDNIIQNFIQITGNIPKKIYIGVDPFSFGSVQNVQVKKALKNTEDIFYPYKSLISLDIFTVSLKNLVFTYKFNRNMYDRKQRFYDKNMLKGIQVKNNISNERYILASQGYILKIQNNINLKVLQNLKKKYRKSKFVIFTMPVHNVIYKDIKDQKNYSLWLESLVEIFGKVYHFMYEK

SEQ ID NO: 14735 - DNA, 672 bp, Unknown
  Obtained from environmental sample
  misc_feature (1)..(672): n is a, c, g, or t
atgtttattgacagggaaagggaagctcaggctctcaaggcaatggctgaaaaagaaataacttcaaactttattaaatatcttccaaaaagaagggttacaattgtagattttattattggaagtaaaactctttgtagtgatgatttcaataatcctgaactctggccgttacttgttgaaccaattataaaaacacacaaaagcggtgttaaagttaatggtacattcaaccctatggaaagaatccacaaaatgaaatctattcttgatggatttggaaaagaatatcctgaacttgatcttgaagggacaattaaaaaacttgaaaaaattgacagaattatcggtataagtgaaaaggattatgtaattacacataatgaccttcttgctgaaaactttatgcttattacagatgaatataaggataaatatacaaacagtgtttatcttattgactgggaaaactctgcaatgggaccaaaatattacgaccttgccgttactttccaggaaactcttgtagagcggaatgttcagaaagagattgtaatggtatattgcgaaggaaaggattttgaaaaaactctgtttaacattgatatgtttaaaccattcagtgaaacatactggacaatctggagtcttattcagatgaattctctctga

SEQ ID NO: 14736 - protein, 223 aa, Unknown
  Obtained from environmental sample
  DOMAIN (1)...(221): Choline/ethanolamine kinase
  misc_feature (1)..(223): Xaa is any amino acid
MFIDREREAQALKAMAEKEITSNFIKYLPKRRVTIVDFIIGSKTLCSDDFNNPELWPLLVEPIIKTHKSGVKVNGTFNPMERIHKMKSILDGFGKEYPELDLEGTIKKLEKIDRIIGISEKDYVITHNDLLAENFMLITDEYKDKYTNSVYLIDWENSAMGPKYYDLAVTFQETLVERNVQKEIVMVYCEGKDFEKTLFNIDMFKPFSETYWTIWSLIQMNSL

SEQ ID NO: 14737 - DNA, 864 bp, Unknown
  Obtained from environmental sample
  misc_feature (1)..(864): n is a, c, g, or t
ttgaaaaagatcctcataatacgatttagttccattggtgatattgtcctcacaactcctattatcagagccattgatgagcaaacagattacgaaatacatgttctcacaaaacattcatacaaaggcttatacgaagtcaatccgagaataaacaaggttcattcgtttattaagtcaacttcggaatgtttaccagatcttagaaaagaaggattcgacactattgtagatcttcaaaaaaacatgagatcgcacaagcttaagaaaaagctcaaagtacccagttactcttttccaaaactaaatataaagaaatggttattagttaatttcaagattaacagaatgcccaaaatccatattgtagaacgttattttgaagctgtatcaaatataggcgttaaaaatgacggcaaaggacttgaatactatattcctgcggatgatgaagttgccccagagagtattgatctcaggcttaaagaaccttttattagtattgtaattggcggacaacataaaacaaaaattctacctcctgaaaaaatagttcaaataatctcagaaattaaaatgccagttgttcttcttggaggaaaagaagacaaaaaaagaggagaggaaatagttaagttggctccaaattatgacattattgttacttgtggtgagatgaatttaaatcagtcagcttcaatgctacaatcttctgaagttgttataaccaacgacaccgggttaatgcacattgccgcagcacttaacaaaaacatcatcagtatttggggtaatacagttcctgaatttgggatgtatccatatatgcctgagaataaagatagtttattatttcagaagtat

SEQ ID NO: 14738 - protein, 288 aa, Unknown
  Obtained from environmental sample
  DOMAIN (54)...(288): Glycosyltransferase family 9 (heptosyltransferase)
  misc_feature (1)..(288): Xaa is any amino acid
MKKILIIRFSSIGDIVLTTPIIRAIDEQTDYEIHVLTKHSYKGLYEVNPRINKVHSFIKSTSECLPDLRKEGFDTIVDLQKNMRSHKLKKKLKVPSYSFPKLNIKKWLLVNFKINRMPKIHIVERYFEAVSNIGVKNDGKGLEYYIPADDEVAPESIDLRLKEPFISIVIGGQHKTKILPPEKIVQIISEIKMPVVLLGGKEDKKRGEEIVKLAPNYDIIVTCGEMNLNQSASMLQSSEVVITNDTGLMHIAAALNKNIISIWGNTVPEFGMYPYMPENKDSLLFQKY

SEQ ID NO: 14739 - DNA, 888 bp, Unknown
  Obtained from environmental sample
  misc_feature (1)..(888): n is a, c, g, or t
gtgttttttataaagactgttttcatcactgcatacaaaattccatctgaatcgatgttgccaactatttgccctggagattggatttgtgtggataaatttggttatggtggggcgcaaaatttactgggaaagcaatatcaattaccaaagtttagagatgtagaacgaaatgatattatagtgtttcattttccagagggggatactgttttaaagaataatccagttagaaactattatgaattaaaacgctggctgaagtatcaggggaaaatgaatgaattaccattttatggagatagagcatatttacctctaaattatcgtatcgcatatgtgaaaaggtgtataggtttaccaggtgatatgctatctatctgtaatggatgtgttaaaattaatggacagttgaaagaagagaagattgatataaagcgtttgtatgaaatctatggaaaagttaagaaagattcaattgtcgcaaatttgcaggattctatttttaatggatggtataaaaatcaaagtacagttgtagctatgtcggaaaaagagaaagggatggtcttaaaattacagggtatagatagccttaatagggttcttgatttgcgcttttacatgagtcgtttcccttttgttgaaggcaatgagaaatattggtcttcggataattatagttctatttatattccaaaagctggagctactataaatttatctctcgaaaacttacctatttattctcgaattattgaagtgtatgaaaaaaacgcactaaaatgtgtaaacgcagatatttatatcaacggtaaaattgttacgcaatatacgtttcaagagaactattattttgtaatgggagaaatcgttcatttttcatga

SEQ ID NO: 14740 - protein, 295 aa, Unknown
  Obtained from environmental sample
  DOMAIN (13)...(137): Peptidase S24-like
  misc_feature (1)..(295): Xaa is any amino acid
MFFIKTVFITAYKIPSESMLPTICPGDWICVDKFGYGGAQNLLGKQYQLPKFRDVERNDIIVFHFPEGDTVLKNNPVRNYYELKRWLKYQGKMNELPFYGDRAYLPLNYRIAYVKRCIGLPGDMLSICNGCVKINGQLKEEKIDIKRLYEIYGKVKKDSIVANLQDSIFNGWYKNQSTVVAMSEKEKGMVLKLQGIDSLNRVLDLRFYMSRFPFVEGNEKYWSSDNYSSIYIPKAGATINLSLENLPIYSRIIEVYEKNALKCVNADIYINGKIVTQYTFQENYYFVMGEIVHFS

SEQ ID NO: 14741 - DNA, 306 bp, Unknown
  Obtained from environmental sample
  misc_feature (1)..(306): n is a, c, g, or t
atgaaattaataaattattacaatattattttattaagcttattgtgctcttgttcttcacctgttgataaagcattaaatttatcaggtgaaaatgaagaggaactttgtagtgttctcgattattataaagaacaaaaggattctaatatgtataagtcagcagagttcttaattcaatatatgccttatcatttttcagtgaattggcatgacgagttaaataattcctttttaccagctgagtgtaagaatgtaccagatgtaaaaagaaaatggattctatggactctcgagccgatctga

SEQ ID NO: 14742 - protein, 101 aa, Unknown
  Obtained from environmental sample
  misc_feature (1)..(101): Xaa is any amino acid
MKLINYYNIILLSLLCSCSSPVDKALNLSGENEEELCSVLDYYKEQKDSNMYKSAEFLIQYMPYHFSVNWHDELNNSFLPAECKNVPDVKRKWILWTLEPI

SEQ ID NO: 14743 - DNA, 522 bp, Unknown
  Obtained from environmental sample
  misc_feature (1)..(522): n is a, c, g, or t
ttgcaggattctatttttaatggatggtataaaaatcaaagtacagttgtagctatgtcggaaaaagagaaagggatggtcttaaaattacagggtatagatagccttaatagggttcttgatttgcgcttttacatgagtcgtttcccttttgttgaaggcaatgagaaatattggtcttcggataattatagttctatttatattccaaaagctggagctactataaatttatctctcgaaaacttacctatttattctcgaattattgaagtgtatgaaaaaaacgcactaaaatgtgtaaacgcagatatttatatcaacggtaaaattgttacgcaatatacgtttcaagagaactattattttgtaatgggagacaatcgttcattttcaatggatagccgtaattggggcttcgtacctgaaggtcacttaatagggaaagcacaaggggtagtctggagttcaaagaaaaatcaatcgaataaaattcgatgggatcgaattggaaagttttga

SEQ ID NO: 14744 - protein, 173 aa, Unknown
  Obtained from environmental sample
  misc_feature (1)..(173): Xaa is any amino acid
MQDSIFNGWYKNQSTVVAMSEKEKGMVLKLQGIDSLNRVLDLRFYMSRFPFVEGNEKYWSSDNYSSIYIPKAGATINLSLENLPIYSRIIEVYEKNALKCVNADIYINGKIVTQYTFQENYYFVMGDNRSFSMDSRNWGFVPEGHLIGKAQGVVWSSKKNQSNKIRWDRIGKF

SEQ ID NO: 14745 - DNA, 429 bp, Unknown
  Obtained from environmental sample
  misc_feature (1)..(429): n is a, c, g, or t
atgtttaaaggcgacagagatttatgggaaactttgctgggcaattgtgacagcgtcctttatttaggcggtaatgagcatagcacccatgaggttatttccaaaatgctgggcaaagcaacgattgacacacgcagttacggacattcaaaaggacggaatggaaactattcaaccaacaaacagattattggacgtgaactgttattacctaatgaagtcagagaactcgacaatgattatggcattttgttcattaaaggcgcaaaacctgtttgggataaaaagttcaggcttgaagcacaccgaaaaaaccacttaacagcaaacgggaaaggtacaccctatatacataggcataggattaagacaaaagcgtttgaggactttgattttgagaacgctgaatactacgaggtaatagagtag

SEQ ID NO: 14746 - protein, 142 aa, Unknown
  Obtained from environmental sample
  misc_feature (1)..(142): Xaa is any amino acid
MFKGDRDLWETLLGNCDSVLYLGGNEHSTHEVISKMLGKATIDTRSYGHSKGRNGNYSTNKQIIGRELLLPNEVRELDNDYGILFIKGAKPVWDKKFRLEAHRKNHLTANGKGTPYIHRHRIKTKAFEDFDFENAEYYEVIE

SEQ ID NO: 14747 - DNA, 777 bp, Unknown
  Obtained from environmental sample
  misc_feature (1)..(777): n is a, c, g, or t
gtgaccaaagatttagagaataagatcatatccatgtacgcaaagggaatgactactggtgatatggaaacccacatcagagagctttacggtcttgaaatatcagatagtacaattagcagaataacagatagagttctgccaatagcaaaagactggcaagcaagaccgcttgaagatatctacgcagtggtttttctggatgccatacactatcacgtcaaacaggatggcagatcgataaaaaaagctgtatacatagcgataggcattaatttagacggcgaaagagacgtattagggctttggataggcgaaaatgagagctctaagttctggttaggtgttttaaacgagataaagaacagaggtgtagatgatatactaatcgcttgtgtggatggattaagcgggtttagtgaggctatatcagcagcatatccaaaaacggagattcaaaaatgtgtcattcatcaaattagaaacagcaccaaatttgtttcctacaaagatattaaaaagttgatggcagctttgaagaaagtatacaaagcgccaacagaacaagaggcgttaataaatctcgattcatttgaagaaatttggggcaaaaaataccccaaaatcgctatatcttggcgcaaaaactgggctgaattatcgacatattttaagtatccagaatcggttaggaagctaatttatacgactaatgcaatagagagctttaaccgccaacttagaaaagtacgaagaacagggtgtatttcccactga

SEQ ID NO: 14748 - protein, 258 aa, Unknown
  Obtained from environmental sample
  DOMAIN (1)...(258): Transposase, Mutator family
  misc_feature (1)..(258): Xaa is any amino acid
MTKDLENKIISMYAKGMTTGDMETHIRELYGLEISDSTISRITDRVLPIAKDWQARPLEDIYAVVFLDAIHYHVKQDGRSIKKAVYIAIGINLDGERDVLGLWIGENESSKFWLGVLNEIKNRGVDDILIACVDGLSGFSEAISAAYPKTEIQKCVIHQIRNSTKFVSYKDIKKLMAALKKVYKAPTEQEALINLDSFEEIWGKKYPKIAISWRKNWAELSTYFKYPESVRKLIYTTNAIESFNRQLRKVRRTGCISH

SEQ ID NO: 14749 - DNA, 888 bp, Unknown
  Obtained from environmental sample
  misc_feature (1)..(888): n is a, c, g, or t
atgaataccaagatacaaacccctttacaagggaaaattttagatggatttaaacctcaaagtttattttgtgtaggagattatgaccaaagtatttatgcttttaatggaagtgatatcaatattatctcttcttttgatgaaagatacccaaatgcaactatctatacactcaataaaaactaccgctcaactgcaaatatattaaatctagcaaatcgagtaatcgaacataatccaagaatatatgaaaagtcacttcaagttgtaagaaatgcccctaatcaacatatacctcaacttctaaaatttgatgaactttatatccaatatgaatttatatcgaaacagatacttaaaagtaccaatgctaaagatgatattgcgattatttataggaataactctagtgcggatggtattgaagccaacttacgagagatggggatagattgtaaacgaaaaggtggtcatagtttttttgattcacgagagataaaagtgatacttgatcttatggttttaatggtaaagcaaaatgatatgatggcatttatccatatagttgagtatggaaaaaatataggaaaagcaatagccaaagatatatttgaagcacttttacgaataggacatggaaatatttttcatggacttttaaatcctgacaacactattatcaaaccatataaaagtaataaaacaaccaatgtacaacttggactttttgatgattttattgagatgggaagtactgcaaagtttaaagatttaggttgggaaactaagtttttaaataactcgattttaaaacatccaaaacttactttagaggggggaaatatttttatacgacttctatactttattaaaagaagtaaaaaggat

SEQ ID NO: 14750 - protein, 296 aa, Unknown
  Obtained from environmental sample
  DOMAIN (1)...(260): UvrD/REP helicase
  misc_feature (1)..(296): Xaa is any amino acid
MNTKIQTPLQGKILDGFKPQSLFCVGDYDQSIYAFNGSDINIISSFDERYPNATIYTLNKNYRSTANILNLANRVIEHNPRIYEKSLQVVRNAPNQHIPQLLKFDELYIQYEFISKQILKSTNAKDDIAIIYRNNSSADGIEANLREMGIDCKRKGGHSFFDSREIKVILDLMVLMVKQNDMMAFIHIVEYGKNIGKAIAKDIFEALLRIGHGNIFHGLLNPDNTIIKPYKSNKTTNVQLGLFDDFIEMGSTAKFKDLGWETKFLNNSILKHPKLTLEGGNIFIRLLYFIKRSKKD

SEQ ID NO: 14751 - DNA, 459 bp, Unknown
  Obtained from environmental sample
  misc_feature (1)..(459): n is a, c, g, or t
atgaaaattgacaaaattgacgaacagattatagccattcttcaaaaagatgcaaaatcaaatgtgaaatctattgcggatcaactcaatatgaccaaaacaccgatttatgagcgcataaaaaagttagaaaatgaaggtatcattgaaaaatacgtagcggttgtaaatcgtcaaaaattaaaagggggaatgttcgttttttgctcggtatccttagaagttcaaaaactagaacatattgagcgatttaaggcagagatttcagagattcctgaagttatggaatgttacttaatgggtggagctaatgattttttattaaaactacacgtcagtgatttaaatgcttatcatcaattctcatctggaaaacttgcagcattagacaatgtgagtcagatcaaaagtacttttgttttggatgtagtgaagaaggaaagtgcaatagaggtttaa

SEQ ID NO: 14752 - protein, 152 aa, Unknown
  Obtained from environmental sample
  DOMAIN (27)...(130): AsnC family
  misc_feature (1)..(152): Xaa is any amino acid
MKIDKIDEQIIAILQKDAKSNVKSIADQLNMTKTPIYERIKKLENEGIIEKYVAVVNRQKLKGGMFVFCSVSLEVQKLEHIERFKAEISEIPEVMECYLMGGANDFLLKLHVSDLNAYHQFSSGKLAALDNVSQIKSTFVLDVVKKESAIEV

SEQ ID NO: 14753 - DNA, 321 bp, Unknown
  Obtained from environmental sample
  misc_feature (1)..(321): n is a, c, g, or t
ttgaagaatggctataatctgttcgtcaattttgtcaattttcattttgtgaatgttttattaggaatatttccccttccaattaatgaaagaagtcattacagtattattttccttgtttgtatcanatatcgggaaaatatactgtatttatataaaacatataacttttgtcttataaaaattaactttgtaagaaatattaaaacgattgaaatgagccataaattcaaaccagaaagtttaatgatgacacatggntataagcctgagttgtctgaaggagcaatcaaatgtccaatttttcaaacatcaactttt

SEQ ID NO: 14754 - protein, 107 aa, Unknown
  Obtained from environmental sample
  misc_feature (1)..(107): Xaa is any amino acid
MKNGYNLFVNFVNFHFVNVLLGIFPLPINERSHYSIIFLVCIXYRENILYLYKTYNFCLIKINFVRNIKTIEMSHKFKPESLMMTHGYKPELSEGAIKCPIFQTSTF

SEQ ID NO: 14755 - DNA, 444 bp, Unknown
  Obtained from environmental sample
  misc_feature (1)..(444): n is a, c, g, or t
atgaaaaaaagaatacacaaaaaacctcctcgaagattaaaatctaaaaagaaatcttaccaaaaaattataacaatattaacgacaatagtggttactatttttttagcatctattattggtgcatatctatttgtggataaaaaagagatagtagtagatatacaacaagaaaaaaatacaatattacaacaaaataaaaaattaataacatttgaagagaaaacaaaagcactagagatagaatatgctaaaaatacagataataatacttatatagaaaaaaaagaaccaaaaaaacaacaacaaagatttcactttgaagagccagactatggagaagtgggagatattcaacatcaacaaatacaacaaccaaaaattgatacaaaagaagagccaacaaaaactgtagctcagcgatctgatcttgcttttttttag

SEQ ID NO: 14756 - protein, 147 aa, Unknown
  Obtained from environmental sample
  misc_feature (1)..(147): Xaa is any amino acid
MKKRIHKKPPRRLKSKKKSYQKIITILTTIVVTIFLASIIGAYLFVDKKEIVVDIQQEKNTILQQNKKLITFEEKTKALEIEYAKNTDNNTYIEKKEPKKQQQRFHFEEPDYGEVGDIQHQQIQQPKIDTKEEPTKTVAQRSDLAFF

SEQ ID NO: 14757 - DNA, 726 bp, Unknown
  Obtained from environmental sample
  misc_feature (1)..(726): n is a, c, g, or t
atgaaaaaagctaaagatgaatttaactttgtctttactttggcaactgataaatttaaaactaaagttgctgcagttatcaaaacagagacacatattactgatgattatggagcagctgaacgtataaaatcgatagtgcataatagaaaattacgctcaggactgatgattgatttttttgaagatgatttagatgaagagatagataagtttttaacacatttcaaaaaatatggtactttaagtgagccgtataagatgatgatcgcattagcacttcctcgtaagcctcccaaaaatgactctattatttatcattatcaggcagaaaaagatggtaaaaaagcccaagtagacggcgttgagataaaagagcttattttggaatattcaaaagagcaatatggtgaagatggtagaggttgtgatggaaaattcattgagtcacaagaaccaaatattaaatatgacaagtatataaaaattgatgatagcattacagctgtagagaatgaaacttctatcaaatatttttccaatatagatggttatgtcaaacatactagtggaaatatatcaatctcaaaagagctagagctaaaaagtgcaactcttacaaggtactggttcacattaaaccagggtgagacaaaagatcttattattaacatagaaggaagtgattgcgcttcagacgatcatgttgccactggtgtcaattag

SEQ ID NO: 14758 - protein, 241 aa, Unknown
  Obtained from environmental sample
  misc_feature (1)..(241): Xaa is any amino acid
MKKAKDEFNFVFTLATDKFKTKVAAVIKTETHITDDYGAAERIKSIVHNRKLRSGLMIDFFEDDLDEEIDKFLTHFKKYGTLSEPYKMMIALALPRKPPKNDSIIYHYQAEKDGKKAQVDGVEIKELILEYSKEQYGEDGRGCDGKFIESQEPNIKYDKYIKIDDSITAVENETSIKYFSNIDGYVKHTSGNISISKELELKSATLTRYWFTLNQGETKDLIINIEGSDCASDDHVATGVN

SEQ ID NO: 14759 - DNA, 543 bp, Unknown
  Obtained from environmental sample
  misc_feature (1)..(543): n is a, c, g, or t
ttgaacacttttcctgattctaatgataaaaaacataaagacattgtaaacctagttgacataaattttattttattctataatctcaaagtatatcacgaaatgataaataacttaataaaaggaaaaactatggatttaaaaaataaaatagcacttgtaacaggagcaaatggtggacttggtgttgctattgtaaaagaatttctagaaaataatataagaaaaatatattgtggtgttagagatactcaaaaagctaaatttttagaagagttatcaaataaaattgttttaatagaattagatttatcaaatcatacgatgttagaaacaaatatgaaaaagatagaaaatatagatttacttatcaataatgcaggggtaaatagtggcaaaagagtatttgatgatgaaaatagtgattttactattaatgtgcaagggacactaaaagtaacacaactattatcaaacaagataaataaagatggtgcaataataaatatcacttctatattagcacttgactctgagccataa

SEQ ID NO: 14760 - protein, 180 aa, Unknown
  Obtained from environmental sample
  misc_feature (1)..(180): Xaa is any amino acid
MNTFPDSNDKKHKDIVNLVDINFILFYNLKVYHEMINNLIKGKTMDLKNKIALVTGANGGLGVAIVKEFLENNIRKIYCGVRDTQKAKFLEELSNKIVLIELDLSNHTMLETNMKKIENIDLLINNAGVNSGKRVFDDENSDFTINVQGTLKVTQLLSNKINKDGAIINITSILALDSEP

SEQ ID NO: 14761 - DNA, 432 bp, Unknown
  Obtained from environmental sample
  misc_feature (1)..(432): n is a, c, g, or t
atgtcaactaggtttacaatgtctttatgttttttatcattagaatcaggaaaagtgttcaataaagttatcttagaaagattacaaaaaaaaggttttcaaggacttagtgaagctctcattgttcttttcccatatattgaccaagcacaaaatatctctatttctgaactttcacgacaagttggatactcaagacaagctatgcataaaaatattaaaaaacttaaagagctaggatatattaccctctctttagaaaatcaaaaagagaaaactgtacattttacttctaaaagtaaacagcttatgattgaagcaaataagattatacaagagattgaaagcgaattaagttcacttcttggaaaagaggaattagatagttataggataaatcaagagaagatttacaactatttaacctcttta

SEQ ID NO: 14762 - protein, 144 aa, Unknown; identical to SEQ ID NO: 13890
  Obtained from environmental sample
  DOMAIN (36)...(137): MarR family
  misc_feature (1)..(144): Xaa is any amino acid

SEQ ID NO: 14763 - DNA, 435 bp, Unknown
  Obtained from environmental sample
  misc_feature (1)..(435): n is a, c, g, or t
atgtcaactaggtttacaaggtctttatgttttttatcattagaatcaggaaaagtgttcaataaagttatcttagaaagattacaaaaaaaaggttttcaaggacttagtgaagctctcattgttcttttcccatatattgaccaagcacaaaatatctctatttctgaactttcacgacaagttggatactcaagacaagctatgcataaaaatattaaaaaacttaaagagctaggatatattaccctctctttagaaaatcaaaaagagaaaactgtacattttacttctaaaagtaaacagcttatgattgaagcaaataagattatacaagagattgaaagcgaattaagttcacttcttggaaaagaggaattagatagttataggataaatcaagagaagatttacaactatttaacctctttatag

SEQ ID NO: 14764 - protein, 144 aa, Unknown
  Obtained from environmental sample
  DOMAIN (36)...(137): MarR family
  misc_feature (1)..(144): Xaa is any amino acid
MSTRFTRSLCFLSLESGKVFNKVILERLQKKGFQGLSEALIVLFPYIDQAQNISISELSRQVGYSRQAMHKNIKKLKELGYITLSLENQKEKTVHFTSKSKQLMIEANKIIQEIESELSSLLGKEELDSYRINQEKIYNYLTSL

SEQ ID NO: 14765 - DNA, 549 bp, Unknown
  Obtained from environmental sample
  misc_feature (1)..(549): n is a, c, g, or t
atgaatactattataaaaatagcatggagaaatatctggcgcaataaaaggcgtaccttaattacgatagcttctatcatgttcgccctgttctttgcgatcatcatgcgtggatttcaagtaggttcctatgccaagatgaaagaaaatgcgattgaatcctattcgggttatatccaaattcaaaaaaagggatattgggatgataagaatatcaataatgtttttccttttgatcaacaaaagattgaagattttgaatctgattcaagaataaaaaatattatacccagattagagtcttttgctttggcttcttcaggagatgctaccaaaggtgttgcagtaatgggaatttctcctgaaaaggaaaacagaatgaccaaaataaaatcatatttacagcaaggtgaatttattgatactgatgatagatctgttttggttgccaaagaactggcggaattcttaaaaataatatcaatgatactttggtcttgttctcttccggatatcacggagcaacagctgcaggattatttcatgtaa

SEQ ID NO: 14766 - protein, 182 aa, Unknown
  Obtained from environmental sample
  misc_feature (1)..(182): Xaa is any amino acid
MNTIIKIAWRNIWRNKRRTLITIASIMFALFFAIIMRGFQVGSYAKMKENAIESYSGYIQIQKKGYWDDKNINNVFPFDQQKIEDFESDSRIKNIIPRLESFALASSGDATKGVAVMGISPEKENRMTKIKSYLQQGEFIDTDDRSVLVAKELAEFLKIISMILWSCSLPDITEQQLQDYFM

SEQ ID NO: 14767 - DNA, 642 bp, Unknown
  Obtained from environmental sample
  misc_feature (1)..(642): n is a, c, g, or t
atgaacttagaagatttagaattagatattgctaaagaagtactgaatgtaggtttaggaaaagcagctgattcaattgcattttttacccatgataaagtggtaataagaagtcttgatttacaaattaaagctcctcataaagtaatatatgatatatctaataaaagagaagatgaaaatctttatgtgctttccacagaacttttaggagaaatgaaaggagtctgttatttaattttctcagaagaagaggtaaataaactttggcaagtttgtttgccagaatcgataagaaataatcctgaagtatttaaagaaatgggagaggctgtattgttagaaatggacaatattattgtagcatctgttgtaactcagttctcaaatttttttaaatataaaatgtatggagatgttccaaatctatcaaaaactatttcaaagggacttgagcaaattatttcatcagcaaatagatgtagtaattactgtttattttttagatcggagtttataaccagcaacctgcaaattaacccagaatttgtgtggttaatagatgaaaaatactttgaaggagttaaagttttagctcaagatgataatgcaatttctcaattattaaacaagaatgcctaa

SEQ ID NO: 14768 - protein, 213 aa, Unknown
  Obtained from environmental sample
  misc_feature (1)..(213): Xaa is any amino acid
MNLEDLELDIAKEVLNVGLGKAADSIAFFTHDKVVIRSLDLQIKAPHKVIYDISNKREDENLYVLSTELLGEMKGVCYLIFSEEEVNKLWQVCLPESIRNNPEVFKEMGEAVLLEMDNIIVASVVTQFSNFFKYKMYGDVPNLSKTISKGLEQIISSANRCSNYCLFFRSEFITSNLQINPEFVWLIDEKYFEGVKVLAQDDNAISQLLNKNA

SEQ ID NO: 14769 - DNA, 651 bp, Unknown
  Obtained from environmental sample
  misc_feature (1)..(651): n is a, c, g, or t
atgattatgaaaaaaaatacaattaacggaaatacattgattgatttgggatatactcctgataaatggtttaaagatgcgataaatcacattaatgaaaatcaactttctagagaagctatgtatgaatatttagagcaattcaaaccagagccagtaacaaaacttcataaggattctgttcaattttctgtaaacattaaggctatgaacgaaatggaaaaagtaaatgtggattcagtaattcgaactatgaaagaagttatgaagactccaacagttgtaggtggaactataatgcctgacgcttgtccaactggctcagtaggaactattcctgttggaggggttgtggcaactaagaatgctattcatcctggaatgcacagtgctgatatttgttgttcagttatgttgactgattatggaaaagtaaatccaaaagcaattttggatgcagcacaattatctactcattttggaccagaaggaagagatcggtcaaatcaatatcgatttccgtcagacttgttaaaagcctttgaaaaaaatgatatgctaaatgatcatcaaatgataaaaatagcaagatcacatcttggaacccaaggagatgggaatcatttcttatttgttggacaatcaaagtaa

SEQ ID NO: 14770 - protein, 216 aa, Unknown
  Obtained from environmental sample
  misc_feature (1)..(216): Xaa is any amino acid
MIMKKNTINGNTLIDLGYTPDKWFKDAINHINENQLSREAMYEYLEQFKPEPVTKLHKDSVQFSVNIKAMNEMEKVNVDSVIRTMKEVMKTPTVVGGTIMPDACPTGSVGTIPVGGVVATKNAIHPGMHSADICCSVMLTDYGKVNPKAILDAAQLSTHFGPEGRDRSNQYRFPSDLLKAFEKNDMLNDHQMIKIARSHLGTQGDGNHFLFVGQSK

SEQ ID NO: 14771 - DNA, 849 bp, Unknown
  Obtained from environmental sample
  misc_feature (1)..(849): n is a, c, g, or t
atgaaatatttaggttatgacacagaatataagaaatatgaattagataattatagtgataataagatagaaaagctaaatatggaagaagtgaaaaatattaaatatataagaagcgatggtgttaaagctaatatggaagcgaaaaaaatattttatcaaaagataataacaagcctcaaaggattttggttgaaagagttggcacctattggcttaacagtatatggaagattggagcatactaaaaaagctgtagaagcattacagaaaaatactttagctaaggaaagtaaattatatattttttcagacgggccaaaatatggtgatgaagaaaaagtaaaagctatgagagagtatcttaaaactatagatggttttaaggaaattgagattatagaaagactagataataatagaattaagaacaatagaggtggacaaaaataccttttagaaaaatatgataagatgatatggatggctgaagatatagttacagcatcaggttatttgcaatttatgaatgatgggttagaaatatataaagacaaaaatgagattttaagcataacaggatatggactaccaattattattcataatattgaatatgattcttatgttttgcaaagatttaatgcttggggtattggcatatggaacaaaaaatatgatcaagtcaaatatataagcttggaagaatacattgagtttataaatgataatccgcaagtaacagaatttgtaaaaagtggtgctgacatgctgaacatgcttgaagtagcacgtagaaaacaaatgatgcttttgacattagagcgatgtattgtcaatttaaaataa

SEQ ID NO: 14772 - protein, 282 aa, Unknown
  Obtained from environmental sample
  misc_feature (1)..(282): Xaa is any amino acid
MKYLGYDTEYKKYELDNYSDNKIEKLNMEEVKNIKYIRSDGVKANMEAKKIFYQKIITSLKGFWLKELAPIGLTVYGRLEHTKKAVEALQKNTLAKESKLYIFSDGPKYGDEEKVKAMREYLKTIDGFKEIEIIERLDNNRIKNNRGGQKYLLEKYDKMIWMAEDIVTASGYLQFMNDGLEIYKDKNEILSITGYGLPIIIHNIEYDSYVLQRFNAWGIGIWNKKYDQVKYISLEEYIEFINDNPQVTEFVKSGADMLNMLEVARRKQMMLLTLERCIVNLK

SEQ ID NO: 14773 - DNA, 582 bp, Unknown
  Obtained from environmental sample
  misc_feature (1)..(582): n is a, c, g, or t
atgtattgtcaagttaaaaataatatgtatactgtttatccattaaaatcaatggtccaaaatataggtcatgatggtagtggtgtgcattgtggagtaactgataagtttaatcataaagagttatgggataaaactgataattttgtatttagtgaggatataaagctaaaccaacatatcgtaaaagaaaattttgattttagatttagtatgaataaatatacaaaagagttaatcattaatgatttagtaagtaagatagagagtcttgatgcagatagcttttccatatatggtatcggcgagttgacaaacctactgatagcaagattattcgtgatcggtagtaataaaaagataacatattttattgattcagatgcagataaaaagcaaatatttgtttatgaaaaacaggctgttactcctaagcaagctattgaaaatggtgaacatagttttgttatactatcttggaatcatagggagttactgaaaaatagtttattaaatcttgtagataatatttcagcaataaatgtgttagtaccagagattttaaagttggagaatatatga

SEQ ID NO: 14774 - protein, 193 aa, Unknown
  Obtained from environmental sample
  misc_feature (1)..(193): Xaa is any amino acid
MYCQVKNNMYTVYPLKSMVQNIGHDGSGVHCGVTDKFNHKELWDKTDNFVFSEDIKLNQHIVKENFDFRFSMNKYTKELIINDLVSKIESLDADSFSIYGIGELTNLLIARLFVIGSNKKITYFIDSDADKKQIFVYEKQAVTPKQAIENGEHSFVILSWNHRELLKNSLLNLVDNISAINVLVPEILKLENI

SEQ ID NO: 14775 - DNA, 600 bp, Unknown
  Obtained from environmental sample
  misc_feature (1)..(600): n is a, c, g, or t
gtgtatgatacaaaaaatggcggtaaatctactattacactagaacactatagcacatttgattacggtgatatttttgcatttgctgattactctattgcagatgaaagatttaaataccaagacacaaaaaatgatttttactatgaaatatcgccaagaatcagtttaagtagagtgagcggcactgacttgtctagtacatttgtaaaagatacctatctcacttttcaatataacagaggtgaagagtataaagcatatttgagtggtgtaggcttggattttattacaccgttctttgatatttttggagtaaatatatatataaaaaatcaaaatatcggagataatacactccaactttcacttaactattttaaggcttctatctttcaaagtggatttgattttagcggatttactgactggactaaagaagattttctatcacaaaatcaactcctgtatgacgtgtctaaaatagtagatatagataaaaaaagtttttttggtggagtagagtggcactactacagagttaaaaagagtaatgtactatctaacactctgcaactgatggttaaatatatttggtaa

SEQ ID NO: 14776 - protein, 199 aa, Unknown
  Obtained from environmental sample
  DOMAIN (3)...(140): Nucleoside-specific channel-forming protein, Tsx
  misc_feature (1)..(199): Xaa is any amino acid
MYDTKNGGKSTITLEHYSTFDYGDIFAFADYSIADERFKYQDTKNDFYYEISPRISLSRVSGTDLSSTFVKDTYLTFQYNRGEEYKAYLSGVGLDFITPFFDIFGVNIYIKNQNIGDNTLQLSLNYFKASIFQSGFDFSGFTDWTKEDFLSQNQLLYDVSKIVDIDKKSFFGGVEWHYYRVKKSNVLSNTLQLMVKYIW

SEQ ID NO: 14777 - DNA, 429 bp, Unknown
  Obtained from environmental sample
  misc_feature (1)..(429): n is a, c, g, or t
atgtacttagatacgccaaataacgaaccattaaaaaagcgaaagctccttaaagattattttgattatcgtaataatcaagtaaaccaaatggggttaattttattttctgcgtttgtcattgccacgtctttacatttcttttttgaaaatcgatttacagaagaacaatggaaatctcgcccaatgacacgccataaaatggtggacgaccttattgatgatcatattttaattgataaatcgaaagaagatgttataaatttattaggcgaacccagttggattttaaaatctgataaagatattatgctatacgaattaggattagcacctaaccgagagaacaatcaagtggagcatctttatattcagtttattaatgataaagttaataaggtatccttagccgactatacttcaaaataa

SEQ ID NO: 14778 - protein, 142 aa, Unknown
  Obtained from environmental sample
  misc_feature (1)..(142): Xaa is any amino acid
MYLDTPNNEPLKKRKLLKDYFDYRNNQVNQMGLILFSAFVIATSLHFFFENRFTEEQWKSRPMTRHKMVDDLIDDHILIDKSKEDVINLLGEPSWILKSDKDIMLYELGLAPNRENNQVEHLYIQFINDKVNKVSLADYTSK

SEQ ID NO: 14779 - DNA, 561 bp, Unknown
  Obtained from environmental sample
  misc_feature (1)..(561): n is a, c, g, or t
ttggctcacacgcttcataaagaagattacatttccgatggaattccattaataaatccaactcatattattaaaggccaaattgtccctaacttaaacttaacgctaacattagaaaagtttgagtcactgcctaattatcacttaaagagtggtgacattatcatgggcagacgaggtgaaatgggacgaacagctttagttgatgactcatcaaaaggttggttctgtggtacgggtagcttatatattcgtccaaaatctaaactcattcagccagtatatttaaattctgttatgtcctgcagctcgatgaaatcgtggttagaagaacaatctttaggtgctacgatgcctaatttaaacaaaaaaatactacactcgattcaagttccaattccttcagaggctttgcagactaaatatacattagcattaaatgtattaaaaaatgagcatttagcccataagcagcattcaaaagagttggatttattatttagcgccctaatgcaaaaagctttcaatggcgagcttaacctcgataacgctaacacttaa

SEQ ID NO: 14780 - protein, 186 aa, Unknown
  Obtained from environmental sample
  DOMAIN (2)...(151): Type I restriction modification DNA specificity domain
  misc_feature (1)..(186): Xaa is any amino acid
MAHTLHKEDYISDGIPLINPTHIIKGQIVPNLNLTLTLEKFESLPNYHLKSGDIIMGRRGEMGRTALVDDSSKGWFCGTGSLYIRPKSKLIQPVYLNSVMSCSSMKSWLEEQSLGATMPNLNKKILHSIQVPIPSEALQTKYTLALNVLKNEHLAHKQHSKELDLLFSALMQKAFNGELNLDNANT

SEQ ID NO: 14781 - DNA, 396 bp, Unknown
  Obtained from environmental sample
  misc_feature (1)..(396): n is a, c, g, or t
atgacaaaaaatattttagacagatgtcttattaaagaagaaacattcaatcctgaaagtattggtggaaaaattgatgttactatcagacagcttacagcaggtgagggattagaataccaatctattttaagagatagtgaaaaaaaacaagaagatgcagtattttttgctgttaaatgtgcgatggtaaaaccaacttttttcacagatgaagaacttaaaaaagtaaatattactggaagaaatttaatctatgagattcatggaagacttccaactataggtatgacagtatcagaaaaaaaagagtatctcaaaaagcttcaagaattatcacagaaacttgaaaattctaaaatagaagatgaagaggatacaactgaaaaaaagtaa

SEQ ID NO: 14782 - protein, 131 aa, Unknown
  Obtained from environmental sample
  misc_feature (1)..(131): Xaa is any amino acid
MTKNILDRCLIKEETFNPESIGGKIDVTIRQLTAGEGLEYQSILRDSEKKQEDAVFFAVKCAMVKPTFFTDEELKKVNITGRNLIYEIHGRLPTIGMTVSEKKEYLKKLQELSQKLENSKIEDEEDTTEKK

SEQ ID NO: 14783 - DNA, 465 bp, Unknown
  Obtained from environmental sample
  misc_feature (1)..(465): n is a, c, g, or t
atgtttgaaaataaattgtatgaaaaaaaatatttagcaattgttgagggaaaaatagataaaaatatcactatagacgagggtataaaaaaagcaacaaatagtaaaattggtgtaaaaatggtaactgcatctgatgggaaagaatccgttactcatataaccccattgcaatataataaagttaaaaatcaaactttagttgaagctacaccaataacaggaagacaacaccaaataagagtacatcttcattctattggacataaaatagtaggagatccaatttatggagtcgatgaagatattgcagataagtatcttttaaaaaagctaacattagaagagagacttttatacataaaggataaacgattaaggttgcaggcaaattttttaaaatttcagtttgaaaataatacctatgcaatttattcaaagcttaagtttaaagtagtaaaataa

SEQ ID NO: 14784 - protein, 154 aa, Unknown
  Obtained from environmental sample
  DOMAIN (1)...(86): RNA pseudouridylate synthase
  misc_feature (1)..(154): Xaa is any amino acid
MFENKLYEKKYLAIVEGKIDKNITIDEGIKKATNSKIGVKMVTASDGKESVTHITPLQYNKVKNQTLVEATPITGRQHQIRVHLHSIGHKIVGDPIYGVDEDIADKYLLKKLTLEERLLYIKDKRLRLQANFLKFQFENNTYAIYSKLKFKVVK

SEQ ID NO: 14785 - DNA, 639 bp, Unknown
  Obtained from environmental sample
  misc_feature (1)..(639): n is a, c, g, or t
gtgaagccaaatcatatatttattttttgtgataatcatgatgaagtagcaaatgaattaattgagtttggattcattgaaggtagcagtagaatacatccaaatcaaggtacaaaaaatagaaaattctatttcaatgatttttatattgaaatactttgggtacatgatatcaatgaagcaacaagtaaactcacaaatcctacgcaattatacgaaagatcaaaatacaaaattaatggtgcttctcaatttggcttatgtgtaaattattcaactagtgatgatgagctttttcaaaatagattagagtataaaccaacatatttaccaaaggatacgatcatagaagttttgtcaaataaagattcaattacacttccttggacatttagatggaaagttgatttatcaaattatgtgattactgaaccgatcaatttaccaaagcaaaaattattgaaagtagcttttggtattaaaagaaatgaagtacaaaataactatttgcaactttttaaaagtgacattatattttttgaaaatgccaaacaagagtttttaaaactaatctttagcgatacttcaaatagagaggttaaaacatttaagagcgtgtcactgatcattgaattttaa

SEQ ID NO: 14786 - protein, 212 aa, Unknown
  Obtained from environmental sample
  misc_feature (1)..(212): Xaa is any amino acid
MKPNHIFIFCDNHDEVANELIEFGFIEGSSRIHPNQGTKNRKFYFNDFYIEILWVHDINEATSKLTNPTQLYERSKYKINGASQFGLCVNYSTSDDELFQNRLEYKPTYLPKDTIIEVLSNKDSITLPWTFRWKVDLSNYVITEPINLPKQKLLKVAFGIKRNEVQNNYLQLFKSDIIFFENAKQEFLKLIFSDTSNREVKTFKSVSLIIEF

SEQ ID NO: 14787 - DNA, 363 bp, Unknown
  Obtained from environmental sample
  misc_feature (1)..(363): n is a, c, g, or t
atgagaaatattttagtagtagacagcttagaagaagagagaaaattgttatcagactctttgtcagagtttggtcttactgtagtaggtgaagctgaaaatggtttggtagcttatgagaagtatgttgagctgaaacctgatcttattactatgaatatcaatatgcctgtattagatggtattagcgccgttaaaaaaattatcggagattttcctcatgcaaaaattatgatggtatcgtacaatgatgacagaactatagcttatgaagctataggttcaggagctttagatttttttctaaaaactgatgatattggaactttgaaatcaaagttatttagtgcgttaggtttatag

SEQ ID NO: 14788 - protein, 120 aa, Unknown
  Obtained from environmental sample
  DOMAIN (2)...(120): Response regulator receiver domain
  misc_feature (1)..(120): Xaa is any amino acid
MRNILVVDSLEEERKLLSDSLSEFGLTVVGEAENGLVAYEKYVELKPDLITMNINMPVLDGISAVKKIIGDFPHAKIMMVSYNDDRTIAYEAIGSGALDFFLKTDDIGTLKSKLFSALGL

SEQ ID NO: 14789 - DNA, 303 bp, Unknown
  Obtained from environmental sample
  misc_feature (1)..(303): n is a, c, g, or t
ttgctagctgaaaacaaagagttaaaaggaatctattcaaaaggctttgtacatacagggttgtggaaatactctcgtcaccccaactacgcttctgagcaaatcatttggattatcacatacttcttcagcgtgacagcaacaggacaatggttaaactggtccattatgggttgtttactactggtaatactattcaaaggaagttccgattttagtgaggaaataacgaacaacaagtataaatcctataaagattacaaatcaaaaacggcacgcttcatacctttctttacgaagtag

SEQ ID NO: 14790 - protein, 100 aa, Unknown
  Obtained from environmental sample
  misc_feature (1)..(100): Xaa is any amino acid
MLAENKELKGIYSKGFVHTGLWKYSRHPNYASEQIIWIITYFFSVTATGQWLNWSIMGCLLLVILFKGSSDFSEEITNNKYKSYKDYKSKTARFIPFFTK

SEQ ID NO: 14791 - DNA, 849 bp, Unknown
  Obtained from environmental sample
  misc_feature (1)..(849): n is a, c, g, or t
ttgagcactgagttagttgatatcaactcattggagttagccgatacatatgcagagtacagtgaacatatagagatattaacacatcttcatgcacggtataaaaaactatgttttgagaaaaagatactagacccgatttttttacctgaactatataaaataaatagtgattatataggttcatttgaaacaataaagattgtaatagatggttatttgacaaattttgaactaaaaattttacaagagtgttgtgaaatatgcaacattgttttagagtttaaaacatcacactacaatcaaaagatgcagagtaaactctcatttgataagcttgagtttacaaacggatatattttcgagatagatttaaataataaagagatattaacagagataaaagagtctataaactttaacataaattgtgaatctatctcacaaagaagtttgcaagtcgcatttattaaagagaaagttcattcatttgtaaagagtggtattgaagtagagaagattgcagttgttcttcctgatgaggagtttgcctcatacataaaagagtttgatgatgaaaataattttaactttgctatggggatatcacttaaagagagttatatatacagaaatataaaagctattacagactatttggataataaaacaatacaaaaccgtgatagattaaacagatatgataaacagctttttgagcttatatcanaaaattatcaaaaaaatctgcaagatatgaatttcagtgatttgcttgaaaaaatgcttagtgttgagagtaacagagatgtaaaaagattcttctttgagagatacacagattcaaaa

SEQ ID NO: 14792 - protein, 283 aa, Unknown
  Obtained from environmental sample
  misc_feature (1)..(283): Xaa is any amino acid
MSTELVDINSLELADTYAEYSEHIEILTHLHARYKKLCFEKKILDPIFLPELYKINSDYIGSFETIKIVIDGYLTNFELKILQECCEICNIVLEFKTSHYNQKMQSKLSFDKLEFTNGYIFEIDLNNKEILTEIKESINFNINCESISQRSLQVAFIKEKVHSFVKSGIEVEKIAVVLPDEEFASYIKEFDDENNFNFAMGISLKESYIYRNIKAITDYLDNKTIQNRDRLNRYDKQLFELISXNYQKNLQDMNFSDLLEKMLSVESNRDVKRFFFERYTDSK

SEQ ID NO: 14793 - DNA, 855 bp, Unknown
  Obtained from environmental sample
  misc_feature (1)..(855): n is a, c, g, or t
atggaaacccaaaacaaagagaatattgaacttaaatttttaagtatggatgattacgatgaattaaaagagacaatgttactctcctatgaaacaatgcaagatgcttattggaaagaaaatcaacttaaaacattaatcgagaagtttcaagagggacaaattgttataaaaatagatggtgagttagctgcttgtgcgttttctatcattgttaattatgatgaattttcaaatcatcacacttataaagagataactggaaactatacattttctacacattcaaataaaggtgatatactttatggtattgatgtatttgtaaagccaaaatttagaggtctaagacttggaagacggttgtatgactatagaaaagagttgtgtgaaaaacacaatcttaaagggatagcttttggtggaagaatcccaaattatcataagtatgagaatgaacttactccaaaagagtatattgaaaaggtaaaaagaaaagagattcatgatcctgtacttaattttcaaatatctaatgattttcatcccgctaaagttttaaaaggatatttagagggagataaagcttctggagaatttgccgttttactagagtgggataatatctattatgaaaaacctaataaactagcaagtataaataaaaaagtggttcgattaggcttaattcaatggcaaatgagaccctataaaaaccttgaagaattgctacaacaagcagaatactttatagatacagtttcaggatatcgttctgattttgcacttttcccagagttttttaatgccccattaatggctgaaaacaaccatctttcagaaccacaagcttaa

SEQ ID NO: 14794 - protein, 284 aa, Unknown
  Obtained from environmental sample
  DOMAIN (55)...(151): Acetyltransferase (GNAT) family
  misc_feature (1)..(284): Xaa is any amino acid
METQNKENIELKFLSMDDYDELKETMLLSYETMQDAYWKENQLKTLIEKFQEGQIVIKIDGELAACAFSIIVNYDEFSNHHTYKEITGNYTFSTHSNKGDILYGIDVFVKPKFRGLRLGRRLYDYRKELCEKHNLKGIAFGGRIPNYHKYENELTPKEYIEKVKRKEIHDPVLNFQISNDFHPAKVLKGYLEGDKASGEFAVLLEWDNIYYEKPNKLASINKKVVRLGLIQWQMRPYKNLEELLQQAEYFIDTVSGYRSDFALFPEFFNAPLMAENNHLSEPQA

SEQ ID NO: 14795 - DNA, 810 bp, Unknown
  Obtained from environmental sample
  misc_feature (1)..(810): n is a, c, g, or t
atgacaaaaataattgatttaaaagagttttcatattttttaagagtacatagaaatagcataatccaaaattggacagaaacaaatgaggttaaaaatattattcataagcattctgttccagttatagaaaaaaataaaaatatattttatgagttttgtgattgttttattagtatctttcaatgggactttacaatatcagaatgtcaagcaagaatgacttttctaaaacttttagagggctatggtgtaacatcagcagagctttttattttgatattacgattaaaaagttctgtagaagatataatttatcaagatggaagtttatcttataatattcaaaaagagttagaaacaataacaatagatatcgctcttgaactaacagatacttataatagtttacaaagagaagataaagataatcacaatgaacaaagtaaccttttagcagaatataaaaaagctgttgatataagtaatatagtttcaaaaacaaatccaaaaggtattatcacttatgttaatgataagttttgtcaaattagtggatacaaaaaagaagaattaataggaaaagctcataatataatacgacatccaagtatggatagagaatcttttaaagagctttgggatacagtaaaatcaaaaaaaccatggacgggtattgtaacaaatatggcaaaagatgggagttcttatgttgttgatacaacagttattcctatacttgatgttgatggagatattgtagagtttattgcagtaagacatgacataacggatttcgagaaaacaaaa

SEQ ID NO: 14796 - protein, 270 aa, Unknown
  Obtained from environmental sample
  DOMAIN (153)...(215): PAS domain
  misc_feature (1)..(270): Xaa is any amino acid
MTKIIDLKEFSYFLRVHRNSIIQNWTETNEVKNIIHKHSVPVIEKNKNIFYEFCDCFISIFQWDFTISECQARMTFLKLLEGYGVTSAELFILILRLKSSVEDIIYQDGSLSYNIQKELETITIDIALELTDTYNSLQREDKDNHNEQSNLLAEYKKAVDISNIVSKTNPKGIITYVNDKFCQISGYKKEELIGKAHNIIRHPSMDRESFKELWDTVKSKKPWTGIVTNMAKDGSSYVVDTTVIPILDVDGDIVEFIAVRHDITDFEKTK

SEQ ID NO: 14797 - DNA, 306 bp, Unknown
  Obtained from environmental sample
  misc_feature (1)..(306): n is a, c, g, or t
atgacagatcggctcagatgcattggtgtgaatgagtcatcaaaaaagattttgaccatagacatctataatgcaaaaacagcgtttgagtattctgccggtatttttaatgtgacgccggcgattgactatgcaaaatgtacgctggaagttaaattttcgattgggaaaaagagctggcaggaaactttctattcagaattagatgatccgacgattggcggttcaagcacgacaggtgtggtggaaaaagtctgggatgatattgccatccaggttgtcaaaaatgtcgtaagccatctatag

SEQ ID NO: 14798 - protein, 101 aa, Unknown
  Obtained from environmental sample
  misc_feature (1)..(101): Xaa is any amino acid
MTDRLRCIGVNESSKKILTIDIYNAKTAFEYSAGIFNVTPAIDYAKCTLEVKFSIGKKSWQETFYSELDDPTIGGSSTTGVVEKVWDDIAIQVVKNVVSHL

SEQ ID NO: 14799 - DNA, 423 bp, Unknown
  Obtained from environmental sample
  misc_feature (1)..(423): n is a, c, g, or t
gtgcgagtagcaattgcagatgcacatgtactatttcgggatggacttgccatggcccttgatcaggtgcttgagcaagagattaagcttgtagaatgcaccgatcttgagcaacttcaacggtgccttaaaatatctgagtgtgatttaatcatagtcgcaagcaacagcctgccagatcactccaaatccactttcgatactttgagaaaaataggcaaacataatccaattattgtatctgttgatcatttacacgagctcccccacttcaggaaaagtaatctggacggcgtaatttctaaaacggcaccaatgtccagccacatcaagttgatgaaattgctcattgagcaaggaaaaagtgagaacctactcaacccctttttaaaaaaagcatgccgccaactgacaaaaaactaa

SEQ ID NO: 14800 - protein, 140 aa, Unknown
  Obtained from environmental sample
  misc_feature (1)..(140): Xaa is any amino acid
MRVAIADAHVLFRDGLAMALDQVLEQEIKLVECTDLEQLQRCLKISECDLIIVASNSLPDHSKSTFDTLRKIGKHNPIIVSVDHLHELPHFRKSNLDGVISKTAPMSSHIKLMKLLIEQGKSENLLNPFLKKACRQLTKN

SEQ ID NO: 14801 - DNA, 801 bp, Unknown
  Obtained from environmental sample
  misc_feature (1)..(801): n is a, c, g, or t
ttgatcatcggcggtttggtggcccttttaatcattccccttgccaggcggatcacacgaagggtcaatcagctgaatcgatctgcccttgaatttgcaaatggcaacctgtcctgcaggacagatatcaaaggcaatgacgagattgccaagctgggccattcctttaatttcatggcagacaaaatggaaaaaataatccagggtagcaaggaattgtccgccaatgtatcccatgaacttcgcagcccccttaccagaatccaggtgtccagggaactgatttttgacaaaatagagaacttggacaaattggataaagaaacggccaaagaggacatacaccggtatatcaaaaacatggaatctgacattcagagtctggacaccctgattgaccaggtgctcaagctgtctaaaattgattaccaggaatcagaactcgccctggaaagctttaattttaaagagttcctggacaacatgctgaaccaataccattccttgctcctgcaaaaacacattggaatagcccataaatttcctggcacaatgcgggcaaaccaggacaaatccgttcttaaatccattctctccaacctattggacaatgccgtaaaatacaccccggaaaacggaaccatcttaatcgagccccttcctggttataggcggggcgtggggttcaccgtggccaatacctgcccccccctggacgacaaagagcttaaaatgatattcaaacccttttacaggaccgcggggaaatacggcccccggctcgggcctgctcagcaataa

SEQ ID NO: 14802 - protein, 266 aa, Unknown
  Obtained from environmental sample
  DOMAIN (189)...(264): Histidine kinase-, DNA gyrase B-, and HSP90-like ATPase
  misc_feature (1)..(266): Xaa is any amino acid
MIIGGLVALLIIPLARRITRRVNQLNRSALEFANGNLSCRTDIKGNDEIAKLGHSFNFMADKMEKIIQGSKELSANVSHELRSPLTRIQVSRELIFDKIENLDKLDKETAKEDIHRYIKNMESDIQSLDTLIDQVLKLSKIDYQESELALESFNFKEFLDNMLNQYHSLLLQKHIGIAHKFPGTMRANQDKSVLKSILSNLLDNAVKYTPENGTILIEPLPGYRRGVGFTVANTCPPLDDKELKMIFKPFYRTAGKYGPRLGPAQQ

SEQ ID NO: 14803 - DNA, 831 bp, Unknown
  Obtained from environmental sample
  misc_feature (1)..(831): n is a, c, g, or t
ttgcctggaggactttccttagcgattctttttaccaacactacaaaggtgattttaattcgaattctcggtggtattttaatttcaacactcttagtattagccgtaatcagctgtcttttttatcttttaaaaatcataaaacatcaaaagcaattagccgaagtaaaaaatgatttaattagcaatatcactcacgaatttaagacacctattgcaacggttagtgccgctttagaaagcattagtaactttaatactattgataacaaagaaaaaactaagaaatacctcagcatgtctaccgaacaattaaacaaattgaatatcatggtagaaaaactcttagaaaccgcaacattagacagtggtagtctaaaactaaacaaagcagattttgattttattacaatgctcaaagcgttgatagagcggtatatcattcaatttccaaacaaaacattttatagcaacattccactccaaagcctaatcattaatgcagataattttcacttagaaaatgcattgaacaacattttagataacgctataaagtatggaggagatactattactatacaattaaaagcaagtaaaacgacatttcatattttaatttctgataatggtaatagtttatcaagcgagcataaaagcaagattttcgataaattttatcgtgttcctacaggtaatactcataatgtaaaaggttttggaattggtctgtactacaccaaaaccataattaataaacatcacggtaatatcgctttagagctagataagaaggcaactacatttaaaataacactaccaaatggctaa

SEQ ID NO: 14804 - protein, 276 aa, Unknown
  Obtained from environmental sample
  DOMAIN (56)...(124): His Kinase A (phosphoacceptor) domain
  misc_feature (1)..(276): Xaa is any amino acid
MPGGLSLAILFTNTTKVILIRILGGILISTLLVLAVISCLFYLLKIIKHQKQLAEVKNDLISNITHEFKTPIATVSAALESISNFNTIDNKEKTKKYLSMSTEQLNKLNIMVEKLLETATLDSGSLKLNKADFDFITMLKALIERYIIQFPNKTFYSNIPLQSLIINADNFHLENALNNILDNAIKYGGDTITIQLKASKTTFHILISDNGNSLSSEHKSKIFDKFYRVPTGNTHNVKGFGIGLYYTKTIINKHHGNIALELDKKATTFKITLPNG

SEQ ID NO: 14805 - DNA, 576 bp, Unknown
  Obtained from environmental sample
  misc_feature (1)..(576): n is a, c, g, or t
atgtcttttagtagtggtgggtctgatgtgttttataaaaatatacaacagaaaacgtacatagatcaaaaggaaactatgggtaaaaaattcttaattaaagatactatagtacctatagattggcagcttcaatccaatactaaacatattggtgaatatatgtgctttaaagctacctataccaagcaagtgcctaaagtgaattttaattttaacagtggttctaataaaaaagaggataatacagaaaaggaaaaagagccagaaatgaccgaacgtacggtaaccgcgtggtatactccgcaaattcctgtaagtaatggacctgcccaataccaaggactcccaggtttaattttagagattcacgatggtaagctcaccgttatttgtagtaaaattgtaattaatcctgaagaacaaattaagattgaatcaccaactaaaggtaaagaagtgaatcaaaaagaatacgatataattatggataaaaaacaaaaagaaatgatggagcgttatgcaccgagcagaggatctaaggatggagcaattcatatcaccataggaggttaa

SEQ ID NO: 14806 - protein, 191 aa, Unknown
  Obtained from environmental sample
  misc_feature (1)..(191): Xaa is any amino acid
MSFSSGGSDVFYKNIQQKTYIDQKETMGKKFLIKDTIVPIDWQLQSNTKHIGEYMCFKATYTKQVPKVNFNFNSGSNKKEDNTEKEKEPEMTERTVTAWYTPQIPVSNGPAQYQGLPGLILEIHDGKLTVICSKIVINPEEQIKIESPTKGKEVNQKEYDIIMDKKQKEMMERYAPSRGSKDGAIHITIGG

SEQ ID NO: 14807 - DNA, 792 bp, Unknown
  Obtained from environmental sample
  misc_feature (1)..(792): n is a, c, g, or t
ttgagtgatctcacatctaaaaactttaatctcacatctataaaaaatataaaaatgagtggaggtctttattcaaccgattccaacgaaattgataaaacacttgatctaacgaagatcaagccttacggtgataccatgaacgatggtaaaactcaggttagttttacattgccagtagagaaaggcgacgaagcaattgaagcggctaagcagatgatgagaaaaatgggttttgaaaatccacaggtcgtgtttgttcaagagctaatgaaaggatttacttttttcaattgctatggcaattgtgttcatactgttgatttcacagggattactgttcctaaagttgaagcaacagcgatggatatgcacgaaactgatgattttatcaaagaaaacatcggtcgtccgattcgtattcttggagccagtacaggttccgatgcacataccgttggtattgatgcgatcatgaacatgaaagggtttgccggacattacggtttagagcgttacggtatgatggaagctttaaatatgggaagtcaggtaccaaacgaagaatttattgccaaggcaatcgaatataaagctgatgttcttttggtttcgcaaacagtaactcanaaggatgttcacattaaaaaccttgtggagctggttgaactaatggaagctgaaggcttacgcgaaaaagtaattttgatttgcggtggaccacgaatttctcatgagttggcaaaagaattaggatacgatgcaggattcgggatgaacaaatatgccgaa

SEQ ID NO: 14808 - protein, 264 aa, Unknown
  Obtained from environmental sample
  DOMAIN (139)...(261): B12 binding domain
  misc_feature (1)..(264): Xaa is any amino acid
MSDLTSKNFNLTSIKNIKMSGGLYSTDSNEIDKTLDLTKIKPYGDTMNDGKTQVSFTLPVEKGDEAIEAAKQMMRKMGFENPQVVFVQELMKGFTFFNCYGNCVHTVDFTGITVPKVEATAMDMHETDDFIKENIGRPIRILGASTGSDAHTVGIDAIMNMKGFAGHYGLERYGMMEALNMGSQVPNEEFIAKAIEYKADVLLVSQTVTXKDVHIKNLVELVELMEAEGLREKVILICGGPRISHELAKELGYDAGFGMNKYAE

SEQ ID NO: 14809 - DNA, 708 bp, Unknown
  Obtained from environmental sample
  misc_feature (1)..(708): n is a, c, g, or t
ttgcttaccgatcctttaaatacccaagcggcaacatggctgaaagcggagctaaaaaaacgtttcggtgtccccattaagtacgtggtctatagccacaaccacagtgatcatatttacggggcacaggtatttgacgatcctaacaccgtttttattgcccatgaattagccgcgcaagatattagaataactaaagctaacaccgttattcctgatatgaccttcaaagaaaaaatggcaatatctttaggtgggcataaagttgagcttagatatcacggccctaatgacggacgcggctccattagcatgctctttaaacccgaaaaattgctatttgttgtcgactggattgtcatcggcaggatgccttggcaaaaactatggagttacgacattcaagggatgatcaactcaacccaacaggtacttgagctagatttcgacacctttgtcggtgggcatgctgacataggtaataaatcagatgtagtgcgataccttaactatctgcaagatctgtataacgcggtcatcacaggcatccataaaggccaaagtgtagatgaaataaagcagacgataaaattaacaaattacagtgatctcaagcaatttaagcaatggcttccactcaatgtagaaggtgtttatgaacgcctaatggaagagtcaggtatgggatggcggcctgatattaagtga

SEQ ID NO: 14810 - protein, 235 aa, Unknown
  Obtained from environmental sample
  DOMAIN (9)...(156): Metallo-beta-lactamase superfamily
  misc_feature (1)..(235): Xaa is any amino acid
MLTDPLNTQAATWLKAELKKRFGVPIKYVVYSHNHSDHIYGAQVFDDPNTVFIAHELAAQDIRITKANTVIPDMTFKEKMAISLGGHKVELRYHGPNDGRGSISMLFKPEKLLFVVDWIVIGRMPWQKLWSYDIQGMINSTQQVLELDFDTFVGGHADIGNKSDVVRYLNYLQDLYNAVITGIHKGQSVDEIKQTIKLTNYSDLKQFKQWLPLNVEGVYERLMEESGMGWRPDIK

SEQ ID NO: 14811 - DNA, 597 bp, Unknown
  Obtained from environmental sample
  misc_feature (1)..(597): n is a, c, g, or t
ttgatttatcacaatccccagatcaccattactctcattatattcaaaattgtaatagtatattggatagcgttcatcataaatccattgctcaaaaaagtaatcaaggttttcaccgcttatatcttcacaaataaactggaaatcttcggttgttgccaaactatacttaaaactatcatcattggcatattgataaataatatcaaaaaacacctcatcaccaacaacatgacgcaacatatgcagtatatatgctcccttactgtatattatttgtcgaaaaaccgtaaacggattacttacatcttccatataaacagtaccctcaccagtatatttaaagtttttcatataattgtgataggaattataaaaacgttccacaaaaagggcttccgaatatgtagcaaaaccttcgttaatccaaccgtgatgccaagtatcacatgtgatcatatcagcaaaccacatatgcgacaactcatgtgcggaaatatgtatccagtcgatactcatattgttagttatggtatttgtctgattttcgattgctccatagtaacccagctgtgtcataccatatttttcatttaa

SEQ ID NO: 14812 - protein, 198 aa, Unknown
  Obtained from environmental sample
  misc_feature (1)..(198): Xaa is any amino acid
MIYHNPQITITLIIFKIVIVYWIAFIINPLLKKVIKVFTAYIFTNKLEIFGCCQTILKTIIIGILINNIKKHLITNNMTQHMQYICSLTVYYLSKNRKRITYIFHINSTLTSIFKVFHIIVIGIIKTFHKKGFRICSKTFVNPTVMPSITCDHISKPHMRQLMCGNMYPVDTHIVSYGICLIFDCSIVTQLCHTIFFI

SEQ ID NO: 14813 - DNA, 375 bp, Unknown
  Obtained from environmental sample
  misc_feature (1)..(375): n is a, c, g, or t
atgagaaacttaaaagtaaaaatgaaacttaatcctatgaaagctttaattgaaggaaaatctttaatagtaattgatgattctattgtaagaggtactacaagtaaaagaattgtacagatgttaaaagaagctggggccgctgaagtgcattttagagttgcaagtccaatgattcaacatccatgtttttatggtatagatacacctacaaaagaggaacttattaatgccgtgatgacaaaagaagaggtatgtgaacatattggtgctgattctttagaatatcttacaattgataatttaaaagattcacttggtcgtgatagaaactattcattagtaagttttgatggcgattatttcgtagtttaa

SEQ ID NO: 14814 - protein, 124 aa, Unknown
  Obtained from environmental sample
  misc_feature (1)..(124): Xaa is any amino acid
MRNLKVKMKLNPMKALIEGKSLIVIDDSIVRGTTSKRIVQMLKEAGAAEVHFRVASPMIQHPCFYGIDTPTKEELINAVMTKEEVCEHIGADSLEYLTIDNLKDSLGRDRNYSLVSFDGDYFVV

SEQ ID NO: 14815 - DNA, 420 bp, Unknown
  Obtained from environmental sample
  misc_feature (1)..(420): n is a, c, g, or t
ttgggtgataaaatagttgcctttgaatatggtgctgatgattatctagcaaaaccttatgaaccaaaagagttggtgatacggataaatgcaatactacgaagaatcaccccaaagcttaacaataagagtgtaggggagtttactattgatgaagataaactagagataacccaagatggacatcacttagagctcacaaaaatagaatatgagatatttttattgcttttaaataatcaaaacaaagttctctctcgagaatcgattgcaaaatttttaggtagtgaatatataaatatcaaagatagagccatagatatgcatataagtaacatacgaaataagatttttgatgactctaaaaatgcaaaatatattaaatctatttggggtattggatataaatttataggataa

SEQ ID NO: 14816 - protein, 139 aa, Unknown
  Obtained from environmental sample
  DOMAIN (61)...(137): Transcriptional regulatory protein, C terminal
  misc_feature (1)..(139): Xaa is any amino acid
MGDKIVAFEYGADDYLAKPYEPKELVIRINAILRRITPKLNNKSVGEFTIDEDKLEITQDGHHLELTKIEYEIFLLLLNNQNKVLSRESIAKFLGSEYINIKDRAIDMHISNIRNKIFDDSKNAKYIKSIWGIGYKFIG

SEQ ID NO: 14817 - DNA, 438 bp, Unknown
  Obtained from environmental sample
  misc_feature (1)..(438): n is a, c, g, or t
atgtcaatttttactaaagtttttatactgttttctattagtattttgttgatgttgtacttatcaacaaaaacaaatgctataactgacgaaaaaatagaactaatacataaagagaaatatatacaagcctcaaaagaactttttaattatcttgtaaatggagatatgacaacattaaataaaagagttcaagagttaaattatgagaaaagaacattagatacaaatagtgaagatttttctactatatataaacaagctatctcctttggacaaataaaaatatttaaacaagatgatctatattttctttttatggaatatcttgatgataagttttatttttatgatagatctcaaaaaaaagggattgaacaaaaagagcattttaattatcttatagtagttgatatagctatcttgattnatatgttt

SEQ ID NO: 14818 - protein, 146 aa, Unknown
  Obtained from environmental sample
  misc_feature (1)..(146): Xaa is any amino acid
MSIFTKVFILFSISILLMLYLSTKTNAITDEKIELIHKEKYIQASKELFNYLVNGDMTTLNKRVQELNYEKRTLDTNSEDFSTIYKQAISFGQIKIFKQDDLYFLFMEYLDDKFYFYDRSQKKGIEQKEHFNYLIVVDIAILIXMF

SEQ ID NO: 14819 - DNA, 870 bp, Unknown
  Obtained from environmental sample
  misc_feature (1)..(870): n is a, c, g, or t
ttgaaattttctatcaatccttatgggcaatctttagggtttagtgaaactgatgttgtgaacttacttaaaccttattatttcaaagggagtttctctaaaatgtatgatgatacgggtgtggttgatatagtgtttcaaagtgtcaataaagatatcaaaaaatctcttgataattttgaaattctaataccaaatagtgacaaaaaagtccttctaaacgatatagtagatttcaaaacaaaatcaagccttagtcaaatcttcaaagaggatggagtagcgatacaaactatcacagcttcattagatgggatcacaagtacagagctttatactcaacttaatcctgttttagatagtttaaaagataaagtgactatagatatcaaaggggaacaaaaagaaaaccaaaaagtacagatggagatgggacaagcttttatcatagcacttattcttatctttatctctttggtatggatgtttgatagtttagtaaaatctctcatcatcctaagtaccatccctctttcagttttaggtgttctggttggacattttatcatgggattgaatcttacaatgcctggacttataggtatggttggacttgctggggttattgtaaatgacgggattattatgatggattttatccaaaaggcaaaagatatagaagagatgaaacaatacgcacttctaagactccgccctattcttcttacttcacttacaactatnttaggtctgagtaccttgatgttttttgcttctgggcaatctttgatattacaaccaatggctgtagctttaggatttgggatactttgggctaccattttgaaattggattatgttcctatgtgg

SEQ ID NO: 14820 - protein, 290 aa, Unknown
  Obtained from environmental sample
  misc_feature (1)..(290): Xaa is any amino acid
MKFSINPYGQSLGFSETDVVNLLKPYYFKGSFSKMYDDTGVVDIVFQSVNKDIKKSLDNFEILIPNSDKKVLLNDIVDFKTKSSLSQIFKEDGVAIQTITASLDGITSTELYTQLNPVLDSLKDKVTIDIKGEQKENQKVQMEMGQAFIIALILIFISLVWMFDSLVKSLIILSTIPLSVLGVLVGHFIMGLNLTMPGLIGMVGLAGVIVNDGIIMMDFIQKAKDIEEMKQYALLRLRPILLTSLTTXLGLSTLMFFASGQSLILQPMAVALGFGILWATILKLDYVPMW

SEQ ID NO: 14821 - DNA, 927 bp, Unknown
  Obtained from environmental sample
  misc_feature (1)..(927): n is a, c, g, or t
ttgatggataatgcagttgaagtaaaagaggacttaagtcttgcctttggtgtgacattaactaaagaacaaatcaatagacttaacaaagatatagtgtggatggaagaaagaatagtagagggacaaaaagtactagtacctgtagtgtatttagcctctttagatacagataacttaaaagatggaacacaaataatagcaggggaagatatagcactatttgcaagtggaactttacaaaaccaaggaaaaatagaagctagaaataatcttgtacttctttcaaatgatattcaaaatcatggtggtacaatagaagccaaaaatgatgcaacactaaatagtaatacagatattcaaaatataagtggagatataaaagcaggaaatgacttagaacttaatgcaaataataatatcaatataaaaagctctacaaatcaaaaaacatttaattatgcacaagggtatcaaaccaccacatttaaagggaaagatgcaacactaaacgcaggtggaaatttaaaagtaaatgcaggggattctgtaactgtacaaggctcacaactacaagtacaagaagatgcaactatcatagcaaagaatggagatgtaaatatagatgccacacaacaaaaagagaagtttgactttgatgtatatggtggatactacaaaggagattctcttaaaaacaatggttcaacagtagaggtaaaaaatcttacagttttaacaaatggaaatctaaatataaatggtagtacaataaaagcacaagaagatgcaaatatctatgcaaacaatgttaatataacctccactacagatacaagctcctcaaaatacaaaagtgaatcaaaaggtttcttctcaagctcaaccacaaaacaagagaaacaaacctctcaaaatatagccctc

SEQ ID NO: 14822 - protein, 309 aa, Unknown
  Obtained from environmental sample
  misc_feature (1)..(309): Xaa is any amino acid
MMDNAVEVKEDLSLAFGVTLTKEQINRLNKDIVWMEERIVEGQKVLVPVVYLASLDTDNLKDGTQIIAGEDIALFASGTLQNQGKIEARNNLVLLSNDIQNHGGTIEAKNDATLNSNTDIQNISGDIKAGNDLELNANNNINIKSSTNQKTFNYAQGYQTTTFKGKDATLNAGGNLKVNAGDSVTVQGSQLQVQEDATIIAKNGDVNIDATQQKEKFDFDVYGGYYKGDSLKNNGSTVEVKNLTVLTNGNLNINGSTIKAQEDANIYANNVNITSTTDTSSSKYKSESKGFFSSSTTKQEKQTSQNIAL

SEQ ID NO: 14823 - DNA, 441 bp, Unknown
  Obtained from environmental sample
  misc_feature (1)..(441): n is a, c, g, or t
atgaaccttaaagaattagaggatagaatctctctcaaagaactaattgataacgtttctattttaggagataagaaagattttacacaacaagtacagttatttactgaaaattcagtttcagaaactatagcaggaggtattacaattttaaaattagagggacgaactaaaatggctgaagcatttggcaagtttctcaaagattttgaaactgtttatcattttaacggtcaacaggtcgtaaacatagaaggcgatagtgctacaggaacgtgttattgtttgattaccctaatcggaaacgagaaaagtaaaaaaataaaaactacgataggtgcgatttacgaggacgattacgttcttataaacaaccgttggcttatcgctaagcggataggaaatttcaattggcaggaaaaaaccgaaatcaatcaataa

SEQ ID NO: 14824 - protein, 146 aa, Unknown
  Obtained from environmental sample
  misc_feature (1)..(146): Xaa is any amino acid
MNLKELEDRISLKELIDNVSILGDKKDFTQQVQLFTENSVSETIAGGITILKLEGRTKMAEAFGKFLKDFETVYHFNGQQVVNIEGDSATGTCYCLITLIGNEKSKKIKTTIGAIYEDDYVLINNRWLIAKRIGNFNWQEKTEINQ

SEQ ID NO: 14825 - DNA, 579 bp, Unknown
  Obtained from environmental sample
  misc_feature (1)..(579): n is a, c, g, or t
atgtttgacattttccgaaaatatttagaagataaaattattttaaccaacgaagattatgggttgattgaatcggtttcgttatttaaaaaattgcgaaaacggcaatatcttttacaggcgggagatgtttgtctttttcatgcatttgtatgcaaaggttttctgcgaaattattatgtggacgaaaaaggtcaggaacacattttgcaatttgctcccgaaaattattggaccggtgacggggaaagcatgaaatcaggcttaccctcaaaatatgatattgatgccattgaagaaagcgaaatcttattgttgaagaaagaagattttgaaatgatccgcaagattattccggctttcaatgattttgtaaatgaaacacttagaaaaaacgctgtggttttgcaggagcgtatccatgccaacatatctctatctgcggaggaaaaatacagtgactttgtttcaaaatatccttccatcagcaatcgtgtgccgctgcacatgattgcatcttacatcggtgtatctgctgaaactttaagcagggtaaggagacaatccgcaaaaaaataa

SEQ ID NO: 14826 - protein, 192 aa, Unknown
  Obtained from environmental sample
  DOMAIN (26)...(120): Cyclic nucleotide-binding domain
  misc_feature (1)..(192): Xaa is any amino acid
MFDIFRKYLEDKIILTNEDYGLIESVSLFKKLRKRQYLLQAGDVCLFHAFVCKGFLRNYYVDEKGQEHILQFAPENYWTGDGESMKSGLPSKYDIDAIEESEILLLKKEDFEMIRKIIPAFNDFVNETLRKNAVVLQERIHANISLSAEEKYSDFVSKYPSISNRVPLHMIASYIGVSAETLSRVRRQSAKK

SEQ ID NO: 14827 - DNA, 579 bp, Unknown
  Obtained from environmental sample
  misc_feature (1)..(579): n is a, c, g, or t
gtggttcattttaaaatgtcagattttaaaagaatctcaaatgaagaagcattggatttaatccaaaatgcttcattattagaacttggaaaactctctagcaacagaaaagaagaactgcatccaaaaaaaacaacaacttttgttgttgatagaaatatcaactatacaaatatatgctgggttgattgtaaattttgtgctttttatcgccatgcaaaagatgaagatgcttatattttaacttatgaagagatagataaaaagatagatgaacttctagaaattggtggtactcaaatactttttcaagggggagtacatcctaaactaaaaatagatttttatgaagacttggttgaacatattcacaataaatatccaactattacaatacacggttttagtgctattgaaattgattatatagcaagactatcaaaaataagttatcaagaagttttagcaaaattaaaggcaaaaggattagcttctatccctggagctggagctgagattttaaatgatgatgttagagatattattgctcctaaaaagttagatacaaaagatggttag

SEQ ID NO: 14828 - protein, 192 aa, Unknown
  Obtained from environmental sample
  misc_feature (1)..(192): Xaa is any amino acid
MVHFKMSDFKRISNEEALDLIQNASLLELGKLSSNRKEELHPKKTTTFVVDRNINYTNICWVDCKFCAFYRHAKDEDAYILTYEEIDKKIDELLEIGGTQILFQGGVHPKLKIDFYEDLVEHIHNKYPTITIHGFSAIEIDYIARLSKISYQEVLAKLKAKGLASIPGAGAEILNDDVRDIIAPKKLDTKDG

SEQ ID NO: 14829 - DNA, 330 bp, Unknown
  Obtained from environmental sample
  misc_feature (1)..(330): n is a, c, g, or t
gtgactcctttggggcatcatgtaacaaaatggctactaccgataataacttttggtgttgctatgtttataatattttttttaattactataaatagtggtgatagaattaatattgatgctcctattgtaaaagaggatctctctgcagatatagtaaaaaaagagaaaagtgtttggattgagcgtttcgctcaaaatgagagagaaggctacttttatccggtaaacgagatctacatagagttagatctagaaaaaaaaatagaatattctaaaatatatagactctctgcatctttgaagatccatatcaactcttttgtttaa

SEQ ID NO: 14830 - protein, 109 aa, Unknown
  Obtained from environmental sample
  misc_feature (1)..(109): Xaa is any amino acid
MTPLGHHVTKWLLPIITFGVAMFIIFFLITINSGDRINIDAPIVKEDLSADIVKKEKSVWIERFAQNEREGYFYPVNEIYIELDLEKKIEYSKIYRLSASLKIHINSFV

SEQ ID NO: 14831 - DNA, 639 bp, Unknown
  Obtained from environmental sample
  misc_feature (1)..(639): n is a, c, g, or t
atgaatttaaaagccccaaaaggaattcgtgatgtggcggaatggtacatgagcacagtaatgcgccccgattatataaaaagtatttacgaaagtcagattgaaattgccattgaaaacctgaaacgaatttatgcggttgtcggaaataaagtaaatgctatgtttatttgcggaaccgatttcggaacacaggattcaacattctgttcacctgaacaatttgatgaaatgtggcttccctattaccgaaaagtcaacgactggattcacgaaaatacactatggaaaacttttaaacactcctgcggtgctgttgaaaatttaatggatggttttatccgggcgggtttcgacattatcaatccggttcaaataagtgccaaagaaatggacccagtaaaactaaaacaaaaatatggtcgcgatttaactttctggggtggcggtgttgatacacaaaatgtacttccatttggaaaacccgaagaagtgcgcgagcaagttttacgaacctgcgatattttcaacaaagacgggggatttgtttttaatacggttcataatattcaggcaaatgtaccggttgaaaatgtggtggccatgctggaagccatcaaagaatataacaggaagtaa

SEQ ID NO: 14832 - protein, 212 aa, Unknown
  Obtained from environmental sample
  misc_feature (1)..(212): Xaa is any amino acid
MNLKAPKGIRDVAEWYMSTVMRPDYIKSIYESQIEIAIENLKRIYAVVGNKVNAMFICGTDFGTQDSTFCSPEQFDEMWLPYYRKVNDWIHENTLWKTFKHSCGAVENLMDGFIRAGFDIINPVQISAKEMDPVKLKQKYGRDLTFWGGGVDTQNVLPFGKPEEVREQVLRTCDIFNKDGGFVFNTVHNIQANVPVENVVAMLEAIKEYNRK

SEQ ID NO: 14833 - DNA, 324 bp, Unknown
  Obtained from environmental sample
  misc_feature (1)..(324): n is a, c, g, or t
gtggcggtgttgatacacaaaatgtacttccatttggaaaacccgaagaagtgcgcgagcaagttttacgaacctgcgatattttcaacaaagacgggggatttgtttttaatacggttcataatattcaggcaaatgtaccggttgaaaatgtggtggccatgctggaagccatcaaagaatataacaggaagtaagacagttggcaggatgaagaaagtagtcgtagttttcagaaagaaattgaaatttatcagcaatgttaactttgaaataattaaacgttctttatcttggcaaaaaaatagtcaattcaggttttag

SEQ ID NO: 14834 - protein, 107 aa, Unknown
  Obtained from environmental sample
  misc_feature (1)..(107): Xaa is any amino acid
MAVLIHKMYFHLENPKKCASKFYEPAIFSTKTGDLFLIRFIIFRQMYRLKMWWPCWKPSKNITGSKTVGRMKKVVVVFRKKLKFISNVNFEIIKRSLSWQKNSQFRF

SEQ ID NO: 14835 - DNA, 489 bp, Unknown
  Obtained from environmental sample
  misc_feature (1)..(489): n is a, c, g, or t
ttggtaaaaaagttactttttttagcattagcattttctatatcttttgcttcaaatgatctacataataaaatagagtctctgataacaaagagagtatacgaaaaaaatagatcatttattgatataattttttcagatgagcagaagtattatgataactccaacctctctgtaattagagttgttgaaacactcaaagagaatggtcttttgaaccttttttttaataaaccgcacaattttgaagttacattttccactaactcttctccactcttttttgttaaattaatgggtgatacactccatgccatgggctattacagatatataacaaagagttctaaattaaacagcagtgaatttacatggagtgtgggtattacttcagagtatgcaacagatcctatcttattagataaagagctttttaaaagagggtgtaaaattgtagatattgagagagtaagcagtgataagtggatt

SEQ ID NO: 14836 - protein, 163 aa, Unknown
  Obtained from environmental sample
  SIGNAL (1)...(17)
  misc_feature (1)..(163): Xaa is any amino acid
MVKKLLFLALAFSISFASNDLHNKIESLITKRVYEKNRSFIDIIFSDEQKYYDNSNLSVIRVVETLKENGLLNLFFNKPHNFEVTFSTNSSPLFFVKLMGDTLHAMGYYRYITKSSKLNSSEFTWSVGITSEYATDPILLDKELFKRGCKIVDIERVSSDKWI

SEQ ID NO: 14837 - DNA, 366 bp, Unknown
  Obtained from environmental sample
  misc_feature (1)..(366): n is a, c, g, or t
atgagtattgaagtagatctatatgaatacctatcaaataacactgctattaaatcaaaagttgaagataggatatatccagtattagcaaaaaaaggtgttaaaaccccatatatcacatatataaatgtaaatgacatggatttaacatctgcacaaggagaaaactatgcaaatgtgacaaggtttcaagttgatatcttttctgagacttattctcaagggaagactatattaggtgcagtcaaagaagcgttgtatcagtttaagcatactcctcacgattttagttcgagagatatgcatgaacaagacacaaagctttatagacagctaatagaatttaaatttataaataaaggataa

SEQ ID NO: 14838 - protein, 121 aa, Unknown
  Obtained from environmental sample
  misc_feature (1)..(121): Xaa is any amino acid
MSIEVDLYEYLSNNTAIKSKVEDRIYPVLAKKGVKTPYITYINVNDMDLTSAQGENYANVTRFQVDIFSETYSQGKTILGAVKEALYQFKHTPHDFSSRDMHEQDTKLYRQLIEFKFINKG

SEQ ID NO: 14839 - DNA, 390 bp, Unknown
  Obtained from environmental sample
  misc_feature (1)..(390): n is a, c, g, or t
atgagtatatttgccctacaatcagcggcaggcggttttttggatgaaggtttaaaacgcttcaataaagagtttgatgaatggtgtattcagtttaacaactatgaagatgctaatcttgttagacaaaatcttggtaaaaaaataagtccagagattgtagagatcacccctttaagttatccaaaatattttttttatactcttcaaggggttatccatgcgacaagacagattgatgataaaatcatatgcattgttgaaccatatatgagttcaacctttcgcatcgcggtgtgtgacttaaatacaaaatatgtaaaaatatcaaagactagctataagaatgtgctaagtgtagagggtgcatttgcacattttgaactgtga

SEQ ID NO: 14840 - protein, 129 aa, Unknown
  Obtained from environmental sample
  misc_feature (1)..(129): Xaa is any amino acid
MSIFALQSAAGGFLDEGLKRFNKEFDEWCIQFNNYEDANLVRQNLGKKISPEIVEITPLSYPKYFFYTLQGVIHATRQIDDKIICIVEPYMSSTFRIAVCDLNTKYVKISKTSYKNVLSVEGAFAHFEL

SEQ ID NO: 14841 - DNA, 441 bp, Unknown
  Obtained from environmental sample
  misc_feature (1)..(441): n is a, c, g, or t
atgaataatattcctgatagcaaaaaagaccgtttaatgaaaaagagaattctcggtcaatacaaacacgagaacggtagtaaatacgatgaacgtccagcaatagttgcgttaatacttcaggcgttcgcacgatatcagaaaaacaattattcatttaccgtaccggaatggtcagagtcagcaaaggaaaaatggagcatagagagtaatacagttttatcctttcttcaggatacatattttaataatgatttttccgaaacaatcgagcgatcattactatacgaaaaatataaagaatggtgcaaagcagaagatcggaaacattacggaaagaataatttctatgaggaattacgcctgaataaagaaaacgttgaagagctcaaaataaacggtaacaatatgtttaaaattaaagataaaataccattttag

SEQ ID NO: 14842 - protein, 146 aa, Unknown
  Obtained from environmental sample
  misc_feature (1)..(146): Xaa is any amino acid
MNNIPDSKKDRLMKKRILGQYKHENGSKYDERPAIVALILQAFARYQKNNYSFTVPEWSESAKEKWSIESNTVLSFLQDTYFNNDFSETIERSLLYEKYKEWCKAEDRKHYGKNNFYEELRLNKENVEELKINGNNMFKIKDKIPF

SEQ ID NO: 14843 - DNA, 828 bp, Unknown
  Obtained from environmental sample
  misc_feature (1)..(828): n is a, c, g, or t
gtgccaggatataaagtaatttcatggctcgggggttcatcggctgtccgccaaactaaatgggaattgttaaccaaatgccaacacatatttatatggcctgatgctgattcaggaagagataaaaacggtgaactattagcagtgtatttacaaccagggatgaaagcagctatctatattaaatcaattctacctcaagcaaagatccttgatgtttaccaatatactcctatagaaacggctaacggctatgacatagccgattatgttgaagatggacacaatccgcttgattttatagaagaattttccccggaaaaatcaattgatatcccattggacccgctggaatataaaaactattttataaaagatttctacggggaaaccggattgagacaatttgctggtggatattgggaatatgaccatgcccgacattattggaaaaagattatcaaaaatgacatcctttgtaatatgcaaacatggttaatagatacatctttacaatatcggatatcagcgaagaaaaaagcaacagagtttataaaccaaatgcgtaattatatcgaccgtcatgcaatcggatatattagtaaaaatccatttattgaagctgcaattgcaccgtatctacattttaaaaatggagctctaaaaataaaaccaaaatcaatggaatggattgaccgagattctaccgatgaagaacattttaaagatctttatccgttaagttgtcttgattttgaacttgatttcgataattataaacatgttgaaccgggaaaaaaatgtccgctattctataattcctgcaag

SEQ ID NO: 14844 - protein, 276 aa, Unknown
  Obtained from environmental sample
  misc_feature (1)..(276): Xaa is any amino acid
MPGYKVISWLGGSSAVRQTKWELLTKCQHIFIWPDADSGRDKNGELLAVYLQPGMKAAIYIKSILPQAKILDVYQYTPIETANGYDIADYVEDGHNPLDFIEEFSPEKSIDIPLDPLEYKNYFIKDFYGETGLRQFAGGYWEYDHARHYWKKIIKNDILCNMQTWLIDTSLQYRISAKKKATEFINQMRNYIDRHAIGYISKNPFIEAAIAPYLHFKNGALKIKPKSMEWIDRDSTDEEHFKDLYPLSCLDFELDFDNYKHVEPGKKCPLFYNSCK

SEQ ID NO: 14845 - DNA, 672 bp, Unknown
  Obtained from environmental sample
  misc_feature (1)..(672): n is a, c, g, or t
atggattttgatgaatttcttatagcctgcaaagaaagaaaactttcagattttcttaacacgatttctcccggcgacactatttcgtctccagttcatcagaaattatgggaatactataaattttttatgattaccggaggtcttcctgaagttgttaaaaactttgttcatacaaaaaacaatataaatgaagcttttactcaggtacgtaaaattcagaaaaacataataaaagactataccgatgatatctcaaaacattccgggaaaataaaatctgttaaaataaaagccgtttttaacaatattccccttcagcttgcaaaggagacaaatggaatcagaaaatttgtttttaaagacgtgcttcctgaaaattcaagatattcaagtcttgaagcaccaattgaatggctgattaaagccggactggttcttaaagtgcctatcataaaaaaggtggaaattccgttaaaagcaatgactgacgaaaaaaaatttaaactttacctttttgactgcggaattcttggatgtatgcttgagctttcgcctgaaattattttcacacaagactacggcctctacaaaggttatttcgcagagaatgttgttcttcctgaacttatcaaaacgtttggtgataagcgatatactcatggcatataa

SEQ ID NO: 14846 - protein, 223 aa, Unknown
  Obtained from environmental sample
  misc_feature (1)..(223): Xaa is any amino acid
MDFDEFLIACKERKLSDFLNTISPGDTISSPVHQKLWEYYKFFMITGGLPEVVKNFVHTKNNINEAFTQVRKIQKNIIKDYTDDISKHSGKIKSVKIKAVFNNIPLQLAKETNGIRKFVFKDVLPENSRYSSLEAPIEWLIKAGLVLKVPIIKKVEIPLKAMTDEKKFKLYLFDCGILGCMLELSPEIIFTQDYGLYKGYFAENVVLPELIKTFGDKRYTHGI

SEQ ID NO: 14847 - DNA, 807 bp, Unknown
  Obtained from environmental sample
  misc_feature (1)..(807): n is a, c, g, or t
ttgctggaatcagaactgttcggtcacgtcaaaggagcttttacaggagcacatgagaaccgtcccggacgtataaagttagctcataacggttcgtttttcctgacagaaattggagacctaccgctgaaccttcaggttaaactgctctcattcttagatgataaagagatatatcctctgggaagttcaaaaggatttaaagcggacgtgcgtgtcattgttgccactcatcgcaacttaaaacaaatggttatagataaaactttccgtgccgatttactgttcagacttaatgtggttcaccttcatctgccgcctctccgagagcgcggggaagatattcttttacttaaaaaccactttctcaaagactactgcacaaaatttcacaagaagattaaaggttttaccaaaaaaactgccaaaataattttagcctatcattttccaggaaacgttcgtgagcttcgaaatattgttgaatatgctgtaaacttttgcgaccgcgattatatcggaactgaacatcttcccgcgtatcttacagaacaagatattctgcgtcccgtaatggaatctgcaaagacttcccatgaatattcccagcaaaaagactactctcctgccgaanactgggatcacgctgaaaagagaatgatcatggatgcgcttgtcaaaaataacggcagaaaaggtgaggcggcaaaaatgctaggctggagcaggtccaccttctggcgcaaaattataaacactccattaatggataaccccatggacaaaaaaatacttatcccactttta

SEQ ID NO: 14848 - protein, 269 aa, Unknown
  Obtained from environmental sample
  DOMAIN (213)...(253): Bacterial regulatory protein, Fis family
  misc_feature (1)..(269): Xaa is any amino acid
MLESELFGHVKGAFTGAHENRPGRIKLAHNGSFFLTEIGDLPLNLQVKLLSFLDDKEIYPLGSSKGFKADVRVIVATHRNLKQMVIDKTFRADLLFRLNVVHLHLPPLRERGEDILLLKNHFLKDYCTKFHKKIKGFTKKTAKIILAYHFPGNVRELRNIVEYAVNFCDRDYIGTEHLPAYLTEQDILRPVMESAKTSHEYSQQKDYSPAEXWDHAEKRMIMDALVKNNGRKGEAAKMLGWSRSTFWRKIINTPLMDNPMDKKILIPLL

SEQ ID NO: 14849 - DNA, 873 bp, Unknown
  Obtained from environmental sample
  misc_feature (1)..(873): n is a, c, g, or t
ttggcaaataaagatgaaaacggtaacactatagactttgacaaaatctacgacgacttcataaaaccagccatcgaagatgctgggcttgaacccatacgagcggatgaagagcaggtgggtgggattattcataagactatgtatgagaggctgattctttgtgagtatgctgtggctgatcttagcacggctaatgcaaatgttttttatgagcttggtattcgtcatgctgttagacctcatagcactgtctctatatttgaagagcagagtaaactcccttttgatacaaattttttacgctcactaccttatgatcgagagttgaaaaatttagatgttttaaaagagcagttgactcaaaaactccttacctctaaaaaagagaaacatacagattcaccactttttcagttagtcgatggtttgaaaccctcaaacatagaacacataaaaacagatgtttttagagatcaggttgagtactctaaaagtgtaaagaagagactctcagatgcacgaaacagtaaagacaaaagtgagctaataagcattgagaactctcttgaaaactttgaagttgtagaatcaggtgtactgatagatctgtttttgtcttacagagcgctcgaagcttacgagcagatgatagagttggtttcaaagatgccaaaacctctaaatcaaactaagatggtgcaagagcagttagggtttgcactaaatagagcagggcagaaaaaagaggctatatctgttcttgaagaggttatagctaaacatggaaaaagtagtgaaacatgtgggattctagcgagagtatataaagattactggagagaaaacagctcaaacgaggcatatgcaaaa

SEQ ID NO: 14850 - protein, 291 aa, Unknown
  Obtained from environmental sample
  misc_feature (1)..(291): Xaa is any amino acid
MANKDENGNTIDFDKIYDDFIKPAIEDAGLEPIRADEEQVGGIIHKTMYERLILCEYAVADLSTANANVFYELGIRHAVRPHSTVSIFEEQSKLPFDTNFLRSLPYDRELKNLDVLKEQLTQKLLTSKKEKHTDSPLFQLVDGLKPSNIEHIKTDVFRDQVEYSKSVKKRLSDARNSKDKSELISIENSLENFEVVESGVLIDLFLSYRALEAYEQMIELVSKMPKPLNQTKMVQEQLGFALNRAGQKKEAISVLEEVIAKHGKSSETCGILARVYKDYWRENSSNEAYAK

SEQ ID NO: 14851 - DNA, 768 bp, Unknown
  Obtained from environmental sample
  misc_feature (1)..(768): n is a, c, g, or t
atgaatgaacctttagctgaacgcatacgacctaaaacattagacgactatattagtcagcaacacttagttggtaaaaatggtgcattaacgcaacatataaaaagaggtattattccttcattaattttatggggaccacctggaattggaaaaacaactttggcaaacattattgcacaagaatctaaaagaccgttttatacattaagcgccataagttctggagtaaaagacgttagagatgtgattactaaagcaaaacaaagtggtggattatttactgaaaaaaatccaatactatttattgatgaaatccatagatttagtaaatctcaacaagattctttattaggtgctgttgaaaaaggttgggttactttaattggtgcaacaactgaaaacccaagttttgaagtaattcccgccctcctatctcgttgtcaagtttatattttaaactcatttagtaaaagtgatttagaagatttattagagcgtgctttacaaactgacatatttatttcaaaaaaaaatataaaaattaaagaaacagaagctctgttgagagtttctggaggtgatgctagaaaattattgaatatttttgagttggtagtaaactctgaagaagaacctattattattacaaatgatatggtactttctaaaattcagaaaaacactgttttatatgataaaactggcgaacagcattacgatattatttctgcgtttataanatcaattcgaggaagcgacccntag

SEQ ID NO: 14852 - protein, 255 aa, Unknown
  Obtained from environmental sample
  DOMAIN (41)...(211): ATPase family associated with various cellular activities (AAA)
  misc_feature (1)..(255): Xaa is any amino acid
MNEPLAERIRPKTLDDYISQQHLVGKNGALTQHIKRGIIPSLILWGPPGIGKTTLANIIAQESKRPFYTLSAISSGVKDVRDVITKAKQSGGLFTEKNPILFIDEIHRFSKSQQDSLLGAVEKGWVTLIGATTENPSFEVIPALLSRCQVYILNSFSKSDLEDLLERALQTDIFISKKNIKIKETEALLRVSGGDARKLLNIFELVVNSEEEPIIITNDMVLSKIQKNTVLYDKTGEQHYDIISAFIXSIRGSDP

SEQ ID NO: 14853 - DNA, 582 bp, Unknown
  Obtained from environmental sample
  misc_feature (1)..(582): n is a, c, g, or t
atggtagaatatagattactcattgagacaagtgatacaaaaggtttggtatatagtatttcaaaagtgttatttgaacacaacttaaatatagtgagcaactcagaatttgttgataatgaaacaaatgagttttttatgagaactgttataactggtagttttgatgaaaaagttctaataagtgacataaaaaaagtacttccacaaaatgcaaatataaagcttacaaatagtgataaaaaagacatagtaatacttgcaacaaaagagatgcattgtttaggtgatttactaattaagaatatggcgggtgatttagatgcaaatattacagctgtcgtatcaaatcatgatagtttaagagagctagttgaaaaatttaatatcccatttgagtatgtatctcatgaaaatttaaatagggaagaacatgaagaacttattataaaagcaatcaaaaaatatgattatgagcttattgttcttgcaaaatatatgagaatattgacacctaattttgtgaaaacttttccaaagcaagtgttaaatatacaccattcatttttaccagctttatag

SEQ ID NO: 14854 - protein, 193 aa, Unknown
  Obtained from environmental sample
  DOMAIN (82)...(193): Formyl transferase
  misc_feature (1)..(193): Xaa is any amino acid
MVEYRLLIETSDTKGLVYSISKVLFEHNLNIVSNSEFVDNETNEFFMRTVITGSFDEKVLISDIKKVLPQNANIKLTNSDKKDIVILATKEMHCLGDLLIKNMAGDLDANITAVVSNHDSLRELVEKFNIPFEYVSHENLNREEHEELIIKAIKKYDYELIVLAKYMRILTPNFVKTFPKQVLNIHHSFLPAL

SEQ ID NO: 14855 - DNA, 522 bp, Unknown
  Obtained from environmental sample
  misc_feature (1)..(522): n is a, c, g, or t
gtgtcccngtttgcatatatcggggtaaaggtgaaagtgatctacacccgtacgatggtccatatctatgccaaaggaaagcaagtggccgttcatatcagaaactacggtatgggcagatacagtacaaacaaagagcacctttgttctgcccacaaccattaccttgatcgtagtcctgaatactatatcagaaaagccaaagctgccagcgatgaacttggagaactcatccagatggtctttaagcaaaaccgccacccggaacaactataccgtacttgtgatggcctgttgagcctttggcgaaaaacaaatcccataacctttaaaaaagcttgcctgatcgcactcaaaaaccaggtgtgttcatacaagtttataaccaatatcatctctaacaagatgatcgatatgccagaagaaaaaaacaatccggctttacctgaacataaaaacatcaggggcaaagcctattattcacaaatacaaataaattttaacacttatgatgcaaattga

SEQ ID NO: 14856 - protein, 173 aa, Unknown
  Obtained from environmental sample
  misc_feature (1)..(173): Xaa is any amino acid
MSXFAYIGVKVKVIYTRTMVHIYAKGKQVAVHIRNYGMGRYSTNKEHLCSAHNHYLDRSPEYYIRKAKAASDELGELIQMVFKQNRHPEQLYRTCDGLLSLWRKTNPITFKKACLIALKNQVCSYKFITNIISNKMIDMPEEKNNPALPEHKNIRGKAYYSQIQINFNTYDAN

SEQ ID NO: 14857 - DNA, 816 bp, Unknown
  Obtained from environmental sample
  misc_feature (1)..(816): n is a, c, g, or t
atgatacgacaaaaaattgtattaacaatgttattattttgcttctcgttaataacagttgcacagactaattttaacacacaacaaacaaattatgagtttagtggcatagatttcatttctatagaagggagatctaaactattaggtgctgtttcttatgaaaggtacaatttccaaatctctttaccaatcttactaaaaaaaccagaaagttatttgtttcataatttaaactactcaaaaactaaaattgtatctggtaagattatatatggtattaagcccaatacaaacgcaaacgtagaagatttccattctgtaggttacacatttggttattcttgcccattaaagcgagattggatgcttacggcaattataagccctagtgtttcatccaactttgaatctgggcttaaaatgaaagaaattcaactttacggtatggctgttttttctaaagcaataggtcgaaagaataatttaatcctgaatttaggagtcttgtcttcaccaaaatttggccttatacctatcgtaagtgcagtatggcagccagctcctaaatggaatctaaatataggctttccagagtttgacattaaatatcaagccactccaactacaacagttggagccaatgtatttattgatggggatcagtttactttctcaaaagatgctgtttatgagcctaatanaaaaaaggttgatgcgctgagtgttttaaatattggtacagctgtttatttaaatcaaaaaatagccaaatcaataaactttaaacctaaatacaggatttacagtacatcc

SEQ ID NO: 14858 - protein, 272 aa, Unknown
  Obtained from environmental sample
  SIGNAL (1)...(21)
  misc_feature (1)..(272): Xaa is any amino acid
MIRQKIVLTMLLFCFSLITVAQTNFNTQQTNYEFSGIDFISIEGRSKLLGAVSYERYNFQISLPILLKKPESYLFHNLNYSKTKIVSGKIIYGIKPNTNANVEDFHSVGYTFGYSCPLKRDWMLTAIISPSVSSNFESGLKMKEIQLYGMAVFSKAIGRKNNLILNLGVLSSPKFGLIPIVSAVWQPAPKWNLNIGFPEFDIKYQATPTTTVGANVFIDGDQFTFSKDAVYEPNXKKVDALSVLNIGTAVYLNQKIAKSINFKPKYRIYSTS

SEQ ID NO: 14859 - DNA, 744 bp, Unknown
  Obtained from environmental sample
  misc_feature (1)..(744): n is a, c, g, or t
atggtattagaaaaagtacttgaaagctctggtttacgactcaatgaagagtatataagagaaactacacttaaaaatgacgatggagaaaaatacagacccgatgtgatagtaaatctccctgctaatagacaagtaatcatcgatgcaaagacttctttgacaaattatgaacaatatacatcgacacaagatgtaatagagaaaaagggccatttgaatttacacataaaatcaataaatacccacatagattccctttcaaataaaaattatgaagagttaaagggggttaatactttagacttcatatttatgtttatccctattgagagtgcattaatgctagctatggaaagtgataaaggtctatttgataaagcctttaaaaagaagattgtactagtttccccaactacacttttagtagctttaaaagcagttgagaatagttggagatatgagaaacaagcacaaagtacaacagaggttatacgacttgcagagaagctttataataaggtaagaacttttgtagaagattttgaaaaagtaggaaaaaatctgagtcaagctcaaaaatcatatgatgatgcctacaaaaaactctcatctggaaaagataatatcgtaagacaaatagaggttttcaaagaaaaatcaaatataagcccttcaaaacagataagtcaagatattgttgatagtgctatggttgaacaaatagagaatatggaagagtaa

SEQ ID NO: 14860 - protein, 247 aa, Unknown
  Obtained from environmental sample
  DOMAIN (1)...(232): RmuC family
  misc_feature (1)..(247): Xaa is any amino acid
MVLEKVLESSGLRLNEEYIRETTLKNDDGEKYRPDVIVNLPANRQVIIDAKTSLTNYEQYTSTQDVIEKKGHLNLHIKSINTHIDSLSNKNYEELKGVNTLDFIFMFIPIESALMLAMESDKGLFDKAFKKKIVLVSPTTLLVALKAVENSWRYEKQAQSTTEVIRLAEKLYNKVRTFVEDFEKVGKNLSQAQKSYDDAYKKLSSGKDNIVRQIEVFKEKSNISPSKQISQDIVDSAMVEQIENMEE

SEQ ID NO: 14861 - DNA, 591 bp, Unknown
  Obtained from environmental sample
  misc_feature (1)..(591): n is a, c, g, or t
atgcttttagatgtagtagaagccaactataaaaaagcaaaagagagagaagatgaaccttatcagttcaatatgtttttaacacttacaagagctcaacttatctttaaacttgtaaactatgtgtctgatttatatatcaaacatcataaacaaatctttgatggttcttttaacagcgctttattagaatatgacaaagcccacgagtgttcacaagctgtagaggtactcaaaaatatctcgtatagatatatttatacacacaagcaggtacaagctttagagataaaaggatattctatcatacaagggttatttgatatttatgagccgcttttaaaacttaatactgaagaatttgaatcactattagctgataaaagagtagattgtgctatttgtcaaaatttactctacagattatcaaaaaaacatcttgtagcctataaaaaaagtgtaagtggtatcagtgatactgagaactataaacttttagagtggtattatagagcaagacttttatgtgactatattagtggtatgacagatgattatgctttatttgaacatcaatctctgtctgcgtaa

SEQ ID NO: 14862 - protein, 196 aa, Unknown
  Obtained from environmental sample
  misc_feature (1)..(196): Xaa is any amino acid
MLLDVVEANYKKAKEREDEPYQFNMFLTLTRAQLIFKLVNYVSDLYIKHHKQIFDGSFNSALLEYDKAHECSQAVEVLKNISYRYIYTHKQVQALEIKGYSIIQGLFDIYEPLLKLNTEEFESLLADKRVDCAICQNLLYRLSKKHLVAYKKSVSGISDTENYKLLEWYYRARLLCDYISGMTDDYALFEHQSLSA

SEQ ID NO: 14863 - DNA, 741 bp, Unknown
  Obtained from environmental sample
  misc_feature (1)..(741): n is a, c, g, or t
atgagaaagtattttttagttttacttttattttgcacttctcttttaagtagtgaaattatcatcaaagatagtgatagctcatttgatgattttggaataaactattttcatgacaaaacaggtgagttaacacttaagcaaatacaaaatatacaagattttaaaacaataaccaatagtgtagctttaggaaaacaagagggaaatatctggtatcacttcagtataaaaaatacaatgcaagaggtacaaaaaagagtcctttttgcaacagaacccaatgtttgggatatggaactatttgttattgatgataaaaaaatcatttccaagcaagctgtcggtcaaaatgtttttaataaagatggaaaaatagcaagcttctatcctgaacttgagatagatcttgaagctggagagaagatagatgtatatattagaaaattttcgccctttcaccatacttttaaggtggttataaatactcataaagatgtagtaaaatataaaatttttaaaaactctttgctaagtttatattgtggtgcaattggtgcgttactgctttataacctatttatctatttttctatacgagataaaaattatctgctatatataggctttgtatttttctatcttttagcacaaatgcaacaaaacaccacttttaatagtttatttagctctacagagattacttttttccattgcatcctcacatgtattttgggtcgc

SEQ ID NO: 14864 - protein, 247 aa, Unknown
  Obtained from environmental sample
  SIGNAL (1)...(17)
  DOMAIN (28)...(164): 7TMR-DISM extracellular 2
  misc_feature (1)..(247): Xaa is any amino acid
MRKYFLVLLLFCTSLLSSEIIIKDSDSSFDDFGINYFHDKTGELTLKQIQNIQDFKTITNSVALGKQEGNIWYHFSIKNTMQEVQKRVLFATEPNVWDMELFVIDDKKIISKQAVGQNVFNKDGKIASFYPELEIDLEAGEKIDVYIRKFSPFHHTFKVVINTHKDVVKYKIFKNSLLSLYCGAIGALLLYNLFIYFSIRDKNYLLYIGFVFFYLLAQMQQNTTFNSLFSSTEITFFHCILTCILGR

SEQ ID NO: 14865 - DNA, 648 bp, Unknown
  Obtained from environmental sample
  misc_feature (1)..(648): n is a, c, g, or t
atggtaagtatctatcaccagtggaaatcacctgtaattaacatatacaactacataacccatatagaaacagcaaaagagtttcaagataaaaatatcgacaaaatagtcgatacaaatctagataagataaaacaaaacaccctctaccttagagatactgcctcagagtttttaaaaatgaatacaatcaaaagctcgacaaaagagaaagtaaacttaagagaaatgatagaatcagttcttagacttatggatacagattttaataaaaataaaatcaaaatcatagacaactataagcaagatatagttctaatgacctatcaaaatcaactacgaaatcttttgatgatactggttgaaaatactataaaaacctttagaaatagagatataaaaaatccacaacttaaagtaagtactaccaaaaacggtaaaagtgtaaccataatagttgaagataatgcagggggaataatagaaaaacctatagataaaatctttgagagataccactctgcaagtgattctagcggtataggactttatttagcaaagtatgttttgatggaaaatttagatggagagataagtgttgaaaataatgatggtggggctaagtttattatgatactaaagtgttaa

SEQ ID NO: 14866 - protein, 215 aa, Unknown
  Obtained from environmental sample
  DOMAIN (108)...(215): Histidine kinase-, DNA gyrase B-, and HSP90-like ATPase
  misc_feature (1)..(215): Xaa is any amino acid
MVSIYHQWKSPVINIYNYITHIETAKEFQDKNIDKIVDTNLDKIKQNTLYLRDTASEFLKMNTIKSSTKEKVNLREMIESVLRLMDTDFNKNKIKIIDNYKQDIVLMTYQNQLRNLLMILVENTIKTFRNRDIKNPQLKVSTTKNGKSVTIIVEDNAGGIIEKPIDKIFERYHSASDSSGIGLYLAKYVLMENLDGEISVENNDGGAKFIMILKC

SEQ ID NO: 14867 - DNA, 687 bp, Unknown
  Obtained from environmental sample
  misc_feature (1)..(687): n is a, c, g, or t
gtggaagagcaaaacccttctaaagttatttttaatgaagagagtgcttatgtacttttagtacttaaaaagaaacaagccaacaggtttaacggaattttagggattgttcccgatgaaacaggaaaggttagattaaacggagatgtaaaacttaatttaatgaactcttttaagcgtggagaagaaatttcgttcaattggagagccatgcaaaacaattcacaagatttaaaattgactacagcttatccttttttattcagcagtccttttggagccgaataccaactaaatatttataaaagagacagtacctatatagatgtctttaataaaattggagcaagatacattctaaaaggaaataattatttcaatatattctatcacaacaaaagttctagcttattatctcaaaaaggttttgaaacccttacagttttacctgattttgcagatgtatctactcaactttacggaattgggattgtttatgaccaattagattacatccacaacccaagaagaggctttagtattactgncaatggttcgttgggaaataaaaaatcacaaaaaacccccactcaacaacagctttatgaagatgtaaacttaaaaacaacctatataccgctcaagcaaatttggcacttacttcctaataaaaaaaggaatgtataa

SEQ ID NO: 14868 - protein, 228 aa, Unknown
  Obtained from environmental sample
  misc_feature (1)..(228): Xaa is any amino acid
MEEQNPSKVIFNEESAYVLLVLKKKQANRFNGILGIVPDETGKVRLNGDVKLNLMNSFKRGEEISFNWRAMQNNSQDLKLTTAYPFLFSSPFGAEYQLNIYKRDSTYIDVFNKIGARYILKGNNYFNIFYHNKSSSLLSQKGFETLTVLPDFADVSTQLYGIGIVYDQLDYIHNPRRGFSITXNGSLGNKKSQKTPTQQQLYEDVNLKTTYIPLKQIWHLLPNKKRNV

SEQ ID NO: 14869 - DNA, 438 bp, Unknown
  Obtained from environmental sample
  misc_feature (1)..(438): n is a, c, g, or t
atgatttttgtagatgaaccatatgtttcggaattttttaaaatgactgccaaagacaatagcatacctatcgtcggcacagaaatagcaaaaaagatagatctttataatggcaccaagataatcggtgaagatgaggctattgaaatagttcgaaagacaaatattcctattatgtatatgacgtctganaattcaatagattggataacgaaacatttggcttttagtgatcttcctgaaaaaataaagttttttaaagataagctgaaatttcgtgaactaacaaaatcaattttccccaattttattttcaaagaggtacgggtagaaaacctaaaaaagattcagtttaatgaattgcccattacatttattatccaaccaactgttggtttttttaatatgggggtttataaagtttcaaattttgaggaa

SEQ ID NO: 14870 - protein, 146 aa, Unknown
  Obtained from environmental sample
  misc_feature (1)..(146): Xaa is any amino acid
MIFVDEPYVSEFFKMTAKDNSIPIVGTEIAKKIDLYNGTKIIGEDEAIEIVRKTNIPIMYMTSXNSIDWITKHLAFSDLPEKIKFFKDKLKFRELTKSIFPNFIFKEVRVENLKKIQFNELPITFIIQPTVGFFNMGVYKVSNFEE

SEQ ID NO: 14871 - DNA, 882 bp, Unknown
  Obtained from environmental sample
  misc_feature (1)..(882): n is a, c, g, or t
atgccctctctggtcattaataccccctacgtcattactatccatgatacaatagctatcgatcacccgaaactttgcacatattcaaatgccttgtattacaatctttttatgaaggcatctgttaaaaaggcaactaaagttatcgcagtctcccaagtcactaaaaacaggattcatggcaatttcaaagttagagattcaaagatagaagttataaatcctggcattgagactgtttttttcagtcaaccagatcttgccaaagaaaattatgtaaaatcaaaatacaatctgcctgataaatatattttatatctaggtaatattgagccaaagaaaaatcttatcaatcttttaaaagcgtttaatcttttagttaaacaatcttgtgagcataaacttgttcttatcggcaaaagaagctggaagagcaaaaagatttggcaatatataaaaaacaactttcaggataatcaggtaatcctcgcgggatatacaaagcgggagcatcttagcagtatttacaaacaggccgatgtttttgtatttccatctatagttgaaggctttggctttccgccgctagaggctatggcctgcaagacagcagtagcatcaagtaaagttggggtattaaaacaatttgatagtaattgttatgttgaaattgattgcaatagccctgaactaatttcaaatggtattttgaaaatcataaacaatggcaagctaaagcaacgcctagtcgaatcggcatataaaaaaatacaggaattcagttgggagaaatgtgcaaataaaacttttgaaatatacnagccaactgttgagaagaaagactgttacnacataaaaaatgaaatacaaacggcaaactaa

SEQ ID NO: 14872 - protein, 293 aa, Unknown
  Obtained from environmental sample
  DOMAIN (90)...(256): Glycosyl transferases group 1
  misc_feature (1)..(293): Xaa is any amino acid
MPSLVINTPYVITIHDTIAIDHPKLCTYSNALYYNLFMKASVKKATKVIAVSQVTKNRIHGNFKVRDSKIEVINPGIETVFFSQPDLAKENYVKSKYNLPDKYILYLGNIEPKKNLINLLKAFNLLVKQSCEHKLVLIGKRSWKSKKIWQYIKNNFQDNQVILAGYTKREHLSSIYKQADVFVFPSIVEGFGFPPLEAMACKTAVASSKVGVLKQFDSNCYVEIDCNSPELISNGILKIINNGKLKQRLVESAYKKIQEFSWEKCANKTFEIYXPTVEKKDCYXIKNEIQTAN

SEQ ID NO: 14873 - DNA, 312 bp, Unknown
  Obtained from environmental sample
  misc_feature (1)..(312): n is a, c, g, or t
atgtataaattaaactattttgttcccgttgattcaaaggaggagactaaaaaagctctatttgatatcggtgttgggaagatcggaaattatgagtgttgttcatgggagtctttaggttatggtcaatttaaagctactggtgatgctaatccctctttaggtgaaatagacaaacttgagatcgtacaagagtataaagtagagttgatttgctctaacgagctaatacatgaagccattaaaacgttaaaagaggctcatccatatgaagaagttgcctatgaagtttttaagatggaagatttttag

SEQ ID NO: 14874 - protein, 103 aa, Unknown
  Obtained from environmental sample
  misc_feature (1)..(103): Xaa is any amino acid
MYKLNYFVPVDSKEETKKALFDIGVGKIGNYECCSWESLGYGQFKATGDANPSLGEIDKLEIVQEYKVELICSNELIHEAIKTLKEAHPYEEVAYEVFKMEDF

SEQ ID NO: 14875 - DNA, 717 bp, Unknown
  Obtained from environmental sample
  misc_feature (1)..(717): n is a, c, g, or t
ttgatatatgattttggtatatacttcataataatatttaaagatagtgaaggaatcaaaaaatatttttctaaaagagcattagatattgatagattttattatgaaaataaagttttaaaagagcataaagatataatgaaatatatcacaacggtgacaaataaaaaaactgttgcattgggtgattatcgtagtcaattttatggtgatggagaattctcttttaacaaaatagataattatgaaacttttataaaactatactctaagctttttaatatttcaaaaacagttatagatagtaattcaataaaagaagctattaaagattctattggaaaaaaagatgagttttttgagtttgatgcatccgaattttatagtagtttttttaaattacaatatcttaataaattttataaaacttatgaaaagaataaaaaaagaataaatgagttaatgaacatttataaaaatgtaatacagatagagagtgatttagatatatcattaaagcaaataaaatatagatatgactatgaacaaaaagaatatgaaagtctgaaaacaaaaattacaagtattgaaaataagctaaatattaaaaattcttactcgagacatttaaaacagagaataaactatatgactgataaaattaaaagattttcagatagtttgatttatgaattaaaagagatagaaaaactttga

SEQ ID NO: 14876 - protein, 238 aa, Unknown
  Obtained from environmental sample
  misc_feature (1)..(238): Xaa is any amino acid
MIYDFGIYFIIIFKDSEGIKKYFSKRALDIDRFYYENKVLKEHKDIMKYITTVTNKKTVALGDYRSQFYGDGEFSFNKIDNYETFIKLYSKLFNISKTVIDSNSIKEAIKDSIGKKDEFFEFDASEFYSSFFKLQYLNKFYKTYEKNKKRINELMNIYKNVIQIESDLDISLKQIKYRYDYEQKEYESLKTKITSIENKLNIKNSYSRHLKQRINYMTDKIKRFSDSLIYELKEIEKL

SEQ ID NO: 14877 - DNA, 531 bp, Unknown
  Obtained from environmental sample
  misc_feature (1)..(531): n is a, c, g, or t
gtgaaaaataaaccatttggtgttataataccttctgattcatgtattggacacatagttacagttgcatattcatctcctgaagataataatggatcatttcttcttacattattatgttcatatggtgaaggtataccgtatctatatttagtagttttgtcacctagttttgttccccattccacttcattaacaatctgtttttcatcagctgaagctttaacaggtcctaaaatactagttgcagctattgcacttacagataaagttgctgaattttttaaaaaatcacgtctgctagactcttctaaagtattattatccttagtagttaatgattttttaaaaatatctttaatcttattcattaacattctcctttttaatattatattgattaggcagttttcataccaaaactacaaattatatagaaatacaacttcaaaagtcaagaaatataagagaaaattttcaaaaataattttttcattaagtaaacaaatatttattataagctcatattga

SEQ ID NO: 14878 - protein, 176 aa, Unknown
  Obtained from environmental sample
  misc_feature (1)..(176): Xaa is any amino acid
MKNKPFGVIIPSDSCIGHIVTVAYSSPEDNNGSFLLTLLCSYGEGIPYLYLVVLSPSFVPHSTSLTICFSSAEALTGPKILVAAIALTDKVAEFFKKSRLLDSSKVLLSLVVNDFLKISLILFINILLFNIILIRQFSYQNYKLYRNTTSKVKKYKRKFSKIIFSLSKQIFIISSY

SEQ ID NO: 14879 - DNA, 849 bp, Unknown
  Obtained from environmental sample
  misc_feature (1)..(849): n is a, c, g, or t
ttgaagcatttaaatacaattggtcgatattggcgaaaaaagtatggacaaaaagtttataaaatacctattagtatatctggatttacttgtccaaatatagatggaacagtagcaaaagggggttgtaccttttgtgaaaatgaatctttttctccaaatttagtagataaatcaagatttaaacttaatcttcattcaaaagagaatccctatttagagaaacaacttttacaacttcaaatgcaatttgatgctacaaaagagagactagaaaataaatatggtgcaaaaaaatttattgtttattttcaatcatttacaaatacctatgctcccctagatactttaaagtcactttatgaaaaagctttgagctttgataatgtggtaggtttaagtataggtacacgaacagatagtatcacagaagaaactttagattatctacaaagtttatcaaaagataaagagatctgggttgagtacggaatacaatcaatttatgatgaaactctagaaaaaataaatcgtggacacacttttgcaaatattcaagagtggatacttaaaacaaaagatagaaatttgttagtttgtggtcatatgatatttggacttcctaacgaaacacaagagatgatgcttaaaggtgttaaagaatcactaaagctaggtatagattctattaaatttcatcctttgtatgtaacgaaaaatacactcttggncaatgaatataagcagggagagtttaccccaataagtgaagaactttatgtaaatacccttgtgaagtctataaaaatgttacctgataatgtatcantatcaagggtaacagcgggg

SEQ ID NO: 14880 - protein, 283 aa, Unknown
  Obtained from environmental sample
  DOMAIN (25)...(222): Radical SAM superfamily
  misc_feature (1)..(283): Xaa is any amino acid
MKHLNTIGRYWRKKYGQKVYKIPISISGFTCPNIDGTVAKGGCTFCENESFSPNLVDKSRFKLNLHSKENPYLEKQLLQLQMQFDATKERLENKYGAKKFIVYFQSFTNTYAPLDTLKSLYEKALSFDNVVGLSIGTRTDSITEETLDYLQSLSKDKEIWVEYGIQSIYDETLEKINRGHTFANIQEWILKTKDRNLLVCGHMIFGLPNETQEMMLKGVKESLKLGIDSIKFHPLYVTKNTLLXNEYKQGEFTPISEELYVNTLVKSIKMLPDNVSXSRVTAG

SEQ ID NO: 14881 - DNA, 522 bp, Unknown
  Obtained from environmental sample
  misc_feature (1)..(522): n is a, c, g, or t
ttgaaatttgacgaagatgcaaaagttgcgggttggacgcgtgatgttgaagttggagattctgtcgcttacaaaaaatctgcaatgctttttgctttcattacaactgttcctgggatcccaataatttattatggtgatgaagttggtatgcctggcggaaatgatcctgacaatcgcaaaatgatgaattttgataatctaaaaccagagcaagcaaaattaaaatataccgcagaacgtctaataaaattacgcagaagttcgatggctcttatttatggcgattttaaatttttgtttgtagatgatgaagttatggtttatcaacgaacatattttgacaaagttgtaattattgtgctaaataattctgacgaatcagagcctctttttgttccaattgacaaaatgtacgattattcaaaaatggagtcaatatttgataattgttttgcaattggcgataatgaattacagattaatattgaaggaaattcttttgaaattttaatgaattag

SEQ ID NO: 14882 - protein, 173 aa, Unknown
  Obtained from environmental sample
  misc_feature (1)..(173): Xaa is any amino acid
MKFDEDAKVAGWTRDVEVGDSVAYKKSAMLFAFITTVPGIPIIYYGDEVGMPGGNDPDNRKMMNFDNLKPEQAKLKYTAERLIKLRRSSMALIYGDFKFLFVDDEVMVYQRTYFDKVVIIVLNNSDESEPLFVPIDKMYDYSKMESIFDNCFAIGDNELQINIEGNSFEILMN

SEQ ID NO: 14883 - DNA, 597 bp, Unknown
  Obtained from environmental sample
  misc_feature (1)..(597): n is a, c, g, or t
atgacatcattttttactaccggcggaataaggggaggaggcgaaaaattagataagttttttcctcgcagttttaatatgggttattcgcgtgaggttttcgataaaacacaaggttttgcaaaaatgcgttttggcgaagatatagatatgagtattcgtattttaaaaaatggttttaaaacacgattaattaaagatgcatttgtatatcataaacgtagaacaaatgtgcgacaattttataagcaggtgtataattccggaatagcacgaataaatttatttaaacgtcatccacaatcgttaaaaattgtgcactttttccctgctctttttaccgtaggaaccctttctcttattccgttatcaatatttatatctgttttatttctgattcctatagcattgttgatagttttaatttttactgattctagcattaaaaataaaagtatacatattggagtattgtctgttttggttagttttattcaattggttgcttatggttttggttttataaaagcttattggaagcgtgtattatttgctaaaaaagaattttctgcttttaccgataatttttacgagtag

SEQ ID NO: 14884 - protein, 198 aa, Unknown
  Obtained from environmental sample
  misc_feature (1)..(198): Xaa is any amino acid
MTSFFTTGGIRGGGEKLDKFFPRSFNMGYSREVFDKTQGFAKMRFGEDIDMSIRILKNGFKTRLIKDAFVYHKRRTNVRQFYKQVYNSGIARINLFKRHPQSLKIVHFFPALFTVGTLSLIPLSIFISVLFLIPIALLIVLIFTDSSIKNKSIHIGVLSVLVSFIQLVAYGFGFIKAYWKRVLFAKKEFSAFTDNFYE

SEQ ID NO: 14885 - DNA, 1071 bp, Unknown
  Obtained from environmental sample
  misc_feature (1)..(1071): n is a, c, g, or t
atgggtaatattgagacacaaaattttgcatcgttttctaatttgcaagcgggcacctacaatattgaagttaatggaacaaactctgactatgtgtggagtagtcatatagccaaatttaagataaaagttgaaaaggtttggtataaaacaaattttgcatatgtgatttttgcagtgtttgtttttatattctttttacttagtattgagatccgaactagacgattacgactaacaaatcagatgttacgagaaaaagaggctgttgctaaggagataaatattcaaagaaatagattagcagaattgaacgaaagcatgacagaaagcatagtttatgcaaagcgaattcagaaggcattgtttccgaacgattaccattttagtaaaatattgccccattcttttaccctgttagtgccaaaagatattattagtggcgatttttattggattgcaaatagaaatagtaaaatttgtgtagctgctattgattgtaccggacatggcgtgccaggttctttaatgtcggtaattgccattgaattattaaaaaaagttatagttgaagaaggttatacaaagccatcagaaatattaaatcaaatagatttagacttaaataatgttttctcaaaagatgaagataacgacgtagctggtggtatggatattagtgtgtgtgttattgatagtgaaagtttgacattggaatttgctggtgcacgaaattcattatatcaagtatcacagtcgaaattaattgaaatagaggctgatatagtgcctgtaagtttagcctgtaaaaataataattttgagtatacaaatcattttgtagattataagcccgacgatatgttttatttgttttctgatggatatccagatcaatttggagggaaaaattctgaaaaggataaatattacaaatttaaaaccttttttagcatcaatagccgaatccgaaaattgatatgccgccaagctttgttgggaaaattatttttaaaaaaatggaaaggtctaaacaaacaaactgaccaagtttatggtggttggttttaa

SEQ ID NO: 14886 - protein, 356 aa, Unknown
  Obtained from environmental sample
  DOMAIN (156)...(337): Stage II sporulation protein E (SpoIIE)
  misc_feature (1)..(356): Xaa is any amino acid
MGNIETQNFASFSNLQAGTYNIEVNGTNSDYVWSSHIAKFKIKVEKVWYKTNFAYVIFAVFVFIFFLLSIEIRTRRLRLTNQMLREKEAVAKEINIQRNRLAELNESMTESIVYAKRIQKALFPNDYHFSKILPHSFTLLVPKDIISGDFYWIANRNSKICVAAIDCTGHGVPGSLMSVIAIELLKKVIVEEGYTKPSEILNQIDLDLNNVFSKDEDNDVAGGMDISVCVIDSESLTLEFAGARNSLYQVSQSKLIEIEADIVPVSLACKNNNFEYTNHFVDYKPDDMFYLFSDGYPDQFGGKNSEKDKYYKFKTFFSINSRIRKLICRQALLGKLFLKKWKGLNKQTDQVYGGWF

SEQ ID NO: 14887 - DNA, 885 bp, Unknown
  Obtained from environmental sample
  misc_feature (1)..(885): n is a, c, g, or t
atgaaaagacattcatatgtgggactagagagcttaaaagggaaaaaggtaggtataagtagaaatattttttataaagatattttagagaagcaagggattgagattgttgagtttgtaggcagtgatgaaaaggttgaagctttagtattaaataaaatagattattttttatcctcatatacttcagctcaaaaatcaattaatactaaaggaataactagtattaaaccactaggggaatttaaagagataaaaaaagaagatttacggtttggaataaataaagagaacaaactattatatagtattataaaaaagtcaatgaagaagataacagaagatcaatactcaaaaattatcaataaatggatgatgaatctatatatacaagataaaagagaagccagtagagtatacctaacaataaaagagaaagaatatttagaaaataaaaaagagataaagttttgtgctgatccctcatggatgcctttagaggggattaaaaacggtaaaattgatgggataacttctgattatataaaaatatttagtaaagctattggtataccatttcgtcttgtagaaactaactcttggagccaaagtttacagtatgccaaaatgagaaaatgcgatattttatcatttctaacaatggaaacaaaaaagagaaaagagtatttgaattttacaacaccatacataaatataccacttgtaatagctactaaatatgatgtaacatttattaccgatcttgctagtttagacaagaaaaaaatagggataccacgaggatatgcattttatgaaatattaaaagagaaatatcctaaaataaattttgtagaggtaaataataatattgaggggcttaca

SEQ ID NO: 14888 - protein, 295 aa, Unknown
  Obtained from environmental sample
  misc_feature (1)..(295): Xaa is any amino acid
MKRHSYVGLESLKGKKVGISRNIFYKDILEKQGIEIVEFVGSDEKVEALVLNKIDYFLSSYTSAQKSINTKGITSIKPLGEFKEIKKEDLRFGINKENKLLYSIIKKSMKKITEDQYSKIINKWMMNLYIQDKREASRVYLTIKEKEYLENKKEIKFCADPSWMPLEGIKNGKIDGITSDYIKIFSKAIGIPFRLVETNSWSQSLQYAKMRKCDILSFLTMETKKRKEYLNFTTPYINIPLVIATKYDVTFITDLASLDKKKIGIPRGYAFYEILKEKYPKINFVEVNNNIEGLT

SEQ ID NO: 14889 - DNA, 630 bp, Unknown
  Obtained from environmental sample
  misc_feature (1)..(630): n is a, c, g, or t
gtgggatacctttttcaaacacaatttgttggggagttgaaaattgcaggaaaatttgatgaaagttgggagttaggaattgctattagaggtgatgatataactttattaaatattttacaaaaaacattagatacaatatctagcgaggaacataaaaatatttttaataactggatagctattaaatatgagagtaaaatagattaccaattactatgggaaataatatctattgcgatggttatttttttagtttttctctactggaatagaaagttacgaataatgaatagtgagttagagtttcaaaaaaacaaagcacaagaagcattaaaagtaaaatcaaattttttagcaaatatgagtcatgagataaggacacctattaatgtaattttaggtatgacttatttagtgcaaaaagaggttcaagataaaaaacagcaagaacaacttcataatatagagaaagcaacaacttcattattaagattgattaatgatattttagatagttcaaaaatagagataggaaagcttaatattgtaaaaaataacttcaatatggatcaagtattaaacaatgttaaagcagttgcaacatctaatatgaagctaaagatatag

SEQ ID NO: 14890 - protein, 209 aa, Unknown
  Obtained from environmental sample
  DOMAIN (114)...(179): His Kinase A (phosphoacceptor) domain
  misc_feature (1)..(209): Xaa is any amino acid
MGYLFQTQFVGELKIAGKFDESWELGIAIRGDDITLLNILQKTLDTISSEEHKNIFNNWIAIKYESKIDYQLLWEIISIAMVIFLVFLYWNRKLRIMNSELEFQKNKAQEALKVKSNFLANMSHEIRTPINVILGMTYLVQKEVQDKKQQEQLHNIEKATTSLLRLINDILDSSKIEIGKLNIVKNNFNMDQVLNNVKAVATSNMKLKI

SEQ ID NO: 14891 - DNA, 375 bp, Unknown
  Obtained from environmental sample
  misc_feature (1)..(375): n is a, c, g, or t
atgttgatcaagtcggataatatgccaaccgaaggcatcttctacaatggacaaatcttcgatgcatggctatttgtttctgatattattaagtcagcaaaaaaagagatagtcttaattgacaattatatcgacgagagtgtttttactttattttcaaaacgtaaaaaggatgtaaaagcaacaatatataccgcacaaatatctaaacaactgatattagatcttgaaaaacacaattctcaatattcggaaatatcacttaaaacattccataaagcacacgaccgcttcctaataatcgataataaaaccgtctatcacataggtgcatccttaaaagaccttggcaaaaaatgcctgcctgccgcctag

SEQ ID NO: 14892 - protein, 124 aa, Unknown
  Obtained from environmental sample
  misc_feature (1)..(124): Xaa is any amino acid
MLIKSDNMPTEGIFYNGQIFDAWLFVSDIIKSAKKEIVLIDNYIDESVFTLFSKRKKDVKATIYTAQISKQLILDLEKHNSQYSEISLKTFHKAHDRFLIIDNKTVYHIGASLKDLGKKCLPAA

SEQ ID NO: 14893 - DNA, 477 bp, Unknown
  Obtained from environmental sample
  misc_feature (1)..(477): n is a, c, g, or t
ttgatcagatcggctcgagtccatacctactcttattcaaatcttgaaacacctaaagaaaataatcaaattaaaagagaagagactattagttttataaaggcacactccgaagttggattcaatcatgatgagaaagaattattacttaaaagtctagatgctgtagataagttaatccaagagatacaaaaaatcaataaactaaaaataaagaattatgaccaatttaatgatataagaaacactacactacaaataatcaacactgatttaaaatttcatgctaaattttatattgatagaatttatctaaatcattttttaatgatggaaccatatttagggtttcaatttaatgagaaacttgaaaatgaagcgaattatgtgaaaaaggttaaaaaagtatggtgtacacagatgttaaaaatagctaatgaatataaagatttaatttactctgtcactaaatggtag

SEQ ID NO: 14894 - protein, 158 aa, Unknown
  Obtained from environmental sample
  misc_feature (1)..(158): Xaa is any amino acid
MIRSARVHTYSYSNLETPKENNQIKREETISFIKAHSEVGFNHDEKELLLKSLDAVDKLIQEIQKINKLKIKNYDQFNDIRNTTLQIINTDLKFHAKFYIDRIYLNHFLMMEPYLGFQFNEKLENEANYVKKVKKVWCTQMLKIANEYKDLIYSVTKW

SEQ ID NO: 14895 - DNA, 489 bp, Unknown
  Obtained from environmental sample
  misc_feature (1)..(489): n is a, c, g, or t
atgaaaaatattccaaacaatctcaaaattgaactagaagaaaaatatcctatagatgttgcaaaaatagtacgaatagaagaaagttctgatggaactaaaaaatatctatttgagtttaaagatggaaaaacagctgaagcagtactacttttaatgaaagataagcaaaaagatgaagatggaaatataacaaaaagtgaaaaatatactttttgtatctcaagtcaagttggttgtaaagtagggtgtagtttttgtttaacagcacgagggggatttgtaagagacttaagtgcaggggagattatagcacaaatagtttacttgaaaaaacaaaataatatagctcaaaacaaagctgtaaatattgtttatatggggatgggtgaaccattagataactttgataatcttacagatgcaattaaaattatctcagatttagatggtttggctatnagtaccagaagacaaacgatctctanc

SEQ ID NO: 14896 - protein, 163 aa, Unknown
  Obtained from environmental sample
  misc_feature (1)..(163): Xaa is any amino acid
MKNIPNNLKIELEEKYPIDVAKIVRIEESSDGTKKYLFEFKDGKTAEAVLLLMKDKQKDEDGNITKSEKYTFCISSQVGCKVGCSFCLTARGGFVRDLSAGEIIAQIVYLKKQNNIAQNKAVNIVYMGMGEPLDNFDNLTDAIKIISDLDGLAXSTRRQTISX

SEQ ID NO: 14897 - DNA, 588 bp, Unknown
  Obtained from environmental sample
  misc_feature (1)..(588): n is a, c, g, or t
atgaaaatagcgatagtacatgactggctggtaactaatgcaggtgctgaaaaagttttaaaagctatatttgaaatatatccacatgccgatatcttttctcttgttgattttttaagtcatgaagatagaaaagttattttaaataacaagttcgtaaaaacttcttttatacaaaaattaccttttgctaaaaagcattttagaaactacttgcctctttttccaaatgctatcgagagttttgatttaagtagttatgatttgattattagcagttcttgggcagttgctaagggaattagaaaaaataaaaaacagcttcacatttgctattgtcatacacccatgcgatacgcttggaatttgtatgatgaatatacttcaagcttaatgggactaaaaaagttgttagtacaagtaactttaaaaagattaaaaaaatgggatattgatactcttgatagagttgattattttatagctaattccaattttgttcaagagagaataagaagaatatataaaagagattctgttgttatataccctcctgtgagtcaagaaattacgctaatgggcaactga

SEQ ID NO: 14898 - protein, 195 aa, Unknown
  Obtained from environmental sample
  misc_feature (1)..(195): Xaa is any amino acid
MKIAIVHDWLVTNAGAEKVLKAIFEIYPHADIFSLVDFLSHEDRKVILNNKFVKTSFIQKLPFAKKHFRNYLPLFPNAIESFDLSSYDLIISSSWAVAKGIRKNKKQLHICYCHTPMRYAWNLYDEYTSSLMGLKKLLVQVTLKRLKKWDIDTLDRVDYFIANSNFVQERIRRIYKRDSVVIYPPVSQEITLMGN

SEQ ID NO: 14899 - DNA, 372 bp, Unknown
  Obtained from environmental sample
  misc_feature (1)..(372): n is a, c, g, or t
ttgaacgacatcgctgatgtcctgacgttcaagaatttcgtcacgaccaaaagctggcatatcgttaaaccgggtatcctcattggcatcccaacggacaccgacatgaatggtttcgttgatggcgtcaagcgcgcccccccaaagccagtcatcatcctgaagggacgggaaaccggggttacccgatccgcctgtaccatgacaaggtgcacagttctcggcaaaaattgctttgccgccagccatcgagaagttcagcagttcgccgtcatcgacgattccgtcaaggtcaagtgcagccagacgttccatataaggggcgcgttcggcagcaacattggccatggtttcgtgaagttgcgtacggtt

SEQ ID NO: 14900 - protein, 124 aa, Unknown
  Obtained from environmental sample
  misc_feature (1)..(124): Xaa is any amino acid
MNDIADVLTFKNFVTTKSWHIVKPGILIGIPTDTDMNGFVDGVKRAPPKPVIILKGRETGVTRSACTMTRCTVLGKNCFAASHREVQQFAVIDDSVKVKCSQTFHIRGAFGSNIGHGFVKLRTV

SEQ ID NO: 14901 - DNA, 363 bp, Unknown
  Obtained from environmental sample
  misc_feature (1)..(363): n is a, c, g, or t
ttgatagaaatcaaaaatctaactaagaagtatgaagagataattgcagttaatgatctatctctggaaatcaaatcaggagaattgtttggtcttcttggacccaatggtgctggaaaaactacagccctgaatttaatgagtacatttatcaaacctgacagtggtaaaatttcaattaacaatattgatattttaaccaatccaaaaaaaataaagccgataatcggattcattccgcaagagatctctctctatgacgatttaactgttgaagaaaatctgaatttctggggtaaaatctataaaatgtcaggaagctcactaaaatcccgaagagaagattacaaagctgagccataa

SEQ ID NO: 14902 - protein, 120 aa, Unknown
  Obtained from environmental sample
  misc_feature (1)..(120): Xaa is any amino acid
MIEIKNLTKKYEEIIAVNDLSLEIKSGELFGLLGPNGAGKTTALNLMSTFIKPDSGKISINNIDILTNPKKIKPIIGFIPQEISLYDDLTVEENLNFWGKIYKMSGSSLKSRREDYKAEP

SEQ ID NO: 14903 - DNA, 480 bp, Unknown
  Obtained from environmental sample
  misc_feature (1)..(480): n is a, c, g, or t
gtgggagagattatggtaaagggtgataatgttatgaagggttattacaagaataaagaagctactgaagcttctatcactaaggataaatggctgagaactggtgatctggggatagttgatcacgaagatgttatatttattaaaggtcgttgtaaaaatatgattcttggcccttctgggaaaaatatctaccctgaagaaatagaatcaaaattaaataatcttccctttgtccaggaatcaatcgtcattgaaaagagtgggcaactaatagctatggtatatccagatatggagatgatcgatgcacaaaagatcagcgaaaaccaacttcaaaacattctggaaaataacagaaaaatccttaatagcaacttcccatcttatatgtcggtaggtaaaattaagatctatgcacaggaatttgagaaaaccccgaaacgaagcataaaaagatatctatattataatgactag

SEQ ID NO: 14904 - protein, 159 aa, Unknown
  Obtained from environmental sample
  misc_feature (1)..(159): Xaa is any amino acid
MGEIMVKGDNVMKGYYKNKEATEASITKDKWLRTGDLGIVDHEDVIFIKGRCKNMILGPSGKNIYPEEIESKLNNLPFVQESIVIEKSGQLIAMVYPDMEMIDAQKISENQLQNILENNRKILNSNFPSYMSVGKIKIYAQEFEKTPKRSIKRYLYYND

SEQ ID NO: 14905 - DNA, 726 bp, Unknown
  Obtained from environmental sample
  misc_feature (1)..(726): n is a, c, g, or t
atggtagaacagtctagatttgcagcaatgggtgagatgataggtaatatcgcgcatcagtggagacagcctcttagctctattagtaccattgcaacaggtgctaggcttagatataaaaataatcttataagtgatgaagaacttgatgaaacttttgtaaagataaaagaccatactcaacatctttcaaaaacaatagatgattttagagacttctttaaacaacataaagagataggtgagtttgagatttgtgatgttatagataagtctataatgcttaccgaagctatgtataaagataataatataaaacttgtccttaaaagtaacataccaaaaattatggttaatggaagcagcagtgaactctctcaggtgtttttaaatattttaaataatgccaaagatgctttacaagaaaaagagataaaaaactcaattgtgtttatagacgtcctagatgaagctgaatatgtagttcttaaaatacatgataacgcaggtggaatcccggatgatataaaaacaaaaatatttgagccatactttacaactaaacataaatctcaggggacaggaataggactgtttatgagtaaaaaaataataacaaaacattttaatagcactattgaggttgaaaatagagaatttaaagtagagaatgaaaagttttatggtgcggaatttagtataaagataaaaaagacaaaaaattaa

SEQ ID NO: 14906 - protein, 241 aa, Unknown
  Obtained from environmental sample
  DOMAIN (9)...(79): His Kinase A (phosphoacceptor) domain
  misc_feature (1)..(241): Xaa is any amino acid
MVEQSRFAAMGEMIGNIAHQWRQPLSSISTIATGARLRYKNNLISDEELDETFVKIKDHTQHLSKTIDDFRDFFKQHKEIGEFEICDVIDKSIMLTEAMYKDNNIKLVLKSNIPKIMVNGSSSELSQVFLNILNNAKDALQEKEIKNSIVFIDVLDEAEYVVLKIHDNAGGIPDDIKTKIFEPYFTTKHKSQGTGIGLFMSKKIITKHFNSTIEVENREFKVENEKFYGAEFSIKIKKTKN

SEQ ID NO: 14907 - DNA, 456 bp, Unknown
  Obtained from environmental sample
  misc_feature (1)..(456): n is a, c, g, or t
atgattcttggcttggattatacgattctttcattaatcatagtttcctttttattacctttttatatctatagaaaaagagtttttaaattctattataataaaagtgatagtgcatattttctaaaagatttacaaatatacttaaaaaacaatcatccaaaaataaattttgattttgcaaaaatagattcaatttataaatcaaatcctcctgaactatcaaaactattggtattagaaaatattgctgaacaatttataaacttcgaatatgtaaagagaacgcaaaaagcagtatcaaaagatattttatggggaagttatgaaaaagaatctaatccaaaaaatagtactgcaaataatcttttaagaagaaaagagattgttttaagaagggataactatagatgtaatagatgtgcaaaggcaaaaaaacttggatactccatggta

SEQ ID NO: 14908 - protein, 152 aa, Unknown
  Obtained from environmental sample
  misc_feature (1)..(152): Xaa is any amino acid
MILGLDYTILSLIIVSFLLPFYIYRKRVFKFYYNKSDSAYFLKDLQIYLKNNHPKINFDFAKIDSIYKSNPPELSKLLVLENIAEQFINFEYVKRTQKAVSKDILWGSYEKESNPKNSTANNLLRRKEIVLRRDNYRCNRCAKAKKLGYSMV

SEQ ID NO: 14909 - DNA, 666 bp, Unknown
  Obtained from environmental sample
  misc_feature (1)..(666): n is a, c, g, or t
atgaaaaaagagacactacaaaaaagaacaaaaattgcaaatgatattatgtattatatctatacacatattgacactcatattgatatagaagagttgagtatagatttaaaagtaagcaagtttcatatgcatagaatcttcaaagatgcctttggaaaaaatatttatgaaagcatcaaatctattcgtcttcaaaaagcatcaaatctgcttttaacaaataaatattcgactatttcaaatattgtaaatcaatgtggttactcttcccaatcctcttttataaaaagttttaaacagagatttgaaatgacaccaaaagagtggagaaatacaggttataaagcctactcttcaaaaatattacaacaatcacaaaaggccatgcagtcaactgctgacttttccaatatgaaaccaacaatagtaaaaatgccaacttttgaaagtttttatattagaaataatggttacaatgcaaatataaaagaggcttggcataaactccaaacttggattttatcaaatgatataaaagagtatncagaaattgcactttttcatgataaccctacaatcacaccacttaatgagtgtcaatatattgcttgtaatgtaactgatgataaagatattaaaagtgataggttgccaaacttttag

SEQ ID NO: 14910 - protein, 221 aa, Unknown
  Obtained from environmental sample
  DOMAIN (67)...(112): Bacterial regulatory helix-turn-helix proteins, AraC family
  misc_feature (1)..(221): Xaa is any amino acid
MKKETLQKRTKIANDIMYYIYTHIDTHIDIEELSIDLKVSKFHMHRIFKDAFGKNIYESIKSIRLQKASNLLLTNKYSTISNIVNQCGYSSQSSFIKSFKQRFEMTPKEWRNTGYKAYSSKILQQSQKAMQSTADFSNMKPTIVKMPTFESFYIRNNGYNANIKEAWHKLQTWILSNDIKEYXEIALFHDNPTITPLNECQYIACNVTDDKDIKSDRLPNF

SEQ ID NO: 14911 - DNA, 975 bp, Unknown
  Obtained from environmental sample
  misc_feature (1)..(975): n is a, c, g, or t
aacccaggaaaaatagaagctagaaataatcttgtacttctttcaaatgatatccaaaatcagggtggtacaatagaagccaaaaatgatgcaccactaaatagtaatacagatattcaaaatataagtggagatataaaagcaggaaatgacttagaacttaatgcaaataataatatcaatataaaaagctctacaaatcaaaaaacatttaattatgcacaagggtatcaaaccaccacatttaaagggaaagatgcaacactaaacgcaggtggaaatttaaaagtaaatgcaggggattctgtaactgtacaaggctcacaactacaagtacaagaagatgcaactatcatagcaaagaatggagatgtaaatatagatgccacacaacaaaaagagaagtttgactttgatgtatatggtggatactacaaaggagattctcttaaaaacaatggttcaacagtagaggtaaaaaatcttacagttttaacaaatggaaatctaaatataaatggtagtacaataaaagcacaagaagatgcaaatatctatgcaaacaatgttaatataacctccactacagatacaagctcctcaaaatacaaaagtgaatcaaaaggtttcttctcaagctcaaccacaaaacaagagaaacaaacctctcaaaatatagcctcactcctacaagcaaataatgtaaatatagatacagggaatctaacacttatagcttcaaaaataaaagcaaatgaagcacaaataacagcagagataataaacctaatctcctcaaaagatagccaatatgaaagtaacttctcagattcaagtgggattcttacaagaacaatagaaacaaaaggttatataaaagagatactaaaagaagcaaaaatagaagtaagtgataaactaatagtaaataataaagatataacaaaccaactcacaactctcgagccgatctga

SEQ ID NO: 14912 - protein, 324 aa, Unknown
  Obtained from environmental sample
  misc_feature (1)..(324): Xaa is any amino acid
MPGKIEARNNLVLLSNDIQNQGGTIEAKNDAPLNSNTDIQNISGDIKAGNDLELNANNNINIKSSTNQKTFNYAQGYQTTTFKGKDATLNAGGNLKVNAGDSVTVQGSQLQVQEDATIIAKNGDVNIDATQQKEKFDFDVYGGYYKGDSLKNNGSTVEVKNLTVLTNGNLNINGSTIKAQEDANIYANNVNITSTTDTSSSKYKSESKGFFSSSTTKQEKQTSQNIASLLQANNVNIDTGNLTLIASKIKANEAQITAEIINLISSKDSQYESNFSDSSGILTRTIETKGYIKEILKEAKIEVSDKLIVNNKDITNQLTTLEPI

SEQ ID NO: 14913 - DNA, 681 bp, Unknown
  Obtained from environmental sample
  misc_feature (1)..(681): n is a, c, g, or t
gtggacctaacttctattgagattataaccccaatagctctagttaacaagcatctggtgaaaataagcaggccacagcttgaagttattcttcatatagaaaataaattaatgcataaaaatttcaatgctgctgatttaattatttgcgatgactctaacctgctctcctttgactttatcgactatttaaaacatatacaaaaaaagtcttctttacttttagtaaatgagcacgatgatgaagacagcacgtttagatttgatgaaagctttaaagataaaaaactaaaagtgattttcaaacaagcaaatcaacatgcaaaagcacttcaagttatttcaaaattactagaagaaaatagttctaaggaaattttagttgtcagcaataacttaagtaaaaagaatttaaatgaagacttagaatttttcatcagagataaagctattctattggatagttctactaatttaatgtatcaagatttagacaacttacttttatgttcatacgcacaaatcagtgcaatgagttctaaatatgtaatactcttggatgttggcgatgcttcattgaatgaagtagaatatgcactaaacttggcacaagacactgcttgtgtcatttacgagaaaaacagtgaaaatataaaaatattaaaggaaaaaatgctntaa

SEQ ID NO: 14914 - protein, 226 aa, Unknown
  Obtained from environmental sample
  misc_feature (1)..(226): Xaa is any amino acid
MDLTSIEIITPIALVNKHLVKISRPQLEVILHIENKLMHKNFNAADLIICDDSNLLSFDFIDYLKHIQKKSSLLLVNEHDDEDSTFRFDESFKDKKLKVIFKQANQHAKALQVISKLLEENSSKEILVVSNNLSKKNLNEDLEFFIRDKAILLDSSTNLMYQDLDNLLLCSYAQISAMSSKYVILLDVGDASLNEVEYALNLAQDTACVIYEKNSENIKILKEKML

SEQ ID NO: 14915 - DNA, 405 bp, Unknown
  Obtained from environmental sample
  misc_feature (1)..(405): n is a, c, g, or t
atgagagaaacaaaatacagagcgtggagcaagaagagcaatagaatgttcagtgttatagaattacgatttgttgcagaagaagtaacgcttaatcctattttgagtgaagtaaggattaacgaccaatacgacactttccaagactttaacgatgttgaattgatgcaatttacaggatttaaagacaaaaaaggtgtcgagatatttgatggcgacattttaagtgattggaacgaaattgacggcaagcaagttcaatctaaaatgcaagtattctggtgcgatattacaggggcttggcgtttagatagtagttttaagcaaaataaaagtaacagcgacttactaagtgatgaattagctaatttcacatacgaaattacaggcaatgtttattcgtag

SEQ ID NO: 14916 - protein, 134 aa, Unknown
  Obtained from environmental sample
  misc_feature (1)..(134): Xaa is any amino acid
MRETKYRAWSKKSNRMFSVIELRFVAEEVTLNPILSEVRINDQYDTFQDFNDVELMQFTGFKDKKGVEIFDGDILSDWNEIDGKQVQSKMQVFWCDITGAWRLDSSFKQNKSNSDLLSDELANFTYEITGNVYS

SEQ ID NO: 14917 - DNA, 699 bp, Unknown
  Obtained from environmental sample
  misc_feature (1)..(699): n is a, c, g, or t
atgacagacatggagtttaaaaaaactgataaaatgacttttcttatccaaagtaactatcatttgctaccggtattgcacaggtttggccttaaacttggatttcgaaataaaactgttgaacaactctgtgatgaaaaagaaaagaacgcggatttctttatcacaatcgcaaatacgttccataacaaaaactatttccctgaagaaaaacttctggcattctctccaatcctaattatcgattatttaaggaaaacacatcagtattatattagttattcacttccaaaaattgaaatattgattcatgatttgatattgagcagcgaccctaataaaaatgaaatgcaaatgattgaggagttttatctcaggtacaaatcaaaatttgttaagcatattgaagatgaagaaaagaaagtatttccttatatcgataaattggtaaataaaccggatagtattaccaataaaacgtttcgctttagttttgaagaagaacataaagatgttgaccttgaaattgacgaccttaagaatcttatacttaaatatatcgctcctgattatgatgaactggtaggcaacgaacttatagctgaaattttcaggtttgaaaaagatatattcgaccatgcacgtattgaagatacgattttaattccgcaggtaaaacaacttcaaaataagctgtag

SEQ ID NO: 14918 - protein, 232 aa, Unknown
  Obtained from environmental sample
  misc_feature (1)..(232): Xaa is any amino acid
MTDMEFKKTDKMTFLIQSNYHLLPVLHRFGLKLGFRNKTVEQLCDEKEKNADFFITIANTFHNKNYFPEEKLLAFSPILIIDYLRKTHQYYISYSLPKIEILIHDLILSSDPNKNEMQMIEEFYLRYKSKFVKHIEDEEKKVFPYIDKLVNKPDSITNKTFRFSFEEEHKDVDLEIDDLKNLILKYIAPDYDELVGNELIAEIFRFEKDIFDHARIEDTILIPQVKQLQNKL

SEQ ID NO: 14919 - DNA, 801 bp, Unknown
  Obtained from environmental sample
  misc_feature (1)..(801): n is a, c, g, or t
atggctcagggctgtgtggaaccaaagaagagcgtagaagaaggatttacaagaaatatcctatcatcattgctcaaatttattatttcttcgatttattttaagcgggttttttccaagttgttttttaccaagtggttctattttttcattactgctggcagaaaccaaacgctctctaaagcagaagctttaggaagagtagcttatgctggttttgaaatgttggaagatacagagattaacaatttgctctattttgttgctcgcaaaataaatgattttgaacctagacctttaccgcggtttagcttgttatttaaaatgcaacgagtaggaaaaaacaataagcccattaccgtttttaaaataagaaccatgcatccttatgccgaatatttgcaggattatttatataaaaccaataatttacaaaaaggagggaagtttaaaaatgattaccgtattacctcttgggggagggtttttagaaaattatggatagatgaattgcctatgatttataactttttaaaaggagaaataaaattagttggagttcgtccgttaagtgaacagtatttgaatctttatacggatgaactaaaagcattaagaaaagaagtaaaaccgggtttaattcctcctttttatgccgatttacccgaaacattagatgatattattgcttcagaaattagatatattaaagcataccaacaacgtccgtttaaaacagatgtgagttatttttataaagcagtatgcaatattctttttaagaaagtaaggagtaagtaa

SEQ ID NO: 14920 - protein, 266 aa, Unknown
  Obtained from environmental sample
  DOMAIN (100)...(266): Bacterial sugar transferase
  misc_feature (1)..(266): Xaa is any amino acid
MAQGCVEPKKSVEEGFTRNILSSLLKFIISSIYFKRVFSKLFFTKWFYFFITAGRNQTLSKAEALGRVAYAGFEMLEDTEINNLLYFVARKINDFEPRPLPRFSLLFKMQRVGKNNKPITVFKIRTMHPYAEYLQDYLYKTNNLQKGGKFKNDYRITSWGRVFRKLWIDELPMIYNFLKGEIKLVGVRPLSEQYLNLYTDELKALRKEVKPGLIPPFYADLPETLDDIIASEIRYIKAYQQRPFKTDVSYFYKAVCNILFKKVRSK

SEQ ID NO: 14921 - DNA, 930 bp, Unknown
  Obtained from environmental sample
  misc_feature (1)..(930): n is a, c, g, or t
ttgagtcccttgcaaaacttttctgtcacagggttgatatggatttatccccactttatacccgtggaaaaatttaaagatgtatccaaaagattgcttgtgaaatcaatcagtcttgggggggatgatataaacgatgccatttgcagtgatcagaacaaggcatatctttccagaattttaaaacagccaaattctaaacaatcaacttctaaaaaaccaacttttaaaacaagcaggcctgaaaataaggtttcatataaaaaacccggagaaaaaataattcccatgtcccatgagaatctaccaaccagtgtaaccttagataataaagtttctgatgatcattttatgaataatgttgcccttttaaataatgcccatgaggtgtttctaaagacaagacaacaaggatctgaaaaactcaaagaactcatagagatccagattgggatggtatctgctcacccccccaaagtagctgataataatgtagctgctaaaaatgtaactgctaataatgtagctgctaaaaaagaaattgctaaaaaagtaatttgggactatgccgatcttctggagtttgccgaaggaaaaatcgcaaaagtttttggagaggattatgccataattgacacatataaaagaagggtaaggcttccaaaggaagaataccttcttgtcagccgtgttacaaaacttactggcgtaagaggagaatataaaccctcaaaaatgaccacggaatatgatatccccacggattctcccatgaccattgacggccagataccatgggccgttgccgttgagtcgggccagtgtgatcttctgctgatctcatacctcgggatagattttcagtgcaagggtgaaagggtatacagacttcttgactgcacctcgagccgaattttgatccttgggtaa

SEQ ID NO: 14922 - protein, 309 aa, Unknown
  Obtained from environmental sample
  misc_feature (1)..(309): Xaa is any amino acid
MSPLQNFSVTGLIWIYPHFIPVEKFKDVSKRLLVKSISLGGDDINDAICSDQNKAYLSRILKQPNSKQSTSKKPTFKTSRPENKVSYKKPGEKIIPMSHENLPTSVTLDNKVSDDHFMNNVALLNNAHEVFLKTRQQGSEKLKELIEIQIGMVSAHPPKVADNNVAAKNVTANNVAAKKEIAKKVIWDYADLLEFAEGKIAKVFGEDYAIIDTYKRRVRLPKEEYLLVSRVTKLTGVRGEYKPSKMTTEYDIPTDSPMTIDGQIPWAVAVESGQCDLLLISYLGIDFQCKGERVYRLLDCTSSRILILG

SEQ ID NO: 14923 - DNA, 813 bp, Unknown
  Obtained from environmental sample
  misc_feature (1)..(813): n is a, c, g, or t
ttgttacactttaaaaaaaattggagtttgtatatggatgattgtttaaaaactcaaaataacaactacaatcagattgaaaaagctattaaatatatagatgaaaattttaaagaacaaccttctatagatgagatagcttctaatattggtatgagtaaataccattttattcgagtgtttaaagaatatgtcggtgtgactccaaagcagtttttacattcactaactctaaactatgcaaaagaacatattagagaatcaaaatccatactagatagtagtcttgatattggactttcaagcacaagtagactccatgaactttttgtaaatcttataggagtaacgccaaaagagtatagagaaaaagggaaaaatgtaactataacttatggatatggagagacaccttttggtgaagcacttattgcttttacacttaaaggtatctgttatctgggatttatagataaaaataaagaggaaaattttgatagattttatgaaatttggggcaatgcaaatctcatacatgacaatgaaaaagcaaaagagtatattgaaaatatttttatcaaaaacaaaaaatacaatcttctagtcaaagggacaaattttcaagtgaatgtttggaaagctcttttaaatcttccaaatggtgtagttactacctatcaagatatggctaatcttattgataaaccaaaagctgtaagagctgtagcaagtgctataggaaaaaatcacataggctatctcatcccttgtcatagagttattgcaaaaagntggtgcaatgagtggatatag

SEQ ID NO: 14924 - protein, 270 aa, Unknown
  Obtained from environmental sample
  DOMAIN (204)...(269): 6-O-methylguanine DNA methyltransferase, DNA binding domain
  misc_feature (1)..(270): Xaa is any amino acid
MLHFKKNWSLYMDDCLKTQNNNYNQIEKAIKYIDENFKEQPSIDEIASNIGMSKYHFIRVFKEYVGVTPKQFLHSLTLNYAKEHIRESKSILDSSLDIGLSSTSRLHELFVNLIGVTPKEYREKGKNVTITYGYGETPFGEALIAFTLKGICYLGFIDKNKEENFDRFYEIWGNANLIHDNEKAKEYIENIFIKNKKYNLLVKGTNFQVNVWKALLNLPNGVVTTYQDMANLIDKPKAVRAVASAIGKNHIGYLIPCHRVIAKXWCNEWI

SEQ ID NO: 14925 - DNA, 396 bp, Unknown
  Obtained from environmental sample
  misc_feature (1)..(396): n is a, c, g, or t
atgaaattagataccaaagagttaaaaaatatcactttattatatgtagaagatgatcagcttattagagaacaaacaaataaaattttaacaaaattatttaaaaaagttttttgtgcatatgatggaaaaaatggattagaaatattcaaagagtatcaaaatgaaattgatgttatcgtaactgatattaatatgccacatttaaatgggttagagatgatagaagagattaataagttacaaaattcaataccaactattgttacaacagcgcatacagactcaaactatttaattaatgctattgatttaaatgttgataaatatattgctaaacctatccaaataaaagatttaactatttctgtagttgataatgttccaaaaatatga

SEQ ID NO: 14926 - protein, 131 aa, Unknown
  Obtained from environmental sample
  DOMAIN (11)...(131): Response regulator receiver domain
  misc_feature (1)..(131): Xaa is any amino acid
MKLDTKELKNITLLYVEDDQLIREQTNKILTKLFKKVFCAYDGKNGLEIFKEYQNEIDVIVTDINMPHLNGLEMIEEINKLQNSIPTIVTTAHTDSNYLINAIDLNVDKYIAKPIQIKDLTISVVDNVPKI

SEQ ID NO: 14927 - DNA, 360 bp, Unknown
  Obtained from environmental sample
  misc_feature (1)..(360): n is a, c, g, or t
atgaaaactttaatcttcacagatcttgatggaacttttttgaatcatgatgattactcttttgaagactcctttgatgctctaaaaaaaattaaacaaaaaaagatccctctcatatttactactagtaaaactaaatctgaagttatacaactacaacaaaaagttggtattgttgagccgtttatcattgaaaatggtgcagcgctttttataccacaaggttatcaaggtttaaatttaaatgatttgacaacttacgatggatataaaaatttaatatttggcataaaatataacgaaatactcaaattctatggaacatataaagataagtttggaatgagaagattccgtggc

SEQ ID NO: 14928 - protein, 120 aa, Unknown
  Obtained from environmental sample
  misc_feature (1)..(120): Xaa is any amino acid
MKTLIFTDLDGTFLNHDDYSFEDSFDALKKIKQKKIPLIFTTSKTKSEVIQLQQKVGIVEPFIIENGAALFIPQGYQGLNLNDLTTYDGYKNLIFGIKYNEILKFYGTYKDKFGMRRFRG

SEQ ID NO: 14929 - DNA, 759 bp, Unknown
  Obtained from environmental sample
  misc_feature (1)..(759): n is a, c, g, or t
ttgaatcatgatgattactcttttgaagactcctttgatgctctaaaaaaaattaaacaaaaaaagatccctctcatatttactactagtaaaactaaatctgaagttatacaactacaacaaaaagttggtattgttgagccgtttatcattgaaaatggtgcagcgctttttataccacaaggttatcaaggtttaaatttaaatgatttgacaacttacgatggatataaaagtttaatatttggcataaaatataacgaaatactcaaattctatgaaacatataaagataagtttggaatgagaggattcagtgatatgagcttagatgaagttatgaacttaactggacttgatgcaaacagtgcaacgctatcaagacaaagagacttcagtgagccatttattgtaaaaaataactcaatgatagatgatttaaacaaacttgcatatgaaaatggaatgaaaattacgcaaggtggcagattttttcatcttataggtcttaaccaagataaaggtatagctgtaaaaaagacatctgaactcttttcaaagctttttgtacaagatattttatctattggtttaggtgatggcataaatgatattgcgatgtttgaaaatgttgacaagcctattgttattaagaatcattatggcgaatatgttaaatcagatatagactctattcagctctcttcacataaaggcagtgctggatttaatgaaatggtattaaaaaatgtctcataa

SEQ ID NO: 14930 - protein, 252 aa, Unknown
  Obtained from environmental sample
  misc_feature (1)..(252): Xaa is any amino acid
MNHDDYSFEDSFDALKKIKQKKIPLIFTTSKTKSEVIQLQQKVGIVEPFIIENGAALFIPQGYQGLNLNDLTTYDGYKSLIFGIKYNEILKFYETYKDKFGMRGFSDMSLDEVMNLTGLDANSATLSRQRDFSEPFIVKNNSMIDDLNKLAYENGMKITQGGRFFHLIGLNQDKGIAVKKTSELFSKLFVQDILSIGLGDGINDIAMFENVDKPIVIKNHYGEYVKSDIDSIQLSSHKGSAGFNEMVLKNVS

SEQ ID NO: 14931 - DNA, 681 bp, Unknown
  Obtained from environmental sample
  misc_feature (1)..(681): n is a, c, g, or t
atgtttgaaaaatttttaagattttttgttgataatgcaaggatgaactatgttctttttgttttaattttttcaattggtatttactcttatatgaaaatgccaaaggagatatttccaacatttgatatggatatgatctctattagtggttcttacactggtgctagtgttgatatccttgataaaatggcagttacagagatagaagataatgtaaagtctttagagggtgtgattgaaactactacaataataagtccagggaaattttctattattttagagctacaaaaagggaaagatagatataacattgctgataaagttaaggatgcagtagctttaactcaaggtgatcttcctagcgatatggatgaaccaaatgtaagtgtaatagatagaagtagagatcttataaatatctcacttacttctgataaactcaatgtagatcaaatgaaaaaatttgcagatgattttaaaagtgaaattctaacaatcagtggtattagtgaagttactgtatttggagatagtgataaatattatgagatacttttagatgataaaaaacttgaagcgtataatatagataaaaatgaacttttcaatacaattagtacactttcttacatatttccaattgggaaaaatagaagggggcaaccaaaacactaa

SEQ ID NO: 14932 - protein, 226 aa, Unknown
  Obtained from environmental sample
  misc_feature (1)..(226): Xaa is any amino acid
MFEKFLRFFVDNARMNYVLFVLIFSIGIYSYMKMPKEIFPTFDMDMISISGSYTGASVDILDKMAVTEIEDNVKSLEGVIETTTIISPGKFSIILELQKGKDRYNIADKVKDAVALTQGDLPSDMDEPNVSVIDRSRDLINISLTSDKLNVDQMKKFADDFKSEILTISGISEVTVFGDSDKYYEILLDDKKLEAYNIDKNELFNTISTLSYIFPIGKNRRGQPKH

SEQ ID NO: 14933 - DNA, 660 bp, Unknown
  Obtained from environmental sample
  misc_feature (1)..(660): n is a, c, g, or t
atgtctattaaacttaaaagagtttccagtagccccttattgcttcctaaaaaagaaaatctctgggaagccgccgcagtatttaattgtgctgcaatttacgacaataataaagttcatatgatctatcgtgctacagacattgcctccagcgggaaagatggaccatttatcagcaggttgggttatgccgtaagcaatgatgggattcacttcaatcgaaagggtacacctttgcttacaaataaaggggagcaggaacttcggggactggaagacccccgaatagtaaaaatagagaacacattctacatgatgtataccggatacaagggaaaagaagcaggagactacagaatatgtctggcttcatcttccaaccttaaagactggaagcgccatggtgttgtccttgatgaatcaaacaaagatggttcattatttccagataaaattagtggaaaattctgcatgttccatcgtagagatcccgatatctggattgcatattctgatgacctgaaaaactggactaatcacacaagtataatgggtccggtagcctcttcagaatgggagtcaaagaaaattggtattgcggggtcctccgataaaaacgaaagacggatggttgctgatctatcatggtgtaagccatag

SEQ ID NO: 14934 - protein, 219 aa, Unknown
  Obtained from environmental sample
  DOMAIN (4)...(219): Domain of unknown function (DUF377)
  misc_feature (1)..(219): Xaa is any amino acid
MSIKLKRVSSSPLLLPKKENLWEAAAVFNCAAIYDNNKVHMIYRATDIASSGKDGPFISRLGYAVSNDGIHFNRKGTPLLTNKGEQELRGLEDPRIVKIENTFYMMYTGYKGKEAGDYRICLASSSNLKDWKRHGVVLDESNKDGSLFPDKISGKFCMFHRRDPDIWIAYSDDLKNWTNHTSIMGPVASSEWESKKIGIAGSSDKNERRMVADLSWCKP

SEQ ID NO: 14935 - DNA, 717 bp, Unknown
  Obtained from environmental sample
  misc_feature (1)..(717): n is a, c, g, or t
gtggagattcagtatatgtcaaagcaacaatttaataactttttagttgataaacttttaacatggtttgaatctaatataaaaataggtgaaaagtataagttcgattctgatgatgaacagcaacttaactcaattatggatagtctaagggctaagaatataaatacacttcctttcttggatgttgaagttccttatataaatatacaaggtacaaagcttatttttgttaataacttcgatgggttattaaacgataataatattgcaacactcagagacagtctttctgagagtgacgactttaaaaactgtgcgatgttaataatatacaaatatcaatcaggtgttttggatacattagatactgcatcaaaagatttatcacttccaggctacccttttagtgcgactctagttgagtctgatatacaacaattaataagtaagagttctactaagaaaaatatttttaaatacttactatcttctgtatcgattattattgaggaagatgatcaatctgcatttggatatgctgatttatacaattctataatcgatgatgctgtagattttaataagtttaatctgtttgaggatacggagatatacaagctagaagcttctcctgatagtatagctaaacgattaaaagaaaatgaaacactttttagaaaaattaaaactacagtgacagattttcccaaatga

SEQ ID NO: 14936 - protein, 238 aa, Unknown
  Obtained from environmental sample
  misc_feature (1)..(238): Xaa is any amino acid
MEIQYMSKQQFNNFLVDKLLTWFESNIKIGEKYKFDSDDEQQLNSIMDSLRAKNINTLPFLDVEVPYINIQGTKLIFVNNFDGLLNDNNIATLRDSLSESDDFKNCAMLIIYKYQSGVLDTLDTASKDLSLPGYPFSATLVESDIQQLISKSSTKKNIFKYLLSSVSIIIEEDDQSAFGYADLYNSIIDDAVDFNKFNLFEDTEIYKLEASPDSIAKRLKENETLFRKIKTTVTDFPK

SEQ ID NO: 14937 - DNA, 933 bp, Unknown
  Obtained from environmental sample
  misc_feature (1)..(933): n is a, c, g, or t
atgggttatcctatcaattctccttacgatgattttatgtttgttcctgctcaaaatggagaagaggcttattttatttctaatagaagaaatgttgctgaaaactacgaattgtacaaaataaagacacccaaaccacctttaacacttactattattaaaggtcattttatgactcaagattctattcctgattttgaggcgaccattacggtttacaacaccaataatcaggaaatagcaggcatttataataccaatagcaataacggaaattacctgatggctttaattccaggagtaaaatatgaatttaacattactaccaactttgattatagagaacatactgcttttgtaaccattccttttcaaaacgagtctttcccgctaaggcaaaatatccgcctaaaaaaagaaggtcgttttgaaatactgaatgtagataattttttcactcaagaagaagcagaaaatgcacccgtttatcaattgactaaaaaagattttaatattcccgaaaacaatcagaactatcaacaaaatacaacagaaaataaaataaaagtgctttcaacagaacaaaagcaattattaaaagatgcacaacagttttataccaacaaacaatatttacagtctgctcaggcttttgagaaagttgccccactaatcgatttatcagaaaaacaagcttatatgtacggaaaaagtcttttttatatctctaaagagtatgaaaaaattttaggctttttagaacatgcggcaacaagcaaagcaattccttacgatgttttttatatgctcggaaaaatgaatcatttagcttaccgatttgaaagagctgttgttgcttacgaaaaatacaaatcctttagcaacagaaaaagaattgtcagaaaaagatattggataatgaaattgtattaa

SEQ ID NO: 14938 - protein, 310 aa, Unknown
  Obtained from environmental sample
  misc_feature (1)..(310): Xaa is any amino acid
MGYPINSPYDDFMFVPAQNGEEAYFISNRRNVAENYELYKIKTPKPPLTLTIIKGHFMTQDSIPDFEATITVYNTNNQEIAGIYNTNSNNGNYLMALIPGVKYEFNITTNFDYREHTAFVTIPFQNESFPLRQNIRLKKEGRFEILNVDNFFTQEEAENAPVYQLTKKDFNIPENNQNYQQNTTENKIKVLSTEQKQLLKDAQQFYTNKQYLQSAQAFEKVAPLIDLSEKQAYMYGKSLFYISKEYEKILGFLEHAATSKAIPYDVFYMLGKMNHLAYRFERAVVAYEKYKSFSNRKRIVRKRYWIMKLY

SEQ ID NO: 14939 - DNA, 630 bp, Unknown
  Obtained from environmental sample
  misc_feature (1)..(630): n is a, c, g, or t
ttgatggctcgagacaggtcagatttgaagaaaatattaaaacaaaacctaattagttttttgaattacccctctgacagcatttatgtttcagatagaaaacaattggagagagttgaaaactataaatgtttagatagtatcgcaacttttaattacacctcaaaaactggagacaatattcaaattgaaattataaaaggaaggtttgacgaagcaaagcattcaatggaatttggatataagaaaaccaaagaagaagaaattggtcatacttatataaaaaatattgttgactataaatatgcttttggaattgataaacatacgcctaaaacagaaataaaatctttaaaaataaaatggaatgataaaaacttagatataccagattcagtattttcaaatttttatgagcccaaattatgccatagatctttaccaattgaatcttacctaacaaataaccaatatctgtttatttatattaatggatcagaaggtgtgggctcatattcagttaagtttatatttaataatgagaagtacattacaagaatagtggatctaaacgagacagaaaatggatttgacttcattgatggtattgaaaaagaaaacaacaaatag

SEQ ID NO: 14940 - protein, 209 aa, Unknown
  Obtained from environmental sample
  misc_feature (1)..(209): Xaa is any amino acid
MMARDRSDLKKILKQNLISFLNYPSDSIYVSDRKQLERVENYKCLDSIATFNYTSKTGDNIQIEIIKGRFDEAKHSMEFGYKKTKEEEIGHTYIKNIVDYKYAFGIDKHTPKTEIKSLKIKWNDKNLDIPDSVFSNFYEPKLCHRSLPIESYLTNNQYLFIYINGSEGVGSYSVKFIFNNEKYITRIVDLNETENGFDFIDGIEKENNK

SEQ ID NO: 14941 - DNA, 447 bp, Unknown
  Obtained from environmental sample
  misc_feature (1)..(447): n is a, c, g, or t
atgagtttaataataacaacaaactcaatgtttgaaactgataattctaattttgaaaaaagtttttacgaagcagaaaatggaagtaaatcatttcaaggagcttcctgttctgctaatagatctcacatgtttgttcttcctgatggcaatgtaactatttgtgagcagttgtattggaagaaaagatttattattggtaatatcttgaataacggaatagaagaaatatggaactcacctgaagcattaaaatgggtaaatctgaatcaaaatgattttagagaggctagcgcctgtaaaaattgtgaaattctagatgcttgttataataaatatccaaataaatgttgggcagatacacttaaggtgtatggtgatgaaaactgggactatcctgaccccagatgtaaaaaagcacctaaaatgatttatgatatagtataa

SEQ ID NO: 14942 - protein, 148 aa, Unknown
  Obtained from environmental sample
  misc_feature (1)..(148): Xaa is any amino acid
MSLIITTNSMFETDNSNFEKSFYEAENGSKSFQGASCSANRSHMFVLPDGNVTICEQLYWKKRFIIGNILNNGIEEIWNSPEALKWVNLNQNDFREASACKNCEILDACYNKYPNKCWADTLKVYGDENWDYPDPRCKKAPKMIYDIV

SEQ ID NO: 14943 - DNA, 585 bp, Unknown
  Obtained from environmental sample
  misc_feature (1)..(585): n is a, c, g, or t
atggctcagacacccctcaatattttaaaaaataacagtggaaaaattggagatgttttaatacttacaaagccaattgggcttggtgtattaacaactgcaataaaaagagatttactagacccctctatgataaaggaagtaataaaagtaatggaatgtttaaactatgaaacttcaaagatattaaaagagtatagagtaagtgcttgtacagatattacagggtttagtcttttaggacatagtttagagtcaacaagagatgatatatcttataaactttataatgactctattcctgtttttgataaagtaagagaacttacagaacaagatgtagtaccaggtggaagtaaaaaaaataaaaaatacttagaagataaagtatcctatgcatcaagtattagtgagataagaaaacaaattttatgtgatgcacaaacttcaggagggcttttagtagcaatagataaaaatgatgccaaagaatatctaaaaagaatagagaattttacttttggatatgcaaaaattattggggaaattgtcccaagagttgataagccaattgttgttgtttag

SEQ ID NO: 14944 - protein, 194 aa, Unknown
  Obtained from environmental sample
  DOMAIN (15)...(194): AIR synthase related protein, C-terminal domain
  misc_feature (1)..(194): Xaa is any amino acid
MAQTPLNILKNNSGKIGDVLILTKPIGLGVLTTAIKRDLLDPSMIKEVIKVMECLNYETSKILKEYRVSACTDITGFSLLGHSLESTRDDISYKLYNDSIPVFDKVRELTEQDVVPGGSKKNKKYLEDKVSYASSISEIRKQILCDAQTSGGLLVAIDKNDAKEYLKRIENFTFGYAKIIGEIVPRVDKPIVVV

SEQ ID NO: 14945 - DNA, 357 bp, Unknown
  Obtained from environmental sample
  misc_feature (1)..(357): n is a, c, g, or t
ttgctgataggaggggtttggtattggaaaaaaagaaaaaacacagctgtcacaaattctgattggattcaaatgggtgaataccaatttgataaaaaaggaatgaaacttttttacaaagggaaaagcgaggagctttcgagtaaagaagcaagtttgttggatttactatacactaatgttaatcaaacggtaagtagagaacatattttacaaatagtttgggaagatgaaggagactatttaggcagaaccttggatgtttttatttctaaacttcgtaaaaagttagaagctgacactaatttaaaaattgtaaatataagaggagtaggctacagaatagtattgaattga

SEQ ID NO: 14946 - protein, 118 aa, Unknown
  Obtained from environmental sample
  DOMAIN (41)...(115): Transcriptional regulatory protein, C terminal
  misc_feature (1)..(118): Xaa is any amino acid
MLIGGVWYWKKRKNTAVTNSDWIQMGEYQFDKKGMKLFYKGKSEELSSKEASLLDLLYTNVNQTVSREHILQIVWEDEGDYLGRTLDVFISKLRKKLEADTNLKIVNIRGVGYRIVLN

SEQ ID NO: 14947 - DNA, 756 bp, Unknown
  Obtained from environmental sample
  misc_feature (1)..(756): n is a, c, g, or t
atgaaatatattgttatcgatgttaaaccatctgataatgatataaaagcattgagagaatcagcagaacaacttgcaaaagatttttctgcatcagaaaatgatagtctatttactgttactaatgaaggtatttatactaatgtttattataaatcggacgaattgcctggtcaaattaaaaatgactctactctaactcttgaaatcggaacggtaatcggaccatatgaagataaagataattttactgttgcaaaaattctagacaaaaagattatacctgatagttccaaagctagacatattttaagaagtgttcaagagggtgatgttgaaggtttggctgctgccagatcaacaattgatagtattaaaacactattggaaaaaagaatagaatcattcgattcattggcaattaaatttagtcaggatccaggaagtgccgctaaaggtggagatcttggaacatttactcaaggtagaatggtccctgcatttaacgaagtttgttttcatggtaatgaaaaagactatcatgttgttactacaaggtttggtgttcatctaatagatgttcaaaaacaaatctatattgacagaacacctaagtttaaagtagcttatgttacttcaatcattattccaagccaggagactncagattcattgtacgaagtagcaagtgaattgctcattactagtacttctgcagatgtttttgattctaatgcaacaaaattaaaactttga

SEQ ID NO: 14948 - protein, 251 aa, Unknown
  Obtained from environmental sample
  DOMAIN (102)...(196): PPIC-type PPIASE domain
  misc_feature (1)..(251): Xaa is any amino acid
MKYIVIDVKPSDNDIKALRESAEQLAKDFSASENDSLFTVTNEGIYTNVYYKSDELPGQIKNDSTLTLEIGTVIGPYEDKDNFTVAKILDKKIIPDSSKARHILRSVQEGDVEGLAAARSTIDSIKTLLEKRIESFDSLAIKFSQDPGSAAKGGDLGTFTQGRMVPAFNEVCFHGNEKDYHVVTTRFGVHLIDVQKQIYIDRTPKFKVAYVTSIIIPSQETXDSLYEVASELLITSTSADVFDSNATKLKL

SEQ ID NO: 14949 - DNA, 321 bp, Unknown
  Obtained from environmental sample
  misc_feature (1)..(321): n is a, c, g, or t
atgcacatctcttactttctgccctttaatattataaatttcaacctgcacattggcagcttctggcaggttaaaacaaatattggcaaattggccacgctcggagctgcgcggattaaaggggtttggataacaactaagcttaatttctggttttatagtttcattttctatcgtgctgacataattcagatcagttactttcatcaggtagatatcattatatctataatcattagtaacattatcgaaaatcaaatagagttcatcattaaaaaagtctccacagaccgaactaaaatatgggataaaaggagatag

SEQ ID NO: 14950 - protein, 106 aa, Unknown
  Obtained from environmental sample
  misc_feature (1)..(106): Xaa is any amino acid
MHISYFLPFNIINFNLHIGSFWQVKTNIGKLATLGAARIKGVWITTKLNFWFYSFIFYRADIIQISYFHQVDIIISIIISNIIENQIEFIIKKVSTDRTKIWDKRR

SEQ ID NO: 14951 - DNA, 645 bp, Unknown
  Obtained from environmental sample
  misc_feature (1)..(645): n is a, c, g, or t
atgaacagttttcattttatcatacttaaaaggggagaaatgaaagaaaacaattatttattgccattatataatagattagatgtatcatttgtaaaaggtaaaaattctattttatatgatgaaaaagggagagattatattgatttttcttctgggattggtgtaaatagtttgggttattgtgataaaaaaattgttaaaacaataactaaacaagccaataaaattttacacacatcaaatatttatcatataaagtcgcaagaaaaatgtgcgaaaaaaatagttacattaagtacttatgatatgcaatgttatttttgtaatagtggagctgaagcaaatgaaagtgctattaaattagctagaaaatatggaaatatagctttttctaaaacaaagtataaaattataactattaaaaattcttttcatggaagaacaatagcaactttaaaagcaacagcacaagaggaaaaacataaatattttggaccttatcctgatggatttgtttatgctgataatataaatgaagcaataaacttgatagatgatgatactgtagctgttatgcttgaactgattcaaggggaaggtggcatctttatgcaagataaagaacaagtaaaaagtaaataa

SEQ ID NO: 14952 - protein, 214 aa, Unknown
  Obtained from environmental sample
  DOMAIN (18)...(214): Aminotransferase class-III
  misc_feature (1)..(214): Xaa is any amino acid
MNSFHFIILKRGEMKENNYLLPLYNRLDVSFVKGKNSILYDEKGRDYIDFSSGIGVNSLGYCDKKIVKTITKQANKILHTSNIYHIKSQEKCAKKIVTLSTYDMQCYFCNSGAEANESAIKLARKYGNIAFSKTKYKIITIKNSFHGRTIATLKATAQEEKHKYFGPYPDGFVYADNINEAINLIDDDTVAVMLELIQGEGGIFMQDKEQVKSK

SEQ ID NO: 14953 - DNA, 513 bp, Unknown
  Obtained from environmental sample
  misc_feature (1)..(513): n is a, c, g, or t
ttgtatatggatgattgtttaaaaactcaaaataacaactacaatcagattgaaaaagctattaaatatatagatgaaaattttaaagaacaaccttctatagatgagatagcttctaatattggtatgagtaaataccattttattcgagtgtttaaagaatatgtcggtgtgactccaaagcagtttttacattcactaactctaaactatgcaaaagaacatattagagaatcaaaatccatactagatagtagtcttgatattggactttcaagcacaagtagactccatgaactttttgtaaatcttataggagtaacgccaaaagagtatagagaaaaagggaaaaatgtaactataacttatggatatggagagacaccttttggtgaagcacttattgcttttacacttaaaggtatctgttatctgggatttatagataaaaataaagaggaaaattttgatagattttatgaaatttggggcaatgcaaatctcataccatga

SEQ ID NO: 14954 - protein, 170 aa, Unknown
  Obtained from environmental sample
  DOMAIN (71)...(114): Bacterial regulatory helix-turn-helix proteins, AraC family
  misc_feature (1)..(170): Xaa is any amino acid
MYMDDCLKTQNNNYNQIEKAIKYIDENFKEQPSIDEIASNIGMSKYHFIRVFKEYVGVTPKQFLHSLTLNYAKEHIRESKSILDSSLDIGLSSTSRLHELFVNLIGVTPKEYREKGKNVTITYGYGETPFGEALIAFTLKGICYLGFIDKNKEENFDRFYEIWGNANLIP

SEQ ID NO: 14955 - DNA, 372 bp, Unknown
  Obtained from environmental sample
  misc_feature (1)..(372): n is a, c, g, or t
atgaatataattaggcaaaagactggctggattgaagttatctgcggaagcatgtacagtggaaagactgaagagctgatccgtcgggttcatagagccgaatatgcaaagcagaaaatacaggtgttcaaacctgaaattgataaccgttatgatgacgaccacgttgtttcacatagtaaaaacaaaactccttctcttaatatctcatctgccgatgaaataatggaacttctggaagatgataccgaaattgtcgctatcgatgaagttcagttccttggagagaacgtggtggacgtttgcaataaacttgctgatatgggtaaaaagagtgatggttgccgggctggaatcagactatttaggtaa

SEQ ID NO: 14956 - protein, 123 aa, Unknown
  Obtained from environmental sample
  DOMAIN (9)...(122): Thymidine kinase
  misc_feature (1)..(123): Xaa is any amino acid
MNIIRQKTGWIEVICGSMYSGKTEELIRRVHRAEYAKQKIQVFKPEIDNRYDDDHVVSHSKNKTPSLNISSADEIMELLEDDTEIVAIDEVQFLGENVVDVCNKLADMGKKSDGCRAGIRLFR

SEQ ID NO: 14957 - DNA, 327 bp, Unknown
  Obtained from environmental sample
  misc_feature (1)..(327): n is a, c, g, or t
atgccactgcatttgaaattttttcaatcattatatcctcccttaaaaataacaacaaatataatttatacttttcatcggagctatgttaaaaagaatccgatttatcttaatccatatattataaaatttctaatccagtcgagagctaagataaccaaaagtggagaaaagtccaccctcatagttggaaaaatgcgccggaccatatttcttaccggagccaaaacaggttcagttacctggatcaaaaaaaagtgcatggggtgtgtaggatatgctactacccaggttaataaggctctaataattatcagaaaattataa

SEQ ID NO: 14958 - protein, 108 aa, Unknown
  Obtained from environmental sample
  misc_feature (1)..(108): Xaa is any amino acid
MPLHLKFFQSLYPPLKITTNIIYTFHRSYVKKNPIYLNPYIIKFLIQSRAKITKSGEKSTLIVGKMRRTIFLTGAKTGSVTWIKKKCMGCVGYATTQVNKALIIIRKL

SEQ ID NO: 14959 - DNA, 498 bp, Unknown
  Obtained from environmental sample
  misc_feature (1)..(498): n is a, c, g, or t
atgtcatatcaaagaaaattaaaagggttatatatcatcactgatgataaatcaacaccatcaaataatgttttagaaaaagtagaattagcattacaaggaggggcttcaattgtacaacttagagataaaattagtagtgatacagttttagaacaaattgtcttaagaattcaaaaattgtgtaaagagtatgaggcactttttgtactcaacgacaaaatagaactagcaataaaacttcaatgcgatggacttcatattggaaaatctgaccataaaaatcttgaaaatatacgaaaaaggtttcatggnattattggtgtntcttgttatggggatatcttattggcaaaatattgtgaactaatgggggctgattatgtagcatttgggtcattttataaatctccaaccaaacctgaatcaaatattgtaccccctaaagtacttcaagaaggcaaagaaaaaaattactatcccctattgtgccaatag

SEQ ID NO: 14960 - protein, 165 aa, Unknown
  Obtained from environmental sample
  DOMAIN (7)...(159): Thiamine monophosphate synthase/TENI
  misc_feature (1)..(165): Xaa is any amino acid
MSYQRKLKGLYIITDDKSTPSNNVLEKVELALQGGASIVQLRDKISSDTVLEQIVLRIQKLCKEYEALFVLNDKIELAIKLQCDGLHIGKSDHKNLENIRKRFHGIIGVSCYGDILLAKYCELMGADYVAFGSFYKSPTKPESNIVPPKVLQEGKEKNYYPLLCQ

SEQ ID NO: 14961 - DNA, 351 bp, Unknown; identical to SEQ ID NO: 7157
  Obtained from environmental sample
  misc_feature (1)..(351): n is a, c, g, or t

SEQ ID NO: 14962 - protein, 116 aa, Unknown; identical to SEQ ID NO: 7158
  Obtained from environmental sample
  misc_feature (1)..(116): Xaa is any amino acid

SEQ ID NO: 14963 - DNA, 687 bp, Unknown
  Obtained from environmental sample
  misc_feature (1)..(687): n is a, c, g, or t
atggcaaaaagtgcaaaaaagcgtgaggtaatagagtttttacgctcgatgggcgatgaagttcaaaatcaagaggagttgaccgttattgcctctgaaattgttcttctgttccataaggtgttaaaagggttccgtctctatccgatgaataatcctgttttcgaaacctatgcaaaagaatttgttagtaatatcgaaagattacatgctcacattcctgttattcctctgcggataacaaaagatgggttctcttttattgatactctgcttgagtcaggtgatgatgacggcagtgacggcgtcagctggattttatttaatgatggtattcgagaaatattttttcaacgagggcttgaatgggatgaaataaccagcttttttcgtattcttgctaaagttacagtatttgcaaatgaggattacgatattgcaactcttttgtgggaagaagagtttgagcatatcggctacattgttgaagaggagttgatggagtcgcctctatttgaagatagtgattttgaggaggtgtttgattttgacgctcactcaaacaagattaaaaagattttagaacaaaaagatcgtgagctaaacagtgaggaatcgaccttttttgatgggaagaaaagatttcccaatattagaaaaagatgtgcaacttttatcaaaaaatga

SEQ ID NO: 14964 - protein, 228 aa, Unknown
  Obtained from environmental sample
  misc_feature (1)..(228): Xaa is any amino acid
MAKSAKKREVIEFLRSMGDEVQNQEELTVIASEIVLLFHKVLKGFRLYPMNNPVFETYAKEFVSNIERLHAHIPVIPLRITKDGFSFIDTLLESGDDDGSDGVSWILFNDGIREIFFQRGLEWDEITSFFRILAKVTVFANEDYDIATLLWEEEFEHIGYIVEEELMESPLFEDSDFEEVFDFDAHSNKIKKILEQKDRELNSEESTFFDGKKRFPNIRKRCATFIKK

SEQ ID NO: 14965 - DNA, 393 bp, Unknown
  Obtained from environmental sample
  misc_feature (1)..(393): n is a, c, g, or t
atgatgtttgagagcatctctgatgttaagcgtgtgaaaaatgatgacgtcatcagcgagagcggatttggtttttttgagggtgagattacttttgaagaggagaagatcgtaaaaaaaggatcttatgaagcttttgatatggtgttagagggttttgaaattcataacggaatctcaaaagagcactcaatcttttgcgaaaaaggtagactttcaggctcattcttacatggggtttttgataatgatagtttcagagagtttatctttaaagattatgagtatgtaggttttgattttaaagagtacaaaaaaaataaaattaatgattttgtacagagtgtaaaagagcatctagacgtgcagaggattttagatagtgttcgttga

SEQ ID NO: 14966 - protein, 130 aa, Unknown
  Obtained from environmental sample
  DOMAIN (1)...(86): CobB/CobQ-like glutamine amidotransferase domain
  misc_feature (1)..(130): Xaa is any amino acid
MMFESISDVKRVKNDDVISESGFGFFEGEITFEEEKIVKKGSYEAFDMVLEGFEIHNGISKEHSIFCEKGRLSGSFLHGVFDNDSFREFIFKDYEYVGFDFKEYKKNKINDFVQSVKEHLDVQRILDSVR

SEQ ID NO: 14967 - DNA, 483 bp, Unknown
  Obtained from environmental sample
  misc_feature (1)..(483): n is a, c, g, or t
atggctgagataactcatacagtaacatcagctcttatactactctttatctttatctatgctcttgtacgattaaaagagatagagtcccatgtcgatgagtttttactctactcaaaacaactcgctactgataatgatggttccaagctctcgcctatacatattcatgctgaaaatgagatagttgaagtaagtgatacaatcaactactttatacaaaagataaattcagcagttgactactcaaatgaagcactcgaaaagtctcaacaagcctcacacaaacttgaagagttgacagatgaatttgatagcatcataaatgatctgcaagataagtcccaaatctcaaaacacctaaacactagtgaaaatatcgctatagaatctacagaggtacttttaaactctactaaaaaactaaaaagactcagagaagaactcgacagtcttgttctctcttgtcaaagtattaaataa

SEQ ID NO: 14968 - protein, 160 aa, Unknown
  Obtained from environmental sample
  misc_feature (1)..(160): Xaa is any amino acid
MAEITHTVTSALILLFIFIYALVRLKEIESHVDEFLLYSKQLATDNDGSKLSPIHIHAENEIVEVSDTINYFIQKINSAVDYSNEALEKSQQASHKLEELTDEFDSIINDLQDKSQISKHLNTSENIAIESTEVLLNSTKKLKRLREELDSLVLSCQSIK

SEQ ID NO: 14969 - DNA, 846 bp, Unknown
  Obtained from environmental sample
  misc_feature (1)..(846): n is a, c, g, or t
gtgccaggagcaattcaaatgcgaaggctttattctgctctttcgaaatactcaactcataattattatctcttaacagaaaaatattcagaaaactcagaccatatttactcgactaatgccaacctaggaatagaaaaatatatacataaaacaataaatagatcactttgcagtcctttatcctttttgtcgacaccatatataaatcagagtgttaaagaagcaaaaaaaatcattattgacaacagcataactcatattcatactgtatcctctccatttgagtctcatatggttggcttaaaattaaaagagtggaataagaaactaaaatggtctgtattttttagcgatccttggccttatgcaattatgcctagcccttacgttagaagaaaaatcttctcaaaaaaagatattagtctacttgaacgagtatttcaaaattgttctggatttgtaacacctagcccatacacaattaaattatttgaaaataaattaaagatgccggattattgctcaagcattccacatatatttggagagacccaagagcaacatcaaacaaaaaaagaaaactatattgtgcatgccggttatttaccacgtgaacgtattaaggaagacttaattattgctattgaagaactcgctagtgaagacacaaatttcagaggattggtacatattggagcttatgataactatcttataaaattgataaaaaaacataaggccaggcatattcatctaacaggtaatatgccagaagacattgcttcatgtttccaaaaacaatttcaacaagtattattattgaagctccgatgtctaatatag

SEQ ID NO: 14970 - protein, 281 aa, Unknown
  Obtained from environmental sample
  misc_feature (1)..(281): Xaa is any amino acid
MPGAIQMRRLYSALSKYSTHNYYLLTEKYSENSDHIYSTNANLGIEKYIHKTINRSLCSPLSFLSTPYINQSVKEAKKIIIDNSITHIHTVSSPFESHMVGLKLKEWNKKLKWSVFFSDPWPYAIMPSPYVRRKIFSKKDISLLERVFQNCSGFVTPSPYTIKLFENKLKMPDYCSSIPHIFGETQEQHQTKKENYIVHAGYLPRERIKEDLIIAIEELASEDTNFRGLVHIGAYDNYLIKLIKKHKARHIHLTGNMPEDIASCFQKQFQQVLLLKLRCLI

SEQ ID NO: 14971 - DNA, 300 bp, Unknown
  Obtained from environmental sample
  misc_feature (1)..(300): n is a, c, g, or t
ttgtattctgttaatttatttaagcctttgaagttttttatgatatcatttgttgaaagagaaatgtcatttaaagaaagatctttagaaaaatgttcaattggttcaatatatataccattgttcgacaaccatttaaatacaacattctcagatggcatatatacttttattccatttgatatggcgataaagatgtttccaagagccatttgcctatatgaattaagtacaagtgttgaagagtttttgtataaattcacaaactcatcaaaaggtaaaaaatcttcaataaattga

SEQ ID NO: 14972 - protein, 99 aa, Unknown
  Obtained from environmental sample
  misc_feature (1)..(99): Xaa is any amino acid
MYSVNLFKPLKFFMISFVEREMSFKERSLEKCSIGSIYIPLFDNHLNTTFSDGIYTFIPFDMAIKMFPRAICLYELSTSVEEFLYKFTNSSKGKKSSIN

SEQ ID NO: 14973 - DNA, 318 bp, Unknown
  Obtained from environmental sample
  misc_feature (1)..(318): n is a, c, g, or t
gtgaatttatacaaaaactcttcaacacttgtacttaattcatataggcaaatggctcttggaaacatctttatcgccatatcaaatggaataaaagtatatatgccatctgagaatgttgtatttaaatggttgtcgaacaatggtatatatattgaaccaattgaacatttttctaaagatctttctttaaatgacatttctctttcaacaaatgatatcataaaaaacttcaaaggcttaaataaattaacagaatacaaaagtcttctcgaatacagacaagagatatactcaataattcaagagagatgctga

SEQ ID NO: 14974 - protein, 105 aa, Unknown
  Obtained from environmental sample
  misc_feature (1)..(105): Xaa is any amino acid
MNLYKNSSTLVLNSYRQMALGNIFIAISNGIKVYMPSENVVFKWLSNNGIYIEPIEHFSKDLSLNDISLSTNDIIKNFKGLNKLTEYKSLLEYRQEIYSIIQERC

SEQ ID NO: 14975 - DNA, 750 bp, Unknown
  Obtained from environmental sample
  misc_feature (1)..(750): n is a, c, g, or t
gtggattatgctcaaagagaacagtcaaaagatgaagttatatatgcaacacagcttgctcataaatataataagaaatgttttatatctaattatcctagtgaagctaagtttagtgaaaaagaagcacgggattatcgatacaatttttttgatgcaattatgcttgaaaatagttatgaatcacttcttacagctcaccagctcaatgataagtgtgagtggtttttgatgcaatttacaaaaggagcaggacttagtgaacttctaggtatgcaaatgcagagttataaaaatggatataatattgtaaaaccacttttagaacacacaaaacaatctctcaaagagtaccttcttactaacaactataagttttttgaagatataagtaatagggatgaaaaatacaaaagaaattattttagacataactttagtgataaacttcttgaacaatatcaaagtgggatatctcatagttttgaatatttggaaaaagattttcactctttatttgataactttacaaaacaggtttttgagcagttgacaatctatgaatacaataaagatttaaatattgctatgagaattattgataaagatttaaaaataagaggtataatcatatcaaaagctacaagagatgaaatagtgcaaaaaaaagaagttgttatttcacacaaaattgcagtagctatagttgatgaaaaaatatatatagcaccatatcttaaaacactatga

SEQ ID NO: 14976 - protein, 249 aa, Unknown
  Obtained from environmental sample
  DOMAIN (2)...(164): PP-loop family
  misc_feature (1)..(249): Xaa is any amino acid
MDYAQREQSKDEVIYATQLAHKYNKKCFISNYPSEAKFSEKEARDYRYNFFDAIMLENSYESLLTAHQLNDKCEWFLMQFTKGAGLSELLGMQMQSYKNGYNIVKPLLEHTKQSLKEYLLTNNYKFFEDISNRDEKYKRNYFRHNFSDKLLEQYQSGISHSFEYLEKDFHSLFDNFTKQVFEQLTIYEYNKDLNIAMRIIDKDLKIRGIIISKATRDEIVQKKEVVISHKIAVAIVDEKIYIAPYLKTL

SEQ ID NO: 14977 - DNA, 972 bp, Unknown
  Obtained from environmental sample
  misc_feature (1)..(972): n is a, c, g, or t
gtgatactaacaaaagatatggatgtgataggttatgatagtgtaaaacttgataacaaatacagtattgttatccctaaaaatgaacttacaagtactacaagatatttttcaaatagtggaatagattatatcatttcaccttttacaattttaaatgaatatgtacaagataatagtattaaaaactctattaatgtgctgatttataataatgttgtctatgttctaattttaaatgatctaaaacttatagtacaatgtggtgtaaaatcattaactccatttgatcaaattgcagataaaagtttttcagatgatgagattgttgaccaaaaactgtatgaagaggtacacttcttagagatacaacaatttttaagtgatatggtacaaacttactatacacaaaatagtgatgtagagttcttagagcaggtaaaaatattatatacccttaaacctttatctgatgaacaagtaaattcattgtatgaaactattatggtagatatagattatgaagctatcaatatagaacaataccttttaaaaataactcaaaaagaggatgctataaaacactcatttatagatcctcgaataaaaaaacaaaacaaaagtgctatgacttggattgtttttgctgctgttagtgtacttattgtacttggattaatttacacacaatatagttcatctcaagagagtagtaagcaaaaagtagaacaacaaaaacagatgcaaaaagttgcaaaaaaagaacctgtaacacccaaagttattgagtttccaaatcatattcttacaaataaccatctattaccagatgtttatatgccatttgataaagttccttatgatgctgttttaaaagatttggagattacccaaaatagtttcaacctaaggttgtttggtccccatcccaaagccaatcctttgaagaaatggaggaaaaaacttccaaaa

SEQ ID NO: 14978 - protein, 324 aa, Unknown
  Obtained from environmental sample
  misc_feature (1)..(324): Xaa is any amino acid
MILTKDMDVIGYDSVKLDNKYSIVIPKNELTSTTRYFSNSGIDYIISPFTILNEYVQDNSIKNSINVLIYNNVVYVLILNDLKLIVQCGVKSLTPFDQIADKSFSDDEIVDQKLYEEVHFLEIQQFLSDMVQTYYTQNSDVEFLEQVKILYTLKPLSDEQVNSLYETIMVDIDYEAINIEQYLLKITQKEDAIKHSFIDPRIKKQNKSAMTWIVFAAVSVLIVLGLIYTQYSSSQESSKQKVEQQKQMQKVAKKEPVTPKVIEFPNHILTNNHLLPDVYMPFDKVPYDAVLKDLEITQNSFNLRLFGPHPKANPLKKWRKKLPK

SEQ ID NO: 14979 - DNA, 657 bp, Unknown
  Obtained from environmental sample
  misc_feature (1)..(657): n is a, c, g, or t
atgaaatttgaagattttgaaatagaaggtgaagacttcgcaacattattggaggagagcgaaaaaaacacagaaacaaacacagtaacgacgggtgaaatagtaattctaaacgatgataactttgttgtaagtatcgctggtaaagagggaagaattcctttaagtgaaattactaatacagatggtacagtaaaatacaaagttggtgataaaattacagttatgattgtaggtacaagaggtgaaaacttatctttatcttacaaaaaagtattacaaaaagctaagtttgatgagttttttgcaaaatatggtgaagaaccagaagatgttgtagttgaaggtacagttgtatctgtaaaaccaagagcaggttttgtagtacaagatgatgaaggtatggaatactttatgcctatggcacaaggtttcttaaaagcacatggtgcagttggaaagaaaattaaagcagcagtacttaaagcaaaaccagaaacatcaagtattgtaatctctagaagaaaacttatcgaagaatcgcanaaaaataaagaagaaaaaatagcacaacttatggaaaacaatgagcccagaactggtatcgttaaaaaaaatcacagttatggtatgtttgttgatttaggtgggaattga

SEQ ID NO: 14980 - protein, 218 aa, Unknown
  Obtained from environmental sample
  DOMAIN (23)...(90): S1 RNA binding domain
  misc_feature (1)..(218): Xaa is any amino acid
MKFEDFEIEGEDFATLLEESEKNTETNTVTTGEIVILNDDNFVVSIAGKEGRIPLSEITNTDGTVKYKVGDKITVMIVGTRGENLSLSYKKVLQKAKFDEFFAKYGEEPEDVVVEGTVVSVKPRAGFVVQDDEGMEYFMPMAQGFLKAHGAVGKKIKAAVLKAKPETSSIVISRRKLIEESXKNKEEKIAQLMENNEPRTGIVKKNHSYGMFVDLGGN

SEQ ID NO: 14981 - DNA, 798 bp, Unknown
  Obtained from environmental sample
  misc_feature (1)..(798): n is a, c, g, or t
gtgggaagaaaaaaaattattacacaaccacccgtaaaagtgacggcacttaaaaataatatagatgtttatcaaccaaatagacttagagaagagagtgtagttgacaagttattaaaaattgagtctgattttatagttgtagcagcttatggacagatacttccccttgaagtattaaatcatgcgccttgtatcaatcttcatgcgtcaattcttcctcagtacagaggagcaagtccaattcagcagtcgttgattaatggtgattcaaaaagtggtgtaacagccatgcttatggatgttggacttgatacaggagatattttacaaatagaagaagttataattgataatgagatgatggttgaagagctgtttttaaaattaacatcaatagcttctgatttaactctatcagttttgaaaaatttcagtgatcttagtgttgaaaaacaagatgattcaaaagcaactcactgtaaaaaaattgtaaaagctgatggtatggtgcagtttgaagatgcaaaaaaaatatacaatatgtatagagcattcactccatggcctggtatatttttagagagtggcttaaaaattaaagagatgaaactctttgatggtgatagtgagcataaatcttttgaggttttagaaataggagctgattatgcaaaaatcggctgtaaaaaaggctctttattaattactaaagttcagccaccttcaaaaaaagagatgagaataacagactatcttaatggaaagagaataacagttggaaatctgctatcttga

SEQ ID NO: 14982 - protein, 265 aa, Unknown
  Obtained from environmental sample
  DOMAIN (165)...(257): Formyl transferase, C-terminal domain
  misc_feature (1)..(265): Xaa is any amino acid
MGRKKIITQPPVKVTALKNNIDVYQPNRLREESVVDKLLKIESDFIVVAAYGQILPLEVLNHAPCINLHASILPQYRGASPIQQSLINGDSKSGVTAMLMDVGLDTGDILQIEEVIIDNEMMVEELFLKLTSIASDLTLSVLKNFSDLSVEKQDDSKATHCKKIVKADGMVQFEDAKKIYNMYRAFTPWPGIFLESGLKIKEMKLFDGDSEHKSFEVLEIGADYAKIGCKKGSLLITKVQPPSKKEMRITDYLNGKRITVGNLLS

SEQ ID NO: 14983 - DNA, 807 bp, Unknown
  Obtained from environmental sample
  misc_feature (1)..(807): n is a, c, g, or t
gtgtatcatcgctggttgtaccccgatgatgttgatgcctcggtgccttatgtttgtccactaaattttggtgttgaagatggacgacacgaaccttttattgccaatgttccgggaacacctgagttgcgcgaaaaaattgaagcctttcagattgaaattcttaaaaatcgcaaagtgcttattccgaaactgcaggaatttgccaaacaaaagaaatacactttccagatttcgatagatgaagtactggattattgcgtattggaatacccttttgctttgtggcaatggggacgaatgaccgataaagttccttctgcaaacgaagatattgatgcactttttaaacatctgatgattgtatcgagtccatcgtattttgctattgaagaaatggaaggtataaagtcgttttttgtacaagctgcccgcgaattaggttattatggttacgataccaaaccgtttaagacgcacctttcaagaaaatcagctaaaggttatttaaaccgcatttttattcctgaagatttagagattaaatacaacaagaaaacagcaaagcaggtaaagaaatttataaaaactaccgactcaaaaatattgtttgtttacggaggctgggatccttgggttgcaagtggatttgaagttccgcaaaaagacaatttcctgaaaattgtaaaaccggaaggcagccattcaacacgaattaataatttacctgagaatcaaaaaattcaggtaaaagaaacacttgaaaagtggttggatatggaagtagatattaatattgaagaatag

SEQ ID NO: 14984 - protein, 268 aa, Unknown
  Obtained from environmental sample
  misc_feature (1)..(268): Xaa is any amino acid
MYHRWLYPDDVDASVPYVCPLNFGVEDGRHEPFIANVPGTPELREKIEAFQIEILKNRKVLIPKLQEFAKQKKYTFQISIDEVLDYCVLEYPFALWQWGRMTDKVPSANEDIDALFKHLMIVSSPSYFAIEEMEGIKSFFVQAARELGYYGYDTKPFKTHLSRKSAKGYLNRIFIPEDLEIKYNKKTAKQVKKFIKTTDSKILFVYGGWDPWVASGFEVPQKDNFLKIVKPEGSHSTRINNLPENQKIQVKETLEKWLDMEVDINIEE

SEQ ID NO: 14985 - DNA, 477 bp, Unknown
  Obtained from environmental sample
  misc_feature (1)..(477): n is a, c, g, or t
atggtccttgtagaagaggtaattaaaaaagcctttagtgtagttggaaaatcattagaaaacaataatgtggcggtgcgtaaaatttttagtagtaaacaagagattgacacttattcaagagaacttatgcaagttttcataaatatcttaaataatgcaaaagaggttttaattgaaaaaaatgttcaaactaaagagattttaatagaactagaagatacagaagatacaataataataaagatatgtgataatgctggtggaataccagattctattattgataaaattttcgagccatattttagtactaaagatgcaaaaactggtacaggacttggattatatatgagtaaaacaattattgaaaaacacttaagtggaactttaagagttgttaatacacatgagggtgcatgttttattatagagttgccttttaaaagagctaacaaaaatattgaggataaatag

SEQ ID NO: 14986 - protein, 158 aa, Unknown
  Obtained from environmental sample
  DOMAIN (38)...(149): Histidine kinase-, DNA gyrase B-, and HSP90-like ATPase
  misc_feature (1)..(158): Xaa is any amino acid
MVLVEEVIKKAFSVVGKSLENNNVAVRKIFSSKQEIDTYSRELMQVFINILNNAKEVLIEKNVQTKEILIELEDTEDTIIIKICDNAGGIPDSIIDKIFEPYFSTKDAKTGTGLGLYMSKTIIEKHLSGTLRVVNTHEGACFIIELPFKRANKNIEDK

SEQ ID NO: 14987 - DNA, 570 bp, Unknown
  Obtained from environmental sample
  misc_feature (1)..(570): n is a, c, g, or t
ttgatacaaattcaattacaggtgaagttccctttttttcaaggtatggcaattaaatatgaggggaagacagttttagattcggaattatttgataagtccatagaagcaaaattagaaataataaacggacataacggtacgctaaaactttgtgatttaagatatctaaatttagcaacaatgaaacgaagacaaataagtgtagaaccagggaaaagtttttctgttgtgacacaatacaaagaagagattttagagacaaaagtgaaacatctatcaacagattttatatcattagttatagacaatgatcaattaacatttagtgagggagatcaacttaacttagagtttgaaataaaaagaacagaagatagacatactttaaaaccaataaaaatagttactcaaggggaagtatatattattgatacaaataatacaaaacaaaaagtacttatggttttatttgagttagataatagtgaaaaaactattttagaatcttatattgaacatagaagattagatttagtagtagagtttaaacaacttaataaaagttag

SEQ ID NO: 14988 - protein, 189 aa, Unknown
  Obtained from environmental sample
  misc_feature (1)..(189): Xaa is any amino acid
MIQIQLQVKFPFFQGMAIKYEGKTVLDSELFDKSIEAKLEIINGHNGTLKLCDLRYLNLATMKRRQISVEPGKSFSVVTQYKEEILETKVKHLSTDFISLVIDNDQLTFSEGDQLNLEFEIKRTEDRHTLKPIKIVTQGEVYIIDTNNTKQKVLMVLFELDNSEKTILESYIEHRRLDLVVEFKQLNKS

SEQ ID NO: 14989 - DNA, 822 bp, Unknown
  Obtained from environmental sample
  misc_feature (1)..(822): n is a, c, g, or t
atgcatccttttaaaaaggaactaaataatcaaaatttaacaaattttcaaacacttgatggtcaatttatatttaaaaatataaataaactggtattagaaaaaggttctggttatataaattatagatggtatagaccagatgacgggattgaagatgaaaaaatttcatatgttagtcttataaaaaagttgaatttagttgttggatcaggattttatttgacagaattaaaagatcttttagcagatgaaaatagaaaacttgaagagtctctgtttacaaatttaaaaaaaatattgctcatactggttattttaattgttctttctcttctatctgctctatatgtatcaagaagaattaaaagagttgaagagtcacaaaaagagtacttaaatatgcttgaacagtatcaactgatcttagattcaagtgctttagtgtctaaagcaaatttagatggagtaattagctatataaacagtagctttacaaatgtaagcggttattcaaaagacgaggcgattggtcaacctcatagtatagtaaggcatcctaactcgtcaaaggagcagtttagacgtttatggaaaactatccaaaatggacagatttggaaaggtgttattaaaaacagaaataaaaatggtgaaacatactttaacagcactacaatagtaccaataaaagatagctatggaaatatagttgagtatatatcttctggtgcagatgtaactgagttacttgaaaatagaactaaaataaaaaatatttttaatacagatcaaataacccggcttaggaaaatagagtaa

SEQ ID NO: 14990 - protein, 273 aa, Unknown
  Obtained from environmental sample
  DOMAIN (137)...(199): PAS domain
  misc_feature (1)..(273): Xaa is any amino acid
MHPFKKELNNQNLTNFQTLDGQFIFKNINKLVLEKGSGYINYRWYRPDDGIEDEKISYVSLIKKLNLVVGSGFYLTELKDLLADENRKLEESLFTNLKKILLILVILIVLSLLSALYVSRRIKRVEESQKEYLNMLEQYQLILDSSALVSKANLDGVISYINSSFTNVSGYSKDEAIGQPHSIVRHPNSSKEQFRRLWKTIQNGQIWKGVIKNRNKNGETYFNSTTIVPIKDSYGNIVEYISSGADVTELLENRTKIKNIFNTDQITRLRKIE

SEQ ID NO: 14991 - DNA, 849 bp, Unknown
  Obtained from environmental sample
  misc_feature (1)..(849): n is a, c, g, or t
atgttttttcccctttttaccaaaaaaaaccataaattccttttgtggggttttaagaaaccgattatggcttctggtcaggggaaaaattttccactcctgtttttaatcaaaaaggggcccccaaatgaattcaatcccctcagatttagtacaggaacgggctatagagtagtaaatttttttacggaagaccacgctgcaacaacaggagccagagaaataattattaaaggctcattaaatcccgaaacttcctacaatgctaacgtgaattaccaaaattttgttaatacaaaatttggatttatcaattttgatattactgctttttacacctatttctccaataaaatcattcctgattatgaaagcaattcacagcaaattatatatgaaaaccttaatggatatgctgtttctaatggggtaagtttcgatatggatattaatttttctatcccattaaatattaaattaggaggaacttttatggatgtttatgaagtaagtgataatgaattagggaaacctgaaaagcaaaaacaactacttaccgaaagtgtttcagggacttttagcataagttatgagtttgctaaacccaatattaaattagattatacaggaaatttatatggaccaatgaagttacctttagtagagaatgattttcgtcctgaatattctgattggtacagcatacaaaacatacaaattaccaaaggctttaaaaagggttgggaaatttatggtggcattaagaacttactcaattttacacctcctgctagctctattttaagagctaacaatccttttgataaaaatgtaaatgctgcgcgataa

SEQ ID NO: 14992 - protein, 282 aa, Unknown
  Obtained from environmental sample
  misc_feature (1)..(282): Xaa is any amino acid
MFFPLFTKKNHKFLLWGFKKPIMASGQGKNFPLLFLIKKGPPNEFNPLRFSTGTGYRVVNFFTEDHAATTGAREIIIKGSLNPETSYNANVNYQNFVNTKFGFINFDITAFYTYFSNKIIPDYESNSQQIIYENLNGYAVSNGVSFDMDINFSIPLNIKLGGTFMDVYEVSDNELGKPEKQKQLLTESVSGTFSISYEFAKPNIKLDYTGNLYGPMKLPLVENDFRPEYSDWYSIQNIQITKGFKKGWEIYGGIKNLLNFTPPASSILRANNPFDKNVNAAR

SEQ ID NO: 14993 - DNA, 672 bp, Unknown
  Obtained from environmental sample
  misc_feature (1)..(672): n is a, c, g, or t
ttgaaacatgaaaaaagtgtttttatcattacatatggaagatcaggttcaaccttattacaaggtgtattaaactctatagaaggatatgaaataaaaggagaaaactattctgctttagtcccattgtttcactcctatttaagaataaaaatgtcgagatatcgacaaggagagagtattaaattttcaacagctccatggtttggtgcagatgaactaataccacgttcttatggaaaaaatcttattgatttatttatcaaagatgtattaaaaccagatgttaacgctaaagtaatttggtttaaagagataagatatgatttaacagagtttagaaaagatgagcatatgaaagaatatttatcttttttaaaagagttttttccagatgcaagatttatttttaatgaaagaaatattcatgatacatcaaaaagtgcatggtggaaagaagataaagatgcagttgaaaagatagaagctatattatcaagaatgaaagttatgtatgaagagttcaggaatatatcatattgngtaaattatgatagatatagtagctatatagaagaactaaagccattgtttgattttttagaagaggactttaatgaaaaacaattaaaaaaagtcttagaaataaaacattccttactaaatgaataa

SEQ ID NO: 14994 - protein, 223 aa, Unknown
  Obtained from environmental sample
  misc_feature (1)..(223): Xaa is any amino acid
MKHEKSVFIITYGRSGSTLLQGVLNSIEGYEIKGENYSALVPLFHSYLRIKMSRYRQGESIKFSTAPWFGADELIPRSYGKNLIDLFIKDVLKPDVNAKVIWFKEIRYDLTEFRKDEHMKEYLSFLKEFFPDARFIFNERNIHDTSKSAWWKEDKDAVEKIEAILSRMKVMYEEFRNISYXVNYDRYSSYIEELKPLFDFLEEDFNEKQLKKVLEIKHSLLNE

SEQ ID NO: 14995 - DNA, 537 bp, Unknown
  Obtained from environmental sample
  misc_feature (1)..(537): n is a, c, g, or t
ttgaatctaacgaaagctagaattagaaatctaactggaataaaaataaaagtagcttcacttcttaaacaagcactaggtaactctatagatattgatccaaaaagtggtgctattagattttcatcaaatattctatttaatcaaggtgaatatgagttgaaagcgggatcaaaagaggagttgaaaggtgtactatataagtatatcaatactctattttcaaatcctgaaatcaaaaagcatatagagagtatcgttattgaaggtcataccaactctgatggagagtatatatataatttagagttatcacaaaagagagcactagaagtgatgaagtttctgttctcattagattttaacaactctatggaacttaagaaatatgtttcagcaagtggtaaatcgtactcaaatattatcatgagaaatggaagagaagatcgtgatgcttcaagaagaattgagattaaatttagaattaaaaatgataaagccattgaagagttagataaatttataagtaataactag

SEQ ID NO: 14996 - protein, 178 aa, Unknown
  Obtained from environmental sample
  DOMAIN (46)...(155): OmpA family
  misc_feature (1)..(178): Xaa is any amino acid
MNLTKARIRNLTGIKIKVASLLKQALGNSIDIDPKSGAIRFSSNILFNQGEYELKAGSKEELKGVLYKYINTLFSNPEIKKHIESIVIEGHTNSDGEYIYNLELSQKRALEVMKFLFSLDFNNSMELKKYVSASGKSYSNIIMRNGREDRDASRRIEIKFRIKNDKAIEELDKFISNN

SEQ ID NO: 14997 - DNA, 351 bp, Unknown
  Obtained from environmental sample
  misc_feature (1)..(351): n is a, c, g, or t
ttgggcatgagcttgctccaatccaatcagaaagagatgaagaaagctaaagtatatatgtatgataaaatggctggtatattaactgaagatgaaaatggttttcattttcaatatgaccaatcatacctaacgtcaaaagaagctgagcctgttagtttaacactacctcttacaagtagcgtatttgaaagtaagactatgtttcctttttttgatggattaataccagaaggttggctactagatatagctcaaaaaaattggaaattaaatccaagagacagaatggaaatattgttaaaaacatgtcaagattgtatcggagctgtatcaatagaagaaatttaa

SEQ ID NO: 14998 - protein, 116 aa, Unknown
  Obtained from environmental sample
  misc_feature (1)..(116): Xaa is any amino acid
MGMSLLQSNQKEMKKAKVYMYDKMAGILTEDENGFHFQYDQSYLTSKEAEPVSLTLPLTSSVFESKTMFPFFDGLIPEGWLLDIAQKNWKLNPRDRMEILLKTCQDCIGAVSIEEI

SEQ ID NO: 14999 - DNA, 891 bp, Unknown
  Obtained from environmental sample
  misc_feature (1)..(891): n is a, c, g, or t
atgagcgcaattagtaatagtgtagagcaattaacacaagctcatcttcgaaatgttcaacagttagctgtatttcgaactggaaataatgatatatatgctatcaatatagcaaaaattaaagcttttataatcactgaagaggtagatgtaacagatactccaaaagagacagatgtaatagagggtattgctacaattagaggggaacctgttactctagtaaatcttgatagatggcttggttattcaaagttggcacttaatgagtataaactaattattttttgtgagttcaatcataagcaagtaggctttttagttaaagatatggtaaatattgtagaaaaaactactgcagagttaaaaaattcagaagatcaaaattctaaagtaacatatacaacgtatgtagaagttgaagggaaagatagactttgtactgtatttaatgcagagcaacttttaagtgatattggatggacagatatcaatgcaagtgatttagatagatatattacaaaacctgtaagtgcagagaaaaaaattcttgttgcagaagatagtgccgttgcaagagaagtgctaaatcaatttctaagaaaagcaagagcaaaatatgatatttttcataatgggggagatcttcttgatgcaatcaagaatatggatcctaaagatataggacttattattacagatattgagatgccaggaactgatggatatcaagttgcacaagctataaaagataattcaccattaaatcatgtaccagtaggtgtaaactctagtatgacaacggaagctgtaaaaaggaaaaatggaaagaaattgggtatagatgggttttgttgggaaagactggataccccctccatttataggagg

SEQ ID NO: 15000 - protein, 297 aa, Unknown
  Obtained from environmental sample
  DOMAIN (181)...(290): Response regulator receiver domain
  misc_feature (1)..(297): Xaa is any amino acid
MSAISNSVEQLTQAHLRNVQQLAVFRTGNNDIYAINIAKIKAFIITEEVDVTDTPKETDVIEGIATIRGEPVTLVNLDRWLGYSKLALNEYKLIIFCEFNHKQVGFLVKDMVNIVEKTTAELKNSEDQNSKVTYTTYVEVEGKDRLCTVFNAEQLLSDIGWTDINASDLDRYITKPVSAEKKILVAEDSAVAREVLNQFLRKARAKYDIFHNGGDLLDAIKNMDPKDIGLIITDIEMPGTDGYQVAQAIKDNSPLNHVPVGVNSSMTTEAVKRKNGKKLGIDGFCWERLDTPSIYRR

SEQ ID NO: 15001 - DNA, 603 bp, Unknown
  Obtained from environmental sample
  misc_feature (1)..(603): n is a, c, g, or t
atgggattaaaaaaagagattgataaattagataaaaatgaagattatattattttaggtgatttaaattcaaattataatgaatttcaaacttttaaatatgataaaaaattaaatgatagctttggaataacaggtataaatcaaattttaaacactacagataaagaaaactttatccatataagtcatatgcttaacttcgataaaaaagtacattataacttgtggttagatttaaagaatgaaaagtttagtacaatatttaaaggggaatacaatacccctgataatatcatcctatctcaaggattatttgaccaaaagggaatctcctatgtacaaaatagtttcaatgtatttaaaaccaattatctaatagagaacaataaaatcaaaagatggaataactttaaaaataatggatattctgatcatctaccaatttatgcaactttttctacaaacaatcaaaattatattttacagaagcaaccttctaaaacaaatacaattgaacacttatatagtttacaaactgtaacaaactacccacttgacaatataattgttatatacaaatcaaaaaaaatgctatcataa

SEQ ID NO: 15002 - protein, 200 aa, Unknown
  Obtained from environmental sample
  misc_feature (1)..(200): Xaa is any amino acid
MGLKKEIDKLDKNEDYIILGDLNSNYNEFQTFKYDKKLNDSFGITGINQILNTTDKENFIHISHMLNFDKKVHYNLWLDLKNEKFSTIFKGEYNTPDNIILSQGLFDQKGISYVQNSFNVFKTNYLIENNKIKRWNNFKNNGYSDHLPIYATFSTNNQNYILQKQPSKTNTIEHLYSLQTVTNYPLDNIIVIYKSKKMLS

SEQ ID NO: 15003 - DNA, 579 bp, Unknown
  Obtained from environmental sample
  misc_feature (1)..(579): n is a, c, g, or t
atgaataaagttttagtattagttgataatggtttttttaagttagttagaaagagttttgaattaaagtcaggtaagaaaaaaatgttcctacagacttttagaaatatttgtaagaatgaagatttggaaatggagcatttatttgtatatatggctccaccatttcaaagtaggattcctattaatgttgaaaaattgttgaggaaaaagtatgattctattaaaaaaatgcttgataagaaagaatggataactgttcgagaaggaaggtgtcaaaagatagtcgacaataaggggattagattcaatcagaaaggtgttgattcttggattgttgctgatatgtgtttgtttaaggaagattctcctgacgttgacaagataattttaatttctagtgatagtgattttgctccaataattgaaatgatacagaaaaagaaaaatatagaagttattctttatacttattttgataaagacagaaatagctttttctttagaagtaatcatttactaaaatcctgttcaaagtggattaaattaagagaggaggattttaaaaataaagaatga

SEQ ID NO: 15004 - protein, 192 aa, Unknown
  Obtained from environmental sample
  misc_feature (1)..(192): Xaa is any amino acid
MNKVLVLVDNGFFKLVRKSFELKSGKKKMFLQTFRNICKNEDLEMEHLFVYMAPPFQSRIPINVEKLLRKKYDSIKKMLDKKEWITVREGRCQKIVDNKGIRFNQKGVDSWIVADMCLFKEDSPDVDKIILISSDSDFAPIIEMIQKKKNIEVILYTYFDKDRNSFFFRSNHLLKSCSKWIKLREEDFKNKE

SEQ ID NO: 15005 - DNA, 624 bp, Unknown
  Obtained from environmental sample
  misc_feature (1)..(624): n is a, c, g, or t
atggatgttaaagttaaactatatttgcaatttctagttaaattgatgaaagataatagtaaaataatcataattattgtaatttttgtttcaatttggatactcacttcatgtgtgcaaaaccctattgttattgatgattatgacctgtactcatcgtttgaagaaaaatctgatgacaagagttttttccaggatactgttaataataaattccttattaacggtggaaatcaacaatctgatctggatagcaagtctggaactttctcagttcttacaactccaaaatctaaatactccttatcaacagagtttattggagtaaaaaaagattgttatgtaacagccagtgtatggagaaaaggcaataatggacatctggctgctacaattacagattataatggatatatttccacaaaggatcctattgaagttgatagcaacggatgggggaaaatatttcttgagtttcacattcccccaataagtgattatcctactctaaaattttatgtatggaattctggtagtgatagtgtatattttgatgattatagtaatattatcaaagaacacaaaactttacccatatataatgaaagaacctttttcacatag

SEQ ID NO: 15006 - protein, 207 aa, Unknown
  Obtained from environmental sample
  misc_feature (1)..(207): Xaa is any amino acid
MDVKVKLYLQFLVKLMKDNSKIIIIIVIFVSIWILTSCVQNPIVIDDYDLYSSFEEKSDDKSFFQDTVNNKFLINGGNQQSDLDSKSGTFSVLTTPKSKYSLSTEFIGVKKDCYVTASVWRKGNNGHLAATITDYNGYISTKDPIEVDSNGWGKIFLEFHIPPISDYPTLKFYVWNSGSDSVYFDDYSNIIKEHKTLPIYNERTFFT

SEQ ID NO: 15007 - DNA, 348 bp, Unknown
  Obtained from environmental sample
  misc_feature (1)..(348): n is a, c, g, or t
atgaaacaaatagatcctaatcaccattctggacaaatattaaataatatagacttagatacaacttttaagtatggatttttaaaaaaaagtcttgtaagagttgcatcttggtatatgggaaaaaagacaaaattttttttagattttcaatatactcaagaatcaatcatcccacccaaatccaataaaaataaaaaatatcttttatatctccacatccctttttgtaagacattgtgtccttattgctcttttcataagtttaattttgaagaaggaaaagcaagagagtactttaaaactttacgaaaagaaatgaatattgccaaatccaagggaatatga

SEQ ID NO: 15008 - protein, 115 aa, Unknown
  Obtained from environmental sample
  misc_feature (1)..(115): Xaa is any amino acid
MKQIDPNHHSGQILNNIDLDTTFKYGFLKKSLVRVASWYMGKKTKFFLDFQYTQESIIPPKSNKNKKYLLYLHIPFCKTLCPYCSFHKFNFEEGKAREYFKTLRKEMNIAKSKGI

SEQ ID NO: 15009 - DNA, 798 bp, Unknown
  Obtained from environmental sample
  misc_feature (1)..(798): n is a, c, g, or t
gtgagtcctacatatgcagctgaaatccaaacaccactttttggaaatgatttagatgatgttttaaaagctaatagctataaactgcaaggtattttaaatgggattagttatgagatatttgatcctaaaaaagatgatatgatttataaaaactttggggttaaaacctatgaaagtaaagatgaaaataaacaacaacttttaaaagagataggatttgtagaatgtgataaacctctttttgtatttatagggagatttacacatcaaaaagggattgaacttttaatagaaaactttaactttttcaaagattttgaagcaaattttatagttcttggaagtggtgaagagcactataatactgtatttaataatatctctgttagttatccaaatgtgtatatcaaagtgggatatgatgagtcttttgctagaaaaatgtatgctggggcagattttttagtgatgccatctttatttgaaccttgtggtttaaatcagatgatttgtatgaaatatggaactgtaccaattgttgctaaaactggtggactaaaagatagtgtaacagactttacagatattgattatactgctttaaaagggtatatggggattggtatcacttatgaagaacataatattttttggtttatgcatgctattgcaaaagcattatcactctatggaaatcataaaaaatttgagaaaatatcaaaacataatatgaaagttgatcactcttggaaacatcttctaaaagtatatagaactttacgagtcataaaatga

SEQ ID NO: 15010 - protein, 265 aa, Unknown
  Obtained from environmental sample
  DOMAIN (66)...(247): Glycosyl transferases group 1
  misc_feature (1)..(265): Xaa is any amino acid
MSPTYAAEIQTPLFGNDLDDVLKANSYKLQGILNGISYEIFDPKKDDMIYKNFGVKTYESKDENKQQLLKEIGFVECDKPLFVFIGRFTHQKGIELLIENFNFFKDFEANFIVLGSGEEHYNTVFNNISVSYPNVYIKVGYDESFARKMYAGADFLVMPSLFEPCGLNQMICMKYGTVPIVAKTGGLKDSVTDFTDIDYTALKGYMGIGITYEEHNIFWFMHAIAKALSLYGNHKKFEKISKHNMKVDHSWKHLLKVYRTLRVIK

SEQ ID NO: 15011 - DNA, 690 bp, Unknown
  Obtained from environmental sample
  misc_feature (1)..(690): n is a, c, g, or t
ttgctaattctatcgtttgttgtatttgctattgcacaaccaaaagtggagttttttcctgataatgagcccaaccaagtgtttgtttatttagaataccctgaaggaacagccattgaaaaaaccaataaactaaccaaagaaattgaagctaaggtttataaaatagttgataattataaagatgaaacaggctacaattatatggtagaatctgctgtttctcaagttggagaaggtgctggaaatccacaaactgatggaggctctaatgctgagatgcctcacaaaggaaaaataactgtttcactcagagaatctaaactacgaagaggaaaaaacagtaaggattttatggaagaagtaagagaagctgttgggtcttatccaggagtaaatatttctgtagaaaaagaagcagctgggcctcctgctggatatcctattaatattgaaattagaggaaaagactataatgatcttattcttacagctaaggatttaagggatgccattaataaattaaacattccgggtattgaagggttaaaaattgatgtaaacaaaagtaaacccgtaacagaaattactgttgatagaaaaaaagcaggagaattaggtgtttctgtaggacaagtaggaagacaattgcgtaggtcgctttatggtgaaaaggctagntgtttataa

SEQ ID NO: 15012 - protein, 229 aa, Unknown
  Obtained from environmental sample
  misc_feature (1)..(229): Xaa is any amino acid
MLILSFVVFAIAQPKVEFFPDNEPNQVFVYLEYPEGTAIEKTNKLTKEIEAKVYKIVDNYKDETGYNYMVESAVSQVGEGAGNPQTDGGSNAEMPHKGKITVSLRESKLRRGKNSKDFMEEVREAVGSYPGVNISVEKEAAGPPAGYPINIEIRGKDYNDLILTAKDLRDAINKLNIPGIEGLKIDVNKSKPVTEITVDRKKAGELGVSVGQVGRQLRRSLYGEKAXCL

SEQ ID NO: 15013 - DNA, 498 bp, Unknown
  Obtained from environmental sample
  misc_feature (1)..(498): n is a, c, g, or t
ttgggtgaagctcaaaatagaattcgatctatggctttaattcatgaaaaaatgtaccagtctggagatctttctaaaatagatgttcaagactatattgtttctttaattgatgatttagttagctcttactctattaactgtaatatacatttagatttaaaaatagatgctttaaaatttgaaattgacactttaattcctattggtttattattaaatgaaataatttcaaactcattaaaatatgcttttaaaacaaaagataaaggaaccattaccattcatttatcagaattaaaaaattcaacatttaaattaattgttggagataatggtgtaggaatgccaaaaggtatgctacaaaaagatgatgagaccttaggtatggaacttataaaagtatttgttagccaaatagatggtgaaatagaacgcatggataaagatggcacctattttgaaattattttcaagaaaagaacaattaaaaaatga

SEQ ID NO: 15014 - protein, 165 aa, Unknown
  Obtained from environmental sample
  DOMAIN (1)...(56): Histidine kinase
  misc_feature (1)..(165): Xaa is any amino acid
MGEAQNRIRSMALIHEKMYQSGDLSKIDVQDYIVSLIDDLVSSYSINCNIHLDLKIDALKFEIDTLIPIGLLLNEIISNSLKYAFKTKDKGTITIHLSELKNSTFKLIVGDNGVGMPKGMLQKDDETLGMELIKVFVSQIDGEIERMDKDGTYFEIIFKKRTIKK

SEQ ID NO: 15015 - DNA, 888 bp, Unknown
  Obtained from environmental sample
  misc_feature (1)..(888): n is a, c, g, or t
atgaatgacattgataaaaaacctttaccaatagattcatgtagtatcgttagcattcctatagcaaacataatgccaaaacttcttgagcaaattcaaactaatgatatactcaatcataaattatttacttgtgaatttttaagctcaactacaaataatattttagtaactcttatctatcacaaaaaattagatgagttatggtcaaatgaagctaaaaaactacaagagaaacttaatatcaaaattatagggagaagtagaaaacaaaaagttattttaagtgatgattttatagatgagacacttataataaacaatgaaaagttttacttccgttatagtgagggtggttttactcaaccaaatcaaaatgttaattcacaaatgatttcatgggttttagataatattgatgcggatgatgacttgtgtgagttgtattgtggtggtggaaatttcactattcaattatcaaaaaaatttaacaaagtgttagcaactgagattagtaaaacttctataaaatctgcaaaaacaaactgcaaacttaataatattactaatatagaatttattagaatgtcaagtgaggaatttgttgaagcaaaaaataaagtgcgtgaatttacaagattgaaagatattgatttggatagttataaattcagtactttgtttttagatcctccaagggctggactagatattactacaacaaagctagcacaaaattttgaacaaattatttatatctcttgtaatccacaaactctccatagagatttagaagctttaacaaaaacacatactatagaaaaatttgccttatttgatcaatttgcctattcaaatcacatagaatcggggctcagccgaatctga

SEQ ID NO: 15016 - protein, 295 aa, Unknown
  Obtained from environmental sample
  DOMAIN (1)...(295): tRNA (Uracil-5-)-methyltransferase
  misc_feature (1)..(295): Xaa is any amino acid
MNDIDKKPLPIDSCSIVSIPIANIMPKLLEQIQTNDILNHKLFTCEFLSSTTNNILVTLIYHKKLDELWSNEAKKLQEKLNIKIIGRSRKQKVILSDDFIDETLIINNEKFYFRYSEGGFTQPNQNVNSQMISWVLDNIDADDDLCELYCGGGNFTIQLSKKFNKVLATEISKTSIKSAKTNCKLNNITNIEFIRMSSEEFVEAKNKVREFTRLKDIDLDSYKFSTLFLDPPRAGLDITTTKLAQNFEQIIYISCNPQTLHRDLEALTKTHTIEKFALFDQFAYSNHIESGLSRI

SEQ ID NO: 15017 - DNA, 657 bp, Unknown
  Obtained from environmental sample
  misc_feature (1)..(657): n is a, c, g, or t
gtgttaacatccaaattaatacaaaaactaaaccttatgaataagaatgcaaatttagttgaaattcactacttggcagatgaattctgcaaggaattttacaaagtaatggaggggcatacccttgaacaaaacaatggtaaaaagcgaagaaacagaaaattcaagctcaatgatgctgaagttatgaccattatgatcgcctttcatcttggtggctatcgcaatcttaaattcttttatatcaattatgtacaaaaacacttgactgggtacttcccagaaacagtatcttataaccgctttgttgaactacaacaaaaggcattacttccattggtaatgtttttgaaaatgtcacggcttggtcaaagtagtgggatttccttcattgattccacccctatacgagtatgtaagaacaaacgaatatataaccataaagtgtttgacggaatagcaaaaagaggtaagtcaacaatgggatatttcttcggatttaaattacatatagtaattaatgacagtggtgaaataattgaattcgttattacgcctggtaatgtagacgaccgggaaccactcaaagatgcaagtttcatcaaaaatatatacggaaagctttcgcagacaaaggatactcgagccgaattctga

SEQ ID NO: 15018 - protein, 218 aa, Unknown
  Obtained from environmental sample
  misc_feature (1)..(218): Xaa is any amino acid
MLTSKLIQKLNLMNKNANLVEIHYLADEFCKEFYKVMEGHTLEQNNGKKRRNRKFKLNDAEVMTIMIAFHLGGYRNLKFFYINYVQKHLTGYFPETVSYNRFVELQQKALLPLVMFLKMSRLGQSSGISFIDSTPIRVCKNKRIYNHKVFDGIAKRGKSTMGYFFGFKLHIVINDSGEIIEFVITPGNVDDREPLKDASFIKNIYGKLSQTKDTRAEF

SEQ ID NO: 15019 - DNA, 630 bp, Unknown
  Obtained from environmental sample
  misc_feature (1)..(630): n is a, c, g, or t
atgaagtttgtcataacaggtggtggcacaggaggacatttgacaattgcaaaagttcttcaagaagcatttataaaaagagggcatgaagttatatttatcggctctacaagtggacaagaccgctcttggtttgaaaaacgtagcggattttcgcacacatattttttagaaacttcaggtgttgtaaataaaagaggttttgcaaaagtcaaatccctttttaatattctaaaagcagtgctaaaatcaatctctattatgagagagcataaaattcaaggtgtaattagtgtgggtggattctctgcagctcccgcatcatttgcctcgatactaattagaaaacctctctacattcatgaacaaaatgcaaaagttggtagattgaactctctattaaaaccttattcacgtgtattttttagctcttatgagagtgattccccactaaagtcttatcctgttaataaagtgctctttgatcaagcaagattacgtgaaaagataaatacaattatctttttaggtggcagtcaaggtgcaaaagcgataaatgatttagcacttaaggtcgccccttacttaaagagaggggataaatattatccatcaatgtggtcaaaatga

SEQ ID NO: 15020 - protein, 209 aa, Unknown
  Obtained from environmental sample
  DOMAIN (3)...(143): Glycosyltransferase family 28 N-terminal domain
  misc_feature (1)..(209): Xaa is any amino acid
MKFVITGGGTGGHLTIAKVLQEAFIKRGHEVIFIGSTSGQDRSWFEKRSGFSHTYFLETSGVVNKRGFAKVKSLFNILKAVLKSISIMREHKIQGVISVGGFSAAPASFASILIRKPLYIHEQNAKVGRLNSLLKPYSRVFFSSYESDSPLKSYPVNKVLFDQARLREKINTIIFLGGSQGAKAINDLALKVAPYLKRGDKYYPSMWSK

SEQ ID NO: 15021 - DNA, 753 bp, Unknown
  Obtained from environmental sample
  misc_feature (1)..(753): n is a, c, g, or t
atgttgnaagagatctaccaaaaagttaaagatgaagatgtagatctatctaatgtaaaagagtttttaactgatctatctcaaaaagaactctcaactttaggtttacatgattcaaaagatatagacaaactctctactgagggagcatacaacctcttaatgcataactatgagacatatgattttgacaatgatggaactgtggagataggtgatgttagaacacaccctcttgtcactcaaaacatggaagatgatgtaaaaaaagcgtgggtagagaccataaacagttcaggtgatgacatgatggcgatcgtggttatgtcattctctttagatgaagagagaatgaaacgcatgtttgctgaagctcttaagagtttatcagcctctgaaagaagagagttacaaaagagtgcatcatatgatatagagagttttattacagagactctatctaagccttacactccaaaagagttgacttttcaagatattcaagatgaagtagatgagatcataaatcaaaaaggtggaagaaaatcatcagctgctatgatccaatctacacaaaacttttgggaaaagtttcaaaaattttacaacgatatacagacagcaaaaacacaaaaacattcaactcaagagatactagatgtaaaacagcaaaacagtaactttactaccgagatagaagagagtaaccttgaaaaagctctaaaaagtaaagcatcactcgagccgatctga

SEQ ID NO: 15022 - protein, 250 aa, Unknown
  Obtained from environmental sample
  misc_feature (1)..(250): Xaa is any amino acid
MLXEIYQKVKDEDVDLSNVKEFLTDLSQKELSTLGLHDSKDIDKLSTEGAYNLLMHNYETYDFDNDGTVEIGDVRTHPLVTQNMEDDVKKAWVETINSSGDDMMAIVVMSFSLDEERMKRMFAEALKSLSASERRELQKSASYDIESFITETLSKPYTPKELTFQDIQDEVDEIINQKGGRKSSAAMIQSTQNFWEKFQKFYNDIQTAKTQKHSTQEILDVKQQNSNFTTEIEESNLEKALKSKASLEPI

SEQ ID NO: 15023 - DNA, 636 bp, Unknown
  Obtained from environmental sample
  misc_feature (1)..(636): n is a, c, g, or t
atgaaatctaaacaaaaatttatttttgacgaaaacaacgatacatacactgtacaacttaaaaagaaaaagtggtggttgttgttacttttattattgccattattattgctgattctgcaaattagaagcaccaaagaagttgtttttaagacaattgataatacttcgggggttgtcttatcagatgctaatgttagttttacttatcccgacagaaattttattgatttttcaactttcaaatttttcacatttgacgaattaaatgttagtgaaaataccgataatgatggatttgttaaatttgaggtttcttgtactttatactcaaaattatttcacaaagaggatatcacaacagttgttgcaactggaggttgttttcaatcagacactttgcatccaatttatattgaattgagtgataaagaagaatttattataaaactcgaggcacgacgaaaaacagttgtttttacagtgattgatagcaaagataatcaagtgcttccagatgctgatgttgttatagattattatttaggaggacaaaaacagaactcaacagtaaaatccgatgcaagaggagttgtagaagcagatattttgtattgtgctgataatatgaaataa

SEQ ID NO: 15024 - protein, 211 aa, Unknown
  Obtained from environmental sample
  misc_feature (1)..(211): Xaa is any amino acid
MKSKQKFIFDENNDTYTVQLKKKKWWLLLLLLLPLLLLILQIRSTKEVVFKTIDNTSGVVLSDANVSFTYPDRNFIDFSTFKFFTFDELNVSENTDNDGFVKFEVSCTLYSKLFHKEDITTVVATGGCFQSDTLHPIYIELSDKEEFIIKLEARRKTVVFTVIDSKDNQVLPDADVVIDYYLGGQKQNSTVKSDARGVVEADILYCADNMK

SEQ ID NO: 15025 - DNA, 627 bp, Unknown
  Obtained from environmental sample
  misc_feature (1)..(627): n is a, c, g, or t
atgaccgagggatattttgttaatcgtgttataaaagacttttatttttttgataaacaaaaaggtggaatacttgaattactttttgaacatgcaaacccaataagaaaagcaaacaaagaaaaatgggatcaagatggtaacctagtatggggagaagaactttataaaaaacttttttatacatttaataaacaaaaaaaacttagtattgagatttttaatgattggcttccaaatgataattgtaatgtatctattgataaatatagagttgataaatatgggattaatgtagctaaaattgcaattggttcccatccacaaaatgagataataggagataaactagctaaaaaagctgtaaaacttctagaaacaatgggagcaaaaaatataaatggaaacatctcaccatatcctccacaaaatctacaagctggtggctgtagatttggtaatgattctaaaacttctgttttaaataaatattgtcaatctcatgagataaataatctttttgtaaccgatggaagctttatgcctacaggaggcagtgtcccttatacttttactatctatgcaaatagttttagggttgctgattacttaaaaaagattctttaa

SEQ ID NO: 15026 - protein, 208 aa, Unknown
  Obtained from environmental sample
  misc_feature (1)..(208): Xaa is any amino acid
MTEGYFVNRVIKDFYFFDKQKGGILELLFEHANPIRKANKEKWDQDGNLVWGEELYKKLFYTFNKQKKLSIEIFNDWLPNDNCNVSIDKYRVDKYGINVAKIAIGSHPQNEIIGDKLAKKAVKLLETMGAKNINGNISPYPPQNLQAGGCRFGNDSKTSVLNKYCQSHEINNLFVTDGSFMPTGGSVPYTFTIYANSFRVADYLKKIL

SEQ ID NO: 15027 - DNA, 438 bp, Unknown
  Obtained from environmental sample
  misc_feature (1)..(438): n is a, c, g, or t
atgtttttgggagaattacttattgatatgcctttagaatataatacagaaacctaccctgatttttgcggaggttgtaatcgctgtattcgttcatgtccaaccaatgctattgttgcacccaaagtagtagatggaagcaagtgtatctcatatttcacaattgaattgaaagatgatatccctgaagtaatgaagggtgagttcgaaaatcgagtgttcggttgtgatatttgccaggatgtttgtccatggaatcgtatggtaaaaccacattccgttgaagctttcaaaccaaatccagagatattatctttgtcgaaggaaagttggtttgatatggatgctcacaagtttggtagtctatttaaaaattcggcagttaaaagaactaaatttaagggtttgaaaagaaatttagattttataagagaataa

SEQ ID NO: 15028 - protein, 145 aa, Unknown
  Obtained from environmental sample
  DOMAIN (16)...(39): 4Fe-4S binding domain
  misc_feature (1)..(145): Xaa is any amino acid
MFLGELLIDMPLEYNTETYPDFCGGCNRCIRSCPTNAIVAPKVVDGSKCISYFTIELKDDIPEVMKGEFENRVFGCDICQDVCPWNRMVKPHSVEAFKPNPEILSLSKESWFDMDAHKFGSLFKNSAVKRTKFKGLKRNLDFIRE

SEQ ID NO: 15029 - DNA, 318 bp, Unknown
  Obtained from environmental sample
  misc_feature (1)..(318): n is a, c, g, or t
ttgtggatgggacgaaattggggggattatccggttttatttcgggaggacatgtttccacatgagtggatgttgccagtaaaaatatatttggcaaagatttttcggaaacttacattactgaagagtctaggcaaaattcaaaaagaggttgagaaatttattttagcttctaatcatcgaccttttaatgtcaattctgatccacaccaaacctttataaaatcgagtttatctaagatttatgagtttttaagaatgaatccatcaattaatttggatgatgtgatagttaatttagaaagtagtcttctttaa

SEQ ID NO: 15030 - protein, 105 aa, Unknown
  Obtained from environmental sample
  misc_feature (1)..(105): Xaa is any amino acid
MWMGRNWGDYPVLFREDMFPHEWMLPVKIYLAKIFRKLTLLKSLGKIQKEVEKFILASNHRPFNVNSDPHQTFIKSSLSKIYEFLRMNPSINLDDVIVNLESSLL

SEQ ID NO: 15031 - DNA, 732 bp, Unknown
  Obtained from environmental sample
  misc_feature (1)..(732): n is a, c, g, or t
atgcgggcacaaaagaggggcgatcaggttatctctcctgcacagataaagatagctacacgttcatctcagcgtgatttatggggtcagtggatgcctgttatgaagtggaaaacatactattccaatgagatcaacacaaaagtcaaacctcttcctgagggagtaaaatttgtaggtgattttcagatagaggctaaaatagacagacgctcagtagatagcggagagcctgtaaatttgacactagagatcagaggacgcggagattttgaggatataaaatctcaaaagccaaaaataaaaggcgtaagcatatatgctgatgagatcaagatagatgaaaaaatagaaaataatgtatataaagctatgtggagtgagaagtttgcatttgtaggcgatagagattatgtgattccatcatttgagctaaagttttacaatcctaaaactcaaaaaattgagattgtcaaaacagatgctatccccataacagtattaaatgcacctaaaaaagcagctgagcctcttaagatagaacgctctgcagttaaagaagaggtagtgaaaaaagatgaaaatattgttctagctgagcaaaaaacatttgatatcttggtatttacatccggtatagtagcagggtttttactatttttatttattagctttattccatggaaaaagttcttaactaaaaagagagattctgtgaacttaaagatctaa

SEQ ID NO: 15032 - protein, 243 aa, Unknown
  Obtained from environmental sample
  misc_feature (1)..(243): Xaa is any amino acid
MRAQKRGDQVISPAQIKIATRSSQRDLWGQWMPVMKWKTYYSNEINTKVKPLPEGVKFVGDFQIEAKIDRRSVDSGEPVNLTLEIRGRGDFEDIKSQKPKIKGVSIYADEIKIDEKIENNVYKAMWSEKFAFVGDRDYVIPSFELKFYNPKTQKIEIVKTDAIPITVLNAPKKAAEPLKIERSAVKEEVVKKDENIVLAEQKTFDILVFTSGIVAGFLLFLFISFIPWKKFLTKKRDSVNLKI

SEQ ID NO: 15033 - DNA, 450 bp, Unknown
  Obtained from environmental sample
  misc_feature (1)..(450): n is a, c, g, or t
atgagagttgatttacacaaccatacaaccttatgtaaccacgcagagggttctatggaggaatatattcaaaaagctattgagttaggaattgatatctatggttttagtgaacatgctcctatgagagactttgaagatggatatcgacttgttttagagaaaaaagaattttatgaaaatagtgttttagagctacaaaaaaaatatcaagataaaatccaaataactttaggatatgaagtagactatatgaatggagactatatcctagatgaaattaaaaatgcaaatgtagactatctcataggaagtgtccactatctagataagtggggatttgataatcctgagtttataggtgtttataaaagtaaaaatatagacactatctgggaagagtactttgaagctatcaaagctatggcaaaaactggttacttaatatga

SEQ ID NO: 15034 - protein, 149 aa, Unknown
  Obtained from environmental sample
  misc_feature (1)..(149): Xaa is any amino acid
MRVDLHNHTTLCNHAEGSMEEYIQKAIELGIDIYGFSEHAPMRDFEDGYRLVLEKKEFYENSVLELQKKYQDKIQITLGYEVDYMNGDYILDEIKNANVDYLIGSVHYLDKWGFDNPEFIGVYKSKNIDTIWEEYFEAIKAMAKTGYLI

SEQ ID NO: 15035 - DNA, 885 bp, Unknown
  Obtained from environmental sample
  misc_feature (1)..(885): n is a, c, g, or t
ttgatgcttttacccaaaaaagatggtcagtctgcaaaacattttggcggaacgggtttaggtctggcaattagtagaaaattgactgaaattatgaacggtaaattgacagtccaaagtgaaattgacaaaggtagtactttttatgtgaaacttcataatgtatctgtcgggtcggctatagttgaagaggatgataaaaaagcttatgaagagttacagtcatataagtttgactttgcaaatattttacttgtggatgatgttgaagaaaatcgtatcttagtcagcaattatctgcgtaattatggttttaatatcattgaagctgaaaatggagcagatgcgattagactctctcataaaaatattgatttggtacttatggacattaaaatgcctattatgaatggatatgatgcaactgaaaaaataaaaaaagaacctagcacatcaaatattcctattttagctcttactgcttcagtaggagataagcccgagttagatgaaaaaaataaaatatttgatgattttttatcaaagccaattgatcgtaaaacattaatatctgctttggctaaatttttaaagcatacgaaagagtcaacttccacagtggttattaaagagaatgaaatagtattgaaaggtgtcaataaagaggaatttgtagaacagtttttctcttattataataatatatatgaaaaaggtgatttagacttaattgttaactttgctacagaggtagtagattttgcaaaaaaacactctgatgaagagctagaaagctatgctaacaatataattaattatgcaaatgcatttgatatagaaaatgttgaaaaattgatgagtaattttgaaaaattttttaaataa

SEQ ID NO: 15036 - protein, 294 aa, Unknown
  Obtained from environmental sample
  DOMAIN (81)...(201): Response regulator receiver domain
  misc_feature (1)..(294): Xaa is any amino acid
MMLLPKKDGQSAKHFGGTGLGLAISRKLTEIMNGKLTVQSEIDKGSTFYVKLHNVSVGSAIVEEDDKKAYEELQSYKFDFANILLVDDVEENRILVSNYLRNYGFNIIEAENGADAIRLSHKNIDLVLMDIKMPIMNGYDATEKIKKEPSTSNIPILALTASVGDKPELDEKNKIFDDFLSKPIDRKTLISALAKFLKHTKESTSTVVIKENEIVLKGVNKEEFVEQFFSYYNNIYEKGDLDLIVNFATEVVDFAKKHSDEELESYANNIINYANAFDIENVEKLMSNFEKFFK

SEQ ID NO: 15037 - DNA, 711 bp, Unknown
  Obtained from environmental sample
  misc_feature (1)..(711): n is a, c, g, or t
atgaaaacactctacataggaaaaaataagaatgaggtacaatggagtgtcgaaaacaccgaaatctcagtcttgtattccaacaatggcctagaagccattaatatactaaaaacccaaaaggatataggcgctataatttgtgaatacaatctgtcgggaaataatggattgtttttgcatcaacaactcaaggaagaatataatctgtcttccataccttttgtgttgttattagaagagcatagtcctaaaatttatagcgaagcttttaaagctggcgtcaatgattactttgtaatgaaatctacttcaatcgagcagatttttttaagaacgagacaattagctcagcaaaataaagaaaccgcagtgcctcatagtacaagtaaacctgcgacatacaaatttccaatatctaagcgtatttttgatataacaatagcatcctttattttgttaatgctttcccctttgttactaattatcattattgccattcgtatagagtccaaaggcaaagtctattacattgcaaaacgagtaggcagaaaaacatttgatttttacaaacttagatctatgcataatggttctgataagttactaaagcagttggctaaagaaaagaatcagtacagtaaaactccagatacaactaaaaccgaaacatcatcttgtcctagatgtaatgcattgccaaaagggtga

SEQ ID NO: 15038 - protein, 236 aa, Unknown
  Obtained from environmental sample
  DOMAIN (1)...(121): Response regulator receiver domain
  misc_feature (1)..(236): Xaa is any amino acid
MKTLYIGKNKNEVQWSVENTEISVLYSNNGLEAINILKTQKDIGAIICEYNLSGNNGLFLHQQLKEEYNLSSIPFVLLLEEHSPKIYSEAFKAGVNDYFVMKSTSIEQIFLRTRQLAQQNKETAVPHSTSKPATYKFPISKRIFDITIASFILLMLSPLLLIIIIAIRIESKGKVYYIAKRVGRKTFDFYKLRSMHNGSDKLLKQLAKEKNQYSKTPDTTKTETSSCPRCNALPKG

SEQ ID NO: 15039 - DNA, 765 bp, Unknown
  Obtained from environmental sample
  misc_feature (1)..(765): n is a, c, g, or t
atggcaaaaaggattttaaattttttaatccagttattattgggaacggaagtttttaaatggggggaggaaaagatgccccatttcacttttttaaatgaggaacttcttaaaagaggttggacacttaaagcatcttttgttattgaagatgatacaaacttgatgaaaaacatctttagacttataaaagctgataaaaactccgttatgttttgttttggtggtattggagctactcctgatgattatactagacaaattgcagctgaagtttttacagatggacaaacagagtttcatgagaaagcaaaagagttaattataaagcagtttaaagatgaagcttatcctcataggattgagatggcacatctgccaattaatgcaaagcttttaaaaaatgtagtaaacaatgttccaggattttatttagaaaatagattcttctttacaccaggttttccaactatgagtcaaagtatgattatagaagcacttgataaacactataaaaaaaatgatatagaaaaatttagattaacattaacagctatttgtggagaaaatgacttaattgatattatgaaaaaaatttcaaatgaagttgagttgtcatctttacctaaaattattgataataaaagaaaagttgttttgtctctgtcctcaaaagataagaaaaagttagatgatgatttttcgatgtttacactatttttggataaacaaaaaatagagtatgaattaaaagatgtggattaa

SEQ ID NO: 15040 - protein, 254 aa, Unknown
  Obtained from environmental sample
  misc_feature (1)..(254): Xaa is any amino acid
MAKRILNFLIQLLLGTEVFKWGEEKMPHFTFLNEELLKRGWTLKASFVIEDDTNLMKNIFRLIKADKNSVMFCFGGIGATPDDYTRQIAAEVFTDGQTEFHEKAKELIIKQFKDEAYPHRIEMAHLPINAKLLKNVVNNVPGFYLENRFFFTPGFPTMSQSMIIEALDKHYKKNDIEKFRLTLTAICGENDLIDIMKKISNEVELSSLPKIIDNKRKVVLSLSSKDKKKLDDDFSMFTLFLDKQKIEYELKDVD

SEQ ID NO: 15041 - DNA, 942 bp, Unknown
  Obtained from environmental sample
  misc_feature (1)..(942): n is a, c, g, or t
atgaacggagtagagtttattcaaagaatgagaagtctctatcctaatttaaatgttatcatttttggtgttactgcaaatagttcagctgaagttaggtcaagctttataaaaagtggtgctatggattacttcactatacctttaattaaagaggaaattaatgcaaaaaccttttcagctatgagaatcatacaaaaagttgaagagaacgccgcacaacaaaaagtgatagataagcagatcatgtatattaagtttgatagaaacggtttgattatagatgcaagcagtgcatatttaaaacgtacaggttatcttcttgaagagattgaaaatttacactgtagtgaaaatcctgtatataaagatgatcccagtatgaaaaatatctggagtaaagtgactaactccagatatgtaaagggtgaggcagaaagtaaaacaaaagcaggtgatatattttatgaagagtttgacattaaacctatacaagatcacacaggagatatagttgagtattactacctctcttttgatataactgataaaaaatatatagaacgactctctatcactgatgagcttacccaactatacaatagaagacattttgacactacatttaaaaaagagctggatcgtaccaaacgtagtagagataattttgcattgattcatttggatattgattattttaaacagtttaatgatacttacggtcatcaagagggtgatcaagtactgcaaagtgttgcaaaggtgttaaaagatagtgcaaaacgtgtaagtgatgcagtatttagaattggaagagaagagttcactataattttaaccggtatgagtggaaatgagtttcaaccctattcagactatataagaaaatccatggagagtcagaaaattcctcataaaaccgttatattagtgaatatgtaa

SEQ ID NO: 15042 - protein, 313 aa, Unknown
  Obtained from environmental sample
  DOMAIN (187)...(313): GGDEF domain
  misc_feature (1)..(313): Xaa is any amino acid
MNGVEFIQRMRSLYPNLNVIIFGVTANSSAEVRSSFIKSGAMDYFTIPLIKEEINAKTFSAMRIIQKVEENAAQQKVIDKQIMYIKFDRNGLIIDASSAYLKRTGYLLEEIENLHCSENPVYKDDPSMKNIWSKVTNSRYVKGEAESKTKAGDIFYEEFDIKPIQDHTGDIVEYYYLSFDITDKKYIERLSITDELTQLYNRRHFDTTFKKELDRTKRSRDNFALIHLDIDYFKQFNDTYGHQEGDQVLQSVAKVLKDSAKRVSDAVFRIGREEFTIILTGMSGNEFQPYSDYIRKSMESQKIPHKTVILVNM

SEQ ID NO: 15043 - DNA, 864 bp, Unknown
  Obtained from environmental sample
  misc_feature (1)..(864): n is a, c, g, or t
atgagcgtcacatcaaaggagataaaactttctcaaaaagtggtcatggagattttttttaaaaataagataccatcagaaaatgagctatatttcagaggaacgactctttacaaacaaaacaaaatgaagtgggaacaactggatagttattataagccatcagaaaagcttacaaatacagaaaatttcatagagtatgacattcttctctaccctcatggaaacagatggctctatgcactagatattcccattaaaaacataaaaaattctactaaaaattttgacaactctataacatcaaaaaaaaatattattgatattaaaagatactccttaacctcagcactaaagtacaatatactctcgaataacctaatgccggcacttacagttgatcgtatcttaaatgaaaaaattgataatgctctaaaaaagctaaaagtgtcaaatctaaccgatcagcaaaaaagtacccttttactaaagttttttaaagatcaaaatcttacatatacgctaaaacctcaaggtcttgatattaacgatcctacagactcatttttgtttgatagtaaaaacggctactgcgtacactttgcatctgcctttgctaccacagctcgactaataggcataccatcaagagtagtaacaggatttaaagcaactaaaaataatatggtgaataattatctcatcgtaagaagttctgatgctcatgcgtgggttgaactttatattaataaacgaggatggagtagatttgatccaacctctactgcatcaaatacaatttcaagaaaatacccaacaaaaccaacactggctcaaaaaaaaaaaaagattgccatattttaa

SEQ ID NO: 15044 - protein, 287 aa, Unknown
  Obtained from environmental sample
  DOMAIN (193)...(260): Transglutaminase-like superfamily
  misc_feature (1)..(287): Xaa is any amino acid
MSVTSKEIKLSQKVVMEIFFKNKIPSENELYFRGTTLYKQNKMKWEQLDSYYKPSEKLTNTENFIEYDILLYPHGNRWLYALDIPIKNIKNSTKNFDNSITSKKNIIDIKRYSLTSALKYNILSNNLMPALTVDRILNEKIDNALKKLKVSNLTDQQKSTLLLKFFKDQNLTYTLKPQGLDINDPTDSFLFDSKNGYCVHFASAFATTARLIGIPSRVVTGFKATKNNMVNNYLIVRSSDAHAWVELYINKRGWSRFDPTSTASNTISRKYPTKPTLAQKKKKIAIF

SEQ ID NO: 15045 - DNA, 837 bp, Unknown
  Obtained from environmental sample
  misc_feature (1)..(837): n is a, c, g, or t
atgaaaaatataattctttcaacattagctttcgtattggcattgttctttagtgggtgtactggtgaagtttctactcctaaagcacaagagcaagtacgagaagatattagaatatttactgcaaataacagtgatgggaagataacagctaaaagtatagaaaaagcttttaaagcaaatggttttacaattgttggtaacaatgatatgaataaagcatttgaaaaaagatttgaaggtggaggaaaagactttaaggtatatagattaatgtttgtacataatccaaaagttagtgcaaagattatcaatgagtacccagagtttggacttatagctccattgagtacttctgtgtattcaaaagatggaacaacaataagtatttcgtcactttcattaacaggtatgtctagagtatcaggagttcctgaaacaaacaaagatatgatacaacttcataatagtatgactaaagctttaaaagaagctttaccagatgggaagtttgagccattaaattataagattacaagaccagaaggttcacttgtaacaagatttgcttttgttttaaaaaatgaaggtaaaatagaagatgcaaaagagagttatcaagaaactatggaaggtgaaatcgaatcagcaggttttatagttgcaggattttatccaattaatgaagatcttgtagatagtggtattaatgattatgatttttacgattcatattctatttgtaagttagaagttatatatccagtacataaagttcaccctgaagttggngcatttgcaccgtgtactatgtatatgtataagaaagaaaaatga

SEQ ID NO: 15046 - protein, 278 aa, Unknown
  Obtained from environmental sample
  SIGNAL (1)...(21)
  DOMAIN (40)...(163): Domain of unknown function DUF302
  misc_feature (1)..(278): Xaa is any amino acid
MKNIILSTLAFVLALFFSGCTGEVSTPKAQEQVREDIRIFTANNSDGKITAKSIEKAFKANGFTIVGNNDMNKAFEKRFEGGGKDFKVYRLMFVHNPKVSAKIINEYPEFGLIAPLSTSVYSKDGTTISISSLSLTGMSRVSGVPETNKDMIQLHNSMTKALKEALPDGKFEPLNYKITRPEGSLVTRFAFVLKNEGKIEDAKESYQETMEGEIESAGFIVAGFYPINEDLVDSGINDYDFYDSYSICKLEVIYPVHKVHPEVGAFAPCTMYMYKKEK

SEQ ID NO: 15047 - DNA, 927 bp, Unknown
  Obtained from environmental sample
  misc_feature (1)..(927): n is a, c, g, or t
ttgctggtttttttaaaaaggtattgggtttgtcaaaatatagatgaagcccaaagagtatttatagataatcaattagaaattgatattgttctattagatgttgacataccagatttgggtggtattaaactcttatctaaaataagagaattagattgggaccttcccgttttaattactacaagctttaatgaaataaatcttttattaaaagccataaaattcaatcttacaaactatattgcaaaacctatgcaattaaatactacattaaaaataatgtcagatacaatcaaaaaaatagaagatgaaaaagaacttgcaattaaaaacaatgaactaagacaatttatgtccatattagattcaaataatattatttgtgagttagacttgaactttaaaatagactcagcaaatgatctgtttttaataaattctggttttgatttagatgaaataattggaaaagagtttaatgataaaataatctttcataacagtgatatctctgattttgaaataaaagaactacttactaaaggtaaaacttgggtgggtctttgtaaaaagaaaacaaaagatggagagttttataacacttattctactatacttcctatttttcacaataacggtaaagttaaaaagtatattgagttttcaactttaacaacaaaatatgaaaaagagatattatcccttaaaaagcatattatgtcattaaaaagtgaaaattttaagacaaattcagaattaagaaaagagaaggattattatattactctttctgataaacttcaaaagccagttgatgatagtgtaaatagtgcacaaggggttgtttttgaaatatatggagcccaaaaagaaaaaaccataaatttacttgaaaaactaaaaaatcccagagcaaagatttga

SEQ ID NO: 15048 - protein, 308 aa, Unknown
  Obtained from environmental sample
  DOMAIN (1)...(103): Response regulator receiver domain
  misc_feature (1)..(308): Xaa is any amino acid
MLVFLKRYWVCQNIDEAQRVFIDNQLEIDIVLLDVDIPDLGGIKLLSKIRELDWDLPVLITTSFNEINLLLKAIKFNLTNYIAKPMQLNTTLKIMSDTIKKIEDEKELAIKNNELRQFMSILDSNNIICELDLNFKIDSANDLFLINSGFDLDEIIGKEFNDKIIFHNSDISDFEIKELLTKGKTWVGLCKKKTKDGEFYNTYSTILPIFHNNGKVKKYIEFSTLTTKYEKEILSLKKHIMSLKSENFKTNSELRKEKDYYITLSDKLQKPVDDSVNSAQGVVFEIYGAQKEKTINLLEKLKNPRAKI

SEQ ID NO: 15049 - DNA, 792 bp, Unknown
  Obtained from environmental sample
  misc_feature (1)..(792): n is a, c, g, or t
atgaatttttttatcatgccatttttattgatgtttttatttattggtatatttgccatgacttcaatgtttggtagagtttggtgtggttgggcatgtcctcaaactatatttagagtgatttatagagacttaatagagacttttttattaaaattgcgaagaattaaaaataaacaaaaagatattgattataataaaacttctacaaagataaaaaaatatattggtcttattttatggataattttatcctttataatatctattaattttatgttatattttgtacctcctgaagacttttttgaatatataaaaaacccacaagaacacttgattttagttatgtttatacttagtattgttacttttttagtgtatgatatagtatttatgaaagagcacttttgtacttatgtatgtccatactctagaattcagtcggctttatatgataataatactaaacaagttatttataactacaacagaggtggacagatatatccaaacaatgaaaagagtatttttaatgtaaaacagtggtcaggtaatgaagagtgtactacttgtgaagcttgtgtaaaagtctgtcctacacatatagatataagaaaaggtttacaagttgaatgtataaactgtttagagtgttcagatgcttgtagcagtgtaatgggaaaacttggtaaaaaatctttaatctattggggagatacaaatagtgtattattaaataaaatagagaagtttttaaatcctagaaacttagtctatattgcttcttag

SEQ ID NO: 15050 - protein, 263 aa, Unknown
  Obtained from environmental sample
  SIGNAL (1)...(19)
  misc_feature (1)..(263): Xaa is any amino acid
MNFFIMPFLLMFLFIGIFAMTSMFGRVWCGWACPQTIFRVIYRDLIETFLLKLRRIKNKQKDIDYNKTSTKIKKYIGLILWIILSFIISINFMLYFVPPEDFFEYIKNPQEHLILVMFILSIVTFLVYDIVFMKEHFCTYVCPYSRIQSALYDNNTKQVIYNYNRGGQIYPNNEKSIFNVKQWSGNEECTTCEACVKVCPTHIDIRKGLQVECINCLECSDACSSVMGKLGKKSLIYWGDTNSVLLNKIEKFLNPRNLVYIAS

SEQ ID NO: 15051 - DNA, 909 bp, Unknown
  Obtained from environmental sample
  misc_feature (1)..(909): n is a, c, g, or t
atgggcaacaaaaattggttagatgcaaaaattttcatgccatctgatgatttaagtaagaaatcttactatgtgttgtctaggtccccttatccatcaggggctttacacatggggcatgtttcaaactattcaatagctgacgccttaacccgcttaaaaatgatggaaggttataacgttatgcagccaatgggatatgattcttttggaatgcctgcagagaattttgcaatccagcataattctcatccaaaactgacaacagaagacaatattaagactatgcgtaatcagtttgatagcattggtttcggatttgattgggatagagaagtaagcacttgccgccctgaatattaccattggggacaatggttatttaaaaaaatgtatgaaaagggcttagcttacaagaaatcatcttttgtaaactggtgtgaggattgtcagactgttttggcaaatgaacaggttgaagatggtaaatgctggcgttgtgacaataatgttgaacagaagaagttaaaacaatggttctttagaattacagattatgctgaagaattattagatttttctaaaataattgattggcctgagagagttatagcaatgcaaaccaactggattggaaaaagtgaaggtacaatcatcaattttaaaaccgaagaaagtgatcatttgttgaaagtttttaccaccagacccgacactatctttggttgcactttcatggctcttcctccagagcatccatatgtttatgatctgcttgagaatagtgctgcagatagtgaattatcagaattctgtcataagataatgaaccaggataagatcagcagaacctcagatgaaacaacaaaagagggcttgttacaggaaatacgaatctcagccatctga

SEQ ID NO: 15052 - protein, 302 aa, Unknown
  Obtained from environmental sample
  DOMAIN (4)...(300): tRNA synthetases class I (I, L, M and V)
  misc_feature (1)..(302): Xaa is any amino acid
MGNKNWLDAKIFMPSDDLSKKSYYVLSRSPYPSGALHMGHVSNYSIADALTRLKMMEGYNVMQPMGYDSFGMPAENFAIQHNSHPKLTTEDNIKTMRNQFDSIGFGFDWDREVSTCRPEYYHWGQWLFKKMYEKGLAYKKSSFVNWCEDCQTVLANEQVEDGKCWRCDNNVEQKKLKQWFFRITDYAEELLDFSKIIDWPERVIAMQTNWIGKSEGTIINFKTEESDHLLKVFTTRPDTIFGCTFMALPPEHPYVYDLLENSAADSELSEFCHKIMNQDKISRTSDETTKEGLLQEIRISAI

SEQ ID NO: 15053 - DNA, 513 bp, Unknown
  Obtained from environmental sample
  misc_feature (1)..(513): n is a, c, g, or t
atggcaaaatcagtttccagccttaaatcaaccattaaagaccagtccggtgccggcaaaaccaaaattggtgaaatcctttcaaaggaaggacagatcaccagcatgcagcttaccgaggcccttaatgttcacaaaaaaacaaatgagcgcctcagcagcattcttttaaacaagggatatattgatccggatacgatcatcaatgttctgggcaggatttacaactacaatgtggcccggttggctgaaatgaaacctgatccggcggttctaaaaattcttccctttgaaatggccaaggcgcatctggtgtttcccctgacacttaagggcgatgacctgacggttaccatggcagaacccacggataccgctattgttgaggagctttcaaaaaaaacccagaaaaatattaaggtctttgtctccacggagaatgatattatccaggcctatcgtgatttttacaagatcagtgatgacgattataaagggtttctttccttttga

SEQ ID NO: 15054 - protein, 170 aa, Unknown
  Obtained from environmental sample
  DOMAIN (56)...(163): GSPII_E N-terminal domain
  misc_feature (1)..(170): Xaa is any amino acid
MAKSVSSLKSTIKDQSGAGKTKIGEILSKEGQITSMQLTEALNVHKKTNERLSSILLNKGYIDPDTIINVLGRIYNYNVARLAEMKPDPAVLKILPFEMAKAHLVFPLTLKGDDLTVTMAEPTDTAIVEELSKKTQKNIKVFVSTENDIIQAYRDFYKISDDDYKGFLSF

SEQ ID NO: 15055 - DNA, 798 bp, Unknown
  Obtained from environmental sample
  misc_feature (1)..(798): n is a, c, g, or t
atgaaattcaatctcaactcttttcttatgagtgtctctttggcactagatatgtcagaaaaagagatacttggcgtagatatctaccatgcgagaaaagttgcatatgttagtcttagaattgcacaaagccttggtttgaaagatgatgagtgttttgatatttgtgcattggcaatactgcatgataacggcattacagaagctgtactgaaaagtaatatttccattaataaaggtgatttttatcaacttgaaaatatagttgaacactgcagtatcggtgaaaaaaatattaaaaattttcctttttttacaaatacgaaaaatgttattatgttccatcatgaaaattatgacggaagtggtttttttggaaaaaaaggtgatgatactcctcttttagcccaaatcatatcatttgcagatgaattagattttaattttaatttgagtgatgacactcttgataacagaaataaaattgagaactatgtaaaagagaacattaatataaaacattctaaaactcttgcagatatttttttaaaattatctactgcaagagctttttggctggatcagcaagatatcacaattgttaaatctattcaaaaatatttacctgagatatcaattgaaattgatcttgaaaatttatttgaaatgtcaaaagtattttccaaaattattgattctaaatcttcttttacatctagacatacaagcggattaattaataaggctgaagagatggctcattactataattttgatgaaatagacttctcaaattaa

SEQ ID NO: 15056 - protein, 265 aa, Unknown
  Obtained from environmental sample
  SIGNAL (1)...(15)
  DOMAIN (27)...(148): HD domain
  misc_feature (1)..(265): Xaa is any amino acid
MKFNLNSFLMSVSLALDMSEKEILGVDIYHARKVAYVSLRIAQSLGLKDDECFDICALAILHDNGITEAVLKSNISINKGDFYQLENIVEHCSIGEKNIKNFPFFTNTKNVIMFHHENYDGSGFFGKKGDDTPLLAQIISFADELDFNFNLSDDTLDNRNKIENYVKENINIKHSKTLADIFLKLSTARAFWLDQQDITIVKSIQKYLPEISIEIDLENLFEMSKVFSKIIDSKSSFTSRHTSGLINKAEEMAHYYNFDEIDFSN

SEQ ID NO: 15057 - DNA, 327 bp, Unknown
  Obtained from environmental sample
  misc_feature (1)..(327): n is a, c, g, or t
ttgagccatatcctttgcaagttcatcaaggaaggtaccaaaagcagcaacaggctcatcgttgtcggcaacggttctcaaagagacttcgagttttcctatgacagatttgggaaccagttgcctgatacctgcatcacaaacaagaaccccctgtctttcaagaagagagacatacacgagtacaccggttcttcttttcgtgagggatactccctgtcgaaaccagataagttcactattggcttttacctgactgaatcttcgttctttggaagtgagaattttgataaaccatatanaatcttttacttagccaatagctga

SEQ ID NO: 15058 - protein, 108 aa, Unknown
  Obtained from environmental sample
  misc_feature (1)..(108): Xaa is any amino acid
MSHILCKFIKEGTKSSNRLIVVGNGSQRDFEFSYDRFGNQLPDTCITNKNPLSFKKRDIHEYTGSSFREGYSLSKPDKFTIGFYLTESSFFGSENFDKPYXIFYLANS

SEQ ID NO: 15059 - DNA, 759 bp, Unknown
  Obtained from environmental sample
  misc_feature (1)..(759): n is a, c, g, or t
atgttcttctttggacaagatggcggacttgatttaaatattttaaaaattcactatgatcacttcattgcttggacaaaagaaaaagaaaaacaacacaaagaaactcaagttctattaaaagagaatttttcattcgatttgaaaccaagtcaattagactgtacctgtgtatcttgtaatggagattatcgaacaaaacttagagaatatgtttttgctcaatgtaagaacgaaatagatattgccactgccggcattaaagctgatatcgaaacgcaaggtctaagagaagttagtcgctactttgtggacatgcaaaagaatattgaaagaatctttcataaggttagatatagacttaaaagatcgactctaaatcgactagactctcaagtgaagccactagttaagaataattttacttatccatcagaacttgctctagctagagagaagacaattcgtccttttttgatgaccctactttataacgaaggcttaaatgacgaactggttagtgatgatgaatttaaaagattttttaatcaactaggaacaaatatttggcgttctgaaaactatatagaacgtgaatttaagaaacttgttaaatcagtaatgcttcttaaaagagaggacatctctggtaaaattcttcaagaatatattggagagttctggatccattcacaagcaagagaaattaaacgaaagattgtctatcatatgggccctaccaatcccgagccgatctga

SEQ ID NO: 15060 - protein, 252 aa, Unknown
  Obtained from environmental sample
  misc_feature (1)..(252): Xaa is any amino acid
MFFFGQDGGLDLNILKIHYDHFIAWTKEKEKQHKETQVLLKENFSFDLKPSQLDCTCVSCNGDYRTKLREYVFAQCKNEIDIATAGIKADIETQGLREVSRYFVDMQKNIERIFHKVRYRLKRSTLNRLDSQVKPLVKNNFTYPSELALAREKTIRPFLMTLLYNEGLNDELVSDDEFKRFFNQLGTNIWRSENYIEREFKKLVKSVMLLKREDISGKILQEYIGEFWIHSQAREIKRKIVYHMGPTNPEPI

SEQ ID NO: 15061 - DNA, 321 bp, Unknown
  Obtained from environmental sample
  misc_feature (1)..(321): n is a, c, g, or t
ttggctgagttgcggcctcttgttngccgcctttttgtttaccccagaacctctaccccaaaatttgccatcaaaataaacctccacaaaaaatatcttggaatgttccggaccgacttcgtccacaatcttatatttgggcaaagaacgatatttcccctgaaaatgttcctgcaccaagctcttgtaattttgcaaataatcaagagtaacctctttttcaaaatcttgcaaacacttctcacaaacaaattttctggcttcatcaatgccgccatccagatagatagcacaaataagagactcgaccacatccgataa

SEQ ID NO: 15062 - protein, 106 aa, Unknown
  Obtained from environmental sample
  misc_feature (1)..(106): Xaa is any amino acid
MAELRPLVXRLFVYPRTSTPKFAIKINLHKKYLGMFRTDFVHNLIFGQRTIFPLKMFLHQALVILQIIKSNLFFKILQTLLTNKFSGFINAAIQIDSTNKRLDHIR

SEQ ID NO: 15063 - DNA, 507 bp, Unknown
  Obtained from environmental sample
  misc_feature (1)..(507): n is a, c, g, or t
gtgcagaggggaatagggttttggtaccaattaagtggcataggtaaatttaaaatttttggttattgcaagaagtattcattagaacctattgttcaaatagctaatattaatataccactttttatttcaaaagagtccaatgtagatatagagatttttaaaaaacgtgaaaaatggtgcatgtttgatttagagatatcttggttatctcaattaataagtattgagacagcagagcaactagagaagattatggatattattccagatgttcttaaaaaagagtgtcaaaaacttatagatataacaaaaaatatatcatatgaaaaagtaaaaatatctccaatatattatagtgctatgaaatactatgacaatatatactatcgagttattgaaggaaatctaacacttgctaaaggtggcggatataaaagtgatggtattaaatctttaggatttgcactatacacagacaatctattaaaagttatggaaggataa

SEQ ID NO: 15064 - protein, 168 aa, Unknown
  Obtained from environmental sample
  misc_feature (1)..(168): Xaa is any amino acid
MQRGIGFWYQLSGIGKFKIFGYCKKYSLEPIVQIANINIPLFISKESNVDIEIFKKREKWCMFDLEISWLSQLISIETAEQLEKIMDIIPDVLKKECQKLIDITKNISYEKVKISPIYYSAMKYYDNIYYRVIEGNLTLAKGGGYKSDGIKSLGFALYTDNLLKVMEG

SEQ ID NO: 15065 - DNA, 315 bp, Unknown
  Obtained from environmental sample
  misc_feature (1)..(315): n is a, c, g, or t
gtgttatgtatattatatttatattttgaaggaatgttagagatgaatattttattactaagtaatgactatactataaaaagttatttagaaattggacaaaacaagttgaactactcttttgtaaattctaatcaaccgatggtagactatgaaaaaaacaattttgatattgtaattgtcgatatttcaactcataaaaaaaaccttcttcaaatactagaactaacccctaaacaaaaaataatagttatctctgacaacttagattgtattaacgaaattggatgtgatatttgtccagttaaaatttaa

SEQ ID NO: 15066 - protein, 104 aa, Unknown
  Obtained from environmental sample
  misc_feature (1)..(104): Xaa is any amino acid
MLCILYLYFEGMLEMNILLLSNDYTIKSYLEIGQNKLNYSFVNSNQPMVDYEKNNFDIVIVDISTHKKNLLQILELTPKQKIIVISDNLDCINEIGCDICPVKI

SEQ ID NO: 15067 - DNA, 828 bp, Unknown
  Obtained from environmental sample
  misc_feature (1)..(828): n is a, c, g, or t
ttgctccgcgggctccaggcgatatattgcaatcgggaggttcgtgcccaggtgtttgaggcactgaccgagctcattccttctcatattgataccaaaaatggccgtaaaggcatggatttgtggaaaatattggtccttggagcccttcgcctctcctgtaactgggattatgacaagcttcatgaaattgccaataatcatataaagctccgtcagatgctcggccacggaaaaatggatgccgattatcaatatgaactccagaccttaaaagataatatttcccttttcacaccggagatactggatagaattaaccagatcgttatcaaatatggccacaagatcgccggtaaaaaagaagatgaaaaactgactggcagttgtgactcttttgttgtcgaaaccaatgttcattacccaactgatatcaatctgctttttgacgccatacgaaaaatgatcgttttgatgatgcaactttgcggttgtctggatatttctgattggcgtcagggcaagtatcacatccgcaaggcaaaacaattttatcgaagagttcaacagttaaagcgctcctcatcaaaggataagaacaaaaaagctgaaagagagcaactgattatcaacgctcacaatgaatatattgatttggctcaattctatattgataaaatccggcaaacgcttatttccttccaggaagtcaacatcctcacccatttaaaaatagaagaaataaagtcatatatcgttcatgccgaaaggcagatcgatcaaatccgcaaaaaagttaatcacggccaagaccctcttacatcatga

SEQ ID NO: 15068 - protein, 275 aa, Unknown
  Obtained from environmental sample
  misc_feature (1)..(275): Xaa is any amino acid
MLRGLQAIYCNREVRAQVFEALTELIPSHIDTKNGRKGMDLWKILVLGALRLSCNWDYDKLHEIANNHIKLRQMLGHGKMDADYQYELQTLKDNISLFTPEILDRINQIVIKYGHKIAGKKEDEKLTGSCDSFVVETNVHYPTDINLLFDAIRKMIVLMMQLCGCLDISDWRQGKYHIRKAKQFYRRVQQLKRSSSKDKNKKAEREQLIINAHNEYIDLAQFYIDKIRQTLISFQEVNILTHLKIEEIKSYIVHAERQIDQIRKKVNHGQDPLTS

SEQ ID NO: 15069 - DNA, 843 bp, Unknown
  Obtained from environmental sample
  misc_feature (1)..(843): n is a, c, g, or t
ttggcatctgtctgcaatttaaagtgccctatgtgctatacaattacggatcattttaaagaacaggtcaacgcgaaattaatggattatgacctgtttacaaaaattgtagatgaatgtgccgagggtggtgtctattccattcgccttagtctaagaggtgaaacttttttacataaacgtgttttagactgcattgagtatgcaaagaaaaaaggcattaaagaagtctcctctctaaccaatgctcataaaatggatgaagatcaattcaccaaaattatgaatatgggcatggattggatcacaatatctgttgacggtatgggtgaggtttacgaagaaatccgcaaacctgcaaaatttgatcgtttactagagaaactagccaatttcaaaaaaataaaagaagaggctggtaaggttaaacctgtcatcaaaattcaaacaatctaccctgctattgctgaagatccagacgcattttacagcacattcgctcctttatgcgacgaagtagcaagtaacccattgattgattaccttcgtcttgatgatgaagatcagattttattccatgaggacttctcttgcccacaactctatcaacgtttaacgattggtgcagatggaaatgttatgttatgtgccaatgatgaaatagaagaatttgttcttggcaatgctcaattccagacaatccatgaaatatggcatggaccgcgtatccaagaagcacgtgagctccacagaaatcatcgcggacatatagagattgaaccttgtcgtaaatgttatttaccacgtagaaccgaaacagaaaccagtattaattggcggtaa

SEQ ID NO: 15070 - protein, 280 aa, Unknown
  Obtained from environmental sample
  misc_feature (1)..(280): Xaa is any amino acid
MASVCNLKCPMCYTITDHFKEQVNAKLMDYDLFTKIVDECAEGGVYSIRLSLRGETFLHKRVLDCIEYAKKKGIKEVSSLTNAHKMDEDQFTKIMNMGMDWITISVDGMGEVYEEIRKPAKFDRLLEKLANFKKIKEEAGKVKPVIKIQTIYPAIAEDPDAFYSTFAPLCDEVASNPLIDYLRLDDEDQILFHEDFSCPQLYQRLTIGADGNVMLCANDEIEEFVLGNAQFQTIHEIWHGPRIQEARELHRNHRGHIEIEPCRKCYLPRRTETETSINWR

SEQ ID NO: 15071 - DNA, 741 bp, Unknown
  Obtained from environmental sample
  misc_feature (1)..(741): n is a, c, g, or t
atgaaagtattgccgtcgcattcaaacgatttgatagactttcatataaagtctttacaaagttttaaagatatccataaaggaaaacgtgcctttataattggtaatggaccaagcctcagtgtttctgacttggatttaatggtagacgaaattagctttgcagccaacaagatttacctgctatttaatcaaacacggtttcgaccaagctattacacatctgttgacttgatatttcttgaaaattttcatgaaaaagtggaaaaactcgattttattaaatttattccagaatggggaaaaaagtggtttgaagaatcgaactctatgttttttttcaaagagaaaggtaatcccattaataagggatttaagccaggattcagttataatatcgataaaggtatttatggtggatatacggtaagctatacaaatattcaattagctttttacatgggaataagagaattatatctggtgggtatggatcatacctataatcttcctgaaaaacgtacccaccatgaaaaatacggtaatgttctggtatctgatggagaggtaaatcatttttgtaatgattatagacaagagggtgaaatatggtctgtgccgaggcctgagtatcaggagatggcatttaaaatggcttctgaaaaatttaaggcatctggtgggaaaattataaatataaccaggggcggaaatctcgaaatatttcaagattgtctttag

SEQ ID NO: 15072 - protein, 246 aa, Unknown
  Obtained from environmental sample
  DOMAIN (6)...(166): Protein of unknown function DUF115
  misc_feature (1)..(246): Xaa is any amino acid
MKVLPSHSNDLIDFHIKSLQSFKDIHKGKRAFIIGNGPSLSVSDLDLMVDEISFAANKIYLLFNQTRFRPSYYTSVDLIFLENFHEKVEKLDFIKFIPEWGKKWFEESNSMFFFKEKGNPINKGFKPGFSYNIDKGIYGGYTVSYTNIQLAFYMGIRELYLVGMDHTYNLPEKRTHHEKYGNVLVSDGEVNHFCNDYRQEGEIWSVPRPEYQEMAFKMASEKFKASGGKIINITRGGNLEIFQDCL

SEQ ID NO: 15073 - DNA, 501 bp, Unknown
  Obtained from environmental sample
  misc_feature (1)..(501): n is a, c, g, or t
gtgnaaaatattaaagccaatttagaagaagaccataatggtgaggataaatctaatgagaaaaacaaagagttatttcaggtttttcctaaatttgaggattggtggattaaagagttatggataaatcatcaggcttattttggattatataaatggaaaactatcatctcttccttatgtcaatcatctgatcaacaaagagcatgggaagttatttttgcgaactgggtaaatataaaaaaacaaatcacatctaaaggtgcattagcatttgaatataactatgcttttgacacccttatacgaaactatagtggtttagaagaggagttagcaacaacaagtttagagtctatggaaaagttgataaactatttaactaataaagaagattttacaaaaatggcatctccgaatgaacatgaacttataacaaaatatacaaaatttaaaagagaaaaaattgattataaagatgtaaaaggtaaaaaatcttaa

SEQ ID NO: 15074 - protein, 166 aa, Unknown
  Obtained from environmental sample
  misc_feature (1)..(166): Xaa is any amino acid
MXNIKANLEEDHNGEDKSNEKNKELFQVFPKFEDWWIKELWINHQAYFGLYKWKTIISSLCQSSDQQRAWEVIFANWVNIKKQITSKGALAFEYNYAFDTLIRNYSGLEEELATTSLESMEKLINYLTNKEDFTKMASPNEHELITKYTKFKREKIDYKDVKGKKS

SEQ ID NO: 15075 - DNA, 555 bp, Unknown
  Obtained from environmental sample
  misc_feature (1)..(555): n is a, c, g, or t
ttgattggatataataccacactaattaagtatataaggttaatgatggattgtaattattttggaatttgtggtagttgtactttaggtggtcaaacttatgaagaacaattaagcaataaaatagatattgaaaaagaacgatttaaaaatttttggaacaatgagatagatattattaaaagtgatgatggctcttttaggaatagagctgaatttagagtttggagaacatatgaaacagatgatactgtagaattctcttacgctatgaatgacattgataaaaaacctttaccaatagattcttgtagtatcgttagtgttcctatagcaaacattatgccaaaacttcttgagcaaattcaaactaatgagatactcaatcataaattatttacttgtgaatttttaagctcaactacaaataatattttagtaactcttatctatcacaaaaaattagatgagttatggtcaaatgaagctaaaaaactacaagagaaacttaatatcaaaattatagggagaagtagaaacaaaaagttattttaa

SEQ ID NO: 15076 - protein, 184 aa, Unknown
  Obtained from environmental sample
  DOMAIN (33)...(184): tRNA (Uracil-5-)-methyltransferase
  misc_feature (1)..(184): Xaa is any amino acid
MIGYNTTLIKYIRLMMDCNYFGICGSCTLGGQTYEEQLSNKIDIEKERFKNFWNNEIDIIKSDDGSFRNRAEFRVWRTYETDDTVEFSYAMNDIDKKPLPIDSCSIVSVPIANIMPKLLEQIQTNEILNHKLFTCEFLSSTTNNILVTLIYHKKLDELWSNEAKKLQEKLNIKIIGRSRNKKLF

SEQ ID NO: 15077 - DNA, 684 bp, Unknown
  Obtained from environmental sample
  misc_feature (1)..(684): n is a, c, g, or t
atgctgtatgctgaatactgtatgctattttctaaatcctgcatgctgtcctccaaagtaatttcgaactggataaaagaaaatccgccgaaaccactactagtagtgctaggacctaccgccagtggtaaaactgatttggcgattgaacttgctcaagaatttgatggtgaaattatttctgccgatagtcgacaaatttataaagaactagacaaaggcaccgccaaaccaacccttgcagaaatgcaaaaaaaaccacaccaccttatctctgaattttcaccaaaagaaacaatcactgttgccaaatatcgagagcttgctgaaaacaaaattgaagaaattttaaaaagaaaaaaactaccaattctctgtggaagtcatacgctattaatatcagcgttagtggaaaattatcaattccctggagaacaagacaccactcgtagacacgaattaactgaggcttataaatcaaaaaatggcgcgaaaaaattgtgggaaatgttaaaaaaaattgattccgcacaagcaaaaaaaataccaccagaaaatcaacatcacctcatccgcgccattgaacgagccgaaacaggagaaaaacaactaaatcttccagaaaattcgacacacttctcgtcggatttaaccctccgcgtgatattttgtacgaaaaaataa

SEQ ID NO: 15078 - protein, 227 aa, Unknown
  Obtained from environmental sample
  DOMAIN (65)...(227): IPP transferase
  misc_feature (1)..(227): Xaa is any amino acid
MLYAEYCMLFSKSCMLSSKVISNWIKENPPKPLLVVLGPTASGKTDLAIELAQEFDGEIISADSRQIYKELDKGTAKPTLAEMQKKPHHLISEFSPKETITVAKYRELAENKIEEILKRKKLPILCGSHTLLISALVENYQFPGEQDTTRRHELTEAYKSKNGAKKLWEMLKKIDSAQAKKIPPENQHHLIRAIERAETGEKQLNLPENSTHFSSDLTLRVIFCTKK

SEQ ID NO: 15079 - DNA, 759 bp, Unknown
  Obtained from environmental sample
  misc_feature (1)..(759): n is a, c, g, or t
atgcaaggggccctgcaaaaatgggtagttctttcttttagtgtaccaataaacctacctgaagatgctccagaagaattggtaggagaattatacattgcggcatggcaaaatggttgtaaaggagtaacagtttatcgtgacggttctcgctcaggagttctaatatcaaacaaaaaagaagacaaaaaagaccccgcgctattagctacacttaagcgaccaaaagtgcttgaagcaaacatactacgtttccaaaacaacaatgaaaaatggattgcttttgtgggcattttagaaggtaaaccttacgaaatatttactggtttagccgaagacgatgtattacctattccaaagtctattgagaaaggacgcattataaaaaacaagaatgaagaaggaaatacacgttacgattttcaatatgagaataaatttggatacaaaactaccgttgaaggtctttctcacaaatttgctcccgaattttggaactatgctaagttaatttccggagtgctacgctacggtatgcccattccacaggtggtaaccttggttgattccttagtgcttgattcagagacaataaacacatggaaaactggggtagcccgagctttaaagaaatatattgaagatggcaccaaagcaaaagaaggcacacgatgccctgagtgtaacgaagaaaacaccattatttatcaagatggatgtttaacttgctcaagctgcggttattcaaaatgtggctaa

SEQ ID NO: 15080 - protein, 252 aa, Unknown
  Obtained from environmental sample
  misc_feature (1)..(252): Xaa is any amino acid
MQGALQKWVVLSFSVPINLPEDAPEELVGELYIAAWQNGCKGVTVYRDGSRSGVLISNKKEDKKDPALLATLKRPKVLEANILRFQNNNEKWIAFVGILEGKPYEIFTGLAEDDVLPIPKSIEKGRIIKNKNEEGNTRYDFQYENKFGYKTTVEGLSHKFAPEFWNYAKLISGVLRYGMPIPQVVTLVDSLVLDSETINTWKTGVARALKKYIEDGTKAKEGTRCPECNEENTIIYQDGCLTCSSCGYSKCG

SEQ ID NO: 15081 - DNA, 555 bp, Unknown
  Obtained from environmental sample
  misc_feature (1)..(555): n is a, c, g, or t
gtgaatagttatcaaataattgttaaaggggtagtccaaggagtcggatttcgtccttttatatttaatcttgcagagcaattaaagattaatggaaatgttagtaatgactctttaggcgttactataaatgttacaacatcaaaagagatgttagatctttttactacacatatatctttaaaaaaaccgcctctttcaaagattgactccattgatgtgaaagatgtagcatataaagagtatgaaaaatttgagattatccagagtcagcggagtatatcaggctttactattatgccatcagatatctccatatgtgaggagtgcgaaaaagagttaaacgataaaagcaacagaagatttgcttatccgtttatcacctgtacaaattgcggacctagatatacaattatagagactcttccctacgatagaaaaaatacatccatgggtgagtttaagatgtgtacagattgcccaaaagagtatgaagatccacatgacagacgctaccatgctcagcctataggttgtcataaattgtggacctga

SEQ ID NO: 15082 - protein, 184 aa, Unknown
  Obtained from environmental sample
  DOMAIN (1)...(87): Acylphosphatase
  misc_feature (1)..(184): Xaa is any amino acid
MNSYQIIVKGVVQGVGFRPFIFNLAEQLKINGNVSNDSLGVTINVTTSKEMLDLFTTHISLKKPPLSKIDSIDVKDVAYKEYEKFEIIQSQRSISGFTIMPSDISICEECEKELNDKSNRRFAYPFITCTNCGPRYTIIETLPYDRKNTSMGEFKMCTDCPKEYEDPHDRRYHAQPIGCHKLWT

SEQ ID NO: 15083 - DNA, 825 bp, Unknown
  Obtained from environmental sample
  misc_feature (1)..(825): n is a, c, g, or t
gtgttgcccaacttttcagattttattattgaatcgaaaaaaattgcttcgggagccgatgttattgtacattgttggcgcgtgggaatgcgatcagaatcgttcgcaaaacatttagcagaaaacggttttaatcgggtgtacgtaattgaaggcggatacaaagcattcagaaattatgcattgaaatcatttacgcaggaggcaaaaatttgtgtaattggcggatatacgggaagtggaaaaacgcatattttgaattgcctgcaaaaaaataatgaacaaattatcgatttagaaggacttgcaaatcacaaaggatcggcatttggtagaatagggaacgagaaacaacccaccatcgaacaattcgaaaataatttattttggagttggaaaaagctagattattcaaaaactatttgggtagaagatgaaagtcatcggattggaaatgtaagtataccaatgactttttatgaaaatataagaagtaaaacaattgtatttattgaaataccacaaaaagaacggattaaacatctggttgtagaatatgcagattgtccgaaaatttcgctgatcgaatccattgaacgtattacaaaacgacttggagggaaaaacacgcaaattgcaattcaaagtattaaggataataattttgaagaaacggcaaaactggcacttacttattacgataaatattatttaaggggtttagaaaacagacctttacagaacaacatttatacattgaaattagaatcagtaaattcggaacagaattcaaaaaaaataaaagactattacgatgcaatttga

SEQ ID NO: 15084 - protein, 274 aa, Unknown
  Obtained from environmental sample
  misc_feature (1)..(274): Xaa is any amino acid
MLPNFSDFIIESKKIASGADVIVHCWRVGMRSESFAKHLAENGFNRVYVIEGGYKAFRNYALKSFTQEAKICVIGGYTGSGKTHILNCLQKNNEQIIDLEGLANHKGSAFGRIGNEKQPTIEQFENNLFWSWKKLDYSKTIWVEDESHRIGNVSIPMTFYENIRSKTIVFIEIPQKERIKHLVVEYADCPKISLIESIERITKRLGGKNTQIAIQSIKDNNFEETAKLALTYYDKYYLRGLENRPLQNNIYTLKLESVNSEQNSKKIKDYYDAI

SEQ ID NO: 15085 - DNA, 399 bp, Unknown
  Obtained from environmental sample
  misc_feature (1)..(399): n is a, c, g, or t
atggatgtagagacactaatcatactcataataggtttaatgctgctgctaggtctgctagctttgatatttgtagttttcagatacagagctgcaaaagcagaaaatgtgactaaagtagagatactaacaatgatggagatgttagagatagttagagataataactctggtgttgctgaacttaaaaaagtcgtatcaaatactatagagaattttctagatatatcagatgaagagtatgagaattacgatcagctgatggttagtttatgttcacataggatggtaaataaagatttagtactggagttagacagagcactgagtaaaaataatcctgcctttaaagataagttacaagccacactaaaaaaagcactaaataaaagaggttaa

SEQ ID NO: 15086 - protein, 132 aa, Unknown
  Obtained from environmental sample
  misc_feature (1)..(132): Xaa is any amino acid
MDVETLIILIIGLMLLLGLLALIFVVFRYRAAKAENVTKVEILTMMEMLEIVRDNNSGVAELKKVVSNTIENFLDISDEEYENYDQLMVSLCSHRMVNKDLVLELDRALSKNNPAFKDKLQATLKKALNKRG

SEQ ID NO: 15087 - DNA, 732 bp, Unknown
  Obtained from environmental sample
  misc_feature (1)..(732): n is a, c, g, or t
gtggtcagcttgactctcggttttttagataatgccgttatagagagaaacgtagttatacaaaatctttatgatatggaaacttcaaaagagagactcatctctagctttagcactctaagcgatttaaattatgaaactgtaaagattccccatctagaacttttaaacagagatgagtttttgaagtacaacatcgttttgaaaatggctgactcacaaatagagagagacaaatatagtaaaaatatgactataacgcagtatctcccagctgtgagcttaacagcaggctatacgtggacagaagcttcaaacgcctttttcgctggtggagaaagaaagttttatgattatggttttagggcttccatgcctatcaatataaatacttttaaagacatagagtctgccaaaattgactacttaaaatcagaagtgacaaaacaagatagtaaaattcaactagatgcgctctttactcaagtaatgcaaaacttagataatttagataagaaaaaacttctcagcgtggaaaataaagagctttactcaaaacttctccaagatacaaaagacctttataacgcagggtataaaacagagtacgacgtaagtcttttagaaaactccgttaacatttctgaacttgactctaagatatacgagatagataaacaactagagcttttaaatctttatgagatgtacgtgaacgactctttaaagtag

SEQ ID NO: 15088 - protein, 243 aa, Unknown
  Obtained from environmental sample
  misc_feature (1)..(243): Xaa is any amino acid
MVSLTLGFLDNAVIERNVVIQNLYDMETSKERLISSFSTLSDLNYETVKIPHLELLNRDEFLKYNIVLKMADSQIERDKYSKNMTITQYLPAVSLTAGYTWTEASNAFFAGGERKFYDYGFRASMPININTFKDIESAKIDYLKSEVTKQDSKIQLDALFTQVMQNLDNLDKKKLLSVENKELYSKLLQDTKDLYNAGYKTEYDVSLLENSVNISELDSKIYEIDKQLELLNLYEMYVNDSLK

SEQ ID NO: 15089 - DNA, 876 bp, Unknown
  Obtained from environmental sample
  misc_feature (1)..(876): n is a, c, g, or t
ttgcttaacaactattttttatctccttttaaatcccaggaatattacaaactatttcacgatacagaattggaattaaacgaagtatattcatttgtttcaaatatttttaacgacagaagccaactactcaagcaatccgccaatttagcacaacacctatacaataaaagcacacatccaaatatcaaaggtggggaattttatgttgtatattttaacgactgcattttggaaggagaaaaagtagatacaataggaattttcaaatctgagaacaaagacactttcttaaaagtgttttcacaaaacaaggattttgcaattgagagtcaagaagggattaatataaacaagctcgacaaaggttgcctgatatttaataaagaatcagaaacaggttatgttgtttcggtaatagacaaaactaataaatcgattgacgctcagtattggatagatgactttttgcatgtaaaacaacgaaacgatgaattttacaatacaaaaaatacattatcgatgtataagaattttgttgtaaagcaattgccacaagagtttgaggtatcaaaagccgaccaagctgattaccttaacagaacaatggattttttcaaagaaaaagaacatttcgagttaaatgaatttaaaaaagaagttctacaacaagaagatgtaatcaatagctttcagaacttcaaagattcatatcagcaagaaagagaaatgaagatatcagacagttttgaaatttctaggactgctgttcaaaaacaaatcccactttataaaagtgtatttaaacttgataagaaatttccctatatatgttcatgggcgatcgcaatagaaatagaaacaggggaaaaataa

SEQ ID NO: 15090 - protein, 291 aa, Unknown
  Obtained from environmental sample
  misc_feature (1)..(291): Xaa is any amino acid
MLNNYFLSPFKSQEYYKLFHDTELELNEVYSFVSNIFNDRSQLLKQSANLAQHLYNKSTHPNIKGGEFYVVYFNDCILEGEKVDTIGIFKSENKDTFLKVFSQNKDFAIESQEGININKLDKGCLIFNKESETGYVVSVIDKTNKSIDAQYWIDDFLHVKQRNDEFYNTKNTLSMYKNFVVKQLPQEFEVSKADQADYLNRTMDFFKEKEHFELNEFKKEVLQQEDVINSFQNFKDSYQQEREMKISDSFEISRTAVQKQIPLYKSVFKLDKKFPYICSWAIAIEIETGEK

SEQ ID NO: 15091 - DNA, 774 bp, Unknown
  Obtained from environmental sample
  misc_feature (1)..(774): n is a, c, g, or t
ttgatgggattgatggctcagatcagctattgtaccactttgctgaatgcattgaaatctgggggatacaatctggaaaatagaaaattcaatttaaaaaagcaacattttcaatatccggtttatatgcaggaagaggatttcaatattatgctggtgttagattccagccactctaccaactgggttatacctcatatcgagaagttcgtaaaattgattacccaaaacgtaagtcaggctcacgataaacttggactcataactttcaacaacgatacagcacaaatttatcattatcccaccttgaatgttaaacaggttattggaacaattaatagtttggaagtttccggtctaacacctttggcggaaggccttaacctggccaagcaaactctgcaaagggaacagtacaatctacctggaactaagaatattatccttctaatttcggattgtttccctgaacctgtgaaaggaggatttgaggatctgctggatgaaccatgttatgtggaagcttttaaagctgcagaaacgattgccgattctaagataagtctgatgattattaatcccgctgttgaagaggggaagtataaaaactggggccagaaattagctgagaaaattgaagcagaaaccgatgtgaagtatctggaattgcatcctaaattgatgtttaaagtatttggtaaggcggaatacctgctggatgaagatgaacttcatcgcttttttagcagtataaatgaactaaggatggagtag

SEQ ID NO: 15092 - protein, 257 aa, Unknown
  Obtained from environmental sample
  DOMAIN (49)...(212): von Willebrand factor type A domain
  misc_feature (1)..(257): Xaa is any amino acid
MMGLMAQISYCTTLLNALKSGGYNLENRKFNLKKQHFQYPVYMQEEDFNIMLVLDSSHSTNWVIPHIEKFVKLITQNVSQAHDKLGLITFNNDTAQIYHYPTLNVKQVIGTINSLEVSGLTPLAEGLNLAKQTLQREQYNLPGTKNIILLISDCFPEPVKGGFEDLLDEPCYVEAFKAAETIADSKISLMIINPAVEEGKYKNWGQKLAEKIEAETDVKYLELHPKLMFKVFGKAEYLLDEDELHRFFSSINELRME

SEQ ID NO: 15093 - DNA, 834 bp, Unknown
  Obtained from environmental sample
  misc_feature (1)..(834): n is a, c, g, or t
ttgaaaactctgcaaaatataggggtaacatcgaaagatttaatggttgaagcttctctctctgtggatcctattaaattactaaaaagtagagtgaaaaaagatcaaaattgtacgatgcaagattttttaacagatttctcatttacgatagatattccttcacctaaaataccgatcattagttctcaatttcaatttagcgatactgttttgtcattaaactccactctttatacagatgaaccatggaagagtttacccaatgaattaaaaacctcttatgatagagatgttctaaatctatttttatcaggtggtgtgagcataaatataggcgcacataaaagagagatgaacgcattaatagactttgaacacagtaaaaatagtaatggaattacattaattacactttcaaaatggagctggaacgatccattttcaatacctaaagttagtattgatgaacttggttataaagtaaatataaataagcaaaataaagattttaatataacaatagatagtttcggtgagatgacttttttaggtaagagatttgatgccatgattgattttacaattaattctgaaaaaagagatggtgaaaagttagaatttaactattttgaaatagaaacagagttgcatttttctgatatttttggaaattatgtagataagttgaaactgaaagatattgataacaaactttttttacataaaattcttcttcagcctacgggtttggagttagaggttgacttaactcttcgaaatgaaactaaaaaagtatcggcttatcttttgaacaagatactcggccattaa

SEQ ID NO: 15094 - protein, 277 aa, Unknown
  Obtained from environmental sample
  misc_feature (1)..(277): Xaa is any amino acid
MKTLQNIGVTSKDLMVEASLSVDPIKLLKSRVKKDQNCTMQDFLTDFSFTIDIPSPKIPIISSQFQFSDTVLSLNSTLYTDEPWKSLPNELKTSYDRDVLNLFLSGGVSINIGAHKREMNALIDFEHSKNSNGITLITLSKWSWNDPFSIPKVSIDELGYKVNINKQNKDFNITIDSFGEMTFLGKRFDAMIDFTINSEKRDGEKLEFNYFEIETELHFSDIFGNYVDKLKLKDIDNKLFLHKILLQPTGLELEVDLTLRNETKKVSAYLLNKILGH

SEQ ID NO: 15095 - DNA, 705 bp, Unknown
  Obtained from environmental sample
  misc_feature (1)..(705): n is a, c, g, or t
gtgataggctttataaaaaagatattaataatatttattacattaattattcttatttcatgtaaagaggaatttaaatatccaaaagctcgtaattatgcatatactgataatttttctaaagggcctatttctttagagatgaaagtagattacacagaaattagtattgccggaaatataactgtattattggaaggaaaggcaagtgacggatggaagccctcatttactgatcttcttgaacaactggataagtttactgtagtgagtgtttctgatacgccttcacgtttagataatgatggttccattggggtaagcagaactgttatattgaaaccatttttatctggagaatatgaaattccgtcattgtctcttaattatattgatgagaatgaaagcaagggtattttattaagtacacctgtatcaattaatgttaccagtctgctacctgaaaatactgaaaatattcagttaaaagaaatacaggaacctaatacttttaattattggaaaatgataataattgcctccatagttttaacccttcttggaagaatttttcttgtaaatttactaacccgtaaacgtaaaaaaagagactcccgggaataccccccgctgaaagaggcttttactaaactgaccccttctttcttgaaaaaaaaacttctctctgggagagaaaaaatttaa

SEQ ID NO: 15096 - protein, 234 aa, Unknown
  Obtained from environmental sample
  misc_feature (1)..(234): Xaa is any amino acid
MIGFIKKILIIFITLIILISCKEEFKYPKARNYAYTDNFSKGPISLEMKVDYTEISIAGNITVLLEGKASDGWKPSFTDLLEQLDKFTVVSVSDTPSRLDNDGSIGVSRTVILKPFLSGEYEIPSLSLNYIDENESKGILLSTPVSINVTSLLPENTENIQLKEIQEPNTFNYWKMIIIASIVLTLLGRIFLVNLLTRKRKKRDSREYPPLKEAFTKLTPSFLKKKLLSGREKI

SEQ ID NO: 15097 - DNA, 537 bp, Unknown
  Obtained from environmental sample
  misc_feature (1)..(537): n is a, c, g, or t
atgggacttgcaacagtccagggaattgttgctcaacatgggggaattattaaagtcaacagcttccccggtcaggggactgtatttgatctctattttccaactacagatgaagctgtcgcagaaccagaacctgagaacaaagagttgccaaagggtacagaacatattctttttgtcgatgatgatgaaatgctagccagccttggtaaggagctactgactgaaatgggttatcaggtaactaccatgacaaaaagtacagaagcactaaagctatttacagctaatgctgaacgtttcgatcttattatcactgatcagactatgcctgaactgcctggtaaagaactgattctggaactaaaaaaagtaagaccagatatccccacaattctctgtactggattcagtagcaagatagacgaggaaaaagcagttgagctgggtatcaatgcttttttgatgaaaccattgaatctcccaaagctatctcagacagtgaggcgggtgttggatgaaaataagtatgggtaa

SEQ ID NO: 15098 - protein, 178 aa, Unknown
  Obtained from environmental sample
  DOMAIN (55)...(176): Response regulator receiver domain
  misc_feature (1)..(178): Xaa is any amino acid
MGLATVQGIVAQHGGIIKVNSFPGQGTVFDLYFPTTDEAVAEPEPENKELPKGTEHILFVDDDEMLASLGKELLTEMGYQVTTMTKSTEALKLFTANAERFDLIITDQTMPELPGKELILELKKVRPDIPTILCTGFSSKIDEEKAVELGINAFLMKPLNLPKLSQTVRRVLDENKYG

SEQ ID NO: 15099 - DNA, 1005 bp, Unknown
  Obtained from environmental sample
  misc_feature (1)..(1005): n is a, c, g, or t
atgatggctcagctgaagtttaaaagacaaaaaaagagttttttaaacgccctattaaaaagtatgaagtttagaaaaagaatgttaaaaaaatatttaaagcgtattgataataaattcgaaaaaaataaagtattagttgatgttaacagaattaataatttgcagaaaataattgttgaggacagagaatattatgagtttataaatcataaattcaaaaaaatgttgcaagggaaaatatgtattattggtcacagtgcgacttccagtatagacttgggaactatacctttgcaaaaagattacccaatgtgcggcttgcacgggaatgttataaatacatttttgacaggtcagtttattaaacttctaccagttaatcttgaattactttttttgattatttttggattgatgacaggcttttctgttccaaaatttaaaatagcaaatggtgcggctttttgtctttttcaaattgttttttacaccatatgtgcctattatctttttttgaaaagttttatccttataaatctgtttacacctttgtttgtaatagtttttacctatctgattatttctgttctaagatttatttatgaggaaaaacaaaagaaatttataaaatcggcatttggacagtatttagcgcctgtaatagttgaacagatttcaagggatccttcaaaactcaaacttggaggtgaacgtaaaatttgcacttcctatttttctgatgttgcaggattttcaactatttcagaaaatcttactccagaagatcttgtggccctgttgaatgaatatcttactgcaatgaccgatataattatagcaaataatggaactatagataagtatgagggggatgcaattattgcactttttggaccgccagttgattttgaaaacatgctgccagagcttgtttttgcaagtttaaaaatgcaaaaaatactggttgaaatgcgtggcccaatggccccccccagggcaaaa

SEQ ID NO: 15100 - protein, 335 aa, Unknown
  Obtained from environmental sample
  misc_feature (1)..(335): Xaa is any amino acid
MMAQLKFKRQKKSFLNALLKSMKFRKRMLKKYLKRIDNKFEKNKVLVDVNRINNLQKIIVEDREYYEFINHKFKKMLQGKICIIGHSATSSIDLGTIPLQKDYPMCGLHGNVINTFLTGQFIKLLPVNLELLFLIIFGLMTGFSVPKFKIANGAAFCLFQIVFYTICAYYLFLKSFILINLFTPLFVIVFTYLIISVLRFIYEEKQKKFIKSAFGQYLAPVIVEQISRDPSKLKLGGERKICTSYFSDVAGFSTISENLTPEDLVALLNEYLTAMTDIIIANNGTIDKYEGDAIIALFGPPVDFENMLPELVFASLKMQKILVEMRGPMAPPRAK

SEQ ID NO: 15101 - DNA, 585 bp, Unknown
  Obtained from environmental sample
  misc_feature (1)..(585): n is a, c, g, or t
atgtttagttttagtatgggcaacagtgacattatagcacaaaaaaaagcattacgacaagaaatgttggttaaaagggtaaagaccaataaggagcttaaaaataagtacgaccaatggatttgtgagcaattagaaaatattatccttgataatggctaccaaaaaatacatgcttatttacccatgggaaaagaaatagatatttctcctttactacaatcgctgttagaaaaaaacattacagtggttgtccccaaaacactaccaaaaagaaaattggagaatttagtcttaaccgacttaaacaaagtagaaaaaggtgttttcggtacaacacatcctgcaagtggaatagtttataatgatgcttttgatttaattattgtgccagggttggctttcgataaaaacaattaccgattaggttatggaggtggttattatgataattttattgttaaccaccaagaagcaaagaagataggcattttttattcttttcaggaagtagaaaaagtaccaacagaagcacatgatatgcagttggatgagttgttggtgaataaggagatggagtgttaa

SEQ ID NO: 15102 - protein, 194 aa, Unknown
  Obtained from environmental sample
  DOMAIN (15)...(189): 5-formyltetrahydrofolate cyclo-ligase family
  misc_feature (1)..(194): Xaa is any amino acid
MFSFSMGNSDIIAQKKALRQEMLVKRVKTNKELKNKYDQWICEQLENIILDNGYQKIHAYLPMGKEIDISPLLQSLLEKNITVVVPKTLPKRKLENLVLTDLNKVEKGVFGTTHPASGIVYNDAFDLIIVPGLAFDKNNYRLGYGGGYYDNFIVNHQEAKKIGIFYSFQEVEKVPTEAHDMQLDELLVNKEMEC

SEQ ID NO: 15103 - DNA, 330 bp, Unknown
  Obtained from environmental sample
  misc_feature (1)..(330): n is a, c, g, or t
atgattaaaattcttttaccactatttcttatacttacatctctagatgcaagtataattcttagagatatagattctaaacctcccagtcgtgcaaaaaactttatgatatggcaatatttaaagcaaaatattagcccagaacaagctgacaaagcatattcacaaattagcggtaaaagcaacaaactatttaggctttatgccaaaaaaacaaataatccggagataaagagaaaaatctcttgcatgaaagaaaaaaatttattatccataaaagatgacacctgcctagagcttgctttttctccatacaaaacactttactaa

SEQ ID NO: 15104 - protein, 109 aa, Unknown
  Obtained from environmental sample
  misc_feature (1)..(109): Xaa is any amino acid
MIKILLPLFLILTSLDASIILRDIDSKPPSRAKNFMIWQYLKQNISPEQADKAYSQISGKSNKLFRLYAKKTNNPEIKRKISCMKEKNLLSIKDDTCLELAFSPYKTLY

SEQ ID NO: 15105 - DNA, 762 bp, Unknown
  Obtained from environmental sample
  misc_feature (1)..(762): n is a, c, g, or t
atgaacacagagagtttgcctaccatgaatagaaattttttaaatttcgcactctctcatctgctaaaagagaagagtgaacacctctttagtgcttttatatttacgtttattgtttttatactctcctcagtgttgtttatctccgcttctatcaaacatgatctctttactcttttaaagtatcagcctcaaatcgtagttaaaaatcaaaaagctggcatgcgtgcgccaatcaccgatgaagagttagatatgattttacagatatctggtgtgaaaaatgttgtaggagaggtagagggaaaatatgtttttgatcaggcgaacagaacctttgagatcataggaagtgaaaaacaagagtcatctcacatgagagtaggagagggtgttaaaaagattttaaatcagttctactacaaagattacttcaacttttttactccagatgcaactgccgtaaaaatagagatgaaagagatcgaaggcgaaaatttaaatctcataaacagtttaaccatgaggctaaatatctatgatgcaaaagaggttttaggttttgatgaagatcagtacagttcactaagtgtttatgtgccaaacgatagtgaaatagactacatagctctcaagatcaaagagttatatccaaatacaaaagtgctcacaaaagaggagattcgtagttcatatgagcatcttttttactacaaagngtggcatcttcatgagctctctcgagcaatcaatgcccgataa

SEQ ID NO: 15106 - protein, 253 aa, Unknown
  Obtained from environmental sample
  misc_feature (1)..(253): Xaa is any amino acid
MNTESLPTMNRNFLNFALSHLLKEKSEHLFSAFIFTFIVFILSSVLFISASIKHDLFTLLKYQPQIVVKNQKAGMRAPITDEELDMILQISGVKNVVGEVEGKYVFDQANRTFEIIGSEKQESSHMRVGEGVKKILNQFYYKDYFNFFTPDATAVKIEMKEIEGENLNLINSLTMRLNIYDAKEVLGFDEDQYSSLSVYVPNDSEIDYIALKIKELYPNTKVLTKEEIRSSYEHLFYYKXWHLHELSRAINAR

SEQ ID NO: 15107 - DNA, 612 bp, Unknown
  Obtained from environmental sample
  misc_feature (1)..(612): n is a, c, g, or t
atgattaacactaaaaaagagaaaaaagtttatatgatgggaaagatgctttttgaaaagaagtgtgatggctcaaaagttgagttagataactttaaaagtatttcatcactaaaagctcatctgcgtgatagtggagtttgtgaagaaaaactgcaagataaacagcttcaagccatgagtgtctatctttttgatattgtaaaaaacaaaaatagtattacaaaaagtgaacatataaaagttccacatggcgctaagtgtccagtgtgtggaatgtttgtagaaaagtacccgaaatgggcggcttatgcaagagtaggaaacgaagagaactattttgatggtgtgaaagatatgattaaatatgtcttcataaaagatgtgatttttgatgagtttaaagttaccggttattacactacaaatgcgatagatgcaaaaaatgcttactttgtttacggctctaacgtgtatggacctatgggacatgagctgattccttttgctagtttggaaaaagccaaagagttttcaaaaaaccatggtggaaaaaagattttaaaattccgagatataaccttagatattgtaaaatctctggatgaataa

SEQ ID NO: 15108 - protein, 203 aa, Unknown
  Obtained from environmental sample
  DOMAIN (64)...(200): NosL
  misc_feature (1)..(203): Xaa is any amino acid
MINTKKEKKVYMMGKMLFEKKCDGSKVELDNFKSISSLKAHLRDSGVCEEKLQDKQLQAMSVYLFDIVKNKNSITKSEHIKVPHGAKCPVCGMFVEKYPKWAAYARVGNEENYFDGVKDMIKYVFIKDVIFDEFKVTGYYTTNAIDAKNAYFVYGSNVYGPMGHELIPFASLEKAKEFSKNHGGKKILKFRDITLDIVKSLDE

SEQ ID NO: 15109 - DNA, 459 bp, Unknown
  Obtained from environmental sample
  misc_feature (1)..(459): n is a, c, g, or t
gtgttatgtatattatatttatattttgaaggaatgttagagatgaatattttattactaagtaatgactatactataaaaagttatttagaaattggacaaaacaagttgaactactcttttgtaaattctaatcaaccgatggtagactatgaaaaaaacaattttgatattgtaattgtcgatatttcaactcataaaaaaaaccttcttcaaatactagaactaacccctaaacaaaaaataatagttatctctgacaacttagattgtattaacgaaattggatgtgatatttgtccagtaaaatataataaacatagacttttaaaacctattcaaattaatactcttcttgatttaattattgattttaatagccatgagtgtaaatatttacaaacagactgttttaaaaatattaaacccaatcctttcagatatcacaaagcgttttaa

SEQ ID NO: 15110 - protein, 152 aa, Unknown
  Obtained from environmental sample
  misc_feature (1)..(152): Xaa is any amino acid
MLCILYLYFEGMLEMNILLLSNDYTIKSYLEIGQNKLNYSFVNSNQPMVDYEKNNFDIVIVDISTHKKNLLQILELTPKQKIIVISDNLDCINEIGCDICPVKYNKHRLLKPIQINTLLDLIIDFNSHECKYLQTDCFKNIKPNPFRYHKAF

SEQ ID NO: 15111 - DNA, 429 bp, Unknown
  Obtained from environmental sample
  misc_feature (1)..(429): n is a, c, g, or t
atgataaaaagattgttcagtattgttttatctttaggcttagtttttaatatgtcattagctcaggagttacaaccacagcttaatggggcggttacaaactataaagaagatatagtagacagagataattacataaaagtatcactaattgatgtggtacttgaaactgtttctcaaagcaataatgtaaaagctgcaagagaaaaagtgatacagtctaatataaaactagatgatgcatatgctggatatttgccatcaattgatggaacctataaaagtgcaagaactgagacaaaaccaggagatgatggaaaaactaacaaatattttggagatgaaagttataaactatcagtaagacagaatatctatgcaggtggggacacttatactgagattaaaagtttagaaaaaaaaatatga

SEQ ID NO: 15112 - protein, 142 aa, Unknown
  Obtained from environmental sample
  SIGNAL (1)...(17)
  misc_feature (1)..(142): Xaa is any amino acid
MIKRLFSIVLSLGLVFNMSLAQELQPQLNGAVTNYKEDIVDRDNYIKVSLIDVVLETVSQSNNVKAAREKVIQSNIKLDDAYAGYLPSIDGTYKSARTETKPGDDGKTNKYFGDESYKLSVRQNIYAGGDTYTEIKSLEKKI

SEQ ID NO: 15113 - DNA, 585 bp, Unknown
  Obtained from environmental sample
  misc_feature (1)..(585): n is a, c, g, or t
atgaatatcctattagtatatcctctttatccaaatactttttggagctttaaacatgctttaaaattcatctcaaaaaaagcagtaaatccacctttaggcttactaactatttctgctatgttgcccgaaaaatggaataaaaaactcgttgaccttaatatagaggcgattaaaaataaagatattttatgggcagattatatattcattagtgctatgaatatacaagctgaatcggcaagaaaagtgattgagatgtgtaaatcagtcaacaaaaaaattgtttgtggtggcccactttttaccgaagaacccgataatttcgatatggtagatcacttaatcttaaatgaagcagaattgacattacctaaatttttaaatgacttaaaaaacggaaatcccaaacatatttataaatcagaaggatttgccaatttagcagaaacaccattgcctaactaccatttagtaaaaacttcaaaatacaatacaatgaattttgcaataaccagagggtgtccgttttattgtgagttttgcgatatcacagcattgttttggacaaaaagtaagaattaa

SEQ ID NO: 15114 - protein, 194 aa, Unknown
  Obtained from environmental sample
  DOMAIN (18)...(130): B12 binding domain
  misc_feature (1)..(194): Xaa is any amino acid
MNILLVYPLYPNTFWSFKHALKFISKKAVNPPLGLLTISAMLPEKWNKKLVDLNIEAIKNKDILWADYIFISAMNIQAESARKVIEMCKSVNKKIVCGGPLFTEEPDNFDMVDHLILNEAELTLPKFLNDLKNGNPKHIYKSEGFANLAETPLPNYHLVKTSKYNTMNFAITRGCPFYCEFCDITALFWTKSKN

SEQ ID NO: 15115 - DNA, 441 bp, Unknown
  Obtained from environmental sample
  misc_feature (1)..(441): n is a, c, g, or t
atggttggattgttaaatgccccaaagaaaacccggctttacaaaagactaaaacaagaaggacgtattacaagtgaaaccaccggtgacaatactgatttctctctgaactttgtccctaaaatggacaaacaaatattattggacggttataaaaaagtaattaatggaatttatggaggcaaagaatattacatgcgggttttggattttataaagagatttactccaaataagacaaataagttcgaactttcattgaatcatataattgctttttttcgctcatttattagtttaggaattgttgactcacacagaaaacattattgggatttattcttttggactttatttaaccgccccaaactattaccgctagcaatcacatattcagtatatggatttcactttaggaaagtatttaataaggttttgtaa

SEQ ID NO: 15116 - protein, 146 aa, Unknown
  Obtained from environmental sample
  misc_feature (1)..(146): Xaa is any amino acid
MVGLLNAPKKTRLYKRLKQEGRITSETTGDNTDFSLNFVPKMDKQILLDGYKKVINGIYGGKEYYMRVLDFIKRFTPNKTNKFELSLNHIIAFFRSFISLGIVDSHRKHYWDLFFWTLFNRPKLLPLAITYSVYGFHFRKVFNKVL

SEQ ID NO: 15117 - DNA, 759 bp, Unknown
  Obtained from environmental sample
  misc_feature (1)..(759): n is a, c, g, or t
atgctcaactggcttacaagtacaaaatatgtaagtaaaactatgaacaatatggagactctatttggtgttaattttgcagatggccgaatcaaaggttatggatataaaaggcttggtagtaacacagatagaaaaaagttttttgcaagatatgtaagaggtactacagagtatggaaaaaataattttattgataatggtaataatacactaactgataaaagcacaaatcttatgtggactaagtttgacagtaaaaaaggtatgaattggaaagatgcattaaagtatgccaaaaatttaagaattgctggacatgatgattggagattaccaagtgcgaaagaactacaatatatagttgattatactaaatcaccagatgctacttcttcgcctgcaattgatagcaagtttagattaactactattacaaatgaagctggaaataaagattacgcatactattggacatctactacacatcaagatggtccaaaaagatacacaaatgctgcttatatatcatttggtagagcaattggtaaaatgagaggaaaaattatggatgtccatggtgctggtgcacaaagaagcgatgctaaagttggaagtgaaaggtttcatggtccacaaggtgatgcaaatcgttcaaacaattatgtactatgtataaggggtggaaatattgaaaatgaatctatctcanatgacataaacaagtacccaaacaaactcatcataaaagagaaataa

SEQ ID NO: 15118 - protein, 252 aa, Unknown
  Obtained from environmental sample
  DOMAIN (72)...(123): Protein of unknown function (DUF1566)
  misc_feature (1)..(252): Xaa is any amino acid
MLNWLTSTKYVSKTMNNMETLFGVNFADGRIKGYGYKRLGSNTDRKKFFARYVRGTTEYGKNNFIDNGNNTLTDKSTNLMWTKFDSKKGMNWKDALKYAKNLRIAGHDDWRLPSAKELQYIVDYTKSPDATSSPAIDSKFRLTTITNEAGNKDYAYYWTSTTHQDGPKRYTNAAYISFGRAIGKMRGKIMDVHGAGAQRSDAKVGSERFHGPQGDANRSNNYVLCIRGGNIENESISXDINKYPNKLIIKEK

SEQ ID NO: 15119 - DNA, 339 bp, Unknown
  Obtained from environmental sample
  misc_feature (1)..(339): n is a, c, g, or t
ttgcacatacctttagtaccgataaacaaaccggctatctctggtattttaaagttgaacacttctttncatttcaaaaaggattttgatgcacaattaactactatttatttagctccagatattattccacaaggtaaaatagcttcaagattttcattgaacattggattaaaaaaatcaattcaaaaaggtaagggagaaattttctttaatgcttctgatctnttaaacacaatggttattaagaaaacaattgacggaaataacttttcttatacaagctctaattactatgaaacgcaagtttttagagttgggtatagttataagttttaa

SEQ ID NO: 15120 - protein, 112 aa, Unknown
  Obtained from environmental sample
  misc_feature (1)..(112): Xaa is any amino acid
MHIPLVPINKPAISGILKLNTSXHFKKDFDAQLTTIYLAPDIIPQGKIASRFSLNIGLKKSIQKGKGEIFFNASDLLNTMVIKKTIDGNNFSYTSSNYYETQVFRVGYSYKF

SEQ ID NO: 15121 - DNA, 822 bp, Unknown
  Obtained from environmental sample
  misc_feature (1)..(822): n is a, c, g, or t
ttggtagatcaagtatcaaaggaatcaatgccttttgtaaatattgtactaaaaaatgctcaggattcttcatttattggcggaactatttcaaatgaagtcggcatctttacatttgaaaagataaaacctgccaattattatatagcaatatcattcataggttacaatacaattgaaaaatctatctatgtaggctctattgcggagtttttaaatttaggaacaatagagttagctgaaagtgtacaaagtttaggagaagtaacaattactgcaaagcaatctgaaataaatgtcaaaatggataaaaaaacttatgctgtagaagataatattagtcaaagtggtggatctgttttacaagcaatggaaaatttaccgggtgtaaccgttcaagataataaagtacaactaagaggaagtgataaaatcattattttgatagatggtaaacagtctgcattaacaggttatggtagtcaatctggattagacaatatacccgcttcttctattgaacgtatagagattataaataatccatcttctaaatatgatgcaaatggaaatgcagggattataaatgtgattcttaaaaaggaaagtaaagatggatttaatggaaaggtaggactttcaactggagctggtgcattatggattaaacaaaataatttaccaatcgtaagatctcaatatcagttcacaccaaagataaatccttctatatcttttgaattatcgaaaaaacaaagtaaatgccttttttcaattcgacaacctctacacagagactttaaattaaaaatgaatttttaa

SEQ ID NO: 15122 - protein, 273 aa, Unknown
  Obtained from environmental sample
  misc_feature (1)..(273): Xaa is any amino acid
MVDQVSKESMPFVNIVLKNAQDSSFIGGTISNEVGIFTFEKIKPANYYIAISFIGYNTIEKSIYVGSIAEFLNLGTIELAESVQSLGEVTITAKQSEINVKMDKKTYAVEDNISQSGGSVLQAMENLPGVTVQDNKVQLRGSDKIIILIDGKQSALTGYGSQSGLDNIPASSIERIEIINNPSSKYDANGNAGIINVILKKESKDGFNGKVGLSTGAGALWIKQNNLPIVRSQYQFTPKINPSISFELSKKQSKCLFSIRQPLHRDFKLKMNF

SEQ ID NO: 15123 - DNA, 414 bp, Unknown
  Obtained from environmental sample
  misc_feature (1)..(414): n is a, c, g, or t
atgcaaaacagaggatttacagatgctattttagtaaatcgtccgtttgagaagcatgatactcagagtttagacttcacaattactatgggaactcatcaagttagcgggatggttgagagtgatggggagtactttatgtgtaaatataagacattcccgaatgaagccattgaagttgttttacctcctaaaagcgaaattgagttagttgataatgatataggtaaaatagagctaaaagatggaatatactatttaactttttacaaattagaagcaaaaaatggtaaagtttgggattctgttcatagtggtaatttaaatcctattaaattgccaattaagttgccggcttatacatttttacgtatagttgcaactccggaaatgactgttttaccaaaaaattag

SEQ ID NO: 15124 - protein, 137 aa, Unknown
  Obtained from environmental sample
  misc_feature (1)..(137): Xaa is any amino acid
MQNRGFTDAILVNRPFEKHDTQSLDFTITMGTHQVSGMVESDGEYFMCKYKTFPNEAIEVVLPPKSEIELVDNDIGKIELKDGIYYLTFYKLEAKNGKVWDSVHSGNLNPIKLPIKLPAYTFLRIVATPEMTVLPKN

SEQ ID NO: 15125 - DNA, 660 bp, Unknown
  Obtained from environmental sample
  misc_feature (1)..(660): n is a, c, g, or t
gtgagtagttataaagagtattttaaaagacttaatgatggatctttaactatgcttgatccaactccaaagtggggagtgttgaaaagtagcactactatagccataggaaacagtgttagtgatgctaatgttattcatgacattaaagagcacacaatggagtcaattttaaatgctgaatctattgaaaagtatgttgcacttgacgaaaaagatatatttgatatggagtattgggagttagaacaagcaaaactgaaaaaatcaagttcaaaaccggagtttgaaggaaaaattgtatttgttaccggtggagccagcagtatagggaaagattgtgtagaaaactttgtatctaaaggtgcagcagttgtagcacttgatatagattcaaatattcagagtatgtataanaaggctcanatattaggaattaaatgtgatcttacaaatgaaattgaaattgatgaagctattaaaaaagcagtgtttacttttggtggtgtagatgttcttataaatagtactataaactccttaagtgctgagagtgaactgttttttgaggaaatagctacgtacctaaaatttaggttttcccctgccgttgtaaatatttttgaaaatgagaatgaaaacctagattatggtttttga

SEQ ID NO: 15126 - protein, 219 aa, Unknown
  Obtained from environmental sample
  misc_feature (1)..(219): Xaa is any amino acid
MSSYKEYFKRLNDGSLTMLDPTPKWGVLKSSTTIAIGNSVSDANVIHDIKEHTMESILNAESIEKYVALDEKDIFDMEYWELEQAKLKKSSSKPEFEGKIVFVTGGASSIGKDCVENFVSKGAAVVALDIDSNIQSMYXKAXILGIKCDLTNEIEIDEAIKKAVFTFGGVDVLINSTINSLSAESELFFEEIATYLKFRFSPAVVNIFENENENLDYGF

SEQ ID NO: 15127 - DNA, 387 bp, Unknown
  Obtained from environmental sample
  misc_feature (1)..(387): n is a, c, g, or t
gtggcatactataggtatataaaaggttgtggggatgtctataccaactatagtattgaacagggaacagattgtataccctgtagtgagttagtctattttaaaaagggagaccaagaatggggaaatttcttattgattccttcctctattgataccaatgaggataagctagaaattaagatataccccaatcctacttctggtaaaataactattgaagctgaaaacattgagattgttgaagttataaatgaatttggactaacaataattaagtctacaaatagtaaagaaattgatttatctatgcattcaaaaggggtctattttattagaattactactgacgataaaataataaatagaaatgttattaaaatgtaa

SEQ ID NO: 15128 - protein, 128 aa, Unknown
  Obtained from environmental sample
  misc_feature (1)..(128): Xaa is any amino acid
MAYYRYIKGCGDVYTNYSIEQGTDCIPCSELVYFKKGDQEWGNFLLIPSSIDTNEDKLEIKIYPNPTSGKITIEAENIEIVEVINEFGLTIIKSTNSKEIDLSMHSKGVYFIRITTDDKIINRNVIKM

SEQ ID NO: 15129 - DNA, 486 bp, Unknown
  Obtained from environmental sample
  misc_feature (1)..(486): n is a, c, g, or t
ttgaattattacatttgttttgtgataatatcattttacataattggttttatacttgtattcgcatatgttgtgcttatttgtgtatttattgtaggtctccaacaaaaaactaaaaaatcaagtaattctagtcgaattatcaaattcccaaaaataagtgtaattgttgcattccgtaacgaagaagactgtctggaatttcttataaatgatttattgaagccaagtgtaagtatagatgagattattcttatntacgaccattcagacgacaaaagccttgagattgcacatcgttttcctgaaactaataagtctctagtattattggatttgcccgaaaattttacaggaaagaaagctgctcttacttatggagttgagaaatcaactggaaaagtattgctttttcctgatgccaattggaagatgagccccaattggcgcaaagactatccttacccaaaatgttaccaaggccat

SEQ ID NO: 15130 - protein, 162 aa, Unknown
  Obtained from environmental sample
  misc_feature (1)..(162): Xaa is any amino acid
MNYYICFVIISFYIIGFILVFAYVVLICVFIVGLQQKTKKSSNSSRIIKFPKISVIVAFRNEEDCLEFLINDLLKPSVSIDEIILXYDHSDDKSLEIAHRFPETNKSLVLLDLPENFTGKKAALTYGVEKSTGKVLLFPDANWKMSPNWRKDYPYPKCYQGH

SEQ ID NO: 15131 - DNA, 966 bp, Unknown
  Obtained from environmental sample
  misc_feature (1)..(966): n is a, c, g, or t
atgttaatgtcacataatattgattatattaaaactcctgttgcttacacattagataaattattaagtggtgaagatgatatgcagactgtatatttatcaaatgagccatatgttgctaaagaagctggattagagatcaccctctttaatccaaaagattatggttttgacggatatggagatattctatttacctctaaaaaaatattaaatagcagacctgatcttgtagaaaaaatgtattcagcaagtaaaaaaggatgggagtatgcattctcacatattgatgagagtgttgatgttatatataatagatacaacactctaaataaaagtaaaaacgcattagcttatgagggcaaaatattaaaatctttaagtggttatggtaaaaattttggagaaattgatgaagacaaaataaggagtattgctcaaatatttagttttatgaacaagggaaaaaataattttgaaaacttggatgagtttatttatagaccagcaaataaagatacagactatgaaacaatatttttcacaaaagaggagttagaatatataaaaaataaaaaaagtgtaaaagtatgtgcacacacaaaagagtttccatttgtaatatttgataaagaagagatcagcggaacatcaatagagtttctaaaactaattaccaatatatctaaattaaattttgaaatagtacaatcaaaaagtcttccagagcatttaaaaatgataaaagatggtctgtgtgatgttgctcctattattgtaacaaaacctaatttacatgattttttaactcctacaagccctatattatctgatactatcgtgcttgttacaaaaatcaatgagccatatgttagtgatttaaatgatttacaaaataaaaaagttgctattcaaaaaggcgccaagaatcttattaaatatgtaaactctatttatcaaatataa

SEQ ID NO: 15132 - protein, 321 aa, Unknown
  Obtained from environmental sample
  misc_feature (1)..(321): Xaa is any amino acid
MLMSHNIDYIKTPVAYTLDKLLSGEDDMQTVYLSNEPYVAKEAGLEITLFNPKDYGFDGYGDILFTSKKILNSRPDLVEKMYSASKKGWEYAFSHIDESVDVIYNRYNTLNKSKNALAYEGKILKSLSGYGKNFGEIDEDKIRSIAQIFSFMNKGKNNFENLDEFIYRPANKDTDYETIFFTKEELEYIKNKKSVKVCAHTKEFPFVIFDKEEISGTSIEFLKLITNISKLNFEIVQSKSLPEHLKMIKDGLCDVAPIIVTKPNLHDFLTPTSPILSDTIVLVTKINEPYVSDLNDLQNKKVAIQKGAKNLIKYVNSIYQI

SEQ ID NO: 15133 - DNA, 402 bp, Unknown
  Obtained from environmental sample
  misc_feature (1)..(402): n is a, c, g, or t
atgttgtttaatcaaatcgtcaggttacctgatgaagatagcggcttatcattgtctattgctcgtttttataacggcttagtcgatgcgaaaaaacaaaacaatgacaaactgtttcgtcgtgaaatggtcgttattaccaataaagaaaatggcaatcagatcttgagatatgtcatgggtagtgcttcgttatctattaagaaaatggctattgctattgattatgatggtatagatgcactcggtataaatactaaaggtcaatgccagctccgggtacacaaagcaaataaatatgaaatcattaaatggttttataaccatgcggatatgagtgttccactcagtactcgtttgggtttgcttggtgcattacttggtgtttttgggttttgctaa

SEQ ID NO: 15134 - protein, 133 aa, Unknown
  Obtained from environmental sample
  misc_feature (1)..(133): Xaa is any amino acid
MLFNQIVRLPDEDSGLSLSIARFYNGLVDAKKQNNDKLFRREMVVITNKENGNQILRYVMGSASLSIKKMAIAIDYDGIDALGINTKGQCQLRVHKANKYEIIKWFYNHADMSVPLSTRLGLLGALLGVFGFC

SEQ ID NO: 15135 - DNA, 666 bp, Unknown
  Obtained from environmental sample
  misc_feature (1)..(666): n is a, c, g, or t
atgaagtatttattagctctttgtatatttttattattgactggctgtactcaaccttcttttacgagtagtgaaagcatgttaacaatcaataacaatagtaagtcgtttgatattccaattataaacaagaaggaatataagtttagtcatgcaaccttgaatagttttgtactaaatgagaaaagatttcatttagaatatatcaaaatgaaatctcaatatacatggacaggtcttgccgatggattttatcaagattttttacaagaaaaaatgaaaaatttaaaagtggtatcacatcaagtagttgatgttgcagatgtttttttatatactaaagaagaccaatatttttatctaataacattatatgatggtagtagtaatacttttattatagattatacaggagatatagcttccaaaattttagatgatgaccaaaatttccaaaaaatagaaaccccctggaactaccctttagtgaaaatatgccttaaaaataatatcctaggtcccttatttttgaaaaaaaataatgccgataatgggacccatagtaatacccctaatatagggaaaaattttggaaaaagtttgaaatttgaaaagcccccaaaagagtttctcggtttttgttgccaaaaaaagcccaaaaatttt

SEQ ID NO: 15136 - protein, 222 aa, Unknown
  Obtained from environmental sample
  SIGNAL (1)...(15)
  misc_feature (1)..(222): Xaa is any amino acid
MKYLLALCIFLLLTGCTQPSFTSSESMLTINNNSKSFDIPIINKKEYKFSHATLNSFVLNEKRFHLEYIKMKSQYTWTGLADGFYQDFLQEKMKNLKVVSHQVVDVADVFLYTKEDQYFYLITLYDGSSNTFIIDYTGDIASKILDDDQNFQKIETPWNYPLVKICLKNNILGPLFLKKNNADNGTHSNTPNIGKNFGKSLKFEKPPKEFLGFCCQKKPKNF

SEQ ID NO: 15137 - DNA, 381 bp, Unknown
  Obtained from environmental sample
  misc_feature (1)..(381): n is a, c, g, or t
atgaaatatactattaatgttgatattatagtaaaaccaaaattaatagtaaatggtgttgaaaatgagtttaaacctgtggttttaaatatattaaataatgctaaagatgcctttattgaaaatgaaataaaagataaaaaaattatcattacattagaaaaagtttatggtaagaatagtatcactatattggataatgcaggaggaatacctgaagatattatagaacatatttttgaagcaaattttacaacaaaagaagaaggtattggtactggtatcggactttatatgtcaaagcagattattgataaatcacaaggtaaattaaaagttcaaaaccaagacaatggtgcttgttttacaattatcctttaa

SEQ ID NO: 15138 - protein, 126 aa, Unknown
  Obtained from environmental sample
  DOMAIN (19)...(126): Histidine kinase-, DNA gyrase B-, and HSP90-like ATPase
  misc_feature (1)..(126): Xaa is any amino acid
MKYTINVDIIVKPKLIVNGVENEFKPVVLNILNNAKDAFIENEIKDKKIIITLEKVYGKNSITILDNAGGIPEDIIEHIFEANFTTKEEGIGTGIGLYMSKQIIDKSQGKLKVQNQDNGACFTIIL

SEQ ID NO: 15139 - DNA, 384 bp, Unknown
  Obtained from environmental sample
  misc_feature (1)..(384): n is a, c, g, or t
atgttagagaaactttatagtaattatcttttaaaatatccaaaattatttttagcttttatagttttttgtatgactattatggctacaaatacaacaaagctagagatagatgcaagtgctcaaacactattacttgaaggggataaagatttagcatttatgcgaaaagttggaaaaaactttgcagcaaatgattttttactcgtaacctataccatagaagataatctattaagtgatgaaaacttagaaaatatccacccaatttccgaaaatttagcaaagctagaaaatattccatcaataactctcattcctaaatgtaccactggcttccatccccccccaagaccaataaaaagaaccttggtgggcgaatga

SEQ ID NO: 15140 - protein, 127 aa, Unknown
  Obtained from environmental sample
  misc_feature (1)..(127): Xaa is any amino acid
MLEKLYSNYLLKYPKLFLAFIVFCMTIMATNTTKLEIDASAQTLLLEGDKDLAFMRKVGKNFAANDFLLVTYTIEDNLLSDENLENIHPISENLAKLENIPSITLIPKCTTGFHPPPRPIKRTLVGE

SEQ ID NO: 15141 - DNA, 969 bp, Unknown
  Obtained from environmental sample
  misc_feature (1)..(969): n is a, c, g, or t
ttgcacgagtttgaaataaataaaatagatgaagccacccctaccgttggagaagatgaagaacttctagagataaaaaagatgctctctaaaaaagagaagatagaggagaagatatctccagccgaagttatttttaatttagaacccagcgttagtgaagccctcctatctttagatatcgacagcagcttttttgatgatgccctgaatgaactgcgtgcaaagtttgatcaatcatatgagatgtttgataaattagagaatgttaacatagaagaggtgttagaccgtattgaagtactatcatcactaaaaagacgttatggctctatagaagaggctctactttatagagatcaaaaaagagtagagcttcagcgatatgaaaatattgatataacaagagatgatcttcaaaatagttcaaaagagcttcaagttaaagtagagcagagtgctcaaattattacacaagagagaacaaataatctactcaagtgtgaaaagtcactgaacagttatcttaaagaactctatatgcgtgatataaatttagatattaaaagttgtgaattaaatattttaggtgcagatgagatagagcttanattagataccacatcacttgataagataagtgcaggggagtttaacagactacgtttggctgttttagccctaaaatccgagtacttgaatgaagatgggggggtattaatgcttgaagaaataaaccctaatttaggtggtggagaagcccttgaggggggccaaagtaccttcgaaagctcccctaaaaaatttccaaaaatttggtatttccccatccagcctccactgaacttccccggggagacccctccctttttgggacctaaaagaaaaaaaaagcccgggttaaaaaatttgaagggcccatcccaagggttggatgaaaaacccccgaaatgtaaaagggggaaaaaa

SEQ ID NO: 15142 - protein, 323 aa, Unknown
  Obtained from environmental sample
  misc_feature (1)..(323): Xaa is any amino acid
MHEFEINKIDEATPTVGEDEELLEIKKMLSKKEKIEEKISPAEVIFNLEPSVSEALLSLDIDSSFFDDALNELRAKFDQSYEMFDKLENVNIEEVLDRIEVLSSLKRRYGSIEEALLYRDQKRVELQRYENIDITRDDLQNSSKELQVKVEQSAQIITQERTNNLLKCEKSLNSYLKELYMRDINLDIKSCELNILGADEIELXLDTTSLDKISAGEFNRLRLAVLALKSEYLNEDGGVLMLEEINPNLGGGEALEGGQSTFESSPKKFPKIWYFPIQPPLNFPGETPPFLGPKRKKKPGLKNLKGPSQGLDEKPPKCKRGKK

SEQ ID NO: 15143 - DNA, 645 bp, Unknown
  Obtained from environmental sample
  misc_feature (1)..(645): n is a, c, g, or t
atggaatcaactcatcaaagaagaacttgggaagaacagtttggagaaggttatttagagagaaatgtatacaatccatcagagctgaataaattttaccaaaatcgctttggagttacaaaagaccaactcaatgatgaatttttaaaagatatcccaaaagatactaaaatactcgaagttggtacaaatattgggaatcaactcttccatttacaatctcaagggtttactaacttatatggtattgagatacaagatagagctataaactatgcaaaacatagaactgacaatcttaatattatcaaaggtgatgcacttgacattccatttaaagatggtttttttgatgttgtctttacacatggtgttttgattcatatttctccagataatatcaaacaagcactcaaagagatttatcgagtaagcaatcaatatatttggggactagaatactatgctgatacatatacagacttagaataccatggacaaaaaaacatcatgtggaagactaacttttgtaagctatatcttgatacatttacatccctaaagcttatcaaagaaaaaaaatataagtatactagtgaaaaccatctagaagatcagatgtttcttctaaaaaaagataattaa

SEQ ID NO: 15144 - protein, 214 aa, Unknown
  Obtained from environmental sample
  misc_feature (1)..(214): Xaa is any amino acid
MESTHQRRTWEEQFGEGYLERNVYNPSELNKFYQNRFGVTKDQLNDEFLKDIPKDTKILEVGTNIGNQLFHLQSQGFTNLYGIEIQDRAINYAKHRTDNLNIIKGDALDIPFKDGFFDVVFTHGVLIHISPDNIKQALKEIYRVSNQYIWGLEYYADTYTDLEYHGQKNIMWKTNFCKLYLDTFTSLKLIKEKKYKYTSENHLEDQMFLLKKDN

SEQ ID NO: 15145 - DNA, 504 bp, Unknown
  Obtained from environmental sample
  misc_feature (1)..(504): n is a, c, g, or t
atgttaaaaaaaatagacatttcacaagtttctagtttccatccgttcttattatggtttagttttgttatattcattgacagctatttaattttatttagtaataaaaatatctttgatgttaattttcaattcttacaggatcatacgggaggattattgtttgcattcgttgtttatttattttgtatgtctgtacttagtaaagttacaaactggatcatcaccatgttatcttttattgaaaaacatatatctattaaattttttaataaaactttagaaaataaacattgtaggaattgtatctttgattcagatgctttgaatttagcgattatacataataacactgtattacataaagaatatctagatcataaaaaaaacattgctgatatgttttttgaaaaagagttagcatcagcattagtagctctttgtactttcaattattttatatcaaatgaaaatacagtttccttactaaagtatatgagttaa

SEQ ID NO: 15146 - protein, 167 aa, Unknown
  Obtained from environmental sample
  misc_feature (1)..(167): Xaa is any amino acid
MLKKIDISQVSSFHPFLLWFSFVIFIDSYLILFSNKNIFDVNFQFLQDHTGGLLFAFVVYLFCMSVLSKVTNWIITMLSFIEKHISIKFFNKTLENKHCRNCIFDSDALNLAIIHNNTVLHKEYLDHKKNIADMFFEKELASALVALCTFNYFISNENTVSLLKYMS

SEQ ID NO: 15147 - DNA, 876 bp, Unknown
  Obtained from environmental sample
  misc_feature (1)..(876): n is a, c, g, or t
atgatggtattttctggagatattggacaagaaaaaaacatcatactagcaagacctactcacattacaaatgcaaactatgttattatggaatcaacctatggtggacgagatcataaagacttagaaagcaaaagagaacaactgcgtgatgtaatcaatgcaactattgcaaaaaaaggaaaagtaattattccctcattttcactagaaagaactcaagaactattatactacttaaaacaattagaagaagatggagaaatcccacctactcctgtttatttagatagtccattagctgcaaaaataacaaaactatacaatagacatgatgaatgtttcaacaaagaaattgttgaagaaatgaaatcaaatgatcatgtatttttctttaaggatctaactattactagtgaccataaaagttccattaaactaaataacctgcatggaagtgcaataattattgcaggaagtggaatgtgtactggtggacgaatacttcatcatttgaagcacaatatatgggatgctaaaaatacaattctatttatcggatatcaaggtgttggaacactaggacgacaacttgtcgaaggtaaaacaagaatacaaatgatgaaccaatattttagtgttcgtgctaatattgaatctattcatggattttcaggacatgctggacaaaaagaattgataaagtggtcaaaggatattgattgttcaaataagcgttcattaaattctactatttttgtttgtcatggagatgaagatcaagcacaaatctttgcagaaaagattgctagacaaaatagaaaaacaattgttccctcaatggtagagagttatgaactagaaataataatttaa

SEQ ID NO: 15148 - protein, 291 aa, Unknown
  Obtained from environmental sample
  DOMAIN (210)...(260): RNA-metabolising metallo-beta-lactamase
  misc_feature (1)..(291): Xaa is any amino acid
MMVFSGDIGQEKNIILARPTHITNANYVIMESTYGGRDHKDLESKREQLRDVINATIAKKGKVIIPSFSLERTQELLYYLKQLEEDGEIPPTPVYLDSPLAAKITKLYNRHDECFNKEIVEEMKSNDHVFFFKDLTITSDHKSSIKLNNLHGSAIIIAGSGMCTGGRILHHLKHNIWDAKNTILFIGYQGVGTLGRQLVEGKTRIQMMNQYFSVRANIESIHGFSGHAGQKELIKWSKDIDCSNKRSLNSTIFVCHGDEDQAQIFAEKIARQNRKTIVPSMVESYELEIII

SEQ ID NO: 15149 - DNA, 468 bp, Unknown
  Obtained from environmental sample
  misc_feature (1)..(468): n is a, c, g, or t
atggaaatatctaataagcaaaattctagtaaaagagtgttaaaattatatgatttaaatgcttgtaaaccaaattcagaggaaattgaaactacaatcagaggatattttaggcatgttaaagaaataaaagtaccaaagcctagtattgttaaattatctcattacttgagaagagttggattggcttctgatagngattcagcaccagaagtaaaatataattcagattactgtgcatataaaagaatatttagtaaattagaagactctaatcctggaaaaaatcctagtgacttacaaattgtaaaaaatttacatccagtgatttcttccaaattattagaaaatgtacttaattggaatataatggctaaagttagaaaagaaaatacttataattttattccgaatatcaataatggaacaggggttaatccaagtgaaacttccttgcttatttattga

SEQ ID NO: 15150 - protein, 155 aa, Unknown
  Obtained from environmental sample
  misc_feature (1)..(155): Xaa is any amino acid
MEISNKQNSSKRVLKLYDLNACKPNSEEIETTIRGYFRHVKEIKVPKPSIVKLSHYLRRVGLASDXDSAPEVKYNSDYCAYKRIFSKLEDSNPGKNPSDLQIVKNLHPVISSKLLENVLNWNIMAKVRKENTYNFIPNINNGTGVNPSETSLLIY

SEQ ID NO: 15151 - DNA, 528 bp, Unknown
  Obtained from environmental sample
  misc_feature (1)..(528): n is a, c, g, or t
ttgaatttacacataaaatcaataaatacccacatagattccctttcaaataaaaattatgaagagttaaagggggttaatactttagacttcatatttatgtttatccctattgagagtgcattaatgctagctatggaaagtgataaaggtctatttgataaagcctttaaaaagaagattgtactagtttccccaactacacttttagtagctttaaaagcagttgagaatagttggagatatgagaaacaagcacaaagtacaacagaggttatacgacttgcagagaagctttataataaggtaagaacttttgtagaagattttgaaaaagtaggaaaaaatctgagtcaagctcaaaaatcatatgatgatgcctacaaaaaactctcatctggaaaagataatatcgtaagacaaatagaggttttcaaagaaaaatcaaatataagcccttcaaaacagataagtcaagatattgttgatagtgctatggttgaacaaatagagaatatggaagagtaa

SEQ ID NO: 15152 - protein, 175 aa, Unknown
  Obtained from environmental sample
  DOMAIN (1)...(160): RmuC family
  misc_feature (1)..(175): Xaa is any amino acid
MNLHIKSINTHIDSLSNKNYEELKGVNTLDFIFMFIPIESALMLAMESDKGLFDKAFKKKIVLVSPTTLLVALKAVENSWRYEKQAQSTTEVIRLAEKLYNKVRTFVEDFEKVGKNLSQAQKSYDDAYKKLSSGKDNIVRQIEVFKEKSNISPSKQISQDIVDSAMVEQIENMEE

SEQ ID NO: 15153 - DNA, 483 bp, Unknown
  Obtained from environmental sample
  misc_feature (1)..(483): n is a, c, g, or t
gtgatcagatcggctcgaggacaattgatcagtatcattatgaaaatgaaaaccaatgataaagacaagttgattgaaaaatataatgaactggaaaaatcgtcttctaaaataagcgatatctcgaatgtcacctcgcatcttgttgatttaatcatgaccatgtcattaggtgagcgatgccagcttctcggtgattttatctcatacagcggccagacaaaacgaaaattttcccgaaaagagtatttcaggccggtgccatttactgtaaacagcaaactttaccacggaagtaccgtaaatattagcatgggcggcatttttatagatattaaagatgccaaaaatcagtttgctgccggagataccatcaagatgaatcttgaacatccggaaacatatcagcattccaatgtaaacggtacgattgtccgaattgcaaaagccggtataggggtttgttttgttgagccgttatag

SEQ ID NO: 15154 - protein, 160 aa, Unknown
  Obtained from environmental sample
  misc_feature (1)..(160): Xaa is any amino acid
MIRSARGQLISIIMKMKTNDKDKLIEKYNELEKSSSKISDISNVTSHLVDLIMTMSLGERCQLLGDFISYSGQTKRKFSRKEYFRPVPFTVNSKLYHGSTVNISMGGIFIDIKDAKNQFAAGDTIKMNLEHPETYQHSNVNGTIVRIAKAGIGVCFVEPL

SEQ ID NO: 15155 - DNA, 720 bp, Unknown
  Obtained from environmental sample
  misc_feature (1)..(720): n is a, c, g, or t
ttggtaaagattagaataccttctctaatgggattaaaacacactaagcattgtaatgaagttaataaaaatgttttattaaaatttcataattatttgtttgctgaaggattaagtattcctagagttgttaaatatttaagattaatatgtcaaattgatttaaaaattaataaaaatttgaaaaaagttaataaaaatgatattgtccattatcttagttggcttgaaatgagtaattatgctgaacttactaaaaaagattttaaaattactttaaaaaaattttatagatggttgcataatggtaaagaacctagttttattagttggtttaaatgtactattaaaactaaaaaacgaatgatgcctcaggaattattaactcaaaaagaaataatgaaaatgattaatgtatgtactaatcctagagataaagcattcattagcatattatatgaaagtggttgtagaattggagaaattttaactttaaaattaaaacatgttagttttgataagtatggattaatttttgttgttaatggtaagactggagttagaagagttaggttagttactagtagtaatttactaggtaattggttaaatgttcatccttgtaaaaatgaggttgataattatttatggacttatatgaatcagaataagttagtatgttatgatcatttaagacaaagaattagaaaaattgcctaa

SEQ ID NO: 15156 - protein, 239 aa, Unknown
  Obtained from environmental sample
  misc_feature (1)..(239): Xaa is any amino acid
MVKIRIPSLMGLKHTKHCNEVNKNVLLKFHNYLFAEGLSIPRVVKYLRLICQIDLKINKNLKKVNKNDIVHYLSWLEMSNYAELTKKDFKITLKKFYRWLHNGKEPSFISWFKCTIKTKKRMMPQELLTQKEIMKMINVCTNPRDKAFISILYESGCRIGEILTLKLKHVSFDKYGLIFVVNGKTGVRRVRLVTSSNLLGNWLNVHPCKNEVDNYLWTYMNQNKLVCYDHLRQRIRKIA

SEQ ID NO: 15157 - DNA, 456 bp, Unknown
  Obtained from environmental sample
  misc_feature (1)..(456): n is a, c, g, or t
atgaattgttgtatctttggtatatcacgcgattatacttctgataaaatcgctgagcttagaggtagtttgaaaattcttatccaaatgaaaagcccaattgatatgatcaaacaatctatagaaaaactaatgaaatttgaagatgaagattatatcttcctattttttgattcagaaaaaaaagaagtatccattataaaatcaacggttttatgttttggattgtgtgataaatccgttcacattactgaagattcgttgatgacaacgatgttaaattattggggagtttttagtttcaggcaggattcagaaattgatttgactcagatttctaaacattatgacaagagtggttacatcaatgatgtggtgggtaatttttacgaatattttacagaagaacagtcgaaagaaaacattatactaattcaatctaattcaaataattaa

SEQ ID NO: 15158 - protein, 151 aa, Unknown
  Obtained from environmental sample
  misc_feature (1)..(151): Xaa is any amino acid
MNCCIFGISRDYTSDKIAELRGSLKILIQMKSPIDMIKQSIEKLMKFEDEDYIFLFFDSEKKEVSIIKSTVLCFGLCDKSVHITEDSLMTTMLNYWGVFSFRQDSEIDLTQISKHYDKSGYINDVVGNFYEYFTEEQSKENIILIQSNSNN

SEQ ID NO: 15159 - DNA, 510 bp, Unknown
  Obtained from environmental sample
  misc_feature (1)..(510): n is a, c, g, or t
gtgcaaaaactaaatcgcctcttcaagaaacgggctaaaaaatcagtggaacatttctttaagaattatgctagaaattttgaagtagaaatggtttcagatcataaagttattgtttatattgaagatgctttaaaacctaaaattataggaacaaaaggaagcaatatttcaagaattgaagaagaattaggaataagtattgatattagaactttagaaaataatggttccacaaaaaatagttntgattcgggcaataaaccaaattctaattctaaaaagaaaacaaaaagtttagattttgactatgaaattactaatacgcacttaaaattctttactgatgtatctaataaaactattaatatttatgttgacaaagaattcatgttaactgcaaatgttagtaagaaaggacaaattagtattaagaaagaaggaaatgctattggtaaacttatagaaaaagctcttgataatgaagcgttagtagaattaaggctttag

SEQ ID NO: 15160 - protein, 169 aa, Unknown
  Obtained from environmental sample
  misc_feature (1)..(169): Xaa is any amino acid
MQKLNRLFKKRAKKSVEHFFKNYARNFEVEMVSDHKVIVYIEDALKPKIIGTKGSNISRIEEELGISIDIRTLENNGSTKNSXDSGNKPNSNSKKKTKSLDFDYEITNTHLKFFTDVSNKTINIYVDKEFMLTANVSKKGQISIKKEGNAIGKLIEKALDNEALVELRL

SEQ ID NO: 15161 - DNA, 564 bp, Unknown
  Obtained from environmental sample
  misc_feature (1)..(564): n is a, c, g, or t
ttgtgttggaacgccattatcattgctaaatggagtcacataaccgcccgctatgctgatttccctatagaatgtagtcttttgagtattccttacattggtaatattatctacagctgctttgcgtataaaacaggttggtcattaactcaatttgattcgggttctaagctgtcatttaaatacgaacaagagacaggagaaatagaaatgcatttttcgggaaataaaaaaaatatttatcctgcataccgctcattcaaaagattactgagtcattcgttaaccaacccaagattaagcgtaataaaactcacatccccattattaacaattgtaaaatttaggacaaaactagaaaattatgtctcttgggcaaatacagtcactaataccacaaaaagaattactattattgaggcaggatattatgtacctcgaatccatgagaggctagggtattggctgacattcactttaaaagatataaaaaaaagtaaagaatattgggaaaaatcaaagttaaattggcctatattaagactaactgttacagaaaaatag

SEQ ID NO: 15162 - protein, 187 aa, Unknown
  Obtained from environmental sample
  misc_feature (1)..(187): Xaa is any amino acid
MCWNAIIIAKWSHITARYADFPIECSLLSIPYIGNIIYSCFAYKTGWSLTQFDSGSKLSFKYEQETGEIEMHFSGNKKNIYPAYRSFKRLLSHSLTNPRLSVIKLTSPLLTIVKFRTKLENYVSWANTVTNTTKRITIIEAGYYVPRIHERLGYWLTFTLKDIKKSKEYWEKSKLNWPILRLTVTEK

SEQ ID NO: 15163 - DNA, 630 bp, Unknown
  Obtained from environmental sample
  misc_feature (1)..(630): n is a, c, g, or t
ttggcactttttgaagtgaggggttgggcagataaacaatctaaacatttttttatcgatgatcctgtttcaagcttggatgatcataatatttttgtaacagcaataacactttttgacttaattgaaaaatattttaaagaaagaaaaattgtaataacaacccatcacattggactgttttctatcttatacaattggttatacaaaggagaaaaagcttccaaatttaaaaaaagaggtggaagttcatatgttaaatcttatatattgaatcgtaaagatgacaatactttatctctagataaatttgaaaaaagtgtatttctttatcacttacatttattgcaaaaattaaaaaaagcaaaagaagacgatgaattatatggctatcattttgtgttattaagacaaattttagaaaatatagcttcatttttgggtgttggacaattggcatatgttttacaacaaattggcattaatgatgcaaaaattccaaatatgataaatgttttatctcataaaaatattttctattatgaaacagataccatatctccaaataataaagatgattttaaagaaatattaaatgctttatttacgaaatataattttcaagtataa

SEQ ID NO: 15164 - protein, 209 aa, Unknown
  Obtained from environmental sample
  misc_feature (1)..(209): Xaa is any amino acid
MALFEVRGWADKQSKHFFIDDPVSSLDDHNIFVTAITLFDLIEKYFKERKIVITTHHIGLFSILYNWLYKGEKASKFKKRGGSSYVKSYILNRKDDNTLSLDKFEKSVFLYHLHLLQKLKKAKEDDELYGYHFVLLRQILENIASFLGVGQLAYVLQQIGINDAKIPNMINVLSHKNIFYYETDTISPNNKDDFKEILNALFTKYNFQV

SEQ ID NO: 15165 - DNA, 834 bp, Unknown
  Obtained from environmental sample
  misc_feature (1)..(834): n is a, c, g, or t
atgtttaacaatatatataaagaccaaaaagtattagtcacaggtcatactggatttaaaggtagttggcttaccacttggcttattaatttaggtgcagatgttattggtatctctaaagatataccaacaactccatctatgtttgaagagctaaaattagaagataaaattaaacactatccagaagatattagaaacttatctaagatgacagaaattatatctgatgaaaaacctgaatttttatttcatttagcagctcagccaattgtatctacttcatatagtgatccaattgaaactatatcttcaaatgttatgggtacagcaaatgtacttgaagctttaaaagtatcaaatcataaatgtacggctataatcattacaagtgacaaagcttatgataatgttgaacaggtttggggttataaagaagatgataaaatgggtggaaaagatatttatagcggtagcaaaggtgccgctgaactaattataaaatcatattaccactcatttttcaaatctaaagattgtaatataaaacttgcaattggtagagctggcaatgttatcggcggtggtgactgggcaaaagataggatagttgtagattgcatggaggcatggagtcaaaatgaaactgttgaaataagaagcccagaggctacaagaccatggcaacatgtacttgaacctttgagtggctatttgaatttagggccagttttgtttgaagataacactttgcatggtgaagcttttaattttggtcccagaagcaaaccaaaatcttacagtaaaagcagttaccttggagaatttaagtaa

SEQ ID NO: 15166 - protein, 277 aa, Unknown
  Obtained from environmental sample
  DOMAIN (11)...(268): NAD dependent epimerase/dehydratase family
  misc_feature (1)..(277): Xaa is any amino acid
MFNNIYKDQKVLVTGHTGFKGSWLTTWLINLGADVIGISKDIPTTPSMFEELKLEDKIKHYPEDIRNLSKMTEIISDEKPEFLFHLAAQPIVSTSYSDPIETISSNVMGTANVLEALKVSNHKCTAIIITSDKAYDNVEQVWGYKEDDKMGGKDIYSGSKGAAELIIKSYYHSFFKSKDCNIKLAIGRAGNVIGGGDWAKDRIVVDCMEAWSQNETVEIRSPEATRPWQHVLEPLSGYLNLGPVLFEDNTLHGEAFNFGPRSKPKSYSKSSYLGEFK

SEQ ID NO: 15167 - DNA, 888 bp, Unknown
  Obtained from environmental sample
  misc_feature (1)..(888): n is a, c, g, or t
gtgtcaaagagtaatgttgacggaaatattacgtatattaatgataacttttgcaaggtcagtggatacagtcgtgaagaagtgattgggggaaatcataatattttaagagataaatctacctctgaaaaaatgtatagaaaattatggtcaacaatcactgctaaaaacacatggcacggcagaataaaaaacgtaaaaaaagatggctcactgtactgggtagatgcaacaattacgccaataattaatgctaaagatgagataattgaatatatttctattagacatgatataacgcaactaattaatcaaaaaaatgaactccatattcttgcaaatacagacactctaacaagcctcagcaatagaaatgcattaaaagaagagatagataataataataatctctcattaataattgtaaatatagatagtttttctcagataaatgacttttacggacatgaacttggagatgcagtcttagtagaatttgctaaagaattacagataagttgtactagaagtgaagaattgaggctttttagagttagtggagatgaatttgctatattagcagtagatgttcctgctcatatagttgtacaaaaagctcaagaaattgcaaagtttataaactcacatgtttatgatgtaaaagctgaaagtatagaattaagtgcaacgttaagtgtttctttggaagaaaaagaacaattattaattacagcagatatggctctcaaaattgcaagaaaagaagcaaaagatattatagtttatggatcaacaatgaacttggataaagagtatcaaaacaatatgctttggactaaaaaaaatcaagaatgcattgaaaatgataaaatagttctccttttttaa

SEQ ID NO: 15168 - protein, 295 aa, Unknown
  Obtained from environmental sample
  DOMAIN (60)...(102): PAC motif
  misc_feature (1)..(295): Xaa is any amino acid
MSKSNVDGNITYINDNFCKVSGYSREEVIGGNHNILRDKSTSEKMYRKLWSTITAKNTWHGRIKNVKKDGSLYWVDATITPIINAKDEIIEYISIRHDITQLINQKNELHILANTDTLTSLSNRNALKEEIDNNNNLSLIIVNIDSFSQINDFYGHELGDAVLVEFAKELQISCTRSEELRLFRVSGDEFAILAVDVPAHIVVQKAQEIAKFINSHVYDVKAESIELSATLSVSLEEKEQLLITADMALKIARKEAKDIIVYGSTMNLDKEYQNNMLWTKKNQECIENDKIVLLF

SEQ ID NO: 15169 - DNA, 489 bp, Unknown
  Obtained from environmental sample
  misc_feature (1)..(489): n is a, c, g, or t
ttggatgaattatggtttgtggtatctcctcaaaatccattgaaagaaaaaaagactttattggcagataaccatcgctggtatatggtaaatttagccattgaaaatgatgcccgtttcaaagccatcgacatcgaatttcacatgcctcgtccttcctacaccatcgatacattaacaagattaaatgaaagatatccaaacaatgtattcgtcttgatttctggatctgatatttttaagaattttaagaaatggaaaaatcatgatactttaatccaacaatttccattttatgtttatactcgaccaagttttcagttagctgaattcggaaatcatccacaaataaaattatttgaagctcctcaaatggaaatctcatctagttttatccgtaaaagcattaaggaaaaaaaagaagttcaatacttattaccacctaaaattgatgagtatatcaaagagatgaatttttataaaaaataa

SEQ ID NO: 15170 - protein, 162 aa, Unknown
  Obtained from environmental sample
  DOMAIN (1)...(135): Cytidylyltransferase
  misc_feature (1)..(162): Xaa is any amino acid
MDELWFVVSPQNPLKEKKTLLADNHRWYMVNLAIENDARFKAIDIEFHMPRPSYTIDTLTRLNERYPNNVFVLISGSDIFKNFKKWKNHDTLIQQFPFYVYTRPSFQLAEFGNHPQIKLFEAPQMEISSSFIRKSIKEKKEVQYLLPPKIDEYIKEMNFYKK

SEQ ID NO: 15171 - DNA, 624 bp, Unknown
  Obtained from environmental sample
  misc_feature (1)..(624): n is a, c, g, or t
atggatttgttggcaatggcacagttgttagcaataagtcangtttttcaaacaataaatttatttgattctaattttaataaagtgaaagagttgaatcaaatgcagggaagatctgtaaataaattaaggattctatcaaaatcatttttttatcagacatataaaaatagaatatatatcagttcagaaaatggattaagtattgatgtgctggatgataagggagacaaaatcaggcgtattttttttccaaattatataaaaaaaaaatttaacagaaaagcaattatggaaaaaatcaggaaaaagaataaagcgaaatatgagatgttgaaaaaccgcattgaattcccaaaattttatcctgaaattctctctttctttatatcagatggaataatatatattgccacatggaaatgggtaaaccagaaaattgagttttttatttttaaagataatggccaatttttaaaaaaagtgttcgtatcactgaaatttcaaaatgaatttttttcccgtccatatcctgcattaacaatttataaacaaaatatctatcaaattgttgaaaatgaagagaaagaagagtgggaactgcataaaacctcaataaaatga

SEQ ID NO: 15172 - protein, 207 aa, Unknown
  Obtained from environmental sample
  misc_feature (1)..(207): Xaa is any amino acid
MDLLAMAQLLAISXVFQTINLFDSNFNKVKELNQMQGRSVNKLRILSKSFFYQTYKNRIYISSENGLSIDVLDDKGDKIRRIFFPNYIKKKFNRKAIMEKIRKKNKAKYEMLKNRIEFPKFYPEILSFFISDGIIYIATWKWVNQKIEFFIFKDNGQFLKKVFVSLKFQNEFFSRPYPALTIYKQNIYQIVENEEKEEWELHKTSIK

SEQ ID NO: 15173 - DNA, 507 bp, Unknown
  Obtained from environmental sample
  misc_feature (1)..(507): n is a, c, g, or t
atgaaaaaactaaatgtcgcaatatacattgtaatagttatactctctcttttttcctgcacaaaaaatagaggaaaaacgggttttaataaaaaaatactgagaattggcatattgacctttccaaaaacattgaatcctgtttatgttacagatgaaacatcaacggtactggtaaataaagtatttgattcattgtattattttgacagtagaggggagccgatgagcaggctgattgagactgaatttgtgacgatcaatgatgattcttttgatgttcaaatattgcttaaaaatgacatttgtttttcagacggaaaattgctggattcagatgatcttatagataccataaaattattgaaaaagaaaaagtatatatcaccctatagacaatatgtaaatgcaataaaaaaagtggaaaaaagagggagatttgaattgaaaattttcttctataaaaaaaatgccaactggcggaattatttaactttcaaaatttga

SEQ ID NO: 15174 - protein, 168 aa, Unknown
  Obtained from environmental sample
  SIGNAL (1)...(19)
  misc_feature (1)..(168): Xaa is any amino acid
MKKLNVAIYIVIVILSLFSCTKNRGKTGFNKKILRIGILTFPKTLNPVYVTDETSTVLVNKVFDSLYYFDSRGEPMSRLIETEFVTINDDSFDVQILLKNDICFSDGKLLDSDDLIDTIKLLKKKKYISPYRQYVNAIKKVEKRGRFELKIFFYKKNANWRNYLTFKI

SEQ ID NO: 15175 - DNA, 810 bp, Unknown
  Obtained from environmental sample
  misc_feature (1)..(810): n is a, c, g, or t
atgaatgcaataatagcagtccaagatttaataaaacaaaatcagaaaagaattaaaatcctccaacagcaacttgatgatcacaattctggtaaatcaaaactctcaattatgggagtagcttcaacagaaaatggaattgaaaaatcacaagaagctttagaaaaaaaccaaatgattcttaatgaactcatgaaacatgatattcaagagatagagaaagaggagcgactaaaagaggctataaaacggaaaaactattttaaatatcaaaaaataagactcaaacgagatatttcaagagataatgaccaaaaacttgaagctatgatgattgtagatgaacttcctgctgatataaatcttgaagatgatgatcttttttcaattgcagaaactactattaagttagatttacgaatacacgatgagcttgatgatgagcttgaggagattaaagaggattttgcaaaacttttaaaaaatgtatcaaaagaggatattagtaaacttggtgttttaaatacacatatccctgtattggttttacatctttctgtattgatatcaaatataaaagatattataaaagaggaagaacttccagaatttaaggggctaccaaaatttgaagattggtggattgaagagttatggagtaatcatcaagcttattttggactttataaatggaaacaaattattttctctttatgtattaccagtgaacaaaaagagcttgggagtgatattttcaaactggatttttataaaaaagttttaaataaaaaacgaaaactttggttttga

SEQ ID NO: 15176 - protein, 269 aa, Unknown
  Obtained from environmental sample
  misc_feature (1)..(269): Xaa is any amino acid
MNAIIAVQDLIKQNQKRIKILQQQLDDHNSGKSKLSIMGVASTENGIEKSQEALEKNQMILNELMKHDIQEIEKEERLKEAIKRKNYFKYQKIRLKRDISRDNDQKLEAMMIVDELPADINLEDDDLFSIAETTIKLDLRIHDELDDELEEIKEDFAKLLKNVSKEDISKLGVLNTHIPVLVLHLSVLISNIKDIIKEEELPEFKGLPKFEDWWIEELWSNHQAYFGLYKWKQIIFSLCITSEQKELGSDIFKLDFYKKVLNKKRKLWF

SEQ ID NO: 15177 - DNA, 672 bp, Unknown
  Obtained from environmental sample
  misc_feature (1)..(672): n is a, c, g, or t
ttgccgctttactctcaattacttagtacttaccctaaagacttaaattacaattataaatatggtgcttgttatctttatgccaccagagataaagaaaaagctattaactatttaagttttgcagcttcccgcccaaatgtagatccgttagcatattattatttagcaaaagcctatcatcataattatgaatttgcttctgcaatcgtttattttaataaatataaaggtaaaacttcttctaaagaacatgaaaaatatgccatagacaggcagattgaaatgtgtaaaaacggacaacaattacttaaaaaaatcaataaaattggtgttatcagtaaaaaagagattaaagaatcagaattttttagaagttatgatttaagaggcttgcaaggaaaagtaatagtaaaaccagatgagtttaagatgaaagtggataaaaaacaaaatgaatattctattttgtattcagatccaaacttaaatacggttgtattttcttcatatggggataaaggctctaataaagacatttataaaattgaaaaaattgggattaatcagttttctgacccaataagtttaggagatgtaattaatacgccttacgatgaagattatgcttttcttcatcccgatgggaaaaacactttatttttcttctaa

SEQ ID NO: 15178 - protein, 223 aa, Unknown
  Obtained from environmental sample
  misc_feature (1)..(223): Xaa is any amino acid
MPLYSQLLSTYPKDLNYNYKYGACYLYATRDKEKAINYLSFAASRPNVDPLAYYYLAKAYHHNYEFASAIVYFNKYKGKTSSKEHEKYAIDRQIEMCKNGQQLLKKINKIGVISKKEIKESEFFRSYDLRGLQGKVIVKPDEFKMKVDKKQNEYSILYSDPNLNTVVFSSYGDKGSNKDIYKIEKIGINQFSDPISLGDVINTPYDEDYAFLHPDGKNTLFFF

SEQ ID NO: 15179 - DNA, 456 bp, Unknown
  Obtained from environmental sample
  misc_feature (1)..(456): n is a, c, g, or t
atgagatatctattttccctttttatcttcactacattaatttttgcagaagtaaaaatcaatctttctcacacaaatataaaacacggtacatcgtttgctgtgatacttcaaagtgataaaaacttatcacaagctccaaatgtgatttttaaagataaaacttatcagatgtttactatcaatggaagtattcaaaactatgaggtttttctccctgttgattatcataatccaaaacaaaaagagaatgtacaggtaagatacttagaagatgagcagttagtaaagaaaaatacctctataaatatcattgatggaaaatatcgacaaaatgagattataaaagttgccaaagggaaagtaacactttcttcaaaaaacaaagaaaaaacagccaaagagtacaatcaagtttttaaaaatgtttactcagtggttactttatatgattaa

SEQ ID NO: 15180 - protein, 151 aa, Unknown
  Obtained from environmental sample
  SIGNAL (1)...(16)
  misc_feature (1)..(151): Xaa is any amino acid
MRYLFSLFIFTTLIFAEVKINLSHTNIKHGTSFAVILQSDKNLSQAPNVIFKDKTYQMFTINGSIQNYEVFLPVDYHNPKQKENVQVRYLEDEQLVKKNTSINIIDGKYRQNEIIKVAKGKVTLSSKNKEKTAKEYNQVFKNVYSVVTLYD

SEQ ID NO: 15181 - DNA, 594 bp, Unknown
  Obtained from environmental sample
  misc_feature (1)..(594): n is a, c, g, or t
atgaagattatagcaagtaactttaagactaatcacacacgaagtagtaccaaatcttttatagatactatcaatcaatttctagaatctaatcaaataaaaaatgaagtatttgtatttcctaccgcaacatcttttgataactttaatacagtaaataacctaaaaataggtgctcaaaatgcatactacactaaaaatggttcatttacaggtgagattgggacagaacaacttgatgaatttgatataaaaacaattttaattggacatagtgaaagaagacatatcttaaaagagtcacaaaaagatttaacactaaaatataactattataaatctttaggatatacaattatatattgtgttggggagcctttagaggtaagagaaaaaggtcttactgaaactttaggatatatctgggaacagtttgaaggtatagatttaagttatgacaaactaattgttgcttatgaaccagtttgggctataggaacaggtgttgtagcaactgcccaagagatagcgcaagtacataaaaaaatcaaaaagaaaatttcacatccccttttatatggaggaagtgtttaa

SEQ ID NO: 15182 - protein, 197 aa, Unknown
  Obtained from environmental sample
  DOMAIN (1)...(197): Triosephosphate isomerase
  misc_feature (1)..(197): Xaa is any amino acid
MKIIASNFKTNHTRSSTKSFIDTINQFLESNQIKNEVFVFPTATSFDNFNTVNNLKIGAQNAYYTKNGSFTGEIGTEQLDEFDIKTILIGHSERRHILKESQKDLTLKYNYYKSLGYTIIYCVGEPLEVREKGLTETLGYIWEQFEGIDLSYDKLIVAYEPVWAIGTGVVATAQEIAQVHKKIKKKISHPLLYGGSV

SEQ ID NO: 15183 - DNA, 372 bp, Unknown
  Obtained from environmental sample
  misc_feature (1)..(372): n is a, c, g, or t
gtgactttagaatacatcaacaaagactcttcaagagaaattataaatatagacagtaatcaaaagattacagatgagtggataaatatagattcatcaagcaaaaaagaatttatacaaaaatttgtaccggcttttttaagtggtcaaaaaatagttctctttgacaaaaaacatcaacaacttctaaacttttatgaacaaaataatctaaatgactttaaaggcatcgaggaagtaaacaaaactactcaacttctgtttttcacatcaagtagtagtggatttcctgttggagcatttaaaagtagagacaatcttttaaaagaaatcgaaatacataaagagttactcaggagttataaaatttaa

SEQ ID NO: 15184 - protein, 123 aa, Unknown
  Obtained from environmental sample
  misc_feature (1)..(123): Xaa is any amino acid
MTLEYINKDSSREIINIDSNQKITDEWINIDSSSKKEFIQKFVPAFLSGQKIVLFDKKHQQLLNFYEQNNLNDFKGIEEVNKTTQLLFFTSSSSGFPVGAFKSRDNLLKEIEIHKELLRSYKI

SEQ ID NO: 15185 - DNA, 816 bp, Unknown
  Obtained from environmental sample
  misc_feature (1)..(816): n is a, c, g, or t
atgaaatataaagaccttatgcttcaaacagcagttgctttaaatctaaaaagatatcttttccctgtaccatttatgagtataactgtatcttctcattggttaaatctctttacaccagtaccctttaccgttgctaaagcattaatagagggattaaaatctgaagttactatgcaaaatgacaatgcaaaaaaatactttccacaaattcaacctcttagttatattgaagcagtaaaaaaagctgttgaagagatagagcaaaatcaagtaataagtagatggagtgatgcagatggaagtaattgggataaaacacatagaaaacagataagtgatgctatatttgtagatagaattgaagctgatattagttcttatgatgaagcaaaagtatttaatgctgtaaaatcaataggtggagaaaatggctggtttgattatagctatctgtggagaataagaggttttatcgataaaataattggtggcgttgggctaagtcgtggacgaagagacatctgtgatttaagacttggtgaatgtttggatttttggagagtggaagatataaaagaaaatgaaagactactactctttgcacaaatgaaagtacctggggaagcttggcttgaatttaaaattcaagataataaacttattcaatcagcctatttttatccccgtggtattttgggtagattgtattggtatagtatgatccctatccattattttatttttaaaaatatgataaaaggtattttaaaaaatagaaataagtgtataaaatctgagccatcatcccnntaa

SEQ ID NO: 15186 - protein, 271 aa, Unknown
  Obtained from environmental sample
  misc_feature (1)..(271): Xaa is any amino acid
MKYKDLMLQTAVALNLKRYLFPVPFMSITVSSHWLNLFTPVPFTVAKALIEGLKSEVTMQNDNAKKYFPQIQPLSYIEAVKKAVEEIEQNQVISRWSDADGSNWDKTHRKQISDAIFVDRIEADISSYDEAKVFNAVKSIGGENGWFDYSYLWRIRGFIDKIIGGVGLSRGRRDICDLRLGECLDFWRVEDIKENERLLLFAQMKVPGEAWLEFKIQDNKLIQSAYFYPRGILGRLYWYSMIPIHYFIFKNMIKGILKNRNKCIKSEPSSX

SEQ ID NO: 15187 - DNA, 852 bp, Unknown
  Obtained from environmental sample
  misc_feature (1)..(852): n is a, c, g, or t
ttgaaagagttggcacctattggcttaacagtatatggaagattggagcatactaaaaaagctgtagaagcattacagaaaaatactttagctaaggaaagtaaattatatattttttcagacgggccaaaatatggtgatgaagaaaaagtaaaagctatgagagagtatcttaaaactatagatggttttaaggaaattgagattatagaaagactagataataatagaattaagaacaatagaggtggacaaaaataccttttagaaaaatatgataagatgatatggatggctgaagatatagttacagcatcaggttatttgcaatttatgaatgatgggttagaaatatataaagacaaaaatgagattttaagcataacaggatatggactaccaattattattcataatattgaatatgattcttatgttttgcaaagatttaatgcttggggtattggcatatggaaaaaaaaatatgatcaagtcaaatatataagcttggaagaatacattgagtttataaatgataatcagcaagtaaaagaatttgtaaaaagtggtgctgacatgcttaacatgcttgaattagaagtaagaaaacaaattgatgcttttgacattagagcgatgtattgtcaatttaaaaataatatgtatactgtttatccattaaaatcaatggtccaaaatataggtcatgatggtagtggggtgcattgtggagtaactgaaaagtttaatcataaagaggtatggggaaaaaaacggataattttggtatttaggggaggatataaaggtaaaaccaacattttcggtaaaagaaaaatttttggattttag

SEQ ID NO: 15188 - protein, 283 aa, Unknown
  Obtained from environmental sample
  misc_feature (1)..(283): Xaa is any amino acid
MKELAPIGLTVYGRLEHTKKAVEALQKNTLAKESKLYIFSDGPKYGDEEKVKAMREYLKTIDGFKEIEIIERLDNNRIKNNRGGQKYLLEKYDKMIWMAEDIVTASGYLQFMNDGLEIYKDKNEILSITGYGLPIIIHNIEYDSYVLQRFNAWGIGIWKKKYDQVKYISLEEYIEFINDNQQVKEFVKSGADMLNMLELEVRKQIDAFDIRAMYCQFKNNMYTVYPLKSMVQNIGHDGSGVHCGVTEKFNHKEVWGKKRIILVFRGGYKGKTNIFGKRKIFGF

SEQ ID NO: 15189 - DNA, 633 bp, Unknown
  Obtained from environmental sample
  misc_feature (1)..(633): n is a, c, g, or t
atgttgcatggtgattctgaaaacgtatataattacagaggaatacaaaatgggaacgatagtaaatggataggtgaattaaaagattaccaaacatggaaatttttatatgaatatttaattatattaggtcctgagaggtntgataaactcggatactcatacgaattaatgataaaaactcttgtagataataagccaaaacttttgaatatgagagatgaagattattcacatctgtgtgattttataaagatagatgaaaaaattagttatataaataatctgtttaaaattagtaattctactgataaaattaatttttctaaagattttaataaattctacgagagtatagaaaaattgaaaaccacaaatgaaaaatatatactttttggtgctggaacaattgggaatacactttataattttatgcctgatagtattatctgttttgttgatcttgatcaatccaaagtagataatataaatatttttcatccagaaaatttaaaaaatatgaagtatgataaaatcattataacagtttttggtagggaaaagagtatagagtctcatttgataaataaaatgggtattgaaaaaaataaaataacaacaattgttatataa

SEQ ID NO: 15190 - protein, 210 aa, Unknown
  Obtained from environmental sample
  misc_feature (1)..(210): Xaa is any amino acid
MLHGDSENVYNYRGIQNGNDSKWIGELKDYQTWKFLYEYLIILGPERXDKLGYSYELMIKTLVDNKPKLLNMRDEDYSHLCDFIKIDEKISYINNLFKISNSTDKINFSKDFNKFYESIEKLKTTNEKYILFGAGTIGNTLYNFMPDSIICFVDLDQSKVDNINIFHPENLKNMKYDKIIITVFGREKSIESHLINKMGIEKNKITTIVI

SEQ ID NO: 15191 - DNA, 531 bp, Unknown
  Obtained from environmental sample
  misc_feature (1)..(531): n is a, c, g, or t
gtgatctttaaaattgagggtcctacaaaacttccaacaggaagagactcacaaatgatgatgtttgatttaggatatggaacatttggaggcgggatacactaccgtccaaatattgagatcaaatataccattccagctactgaagttaccattgaagtaaaaacaacagccacaatctcaaaagatagtgaaagctttgagaaaatcgcatgtggctttgataaaaataatgacaaaatttacggtctcatggagtttgaattaacttctcttccaaatcctgataaaacggttattacagagtgttacatagagataaaaaataaaaatacaacaaaaagcaaagaagatatcagatacaacttagagtttgtagatattgaagagttaaactataacaatattcaaaatagagacagaattgagtttataggctatgaagtcagcagagatgatctacaaaataaaaaaacccataaattcatctttgacagttactcaatgctttgcgtagaccagatgcattaa

SEQ ID NO: 15192 - protein, 176 aa, Unknown
  Obtained from environmental sample
  misc_feature (1)..(176): Xaa is any amino acid
MIFKIEGPTKLPTGRDSQMMMFDLGYGTFGGGIHYRPNIEIKYTIPATEVTIEVKTTATISKDSESFEKIACGFDKNNDKIYGLMEFELTSLPNPDKTVITECYIEIKNKNTTKSKEDIRYNLEFVDIEELNYNNIQNRDRIEFIGYEVSRDDLQNKKTHKFIFDSYSMLCVDQMH

SEQ ID NO: 15193 - DNA, 702 bp, Unknown
  Obtained from environmental sample
  misc_feature (1)..(702): n is a, c, g, or t
atgaaaaacaaaattaaagagtttttaatgagatataaaatattaatagtagaagatgatcgtatcattgcgaaagatatagaaaaaacattaagtaaaaaaggctttaatgttattcaaatcacatctagtcatattgagacaatcaactttctagaaaataataaagttgatttaatccttatggatatcaatattaaaggagctattgacggaatacaaagttgtgatgaaataaatcaaaagtataatattcctataatatttattactgcatataatgatatagaaaccatatctttgattaaagacagctatgccgttggttacttgcaaaaaccttttaaatatgcagatttattgttaaatatatttttaatattgaagcataattctcatcaacctaaaatcattcaaaaacatattatttttcttcaaaatggatttcactattgtttagaaaagcgattgctttataaaaataatgtagaggtaaatttgtctcaaatagagaaagatatcttatttattttatgtaaaaataaaaataattttatttcttatgagcaactatttgaaaatgtttggaaaaatcaaaaattttgtattaataaaatacgaggttccatttttaggttgaaacataagggagtggatttaaatattataaaccataaagagtatggttataagatagagtaa

SEQ ID NO: 15194 - protein, 233 aa, Unknown
  Obtained from environmental sample
  DOMAIN (12)...(132): Response regulator receiver domain
  misc_feature (1)..(233): Xaa is any amino acid
MKNKIKEFLMRYKILIVEDDRIIAKDIEKTLSKKGFNVIQITSSHIETINFLENNKVDLILMDINIKGAIDGIQSCDEINQKYNIPIIFITAYNDIETISLIKDSYAVGYLQKPFKYADLLLNIFLILKHNSHQPKIIQKHIIFLQNGFHYCLEKRLLYKNNVEVNLSQIEKDILFILCKNKNNFISYEQLFENVWKNQKFCINKIRGSIFRLKHKGVDLNIINHKEYGYKIE

SEQ ID NO: 15195 - DNA, 846 bp, Unknown
  Obtained from environmental sample
  misc_feature (1)..(846): n is a, c, g, or t
ttggaaaattttaaagggcggatcaaagagaatccatacatcttaacctctattaacggtatcggttttaaaagggcagatgagttagcactcaaaatgggagttgatactaaaagtgaaaaccgcataagctctgctatggattttgtgcttcttgaagagtgcgagcgaaacggcaacagtgccattgaaaagagtaaacttttttcaaaactagatgagctnttaggttttcataactcagagattctctatgaatcgatcttagttatgatggtttcagaagagactatagtacatttagcccatgagaggctctctccaaaaagactctatgatgctgaaaaatatctctacgatcagtttaaaagccgttcctctcttaagtatgagaagatagagaaagatttagatacatttttagagaactccacacttaagttgggagaccagcaaaaagatgcagtccagatcataaacaacggctcaaaacttctctttttagtaggttatgcaggaacaggaaagagcactacttcccgcgctattttagatattttatgtaaaagatactctgctgaaaatattatgacttgtgcactgagtggaattgcatctcaaagaattgcagagacgacaggttatgagagtgcaaccatacagtcgcttcttatgaagtttgaagataaagatgagatgccgtactctgttgttttaatcgatgaagcctctatgattaactcatctttgtttgcaaggttagttgctaaaatctcttcaaaatccataatcattgttgtcggggatgatgctcaacttccccccattggtgcggaaatgtactaa

SEQ ID NO: 15196 - protein, 281 aa, Unknown
  Obtained from environmental sample
  misc_feature (1)..(281): Xaa is any amino acid
MENFKGRIKENPYILTSINGIGFKRADELALKMGVDTKSENRISSAMDFVLLEECERNGNSAIEKSKLFSKLDELLGFHNSEILYESILVMMVSEETIVHLAHERLSPKRLYDAEKYLYDQFKSRSSLKYEKIEKDLDTFLENSTLKLGDQQKDAVQIINNGSKLLFLVGYAGTGKSTTSRAILDILCKRYSAENIMTCALSGIASQRIAETTGYESATIQSLLMKFEDKDEMPYSVVLIDEASMINSSLFARLVAKISSKSIIIVVGDDAQLPPIGAEMY

SEQ ID NO: 15197 - DNA, 687 bp, Unknown
  Obtained from environmental sample
  misc_feature (1)..(687): n is a, c, g, or t
atgcagacactcataggtcaaatagataaaatattatttgaagatgagagttttttcatagctactttaaagagtggtgaaaagataagcggaagttactatgagagtagtatttcatccattttaggctctgctataactcttgagggcttctatgatgagcataaaaaatatggtaaaactttcaaatttgactctatcaaagtaaatcaaaatgaactcttcttttttttaaatcgtgtaattaaaggctttagtaaaaaactcactgctgatcttatagagaagtttacacaagagggtttagtagatattttagataatgatattgagaaacttttagagtttagcggcattaaagagaagcgtctgaagaagatacaagcctcatggagagagtttcgctccatgagagagattggtgagtttctaacaccttatggagtctcttcgaaactactgactacaatccgcactgctctaaaagatatgaaaaatataaaagagcgaatccaagagaatccatacatcttaacctctattaacgtatccggttttaaaaggccagatgagtaccccctcaaaatggggattgaaactaaaagtgaaaaccgcaaaagcccccgctatggaattttgtgcttcctgaaaagggccaagccaaaacggccacccttgcccctttaa

SEQ ID NO: 15198 - protein, 228 aa, Unknown
  Obtained from environmental sample
  misc_feature (1)..(228): Xaa is any amino acid
MQTLIGQIDKILFEDESFFIATLKSGEKISGSYYESSISSILGSAITLEGFYDEHKKYGKTFKFDSIKVNQNELFFFLNRVIKGFSKKLTADLIEKFTQEGLVDILDNDIEKLLEFSGIKEKRLKKIQASWREFRSMREIGEFLTPYGVSSKLLTTIRTALKDMKNIKERIQENPYILTSINVSGFKRPDEYPLKMGIETKSENRKSPRYGILCFLKRAKPKRPPLPL

SEQ ID NO: 15199 - DNA, 753 bp, Unknown
  Obtained from environmental sample
  misc_feature (1)..(753): n is a, c, g, or t
atgaaaaataaaggcgtagctgaacaagaaatagccaaacaacttttgcaagaaactgtggcttatgcagaatcggccatttgcagaagaaaacaattgctacattattttggtgaagattaccatcaggacaattgtaattgctgcgataactgtcttcatccaaaaaaacaattcgatgggaaagaatatattgaattggtaattaaagcagtattgcaggccaaagaactttttaaacctaaccacattattaatattctcatcggaaagaatacagcaagcctgaaatcatataaacacgatcatttagctgtgtttggaatgggctgcgaacatgatgagaaattttggaatgcagttattcgccaagcattaatcttaggtcttgttgaaaaagatatagagatgtatggcacacttaaagttcctcaacgaggccacacttttcttgaaaagccctatactgtatggcttacagaagatcatgattacgaaaaggaagaaggtactacaatacaggaaggggttattaagccgggttcaaccgacaaaatacttttcagtatgctgcaggatctcagaaaagatatttcaaaaaaggaaaatctgcccccatttgtaatctttcaggatccgtcgttggaagacatggcaatacaatatcccgtaacagttgaagaattaagaaacataaccgggcgtggagtaggaaaagccaaaaaatatggaaactccttttcctttcattaa

SEQ ID NO: 15200 - protein, 250 aa, Unknown
  Obtained from environmental sample
  DOMAIN (181)...(246): HRDC domain
  misc_feature (1)..(250): Xaa is any amino acid
MKNKGVAEQEIAKQLLQETVAYAESAICRRKQLLHYFGEDYHQDNCNCCDNCLHPKKQFDGKEYIELVIKAVLQAKELFKPNHIINILIGKNTASLKSYKHDHLAVFGMGCEHDEKFWNAVIRQALILGLVEKDIEMYGTLKVPQRGHTFLEKPYTVWLTEDHDYEKEEGTTIQEGVIKPGSTDKILFSMLQDLRKDISKKENLPPFVIFQDPSLEDMAIQYPVTVEELRNITGRGVGKAKKYGNSFSFH

SEQ ID NO: 15201 - DNA, 711 bp, Unknown
  Obtained from environmental sample
  misc_feature (1)..(711): n is a, c, g, or t
ttgaaacttcttggaataggtagtattttacttcaagttcttttgtgcagtgtaagtgctggcacaatggacaactttaatgagagctatcaaaatatctcttctgttaaacagagaaaactagtatttaaagatatacttcttccaaaaataaaaagtgttaacagagaaattttaaaagagagagattttgtaaaaaagtttttcaaatctcactatctaacttctagcatagacagataccatatttacaaactcaccaaacttgcaaaaaagtatagaatcaaaaacatctataatgaaaagtcttacctaaaaaaaatagccccgattcctgaagctttagcacttgcccaagcagcaacagagtctgcatggggaaaaagcagatttgcaaaagatgcaaataatatatatggtgaatggacatggggtaaaaaaggtattgtgccaaaaaaacgtgaaaatgggaaaaaacataaaataaagcttttctcatctctaagaaaatctattgcgtcatatatgttaaatctaaatagacataaagcatacaaaaagtttagagatttaagatactcattttatgaaaaaaacaaaaaattccgtggagttgatgctgctactactatgaacaactattcagcaataggtgaagagtacaataaaattttaaaaaaaattataagatccaatgggtgggataagtag

SEQ ID NO: 15202 - protein, 236 aa, Unknown
  Obtained from environmental sample
  SIGNAL (1)...(20)
  misc_feature (1)..(236): Xaa is any amino acid
MKLLGIGSILLQVLLCSVSAGTMDNFNESYQNISSVKQRKLVFKDILLPKIKSVNREILKERDFVKKFFKSHYLTSSIDRYHIYKLTKLAKKYRIKNIYNEKSYLKKIAPIPEALALAQAATESAWGKSRFAKDANNIYGEWTWGKKGIVPKKRENGKKHKIKLFSSLRKSIASYMLNLNRHKAYKKFRDLRYSFYEKNKKFRGVDAATTMNNYSAIGEEYNKILKKIIRSNGWDK

SEQ ID NO: 15203 - DNA, 357 bp, Unknown
  Obtained from environmental sample
  misc_feature (1)..(357): n is a, c, g, or t
gtgataactatgaatacgaacaaattggttattggaacaggttccactccatatcatccaagttggttacacggcacagagctgaaaaatgtttttagtgtacctaaagacaaaaactatctggacgacatgcaacaaaaactccagggatgtaataaaataattaccattggagcaggatttattggtgtagaactttctgatgagttaagaaaagcaggcaaagatgttttgttaattgaaaaacttccaaacattctcggtttagcatttgatgaagacatctcagttagagcccaggagttgctggttaatcgaggtataattttaaaaccggtgtggcgtgcgaaatcatga

SEQ ID NO: 15204 - protein, 118 aa, Unknown
  Obtained from environmental sample
  misc_feature (1)..(118): Xaa is any amino acid
MITMNTNKLVIGTGSTPYHPSWLHGTELKNVFSVPKDKNYLDDMQQKLQGCNKIITIGAGFIGVELSDELRKAGKDVLLIEKLPNILGLAFDEDISVRAQELLVNRGIILKPVWRAKS

SEQ ID NO: 15205 - DNA, 768 bp, Unknown
  Obtained from environmental sample
  misc_feature (1)..(768): n is a, c, g, or t
gtggttgccgattgtgatgttgatgcgtcgaacctacaccttattttacaaccgaaagactcggtaaaacatccatttttctgcggtgagctggctatattagatcaaaacctatgtatacaatgcggtaaatgtctggaggtgtgtcaatttgatgcagtacaacataactccgataaatatatcatcgacgacatcagctgtgaaggatgcggatattgttttgaggtttgcccatcaaaagccattaccatggagacccaacaggtgggaacatatagcatcagtaattccaaagtttctgcatctatggttgatgcaagtctttttgccggagcagaaaattcaggtaaactggtggcgaaagtaaaaaacgaagcaaaagaaaaagccaaagagttatcgtgtgatataattctagtagatggctctccgggcataggttgtccggtagtttcatcactctcgggtgcaagttatgtagtcattgttacagagcctaccatctctggttttcatgatctaaagcgtgttattagtctgattcaaaaattccaattgccgtcaggttgtatcatcaataaatatgacctcaacttcacagcatcaaaagagataaaaggctatttacaacaggaaaacatactccatctcggcgacataccataccatagcgttttttcggatgcaataaagcaaggaaaaacatttttgaaatgcaaaatccagagattacgaatttattaccccccctttgggaaaaattaa

SEQ ID NO: 15206 - protein, 255 aa, Unknown
  Obtained from environmental sample
  DOMAIN (31)...(229): CobQ/CobB/MinD/ParA nucleotide binding domain
  misc_feature (1)..(255): Xaa is any amino acid
MVADCDVDASNLHLILQPKDSVKHPFFCGELAILDQNLCIQCGKCLEVCQFDAVQHNSDKYIIDDISCEGCGYCFEVCPSKAITMETQQVGTYSISNSKVSASMVDASLFAGAENSGKLVAKVKNEAKEKAKELSCDIILVDGSPGIGCPVVSSLSGASYVVIVTEPTISGFHDLKRVISLIQKFQLPSGCIINKYDLNFTASKEIKGYLQQENILHLGDIPYHSVFSDAIKQGKTFLKCKIQRLRIYYPPFGKN

SEQ ID NO: 15207 - DNA, 444 bp, Unknown
  Obtained from environmental sample
  misc_feature (1)..(444): n is a, c, g, or t
atgttcgaacagacttttaaaaatattgatgatattcttcataaagatgctggctgtggtagtgaacttgattacgtagaacaaacgtcttggattttattcctaaaatatttggatgatttagaaaaagataaagagaccgctgctcttctaaccggtaaaacttacgaaaaaataattactgatcaatacagatggactacctgggctgctccaaaacttgccaatggtaagatagaccataatgctatgactggtgatgacctgattgatttcgtaaatggtgatcttttcccctatctaaagaaatttaaagctaatgcccaaagtgctgacaccattgaatacaaaatcggcgaaatctttcgtggattgaaaaacaggattcaaaggggatacaatctgcgagaagttggcaacctgaatgatgaactccgtttttag

SEQ ID NO: 15208 - protein, 147 aa, Unknown
  Obtained from environmental sample
  misc_feature (1)..(147): Xaa is any amino acid
MFEQTFKNIDDILHKDAGCGSELDYVEQTSWILFLKYLDDLEKDKETAALLTGKTYEKIITDQYRWTTWAAPKLANGKIDHNAMTGDDLIDFVNGDLFPYLKKFKANAQSADTIEYKIGEIFRGLKNRIQRGYNLREVGNLNDELRF

SEQ ID NO: 15209 - DNA, 714 bp, Unknown
  Obtained from environmental sample
  misc_feature (1)..(714): n is a, c, g, or t
ttgtatttaattgttgcttttgttgttgcatttagcttaaccttttttatatattttgaagatattaaaagtgatgctgtagagaaatttcaaaagcaaaattataatatggagatatatttacaagagttattaaaaaatacaacaattgataataattttgccaaaatagattcatctattaaaacatttttaacagttgagttttttaaagatatccaaattgattataaaaggtttgttttttcaaaaaaagctatacttattaattctaataaaataaataatgaaaaatacaaactaagtgatgtaacaacagactataagtttggtaaaatagtatctttaaatgaaaatagttatgaatttatcccaaatgtatattttgatattaaaacaccagttttgataaagtttcaagcttatgatgcaggagatgtttataactctacatcaactctaaacttttataagttagtggtaaacgagcagttaaatgaagatactaccacaacatcatggttagaaaatatcataagttttgatactattcaaaccaataaaaattttaaaattcagtatgatagtaaaccgtatgtagaagtgaaatatactcttaataaagcccctttaattgaacaaaacaaaacttttatcaaaaaaatatttatatattcttttagtttatttaaaaatactattattatattatag

SEQ ID NO: 15210 - protein, 237 aa, Unknown
  Obtained from environmental sample
  misc_feature (1)..(237): Xaa is any amino acid
MYLIVAFVVAFSLTFFIYFEDIKSDAVEKFQKQNYNMEIYLQELLKNTTIDNNFAKIDSSIKTFLTVEFFKDIQIDYKRFVFSKKAILINSNKINNEKYKLSDVTTDYKFGKIVSLNENSYEFIPNVYFDIKTPVLIKFQAYDAGDVYNSTSTLNFYKLVVNEQLNEDTTTTSWLENIISFDTIQTNKNFKIQYDSKPYVEVKYTLNKAPLIEQNKTFIKKIFIYSFSLFKNTIIIL

SEQ ID NO: 15211 - DNA, 360 bp, Unknown
  Obtained from environmental sample
  misc_feature (1)..(360): n is a, c, g, or t
atgcgacaagtagatagaacaaaaattatatttatatatattatactctctttggtgagtgttttttttattattggctgtgcatcaaaaagtgaatatacaagtacaactaaaagttttgataaaaatataacaaaagatcaacttttacatgctgtaaaaagagtttttactattacagataaagatgcttttattatagattcgtatagaaatgacctaaatgttacaaagccaaaagctgttcataaattatatactatggatatacaaaatgataactttaacttcaaagtagatgacaaccaaagcgaacctacaattaagggtacaatatctatatctagaacctatggatag

SEQ ID NO: 15212 - protein, 119 aa, Unknown
  Obtained from environmental sample
  misc_feature (1)..(119): Xaa is any amino acid
MRQVDRTKIIFIYIILSLVSVFFIIGCASKSEYTSTTKSFDKNITKDQLLHAVKRVFTITDKDAFIIDSYRNDLNVTKPKAVHKLYTMDIQNDNFNFKVDDNQSEPTIKGTISISRTYG

SEQ ID NO: 15213 - DNA, 513 bp, Unknown
  Obtained from environmental sample
  misc_feature (1)..(513): n is a, c, g, or t
atgataattggggtgagtatgaagagctgtccatggatgatgcactttcaagttttggaatctaagattaaaaattatgaagggatgttgatagaggtgaagtatctgtttactttcaacaaagtaaatataattccgacccctgcattagaagagtttgaagctgatttagagacatataactctaatcaagctacaagatatgatagagattttaactatcaagatgtaaaaaatatgcgtctatcgggcaagtttgtattttttggctggggacacaaatatgatagacaccatccgcaccttttccactatgcaaaatctatctcaatacaagcacaagcattaggcaaagctatagcttttgtatataatgagacaaaatcacttgaagagagcatagagagtgctagatactttcatcctgtatcttctggaaaaatcaaagctaaagtagcaaatgcaataaaaaaatcatttgaatcctcaccacctgttcctgtacagttttaa

SEQ ID NO: 15214 - protein, 170 aa, Unknown
  Obtained from environmental sample
  misc_feature (1)..(170): Xaa is any amino acid
MIIGVSMKSCPWMMHFQVLESKIKNYEGMLIEVKYLFTFNKVNIIPTPALEEFEADLETYNSNQATRYDRDFNYQDVKNMRLSGKFVFFGWGHKYDRHHPHLFHYAKSISIQAQALGKAIAFVYNETKSLEESIESARYFHPVSSGKIKAKVANAIKKSFESSPPVPVQF

SEQ ID NO: 15215 - DNA, 699 bp, Unknown
  Obtained from environmental sample
  misc_feature (1)..(699): n is a, c, g, or t
atgcaaatatttggtaaatttgaaacactacacaacttagagtatttaacggaacactatatctattttaataaagaagatgaagttattgatacaaaagagcttcaggtacttttgaaaaatagaagaaagaagattgccggtacaatttttctatacaatcctacatcagcaccaaaaggttatgatctaaatcgtaaactttcactgcaagattatgataattggggtgagtatgaagagcttgtcatggatgatgcacttcaagtttttgaatctaagattaaaaattatgaagggatgttgatagaggtgaagtatctgtttaacttcaacaaagtaaatataattccgacccctgcattagaagagtttgaagctgatttagagacatataactctaatcaagctacaagatatgatagagattttaactatcaagatgtaaaaaatatgcgtctatcgggcaagtttgtattttttggctggggacacaaatatgatagacaccatccgcaccttttccactatgcaaaatctatctcaatacaagcacaagcattaggcaaagctatagcttttgtatataatgagacaaaatcacttgaagagagcatagagagtgctagatactttcatcctgtatcttctggaaaaatcaaagctaaagtagcaaatgcaataaaaaaatcattttga

SEQ ID NO: 15216 - protein, 232 aa, Unknown
  Obtained from environmental sample
  misc_feature (1)..(232): Xaa is any amino acid
MQIFGKFETLHNLEYLTEHYIYFNKEDEVIDTKELQVLLKNRRKKIAGTIFLYNPTSAPKGYDLNRKLSLQDYDNWGEYEELVMDDALQVFESKIKNYEGMLIEVKYLFNFNKVNIIPTPALEEFEADLETYNSNQATRYDRDFNYQDVKNMRLSGKFVFFGWGHKYDRHHPHLFHYAKSISIQAQALGKAIAFVYNETKSLEESIESARYFHPVSSGKIKAKVANAIKKSF

SEQ ID NO: 15217 - DNA, 651 bp, Unknown
  Obtained from environmental sample
  misc_feature (1)..(651): n is a, c, g, or t
ttggctgaaaaattaagaacagacatactaaccggtgcaaataatgtatttgtactatttgaagatttaaaaaatggtgatgaaaagatggtttttttattgaatataaatcatttttcaaatattaatgatatttacggttttccagtaggtgatgaagttctaaaaagtataaaattactactcgatagacttatacataaagattctaaactgtatagattagactctgatcagtttgttatagtgagtgataatttagatattaaatatgcatcattttttgcaaatacccttctctcattttttaatgaaacaactatatctgcctcagatttagagttaaaattaacatttagcatcggcatagatcatggatgtacaaatgaggttataaataatgctaaagtcgctcttttggactctcgtaaaagcgggagaaataattttaaattttttgataagaattctgaggtcttaaaacagcaagagcgaatgtctatgtggatgcataaaattcaagatgcaatacatgaagatgagttagtgccatattttcagcccattgtaaataacacaacaggtgaagtagagaagtatgagtgtctagctagaataataaaagatgatgaggttcatattcctttttga

SEQ ID NO: 15218 - protein, 216 aa, Unknown
  Obtained from environmental sample
  DOMAIN (1)...(149): GGDEF domain
  misc_feature (1)..(216): Xaa is any amino acid
MAEKLRTDILTGANNVFVLFEDLKNGDEKMVFLLNINHFSNINDIYGFPVGDEVLKSIKLLLDRLIHKDSKLYRLDSDQFVIVSDNLDIKYASFFANTLLSFFNETTISASDLELKLTFSIGIDHGCTNEVINNAKVALLDSRKSGRNNFKFFDKNSEVLKQQERMSMWMHKIQDAIHEDELVPYFQPIVNNTTGEVEKYECLARIIKDDEVHIPF

SEQ ID NO: 15219 - DNA, 729 bp, Unknown
  Obtained from environmental sample
  misc_feature (1)..(729): n is a, c, g, or t
ttggtaacaaataatccttcatttttaagtcttaatactaatagataccttatcaatatacctgtaagtaatattacaaatacggtatttgaatctatgcaacaagatattacaatacttccttatgatatagaaaaaaaatatatttgtatctatatctatgataacacactcatgtgcgaaattaatcaaaaacttgaaaaggcaaatgaagagcttgtagatatgtcccatagggaccctttaacacagatttttaatagaagatacttctcagaacaatctaaaaaaataaaatctttctcacaaagaaataataatataccatttagcattataactttagatattgataaatttaaaaaaatcaatgatacctatggacatcttgttggagatgaagtaattataaaagttgcacatattattgaagcagaggtaagaacaagtgatattgttgcaagatttggtggtgaagagtttgtgatgttacttcaagattgtaatctagatgatgcatataaggtagctgaaaaggttagagaagatatagaaaaaacatctattagtgttcatatcgatacagaggtgaaatttactgttagtattggtgtagctcaatttagtgaagtagataataacaatatagaacttaccctctcaagagcagatgaagcactttataaagccaaaaatatagggagaaataaaactgtagtatcaaactaa

SEQ ID NO: 15220 - protein, 242 aa, Unknown
  Obtained from environmental sample
  DOMAIN (73)...(237): GGDEF domain
  misc_feature (1)..(242): Xaa is any amino acid
MVTNNPSFLSLNTNRYLINIPVSNITNTVFESMQQDITILPYDIEKKYICIYIYDNTLMCEINQKLEKANEELVDMSHRDPLTQIFNRRYFSEQSKKIKSFSQRNNNIPFSIITLDIDKFKKINDTYGHLVGDEVIIKVAHIIEAEVRTSDIVARFGGEEFVMLLQDCNLDDAYKVAEKVREDIEKTSISVHIDTEVKFTVSIGVAQFSEVDNNNIELTLSRADEALYKAKNIGRNKTVVSN

SEQ ID NO: 15221 - DNA, 372 bp, Unknown
  Obtained from environmental sample
  misc_feature (1)..(372): n is a, c, g, or t
gtgacacaaattttagtaaatacttcttctaaatcttctaaaaaattgaaggaacaagctaacatagcagcacgaaaattagcctataacaaaaaattgaaaactgaaaacaatgagccgtttttgctgaacgaactacaaacacatactgttagcaaatgctggggattaataaaaaaacaagtgtcggtttattgtttagtattagaaactactcccgaagcttttgatatggaaaaaatacaacaagaaatacaacattatttaatagaaaaccaaccgtttactcaaaagaaaaaacacggaacgggcataatggtaagtaaacgcaaaaacattttacgtattacgcttgtaagtatggcggtgtag

SEQ ID NO: 15222 - protein, 123 aa, Unknown
  Obtained from environmental sample
  misc_feature (1)..(123): Xaa is any amino acid
MTQILVNTSSKSSKKLKEQANIAARKLAYNKKLKTENNEPFLLNELQTHTVSKCWGLIKKQVSVYCLVLETTPEAFDMEKIQQEIQHYLIENQPFTQKKKHGTGIMVSKRKNILRITLVSMAV

SEQ ID NO: 15223 - DNA, 360 bp, Unknown
  Obtained from environmental sample
  misc_feature (1)..(360): n is a, c, g, or t
atgaaactaccccatttagaccctttaatttttgctaaaaaaattatccaaaaagatgaaaataattctattgtattttgtgaatttaaagagataccaactttgacaactttcatagaagcttctgcacaaggaagttcatcttttgtagatcaaagtaaaccaaagttaggttttttagctacagttaaaaatattgaacaacataaagaatttgatagtttacaatatcatattcacttaaaattagaagctcaaattgcagaatttaagcaatttcattttgaagtatttaatctttctaatacaacagaatcatatatttctggtaactttagtgttattataaaagaagcgtaa

SEQ ID NO: 15224 - protein, 119 aa, Unknown
  Obtained from environmental sample
  misc_feature (1)..(119): Xaa is any amino acid
MKLPHLDPLIFAKKIIQKDENNSIVFCEFKEIPTLTTFIEASAQGSSSFVDQSKPKLGFLATVKNIEQHKEFDSLQYHIHLKLEAQIAEFKQFHFEVFNLSNTTESYISGNFSVIIKEA

SEQ ID NO: 15225 - DNA, 630 bp, Unknown
  Obtained from environmental sample
  misc_feature (1)..(630): n is a, c, g, or t
gtggataacaaaaataaattttcaattttaaatatagatgataagaacttacaaaacttatcaacattagggtatacctatatgacccctatacaagaaaaaagtttgccaattattttagaaaaacaagatgttataggaaaagcaaaaacagggagtggaaaaactgtttcatttggtttgggtattttaaataacttagatagtacaaatttcagaattcaatcgttggtgctttgccccacaagagaactagcaacacaagtagctaatacattgaaaaatttagcaagatataaacataatataaaaatacttacacttacaggaggagtaccatacaaaccacaagtacattcactttctcatcaagcacatattattgtagggacacctgggagaattttaaagcatcttactgaagataatttttcttgcgaatctatcaatactcttgtattagacgaagcagatagaatgttagatatgggttttaccgaagatataaatttaattattgattatcttccaaaaaaacgacaaacgatgcttttttctgcaacatacccagaaactatagaggaactttcaaagactattttacaaaaccctataacgtgtggaggttga

SEQ ID NO: 15226 - protein, 209 aa, Unknown
  Obtained from environmental sample
  DOMAIN (28)...(196): DEAD/DEAH box helicase
  misc_feature (1)..(209): Xaa is any amino acid
MDNKNKFSILNIDDKNLQNLSTLGYTYMTPIQEKSLPIILEKQDVIGKAKTGSGKTVSFGLGILNNLDSTNFRIQSLVLCPTRELATQVANTLKNLARYKHNIKILTLTGGVPYKPQVHSLSHQAHIIVGTPGRILKHLTEDNFSCESINTLVLDEADRMLDMGFTEDINLIIDYLPKKRQTMLFSATYPETIEELSKTILQNPITCGG

SEQ ID NO: 15227 - DNA, 414 bp, Unknown
  Obtained from environmental sample
  misc_feature (1)..(414): n is a, c, g, or t
ttgatggctcgctggcgtatttacaccgagaatttcaaaaatgtagttattaattttaatttttctaaagaagagaagattttagctcctctcaatgtttcattatttagttgggtaatagaaaatctgattaaaaatgctgttgatgcgatgcaaggtggtggaaccatagatattttcatgatagaccaaaaacaatttgtttatatagatattagtgatactggacatggcatttcgaaatctaaacaaaaaaccatttttgagcctggttttactactaagaaaagaggttggggactaggactttctctaaccaaacgtattattgagaactaccataacggaaaaatttttgtaaaacaatctagtgaaaaaggcactacctttagaattgtgcttaaaaaatattaa

SEQ ID NO: 15228 - protein, 137 aa, Unknown
  Obtained from environmental sample
  DOMAIN (31)...(137): Histidine kinase-, DNA gyrase B-, and HSP90-like ATPase
  misc_feature (1)..(137): Xaa is any amino acid
MMARWRIYTENFKNVVINFNFSKEEKILAPLNVSLFSWVIENLIKNAVDAMQGGGTIDIFMIDQKQFVYIDISDTGHGISKSKQKTIFEPGFTTKKRGWGLGLSLTKRIIENYHNGKIFVKQSSEKGTTFRIVLKKY

SEQ ID NO: 15229 - DNA, 453 bp, Unknown
  Obtained from environmental sample
  misc_feature (1)..(453): n is a, c, g, or t
atgtctggaatttatattcatatccccttttgcaggaagaaatgtagctattgcgattttcatttttccaccagtttaaaacataaaactgagttattagctgctctgcaaaaagaaatagaattaaagcaaaagctttttgagaaagaaactgttaatactatttattttggaggaggaacgccttccatattgaacgaagtggaattaaatcagttggtagaaactattcataacaattacaatgttgatgaaaatatggagtttaccgtagagtgtaaccctgatgatattacaactaaaaaattaaatgagtataaaaaaattggcgtaaataggctaagtttaggagttcaatctttttttgatgacgatttgcaattttttaatcgtgcccacaatgctaacgaagcagaacaaagtattttaaaaacgcaagatacctggaattga

SEQ ID NO: 15230 - protein, 150 aa, Unknown
  Obtained from environmental sample
  misc_feature (1)..(150): Xaa is any amino acid
MSGIYIHIPFCRKKCSYCDFHFSTSLKHKTELLAALQKEIELKQKLFEKETVNTIYFGGGTPSILNEVELNQLVETIHNNYNVDENMEFTVECNPDDITTKKLNEYKKIGVNRLSLGVQSFFDDDLQFFNRAHNANEAEQSILKTQDTWN

SEQ ID NO: 15231 - DNA, 471 bp, Unknown
  Obtained from environmental sample
  misc_feature (1)..(471): n is a, c, g, or t
ttgtttttttcaacatttaagtatggaaatttaaaatcagtatttaagtttaatacaaaaaatattgatataaatacttgtaaagaaaacaattacagttttcttcttataaccggtattgcaaaaaccgatgatcttaaaatgtatttaaacgaattttctgaagaaataattcatctaaaatatttcgatcatcattattactcaaaaaaagatattcaaaatattgtaagaaaatttaattcaattgaaaacaaaaataaaattattattacaacagaaaaagatgcaatgcgcataaaagaatctccggaattaaatcaacatgaagaaataaaatcattatgctattatattcccattgaagtagaattcttaaatgatcatcaggacgatttcgataaattaatattacgttatgtttgcaaagacaaaaaacccaatattttaaaaataaaaacaatcaattaa

SEQ ID NO: 15232 - protein, 156 aa, Unknown
  Obtained from environmental sample
  misc_feature (1)..(156): Xaa is any amino acid
MFFSTFKYGNLKSVFKFNTKNIDINTCKENNYSFLLITGIAKTDDLKMYLNEFSEEIIHLKYFDHHYYSKKDIQNIVRKFNSIENKNKIIITTEKDAMRIKESPELNQHEEIKSLCYYIPIEVEFLNDHQDDFDKLILRYVCKDKKPNILKIKTIN

SEQ ID NO: 15233 - DNA, 744 bp, Unknown
  Obtained from environmental sample
  misc_feature (1)..(744): n is a, c, g, or t
atgagtgcagaacttatgtttattaaaaatgcacttgataaacttggaattgaaccacaaattattcgcggaaaaaataataaattcaaaagtgctgttgagccattaattcgtgaaaacatgagtgatgcaaacagaaaacaaacagaaacttatatgggttcaatttggaatcatattcttgaaggtattgctacggaaagaaatctaacagttgagaagttaaatgaatatgctgacaacatgatgattacaaatccgaaaacagcaatagagtataaaatgatggatggctcaaaatataaagatgaaattttaagcgaattaaaaaaactttctgaaattgatgaggatgaagatttaaaattcatttctttaaataaatacacgaaagtagctgatagtaattcaaatgaaaatttaggtgccaagaaagataaaattgctgtaatttatgctaccggcgaaattataatgngagaaggagacggagaaaccatgggtgcagataaaatttcaaaagctattcgtaaagcaaggctcgataaaaaagttaaagcaattgttttaagagtaaactcaccgggggggaagtgctttggcttcggaaattatatggcgcgaagtagttcttgcacaaaaagagaaacctgtagtagcttcatttgggaatgttgctgcaccaggtggaaattatattgcctgccgagcccgatactattggtgccagggaaaatacaataa

SEQ ID NO: 15234 - protein, 247 aa, Unknown
  Obtained from environmental sample
  DOMAIN (1)...(116): Peptidase family S49
  misc_feature (1)..(247): Xaa is any amino acid
MSAELMFIKNALDKLGIEPQIIRGKNNKFKSAVEPLIRENMSDANRKQTETYMGSIWNHILEGIATERNLTVEKLNEYADNMMITNPKTAIEYKMMDGSKYKDEILSELKKLSEIDEDEDLKFISLNKYTKVADSNSNENLGAKKDKIAVIYATGEIIMXEGDGETMGADKISKAIRKARLDKKVKAIVLRVNSPGGKCFGFGNYMARSSSCTKRETCSSFIWECCCTRWKLYCLPSPILLVPGKIQ

SEQ ID NO: 15235 - DNA, 459 bp, Unknown
  Obtained from environmental sample
  misc_feature (1)..(459): n is a, c, g, or t
atgaatttcaagcaactttttttatccgtattattgatacttactattgttttatctatcaatgctcaaaatggaactattagaggatttatttataatgaaaaaacaggtgaatctgaaattggtgctacagcctatttaaaaggcactactatgggggccgcttcagatgttaatgggttttattctattaccaaaattccagcaggaaattatactttaatggttacttctttaggttttgacaccgttaaaattgctatttctataaaagcagatgaaattattaatcagaaagtatatttaaaagagggttcttttaatgtaaaatactttgaactttcagcagaaaaacaagaagcaagaactgaagtgaaaatgtcggtttctaaagtaacgcccaaagaaataaagtctatggtttcaattggtggaaacctgaatatcgctcaatattta

SEQ ID NO: 15236 - protein, 153 aa, Unknown
  Obtained from environmental sample
  SIGNAL (1)...(19)
  misc_feature (1)..(153): Xaa is any amino acid
MNFKQLFLSVLLILTIVLSINAQNGTIRGFIYNEKTGESEIGATAYLKGTTMGAASDVNGFYSITKIPAGNYTLMVTSLGFDTVKIAISIKADEIINQKVYLKEGSFNVKYFELSAEKQEARTEVKMSVSKVTPKEIKSMVSIGGNLNIAQYL

SEQ ID NO: 15237 - DNA, 453 bp, Unknown
  Obtained from environmental sample
  misc_feature (1)..(453): n is a, c, g, or t
atggcagtaattggaaaaattaggaaacactcaggattattggtaatagttattggagttgcattggcagcttttgttttaggcgatttctctaaaactcaaacaaaaaataccgataccattggtgagattaatggcgaaaaagtttcatatcgcgaatttattaataaactcgaacaaaacattgaatacgaaaagcaacgtgtaggtaagcaaaaccttactgctaatgaaagttttagtgttcgacaaatgacatggaatcaatatttgaatgatattattatgggcaaagagtatgctgctattggccttgaggtttcatcagatgaattgtttgagttggttcagggaaataagccacatcgatttatcatgcaatatttttcaaaccctaatacaggtgagtttgatagaaatgtgggttttaaactttttacaaaacatcgataa

SEQ ID NO: 15238 - protein, 150 aa, Unknown
  Obtained from environmental sample
  misc_feature (1)..(150): Xaa is any amino acid
MAVIGKIRKHSGLLVIVIGVALAAFVLGDFSKTQTKNTDTIGEINGEKVSYREFINKLEQNIEYEKQRVGKQNLTANESFSVRQMTWNQYLNDIIMGKEYAAIGLEVSSDELFELVQGNKPHRFIMQYFSNPNTGEFDRNVGFKLFTKHR

SEQ ID NO: 15239 - DNA, 786 bp, Unknown
  Obtained from environmental sample
  misc_feature (1)..(786): n is a, c, g, or t
gtggaagtctttaaaatagcaaaacaaaaaatattaagtgaaaaaacttttttacacaatgtgaatcgagatattttagaagaaaaaatacaaaaattaaaagaaaaattagagactgaaaaagcatcattacaagctttaagtaaagaacttattcaattaaagcaggattcaaaagaagtaacaacaattaaagaaaaagaacaactgctttatgaaataaaaggaatgattaaaaaaaatattcaaacgataattgagtatgaagaaaaatcatctaatgatgctcaaatagaagctctacaacaagaattggaaatattagaaaaagaactagttaaaatagatataaaaaagaaaaaacaagaagcagaattgtatataggcaaatactctactgatatgcttaaaacattgccttttgataaaagtgattatggtgatccaaatttgaaatttgatataaaagatgtgacagcttatcaacaatctacaaataacatattctatttatcagatattggtagtgctgaaaatcatttatcatttcatttatctatattcttagggcttcataaatatattttggaacataatcaatcaatactaccgtctttaatatttttagatcaacccagtcaagtttattttcctaaagaagaagattttaaggatggaaccggtgatattaagaaagttgaagatatgtataaatccataattaaatttattgaggatgcaaataaaacttcaatgtttaataaaatcccaaattattgtagttga

SEQ ID NO: 15240 - protein, 261 aa, Unknown
  Obtained from environmental sample
  misc_feature (1)..(261): Xaa is any amino acid
MEVFKIAKQKILSEKTFLHNVNRDILEEKIQKLKEKLETEKASLQALSKELIQLKQDSKEVTTIKEKEQLLYEIKGMIKKNIQTIIEYEEKSSNDAQIEALQQELEILEKELVKIDIKKKKQEAELYIGKYSTDMLKTLPFDKSDYGDPNLKFDIKDVTAYQQSTNNIFYLSDIGSAENHLSFHLSIFLGLHKYILEHNQSILPSLIFLDQPSQVYFPKEEDFKDGTGDIKKVEDMYKSIIKFIEDANKTSMFNKIPNYCS

SEQ ID NO: 15241 - DNA, 510 bp, Unknown
  Obtained from environmental sample
  misc_feature (1)..(510): n is a, c, g, or t
atgaaattagataccataacaaagcaagtagtaaacctcagcaaggcagtgggtcaaataatcaaaaatgaatctgttaaactaaagtcttcagatattgagtcgaagggtatccacaattttgttacttatgtagataaactttcagaaaaaataatagtagaggagttaggaaaaatacttcctgaagcaggatttattgcagaggaagattcaagtttagaggtatctgataagtacaattgggtgattgatccgctcgacggcacaacaaatttcatccatgggcttcctccacatgcaatatcaatagcactagtggataaggaagaacccataataggtgttatttttgaaattaactcaggtgagtgtttctatgcatggaaaggtggccccgcattccttgatgggaaggaaattaatgtttcccctacctccttttttaatgactcatttatagcaactggttttccctattatgactttgataaactccccaatacatga

SEQ ID NO: 15242 - protein, 169 aa, Unknown
  Obtained from environmental sample
  DOMAIN (2)...(169): Inositol monophosphatase family
  misc_feature (1)..(169): Xaa is any amino acid
MKLDTITKQVVNLSKAVGQIIKNESVKLKSSDIESKGIHNFVTYVDKLSEKIIVEELGKILPEAGFIAEEDSSLEVSDKYNWVIDPLDGTTNFIHGLPPHAISIALVDKEEPIIGVIFEINSGECFYAWKGGPAFLDGKEINVSPTSFFNDSFIATGFPYYDFDKLPNT

SEQ ID NO: 15243 - DNA, 759 bp, Unknown
  Obtained from environmental sample
  misc_feature (1)..(759): n is a, c, g, or t
atgttaaaattcaacggccatgatgaaacaaaacagtttaactccctatatgaagctattggggataattttaaacgacttattacactagatagtgatatagaagatttttcaaaacattatgacaaactcaattggaaaatacttttttcaagtatagcagggagtttggaagaagaacataccacaagactactacaacatatagctagtgaaattggctttcatacagagtttgcctatgtggaagatgtggagtttagtgatgatggagtttcagtgaatgatgaactctatgagttctggtttaaacttgtcccttgggaagagatagggatacaagagggggaattagcggtaatcttaacagggataatcaacgataaaaaagcaattttattaaatcctgcttatactctactattccaaagtaaagggatgatgaagatactttgggatctctttccaaatcatccactacttcttgaaacatcatttgaaccactccaaaataagaaacaagtagagaagatgtgttttggaagagagggagctaatgttgctatagtaaatgcagataactctcttgagcttaaaacagagggtgaatacgatagctttaaacctatctatcaagagtatgtagagttttcacaagatagtgaaggtaaatactaccaagctggagtgtttcactcttatgaagcgtgtggattaggctttaaaaaagggggaaagatactaaataataccggctaa

SEQ ID NO: 15244 - protein, 252 aa, Unknown
  Obtained from environmental sample
  DOMAIN (1)...(251): Glutathionylspermidine synthase
  misc_feature (1)..(252): Xaa is any amino acid
MLKFNGHDETKQFNSLYEAIGDNFKRLITLDSDIEDFSKHYDKLNWKILFSSIAGSLEEEHTTRLLQHIASEIGFHTEFAYVEDVEFSDDGVSVNDELYEFWFKLVPWEEIGIQEGELAVILTGIINDKKAILLNPAYTLLFQSKGMMKILWDLFPNHPLLLETSFEPLQNKKQVEKMCFGREGANVAIVNADNSLELKTEGEYDSFKPIYQEYVEFSQDSEGKYYQAGVFHSYEACGLGFKKGGKILNNTG

SEQ ID NO: 15245 - DNA, 504 bp, Unknown
  Obtained from environmental sample
  misc_feature (1)..(504): n is a, c, g, or t
ttggataaaaacacgcttatttgggatgattactacaaaattggcaaaccaattattacctctccgctacgatttatattatccaatcctgctttaaagtttgcttactttttagccatctttagcttattggtttatattatttttaacattaaaagaaggcaacggattattcctgttatagaacctttaagcaatgctaccacagattttgtagacgtggtttcgcagatgtattaccatcaaaaaaatcatttggatttggctaataaaaaaatcatttatttcctcgaaaatgtaagaaccaactacttgctcaacacccaagaattagatagcaattttaagaaacaactggcaagaaaatcaggaatagatatgaaatttgccgatgaacttattaacgaattcaatactattttgaacaaaaaatcgcttactgaaatagaattattacatttaaatcaattaattaacgcttttcataaaaacaaaatacgataa

SEQ ID NO: 15246 - protein, 167 aa, Unknown
  Obtained from environmental sample
  misc_feature (1)..(167): Xaa is any amino acid
MDKNTLIWDDYYKIGKPIITSPLRFILSNPALKFAYFLAIFSLLVYIIFNIKRRQRIIPVIEPLSNATTDFVDVVSQMYYHQKNHLDLANKKIIYFLENVRTNYLLNTQELDSNFKKQLARKSGIDMKFADELINEFNTILNKKSLTEIELLHLNQLINAFHKNKIR

SEQ ID NO: 15247 - DNA, 639 bp, Unknown
  Obtained from environmental sample
  misc_feature (1)..(639): n is a, c, g, or t
atgcttaatgttcaattattactgcgttactttatattgctatgtctgcttagtctgcagctaaatgttttcagtaatgatacgctaaaaataaaagttgactcttcaagtactattgatgtaaaaaaagtagctgacgaatctattgaaaaatacacaaacgataaagaatttttatacgaccgtactccaccaccggcagagtctccttgggaagcttttaagcgatggttaaataagctttttaataaatatgtaagcaataatcttcctcccattttttgggatattttaatttggactattgttgctgcttcaattatattaatcatttatcgactatttcgacatgaaataaaaagtgtgtttagaggcaaagcagcaagtaaccaagtggcttttattcgtgaagatgaaaacatccatgaaatggattttaaccaacttattaccaatgccattactcaaaaagattataagaatgccattcgcttatcttatttaaagctattaaaaacccttacagatgaagatttaattacctggaaagctgacaaaacccatttagattatattgcccgaattagaacaatctcctctaccaactcccttttagaaaaaactaccattgttttttga

SEQ ID NO: 15248 - protein, 212 aa, Unknown
  Obtained from environmental sample
  misc_feature (1)..(212): Xaa is any amino acid
MLNVQLLLRYFILLCLLSLQLNVFSNDTLKIKVDSSSTIDVKKVADESIEKYTNDKEFLYDRTPPPAESPWEAFKRWLNKLFNKYVSNNLPPIFWDILIWTIVAASIILIIYRLFRHEIKSVFRGKAASNQVAFIREDENIHEMDFNQLITNAITQKDYKNAIRLSYLKLLKTLTDEDLITWKADKTHLDYIARIRTISSTNSLLEKTTIVF

SEQ ID NO: 15249 - DNA, 534 bp, Unknown
  Obtained from environmental sample
  misc_feature (1)..(534): n is a, c, g, or t
gtgaatacacataatttcagaataaataaatttatgctagaaaaagtccattttgatgaagctcgacaatcacagctcccatttattgagctgcttttgaatatgggatatcaatatatctccacgggggatgcaatgaaacaaagaggggaagatccgactaatttcattctttctgagatcgcaaacaagaagctcatggaaatcaacgactatgagattgatggaaattctcataaatttagtgaaaaagatgttcatgatgcagttgatgaactcggaaatgtgcaatatgaaggactgattgatacagcgcagaagatacacaacactatcatgccaaccaaaggaggcaagactatcaaagtgagccacagtggcaaaacaagttcgcataattttagatttattgattttgaaaatcctttgaacaacgtttttcatgttactgctgaatttgaagcgactggaaaaaagaacattcgggccgatattgtttgttttggtgaacgggatccctttcgccgggattga

SEQ ID NO: 15250 - protein, 177 aa, Unknown
  Obtained from environmental sample
  misc_feature (1)..(177): Xaa is any amino acid
MNTHNFRINKFMLEKVHFDEARQSQLPFIELLLNMGYQYISTGDAMKQRGEDPTNFILSEIANKKLMEINDYEIDGNSHKFSEKDVHDAVDELGNVQYEGLIDTAQKIHNTIMPTKGGKTIKVSHSGKTSSHNFRFIDFENPLNNVFHVTAEFEATGKKNIRADIVCFGERDPFRRD

SEQ ID NO: 15251 - DNA, 753 bp, Unknown
  Obtained from environmental sample
  misc_feature (1)..(753): n is a, c, g, or t
atgaaaattattttacttattttttttcttttattaagtttctcttttgcaaatgatagagagttagaagctatatttaaaaaatctaatataaatggtacacttgtattaagcagtttagataacaaagaaaactatatatacaatacaaaaagagccttaacacaatatatcccagcttcaacatttaaaataccaaatacacttatagcacttcaagagcaagtgataaaagatgagtatgaaactataaaatgggatggagtagttcgaacttataaaccttggaatgaaaaccaaaaccttcaaacagcaatagctgtatcgtgtgtatggtgttatgaaaagtttgcacaaaaaataggaaaagagaactatttagaatatttacaaaaaatagactatggaaaccataaagtaggtgatgttgtctcaaagttttggttagagggagatataaaaatatctgcagtacaacaaatagagtttctacaaagactctataaaaatcaattaccatttgaacaaaaatatatagatatcacaaaaaagatattgatagttgaacaaaatgagaactataccattagagtaaaatctggttggtcaggaacaataggttggtatgttggttatatccaaaaagcaaatacagtttggttttttgcttttaatggtgatataaatagagaaaaattaatctatagaaaacaaatagttatggaagctttaaaaataaaaggtattttatag

SEQ ID NO: 15252 - protein, 250 aa, Unknown
  Obtained from environmental sample
  SIGNAL (1)...(17)
  DOMAIN (33)...(245): Penicillin binding protein transpeptidase domain
  misc_feature (1)..(250): Xaa is any amino acid
MKIILLIFFLLLSFSFANDRELEAIFKKSNINGTLVLSSLDNKENYIYNTKRALTQYIPASTFKIPNTLIALQEQVIKDEYETIKWDGVVRTYKPWNENQNLQTAIAVSCVWCYEKFAQKIGKENYLEYLQKIDYGNHKVGDVVSKFWLEGDIKISAVQQIEFLQRLYKNQLPFEQKYIDITKKILIVEQNENYTIRVKSGWSGTIGWYVGYIQKANTVWFFAFNGDINREKLIYRKQIVMEALKIKGIL

SEQ ID NO: 15253 - DNA, 513 bp, Unknown
  Obtained from environmental sample
  misc_feature (1)..(513): n is a, c, g, or t
ttggcaactttagtaaatgaatcattactaaatatgataaaaagagatggtaattcagttttggaagaagatatatctatagcaaaacaaaaaatacaacatggtaaaaaacagatacacctactaaatatagaacaaaaagatatcttagcaacttatcaagcaggaaaagcatttatcacaaaagcaaaagtaaatctttttgaaaatgggatagtgcaagaggatttaatttatccatcacttacacaactacaaagtcagattaaaaaatatttagctggtagtatcgctttagaggtgataaaaggtgaatcatatatagtttttgaagatgagataaaagaggcttataaaatagctcataatctagtagaagtgtataagatgaaaaattcacagcaaagtgtgatacaaaaagcaaaagatgatttaaaagatgaaatatctgcaaatattgaagttgtaaaagagttaaaagagaaacttttaaaggatgaagttgtattttag

SEQ ID NO: 15254 - protein, 170 aa, Unknown
  Obtained from environmental sample
  misc_feature (1)..(170): Xaa is any amino acid
MATLVNESLLNMIKRDGNSVLEEDISIAKQKIQHGKKQIHLLNIEQKDILATYQAGKAFITKAKVNLFENGIVQEDLIYPSLTQLQSQIKKYLAGSIALEVIKGESYIVFEDEIKEAYKIAHNLVEVYKMKNSQQSVIQKAKDDLKDEISANIEVVKELKEKLLKDEVVF

SEQ ID NO: 15255 - DNA, 747 bp, Unknown
  Obtained from environmental sample
  misc_feature (1)..(747): n is a, c, g, or t
atgatgaaaggtatgcaagatgagttgaataaagtaaaacaacaaaaaattcttgctttaggagataagattactgatgaaaaacttaaagagatacttgctttaagaaatagaattgaaaaaatagccattaaagatgccaagctaagaacatttatcactcaagatgatgatagaaatgatttggtaacacacgtttatgacattacttatggctctgtaaaaccaactgataacttggttattattgatgattctattgtaagaggtactactttaaagcaaagtatcttaagaattttagacaggttaaacccaaagaaaatcgttgttgtttcttctgctccacaaattcgttatccagattgttatggtattgatatggctaaattaggcgattttattgcatttcaggcagcaattgctttattacaagataccaatcaacaacatattttagagaaagtttataaaaaatgtgttgaacaacaagacttgcccaaagagcaaattaaaaattatgtaaaagaaatttatgctccttttaatgcagatcaaatttcaaaaaaaattactgagttactaactcctgaaggcatgaatgcagaagttgatattgtttttcaaacgattgaaggcctgcatgatgcttgccctaaccatacaggcgattggtattttacaggaaattatcctactccaggaggtaataaagtggtaaataaagcacttattaattatttttga

SEQ ID NO: 15256 - protein, 248 aa, Unknown
  Obtained from environmental sample
  misc_feature (1)..(248): Xaa is any amino acid
MMKGMQDELNKVKQQKILALGDKITDEKLKEILALRNRIEKIAIKDAKLRTFITQDDDRNDLVTHVYDITYGSVKPTDNLVIIDDSIVRGTTLKQSILRILDRLNPKKIVVVSSAPQIRYPDCYGIDMAKLGDFIAFQAAIALLQDTNQQHILEKVYKKCVEQQDLPKEQIKNYVKEIYAPFNADQISKKITELLTPEGMNAEVDIVFQTIEGLHDACPNHTGDWYFTGNYPTPGGNKVVNKALINYF

SEQ ID NO: 15257 - DNA, 465 bp, Unknown
  Obtained from environmental sample
  misc_feature (1)..(465): n is a, c, g, or t
atgaaattaaaaagctttaaaatattttataagcaactaaaggaggcagttcttttttatgtaataaaaaatgcaccacacttttctaaacataacttagtttccatatcgacaacaaatggtatanctatggcagtaccagtggaaatagaagcaaatatgtcaaagataaaaaatgtactttcaaagtcaggaactagcttccctctttttctaaaaataaattcagaagagattccaacaatagatatcacactaagtattcaaaatatgatagatcaaatacttaatggatatcgtcctaataagcatgaccgaaatactattgttatatttgatgaactggttcaaaatatacttgctaaagcagtacattctaaggaaattgttttattgtcggataagaaaaaaatacattttaagaataatgaagatgagatagaggtagttgaagatgaagcataa

SEQ ID NO: 15258 - protein, 154 aa, Unknown
  Obtained from environmental sample
  misc_feature (1)..(154): Xaa is any amino acid
MKLKSFKIFYKQLKEAVLFYVIKNAPHFSKHNLVSISTTNGIXMAVPVEIEANMSKIKNVLSKSGTSFPLFLKINSEEIPTIDITLSIQNMIDQILNGYRPNKHDRNTIVIFDELVQNILAKAVHSKEIVLLSDKKKIHFKNNEDEIEVVEDEA

SEQ ID NO: 15259 - DNA, 1014 bp, Unknown
  Obtained from environmental sample
  misc_feature (1)..(1014): n is a, c, g, or t
atgcaacacnatagttttaaatcaaatcaaactgccacgcaagcattagatgatagctttcgcaggtatcttgaaaacgaaaagtctttagtcgttggtataaacataggtatccttatgaattatgtggaagaaggtgacgtagatctagcaagtataaaagaacatataaaagcttttttagaatctaatgaaaatacaaataacaccttctttattaattttgacgattactcaaaatttgagtttgatgattctatagtgtcatcaccatttatacaaagcatatttaaaaaaataacattgcactcaaataacaatcctttttatcaagcatttttaaaggatgtagaagaaaatagtatttcagtattacatcaaaactttaaactactatctgttgaaagtattcagaactctataattgaactactagtaactataaacttaaaatatgatcagtttttaactacaagaagcttattagatttagtatatgtacttcttacagctaaagattctcttatacatcaactgtttgaagatactagtactagtatgatgaaaaatttatctaaagaggatccccttcaaaatcgttcttatcaattagataagtttattcttgatagagcaagtggtaaagaagatgaaaaattaattgagtttataagaggttttaacagtttatgtaaaaaagagattctaaatgaaaaagatgcatttttacttatacgaacattttatttatttagaaatagttctatatcaaatgattaccataaagaatttgcaataaactttgatgatagtaaggtatatagctttatacatttagttgcatctcatcctgagtataaagatgaaaataaaaaagctattaaatacttttataagcaactaaaagaaggcgttcttttttatgtaaataaaaatgcccaaccctttctaaacataactttattttcatatcgacaacaaatggaatacctatggcggaccagggggaaatag

SEQ ID NO: 15260 - protein, 337 aa, Unknown
  Obtained from environmental sample
  misc_feature (1)..(337): Xaa is any amino acid
MQHXSFKSNQTATQALDDSFRRYLENEKSLVVGINIGILMNYVEEGDVDLASIKEHIKAFLESNENTNNTFFINFDDYSKFEFDDSIVSSPFIQSIFKKITLHSNNNPFYQAFLKDVEENSISVLHQNFKLLSVESIQNSIIELLVTINLKYDQFLTTRSLLDLVYVLLTAKDSLIHQLFEDTSTSMMKNLSKEDPLQNRSYQLDKFILDRASGKEDEKLIEFIRGFNSLCKKEILNEKDAFLLIRTFYLFRNSSISNDYHKEFAINFDDSKVYSFIHLVASHPEYKDENKKAIKYFYKQLKEGVLFYVNKNAQPFLNITLFSYRQQMEYLWRTRGK

SEQ ID NO: 15261 - DNA, 867 bp, Unknown
  Obtained from environmental sample
  misc_feature (1)..(867): n is a, c, g, or t
ttggctccatgcatttatctaagaatggcccatcttagcgaaaagagttatctctatttcttgaagctggctttcgtaaaaacaccactttcaatcaatttgatgaaaaaagttctgaatattaatgagaaggagttgtttttcttgatcaaagatggaatctctaatgagttattgaaagaagaagagggatattattatttcacttatcgtgaagcggtgacaagattcaacagggaattggatcgtaaagttaagcataagatatctaaagctgtgattaattatttcaaggatgttgagataaccaagctgatgttcctggaaggagtaatcaaacatgcttattttgttagagattatgcatcggttagagagtttgaacttaaacaggttaacctcttcatagttcaggaggaaccatcaaaagcatttaagatgatttgcaaaattgttgaattggattattcaaaaaaattcaatccatctagaagtaatttcattaaagatgtaaatttattagcagaaagatctttgtggggccaggagaacgagattaatgaagatctgttacttaaaattgaaaattccaatgaatctccagaaagaaatttactacttggaattttttacaagattcaggagaaaaacgagatatctttagcgtattatgaagctgcattaaaatcaactataactggaaaagaaagaatatttttattgtttgaattagctgagcattatctgcctactagaaaactcgataaaatagaacagattctagatgagttagattttgcctatcttacatcggattatcaactggattacataggcttaaaagctatgtatctgggggcttactaa

SEQ ID NO: 15262 - protein, 288 aa, Unknown
  Obtained from environmental sample
  misc_feature (1)..(288): Xaa is any amino acid
MAPCIYLRMAHLSEKSYLYFLKLAFVKTPLSINLMKKVLNINEKELFFLIKDGISNELLKEEEGYYYFTYREAVTRFNRELDRKVKHKISKAVINYFKDVEITKLMFLEGVIKHAYFVRDYASVREFELKQVNLFIVQEEPSKAFKMICKIVELDYSKKFNPSRSNFIKDVNLLAERSLWGQENEINEDLLLKIENSNESPERNLLLGIFYKIQEKNEISLAYYEAALKSTITGKERIFLLFELAEHYLPTRKLDKIEQILDELDFAYLTSDYQLDYIGLKAMYLGAY

SEQ ID NO: 15263 - DNA, 687 bp, Unknown
  Obtained from environmental sample
  misc_feature (1)..(687): n is a, c, g, or t
ttgtgtgtgggaattgttcatctacatcatggaaaaaactgtatcataacaggcaaggggctccaacgcctgagaaggctattcatgtcccttaagattcgttataaatttttaatcagtttttccactatttttttcctgttcatgctcctgtgtagccttgtggtgtatctgtttctcaaaaaaaatattgaagaaaatattgaaagtgaactcaataacaccacccagatgattcacagtatggtcaaaacatctgccacggtttccataaagaattatttgcgggccgtggccgaaaaaaacaaagaaatcgttgccagcatataccagctgtcccttgacaataacttaactatatcccaggcagagcaaaaagcagcggccatactgctcagtcaaaccattggcagttctggatatatctattgcgttaacagctcgggcacggtgctcatccaccccaaacccgccctgattggatccaatgttgcccaccatgcctttgtcacacggcagatgacatccccccagggctacctggaatatgactggaaaaatcccggagaaaaaaattcccggcctaaagccctttacatggtttactttgaaccatgggattggatcatttccgtgagtacctaccgctccgaatttaataagctgatcaagtctgagccgatctga

SEQ ID NO: 15264 - protein, 228 aa, Unknown
  Obtained from environmental sample
  misc_feature (1)..(228): Xaa is any amino acid
MCVGIVHLHHGKNCIITGKGLQRLRRLFMSLKIRYKFLISFSTIFFLFMLLCSLVVYLFLKKNIEENIESELNNTTQMIHSMVKTSATVSIKNYLRAVAEKNKEIVASIYQLSLDNNLTISQAEQKAAAILLSQTIGSSGYIYCVNSSGTVLIHPKPALIGSNVAHHAFVTRQMTSPQGYLEYDWKNPGEKNSRPKALYMVYFEPWDWIISVSTYRSEFNKLIKSEPI

SEQ ID NO: 15265 - DNA, 597 bp, Unknown; identical to SEQ ID NO: 7395
  Obtained from environmental sample
  misc_feature (1)..(597): n is a, c, g, or t

SEQ ID NO: 15266 - protein, 198 aa, Unknown; identical to SEQ ID NO: 7396
  Obtained from environmental sample
  misc_feature (1)..(198): Xaa is any amino acid

SEQ ID NO: 15267 - DNA, 729 bp, Unknown
  Obtained from environmental sample
  misc_feature (1)..(729): n is a, c, g, or t
atgagaattttcattaagggaattataaaagtaaaacataaacaatttctattaatacttatttcaaaaattaaattatttttttataaaaaagatataggaaataatacatacatggataaaacagtgaatgcatttggttggaaacatataagaattggttctaatacacttattggagagcagacttggcttaatattaatggtagagtaagtaatcataaacatatacaaataggcaactattgttaccttggaagaaggaacttattggcatcaagtaaagaacttataataagtgattatgtaatgacgagcaatgactgtaagtttttgggaagtaatcatgtttataacaaccctttggaaccttatattgccacaggtactatggatgatgatgtattgaaaataggagttaatgtttggattggtgctggtgcaatagtacttggagctgtaactgtagggcatggttccattataggggcaggcagtgttgttactaaagatattccaccttttagtatagctgttggaaatccttgtaaggttgttaaaagatttaattttaaaataaatagatgggaaaaagtagctgattttgataaaaatctagaaatactgatgataaatgaagaagaatatttagaaatattaaaaaaaaataagccaactattaatatgccattaatggcagcaacatcaaaatacggagacatgttatga

SEQ ID NO: 15268 - protein, 242 aa, Unknown
  Obtained from environmental sample
  misc_feature (1)..(242): Xaa is any amino acid
MRIFIKGIIKVKHKQFLLILISKIKLFFYKKDIGNNTYMDKTVNAFGWKHIRIGSNTLIGEQTWLNINGRVSNHKHIQIGNYCYLGRRNLLASSKELIISDYVMTSNDCKFLGSNHVYNNPLEPYIATGTMDDDVLKIGVNVWIGAGAIVLGAVTVGHGSIIGAGSVVTKDIPPFSIAVGNPCKVVKRFNFKINRWEKVADFDKNLEILMINEEEYLEILKKNKPTINMPLMAATSKYGDML

SEQ ID NO: 15269 - DNA, 705 bp, Unknown
  Obtained from environmental sample
  misc_feature (1)..(705): n is a, c, g, or t
ttgaatctaaaagatattcttagaaagataaataattgtgaaaatcacttagatattaaaaatattaattatataaatttcaatccctggccaatgattcgccttatgacagttcataaggttaatgtaaataataattgtaagaatgtagctatgcaaaatagtctatataaaaaaatattgttaaaaataaaaactcttatagtgtcattttataaatatattaaaaatcctataaaaaaagaaaaaatagatatattatattttacaagaaaatctgaattacaagatattattcatcaaaagttatttaatagatattcagatacactaaaatatttttttgatgaacaatataaaattaaagttttagaaatcaaagataatgagatagatgctgatgtaacatatattgattttctaataaaaatagtacaagttaaaattaaaataaaaaaattatttaagttaaatcagaactttgatgtaagatcaataaatgatgtaataaagagtgagtttaactttacattagatatagttacattaaagaataatttatttttaatttatgaattatctttaatgtttgaaaaaatccctcaaaaactagatccaaaagtagtctttcttgtatgcttttatagagttgatgctatggctatgtctctagcttgtcataatctagggataaaaaccggttga

SEQ ID NO: 15270 - protein, 234 aa, Unknown
  Obtained from environmental sample
  misc_feature (1)..(234): Xaa is any amino acid
MNLKDILRKINNCENHLDIKNINYINFNPWPMIRLMTVHKVNVNNNCKNVAMQNSLYKKILLKIKTLIVSFYKYIKNPIKKEKIDILYFTRKSELQDIIHQKLFNRYSDTLKYFFDEQYKIKVLEIKDNEIDADVTYIDFLIKIVQVKIKIKKLFKLNQNFDVRSINDVIKSEFNFTLDIVTLKNNLFLIYELSLMFEKIPQKLDPKVVFLVCFYRVDAMAMSLACHNLGIKTG

SEQ ID NO: 15271 - DNA, 867 bp, Unknown
  Obtained from environmental sample
  misc_feature (1)..(867): n is a, c, g, or t
gtgcctgctattaaaggacattatattttttcaatgtctgtttttaatggtcaagagcgaattgaaaccaatatttttcctgtttttgtagagtgttcaaaagaagttttatggcgtaaaaatataaggtcaaaacttgtaaaaaagaaaatagattttacaagtttggataggaaatatatttctcagtccagtcaggataaagctgtttttaatttttttaatgaccttagaaaaaaatttggtcttaaattatttaataaaagtaaacaacttagtgatttttcagaagttcactgccgggatatggcagaaaatagttttttttcacactattcggatattagaggaggatttttaaaaagacttatgaatctttcatttcagttttctcaaagttcagagattataaagaagtctaaaaaaagatcatcccttttacaaagagttttttttagcccactggcggtttacaaccttttaaatcctgaatttaactatgccggtgtttcagttcaaatagcaactgatcaaaccttttttctttcaggcgctttttttaaagagcatgattatatttcatcaacaggttcggctganataattttaaaaagtatgaatcataaaagaaaagagaataatttaaaatctcttatagaggattattctctttcaaaagcagcattaaagcattgcgaatatatgtctgataaagggtatcccctaattaggagagaaaaacaaaacggaagtatttcagaagatataaaacagatcagacgacattttggaaaattgaaattacaggtttggtattgcgggaacctagtccttcctgaatggatttttaaaataagggaattatga

SEQ ID NO: 15272 - protein, 288 aa, Unknown
  Obtained from environmental sample
  misc_feature (1)..(288): Xaa is any amino acid
MPAIKGHYIFSMSVFNGQERIETNIFPVFVECSKEVLWRKNIRSKLVKKKIDFTSLDRKYISQSSQDKAVFNFFNDLRKKFGLKLFNKSKQLSDFSEVHCRDMAENSFFSHYSDIRGGFLKRLMNLSFQFSQSSEIIKKSKKRSSLLQRVFFSPLAVYNLLNPEFNYAGVSVQIATDQTFFLSGAFFKEHDYISSTGSAXIILKSMNHKRKENNLKSLIEDYSLSKAALKHCEYMSDKGYPLIRREKQNGSISEDIKQIRRHFGKLKLQVWYCGNLVLPEWIFKIREL

SEQ ID NO: 15273 - DNA, 366 bp, Unknown
  Obtained from environmental sample
  misc_feature (1)..(366): n is a, c, g, or t
atgaaaatttttgagaacagtttaatatttatagagatagaaaagagtgaagtcccttggcttaaaatttttactaatgaagttaaaaaagagttcagtgaatgtaccttagatgaaaagagtgagatatttagggtactagatattattgaaaaagtaatgcttagttactataaacctactaaaataaatatagcatcttttggaaatatgttgcctcatgtgcattggcatattatggctagatttaagaatgatagctattttccagaaccaatgtggggatcaaaaagaagagaaagttccttagtacttccatcatttgaagagtttttaaaagtgattaaactagaattgataaaatag

SEQ ID NO: 15274 - protein, 121 aa, Unknown
  Obtained from environmental sample
  DOMAIN (2)...(85): HIT domain
  misc_feature (1)..(121): Xaa is any amino acid
MKIFENSLIFIEIEKSEVPWLKIFTNEVKKEFSECTLDEKSEIFRVLDIIEKVMLSYYKPTKINIASFGNMLPHVHWHIMARFKNDSYFPEPMWGSKRRESSLVLPSFEEFLKVIKLELIK

SEQ ID NO: 15275 - DNA, 402 bp, Unknown
  Obtained from environmental sample
  misc_feature (1)..(402): n is a, c, g, or t
ttggtacaattataccaatttaaatcgaggtataaaatgaagtatattttactagcactgttaatcacaatctcatcagcttttgcagaggttaaaaatcagtatatatcacaagagttactaaactcaaaagtgaaaataatagatatcagaactccatctgagtgggctgaaacaggtattgtaaagggttcaattcctattacattttttaatgaacaaggtagttacaacatagatgagttcttaaaagagttaaataaaaatgtaaaaacaaatgaagagtttgcactgatctgtagaacaggaagcagaactaaactggtttccaactttttatctactaaattgggatataacgttataaatcttcaaggcgggattttatatgccttggggtaa

SEQ ID NO: 15276 - protein, 133 aa, Unknown
  Obtained from environmental sample
  misc_feature (1)..(133): Xaa is any amino acid
MVQLYQFKSRYKMKYILLALLITISSAFAEVKNQYISQELLNSKVKIIDIRTPSEWAETGIVKGSIPITFFNEQGSYNIDEFLKELNKNVKTNEEFALICRTGSRTKLVSNFLSTKLGYNVINLQGGILYALG

SEQ ID NO: 15277 - DNA, 921 bp, Unknown
  Obtained from environmental sample
  misc_feature (1)..(921): n is a, c, g, or t
ttgnnnnnnnngtttgatggccgagttgtcgattttgatatgagagatgtgattaaaaatattcaaaatataatagaattagaaagtgaaaaaaagaatttagaatttaatatattttatgatagtaagcacagtatttatgtaggagattctttaagaatagggcaggttctaaataatcttcttaataatgcaattaaatttacaaatacaggtaaagtagagttgcaaattattgataaaccaaataattatgtagaatttaaggtgaaagatactgggattggaataaatttagagaaacaacaagatatatttaattcattttcacaagcagatgggaccactacaagaaaatatggtggaaccggattgggactttctatctctaaacaacttgtagagttaatgggtggaagaatttggttagagagtattgtaggtgttgggtcttcttttagttttaaattaaaactagaaaaaagtatctgtagctcgattgaaaacgataatacaataaactctatagaacaagagattgcaatattaaaaaataaaacaattctcttagtggaagacaatcaaacaaatcaagagatagtaataggattgttagaacaaagtggagtaacaattgatctagcttcaaatggaaaagaagctataaagatgtttaaagaaaataaaaatagatatcacttaattttgatggatatacagatgccaataatggatgggtatgaagcaacaaagattataagagcagaagataagcaaataccaataatagcacttagtgcaaatgcaatggtaagtgataaaaaagaaaacaaagccatagggaagccagagcatttaaataaaccaattcaagttgataaactttataccacattacaaaaatatcctctcattagataa

SEQ ID NO: 15278 - protein, 306 aa, Unknown
  Obtained from environmental sample
  DOMAIN (186)...(306): Response regulator receiver domain
  misc_feature (1)..(306): Xaa is any amino acid
MXXXFDGRVVDFDMRDVIKNIQNIIELESEKKNLEFNIFYDSKHSIYVGDSLRIGQVLNNLLNNAIKFTNTGKVELQIIDKPNNYVEFKVKDTGIGINLEKQQDIFNSFSQADGTTTRKYGGTGLGLSISKQLVELMGGRIWLESIVGVGSSFSFKLKLEKSICSSIENDNTINSIEQEIAILKNKTILLVEDNQTNQEIVIGLLEQSGVTIDLASNGKEAIKMFKENKNRYHLILMDIQMPIMDGYEATKIIRAEDKQIPIIALSANAMVSDKKENKAIGKPEHLNKPIQVDKLYTTLQKYPLIR

SEQ ID NO: 15279 - DNA, 414 bp, Unknown
  Obtained from environmental sample
  misc_feature (1)..(414): n is a, c, g, or t
ttgaaaggattaagtggtaatattggtgcagtaaatttggtgaaaataattgaaaagttagaaactacaaacgatacaatgttgctatctaaactctatgaacagcatagtaaaataataggtgaattggaacaattagatatttttgatgaagcaattattaaatctaaagggataataactaaagagaagcgaaaagagttatttgaaaagcttaaagaggttttgcacacaaaacgacctaaaaatattgaaaaggtactactggaaatagaccagtatcagattaatattgaggaagaaaataatttgaatatgataaaagaatatacagaaaaatttgattttcaaaaggctttggattgtttgtcattgtatgaagaaaactatttaaatcataaaaaaggaaaataa

SEQ ID NO: 15280 - protein, 137 aa, Unknown
  Obtained from environmental sample
  misc_feature (1)..(137): Xaa is any amino acid
MKGLSGNIGAVNLVKIIEKLETTNDTMLLSKLYEQHSKIIGELEQLDIFDEAIIKSKGIITKEKRKELFEKLKEVLHTKRPKNIEKVLLEIDQYQINIEEENNLNMIKEYTEKFDFQKALDCLSLYEENYLNHKKGK

SEQ ID NO: 15281 - DNA, 414 bp, Unknown
  Obtained from environmental sample
  misc_feature (1)..(414): n is a, c, g, or t
atggactattttgcaaaacgtatcatcccctgtctagatgtcaaagacggacgtgtcgtcaaaggggtcaacttcgtgggactcaaagatgcaggtgatcccgttgaggtcgccaaacgctataacgacgaaggtgccgacgaaataaccttcctggatatcaccgcatcaagcgataaccgggagaccatcacccatatcgttgaaaaagtagcaaaagaggtctttatccctctgactgtcgggggcgggatacgtaaacttgaagacatctacaaactcttgaatgtcggatgcgacagggtcagcctgaactccgcagccatcaaacgtcccgagttcatcaatgaaggcgcccaacgtttcggttcacaatgcattgtccttgccatccaagtgaaagaagacccgtga

SEQ ID NO: 15282 - protein, 137 aa, Unknown
  Obtained from environmental sample
  DOMAIN (7)...(137): Histidine biosynthesis protein
  misc_feature (1)..(137): Xaa is any amino acid
MDYFAKRIIPCLDVKDGRVVKGVNFVGLKDAGDPVEVAKRYNDEGADEITFLDITASSDNRETITHIVEKVAKEVFIPLTVGGGIRKLEDIYKLLNVGCDRVSLNSAAIKRPEFINEGAQRFGSQCIVLAIQVKEDP

SEQ ID NO: 15283 - DNA, 333 bp, Unknown
  Obtained from environmental sample
  misc_feature (1)..(333): n is a, c, g, or t
atgactgacggtaaattattttatactattggtgaagtggctagcatgtttaatgtgaatacttcccttattcgtttttgggagaaggagtttgatattataaagcctcaaaaaaacaaaaaaggtaatcgactgtttactaaaaaagacattgataattttcatgttatctttcatttggtaaaagaaaagggctatactttagaaggagctaaaaacaaacttaaaagtggagcaactgcttttcaggaagaaaccaaagaaaacctcgaagtcatcaaatcattagaaaatgtaaaagctttcttactgagcttgaaagaggagttgtag

SEQ ID NO: 15284 - protein, 110 aa, Unknown
  Obtained from environmental sample
  DOMAIN (9)...(46): MerR family regulatory protein
  misc_feature (1)..(110): Xaa is any amino acid
MTDGKLFYTIGEVASMFNVNTSLIRFWEKEFDIIKPQKNKKGNRLFTKKDIDNFHVIFHLVKEKGYTLEGAKNKLKSGATAFQEETKENLEVIKSLENVKAFLLSLKEEL

SEQ ID NO: 15285 - DNA, 414 bp, Unknown
  Obtained from environmental sample
  misc_feature (1)..(414): n is a, c, g, or t
atgagtaaagtagagtttgaaatgataatgaaaaatatcaaagataatattgtaagtgattgtgaagaagatgttgagatttattatgtgataaatagagttaaagatatgattttaggtctttaccttgatgaaaagataataaaagagggtgatttaaagcaaaaagctggatatttatgtttagaacaagatttaggtaaaagctctgctgtaacatttttcttaacaacaaaatcaaaaaactaccaagcagcgtatcaaaaagcaggaatcataggacacagactatatttggcctcaaattacttaggatatgggtgcagtggaataggggcttattatgatgatgaagtatgtgagttcataggtgaaaatacaatggtattatatgctttagctataggaaaatag

SEQ ID NO: 15286 - protein, 137 aa, Unknown
  Obtained from environmental sample
  misc_feature (1)..(137): Xaa is any amino acid
MSKVEFEMIMKNIKDNIVSDCEEDVEIYYVINRVKDMILGLYLDEKIIKEGDLKQKAGYLCLEQDLGKSSAVTFFLTTKSKNYQAAYQKAGIIGHRLYLASNYLGYGCSGIGAYYDDEVCEFIGENTMVLYALAIGK

SEQ ID NO: 15287 - DNA, 312 bp, Unknown
  Obtained from environmental sample
  misc_feature (1)..(312): n is a, c, g, or t
gtggtttccctccttcaaaaagaggggtttagatgcggcaaaaaaaccaggcagctgattttttcatacaaatttgtggagggcctagatattttgataaatcaagggggagcaccaagaatggtagctaggcattcaccttttagaattgattcaaaggcaagaattatttggcttgaaaattttgcaaaagcaatagaagaaacaaatttagatgaagagttaaaaaaatcattttggaactatattgatattttttctatttggatggtaaactccagtgataatccacaaggagtatttaaaacctaa

SEQ ID NO: 15288 - protein, 103 aa, Unknown
  Obtained from environmental sample
  misc_feature (1)..(103): Xaa is any amino acid
MVSLLQKEGFRCGKKTRQLIFSYKFVEGLDILINQGGAPRMVARHSPFRIDSKARIIWLENFAKAIEETNLDEELKKSFWNYIDIFSIWMVNSSDNPQGVFKT

SEQ ID NO: 15289 - DNA, 813 bp, Unknown
  Obtained from environmental sample
  misc_feature (1)..(813): n is a, c, g, or t
atgtggcggacaataaaagtagagaaaaaagagtggcatggtataataaaaaatgtctcaaaaacaggcaaaatttattatatgaaggctactataaaacctctttttgatgtagatgggaatatagttgaatttattgcctttagagatagtttaaatcttattttagatgataaaaaacacttacttaataaaatagaattaaataaattatcccttcttattttagtacaaattcaagagtttgatatgttagaaaagttttataacatagtaaaagttgatcaagttgaaaagacttttgcctctaatttagtctcctatttacctgcctcatttatttttgaagatatctataccttgggtgatggaagatatgcccttttaactgattataagaattttgagaaattagaaattaatttacatgaataccttgaagattttgtaaaaaatgttacagattctattttagaaatagatgggatagagtatgatttaaatattattcttagttattcatgtgggaaatatagtctttatgaagatgcaaaagctggactagaagttgcaatagctaagaataaggtaataaactattcaaatgattcatctataaaaattaaccaagaagcaaaaaagaattttgaaattataaaaatggttaaaatagctcttgataactataagatagtctcttactttcaaccaattattaataacaaaacaaaagagatagagaagtatgagtctttggttagattgattaatgaggagggagaggtcatctctcctttctcgagccgattctga

SEQ ID NO: 15290 - protein, 270 aa, Unknown
  Obtained from environmental sample
  misc_feature (1)..(270): Xaa is any amino acid
MWRTIKVEKKEWHGIIKNVSKTGKIYYMKATIKPLFDVDGNIVEFIAFRDSLNLILDDKKHLLNKIELNKLSLLILVQIQEFDMLEKFYNIVKVDQVEKTFASNLVSYLPASFIFEDIYTLGDGRYALLTDYKNFEKLEINLHEYLEDFVKNVTDSILEIDGIEYDLNIILSYSCGKYSLYEDAKAGLEVAIAKNKVINYSNDSSIKINQEAKKNFEIIKMVKIALDNYKIVSYFQPIINNKTKEIEKYESLVRLINEEGEVISPFSSRF

SEQ ID NO: 15291 - DNA, 543 bp, Unknown
  Obtained from environmental sample
  misc_feature (1)..(543): n is a, c, g, or t
atgtcaaataataatattgaaatagagttagatgacattttaaagcaaattgaccattttcatccaagtgatattgcttatagacttaaaaaaataaaaaaaaacagcaatgagcttttttatgaatacttacataaaattcctaaacaatatctaggggaagttctactagaactcccagaatcacttagggaaaaagcctacaattcactctcacaccaacaaatatctcgtgcacttgaaaatttagaaacagataatgcaaccgatattattcaaggtattgaagagattgatcaagaaaaagcaaaaaatgttttagattctttagacaaaaaagatcaagatgatattaactggcttaaaaaatatgatgaaacaaaagctggtgcatacatgcaaactgaactttttagtgcgcatattaatgaaacgatacaagattcaatagatagattaaagtttttaaaaaaaaatcatcatataggaaatattcatcagttttttgtagtagatgatgatacaccacttttagctttcatc

SEQ ID NO: 15292 - protein, 181 aa, Unknown
  Obtained from environmental sample
  DOMAIN (3)...(129): MgtE intracellular domain
  misc_feature (1)..(181): Xaa is any amino acid
MSNNNIEIELDDILKQIDHFHPSDIAYRLKKIKKNSNELFYEYLHKIPKQYLGEVLLELPESLREKAYNSLSHQQISRALENLETDNATDIIQGIEEIDQEKAKNVLDSLDKKDQDDINWLKKYDETKAGAYMQTELFSAHINETIQDSIDRLKFLKKNHHIGNIHQFFVVDDDTPLLAFI

SEQ ID NO: 15293 - DNA, 444 bp, Unknown
  Obtained from environmental sample
  misc_feature (1)..(444): n is a, c, g, or t
atgagaccaaccgtaagaacaagagttgccactataacacctcaaggttttttagatggcagtagtgcaccaaattatttaaccactgaagacgtaagatctattaaaaaacttgatataaatatatttttaatctctttaaaaagtgttatattttttaataaaaatggattagatatttttgtaaaacttatgattcagttaaaaaatgaaaaaaaaataactgttggcttttgtgattatgactataaaaagtacaatgcaattatcaaatactacagagacgatctagtattctcactatttaaaacacaggcaattgctgaactttttgctccaaagaataaagaaaatcaaaaaaacatccttatctaccatgaagatccatcacaaaaatcaaccatggcaatagaactttttaatgcgtggttacaaccccaatag

SEQ ID NO: 15294 - protein, 147 aa, Unknown
  Obtained from environmental sample
  misc_feature (1)..(147): Xaa is any amino acid
MRPTVRTRVATITPQGFLDGSSAPNYLTTEDVRSIKKLDINIFLISLKSVIFFNKNGLDIFVKLMIQLKNEKKITVGFCDYDYKKYNAIIKYYRDDLVFSLFKTQAIAELFAPKNKENQKNILIYHEDPSQKSTMAIELFNAWLQPQ

SEQ ID NO: 15295 - DNA, 678 bp, Unknown
  Obtained from environmental sample
  misc_feature (1)..(678): n is a, c, g, or t
atgggatgcaaatttatcaaaacaggtattactttttacaaaccgtcgggctttggtgagatagcggaagtttcaggcgcagaaagaattttcacaattactcttattattgcaggttttgcagtattttcaagtgctataggtattttagtaaatgagatgaataaagggcactttgctaaggccttaaaggagcgtagaatgctatttcaaattgcaagactcaaaaaacattttgtagtctgttatcataatgactatactatagaagttacaaaacagttgagagaaaaccatactccatttgttgtgattgatccaagagaagacttggaagagttatcaaaaaaatataaatatccaaattttttacaattagaacctcacactgaagaagctatgttaaaatcaaatttaagttctgcaaaaggcttaattacgttgtctgattctatctcagataatattgcactgattgcatcagtaagactttttgaaaaagagcatcatctaccacgtccatactacataataagttcagtagataatatcagtgatgtagtcaaacttaaaaagctaggtgcggatacagttgtctcacctacaaaactgacagctcaacgtattagttctatggcaattcgtcctgatatggaaaaccttttagagtcattttaa

SEQ ID NO: 15296 - protein, 225 aa, Unknown
  Obtained from environmental sample
  DOMAIN (78)...(201): TrkA-N domain
  misc_feature (1)..(225): Xaa is any amino acid
MGCKFIKTGITFYKPSGFGEIAEVSGAERIFTITLIIAGFAVFSSAIGILVNEMNKGHFAKALKERRMLFQIARLKKHFVVCYHNDYTIEVTKQLRENHTPFVVIDPREDLEELSKKYKYPNFLQLEPHTEEAMLKSNLSSAKGLITLSDSISDNIALIASVRLFEKEHHLPRPYYIISSVDNISDVVKLKKLGADTVVSPTKLTAQRISSMAIRPDMENLLESF

SEQ ID NO: 15297 - DNA, 843 bp, Unknown
  Obtained from environmental sample
  misc_feature (1)..(843): n is a, c, g, or t
atgggggcagctagaagtaaagatgaattagaggtatttttaacaaatatgtttaatgatgagaatatattaacattcaaaaatacaacttttcgttctattctagcttcattgattgttacatttagattaaataaagcttggggaaactatgaacaaattggtggtaaatctccattacatgaattaacaaataagcttatagataaattggaaaaagaattacctaactattttataacagatgctatgagatatacttcacctttttctcaaactgcaattgcaagaataaaagaaagaggtattaaagatgtaacacttttccctttgtatccacagtattctactacaacagtcaagtcaagtgtagatgattttatgttaaaagcaaaagatgtaggttttaatattaaacttatagagcctttttatcataatgaattatataataaagctatttgtgatgagataattcgtgtacaagggaaatacaatgattttcatcttatattttcagctcatggacttccccaaaaaattgtaaataatggtgacccatatcaaaaacaagtagaagaacatgtagagcttttgaaagaaaaacttacccactatgcaacaaatataaagtcaattaatttagcatatcaatcaaaagttggaccaatgaaatggttaacacctagcttagaagatatgttgaaacactttaaaggtgaaaaagtaatcatctatcctatctcttttataattgataatagtgaaactgtatttgaacttgatatagaatatagagaaatagcaaaagagttagggataaaagagtatagagtttggtaa

SEQ ID NO: 15298 - protein, 280 aa, Unknown
  Obtained from environmental sample
  DOMAIN (1)...(278): Ferrochelatase
  misc_feature (1)..(280): Xaa is any amino acid
MGAARSKDELEVFLTNMFNDENILTFKNTTFRSILASLIVTFRLNKAWGNYEQIGGKSPLHELTNKLIDKLEKELPNYFITDAMRYTSPFSQTAIARIKERGIKDVTLFPLYPQYSTTTVKSSVDDFMLKAKDVGFNIKLIEPFYHNELYNKAICDEIIRVQGKYNDFHLIFSAHGLPQKIVNNGDPYQKQVEEHVELLKEKLTHYATNIKSINLAYQSKVGPMKWLTPSLEDMLKHFKGEKVIIYPISFIIDNSETVFELDIEYREIAKELGIKEYRVW

SEQ ID NO: 15299 - DNA, 537 bp, Unknown
  Obtained from environmental sample
  misc_feature (1)..(537): n is a, c, g, or t
ttgcttttgcaaggttgtgcaaaaaacaactcctcatataacactcttcttatagataaactacatgaagaacaacaactgctctccaaagagatagctgaaataaaatcaaattattccgaagcaaatgccacaaaaaataacgaaatttatatactaaagctgaaaaaaagcatcgattttcatgaaaatatacttttacaattagtaagagatgtagaagatattaaaaatcaaaaaaagggaatagagaagaagagtgttaaaaaaccttttaaaaaagagataactagtgaagagagttcaaaaaaaggtttaatagataaatttcctgcttccacttttaaaacattagaaaattcacatatatatgatgacagtggtgaagttattgatagttgggctaataatgtatcttttacatcttatatgagcagaggtgatctatacttaattacaggatactttaaagagaaaaattgggttgcttcaaataggtctatgtggatcaaaaagagcagttgtgagatacgttaa

SEQ ID NO: 15300 - protein, 178 aa, Unknown
  Obtained from environmental sample
  misc_feature (1)..(178): Xaa is any amino acid
MLLQGCAKNNSSYNTLLIDKLHEEQQLLSKEIAEIKSNYSEANATKNNEIYILKLKKSIDFHENILLQLVRDVEDIKNQKKGIEKKSVKKPFKKEITSEESSKKGLIDKFPASTFKTLENSHIYDDSGEVIDSWANNVSFTSYMSRGDLYLITGYFKEKNWVASNRSMWIKKSSCEIR

SEQ ID NO: 15301 - DNA, 690 bp, Unknown
  Obtained from environmental sample
  misc_feature (1)..(690): n is a, c, g, or t
atggcaagtatgggtgaaatgattggaaatatcgctcatcaatggaggcaacctctcaatgctttagggttaccaatacaaaaaataaaaatgtattatgaagaagatatgttatctcaagaagaactggataaggcagtagataaaagtaaagttctgattactaaaatgtcaacaactatagatgattttagaaatttttttagaatagataaaacaaaacaacaatttaatataaaagatgccatacaagatacaatgggtttagtagatgctagtctaaaaaatcatcatatttttattgatataactaaaacaaataatgatattgattttttagggtataaaaatgaattagaacaggtattattaaatcttattaataatgccaaagatgctttagtggaaaataatattgaaaatccaaaaatatctatagaaagttttctacaaaataactatatatttatagaaatacaagataatgcaggtggaatttctaatgaaattattgcaaatatatttgatccatattttactacaaaagagcaaggaaaaggtacgggaataggtttatatatgtcaaaaatgataatacaaaataatatgagtggaaatatcacagtagaaaataaactagatggtgcttgttttagtataaagttaaatcaggaaaaaataaatgaataa

SEQ ID NO: 15302 - protein, 229 aa, Unknown
  Obtained from environmental sample
  DOMAIN (3)...(73): His Kinase A (phosphoacceptor) domain
  misc_feature (1)..(229): Xaa is any amino acid
MASMGEMIGNIAHQWRQPLNALGLPIQKIKMYYEEDMLSQEELDKAVDKSKVLITKMSTTIDDFRNFFRIDKTKQQFNIKDAIQDTMGLVDASLKNHHIFIDITKTNNDIDFLGYKNELEQVLLNLINNAKDALVENNIENPKISIESFLQNNYIFIEIQDNAGGISNEIIANIFDPYFTTKEQGKGTGIGLYMSKMIIQNNMSGNITVENKLDGACFSIKLNQEKINE

SEQ ID NO: 15303 - DNA, 468 bp, Unknown
  Obtained from environmental sample
  misc_feature (1)..(468): n is a, c, g, or t
gtggaaaatggtaagaaattgattattttcagtcagtttgtacagatgctgaagttattgaaagagatgttggacgaccttaatattcagcacgaatatatggatggctccactcgagatcgtcagaaagttatcaataatttcaatgaaaatgataatgtaagagctttcttagttagcttgaaaacaggtggatttggtttgaacctaacagcagccgatactgtgataatagtagatccttggtggaatccgatgggtgaaaaccaggcgattgatcgtgctcacagaatagggcagaccaagaaagtgaacgtgtataaaattattaccaaaggttccattgaagagaagattcttgatctgcaaaatcataagaaagagctttttgaaaatctgatcgaaggtggtagcggtgtattgaaaagtctgacaatagaagatctaaaaaacttgttggaatattag

SEQ ID NO: 15304 - protein, 155 aa, Unknown
  Obtained from environmental sample
  DOMAIN (23)...(99): Helicase conserved C-terminal domain
  misc_feature (1)..(155): Xaa is any amino acid
MENGKKLIIFSQFVQMLKLLKEMLDDLNIQHEYMDGSTRDRQKVINNFNENDNVRAFLVSLKTGGFGLNLTAADTVIIVDPWWNPMGENQAIDRAHRIGQTKKVNVYKIITKGSIEEKILDLQNHKKELFENLIEGGSGVLKSLTIEDLKNLLEY

SEQ ID NO: 15305 - DNA, 882 bp, Unknown
  Obtained from environmental sample
  misc_feature (1)..(882): n is a, c, g, or t
gtggtaagcaaaaataatgataatggttatgtcttacgtccatcctcatcagaattgatctcagctacctacttgggcaaaacatcttatatctttaagaaaaatatagttcacgccaccaattttccttttaatcctgaaatttctgctaaaatttttcatgagggtttagaacttaaggctactgacttggtttatctcttttctgttgtggcacgccaacttagtcttatcaaatgctatttggatctggatgaagatatagtggttccaaaactttacaataatgttcccgtgatcacctttaaatttcataaagaggatgaggacatcattatggatggcggattggattatggcgataatgtgatgattcctatgtctgctgtgcgctttcctgcagaattagtacgctttgatcagcagggtgaagaatgttggttttacattccacctcagataaaatatgagatcaaacaattttcggaattactacctcaatctcaatctcatcgtttggaaaataaatcacaattggtgttttctgatgatgataatattgccgctttgaaacaggtgatatttgagcataccaaacctaattgggagattgaattatcggatgaattgaagcaggaatttatctataaagttgttttaaaacctataattaatactcatcagagtaagcatattaactggtttggatatgatggacagtacaattataaagatattagttttagtcatgaagagttaaaaaaaattctttttcatcgccagaaaaaatttatgcgcctgggaaaaatggtaaaaatgccttttcttttgataaaaaaaagtggctttttggaacaaagtggagagaaccttattggataa

SEQ ID NO: 15306 - protein, 293 aa, Unknown
  Obtained from environmental sample
  misc_feature (1)..(293): Xaa is any amino acid
MVSKNNDNGYVLRPSSSELISATYLGKTSYIFKKNIVHATNFPFNPEISAKIFHEGLELKATDLVYLFSVVARQLSLIKCYLDLDEDIVVPKLYNNVPVITFKFHKEDEDIIMDGGLDYGDNVMIPMSAVRFPAELVRFDQQGEECWFYIPPQIKYEIKQFSELLPQSQSHRLENKSQLVFSDDDNIAALKQVIFEHTKPNWEIELSDELKQEFIYKVVLKPIINTHQSKHINWFGYDGQYNYKDISFSHEELKKILFHRQKKFMRLGKMVKMPFLLIKKSGFLEQSGENLIG

SEQ ID NO: 15307 - DNA, 657 bp, Unknown
  Obtained from environmental sample
  misc_feature (1)..(657): n is a, c, g, or t
ttgatccccaaatcaaaaaaagaacaggagaaattaaaagtatttacagaaacagtagataaacttaacagtgatgttgaaaaactttatacaatcattgatgagacaaaaaataaaagaattaaaaatgatattcacttaaaagagttatctgataaattatcagagattgaaggtaaacataaacttgctaaaaatgaaaaagaggtaaaagctttacaacttgaagaagagatagcaaaagagcaagtaaactttgcaaatgaagagatagtaagacttgatagtttaattacatctaaaaacgaagagttagaagctattaaagctgaactagtacaagaggaagagtcagttaaagagttaaaagatttaattgatgcaaatattgcaaaacttgaatcagaaagaaataaagtatatgaagaaaaatcagtacttgtagggacagttgattctaaagttcttgcattctatgaaaagattagaagatgggcagcagaaagtgctgttgttcctgttaaaaaacaagcatgttatggttgtaatatgaaaataaatgatagattttattctgagtttattgtaagtgatgagattatgacttgtcctcactgtggtagaattatttataaggatgattctgctgaggcataa

SEQ ID NO: 15308 - protein, 218 aa, Unknown
  Obtained from environmental sample
  DOMAIN (1)...(214): Uncharacterized ACR, COG1579
  misc_feature (1)..(218): Xaa is any amino acid
MIPKSKKEQEKLKVFTETVDKLNSDVEKLYTIIDETKNKRIKNDIHLKELSDKLSEIEGKHKLAKNEKEVKALQLEEEIAKEQVNFANEEIVRLDSLITSKNEELEAIKAELVQEEESVKELKDLIDANIAKLESERNKVYEEKSVLVGTVDSKVLAFYEKIRRWAAESAVVPVKKQACYGCNMKINDRFYSEFIVSDEIMTCPHCGRIIYKDDSAEA

SEQ ID NO: 15309 - DNA, 531 bp, Unknown
  Obtained from environmental sample
  misc_feature (1)..(531): n is a, c, g, or t
atgataaataaaactaaatctcagaaaattatcgtactttacttaactttaatgttgggttttgttatatttttatccgtcatgctatttacctctataaaaccaagagatataccctcactatacacttcagatactacaaaagcacaaagaggctcaattattagcgctgatggtttcaatgttgcgactactaaaaagctctataaagccgttgtaaataaaaaaaatattgatcctaaaaagtatgatctatttgttgaactctttagtatttacagcaacattgatagtaaaaaagtacgcaaaagattgaatgccagaaaatctatcgtaacactaagctatagtatctcagccaaacaagcacaagcccttaaatctttagcttttgaacttttacgtatgggagtatttgtagagtacacaagctctagcggagttaaaatctttcatgggttaaatattttagagagtggtgaaaagagagagttccttatgccaaactactcacactcgagccgaatctga

SEQ ID NO: 15310 - protein, 176 aa, Unknown
  Obtained from environmental sample
  misc_feature (1)..(176): Xaa is any amino acid
MINKTKSQKIIVLYLTLMLGFVIFLSVMLFTSIKPRDIPSLYTSDTTKAQRGSIISADGFNVATTKKLYKAVVNKKNIDPKKYDLFVELFSIYSNIDSKKVRKRLNARKSIVTLSYSISAKQAQALKSLAFELLRMGVFVEYTSSSGVKIFHGLNILESGEKREFLMPNYSHSSRI

SEQ ID NO: 15311 - DNA, 468 bp, Unknown
  Obtained from environmental sample
  misc_feature (1)..(468): n is a, c, g, or t
atgcggctttttcccaccaataattttttatcccctaaagaactttttaatagaattaaatttgatgaaagcttagtaaaatatggacatgaagacaccttatttggttacgaattgtcccaacaaaacatcattattcatcatattaacaatccgcttatacatgttggcttagaaagtgcgaccgtttttttacaaaaaactgaagaaggtataaaaaatcttattcagataatacaaactaaaaaaccggaaaaaaaattctatcaagatgttaaattactctcttacttcttaataattaagcaatataagctaaattggttctttaatttattgtacaaacttttgcaccaaaaaatatataaccacctgaaaaacaacacaattcctaccataaaatatttcgatttatataaaatcttacttcttaattattacttcaacttatccgcaaaaaaacgttaa

SEQ ID NO: 15312 - protein, 155 aa, Unknown
  Obtained from environmental sample
  misc_feature (1)..(155): Xaa is any amino acid
MRLFPTNNFLSPKELFNRIKFDESLVKYGHEDTLFGYELSQQNIIIHHINNPLIHVGLESATVFLQKTEEGIKNLIQIIQTKKPEKKFYQDVKLLSYFLIIKQYKLNWFFNLLYKLLHQKIYNHLKNNTIPTIKYFDLYKILLLNYYFNLSAKKR

SEQ ID NO: 15313 - DNA, 336 bp, Unknown; identical to SEQ ID NO: 11239
  Obtained from environmental sample
  misc_feature (1)..(336): n is a, c, g, or t

SEQ ID NO: 15314 - protein, 111 aa, Unknown; identical to SEQ ID NO: 11240
  Obtained from environmental sample
  DOMAIN (8)...(104): Ferric uptake regulator family
  misc_feature (1)..(111): Xaa is any amino acid

SEQ ID NO: 15315 - DNA, 486 bp, Unknown
  Obtained from environmental sample
  misc_feature (1)..(486): n is a, c, g, or t
atgatagtatacggaaaacaaatagtattttatattttagagcaacatcctaagatgataaagcaaatatttttaacaaaagagatagataaaaaacttttcaataagtttatggatgttggggtgaaaatagttcgacctgacaatatgaaagcacaagcaatggcaaaaggtggaaatcatcaaggctttttgcttgatattgatgagtttgaatttgcagatattaaagatgtaaaaaaagatgagtttatagttatacttgatggtttaacagatactggaaacataggggcaattattagaagttgttacgcaatgggtgttgatagtgtggttatatgtggacataaaaatttttatgcagcaccaatagttcgtacaagtagtggagctatgctagatatgtcagttgcaatttcatatagtagttatgacttagcaaatgaactaaaaacagtttggcttttctttgggtggcgctga

SEQ ID NO: 15316 - protein, 161 aa, Unknown
  Obtained from environmental sample
  misc_feature (1)..(161): Xaa is any amino acid
MIVYGKQIVFYILEQHPKMIKQIFLTKEIDKKLFNKFMDVGVKIVRPDNMKAQAMAKGGNHQGFLLDIDEFEFADIKDVKKDEFIVILDGLTDTGNIGAIIRSCYAMGVDSVVICGHKNFYAAPIVRTSSGAMLDMSVAISYSSYDLANELKTVWLFFGWR

SEQ ID NO: 15317 - DNA, 507 bp, Unknown
  Obtained from environmental sample
  misc_feature (1)..(507): n is a, c, g, or t
atgaaattgtattttagtggattttctttaaaaggggaaaaagagctttttaaagattatattatagaaaatgattttaccgtatctggttttagttatggagcacaaaaagcttttgaatatgttttaaatacagataacagagtcgatttattgcaacttttttctccagcattttttcaggataaagatacaaaatataaacgccttcagttgatgttttttaaaaaagattcgcaaacatattgtgataactttttaacaaattgtggttttagtaaagaattagctagtaaatattttgaagagggaacatttgaagagctagaagaattactaacttatgaatggggtcaagaaaaattacaaaaattaattgataaaaatataaaaatagagatctacttaggaagtgatgataagattattgatgcaaatgttgcattagagttttttaaacagtttggtgaagtatattttataaaagaaaaggggcatatcttatga

SEQ ID NO: 15318 - protein, 168 aa, Unknown
  Obtained from environmental sample
  misc_feature (1)..(168): Xaa is any amino acid
MKLYFSGFSLKGEKELFKDYIIENDFTVSGFSYGAQKAFEYVLNTDNRVDLLQLFSPAFFQDKDTKYKRLQLMFFKKDSQTYCDNFLTNCGFSKELASKYFEEGTFEELEELLTYEWGQEKLQKLIDKNIKIEIYLGSDDKIIDANVALEFFKQFGEVYFIKEKGHIL

SEQ ID NO: 15319 - DNA, 597 bp, Unknown
  Obtained from environmental sample
  misc_feature (1)..(597): n is a, c, g, or t
ttgggctataacaaacctcccgaggttaaagctaaaattgttgccatagactttggcgtaaaaagaaatattttaaatgaactgacacaagctggtatgagtgtggaagttgttccaaatacatttagtgcagatgagcttattaagcgttttgaagcaaaagagataaatggagtatttttatcaaacggtcctggtgatccgttagttttaaaagatgaacaagagcagattaagaagcttatagttgctaaaatcccaatgttcggtatctgtttaggacatcaactgctctctatctctcatggatatgaaacatacaaactaaagtttggtcaccatggtggaaatcatcctgttaaaaatatggataatggaacggttgaaattacagcacaaaaccataactataatgttcctaataacataactgaaattgcagaggttacacatacaaatctttttgataatacaatcgaaggattgcaatataatgatgaaccaatcttttcagtacaacaccaccctgaatcttctccaggaccaaaagagagtagatatatctttaataaatttttagaccttatgaacgcttaa

SEQ ID NO: 15320 - protein, 198 aa, Unknown
  Obtained from environmental sample
  DOMAIN (14)...(195): Glutamine amidotransferase class-I
  misc_feature (1)..(198): Xaa is any amino acid
MGYNKPPEVKAKIVAIDFGVKRNILNELTQAGMSVEVVPNTFSADELIKRFEAKEINGVFLSNGPGDPLVLKDEQEQIKKLIVAKIPMFGICLGHQLLSISHGYETYKLKFGHHGGNHPVKNMDNGTVEITAQNHNYNVPNNITEIAEVTHTNLFDNTIEGLQYNDEPIFSVQHHPESSPGPKESRYIFNKFLDLMNA

SEQ ID NO: 15321 - DNA, 552 bp, Unknown
  Obtained from environmental sample
  misc_feature (1)..(552): n is a, c, g, or t
atgaaagtctcactaaaacatgttccacatatttgtagtaaaattgctgtcgatttgaatcgtagtggattagttataatgacttcagggttagagcctattgcacatgaagcagagaaactatttatagaaaatattaaaaaagagatggcactagaagagagagttcatgagatagtggatgagaatgaagaggagatagatttttatctagctgatgagagacaactattttttatgattaaaaagaaacttgcacaggaatatggtgttattttatcttatgaagacagatactctgatctttcacataaaatcttagatgagctttatgaagaggatctgattaattatgaagtaagtgaaaacagaattaaaaatgttatttatgattcaattacatcatttatctcagatacatcagagatagaaaatgctgtatatgacaagataaaaacctataaaagagagcttatccctggtagtgatgattatgaaattttatatgaaaaactttacaaagaagagttgttaaaaagaggtatggagtaa

SEQ ID NO: 15322 - protein, 183 aa, Unknown
  Obtained from environmental sample
  DOMAIN (1)...(183): Protein of unknown function (DUF507)
  misc_feature (1)..(183): Xaa is any amino acid
MKVSLKHVPHICSKIAVDLNRSGLVIMTSGLEPIAHEAEKLFIENIKKEMALEERVHEIVDENEEEIDFYLADERQLFFMIKKKLAQEYGVILSYEDRYSDLSHKILDELYEEDLINYEVSENRIKNVIYDSITSFISDTSEIENAVYDKIKTYKRELIPGSDDYEILYEKLYKEELLKRGME

SEQ ID NO: 15323 - DNA, 315 bp, Unknown
  Obtained from environmental sample
  misc_feature (1)..(315): n is a, c, g, or t
atgattaaaatagaaaagattatcgattattctttgattaaaaataaagatatttttaatcaattaataaaacaaagagaaaagaaaatagatgttactattggatttgaacaatttaatattgaggatagtcataaagaagaatatattaaaaatttaaactatttacaagaactatatgaagatataaaagccaaaaagagaaataatgttgagaactttatatttatattaaaagagtatctatcagctagagaaatattagtagagaaaaaagatataaaaacttcagaatatatttatagattattttag

SEQ ID NO: 15324 - protein, 104 aa, Unknown
  Obtained from environmental sample
  misc_feature (1)..(104): Xaa is any amino acid
MIKIEKIIDYSLIKNKDIFNQLIKQREKKIDVTIGFEQFNIEDSHKEEYIKNLNYLQELYEDIKAKKRNNVENFIFILKEYLSAREILVEKKDIKTSEYIYRLF

SEQ ID NO: 15325 - DNA, 855 bp, Unknown
  Obtained from environmental sample
  misc_feature (1)..(855): n is a, c, g, or t
gtgtggcagaagcctcaattcttcggtttctatcatgatgagtataattttacatcggcaaaatcacccctttcacaatcatcactatttggtgatcgttcagttttagttataaagagtgaaaaaaaaattcctaaaaaagatcttgatactcttatagagttatgtcaaaaaaatagagacaatatttttatatatgcatattatggagtagattacagaacttcagcaactgcgtttaataaaaaaagtggctctgaaaatataagattttttactcctaatgagaatgaagcaaaaaatatacttattcaagccgctcgtgagatgaaactggatttagatccatacagtgcttcacatcttcttttagcacaaaacagtgatattgcattagcatataatgagctatcaaaattatctattttaaatcgagctatcactcccaaagatatcgatgaattggtctatggtttggcacaagtttcactagatcaactcatcaaaacaattttaaataaaaaagattttaaaatacaactacagcaaattatagaccatggagaagatgaaataagaattattacctcaatcagtaactatattacacaactttttctgtttcatacatatataaaactccatggaatctccagttcagtcgctgttttaggctataaactaccacctaaactagaggagactcttgcccagtttagcataaaattcagactagatagctatgaaaaagcactcaaacttctgcttagcacagaactctcaatgaaatcaaaaaatatagacaaaaattcactactactttctagcttaatcaaacttcaagctattttataa

SEQ ID NO: 15326 - protein, 284 aa, Unknown
  Obtained from environmental sample
  misc_feature (1)..(284): Xaa is any amino acid
MWQKPQFFGFYHDEYNFTSAKSPLSQSSLFGDRSVLVIKSEKKIPKKDLDTLIELCQKNRDNIFIYAYYGVDYRTSATAFNKKSGSENIRFFTPNENEAKNILIQAAREMKLDLDPYSASHLLLAQNSDIALAYNELSKLSILNRAITPKDIDELVYGLAQVSLDQLIKTILNKKDFKIQLQQIIDHGEDEIRIITSISNYITQLFLFHTYIKLHGISSSVAVLGYKLPPKLEETLAQFSIKFRLDSYEKALKLLLSTELSMKSKNIDKNSLLLSSLIKLQAIL

SEQ ID NO: 15327 - DNA, 726 bp, Unknown
  Obtained from environmental sample
  misc_feature (1)..(726): n is a, c, g, or t
ttgtgttgggaaggtgaagggcaaaaatggattaaagaaaatatattatcttataataaaaatataactatcaaaaaagaggttattgtaaaagatatatataatacagaccgttgttttgatgtagaaattagttctatagaatttgatggtcaaattgagttagtaattattggaaaggatatcacagaagagaaacttaatgcggataagctaaaaaatgcttatactgtttttgataatacaaatgatgggattttaataacagatgaagatgctaaaatagtagatgttaataaagcttttacgaaaaatacagggtatactctattagatgtagtgggaaaaaatcctaatatattaaaatcacaaagacatgataatgatttttataataaaatgtggaaagtattagaaaaagataatttttggcatggtgaaattgtaaataaaaataaagatggttctttttatgttgagcttttaactattaatagaatattgaaaaatgatggtagtgttaaaaactatatagcagtttttaccaatataacaaaacaaaaaaaacaagaaaaactcttaaaagagaaagagcaaatactttttcaacaatcaaaaatggctgcaatgggggagatgcttgagaatatagcacaccaatggcgacaacctttatctgtaatatcaacagctgcaagtggtattcagatgcaaaaagaagtttaa

SEQ ID NO: 15328 - protein, 241 aa, Unknown
  Obtained from environmental sample
  DOMAIN (73)...(136): PAS domain
  misc_feature (1)..(241): Xaa is any amino acid
MCWEGEGQKWIKENILSYNKNITIKKEVIVKDIYNTDRCFDVEISSIEFDGQIELVIIGKDITEEKLNADKLKNAYTVFDNTNDGILITDEDAKIVDVNKAFTKNTGYTLLDVVGKNPNILKSQRHDNDFYNKMWKVLEKDNFWHGEIVNKNKDGSFYVELLTINRILKNDGSVKNYIAVFTNITKQKKQEKLLKEKEQILFQQSKMAAMGEMLENIAHQWRQPLSVISTAASGIQMQKEV

SEQ ID NO: 15329 - DNA, 678 bp, Unknown
  Obtained from environmental sample
  misc_feature (1)..(678): n is a, c, g, or t
ttgaagaatatttataaaattattttactttcactattaattatatcgataattttaggtggaattcttttctctatgaatattttaaaaagtgaagcgattaaaaatcatatagaaattgcgaagtttcactcaaatattttttcagaacaattaacacaaacttttaatagtatcgaacatacagtaagtggattgtcattatttttagaaaatacaaatagtaaggtattggaaaaaaagatggatgatattttagcctcgaatccatacattcgttccttgaatatagtcgatgaaaacaatataataataaaaagttctaatagtaaaaacacaggttacaaaatagatattagtgattactacccaactcccgtgtttgataaatatattttacgctttggagagttatcgtatggtagggatattaatcaaagtgacacaaaactagtatatatacctattagtaaaaaagtatctacacttaaaggtgattatacaataataattgttgttaatattgataattttgtcaatagatataaagattcaatagctcaaaaattagatcatattgacattataagggtagatggtaaattgctttattctactggaaaaaatcataagttaaattccactattgtagaaacaaattttataaggattcactag

SEQ ID NO: 15330 - protein, 225 aa, Unknown
  Obtained from environmental sample
  SIGNAL (1)...(20)
  misc_feature (1)..(225): Xaa is any amino acid
MKNIYKIILLSLLIISIILGGILFSMNILKSEAIKNHIEIAKFHSNIFSEQLTQTFNSIEHTVSGLSLFLENTNSKVLEKKMDDILASNPYIRSLNIVDENNIIIKSSNSKNTGYKIDISDYYPTPVFDKYILRFGELSYGRDINQSDTKLVYIPISKKVSTLKGDYTIIIVVNIDNFVNRYKDSIAQKLDHIDIIRVDGKLLYSTGKNHKLNSTIVETNFIRIH

SEQ ID NO: 15331 - DNA, 561 bp, Unknown
  Obtained from environmental sample
  misc_feature (1)..(561): n is a, c, g, or t
atgccctatgaaaaaattgaaaatttgatagaaaaattttcttgtgaactgatactggctgatttggaagaggaaaatagtctatctggtttattaccactccttaaacatcttcataccctatgcatgagggtctcattaaaatcagaagccaaagaaatcatacgggccaaaaacctcataaatgaaggcataaaaaacaactcaacaaatgtcatacagcaaatgacttttttagaaacgtttatatctgacttatcaacatccataagtgaacttttaggaaaaaaagatcagatgattgaaatagaagaaaaaaatatgatggaaagcgattttgataacagacctgacgattactctgatttagaaaaaaaacttgaagacttttccgctttgatcggtgttttttgtccaggagaaattcctgattttggggatatactcaataatctggacagtcttattgaagtatcaaaagaaattgaaccatcaaccttttatcaaatttccaaggcttgcaaagagtatgttgaaaacatgacatttggaggatattaa

SEQ ID NO: 15332 - protein, 186 aa, Unknown
  Obtained from environmental sample
  misc_feature (1)..(186): Xaa is any amino acid
MPYEKIENLIEKFSCELILADLEEENSLSGLLPLLKHLHTLCMRVSLKSEAKEIIRAKNLINEGIKNNSTNVIQQMTFLETFISDLSTSISELLGKKDQMIEIEEKNMMESDFDNRPDDYSDLEKKLEDFSALIGVFCPGEIPDFGDILNNLDSLIEVSKEIEPSTFYQISKACKEYVENMTFGGY

SEQ ID NO: 15333 - DNA, 579 bp, Unknown
  Obtained from environmental sample
  misc_feature (1)..(579): n is a, c, g, or t
ttgagaaaattgaagatattatctaataaagatttttatgaaaaatctataaaagagtttggtgtatccgcaaaaggggtacactggaatagcaaatttacccaatataaaagatttgagatacttactaagtgtataaaaaaaaatatccaaaactcctctatagtagatgttggatgtggttttggtgagtactataattatctttcacacaacaataaattaccacaaaaatatgtaggtatagattgtgaagagaagatgatagatgtttgtaatattcgtttcccaaatgaacagtttattgtacaaaatgtacttggagataagttattagatgccgattattatatctgtagtggagctatgaatatcttgacttttgatgaggtagagatatttattaagagatgttttgaagcttcaaataaaggttttgtatttaattatcttaaaaatgtaacttttaatgatataaaacaataccacattgaagagatttgtaaaagatatacgcaaaatattattctaaaagatgggtatttagataatgattttactatctttatggtaaaatga

SEQ ID NO: 15334 - protein, 192 aa, Unknown
  Obtained from environmental sample
  misc_feature (1)..(192): Xaa is any amino acid
MRKLKILSNKDFYEKSIKEFGVSAKGVHWNSKFTQYKRFEILTKCIKKNIQNSSIVDVGCGFGEYYNYLSHNNKLPQKYVGIDCEEKMIDVCNIRFPNEQFIVQNVLGDKLLDADYYICSGAMNILTFDEVEIFIKRCFEASNKGFVFNYLKNVTFNDIKQYHIEEICKRYTQNIILKDGYLDNDFTIFMVK

SEQ ID NO: 15335 - DNA, 705 bp, Unknown
  Obtained from environmental sample
  misc_feature (1)..(705): n is a, c, g, or t
atgtgcggaatagtcggttacttaggtaataaaaatataaaaaatatacttctagatggcttaaaagagttagagtaccgcggatatgattctgcgggaatagcaattttagaaaatagtaacttctcactctataaagcagttggaaaactaaaaaatcttgaagagaagatgaaagagtatgagagccttgacttttgtattggtattggtcatacaagatgggcaacgcatggaaagccgacagaacttaatgcacatccccatatcggtgagagtacttatatcgttcataatggaattatagagaactatcaggagctaaaaaactcactgctgaatgatggagtaaaatttttatctcaaacagatactgaagttattgttcatctgtttgagagagaattaaaaagtataaaagatccttttgaagcttttcaatctacactaaaacaactccatggagcatacgcactgctgttaatcacaaaaagtgagagtgaaaaaatcttttatgcaaaacacggatcacctatgattatgggtttaaataagagtggtgaaaagttttttgcttcatctgatgcaccattaatcgggcattgtgaaaaagtatcttatcttgatgatggagattatggatatatatctaaaagtgaaatggtaaatttgataaaaaagtcaaaaaggagaactctcatttaa

SEQ ID NO: 15336 - protein, 234 aa, Unknown
  Obtained from environmental sample
  DOMAIN (2)...(134): Glutamine amidotransferases class-II
  misc_feature (1)..(234): Xaa is any amino acid
MCGIVGYLGNKNIKNILLDGLKELEYRGYDSAGIAILENSNFSLYKAVGKLKNLEEKMKEYESLDFCIGIGHTRWATHGKPTELNAHPHIGESTYIVHNGIIENYQELKNSLLNDGVKFLSQTDTEVIVHLFERELKSIKDPFEAFQSTLKQLHGAYALLLITKSESEKIFYAKHGSPMIMGLNKSGEKFFASSDAPLIGHCEKVSYLDDGDYGYISKSEMVNLIKKSKRRTLI

SEQ ID NO: 15337 - DNA, 342 bp, Unknown
  Obtained from environmental sample
  misc_feature (1)..(342): n is a, c, g, or t
atgaaaaatcttcaaaaatttccgctaacccattgtcatagttttacttatagtaaaagggatggaacaccaagtgctacaatgaaaccacaagtcaatggagcgattgcaaaacagcgtctaaaacaattagatgatataataaaacaaaaaaaccttgagtttagaaaacaacaaaaaagtttagatatacttatagaatcttctaaagatgatatttatacaggctatgatcaattttttaatcctattgaagtatcatcaagtagtgatattgttggggattggatagtatgtgatcagtttgaggtaaaggagaattataatgtttccaaattttaa

SEQ ID NO: 15338 - protein, 113 aa, Unknown
  Obtained from environmental sample
  misc_feature (1)..(113): Xaa is any amino acid
MKNLQKFPLTHCHSFTYSKRDGTPSATMKPQVNGAIAKQRLKQLDDIIKQKNLEFRKQQKSLDILIESSKDDIYTGYDQFFNPIEVSSSSDIVGDWIVCDQFEVKENYNVSKF

SEQ ID NO: 15339 - DNA, 537 bp, Unknown
  Obtained from environmental sample
  misc_feature (1)..(537): n is a, c, g, or t
atgtttccaaattttaataaaaaaaatgagaaagaaactcaatcaaatgtagataaaaatttaaagatgatgagtatttcagctattgtgttaatagtattatttttatatacacttacaaaagcagataatgtgatacatggctcaagttattatgtaggggttggctttttatttatacttttaattttaacatttgcattacaaaaatataaagataaaattcgtaaaaaattagggacaagtagattttcaaatgaattggaaaaagcacaagaggaaacacctacaaatgaaaagagcanagtgaaacanaaagaggagataacttctcaaataatgccaataagctcaaacattacttttcaagatgtagcagggatagaaagtataaaagaggagctagaagaggtagttgaatttttaaatcctccaaaaaaattttcaaaaccttatatctcttttcccaaagggggttttacttggaaggactcccaggtgtgggaaaaactccttattggccaaagccgtttgcgg

SEQ ID NO: 15340 - protein, 179 aa, Unknown
  Obtained from environmental sample
  misc_feature (1)..(179): Xaa is any amino acid
MFPNFNKKNEKETQSNVDKNLKMMSISAIVLIVLFLYTLTKADNVIHGSSYYVGVGFLFILLILTFALQKYKDKIRKKLGTSRFSNELEKAQEETPTNEKSXVKXKEEITSQIMPISSNITFQDVAGIESIKEELEEVVEFLNPPKKFSKPYISFPKGGFTWKDSQVWEKLLIGQSRLR

SEQ ID NO: 15341 - DNA, 435 bp, Unknown
  Obtained from environmental sample
  misc_feature (1)..(435): n is a, c, g, or t
ttgatgctttcaggattttattattttaatcaatttttaaaaaataaaaattataaaaatattattttttcaggattattatttggatatttatatttaactaaaataatccttctaatttttccattcattttaggaatttatctattatttaaatacaaaaaagcagcaataatatttggaattgttgtaattttatctgcaattcctggaatgatatataatcatatattatttggttcaattttaactacaggatattcatcagtttacaaatataatttaagtattttagattcgtcattatctggattttatcataatagtttaataggattatggattgtattaattgggattttgatacattgcccttttatttttttatccataaaaaaaattttaaaaaaagattttgaacccaattttaaataa

SEQ ID NO: 15342 - protein, 144 aa, Unknown
  Obtained from environmental sample
  misc_feature (1)..(144): Xaa is any amino acid
MMLSGFYYFNQFLKNKNYKNIIFSGLLFGYLYLTKIILLIFPFILGIYLLFKYKKAAIIFGIVVILSAIPGMIYNHILFGSILTTGYSSVYKYNLSILDSSLSGFYHNSLIGLWIVLIGILIHCPFIFLSIKKILKKDFEPNFK

SEQ ID NO: 15343 - DNA, 453 bp, Unknown
  Obtained from environmental sample
  misc_feature (1)..(453): n is a, c, g, or t
atgtacaaaaaagttaaaattatcgactcaaaaaaagatctgaatttaaaaattggcgaaataaaagattttaaatattcaaaaaatttaatgaatattattataactgctgaagagtttttcagagctagtaaatctcaacctatcgtattttctaaaaaagaagatggagagtttgtagcaactgcaatcatggggattaaagagaattctaacctctttgtaaatgcaaaaggagagtggaaaaattcagagtatattcctgcttatttaagacgttatccattcatttttgttcaaaatgaagagactttagcacttgctgttgatgaagattgtaaagctgtaaatgagaaagagggtcaaagtctatttgatgaaaatggagaatcatctgaatatacaaaaaaaggttatggaatttatgcaaaattttcaaagttcaagcattaa

SEQ ID NO: 15344 - protein, 150 aa, Unknown
  Obtained from environmental sample
  DOMAIN (8)...(147): SapC
  misc_feature (1)..(150): Xaa is any amino acid
MYKKVKIIDSKKDLNLKIGEIKDFKYSKNLMNIIITAEEFFRASKSQPIVFSKKEDGEFVATAIMGIKENSNLFVNAKGEWKNSEYIPAYLRRYPFIFVQNEETLALAVDEDCKAVNEKEGQSLFDENGESSEYTKKGYGIYAKFSKFKH

SEQ ID NO: 15345 - DNA, 678 bp, Unknown
  Obtained from environmental sample
  misc_feature (1)..(678): n is a, c, g, or t
atgggtgaaatgatagaaaatattgcacatcagtggagacagcctatatcacaaattaactcagctgttttagtaatgcatggtactttacaagttgcaaatattaataatcctacactaaaaaataaacttttagagatcgagtatttgacaaagtatatgtcaaataccatagatgcttttagaaacctatttgaaaacagtaagcaaaaagagaaatttactctgcaagaagttataaataactccatctctattttaagaggttctttgttagataataacatagaggtagagttgttaattaacaacaatagtattataaacggatatcctcaagagatacaacaggtgatatttgtgattgtaaataatgccagagatgctctgatatctaaaaaaatagaaaaacctatgattatgattactactcttgaaagagaagataaacacattataaatatttgtgataatgcaggcggaattgaagagacaataatagataagatatttgagccatactatacaacaaaacacaaatcaaaaggaactggacttggactttatatatcaaaaatgattattgaagatgcaatggatggatatatacatgttaataatatccacgatggtgcctgttttacaattgaacttaaaaaggaggagtctgatgaatga

SEQ ID NO: 15346 - protein, 225 aa, Unknown
  Obtained from environmental sample
  DOMAIN (110)...(221): Histidine kinase-, DNA gyrase B-, and HSP90-like ATPase
  misc_feature (1)..(225): Xaa is any amino acid
MGEMIENIAHQWRQPISQINSAVLVMHGTLQVANINNPTLKNKLLEIEYLTKYMSNTIDAFRNLFENSKQKEKFTLQEVINNSISILRGSLLDNNIEVELLINNNSIINGYPQEIQQVIFVIVNNARDALISKKIEKPMIMITTLEREDKHIINICDNAGGIEETIIDKIFEPYYTTKHKSKGTGLGLYISKMIIEDAMDGYIHVNNIHDGACFTIELKKEESDE

SEQ ID NO: 15347 - DNA, 717 bp, Unknown
  Obtained from environmental sample
  misc_feature (1)..(717): n is a, c, g, or t
atggttccagaagcaactatggtttctacttatatggaaatcaaaaaacttttccaaactgcagaagcatctaagggtggatttgacttattacctgaagagttagtagacgttttagagcaaatcaaacgtggtaagaaaatcacagatgaagcaaaaactagaatggcaaaatcaaaccttagacttgtagtatctattgcaaaaagatatacaaatagaggtttacctttcctagacttaatccaagaaggaaatataggtcttatgaaagctgttgataagtttgagtataaaaagggatataaattctctacttatgcaacttggtggattagacaagcaatttcaagagcaattgctgaccaagctagaactattagaattccaattcatatgattgaaactattaatagaattaataaaatcattagaaaaggtattcaagaaaatgggaaagagccaaatgtggatgaaatcgcaaaagaagttggactacctgttgataaagtaaaacaagtaattaaaatcacaaaagaaccagtatctttagaggctcctattggatctgatgaagatggtaaatttggagattttgtacctgatgaaaaagctccaacacctgttgataatattatgaaagaagatttacaaaatcaaattgatcagatattagcccaactaaatgaaagagaacaaggcagttgtaagaaatga

SEQ ID NO: 15348 - protein, 238 aa, Unknown
  Obtained from environmental sample
  DOMAIN (56)...(126): Sigma-70 region 2
  misc_feature (1)..(238): Xaa is any amino acid
MVPEATMVSTYMEIKKLFQTAEASKGGFDLLPEELVDVLEQIKRGKKITDEAKTRMAKSNLRLVVSIAKRYTNRGLPFLDLIQEGNIGLMKAVDKFEYKKGYKFSTYATWWIRQAISRAIADQARTIRIPIHMIETINRINKIIRKGIQENGKEPNVDEIAKEVGLPVDKVKQVIKITKEPVSLEAPIGSDEDGKFGDFVPDEKAPTPVDNIMKEDLQNQIDQILAQLNEREQGSCKK

SEQ ID NO: 15349 - DNA, 399 bp, Unknown
  Obtained from environmental sample
  misc_feature (1)..(399): n is a, c, g, or t
ttgcaacactttctttcatataaaagaaatgtaagcaagagacttgaaaatattgattatgatgcacagctttctaatgatagggatgaacttgataaaatagatgatccctatgatttatatgatgaggaagagataaatgagaaaaaagatttttcagcctcagagataaaagatattataaaagaagaaaaatcaaaaatcaaacaaaatagctttaaaaacacaatttatactagtggtagttttatatcagtttatagaattgtaggttatgtactacttatatttggatttttttctttgaataataacgggatatttaatgcaatgccatatttagcaggactttttattgtcccactatcaatgctttgtgctaaatttattttaaaataa

SEQ ID NO: 15350 - protein, 132 aa, Unknown
  Obtained from environmental sample
  misc_feature (1)..(132): Xaa is any amino acid
MQHFLSYKRNVSKRLENIDYDAQLSNDRDELDKIDDPYDLYDEEEINEKKDFSASEIKDIIKEEKSKIKQNSFKNTIYTSGSFISVYRIVGYVLLIFGFFSLNNNGIFNAMPYLAGLFIVPLSMLCAKFILK

SEQ ID NO: 15351 - DNA, 351 bp, Unknown
  Obtained from environmental sample
  misc_feature (1)..(351): n is a, c, g, or t
atgttaaccaggataaaaaataggcaccaaaaaatgtttcaaaaacaaatatttttacccctagttgacttgacaatctcgacaagaaaaactaaatcagaaattaaatttgtgaaaaattatgacccctctattccagagtttatgatggttgcttcagactttctaaaacttttaaatagtatttatgattcatttgatagtgattgtaaatatataaacacttctgtgaaattaaaaacaggtgaatatattaaactagaagataagaagtactctttagttactattgaaatttatggagataactataattgtgattctgaattaataagacatgatcaaaaatag

SEQ ID NO: 15352 - protein, 116 aa, Unknown
  Obtained from environmental sample
  misc_feature (1)..(116): Xaa is any amino acid
MLTRIKNRHQKMFQKQIFLPLVDLTISTRKTKSEIKFVKNYDPSIPEFMMVASDFLKLLNSIYDSFDSDCKYINTSVKLKTGEYIKLEDKKYSLVTIEIYGDNYNCDSELIRHDQK

SEQ ID NO: 15353 - DNA, 966 bp, Unknown
  Obtained from environmental sample
  misc_feature (1)..(966): n is a, c, g, or t
atgcgaaaaacgaaaattggttttgtaacatttgcggatcaatttaaagaattagcaataaaatctgctaatanccatgataaagctaaagctattgcatttgatgtaaataacgaagatgaaagaaaccgtttgattgatgagaatgatattattatttctatgcttccagctcacatgcatatttctgtagcaaaagattgtattcgattaaaaaaacacatggttaccgcttcttatgtttctaaagaaatgaaagcactaaaacaagaagccattgatgcaggtgtggttataatgaatgaaattggtgttgatcctgggattgatcacctttctgccatgcgtttgattaatgaaattagagaaaatggtggagagttagaagcttttgaaacctttactggtggtttggtagctcccgaaagtgataataacccttggaattataaatttacttggaacccaagaaatgtagttttggcaggacaaggaactgtaaaatttattcaaaatcataaatacaaatatattccttatcataaattgtttagaagaactgaaataatagatattgatggacatggaaagtttgaaggatatgctaatagagattctttgcaatacagaggaatttacggattagaagatattcctactatgtatagaggaacacttagaaagccgggtttttgtagagcttgggatgttttcgtgcaactaggagcaacggacgattcttatattatggaaggttctgaaaatatgacaaacagagagtttattaattcatttttggcttacaacgaaactgattcagttgagctaaaatttaaacactatctaaatattcgtcaggatgatgttgatttgtttgacaaatttgtttggttaggtatttttgaaaatactaaaataggtatgaaagatgctactccagcacaaattctcaacactcagccataa

SEQ ID NO: 15354 - protein, 321 aa, Unknown
  Obtained from environmental sample
  DOMAIN (2)...(312): Saccharopine dehydrogenase
  misc_feature (1)..(321): Xaa is any amino acid
MRKTKIGFVTFADQFKELAIKSANXHDKAKAIAFDVNNEDERNRLIDENDIIISMLPAHMHISVAKDCIRLKKHMVTASYVSKEMKALKQEAIDAGVVIMNEIGVDPGIDHLSAMRLINEIRENGGELEAFETFTGGLVAPESDNNPWNYKFTWNPRNVVLAGQGTVKFIQNHKYKYIPYHKLFRRTEIIDIDGHGKFEGYANRDSLQYRGIYGLEDIPTMYRGTLRKPGFCRAWDVFVQLGATDDSYIMEGSENMTNREFINSFLAYNETDSVELKFKHYLNIRQDDVDLFDKFVWLGIFENTKIGMKDATPAQILNTQP

SEQ ID NO: 15355 - DNA, 762 bp, Unknown
  Obtained from environmental sample
  misc_feature (1)..(762): n is a, c, g, or t
ttgaaagataaacatgcgattacaacacaatatatctcaatgcctctgaagttttcaaaaacagttgataagtttaaacatccacaaattaaaattttaaatagtttcaaacatcatgagaaaatttcaataggtgatctcagttcaaacagtttttatgtacgcctacagtacgtaagtgctcaaagtgcagaaaaaatccaaaatgttctagagatacttatgcgttatggcataccaaactattttggttttcagcgtttttcaaaagatagtgacaacaaagagatgtgtcaagagatagcttatggtgaaatagatctgaaaaataaaaataaacaaaaactcttgacaagtgcttatcaaagttatctttttaatgattggctgattgagcgtgtgaaactctcaaaagatattgatcgacttagttcaaaagagctctctgaaatgttaaaaatagatgagaagagtgcaaatgaactaaaagggcaaaactatccatttaaacttttatatggtgatgtactgctagatcaagagaataaaaagtgggtaaaccttgatgatattaaatcatataaaaaagcatttaaagatcgtaaagtgacacctacaggcttaatgtgtggaaaaagaccttggcgagctaaaaatttagccggaacatttgagagtgaatttgatgatatattagttcaagcaaatggtgctagaagagaggcttgggtctacccaactaagataagctcaaatttataa

SEQ ID NO: 15356 - protein, 253 aa, Unknown
  Obtained from environmental sample
  DOMAIN (1)...(253): tRNA pseudouridine synthase D (TruD)
  misc_feature (1)..(253): Xaa is any amino acid
MKDKHAITTQYISMPLKFSKTVDKFKHPQIKILNSFKHHEKISIGDLSSNSFYVRLQYVSAQSAEKIQNVLEILMRYGIPNYFGFQRFSKDSDNKEMCQEIAYGEIDLKNKNKQKLLTSAYQSYLFNDWLIERVKLSKDIDRLSSKELSEMLKIDEKSANELKGQNYPFKLLYGDVLLDQENKKWVNLDDIKSYKKAFKDRKVTPTGLMCGKRPWRAKNLAGTFESEFDDILVQANGARREAWVYPTKISSNL

SEQ ID NO: 15357 - DNA, 648 bp, Unknown
  Obtained from environmental sample
  misc_feature (1)..(648): n is a, c, g, or t
atgttgaaagttacccaatcaataaaaaatgcttgtgataaagatatagcagataacctattttattacaaatatggagtaaagcatcttttatcacttattcgcaaaaatgtagatccggaatctcctgaatttatcagctcttatcgatcttttgagggtgaagtttttgaaaactacctgtatgaaaaattggttgtatatgcgcaggagaatgagcatgttgaaaaatttatcattaaaggtgctcatgccgaaaatacaaaatctatcccaaatacgatctctgtaaatgagaagggtcaaattgtctgtagaacaaacagaaatgagataggtgaatttgacgctttaatatttacaaaaaatgagctctattttgtagagatgacactggttaaatctgttagctctctgagaaaaagactccgtaaaaaaatagcacttcttgaagcatacttcccagatcttaaagtaaaagcactacttatcttaaatgagggtgtagtcggtacaaaagttttaccggattatgctattacatggattataaagcccttctcatcacaaaaaatatttgattggattactttctacaaaaaaaagaaaactaagaccttttcaaagagcccattcctcataagatga

SEQ ID NO: 15358 - protein, 215 aa, Unknown
  Obtained from environmental sample
  misc_feature (1)..(215): Xaa is any amino acid
MLKVTQSIKNACDKDIADNLFYYKYGVKHLLSLIRKNVDPESPEFISSYRSFEGEVFENYLYEKLVVYAQENEHVEKFIIKGAHAENTKSIPNTISVNEKGQIVCRTNRNEIGEFDALIFTKNELYFVEMTLVKSVSSLRKRLRKKIALLEAYFPDLKVKALLILNEGVVGTKVLPDYAITWIIKPFSSQKIFDWITFYKKKKTKTFSKSPFLIR

SEQ ID NO: 15359 - DNA, 318 bp, Unknown
  Obtained from environmental sample
  misc_feature (1)..(318): n is a, c, g, or t
atggggagtagtatcgtattgacttctggtatccgaaaggtagtaaaccaacttagtctttatgtttctaaattaaaatctcttaatggaaaccttacaagagcatcatcaattattgcacctccagcctatacttaccatgcaattagtgattttgacatagggaaaaaagggtggggaaataaaaacttcactgcagatttcgcaagaacccaagagttcgcacaaatgagaaagctaaactatataagtatacgatataccccaaataataaagatggtgtaagatttgaaccttggcatgtaaaggttatatag

SEQ ID NO: 15360 - protein, 105 aa, Unknown
  Obtained from environmental sample
  misc_feature (1)..(105): Xaa is any amino acid
MGSSIVLTSGIRKVVNQLSLYVSKLKSLNGNLTRASSIIAPPAYTYHAISDFDIGKKGWGNKNFTADFARTQEFAQMRKLNYISIRYTPNNKDGVRFEPWHVKVI

SEQ ID NO: 15361 - DNA, 795 bp, Unknown
  Obtained from environmental sample
  misc_feature (1)..(795): n is a, c, g, or t
atgacagatcggctcaggctctcatatatagaagaaaattcaaaattaagcattcaaaatttaccattaaaatactactggaactctggaatgtttatgtttaaagcaggtgtttttctagaagaacttcaaaaatactctcctgaaatatttgatacttctaaacaagctttagaaaatgcctcaaaagagggaatgattagaataaaatatgaagatatgataaatatccctgaagatagtatagactatgcagtgatggaaaaatcttcaaaagttaaagtgataccatcagatataaattggtcagatgtcggaagttttgattctctttatgatgagttaccaaaagatgaaaatggtaatactcaaaataaaaatcatattagtataaatagtaaaaataatttcatctatggaagtgaaagaaaaatagcaacaatagatatagaagatatgattatagtcgatacaggagatgcacttttagtttctaaaaaaggaagctctcaaaaagtaaaaaaggttgtagaaaccctaaaaaatagagattcagaattacataatattcatcttacaggtcatagaccttggggtacatatactgtattagaagatagtataggatataaaattaagcggatagaagtaaaaccaggtaaaagacttagtttacaaaaacattttcatagaaatgaacattggatagtagtatcaggtactgcaactgtaacagttggagaaactacaagactaatcagaccaaatgaatcaacatatataaaaatggggtga

SEQ ID NO: 15362 - protein, 264 aa, Unknown
  Obtained from environmental sample
  DOMAIN (132)...(264): Mannose-6-phosphate isomerase
  misc_feature (1)..(264): Xaa is any amino acid
MTDRLRLSYIEENSKLSIQNLPLKYYWNSGMFMFKAGVFLEELQKYSPEIFDTSKQALENASKEGMIRIKYEDMINIPEDSIDYAVMEKSSKVKVIPSDINWSDVGSFDSLYDELPKDENGNTQNKNHISINSKNNFIYGSERKIATIDIEDMIIVDTGDALLVSKKGSSQKVKKVVETLKNRDSELHNIHLTGHRPWGTYTVLEDSIGYKIKRIEVKPGKRLSLQKHFHRNEHWIVVSGTATVTVGETTRLIRPNESTYIKMG

SEQ ID NO: 15363 - DNA, 429 bp, Unknown
  Obtained from environmental sample
  misc_feature (1)..(429): n is a, c, g, or t
ttggattcttcaaaatttgaaattaataaaagaaattttagagtagttgatatcattgataattctttagatattttacttgtggacaatgatgtaatcgaattaaatattcaacaagatatgatagtaaatatagattttgaacttttttcaatagctataaaaaatttaatagacaatgctgtgaaatatagtaaagagaaaccaaacatttcgataattgataattcttttataatatcatcaagtggagataaattatcaaaatcattagaagagtataaaaaaccatttaataaagagtttgaaaatagtaaaagtggtttagggctggggctatatattgttcaaaatatattaacagcacataatttagtattagaatatatttatcataatgggaataatatttttaaaatacaattttaa

SEQ ID NO: 15364 - protein, 142 aa, Unknown
  Obtained from environmental sample
  misc_feature (1)..(142): Xaa is any amino acid
MDSSKFEINKRNFRVVDIIDNSLDILLVDNDVIELNIQQDMIVNIDFELFSIAIKNLIDNAVKYSKEKPNISIIDNSFIISSSGDKLSKSLEEYKKPFNKEFENSKSGLGLGLYIVQNILTAHNLVLEYIYHNGNNIFKIQF

SEQ ID NO: 15365 - DNA, 333 bp, Unknown
  Obtained from environmental sample
  misc_feature (1)..(333): n is a, c, g, or t
ttgatacatttcttttttaatttaggagaaatattgagtattataaagcaaacaatctatttggcaagaaaaactaaagagaaagatttagaaaaaaagctatacaatttgaaaaattcattattagatatgaagggttgtatttattttgaagtttacaaatctgatgattgtgatgatgagtttttaatttatgaagagtgggacagtgaagagttatacacaagctcactctcaagcgaagcctatgtatcttttgaaaaaaattggggatactttggttttaaaaaaacccaatctacctattctttaaactatttatttttattttag

SEQ ID NO: 15366 - protein, 110 aa, Unknown
  Obtained from environmental sample
  DOMAIN (22)...(85): Antibiotic biosynthesis monooxygenase
  misc_feature (1)..(110): Xaa is any amino acid
MIHFFFNLGEILSIIKQTIYLARKTKEKDLEKKLYNLKNSLLDMKGCIYFEVYKSDDCDDEFLIYEEWDSEELYTSSLSSEAYVSFEKNWGYFGFKKTQSTYSLNYLFLF

SEQ ID NO: 15367 - DNA, 783 bp, Unknown
  Obtained from environmental sample
  misc_feature (1)..(783): n is a, c, g, or t
ttgtttatttttatattttcaacagttgttacatttgcaacagttgtatatactttaagtattcccaatagttatagtgttaaaacaacacttctaccactagaagaaaaaggtggtagttcattaggtggacttggtgccttagcttcgatggcaggcgttagtttaggcgggagtgcttcgctaggaccggcagactcatttaatctttttttagaagataaaaatctcatgagcaaatttattttagataataacttgactcagttattaaataaaaatgatacatctaaataccattttgccttggggagcagatttgtttatgatcttacacactcaaagggttcttctaaaaatattactgaggatgataagctatatagtgcctataaaagattaaagagtatgatatctatttcaagtgataaaaagacaggtgctatgagtgtaactgtaagtgattcagatatgtatttatcaaaaaatattttagagctttttatagtcaaagcaagcagttatctaaaggggcttgatattgatttgttagataagaatttagactactatgcaaatgcaatttctgatacaagagatgtgcaaatatcatctcaattggcgtcacaaatatcagcactgattcaacaaaagatagttcttagatcaagtccatactataaatttaagatgatcactgaacctacccttccattttatcaagataaaactaaaccaaaacgcggattgattggtggtgtggtctgccaattacctcattaa

SEQ ID NO: 15368 - protein, 260 aa, Unknown
  Obtained from environmental sample
  DOMAIN (1)...(171): Chain length determinant protein
  misc_feature (1)..(260): Xaa is any amino acid
MFIFIFSTVVTFATVVYTLSIPNSYSVKTTLLPLEEKGGSSLGGLGALASMAGVSLGGSASLGPADSFNLFLEDKNLMSKFILDNNLTQLLNKNDTSKYHFALGSRFVYDLTHSKGSSKNITEDDKLYSAYKRLKSMISISSDKKTGAMSVTVSDSDMYLSKNILELFIVKASSYLKGLDIDLLDKNLDYYANAISDTRDVQISSQLASQISALIQQKIVLRSSPYYKFKMITEPTLPFYQDKTKPKRGLIGGVVCQLPH

SEQ ID NO: 15369 - DNA, 315 bp, Unknown
  Obtained from environmental sample
  misc_feature (1)..(315): n is a, c, g, or t
ttgtataatgtttatattaatgtatatgattggaaaaatatggtcaattcgcctcttgtgcaaaatagtattcaaaaattatttgataatggaacttcaactttatttatttggaataatgatgattcttggagtgtcaattatgtttctcataatgtatcaaaactattaggatattcaagttctgattttttacaaaataatatcacttatattcaatgtgtgcataaagattatatagatcaaataaagaaggagttacacatttttcacaaaatggtagtgaatttttcgagcataaaccgttataaataa

SEQ ID NO: 15370 - protein, 104 aa, Unknown
  Obtained from environmental sample
  misc_feature (1)..(104): Xaa is any amino acid
MYNVYINVYDWKNMVNSPLVQNSIQKLFDNGTSTLFIWNNDDSWSVNYVSHNVSKLLGYSSSDFLQNNITYIQCVHKDYIDQIKKELHIFHKMVVNFSSINRYK

SEQ ID NO: 15371 - DNA, 606 bp, Unknown
  Obtained from environmental sample
  misc_feature (1)..(606): n is a, c, g, or t
atggatttcgcttctgatggtatccatatattaagcccccagggcaatctaatagagttcagtcaatcatttgcaaatatgttgggatatagtaaggatgagctaggttcccttagtgtacatgattgggatgataatatttcaaaagaaaaaattatatatatgatagaaaagttaataaagaaaccagataagttttatacaaaacataaaagaaaagatggttcaattattgaagtagagataaatgcaaaaggtattgaacttgatgggaaaaaacatctttatgcttcagcaagagatattacagacttaactaaacttcaaaatcaaattttatatgaaaagaattttgtctctacaattattgaaagttcaaatgccattatagctgttattgatagtaatggaacaatgattaagctcaatagttatgggcaaaaatttacaggatatactgaagaagcgatatcctcagaaccttttaaatggcgatgttttctacctgaagatattcaagaaaaagttgtaggtatcgttgaaaatgcaaaaaaaggaaatattataaaaagctaccaaaactcttgggtttcaaaaacagggtga

SEQ ID NO: 15372 - protein, 201 aa, Unknown
  Obtained from environmental sample
  misc_feature (1)..(201): Xaa is any amino acid
MDFASDGIHILSPQGNLIEFSQSFANMLGYSKDELGSLSVHDWDDNISKEKIIYMIEKLIKKPDKFYTKHKRKDGSIIEVEINAKGIELDGKKHLYASARDITDLTKLQNQILYEKNFVSTIIESSNAIIAVIDSNGTMIKLNSYGQKFTGYTEEAISSEPFKWRCFLPEDIQEKVVGIVENAKKGNIIKSYQNSWVSKTG

SEQ ID NO: 15373 - DNA, 927 bp, Unknown
  Obtained from environmental sample
  misc_feature (1)..(927): n is a, c, g, or t
gtgatgggctatccgcacatagataaagcagtatttgattctattattttttggaataaagagagatacaatattgagatagataaaaaacaaatacaccttatgcctagtgttttaagctctctagcttgttgtattacagctttaagtgaacaaaatgatgaagtgattatccaaactcctgtatatccccctttttatgatattgttaaacttaataaaagagtactcatagaaaataaactaaaaaaagtaaatgataaatatgagatagattttaaagatttaaaaaagaaaatatcacaaaaaacaaaactacttattctttgtaatccacacaatcctataggtagagcttgggataaaaaagagttacaaaaactttcaaaaatctgtaagcaaaataatataatcatcataagtgatgagattcatagtgatatttgttttacaacatttcaatctgttttaaacattaaagagtgtgaaaacaactgtgttgtattaaactcaccaacaaaatcatttaatctagctggggtaaaaatagcttataccctttgtaaaaatgagtatattcataatacacttcaatcagagataaaaaaacgatatgtagatgagcttaatatttttgcacccgttgcacttaaaagtgcttatagtaaaaaaggtttaatatatatagaaaaactcgcttcgtatctcanagaaaattgcacttatacatacaactgcttcaataataatttaccaaaacttattgttattcaaaatgaagctacttatcttatttggctagatttttctaactttgatttatctcataatcaaatatttacaaagcttacaaacgaagcaaaagtactattaaatgatggaaaaggttttttccaaaaaagaggggaaaaaaatgttttaaaatcn

SEQ ID NO: 15374 - protein, 309 aa, Unknown
  Obtained from environmental sample
  DOMAIN (16)...(308): Aminotransferase class I and II
  misc_feature (1)..(309): Xaa is any amino acid
MMGYPHIDKAVFDSIIFWNKERYNIEIDKKQIHLMPSVLSSLACCITALSEQNDEVIIQTPVYPPFYDIVKLNKRVLIENKLKKVNDKYEIDFKDLKKKISQKTKLLILCNPHNPIGRAWDKKELQKLSKICKQNNIIIISDEIHSDICFTTFQSVLNIKECENNCVVLNSPTKSFNLAGVKIAYTLCKNEYIHNTLQSEIKKRYVDELNIFAPVALKSAYSKKGLIYIEKLASYLXENCTYTYNCFNNNLPKLIVIQNEATYLIWLDFSNFDLSHNQIFTKLTNEAKVLLNDGKGFFQKRGEKNVLKS

SEQ ID NO: 15375 - DNA, 552 bp, Unknown
  Obtained from environmental sample
  misc_feature (1)..(552): n is a, c, g, or t
ttggttttaacaacatttccaatctgttttaaaccattaaagagtgtgaaaacaactgtgttgtatttaaactcaccaccaaaatcatttaatctagctggggtaaaaatagcttataccctttgtaaaaatgagtatattcataatacacttcaatcagagataaaaaaacgatatgtagatgagcttaatatttttgcacccgttgcacttaaaagtgcttatagtaaaaaaggtttaatatatatagaaaaactcgcttcgtatctcaaagaaaattgcacttatacatacaactgcttcaataataatttaccaaaacttattgttattcaaaatgaagctacttatcttatttggctagatttttctaactttgatttatctcataatcaaatatttacaaagcttacaaacgaagcaaaagtactattaaatgatggaaaaggtttttccaaaaaagaggggaaaaaatgttttagaatcaatgtagctttaccatttaatgagcttaaaaactcacttgaaaatatcgtaaaagcttttagttaa

SEQ ID NO: 15376 - protein, 183 aa, Unknown
  Obtained from environmental sample
  misc_feature (1)..(183): Xaa is any amino acid
MVLTTFPICFKPLKSVKTTVLYLNSPPKSFNLAGVKIAYTLCKNEYIHNTLQSEIKKRYVDELNIFAPVALKSAYSKKGLIYIEKLASYLKENCTYTYNCFNNNLPKLIVIQNEATYLIWLDFSNFDLSHNQIFTKLTNEAKVLLNDGKGFSKKEGKKCFRINVALPFNELKNSLENIVKAFS

SEQ ID NO: 15377 - DNA, 378 bp, Unknown
  Obtained from environmental sample
  misc_feature (1)..(378): n is a, c, g, or t
gtggtggtggatttgaattctaataatatattacctagcccatgttatgtatgtgaagaggaacttttagaaaataatctaaaactacttaaaaaagtacaagaggaagcaaatataaaaattcttttagcattaaaagggtttgcaatgtttagtacttttgaactttgcaaaaaatatcttaaaggatgttgtgctagtggtttaaatgaagctattttggcaaaagaagagtttggacttgaagtacatacttattctccagcttttaagccaaatgaatttgaaaaaattgtagagatatcaaatcatatagttttttattcatttaatcagtttgaactttataaagaaaaactaactccaacaatagtatag

SEQ ID NO: 15378 - protein, 125 aa, Unknown
  Obtained from environmental sample
  misc_feature (1)..(125): Xaa is any amino acid
MVVDLNSNNILPSPCYVCEEELLENNLKLLKKVQEEANIKILLALKGFAMFSTFELCKKYLKGCCASGLNEAILAKEEFGLEVHTYSPAFKPNEFEKIVEISNHIVFYSFNQFELYKEKLTPTIV

SEQ ID NO: 15379 - DNA, 654 bp, Unknown
  Obtained from environmental sample
  misc_feature (1)..(654): n is a, c, g, or t
atgacagatcggctcggatttcatactgataatcaaaccaatggaagaggacaaagaggaagtgtttgggaaacaatacctaatgaaaacctgactttttctatcctacttaaacccaatttattggtaaatgaacaatttctgttgagcaaagtttgtgctttgggtattttagattttttaacagatttaggtataaaaaataccaacataaaatggcctaatgatatttatgttggtagtcaaaaaattgcaggaatgttattagaaaacaccttgaaaaattctaaaattgagttttgtgttgcaggaattggtataaacattaaccaaactagttttaatgaacacctacaacaagctacttctttgcaacttattaccaataaaagctacgacttaaatagtattttaaatcaattgcttttttttattgaaaaacgctatttaaaacttaaagcaggtaaactcctacaaatcaataacgattacctcaagcatcttttgggctataataccgaaagaacttaccttataaataaccaaaaagttttgggtgtaattaatggtgttgctccctctggtaaattacgacttatccatgataacaagctacacgaatacgatatgaaagaaattgggtttgtgttttga

SEQ ID NO: 15380 - protein, 217 aa, Unknown
  Obtained from environmental sample
  DOMAIN (1)...(115): Biotin/lipoate A/B protein ligase family
  misc_feature (1)..(217): Xaa is any amino acid
MTDRLGFHTDNQTNGRGQRGSVWETIPNENLTFSILLKPNLLVNEQFLLSKVCALGILDFLTDLGIKNTNIKWPNDIYVGSQKIAGMLLENTLKNSKIEFCVAGIGININQTSFNEHLQQATSLQLITNKSYDLNSILNQLLFFIEKRYLKLKAGKLLQINNDYLKHLLGYNTERTYLINNQKVLGVINGVAPSGKLRLIHDNKLHEYDMKEIGFVF

SEQ ID NO: 15381 - DNA, 546 bp, Unknown
  Obtained from environmental sample
  misc_feature (1)..(546): n is a, c, g, or t
ttgcatagaataaactcatttttaggaagcggttctgttttagcttatcatgatttagagattcgtggcggtggaaatttagtgggtgatgcacaaagcggacatattaaaaatataggttattcactctatttgaagatgttggaagagtcgattaaagagcttacaaactcagtagagaaagagcgtaaaaaagtagatattaaactcgctatcagtgcttatatctctgatgaagtgataagtgaagatagactaagattagagctctatcgtcgtctaagccactgtgaaactcctcaagagatttatgagatagaagaggagatcatagatcggtttggaaaattagatactcctacaaaacagttttttgagctgatggtaattaaacttctttcattaaaagcaaacattaagagtgttagcaactatggacaaaatataacaattgagttagaaaatgagactaaaacaactattaaatcagcaagtaaagatgatgatgacataatagccgcacttttacaacatttacgcaaataa

SEQ ID NO: 15382 - protein, 181 aa, Unknown
  Obtained from environmental sample
  DOMAIN (69)...(174): TRCF domain
  misc_feature (1)..(181): Xaa is any amino acid
MHRINSFLGSGSVLAYHDLEIRGGGNLVGDAQSGHIKNIGYSLYLKMLEESIKELTNSVEKERKKVDIKLAISAYISDEVISEDRLRLELYRRLSHCETPQEIYEIEEEIIDRFGKLDTPTKQFFELMVIKLLSLKANIKSVSNYGQNITIELENETKTTIKSASKDDDDIIAALLQHLRK

SEQ ID NO: 15383 - DNA, 561 bp, Unknown
  Obtained from environmental sample
  misc_feature (1)..(561): n is a, c, g, or t
atgatgcatttttacaagacaaaattcaagtataccgtccttatcacatttttacttttattcaatttctgtcagacgaatacggtaataaagaaattagaaacaacaccatccccccctgagtcaaatatcgtcttagaaaatggcagcagacctccggaatattttaaagttttatcagaagcaaagatcgatccggattgcctcacctgcaattcacaaaacagatatagtacagggttaaaacctttttctaaagtctcagcagagatccttttgaaaaaattaaaaccttttttaaacgataaatttaccaatactcataatgaagacttgaacgagaagcttgaggatcacgtgatgtgggcgatggtcagaggggttttaattgagggaaataataataacctgggggccatcatcctaaaaggtcatttctggaccgataaaaacggaagaaagcaaccactgacaatattcccggactgcatttaccaccatttccaaatgccaaaaaactcctggttttcgatctttaccttgaaaaggggaaaaggttaa

SEQ ID NO: 15384 - protein, 186 aa, Unknown
  Obtained from environmental sample
  misc_feature (1)..(186): Xaa is any amino acid
MMHFYKTKFKYTVLITFLLLFNFCQTNTVIKKLETTPSPPESNIVLENGSRPPEYFKVLSEAKIDPDCLTCNSQNRYSTGLKPFSKVSAEILLKKLKPFLNDKFTNTHNEDLNEKLEDHVMWAMVRGVLIEGNNNNLGAIILKGHFWTDKNGRKQPLTIFPDCIYHHFQMPKNSWFSIFTLKRGKG

SEQ ID NO: 15385 - DNA, 540 bp, Unknown
  Obtained from environmental sample
  misc_feature (1)..(540): n is a, c, g, or t
atggcatttaccccaattttcaaaatgccaaaaactcccgttttcgatctttacctgaaaaaggaaaagtttaaacatgtgatcaacctctatgatggagatatgaatctaagggcccttattattcaggagaaagagacatcagaagaattaaaggcatcatatgtcagaacagctgaacttaactatggacattggagatcagcaatcagaagtcatcctgagaaaggaccggagttaactgacgcaacaaaaagtgttgcaaaattaattaaggaacagatactgaacccccggggagaaaaactaaaaggaaatatcctcattcattgtggtggaggcatgcatcggaccggaatgattatggggttattaatgagagttattaataaaagtcccagacaattaattattgacacatataaatatcatactggatatagagggaaaaacacaccaggtggatttgaacagggaaatctggatttcattttcaattttgatccagatcttttaatatcaaagactccggagcaataa

SEQ ID NO: 15386 - protein, 179 aa, Unknown
  Obtained from environmental sample
  misc_feature (1)..(179): Xaa is any amino acid
MAFTPIFKMPKTPVFDLYLKKEKFKHVINLYDGDMNLRALIIQEKETSEELKASYVRTAELNYGHWRSAIRSHPEKGPELTDATKSVAKLIKEQILNPRGEKLKGNILIHCGGGMHRTGMIMGLLMRVINKSPRQLIIDTYKYHTGYRGKNTPGGFEQGNLDFIFNFDPDLLISKTPEQ

SEQ ID NO: 15387 - DNA, 930 bp, Unknown
  Obtained from environmental sample
  misc_feature (1)..(930): n is a, c, g, or t
atgattgccggagattatgaatggggcttatccatgagaatggacagtacggtcagatatccgcgtcaaatgatgcttggtgctattcaagatgatttattaattaatgaatttgggattgaagtagcaaggcaatgtaagcgacttggtgtacatattaactttgctcctgtgattgatgttaataataacgcaaataacccggttattaacagtcgttcatttggtgaaataaaagaaaatgtagctcgaaaaggtttagcatatatggtcggaatgcaagacaataacattcttgctaccggcaaacattttcccggacatggtgatacagatgttgattctcataaagatttaccgattattcttcattcaaaagaaagattagattcgttagaaatgtatcctttcaaagaactgataaatacaggaataggaggaattatggttgctcatcttaatatcccttcattagattctaaaaaaaatgccatatcaagcctttcaaaatcaattgtaacggatattttaattaaaaaaatgggttttaaaggcctaatatttacagatgcattaggcatgtacggagtaactaaacattataatcctggagaaacagaagttgctgcattagttgccggtgttgatgttttattaatgcctaagaatgtgtctcttgcttttcagaaaataaaagaagcaataaaaaaaggaaaaattactcaggatgaaattgataaaaaatgtcgtaaagttcttatagcaaaaaaatggtttggtcttagtaattataagaaaactaagattaacaatatttataatgacctgaattcggaatatgctaatcacttaaacaaaaaattaattggatctttcattaactttaggcaattaataaagaaaaagatatttccgtttaaaaaactttga

SEQ ID NO: 15388 - protein, 309 aa, Unknown
  Obtained from environmental sample
  DOMAIN (2)...(220): Glycosyl hydrolase family 3 N terminal domain
  misc_feature (1)..(309): Xaa is any amino acid
MIAGDYEWGLSMRMDSTVRYPRQMMLGAIQDDLLINEFGIEVARQCKRLGVHINFAPVIDVNNNANNPVINSRSFGEIKENVARKGLAYMVGMQDNNILATGKHFPGHGDTDVDSHKDLPIILHSKERLDSLEMYPFKELINTGIGGIMVAHLNIPSLDSKKNAISSLSKSIVTDILIKKMGFKGLIFTDALGMYGVTKHYNPGETEVAALVAGVDVLLMPKNVSLAFQKIKEAIKKGKITQDEIDKKCRKVLIAKKWFGLSNYKKTKINNIYNDLNSEYANHLNKKLIGSFINFRQLIKKKIFPFKKL

SEQ ID NO: 15389 - DNA, 360 bp, Unknown
  Obtained from environmental sample
  misc_feature (1)..(360): n is a, c, g, or t
atgaaacatgttggtaaaatgaataaagaggaacttttagaaacattaaaaacatttaaaatgtctcctcaacaaatacattttttacttggcaataatagaactataaagtttatgtctgaaaatcataacatacaccatatctttattacaatatatgatattaaaaatgaaaaaacaatacttaccaataaaaaaataaatattgataataatatttttttagatccaggagtttatcaacttacaattaatgccaatggctataaacaaagagattcacgagaaataattcctaaacaaggcattgaagagattgttattagttttaatctagccaaagaaataaaaaagcaatga

SEQ ID NO: 15390 - protein, 119 aa, Unknown
  Obtained from environmental sample
  misc_feature (1)..(119): Xaa is any amino acid
MKHVGKMNKEELLETLKTFKMSPQQIHFLLGNNRTIKFMSENHNIHHIFITIYDIKNEKTILTNKKINIDNNIFLDPGVYQLTINANGYKQRDSREIIPKQGIEEIVISFNLAKEIKKQ

SEQ ID NO: 15391 - DNA, 663 bp, Unknown
  Obtained from environmental sample
  misc_feature (1)..(663): n is a, c, g, or t
atgaactttacaccaatagcaccaactgatataaaaggtaatataaattcgtctcttttgcaaaaagcagataagttattattggaagctgctaaacttgaaggttcccatactcctcagatacttcaagccgttaaaaatcttttatatacagttaatagctactactcaaataagatagagtctgaaggtactcatattattgatatagaaagagcaatgcaacaagagtattcccaagatactaaaaaaagaaacttacagatactatcacttactcatataacagttcaaaaagagtgtgaagaatattttaaaacaaatccatctgcatcagcatatgacaaagaatttatactaggcacccataagagtttttattctaaagagggtatggagccttttatagatgttactcatgatggtatgcaagataggatagtccctggtgctattagaaaaagagatgttaaggtaggaaatcatatagcaccaagtgcagataaacttgatagcatgatgaatgagtttgagcacctttataataaatctttagtctccaatgatgcagtgaaacttattcatatattagcatctcaccataggttgatgtggatacacccttttttagatggaaatggaagaacggctaggttggcatag

SEQ ID NO: 15392 - protein, 220 aa, Unknown
  Obtained from environmental sample
  DOMAIN (136)...(220): Fic protein family
  misc_feature (1)..(220): Xaa is any amino acid
MNFTPIAPTDIKGNINSSLLQKADKLLLEAAKLEGSHTPQILQAVKNLLYTVNSYYSNKIESEGTHIIDIERAMQQEYSQDTKKRNLQILSLTHITVQKECEEYFKTNPSASAYDKEFILGTHKSFYSKEGMEPFIDVTHDGMQDRIVPGAIRKRDVKVGNHIAPSADKLDSMMNEFEHLYNKSLVSNDAVKLIHILASHHRLMWIHPFLDGNGRTARLA

SEQ ID NO: 15393 - DNA, 528 bp, Unknown
  Obtained from environmental sample
  misc_feature (1)..(528): n is a, c, g, or t
atgataaagttaaatacccatcaatacccagtaccgaaagatatagcagtatctgctgattttgcattggatatattaaaaaataatgatacctatttaaaattagaggctgatttattaaggtcatttaactttggagatttaaaatcattttcatttaatagtgatggatttttaagcttactgtgtcatttaggattgcaagggaaaattgccattagtgtaggtgaaacagaggcactatatgaagcaggtaaactttatgaatctttagggtttgatgttgtttggattggtttaaagcaagatggacatatagatattgatagtataaaaaatagtaatttagattttatatttatctcttcatatacagtagatacttatgtaaaaaatgatttagaaagtcttaaaaaaataacaaacggaaaaattatctctaacggaagctttgatatatcaactaaaagtgatgcgttgtattttgacccatataagttaagtggtttgcaatatcggaaaatatag

SEQ ID NO: 15394 - protein, 175 aa, Unknown
  Obtained from environmental sample
  misc_feature (1)..(175): Xaa is any amino acid
MIKLNTHQYPVPKDIAVSADFALDILKNNDTYLKLEADLLRSFNFGDLKSFSFNSDGFLSLLCHLGLQGKIAISVGETEALYEAGKLYESLGFDVVWIGLKQDGHIDIDSIKNSNLDFIFISSYTVDTYVKNDLESLKKITNGKIISNGSFDISTKSDALYFDPYKLSGLQYRKI

SEQ ID NO: 15395 - DNA, 657 bp, Unknown; identical to SEQ ID NO: 7997
  Obtained from environmental sample
  misc_feature (1)..(657): n is a, c, g, or t

SEQ ID NO: 15396 - protein, 218 aa, Unknown; identical to SEQ ID NO: 7998
  Obtained from environmental sample
  DOMAIN (1)...(214): FdhD/NarQ family
  misc_feature (1)..(218): Xaa is any amino acid

SEQ ID NO: 15397 - DNA, 636 bp, Unknown
  Obtained from environmental sample
  misc_feature (1)..(636): n is a, c, g, or t
ttgctggcgtatttatttgtagaaaatgaaaaactggaggtaaccgcttcttttacatctcctaaatttatgttagaagattttttattgcaatcctcctcttccaaccaatcggagcaagaagttagtttacccagcaacattacctttacttttaaaacacaaatagatacctttcttttcagacgctttaaagctcaaaattttagaggagttatccaattggaagacaacttactttcggctaccgatgttgcttttaatgctatgggtggacatattaaaggaagtatcgccttagataatgaaaaccctaatgaattactcattacaagcaatgctaaaatgttcgatattgatattacccaactgttttatcagtttgagaattttggacaaaaagcgttagatgccgaaaacctaaaaggtaaagctgccattgcagtagattttgcttccgtttgggataaacacctaaacgtaaataaggataaaatttatgtttcttctaccgtcattattaaaaatggagaattgttagactatgagcctgttatggcgttgagtaaatttatagaagtagatgaactgaaacgcattaagtttaaccagttaaaaagcggttatagaaattaa

SEQ ID NO: 15398 - protein, 211 aa, Unknown
  Obtained from environmental sample
  misc_feature (1)..(211): Xaa is any amino acid
MLAYLFVENEKLEVTASFTSPKFMLEDFLLQSSSSNQSEQEVSLPSNITFTFKTQIDTFLFRRFKAQNFRGVIQLEDNLLSATDVAFNAMGGHIKGSIALDNENPNELLITSNAKMFDIDITQLFYQFENFGQKALDAENLKGKAAIAVDFASVWDKHLNVNKDKIYVSSTVIIKNGELLDYEPVMALSKFIEVDELKRIKFNQLKSGYRN

SEQ ID NO: 15399 - DNA, 357 bp, Unknown
  Obtained from environmental sample
  misc_feature (1)..(357): n is a, c, g, or t
ttgtcaacaatggaagataaaaatatgaaacaaaaaagaggttttgcacttcttataactataattttagttgtagtgataagttatctttcttatagtattgtacaaagtaatattttttcatcaaatctcaataaactaaaatatcttcacttgcaagcaaatattcatcttgattttatcaaagagtatatagcaacacatacccaaacacaaatagataatgtaacgcttgatgatcagagatttgaactctcaatagtttcacgagatcaaaataccacaatggtgtattatatctatttaaaaacagttgatgatactcctataagattaagcgataaaattataaaatag

SEQ ID NO: 15400 - protein, 118 aa, Unknown
  Obtained from environmental sample
  misc_feature (1)..(118): Xaa is any amino acid
MSTMEDKNMKQKRGFALLITIILVVVISYLSYSIVQSNIFSSNLNKLKYLHLQANIHLDFIKEYIATHTQTQIDNVTLDDQRFELSIVSRDQNTTMVYYIYLKTVDDTPIRLSDKIIK

SEQ ID NO: 15401 - DNA, 546 bp, Unknown
  Obtained from environmental sample
  misc_feature (1)..(546): n is a, c, g, or t
atggctttttttgattacgatgaaaagagggaaagttttaaaaactttttattcattttttgtcgaaatattaactatatgggacaattaaaactttatgggaacccatacaaaaatggttttaaagtttttataactgacattattaaaaataaaattattgaagaacttcaattacaaaagggagcaggtaacccttttgattttgaacaatttttaaaagtactaaattctcaaattccacaaaagattcatagaaaagaaaaaattaaaatattaaaagataactttagagaaatcgacttagaaaaaagaaaaaagttagttactgaagcaaacaaaatttatttatacggtgttaacacactgccttcgtataaaacacctcaagagaaaacattacggaaactttatttatatgttgatggttcaagtgatgatatatcagactttattaaagaattaaaaaaacaaaataaaactctaatgtggacagacaatccaagtttagaaaaagattttgtgagtatagtagcagggctttaa

SEQ ID NO: 15402 - protein, 181 aa, Unknown
  Obtained from environmental sample
  misc_feature (1)..(181): Xaa is any amino acid
MAFFDYDEKRESFKNFLFIFCRNINYMGQLKLYGNPYKNGFKVFITDIIKNKIIEELQLQKGAGNPFDFEQFLKVLNSQIPQKIHRKEKIKILKDNFREIDLEKRKKLVTEANKIYLYGVNTLPSYKTPQEKTLRKLYLYVDGSSDDISDFIKELKKQNKTLMWTDNPSLEKDFVSIVAGL

SEQ ID NO: 15403 - DNA, 789 bp, Unknown
  Obtained from environmental sample
  misc_feature (1)..(789): n is a, c, g, or t
atggatgtaagatcatatgacgcgaatgagctactaatcattaatgagctctttcaaaaaattgaaaaagataatgcagcactttatgaaaaagctataggtttattcaatatattaaatgaaaaagtatctcatactatatataaacaatcatctgtagaagatatattatctacttgtaaaaatgaattttatttagttaaaaatgcaattgaaaatacgcaagaaataaaattcagttttttttatgatgacaacattaaacatgtccaaccattgaaaattgcgaatttagaaaagtattggtatctattatgttttgatattgatgaaaaaagattttcaaagtatcactttaaaggtgtaaaaaatgttaaagtcttagatagacaattcgatataaagaaacatgattatttagataaattggaatatgcaataaatgcatattttaatattgaagatactaatagagtaaagttaaaattatcaaaagaggcaaaaaaagtcttatctagaaaaaaactaaatccatctcaagaaatatataaaaatgatgaagatgaatatatattagatataacggtttctgatttgagggaaatatcaccaatagtacaacagtggattccccatattcaagttattaaaccagaagaattaaaaaacttgataaaagaaaatttaaaaaactatgaaattttattttatgcggacatgtttttgtcctcactgtattttataattaaaaaaattatatccatagatgggagtattaatatggcttaa

SEQ ID NO: 15404 - protein, 262 aa, Unknown
  Obtained from environmental sample
  misc_feature (1)..(262): Xaa is any amino acid
MDVRSYDANELLIINELFQKIEKDNAALYEKAIGLFNILNEKVSHTIYKQSSVEDILSTCKNEFYLVKNAIENTQEIKFSFFYDDNIKHVQPLKIANLEKYWYLLCFDIDEKRFSKYHFKGVKNVKVLDRQFDIKKHDYLDKLEYAINAYFNIEDTNRVKLKLSKEAKKVLSRKKLNPSQEIYKNDEDEYILDITVSDLREISPIVQQWIPHIQVIKPEELKNLIKENLKNYEILFYADMFLSSLYFIIKKIISIDGSINMA

SEQ ID NO: 15405 - DNA, 366 bp, Unknown
  Obtained from environmental sample
  misc_feature (1)..(366): n is a, c, g, or t
atgaacttttcctttgaaataaaaaaagaacaagagttacttgttatatcgctttcgggtagtttgaataataaacaacaagccgaagagttgctttcggaattagatttttattataacgaaggcttaaattttattattttagatttagctaaaatggactatatgaatagttcaggtttaggcgttttcatctcaattcttacccaaacaagaaacagaaatggagaggtgtttatagtaaatatcccgaaaaaaataaaccaattattagttattactaaactaaataatgtgtttaacattgccgaaaatataaaagaagcaaaaagaaatattcttaaaataaaacagccaataaattaa

SEQ ID NO: 15406 - protein, 121 aa, Unknown
  Obtained from environmental sample
  DOMAIN (4)...(109): STAS domain
  misc_feature (1)..(121): Xaa is any amino acid
MNFSFEIKKEQELLVISLSGSLNNKQQAEELLSELDFYYNEGLNFIILDLAKMDYMNSSGLGVFISILTQTRNRNGEVFIVNIPKKINQLLVITKLNNVFNIAENIKEAKRNILKIKQPIN

SEQ ID NO: 15407 - DNA, 528 bp, Unknown
  Obtained from environmental sample
  misc_feature (1)..(528): n is a, c, g, or t
atgagaagaagattttcagaaaaatatggatatacaaaacctagagaagttttacaaattgataatgtagatgaacgtttaaaaaatagaatttggaatgctattaataatataatcttagaaaaaattgaattacaaagtggaaattttggtaatccgtttgatacaattaagtatcaaaaagattatgatatttttattaaactatatgatgaagtttttgctgaaaaaagaaaaccctatttagaatttaaaaagctgtctcaaaacttacacaataaatatgaatcttttatttggtatgaaatatataattttttagaagatatatgttttgctcattatagtgatgaaataatacaaacatttaaattaactatcaataaagttctagaagaagagctatcaggctatagattaattgaaaactatattgttcaaataattgacgaaatagaaattaaagaaattgaagaaatttttaatagtaaatatacaccagtaaaagggcattatcttaaggattaa

SEQ ID NO: 15408 - protein, 175 aa, Unknown
  Obtained from environmental sample
  misc_feature (1)..(175): Xaa is any amino acid
MRRRFSEKYGYTKPREVLQIDNVDERLKNRIWNAINNIILEKIELQSGNFGNPFDTIKYQKDYDIFIKLYDEVFAEKRKPYLEFKKLSQNLHNKYESFIWYEIYNFLEDICFAHYSDEIIQTFKLTINKVLEEELSGYRLIENYIVQIIDEIEIKEIEEIFNSKYTPVKGHYLKD

SEQ ID NO: 15409 - DNA, 381 bp, Unknown
  Obtained from environmental sample
  misc_feature (1)..(381): n is a, c, g, or t
ttgaaagataataaagtatcacataaatttcacatacctgttttagggacaggaccctctttagatacagcaattaaagtttctcaatttggaattgattcggttatttctctaacagatgaaaatattattgaaaccactagggaattttattcaaataaatatggttgggattatgaactcattaaatttaaagaagaaaatagtagggcaaaaagaattacagcatatttaaatttagtcgataagattgttgatataaaattaaataaattaaaaggaatgtctttttttgaaggatataataatttgcataaaaattttcaaatgttagcaccaactcatccagtaaaagaaatgataacaattagcccggcataa

SEQ ID NO: 15410 - protein, 126 aa, Unknown
  Obtained from environmental sample
  misc_feature (1)..(126): Xaa is any amino acid
MKDNKVSHKFHIPVLGTGPSLDTAIKVSQFGIDSVISLTDENIIETTREFYSNKYGWDYELIKFKEENSRAKRITAYLNLVDKIVDIKLNKLKGMSFFEGYNNLHKNFQMLAPTHPVKEMITISPA

SEQ ID NO: 15411 - DNA, 543 bp, Unknown
  Obtained from environmental sample
  misc_feature (1)..(543): n is a, c, g, or t
atgataaaagaattaacagaaattggttttacaaataatgaagcaaagatttatgcatcactttcaaaagaaggcgattcatctgcaccaaatctttcaaaaatattgaaaatagatagaagaacaatctatgatactttaattaaattaaatactaaaggctggattacaaaaataaagattcaaaataaacaaatatattcagcaacagatattgaaattataaaaaaagaagtttatgaaaaatatttgaattttaaaaaaataataccagaattaaaaaataatattaaaaataacacagagattaatattttaattggactaaatgcgattaaaattttagtaactaaagccttagaagaaaaaaaagaaatattactcttaggaagaggaggatatttagcagaacaattaanaaattctaaacaccaatatgtatctaaacttgcacaattgaattggaagatgatacaaactaaagattatactaattcattttttaaaccaaaagcaataagatattttaccttcaaatactaa

SEQ ID NO: 15412 - protein, 180 aa, Unknown
  Obtained from environmental sample
  misc_feature (1)..(180): Xaa is any amino acid
MIKELTEIGFTNNEAKIYASLSKEGDSSAPNLSKILKIDRRTIYDTLIKLNTKGWITKIKIQNKQIYSATDIEIIKKEVYEKYLNFKKIIPELKNNIKNNTEINILIGLNAIKILVTKALEEKKEILLLGRGGYLAEQLXNSKHQYVSKLAQLNWKMIQTKDYTNSFFKPKAIRYFTFKY

SEQ ID NO: 15413 - DNA, 828 bp, Unknown
  Obtained from environmental sample
  misc_feature (1)..(828): n is a, c, g, or t
ttgaagcttgataaaagtagttatttggtgtatgaaaaaggaaatcttagtataaaaaaatactataaaataaaaacatataaagctataaaagatgaaaaaaatgccttagaatctattgaaaaacttttagtaaatagtgtacaacaaagactcaaaagtgatgttgaagtggggacacttttaagtggtggtattgatagctctttgatttctacaatttatgcacaacatacaaatcatcaaataaatacttttagtgttggatataaaacaaataaaaaatattgtgaacttccctatgcttcaatagttgcaaaaaatataaatagtaaccacacaagcctagaaataggacaaggagaatttattgatagcttagaagatgtttttgaaaatctagaggaaccacatgctgatccagcaagtatccctctttggcatttaacaaaagaggtaaaaaaacaagggattaaaactgtacttagtggtgagggaagtgatgagctttttttaggatatgataattatgctaagtttttaaaatactataattttaaggataccctttcttctgatcaatatagttttatggatgatattatctctacattgcaagcagatacaaaagaatcggagtatctaagacgcgttataaaaaaagagaatctatataatagttttggtgaaatttttacagaaaaacaacgaaaaaagcttcttctaaaagtggctacttttaaaacagaaaatcccaaaaaagatcctgtagattggatgagttatattgatatgaaaatttggtttaggggaagcattattaagtaa

SEQ ID NO: 15414 - protein, 275 aa, Unknown
  Obtained from environmental sample
  DOMAIN (39)...(239): Asparagine synthase
  misc_feature (1)..(275): Xaa is any amino acid
MKLDKSSYLVYEKGNLSIKKYYKIKTYKAIKDEKNALESIEKLLVNSVQQRLKSDVEVGTLLSGGIDSSLISTIYAQHTNHQINTFSVGYKTNKKYCELPYASIVAKNINSNHTSLEIGQGEFIDSLEDVFENLEEPHADPASIPLWHLTKEVKKQGIKTVLSGEGSDELFLGYDNYAKFLKYYNFKDTLSSDQYSFMDDIISTLQADTKESEYLRRVIKKENLYNSFGEIFTEKQRKKLLLKVATFKTENPKKDPVDWMSYIDMKIWFRGSIIK

SEQ ID NO: 15415 - DNA, 357 bp, Unknown
  Obtained from environmental sample
  misc_feature (1)..(357): n is a, c, g, or t
ttgaagaattatattcagcaaaaaaaattcttcactaaaattaaaacattgccttttatgaaggctgatgaaatacgtaagtactacaatgctgctgatataggcatttttaccagagtagctatttctatttttgaagcgttggctaccggattatatttatttttaccacaccaaaacaatgtaaaacatatccttaacaatgaaaatggcaattattttaatgaattaactacagagtatatttataaaataaagacttcaataacaaaaaacagagaagaacgcattactttagccaaaaagtttaactatcagaacttggcaaaaaaaatactgtcgcacagtgaaatttaa

SEQ ID NO: 15416 - protein, 118 aa, Unknown
  Obtained from environmental sample
  misc_feature (1)..(118): Xaa is any amino acid
MKNYIQQKKFFTKIKTLPFMKADEIRKYYNAADIGIFTRVAISIFEALATGLYLFLPHQNNVKHILNNENGNYFNELTTEYIYKIKTSITKNREERITLAKKFNYQNLAKKILSHSEI

SEQ ID NO: 15417 - DNA, 954 bp, Unknown
  Obtained from environmental sample
  misc_feature (1)..(954): n is a, c, g, or t
gtgggtcgccgagatataaaacaactttatattgcttctgaaaatggcatttacaagctatctaatactaattatgaattcatagggagtggacaagggttaaactgcaccagagccagaagttttgttaccgataatgagttactttgggtgggaaccaatgatggtgtctatatttatgacgggaacaaagtaatttttaaaataagtaatgaacaacatctttcttccgaaaatatttattttctgaaaaaagacaagaataacaatatttggactggtactaataaaggcgtagataaaattgctattaaaagcgtttacgaagctttgagtgacagcactaaaactccagaaataaatagctactctaaaaataaaggatttaatggcgtggagtgtaacttaaacgcagttgaagtgctaaacgataatgagttattatttggaacaattgacggtttgtttatttacaacaaaaacgatgatttaaaaaatgaactccctcctattctatctctaaacaacattaaattaaattttattgatgtagattggagtgcttttggcgaagtagaaaataaacttcctaaaaacctatcattaacctatgtaaacaacaaccttatttttgaatatgttggcgtttcattaaccaatcctgaacaggtggtttatcaatacaagctggatggattagataacaattggctgccaacaaccaccgaccaaaaagcagtttataccgccattcctcccggagattatacctttatgcttaaagcaaaaaatgccgatggcgtttggatagaagaacccctaactttttctttttcaataactccgccttggtggcaaaccacttggttttatgtaactgctgttattactatttcttttagtttttattttataatggattatagaaccaaaaaactaaaaaaagaccaccaa

SEQ ID NO: 15418 - protein, 318 aa, Unknown
  Obtained from environmental sample
  DOMAIN (226)...(264): Two component regulator three Y motif
  misc_feature (1)..(318): Xaa is any amino acid
MGRRDIKQLYIASENGIYKLSNTNYEFIGSGQGLNCTRARSFVTDNELLWVGTNDGVYIYDGNKVIFKISNEQHLSSENIYFLKKDKNNNIWTGTNKGVDKIAIKSVYEALSDSTKTPEINSYSKNKGFNGVECNLNAVEVLNDNELLFGTIDGLFIYNKNDDLKNELPPILSLNNIKLNFIDVDWSAFGEVENKLPKNLSLTYVNNNLIFEYVGVSLTNPEQVVYQYKLDGLDNNWLPTTTDQKAVYTAIPPGDYTFMLKAKNADGVWIEEPLTFSFSITPPWWQTTWFYVTAVITISFSFYFIMDYRTKKLKKDHQ

SEQ ID NO: 15419 - DNA, 750 bp, Unknown
  Obtained from environmental sample
  misc_feature (1)..(750): n is a, c, g, or t
atgcatatgaacaaacaaacatttctctcacttcttcttggagtatttatccatgttgggctgctagctcaacctacttttttagattatcaaattgttgaagctgttggctttaagaatttggataacacttcctttaataattatcgttttatacaaaataaatccttgtatgacgagaagtgggacactttggctcaacctactttttggagaacattaatgagaatggatgaagattctgctttgttgaacattggtgctagcagacaaataataaccaaagtagctgttaaagaatggagtgcacttcaggaagaacgtaaaaatgccattagagatagtattagaactcattacggcttatcagctgatgcacgtattttccttacttccgggaagaaagctttttatgattttcaacgagtgttgccttctatagaaaaaggtattgatgtgttcaagagaaatggggtagatccgttttatgctcaaaccattttgttgatagaaagtccgaataagttacaaaaatcttctgttggtgcttatggttcttttcagttaatgaaaaatgttgctatacaaatgggtttaaaagtgaatggatatgttgatgaacgtgaggattttgataaatctgcctgggcggcttctcagttaataaaaccatttgtattcctgaaacccataaaatgttgtcagaaagaaacattgctattaccgagaaccagatttggtataaattgt

SEQ ID NO: 15420 - protein, 250 aa, Unknown
  Obtained from environmental sample
  misc_feature (1)..(250): Xaa is any amino acid
MHMNKQTFLSLLLGVFIHVGLLAQPTFLDYQIVEAVGFKNLDNTSFNNYRFIQNKSLYDEKWDTLAQPTFWRTLMRMDEDSALLNIGASRQIITKVAVKEWSALQEERKNAIRDSIRTHYGLSADARIFLTSGKKAFYDFQRVLPSIEKGIDVFKRNGVDPFYAQTILLIESPNKLQKSSVGAYGSFQLMKNVAIQMGLKVNGYVDEREDFDKSAWAASQLIKPFVFLKPIKCCQKETLLLPRTRFGINC

SEQ ID NO: 15421 - DNA, 453 bp, Unknown
  Obtained from environmental sample
  misc_feature (1)..(453): n is a, c, g, or t
atggaaaaacttcaaaaagcaatagagaagctacatcaaaatgagatagaagtttccctttttattgacccaacacaacagatgatagaattatctcgtgaactcaatgtagagtggatagagctacatactggaagttttgcaaatatctatgctatgttatatgggggattacaaaactcacaccatagtatcaaagagttagaattaccacgaaatactcttacaaaaaaattcaataattcaatccaagagattcaaaatgcatcaaaatatgcacataaactccaactcaaagttgcagcaggtcatggactaaattatcaaaatgtaaaatatatgacaaatatcaatgagatagaggagttaaatattggtcaaagtattattgcacgaagtgtatttacaggactagaaaaagcaataatagagatgaaagagttagtacaataa

SEQ ID NO: 15422 - protein, 150 aa, Unknown
  Obtained from environmental sample
  DOMAIN (1)...(150): Pyridoxal phosphate biosynthesis protein PdxJ
  misc_feature (1)..(150): Xaa is any amino acid
MEKLQKAIEKLHQNEIEVSLFIDPTQQMIELSRELNVEWIELHTGSFANIYAMLYGGLQNSHHSIKELELPRNTLTKKFNNSIQEIQNASKYAHKLQLKVAAGHGLNYQNVKYMTNINEIEELNIGQSIIARSVFTGLEKAIIEMKELVQ

SEQ ID NO: 15423 - DNA, 459 bp, Unknown
  Obtained from environmental sample
  misc_feature (1)..(459): n is a, c, g, or t
atgttaaaaaaagttgctattagtattggagatataaatggtgttggtattcagctagctttagaaaatcatgaaatagtatcaaaactttgtacaccaatatattgtatagataaaaagctgttaaaaacagctgcaaaaaaactgaatctatcaatacctataaattttaatacatttggaaaatataaaaaaacagatataaatccaggacttgtaaagaaagattctgggttattctcatatacttcttttataaattgtataagtctagcaaaaaatggcaaagttgatgctatctgtacacttcctataaataaagaatcttggagtaaagcagggataaattatgttggacatactgatatgttgcgagatatatttaaacaggacgctatcatgatgctaggctgtgaaaagatgttttgtagcaccttttacggaagcaattgcttttaa

SEQ ID NO: 15424 - protein, 152 aa, Unknown
  Obtained from environmental sample
  DOMAIN (21)...(151): Pyridoxal phosphate biosynthetic protein PdxA
  misc_feature (1)..(152): Xaa is any amino acid
MLKKVAISIGDINGVGIQLALENHEIVSKLCTPIYCIDKKLLKTAAKKLNLSIPINFNTFGKYKKTDINPGLVKKDSGLFSYTSFINCISLAKNGKVDAICTLPINKESWSKAGINYVGHTDMLRDIFKQDAIMMLGCEKMFCSTFYGSNCF

SEQ ID NO: 15425 - DNA, 837 bp, Unknown
  Obtained from environmental sample
  misc_feature (1)..(837): n is a, c, g, or t
gtgccctcgaattggcagtttgaaggctatgataaaatgcattataccgatgttttatatttatttcctataaatccaccttttgttcctagtgacaatcctacaggaatttatagaagagaattttcaatagataaaaatcaaattaaaaagagttgtatattatcctttggaggcattaatagtgctttcgatatttggattaatggcaaagctgcaggctacggtaaatgcagcagactttcaagtgaatatgatatttcctcattaattgaaattggaaataataatataaccataagagtctataagtggtctgatggaacatatttagagaaccaagatcaatggtggttaagtggaatttatagagatgtaaaattaatttttagagcagtagcatgtattgaagatgttattattaatactagctttaaaaaagcttctagtcttggacttttagacattgaattagccattaataatgcaaatgcaaattataaaattaaatatttactcaaagaaaaagcctcaacatcaataaaagaagaaaaatctattgaattaaataaagaaaataaatatcaaattaattcaaaagttaaaaatgtaaaaaaatggtcagcagaatctccaagcctttatactcttgaattagtattagaagttgataatataataagtgatacagcagtcattgattttgggtttagagaagtcaaaattattgataatatttttaaaattaatgataaagaagtattgttaaatggtataaattaccacgattttagtccggaaaatggacaaagtgttgattataatacagttgtttga

SEQ ID NO: 15426 - protein, 278 aa, Unknown
  Obtained from environmental sample
  DOMAIN (134)...(238): Glycosyl hydrolases family 2, immunoglobulin-like beta-sandwich domain
  misc_feature (1)..(278): Xaa is any amino acid
MPSNWQFEGYDKMHYTDVLYLFPINPPFVPSDNPTGIYRREFSIDKNQIKKSCILSFGGINSAFDIWINGKAAGYGKCSRLSSEYDISSLIEIGNNNITIRVYKWSDGTYLENQDQWWLSGIYRDVKLIFRAVACIEDVIINTSFKKASSLGLLDIELAINNANANYKIKYLLKEKASTSIKEEKSIELNKENKYQINSKVKNVKKWSAESPSLYTLELVLEVDNIISDTAVIDFGFREVKIIDNIFKINDKEVLLNGINYHDFSPENGQSVDYNTVV

SEQ ID NO: 15427 - DNA, 795 bp, Unknown
  Obtained from environmental sample
  misc_feature (1)..(795): n is a, c, g, or t
atgatgcagcagtcttcaagccaattggtattaccatctgttaatggtattcaatctaaatttctcgaaatgttttatatcgatgggaagttaattctatttactgaagtacttaacaatacaataaagcaaaaggatttatatgttcaatatataaatgaatcaggaaaaattattggagaatcacaactaattggtcgtttgcttgaccagaatgttgcttgtgattttaatgtagaacttgcacaaaacaagcaaaatatttttattcattattttcgacctttttcaaaatataacgaagaacctttttattttaaggttttaggttccgatttagaattaattattgacaagcaggtaaagcttccaatgaataatttaaattttgacattctgcaatacaaattacacaagagtggcaaaatatatatgttggcaaaaatcacacccgaacaaaggagaaaacgtagcaagggtgatgtaatttatcaatatcgtttattagtttatgatattgaaatgaaaaaagttgataattacgatgttagagcttctaaatatatattgaaagatattatgttaggtgttgattttgatggcaatgttgacatttatgcaactatgacaaggaaaaacaaagaagagttagaaggtttttttcataaaagattaaatattgaagaaggcgattggatgcgagcatattctaaaaaagctaactatttgtttgaaagatctgagaaaccatattttagaaacgaaagagtttctgaacagtttgggcaaatctaa

SEQ ID NO: 15428 - protein, 264 aa, Unknown
  Obtained from environmental sample
  misc_feature (1)..(264): Xaa is any amino acid
MMQQSSSQLVLPSVNGIQSKFLEMFYIDGKLILFTEVLNNTIKQKDLYVQYINESGKIIGESQLIGRLLDQNVACDFNVELAQNKQNIFIHYFRPFSKYNEEPFYFKVLGSDLELIIDKQVKLPMNNLNFDILQYKLHKSGKIYMLAKITPEQRRKRSKGDVIYQYRLLVYDIEMKKVDNYDVRASKYILKDIMLGVDFDGNVDIYATMTRKNKEELEGFFHKRLNIEEGDWMRAYSKKANYLFERSEKPYFRNERVSEQFGQI

SEQ ID NO: 15429 - DNA, 639 bp, Unknown
  Obtained from environmental sample
  misc_feature (1)..(639): n is a, c, g, or t
atgagtagtaaacgtggtcgcccagctcgtcagatgagcgaagataaaataatcaatatgcttgaagatgtttatcttaacaaagaatactttgaaaaactcttcagcgtattaaagtctgaagaagaaaagttttttactgatttttttgaaagttttcatgaaaaattagcagagacaactgttaagaaatctagatttttaataagttcttctgaagcagaaagcagaataattgaacttaaaggttctaatttaaatgaatctgaaataaagaaaagaataaaagacgtggaggctaaagtagccgtttttgaggatgaggatatcaatgaatttcaatctgttatcgacaagcttccagacgagttatggatacgctataacaatcgattaagacagcaagcgtataaaaaaaataatagatggtcgagacaaattgaatttagtgaagatgcttatttagatcttaaagttttaaaaaactccttgaatgcaaaaacttggaatgacttgccacttaaattgaagcgtgactacttacagatagaaaatatttgtgcagcattacgagttgataatcttgatgaggctttgctaaaaattaaagaaaataaactcttgatgagcaataaataa

SEQ ID NO: 15430 - protein, 212 aa, Unknown
  Obtained from environmental sample
  misc_feature (1)..(212): Xaa is any amino acid
MSSKRGRPARQMSEDKIINMLEDVYLNKEYFEKLFSVLKSEEEKFFTDFFESFHEKLAETTVKKSRFLISSSEAESRIIELKGSNLNESEIKKRIKDVEAKVAVFEDEDINEFQSVIDKLPDELWIRYNNRLRQQAYKKNNRWSRQIEFSEDAYLDLKVLKNSLNAKTWNDLPLKLKRDYLQIENICAALRVDNLDEALLKIKENKLLMSNK

SEQ ID NO: 15431 - DNA, 798 bp, Unknown
  Obtained from environmental sample
  misc_feature (1)..(798): n is a, c, g, or t
atgggtaaaacgcttcaatttttaattagtaaagcaatggaattgaaatatattaattttgataaatctaaaataggtgatttatcaaatataaatgataaagacgcggtagttttaatttcaaatgaaaaagaaaaaccttataatcatttagaaaaaatattaaatggttatgataaatatattaaattaaagccagaagacttagttataattgctgaatcttcagaagcaggaaatgaaaaaacagaaactagagttatggatgatattgctaaaataggagcttcgattgttaatttagggtcaagtaaacaattacttcatcatgcttcacgcgaagacttgatgttaatgttgaacttgatggatccgaaatattatatcccagtaaaaggggaatatagataccaagtagctaatgcatcagctgcggaagcggtaggaatcaatcctaaaaacatattattaaaacaaaatggtgatattgtgcaattcattgacggtaagttagttgaatgttttgatcgcatcaaggctgattctattttaattgatggtaaaagcactggcgatgttggtgaattagtattaagagatagatcaatgttaagtaaagatgggattgtaattgtggccgctactattgagaagcaaggcaaaaagattcttgccggggctgaaatattaaccagaggatttatttatgtaaaaaataatactgacattataactgaagctcaaaagatttccgttgaaggttataaagaacataccccagctaggtttattgattaa

SEQ ID NO: 15432 - protein, 265 aa, Unknown
  Obtained from environmental sample
  misc_feature (1)..(265): Xaa is any amino acid
MGKTLQFLISKAMELKYINFDKSKIGDLSNINDKDAVVLISNEKEKPYNHLEKILNGYDKYIKLKPEDLVIIAESSEAGNEKTETRVMDDIAKIGASIVNLGSSKQLLHHASREDLMLMLNLMDPKYYIPVKGEYRYQVANASAAEAVGINPKNILLKQNGDIVQFIDGKLVECFDRIKADSILIDGKSTGDVGELVLRDRSMLSKDGIVIVAATIEKQGKKILAGAEILTRGFIYVKNNTDIITEAQKISVEGYKEHTPARFID

SEQ ID NO: 15433 - DNA, 918 bp, Unknown
  Obtained from environmental sample
  misc_feature (1)..(918): n is a, c, g, or t
gtgaattataccgaaaacgactcattagcaggaaattttgtgaaaagcctttatgtcgacagtaaaggaatattatggatcggacacaatgaagggaaactatcctaccgaaaagatggaatttttcataaaatcgaatctttaaaatcgaatcaaccaatcaatgacatttgtgaagacaatgaaggtaacctttggtttattgaccaaaaatcaggcttatgtcaagtttcttcaacattcgaatcacgcagaataaaatacaactggagggctgaagggcgtttaactttttactcattactcgcagtgtcttcacatgaatttttgttggggtcgtcacatggattatatcaggtactacttgatgacttaaatgaaataaagaccgcaaatttagtacaggatattccacaaacgagaataaacagaattataaagcaacggaacaaagagaacaaacacgaatactgggttgcaactgatgatcagggtttttaccattactcgcatgatagtcaaagtgcagaacacatcataaataatgaactttgtttgaagttcaacattgaaaaagaaagtatcctggacatttacgaagaaaaagaaggacaccttttgttggcaacctttggcaacggtgttataaaactaatatatgatcgtgtcactggtaagtattcagaaaatttaaacttctctacaacgaatggattaaaagaaaataatattaaaaaaattctttgcgatcgggaaggaaattattggtttggatccttcaccgaaggtgtattctccttaactcaggatcatttcatcttttacaacctggaagaaataggctttaaggagaataaagctttctcagtatttaaaacagaggatgcactttggatgggattaaaaatggcttgttaa

SEQ ID NO: 15434 - protein, 305 aa, Unknown
  Obtained from environmental sample
  misc_feature (1)..(305): Xaa is any amino acid
MNYTENDSLAGNFVKSLYVDSKGILWIGHNEGKLSYRKDGIFHKIESLKSNQPINDICEDNEGNLWFIDQKSGLCQVSSTFESRRIKYNWRAEGRLTFYSLLAVSSHEFLLGSSHGLYQVLLDDLNEIKTANLVQDIPQTRINRIIKQRNKENKHEYWVATDDQGFYHYSHDSQSAEHIINNELCLKFNIEKESILDIYEEKEGHLLLATFGNGVIKLIYDRVTGKYSENLNFSTTNGLKENNIKKILCDREGNYWFGSFTEGVFSLTQDHFIFYNLEEIGFKENKAFSVFKTEDALWMGLKMAC

SEQ ID NO: 15435 - DNA, 909 bp, Unknown
  Obtained from environmental sample
  misc_feature (1)..(909): n is a, c, g, or t
gtggagatcacggagatcagttttaagacgacaggatccattgaggccggcgtcaatacggatgtctcgataaacgtcaaagagaaagatgccttcaaagatgcaattggtgccggtatggaagtcgaagtcaatgagatcaatgtggacggcaatgtcggcagcaatgcaaagatcaaagcaaagaaggtaaagatagaaggtcagacacatcaaagttcctatatagaggctgatgaggtcaaggtcaatatccataagggcaagatcaaaggccaaaagatcgaagtgacaaggttagagcagggcgtgattgaaggcgagtatgttgaggtgtttcaagcagcaggcggcaagattatcgccaaagaagtcgtgatcgatacgctcgcttcgcatgtggatatcattgccagctccaagatagagataaaaaacttcaagggtgaagagaacacgctgaccatttcgccggtactgtatgaagaagacaaagatgctctgcagggtaatgaagaagagataaaagtgcaaaaaagaaagattcgcaccttgcaagaagaggtcaataagaaacaggcttttttaaacgagaatgccgcagcgattgctgatatcaagaagcgtttggcgcattataaacagagcgggacaaagatgcctgtttcgtttgtgacaaagtttaaagagtttcaagaattgcaaacccatctgctttcactcaaacaggaattgaaacagaatgaagaggcctgtgaacttctcagagatgaacatcagacctttcaaacgaacattctcgagtcaaggatcatcaatcacgataaatacccgggccacaatgagatcaggttcaaactagtcgatccggacattgaactctacctggtcccaaaggcggtgatcatg

SEQ ID NO: 15436 - protein, 303 aa, Unknown
  Obtained from environmental sample
  misc_feature (1)..(303): Xaa is any amino acid
MEITEISFKTTGSIEAGVNTDVSINVKEKDAFKDAIGAGMEVEVNEINVDGNVGSNAKIKAKKVKIEGQTHQSSYIEADEVKVNIHKGKIKGQKIEVTRLEQGVIEGEYVEVFQAAGGKIIAKEVVIDTLASHVDIIASSKIEIKNFKGEENTLTISPVLYEEDKDALQGNEEEIKVQKRKIRTLQEEVNKKQAFLNENAAAIADIKKRLAHYKQSGTKMPVSFVTKFKEFQELQTHLLSLKQELKQNEEACELLRDEHQTFQTNILESRIINHDKYPGHNEIRFKLVDPDIELYLVPKAVIM

SEQ ID NO: 15437 - DNA, 432 bp, Unknown
  Obtained from environmental sample
  misc_feature (1)..(432): n is a, c, g, or t
ttgcaagaagaggtcaatagaaaacaggcttttttaaacgagaatgccgcagcgattgctgatatcaagaagcgtttggcgcattataaacagagcgggacaaagatgcctgtttcgtttgtgacaaagtttaaagagtttcaagaattgcaaacccatctgctttcactcaaacaggaattgaaacagaatgaagaggcctgtgaacttctcagagatgaacatcagacctttcaaacgaacattctcgagtcaaggatcatcaatcacgataaatacacaggccacaatgagatcaggttcaaactagtcgatccggacattgaactctacctggttcccaaaggcggtgatcatgagaagtgttttatgttaaaagagaatgaagatgacacctcatacacgattgtcgcaacagagataggagggtaa

SEQ ID NO: 15438 - protein, 143 aa, Unknown
  Obtained from environmental sample
  misc_feature (1)..(143): Xaa is any amino acid
MQEEVNRKQAFLNENAAAIADIKKRLAHYKQSGTKMPVSFVTKFKEFQELQTHLLSLKQELKQNEEACELLRDEHQTFQTNILESRIINHDKYTGHNEIRFKLVDPDIELYLVPKGGDHEKCFMLKENEDDTSYTIVATEIGG

SEQ ID NO: 15439 - DNA, 519 bp, Unknown
  Obtained from environmental sample
  misc_feature (1)..(519): n is a, c, g, or t
atgagtgaaatagagtacataattatagtaatagcgatacttttaatatacataatttatcaaaactatgttaaagatacaaaatatacaaaaaatattagatcattagcattagcggttgagaacttaaatcgtgagttttatgaacttcaaaagcgtgtagagaaatattctcaagagttagagattacatctagcatgacaagttctggtgatgatgtggatggtaaaattcaaaaatcaatctcagaactttccgttccacttgctcaaagtttagaagaggtggagaaatctttagagttatttgaagagtataaaagcagtacaagcagacgattgagtatgttagaagacggcatgaagtcattttctatgccatcatcaataaatagcatggatgatgataaaattttaactctatataaacagggtgtttcagtggaaactatagcaaaagagctacatttggcaaaacctgaagtagaattcacactaaaattaaaccaaatgagataa

SEQ ID NO: 15440 - protein, 172 aa, Unknown
  Obtained from environmental sample
  misc_feature (1)..(172): Xaa is any amino acid
MSEIEYIIIVIAILLIYIIYQNYVKDTKYTKNIRSLALAVENLNREFYELQKRVEKYSQELEITSSMTSSGDDVDGKIQKSISELSVPLAQSLEEVEKSLELFEEYKSSTSRRLSMLEDGMKSFSMPSSINSMDDDKILTLYKQGVSVETIAKELHLAKPEVEFTLKLNQMR

SEQ ID NO: 15441 - DNA, 768 bp, Unknown
  Obtained from environmental sample
  misc_feature (1)..(768): n is a, c, g, or t
atgataaatcaggcacagcaattttgcgattacattcagcatcaaaaaagatattcccaccatactgttgttgcttataaaaatgatttagagcagtttgttcaatatgcacatcaagcatttgctttaaacgaatggagagaaataaacacatcaatcattcgctcatggatagttgctttaattgaagaaggaaacacatcaacaaccattaatcgaaaaatttcatcattaaaatcattatataaatacatgatgaaaaatggattggtagcaactaacccattattaaaaatagttattcctaaaacttccaaaagacttccggtatttgttaatgaaaatgaaataaaccagctattttctactatagaatttgaagatacatttgaagggcaaagagataaattaataatggagttattttatctaacaggcattcgtttaacggaattaataaatctaaaaataagtgatgttaacacctataatttaaccataaaagtgttggggaaaagaaataaagaaagagttattcctattacaagtgaatttataaaactatttcaaagttaccttatatatagagacgaaattcctgccgattccaattatgtatttttaacagaaagaggcaagaaaatatatgaaaagcttgtgtatagaatagtaaataactaccttagccttgtaacaacagctgataaaaaaagtccacatgtaataaggcatacgtttgctacacatatgttaaatagggggggctga

SEQ ID NO: 15442 - protein, 255 aa, Unknown
  Obtained from environmental sample
  DOMAIN (112)...(255): Phage integrase family
  misc_feature (1)..(255): Xaa is any amino acid
MINQAQQFCDYIQHQKRYSHHTVVAYKNDLEQFVQYAHQAFALNEWREINTSIIRSWIVALIEEGNTSTTINRKISSLKSLYKYMMKNGLVATNPLLKIVIPKTSKRLPVFVNENEINQLFSTIEFEDTFEGQRDKLIMELFYLTGIRLTELINLKISDVNTYNLTIKVLGKRNKERVIPITSEFIKLFQSYLIYRDEIPADSNYVFLTERGKKIYEKLVYRIVNNYLSLVTTADKKSPHVIRHTFATHMLNRGG

SEQ ID NO: 15443 - DNA, 777 bp, Unknown
  Obtained from environmental sample
  misc_feature (1)..(777): n is a, c, g, or t
atgaagtcatttccaacatataaaatttttaaacacacattaggcgtatttctcatagcagttgcttttagttgcagttccgctaaacgcgttatagcctctggtgaagctagcgagcaattgtcggttaaacaggtcataaaacagcatcaaaagaatgagacggactttaaaaccttaaaagctagattaaaaattgatattacacaaaataatcgttcacaaggtgctggttttacactgaggatagaaaaggataaagtgatttggttaagtgaatccatcttaggtatggcacgtatgatgattactccagataaagtaagattctacaataaaatagataatgaatattttgacggagattacaaattattgagtgatgttgctggtattgatctcgatttcatgaaagttcaaaacatccttttgggtcaaactatccatagtcttaatgataagccttatcaagtttcggttaacaataactcttatgccgtaagtccgaaagaacaaaatgcactgttagagttattttatttaattaacccttcgcattttaaaatggatagcttacaattgcaacaagtcttaaagaggcgattgcttcaagtggattatgccgcttatcaagaagtagataaacaaatcattcctaaaaacatcagtattgtcgcagttgaagatactgatgaagttgctataagtatggagtttaaatcggtatctttgaatgaaggaagtccgttttcccgtttaatattcccctcgggctaa

SEQ ID NO: 15444 - protein, 258 aa, Unknown
  Obtained from environmental sample
  misc_feature (1)..(258): Xaa is any amino acid
MKSFPTYKIFKHTLGVFLIAVAFSCSSAKRVIASGEASEQLSVKQVIKQHQKNETDFKTLKARLKIDITQNNRSQGAGFTLRIEKDKVIWLSESILGMARMMITPDKVRFYNKIDNEYFDGDYKLLSDVAGIDLDFMKVQNILLGQTIHSLNDKPYQVSVNNNSYAVSPKEQNALLELFYLINPSHFKMDSLQLQQVLKRRLLQVDYAAYQEVDKQIIPKNISIVAVEDTDEVAISMEFKSVSLNEGSPFSRLIFPSG

SEQ ID NO: 15445 - DNA, 879 bp, Unknown
  Obtained from environmental sample
  misc_feature (1)..(879): n is a, c, g, or t
ttgtatatggaagagtatactgatgcaattgtgaaaagattaggcgaattagagatgataagtgtagaggaagatccaacttatgagtatgatgttaaaattacaaaaatacttgaatcacttggatttccagcagaacaacacactgatcttatgagtacaatagctggtggagataaatttaaagttttacttgcgcaagtattatttccaaaacctgatgtattatttctagatgagcctacaaataaccttgatatggcaactatctcttggcttgaaaatcaattacaacatcatgagggaactatggtagttatctcacatgatagacacttcttgaatgctgtttgtacacacatacttgatgttgattttaaaaagattagagagtttactggaaactacgatgattggtatattgcatcaactgtattatctaaacaagcagatgcacaacgagataaaaaacttaaagagaaagcagaacttgaagcctttgttgcaagatttagtgccaatgcttcaaaagcaaaacaagcaacttctagacaaaaacaacttgataaaatagatattgaagctattcaagtaagttcaagaagagacccatcaattgtatttaaacaagaaaaacctatttcaaaagaggttttagaggttaaagatatttgtaaatcttacgatggagaagttgtattaaaagatattaactttatgttagagaaaaaagataaaattgctttaataggtccaaatggagctggtaaaacaactttatgtgaaatattaatggaaaatattaaaccagacagtggtgaagtaaaatggggtgcaactgcccttgtgagttactttccacaaaatacaactgattaa

SEQ ID NO: 15446 - protein, 292 aa, Unknown
  Obtained from environmental sample
  DOMAIN (1)...(127): ABC transporter
  misc_feature (1)..(292): Xaa is any amino acid
MYMEEYTDAIVKRLGELEMISVEEDPTYEYDVKITKILESLGFPAEQHTDLMSTIAGGDKFKVLLAQVLFPKPDVLFLDEPTNNLDMATISWLENQLQHHEGTMVVISHDRHFLNAVCTHILDVDFKKIREFTGNYDDWYIASTVLSKQADAQRDKKLKEKAELEAFVARFSANASKAKQATSRQKQLDKIDIEAIQVSSRRDPSIVFKQEKPISKEVLEVKDICKSYDGEVVLKDINFMLEKKDKIALIGPNGAGKTTLCEILMENIKPDSGEVKWGATALVSYFPQNTTD

SEQ ID NO: 15447 - DNA, 435 bp, Unknown
  Obtained from environmental sample
  misc_feature (1)..(435): n is a, c, g, or t
atgagtgaagtttctgagataaaacttaacgcttttacattagcagacttaccgcaaatagccgagcagcttttgtcagcaataggaaatcataaaatcattactttttatggagaaatgggagcaggtaaaactactttaattaagcaattgtgtaaaacattaaaagttacagataccattcagagtcctactttttctattgttaatgaataccttacggaagataatcaacaagtttatcattttgatttttatagaattaaagaagaggaagaagccttggattttggtgtggaagaatatttttacagtggaaattattgttttatagagtggccagagaaaattcctaaccttattcccgaaaaagcagtaaaagtttccataaaacaaacagaagacaataaaagattaataacaattttgtattaa

SEQ ID NO: 15448 - protein, 144 aa, Unknown
  Obtained from environmental sample
  DOMAIN (13)...(140): Uncharacterised P-loop hydrolase UPF0079
  misc_feature (1)..(144): Xaa is any amino acid
MSEVSEIKLNAFTLADLPQIAEQLLSAIGNHKIITFYGEMGAGKTTLIKQLCKTLKVTDTIQSPTFSIVNEYLTEDNQQVYHFDFYRIKEEEEALDFGVEEYFYSGNYCFIEWPEKIPNLIPEKAVKVSIKQTEDNKRLITILY

SEQ ID NO: 15449 - DNA, 723 bp, Unknown
  Obtained from environmental sample
  misc_feature (1)..(723): n is a, c, g, or t
gtgtttttaagcgttgcaaaaggtgaaaattatgccaccatagcatctttacctattacctcttatatgataagtaaatatggattacaagatttacaaatagcaggatatttgaatattaaatatgatttatcaattgcagttagagatgataatgaacaattattaaagatattaaataaagctttacagcaaataccaaaagagaaatacaagcagttttttaataattggacctcattggtggtggagcaaaagtcagattacacatttttttataaaattatagctcttgttgttgttttattgtttgttgcaggatatttaaactataaactcaattcaaaggtaaatgaaaaaacaaaagagttgaaaaatcttaatgaacatctagaagaaaaagttttacagcgaacaaaagagttacaaatagaaaaagaaaaagctgaaaatagcacaaaagcaaaatcagaatttttagcaaatatgtcccatgagataagaacacctatgaatagtatattaggtatgagctatttagctttagaatctcaagattttgcaaaacaaaaaaaatatatacaaaatatagataattctgcaaaaacacttttaaatataattaatgatattttagactttagtaaaatagaagctgggaaattagatattgaatatgtcgattttgatatgagagatgtgattaaaaattttcaaatataa

SEQ ID NO: 15450 - protein, 240 aa, Unknown
  Obtained from environmental sample
  DOMAIN (155)...(220): His Kinase A (phosphoacceptor) domain
  misc_feature (1)..(240): Xaa is any amino acid
MFLSVAKGENYATIASLPITSYMISKYGLQDLQIAGYLNIKYDLSIAVRDDNEQLLKILNKALQQIPKEKYKQFFNNWTSLVVEQKSDYTFFYKIIALVVVLLFVAGYLNYKLNSKVNEKTKELKNLNEHLEEKVLQRTKELQIEKEKAENSTKAKSEFLANMSHEIRTPMNSILGMSYLALESQDFAKQKKYIQNIDNSAKTLLNIINDILDFSKIEAGKLDIEYVDFDMRDVIKNFQI

SEQ ID NO: 15451 - DNA, 429 bp, Unknown; identical to SEQ ID NO: 13745
  Obtained from environmental sample
  misc_feature (1)..(429): n is a, c, g, or t

SEQ ID NO: 15452 - protein, 142 aa, Unknown; identical to SEQ ID NO: 13746
  Obtained from environmental sample
  misc_feature (1)..(142): Xaa is any amino acid

SEQ ID NO: 15453 - DNA, 465 bp, Unknown
  Obtained from environmental sample
  misc_feature (1)..(465): n is a, c, g, or t
gtgaatatgtccaaagagttatcaacacactcactaagtagtacattttcacatatttacgtggaaaaaagagttttagatcatgagaaaacaaaagatattttaaaaaagtttaaaaattctcatatcatcatgatagatcactataaagatatttttaaccgttcacaccaaagtttttcagagcagtctcttagtaaaaatcttattttagctgcgagagatgagaactttttaatagaaggctcatattttagtgatggttttgagtatgaaaacttcttctacacaccatcgattttagggtgtctgtatgattgtgattactgttacttacaaggcatgtacaactctgcgaacagtgtcatttttgtaaatatagaagatttcataaatgatagtaaaaaatatttagacaaacctaccctcatagcaatctcttacgatacagaacctcagcgataa

SEQ ID NO: 15454 - protein, 154 aa, Unknown
  Obtained from environmental sample
  misc_feature (1)..(154): Xaa is any amino acid
MNMSKELSTHSLSSTFSHIYVEKRVLDHEKTKDILKKFKNSHIIMIDHYKDIFNRSHQSFSEQSLSKNLILAARDENFLIEGSYFSDGFEYENFFYTPSILGCLYDCDYCYLQGMYNSANSVIFVNIEDFINDSKKYLDKPTLIAISYDTEPQR

SEQ ID NO: 15455 - DNA, 681 bp, Unknown
  Obtained from environmental sample
  misc_feature (1)..(681): n is a, c, g, or t
ttgaaaatagacaatattattttttccgatagaatagaagcaacaaaaatgctttatagtgtcttacctacagaagatatgaagaaagagcaatggattatactagctatttctgctggtggagtacccattgcattagatttagcgaaaaaattgaatgcaaaattcgattatctatttacaaaaaaaatatttacaaaaaataataatgaatgtgaaatagcaattataacagaaacacaagatattgttgttcatgaagaattattgaaatcattttcattggatttagaaaatatttatgatgagtctaaagatatgtacttaactgatatacaagattataaagctaagtatagagatggtttagatataataaacttagctaacagtaatgttttattagttgatgagggtttaaatacaggacttacaatgatggcttgtattaagtctgttattagcaagcaagcaaagtcaatttgtgttgcagttccagttttacctgaagttacaattaacgatatagaaacaattgcggatgatttgtattatgttcaagcacctgcacattttgtttcaattgatttttattatgaaaaattagaacaaatagaattagaagatatagaaaaattaaaagataattataaaaaggaaaatgatgtcaaccgtatgtga

SEQ ID NO: 15456 - protein, 226 aa, Unknown
  Obtained from environmental sample
  DOMAIN (5)...(184): Phosphoribosyl transferase domain
  misc_feature (1)..(226): Xaa is any amino acid
MKIDNIIFSDRIEATKMLYSVLPTEDMKKEQWIILAISAGGVPIALDLAKKLNAKFDYLFTKKIFTKNNNECEIAIITETQDIVVHEELLKSFSLDLENIYDESKDMYLTDIQDYKAKYRDGLDIINLANSNVLLVDEGLNTGLTMMACIKSVISKQAKSICVAVPVLPEVTINDIETIADDLYYVQAPAHFVSIDFYYEKLEQIELEDIEKLKDNYKKENDVNRM

SEQ ID NO: 15457 - DNA, 729 bp, Unknown
  Obtained from environmental sample
  misc_feature (1)..(729): n is a, c, g, or t
ttgattttcaaggatattttgtttaaaggccataacatgggtctgaccattgatatcaaaccagttgaccatgaaaattatgaaaaatgggtccttgcccagggcaaggaacggcggattatcaccattctgggcaggaccatgaccgctcatcagatttcttctgttgcctcggtgatagctgaaaataatctgaatatcgattccatcacccggttgaccggcaggcgctcctttgtccatcccgatatccgtcccaaggcaagcgttcagttttccgtttccggcgcccctaccaatctctctcaaatgcggggggaatttatgaaaatttcccagcaggccggtattgacatctcttttcacgtggacaatatttatcggaaaaaccggaagctggtggtctttgatatggattccaccctgatccaggccgaagtgattgtggaattggctaagcttgccggtgtgggggaagaggtggataaaatcaccgagtctgccatgagaggagaaattgattttaaggagagctttcgaaaacgggtggccttgctcaagggtcttgaactggaaaaaatcgaaaaaatcacccatgaactgcccctgacagaaggggcggacctggttaccaaaaccctgaaaagcctgggatataagctgggaattctgtccggcgggtttacctttgtgggcgagtatttacaggatctgctggggtttgactag

SEQ ID NO: 15458 - protein, 242 aa, Unknown
  Obtained from environmental sample
  misc_feature (1)..(242): Xaa is any amino acid
MIFKDILFKGHNMGLTIDIKPVDHENYEKWVLAQGKERRIITILGRTMTAHQISSVASVIAENNLNIDSITRLTGRRSFVHPDIRPKASVQFSVSGAPTNLSQMRGEFMKISQQAGIDISFHVDNIYRKNRKLVVFDMDSTLIQAEVIVELAKLAGVGEEVDKITESAMRGEIDFKESFRKRVALLKGLELEKIEKITHELPLTEGADLVTKTLKSLGYKLGILSGGFTFVGEYLQDLLGFD

SEQ ID NO: 15459 - DNA, 588 bp, Unknown
  Obtained from environmental sample
  misc_feature (1)..(588): n is a, c, g, or t
atgttaactgttgcgatttttggctatttttactcacttaaaataaatgcttgtgataaaagaattcaaaataatttttttgtagcactttttcatgatctccctgaagctctaactcgtgatattataagtcccgtaaaatatagtgtagatgagttagcagatatcatagcagaatatgaggtgagtcaaattgaagataaaattatgccttatgttcctatgaatttaaaaaaagaattttcatatattttaggtcttgataaaaacaatatcaaagatgaatttgaaaataaaattattcaaaatgagacaatcacaacagttgcagatatgtctcaatataatcttgataaatataatcctatagatggaaaagcattaaaacaatgtgataaactttctgcatttatagaagctagcttatctatatcacatgggattaaatcaaaagagttaatcagtggtaaaaaacagattatggcatctttacaagaggtacaaggtgtagatttcaaagcaattgcaacttgtattgatgaagagttttgtacaactggaaaaacccaaacaacaatggagttataa

SEQ ID NO: 15460 - protein, 195 aa, Unknown
  Obtained from environmental sample
  misc_feature (1)..(195): Xaa is any amino acid
MLTVAIFGYFYSLKINACDKRIQNNFFVALFHDLPEALTRDIISPVKYSVDELADIIAEYEVSQIEDKIMPYVPMNLKKEFSYILGLDKNNIKDEFENKIIQNETITTVADMSQYNLDKYNPIDGKALKQCDKLSAFIEASLSISHGIKSKELISGKKQIMASLQEVQGVDFKAIATCIDEEFCTTGKTQTTMEL

SEQ ID NO: 15461 - DNA, 948 bp, Unknown
  Obtained from environmental sample
  misc_feature (1)..(948): n is a, c, g, or t
ttgcccttggaaaaagggttaaaaattgattattattgcctggaggtaggcatttaccacttgaacgaaaaaaaagaaattttttttttacttgatgaaaggcatcctctcaagttgggtctgtactttttagacataaaaaatgtacctatagagtctatatttgatttagaagataaaaatatagctgtattagaaaatactattcaatctactgcaataaaagaatcaatgaaaaaatttaatattcaccctcatagttatattgaggtatcagattatgaagagggttttaaacttttaactgataaaaaagttgattgtgttctagtgaatcgcttttatgaactaaatcataaatttgcagatactattattaaaacaaatattgtacttgagccttctgtgatgaaatatgcatttaatttatcacgaagtgatttagcaaaagatgtagacacaaatataaaagaatttaaagcagacaaaaattcgatattttatgaagcgacactcaaatggatcacacctaatgtaccaacacaaataccaaattggataaaatggatagttttaggcagtataatagttattttaactttaagcgtggtggttattttatttcaaagaatggttcgtaaacaaactcaagagttactacaaaatgaaaaattaatgataattcaatccaaacatgctgctatgggagagatgattgcactcattgcacatcaatggagacagccacttaatattatttccataatttcctctaatattacagcttctatagagcttgaagaaaaaattaaagataatgagttagctgaatatatgaaaagcatctccaaacaagtagaacatttatcaaccactattgatgattttagaaatttttttaagccaaataaaaaaaaggtcaaaatcaaatctcctcagccaatctga

SEQ ID NO: 15462 - protein, 315 aa, Unknown
  Obtained from environmental sample
  DOMAIN (234)...(305): His Kinase A (phosphoacceptor) domain
  misc_feature (1)..(315): Xaa is any amino acid
MPLEKGLKIDYYCLEVGIYHLNEKKEIFFLLDERHPLKLGLYFLDIKNVPIESIFDLEDKNIAVLENTIQSTAIKESMKKFNIHPHSYIEVSDYEEGFKLLTDKKVDCVLVNRFYELNHKFADTIIKTNIVLEPSVMKYAFNLSRSDLAKDVDTNIKEFKADKNSIFYEATLKWITPNVPTQIPNWIKWIVLGSIIVILTLSVVVILFQRMVRKQTQELLQNEKLMIIQSKHAAMGEMIALIAHQWRQPLNIISIISSNITASIELEEKIKDNELAEYMKSISKQVEHLSTTIDDFRNFFKPNKKKVKIKSPQPI

SEQ ID NO: 15463 - DNA, 765 bp, Unknown
  Obtained from environmental sample
  misc_feature (1)..(765): n is a, c, g, or t
atgcttctgggccttcctttagttgggttaggttttttggcatatagtggaggtcttcgatttactatttatgccgttcctattatggcacttggtgttggtttttttatctacgaaatagctaatttttttaaacagagtgttgtaaaacatagtatcatagctattttaacaatcctggcattggttccaaatattaatcatataattgaatatcgagtaccaactgtttttaataaagctgaagtggaggtacttgacaaactaaaatcaatagctaagcgggaggattatgtagttggatggtgggattatggataccctatacgatactacagtgatacaaaaacattaagtgatggggggaaacatagtggtgctataaattttccaacaagttttgtcttaacaaagtcacaaaaagaatctgcaaatatgttacgacttgatgtggaatatacagaacaatcttttatcgtagaaaatgataaagatagaaatcgtacaaatatagcaaatatgacacttgattataactttaaagatacaaatgattttttagaatcattaaaaacagatataaagttacctcanagtagtagagatatttatttatatttacctaataggatgatagatatatatcctactattaaatctttttcaaatataaaccctatgaatggggaaaaaggaaagcaacattttttttattttactaaaaaatttaaagattatgatactccttatggaccttggaaatga

SEQ ID NO: 15464 - protein, 254 aa, Unknown
  Obtained from environmental sample
  misc_feature (1)..(254): Xaa is any amino acid
MLLGLPLVGLGFLAYSGGLRFTIYAVPIMALGVGFFIYEIANFFKQSVVKHSIIAILTILALVPNINHIIEYRVPTVFNKAEVEVLDKLKSIAKREDYVVGWWDYGYPIRYYSDTKTLSDGGKHSGAINFPTSFVLTKSQKESANMLRLDVEYTEQSFIVENDKDRNRTNIANMTLDYNFKDTNDFLESLKTDIKLPXSSRDIYLYLPNRMIDIYPTIKSFSNINPMNGEKGKQHFFYFTKKFKDYDTPYGPWK

SEQ ID NO: 15465 - DNA, 558 bp, Unknown
  Obtained from environmental sample
  misc_feature (1)..(558): n is a, c, g, or t
ttgtgcttcgaaatcgcctacattttcatagcccaaccgttaccaacaataatgagaagaaccataacaataataattttactcatatttggacttaatttcaaagtaagtgccgactcagtttcgtatagtaattctttggaaatacagactgaatcagaaaactatattgtaatccattttcatgactggactgacacaacacgcgatagccgttataaaatgatttcaaataatcaagatccgtttacatctgaaaatgattattcttacatagaatgtattgataaaaagactggagaaactatattcaagaaaccatgccctgcgttgacaaatatttcaatatctcctgacgaaaaatatattgttggaatttcaaacataaaattatggaatccatatcaattagtcatttttgaaacttcaggaaaacttattaaaaaaagacatatttcacgagaagaatcaaaacttgattctatacaatttgtggattttaagaataaataccccagacnatttctaataatggactcgtttagaatttattcataa

SEQ ID NO: 15466 - protein, 185 aa, Unknown
  Obtained from environmental sample
  misc_feature (1)..(185): Xaa is any amino acid
MCFEIAYIFIAQPLPTIMRRTITIIILLIFGLNFKVSADSVSYSNSLEIQTESENYIVIHFHDWTDTTRDSRYKMISNNQDPFTSENDYSYIECIDKKTGETIFKKPCPALTNISISPDEKYIVGISNIKLWNPYQLVIFETSGKLIKKRHISREESKLDSIQFVDFKNKYPRXFLIMDSFRIYS

SEQ ID NO: 15467 - DNA, 339 bp, Unknown
  Obtained from environmental sample
  misc_feature (1)..(339): n is a, c, g, or t
atggagtctaatctgaatatgcgagtgaaaggagagattgataaaacatatttcactatcaatgggaacaattatacatcacacattgatttaaaattaaaatatgatgattttgatgtgtttattttaaaagaaaatggtaaagtaaaaaataagtttttatcaaacataataagtttttttgtttctaaaaatagtaatgatgcttccgaagactttagacatggttcagaatctgaggttaaaagaactgtgaacaaatctgtgtttaattatttttggctgaatataaaagccggtttgctagaggctatgacaggagatggtaaagaaaaataa

SEQ ID NO: 15468 - protein, 112 aa, Unknown
  Obtained from environmental sample
  misc_feature (1)..(112): Xaa is any amino acid
MESNLNMRVKGEIDKTYFTINGNNYTSHIDLKLKYDDFDVFILKENGKVKNKFLSNIISFFVSKNSNDASEDFRHGSESEVKRTVNKSVFNYFWLNIKAGLLEAMTGDGKEK

SEQ ID NO: 15469 - DNA, 570 bp, Unknown
  Obtained from environmental sample
  misc_feature (1)..(570): n is a, c, g, or t
ttggcaaacggtgctttgagtggaggtggcgaagaatacaaaatacgcagaaaactcattgaaaataaaattgtggaagcaattttggttttgccacaaggtatgttttacaccacacctataagtgtttcaatttggatattaaacaaaaataaaaaatcaaacaccagaaaaattggtaataaaacccgtaattaccgtgaccgctcaaccgaaattctatttatggatttacgacaaatgggagagccttttgaaaagaagtttgtccaattctcagaaacagatattgataaaattgcttcaacctatcaccaatggcaggtgaaagaaattaaaagcatacccgaattctgttatgctgctaccttggaagaagtgaagaaaaaagatttttcactcgtacccagcaagtacattgaatttgtaaaccgagatgaaaacattgactttgatgataaaatgaaagccttgaaaaacgaatttgccgacttgttgaaagctgaggcacaaagcaaaaatgatttactaaatgtgtttaaagagttgggttatgaaatcgaattataa

SEQ ID NO: 15470 - protein, 189 aa, Unknown
  Obtained from environmental sample
  DOMAIN (1)...(133): N-6 DNA Methylase
  misc_feature (1)..(189): Xaa is any amino acid
MANGALSGGGEEYKIRRKLIENKIVEAILVLPQGMFYTTPISVSIWILNKNKKSNTRKIGNKTRNYRDRSTEILFMDLRQMGEPFEKKFVQFSETDIDKIASTYHQWQVKEIKSIPEFCYAATLEEVKKKDFSLVPSKYIEFVNRDENIDFDDKMKALKNEFADLLKAEAQSKNDLLNVFKELGYEIEL

SEQ ID NO: 15471 - DNA, 957 bp, Unknown
  Obtained from environmental sample
  misc_feature (1)..(957): n is a, c, g, or t
ttggcggccggagagtggcgaaattttaataaagactttatctctattaaaatagatagggaacaatttcctcatatcgatggtttttatcaaaaagtgtatagagtgatgaataaaaaaggtggtggttggccacttactattgtgatgacgcctaatatggagccatttttttcggcaacctatgtaccaaaatatgcaggatatggctcaagaggacttatggaagtattaagagagattgcagtttatgataaagacaaactacaagagcaagggaaacatatacttgaagttgtaaataatgaagagaatgttactttatcaaatgcaacttttgatgataagttatcacacaatatagtaaaccaatttcaaagtagttatgacaaaaaatacaaagggtttggtacacatccaaagtttccacagtttacaaatcttatattacttttaaaactctatgaaatcaacggtgataaagaggctttaactatggctgtagattctttaaaagctatggcaagaggtgggatttttgatcaaatagagggggctttttatcgatatagtgtagatcaaaagtggacaataccacattttgaaaagatgttatataccaatgctgaagcactagaagcatataccttggcttacaaaatcacaaaagagcctttatttaaagaggttattgagaaaacaatttctcaaattgatgtgagatttttagaagatggtgtttataaaagtgctagtaatgctgatagtaaaaatgccgaagggaaaaatgaagagggatattattttgtttttgattatatggagagcttagagtatttagaacaaaatggtattgatgaaaaagctgcaattgaaaacttaacctatctaggtattgtaaaagatggaaactttgatggggaatattcaaatccagagatttttaggagtcaataa

SEQ ID NO: 15472 - protein, 318 aa, Unknown
  Obtained from environmental sample
  misc_feature (1)..(318): Xaa is any amino acid
MAAGEWRNFNKDFISIKIDREQFPHIDGFYQKVYRVMNKKGGGWPLTIVMTPNMEPFFSATYVPKYAGYGSRGLMEVLREIAVYDKDKLQEQGKHILEVVNNEENVTLSNATFDDKLSHNIVNQFQSSYDKKYKGFGTHPKFPQFTNLILLLKLYEINGDKEALTMAVDSLKAMARGGIFDQIEGAFYRYSVDQKWTIPHFEKMLYTNAEALEAYTLAYKITKEPLFKEVIEKTISQIDVRFLEDGVYKSASNADSKNAEGKNEEGYYFVFDYMESLEYLEQNGIDEKAAIENLTYLGIVKDGNFDGEYSNPEIFRSQ

SEQ ID NO: 15473 - DNA, 756 bp, Unknown
  Obtained from environmental sample
  misc_feature (1)..(756): n is a, c, g, or t
atgagaggcacgatttgctctatacttatattatcatttatatttcttattaccgcttgtgataataaggataaatttaatcatgacccaaatttcaagttagtattctcaaaagacagcataacattcgatactattttttctgggcttccttctacaactaaacaactaaaaatttacaatcaatcctcacatcctattcttataagtgagattagtttagaagatggaaataactaccaattaaatatcaatggtataaatgggaatatttcgaatgagattgagattgcctctaaggatagtttatacattttcatacaattgaatgctgtcgatattgatcaaaatgcacctcgtataattgaggatcgaatactgtttacaatcaattcaaaggtcgaaaaattcttacttaaaagttgggctcaagatgttattcgattttccgaaaatgaactcgaaactcaagattggacacaaaatcgcccatattatatagataaggatctaattctagaagagaatcaaaaattatcaatacaagctggtactaaagtttattttcaaaaaggtgcaggtttacacattaaaggtgagctaaatatcgaaggtagctttgacaaacctgtcttttttggatcatatcgtaaagaagaactatacaaaggtgtaccagggcaatgggaaagcctattcttttattcagaaagcaaaaataatttaatctctcatctgtatttagaaattgcataa

SEQ ID NO: 15474 - protein, 251 aa, Unknown
  Obtained from environmental sample
  SIGNAL (1)...(19)
  misc_feature (1)..(251): Xaa is any amino acid
MRGTICSILILSFIFLITACDNKDKFNHDPNFKLVFSKDSITFDTIFSGLPSTTKQLKIYNQSSHPILISEISLEDGNNYQLNINGINGNISNEIEIASKDSLYIFIQLNAVDIDQNAPRIIEDRILFTINSKVEKFLLKSWAQDVIRFSENELETQDWTQNRPYYIDKDLILEENQKLSIQAGTKVYFQKGAGLHIKGELNIEGSFDKPVFFGSYRKEELYKGVPGQWESLFFYSESKNNLISHLYLEIA

SEQ ID NO: 15475 - DNA, 948 bp, Unknown
  Obtained from environmental sample
  misc_feature (1)..(948): n is a, c, g, or t
ttggcggccggagattttttcgctatatttggcatttttatgtcgctgtctttattggccaatgagttaacattaaagcctgatgctccaaagtcctatactgtaaagaaaggtgataccctttgggatatatctggtatttttcttaaccaagcttggttgtggccaaaattatggcgccttaatcctgaaattaacaaccctcatttaatttaccctggtgatgaactacgtttagtctttgatgcacaaggtcaacccatgttagtcaaaggtaagcctgagctcaaatggtcacctaaagttcgtcagcaatcaaaaaatcaaatgccaattaataccttgcctctacaggctattgcgccttatattcgctatgacagtgtaaaaacattagctgagttggaacatcttccctatattattggtagtgataaaggttataaatctagcctcgatggctttaaagtttatgtaaacaatgatcttattattggtcagagctatgctatttatcataaaggtagcgctattgttgaccccgttacagcagataacctaggttataacatcgtacttgttggtactgggaaagcattagaacgtggcgatataagcaagaagctgccaagtacgctttatattgatggtgtaaaacgtgaaatccattctggagccttcgtagtgccagtaaatgacgagcagcagtatcctgctgtttttactatgcgggccagtgctaaaaatactaaaggtctgattattagctctgtcacaaaactgcgtgagtttgctaaatttgatgtggtgatgataaaatcaggaacgaaacaagcggttcaagctggcgatgtattgactgttagtcgaaaaagtcctgctgtgctcaacactgatagtggtcctgagtatacccataaaacttcccgtgggaatcaaatagtggcn

SEQ ID NO: 15476 - protein, 316 aa, Unknown
  Obtained from environmental sample
  SIGNAL (1)...(20)
  DOMAIN (33)...(80): LysM domain
  misc_feature (1)..(316): Xaa is any amino acid
MAAGDFFAIFGIFMSLSLLANELTLKPDAPKSYTVKKGDTLWDISGIFLNQAWLWPKLWRLNPEINNPHLIYPGDELRLVFDAQGQPMLVKGKPELKWSPKVRQQSKNQMPINTLPLQAIAPYIRYDSVKTLAELEHLPYIIGSDKGYKSSLDGFKVYVNNDLIIGQSYAIYHKGSAIVDPVTADNLGYNIVLVGTGKALERGDISKKLPSTLYIDGVKREIHSGAFVVPVNDEQQYPAVFTMRASAKNTKGLIISSVTKLREFAKFDVVMIKSGTKQAVQAGDVLTVSRKSPAVLNTDSGPEYTHKTSRGNQIVA

SEQ ID NO: 15477 - DNA, 336 bp, Unknown
  Obtained from environmental sample
  misc_feature (1)..(336): n is a, c, g, or t
gtggtgccggtactgcattcaggaaagttgaaaggtatttgttttatttttccgttttgtaataaaatcattgcaggtaaaaatctatgcaagcctttaaacattggaatatttttggcgaattcggttttaattacttttaacggacaaccagtatcgtccattccatcgtttgtaaaacttcttctaattccgtttgcaattgtagacgacatttttttaacaaaagaatcttttctatttgctcttacaccagttactaaatcaaagtcctcaatttcctttagtaataaattaaaatcttcaggagcagtttgtaaatcggagtctatataa

SEQ ID NO: 15478 - protein, 111 aa, Unknown
  Obtained from environmental sample
  misc_feature (1)..(111): Xaa is any amino acid
MVPVLHSGKLKGICFIFPFCNKIIAGKNLCKPLNIGIFLANSVLITFNGQPVSSIPSFVKLLLIPFAIVDDIFLTKESFLFALTPVTKSKSSISFSNKLKSSGAVCKSESI

SEQ ID NO: 15479 - DNA, 549 bp, Unknown
  Obtained from environmental sample
  misc_feature (1)..(549): n is a, c, g, or t
atgagtaaatctatatttttaaataacaaacttgttgaagattgcaaacttaacaagtctagagctcaaatgcaattgtatgataaatattgtaatgcaatgtttagtatagcacagcggtatgtaaaagatgattttacagctgaagatgtaatgcaagatgcatttataaaggtgtttaaaaatattaaaaactttaaaggagaagttactattggcgcctggataaaaagaattgtaattaatcaatgcattgattatttgaaaaagaaaaaagttgagttggtttcaattgaagaaaagaaactagatgttgcatcgaatgatgattggactattgatgaagttgttaatgttaatatggttacaacagctattaataatttacctgaaaagtacaaagttgtattgagcttgtatttattagaagggtacgatcatcaggaaatagcgcaagtattaagcataagcgaggttgcttcaagatctcaattaatgcgtggtaaaaacaaattaaaaattcaattaaaagagtttaattatgcctaa

SEQ ID NO: 15480 - protein, 182 aa, Unknown
  Obtained from environmental sample
  DOMAIN (125)...(174): Sigma-70, region 4
  misc_feature (1)..(182): Xaa is any amino acid
MSKSIFLNNKLVEDCKLNKSRAQMQLYDKYCNAMFSIAQRYVKDDFTAEDVMQDAFIKVFKNIKNFKGEVTIGAWIKRIVINQCIDYLKKKKVELVSIEEKKLDVASNDDWTIDEVVNVNMVTTAINNLPEKYKVVLSLYLLEGYDHQEIAQVLSISEVASRSQLMRGKNKLKIQLKEFNYA

SEQ ID NO: 15481 - DNA, 870 bp, Unknown
  Obtained from environmental sample
  misc_feature (1)..(870): n is a, c, g, or t
atgtcacatgagataagaacacccatgaatggaataattgggatgtctcatttggcattacaaactaatttaaatgagagacaaaaaaactatatacaaaagatagataatagcgcaaaaagtttattaaatataataaatgatattttagatttttctaaaatagaagctggaaaattagagatagagaagatagaatttgatctctttacagttatagatagcagtataaatcttatcgaactaacggcacacgaaaaaaacttagagataattgtaagttatggctcaaacataggaaaaaaattttcaggtgatcctttacgactatctcaagtcattataaatcttttaacaaatgcagtaaagtttacacaagatggtgagattggtatttatattgaaaagaaatcagatgacagatttcaatttatagttaaagatacaggtattggcttaacaaaagaggaacaaaataaactatttcactcattttcacaagcagatggaagtacgactagaaaatatggtggtacaggattaggactttctatttcaaaacaacttattgaacttatgggtggagatatatgggttgagagtgaaaaagatataggaagtagctttatatttgagatagacttagaagagctaaagaacaataaaaaagagtatcaacaattttataataaaagagcattagtagttgatgataataaaacatggcatgaaatattacacagtttactttctaattttggtttaagtgtagatgtagttttgagtggtaaagaagcgatagaaagagtagataaatgtaacaacagttatgacattatcccttatggattggaatatgccaaatcttga

SEQ ID NO: 15482 - protein, 289 aa, Unknown
  Obtained from environmental sample
  DOMAIN (1)...(58): His Kinase A (phosphoacceptor) domain
  misc_feature (1)..(289): Xaa is any amino acid
MSHEIRTPMNGIIGMSHLALQTNLNERQKNYIQKIDNSAKSLLNIINDILDFSKIEAGKLEIEKIEFDLFTVIDSSINLIELTAHEKNLEIIVSYGSNIGKKFSGDPLRLSQVIINLLTNAVKFTQDGEIGIYIEKKSDDRFQFIVKDTGIGLTKEEQNKLFHSFSQADGSTTRKYGGTGLGLSISKQLIELMGGDIWVESEKDIGSSFIFEIDLEELKNNKKEYQQFYNKRALVVDDNKTWHEILHSLLSNFGLSVDVVLSGKEAIERVDKCNNSYDIIPYGLEYAKS

SEQ ID NO: 15483 - DNA, 855 bp, Unknown
  Obtained from environmental sample
  misc_feature (1)..(855): n is a, c, g, or t
atgagaattgatgtagttcttaacggccaagaggctatagacttttttattaaaaatagatatgacttaatactaatggatattcaaatgccaataatggatggatatgaagcaacaaaaatattcagaaaagagaataaagagattccaattatagcactgagtgcaaatgctatgaaaagtgatatggaaaaaacaaaaaatataggcatgcaagagcatcttaataagcctatcgaagtagaaaagttatatgctacattattaaaatatttatctatatacaatttagaagaagttaaagagaaaatatatatccctgattttaaaaatattgatacaagtttaggcttacttcatctaggagacaatcaaaaactctatatgaaagtacttaataatttttatagtagttataaaaatttcactttaaatattttagatgatgaagaaaaatcaagaataattcatacacttaaaggattaagtgcaaatattggtgctacaaatttacataacatcatacaagagttagagaataaagatagtgatgagttaattcaaaaactatatgaagagttaaataaggtaattgaagagttaaagttagttaccacgcaaagtgatcaatctgtagatattaaagagccgtggagtgatgaaataaaaagagaattattaaaaaaacttcatactgttattcgaacaaaaagaccaaaaaatattgcactagtagttaaagagatagaaaaatatcagttatccgtagaagaaaaaaacagttttgaaactatcaaaatatatattgaaaagtttgattttcaaaaagctttagagcttgtagaacttatttaa

SEQ ID NO: 15484 - protein, 284 aa, Unknown
  Obtained from environmental sample
  DOMAIN (1)...(96): Response regulator receiver domain
  misc_feature (1)..(284): Xaa is any amino acid
MRIDVVLNGQEAIDFFIKNRYDLILMDIQMPIMDGYEATKIFRKENKEIPIIALSANAMKSDMEKTKNIGMQEHLNKPIEVEKLYATLLKYLSIYNLEEVKEKIYIPDFKNIDTSLGLLHLGDNQKLYMKVLNNFYSSYKNFTLNILDDEEKSRIIHTLKGLSANIGATNLHNIIQELENKDSDELIQKLYEELNKVIEELKLVTTQSDQSVDIKEPWSDEIKRELLKKLHTVIRTKRPKNIALVVKEIEKYQLSVEEKNSFETIKIYIEKFDFQKALELVELI

SEQ ID NO: 15485 - DNA, 774 bp, Unknown
  Obtained from environmental sample
  misc_feature (1)..(774): n is a, c, g, or t
ttgatgacatatgatgtaattttactttcaacaaatattagtacaaatgatgtacataaaattatttcaaaatttaaagagagtattattattttacttgtttcctatattaatgatacaactgtaaccaaacctttaaaagatggtgcaatggattacattgtaaaaccttttattatggatgagctagtgcgaaagatttatcactatgatgaatttaaaaaattaaaacagatgaaaaaaaatcttacaaactatatcgactttgctttttataatattgaacatgatgtggctattccacaaactcttccatttgcaattgagacaaatgaccaaagagttgcagataaaatagttttagaagttgcacaaagactagataaaactattaaatttatctcattagagaacaatactaaaattgaaccaaacgattttaaagatgagttactctatatttacgatttccactatgttaaaaaaagttcaaaagatttaatcctaaaaacaatagaaaattttgatgttatactctcatctttagaagatttaggagatatcccttatcctaagatagaattaaaaatagcgaataaactctcaacagttgattcaatacttacaattaacgattatgtaaaacttatggttaccagttttcaagacaagtatccagatacagaacttagtcgtagacttggaattagtagaaaatctctttgggaaaaaagaaaaaaatttggtatagagaaagataaaggtgataaatag

SEQ ID NO: 15486 - protein, 257 aa, Unknown
  Obtained from environmental sample
  misc_feature (1)..(257): Xaa is any amino acid
MMTYDVILLSTNISTNDVHKIISKFKESIIILLVSYINDTTVTKPLKDGAMDYIVKPFIMDELVRKIYHYDEFKKLKQMKKNLTNYIDFAFYNIEHDVAIPQTLPFAIETNDQRVADKIVLEVAQRLDKTIKFISLENNTKIEPNDFKDELLYIYDFHYVKKSSKDLILKTIENFDVILSSLEDLGDIPYPKIELKIANKLSTVDSILTINDYVKLMVTSFQDKYPDTELSRRLGISRKSLWEKRKKFGIEKDKGDK

SEQ ID NO: 15487 - DNA, 903 bp, Unknown
  Obtained from environmental sample
  misc_feature (1)..(903): n is a, c, g, or t
atggagataaataatggtaagttgaaatattggtcagatgtatatctatcaaatacaacaaatacaccagtgatatcttatagtgtaaaaatagatgatgataatattattgtttttgttcttgatcttgccatgctaaacacatttgcacagaagtttcagagtggagatggttcaactatggttagaattatggataacaatggtgtctttttagcaaatcccgataagccagagtttgtatttcagcaaaaaaatatcttaaatcttggattgtataaaaattttatttcaaagggatataaataccgacaaataacatttcaaaatgcagctaaaaattctttgaacaatattggagtatatggcgtaacaaaaaaacttcaatggtatgtagtagtaaaagagagatatgagtatatatttcaaacatattttaatattatgtattttcttggcttatttattgttgtgatgatagttttatctatgattgttgcagtaagacttgctaagtcaattttaaaacctttagatgaggtaagtttacagatggaaaatattgctcaagagaaggatatcgaaggtattgataaaaataattataaagagttaaaaaaacttattaatagttttatgataatgaaaaataaaattcataaaagggaaaatgatcttcatcagttaaatcagagtttagaggataaggttaaagagaaaacaaaagagcttcagatacttaatgaggatttagaaaaaaaagtggacgaggagatagctaagaatatggaaaaagaactccatatattagaatcttcaaaaatgatacaaatgggtgagatgataggaaaatatgctcatcagtggagacagccgttaagtgttattaatacagcagcttag

SEQ ID NO: 15488 - protein, 300 aa, Unknown
  Obtained from environmental sample
  DOMAIN (152)...(221): HAMP domain
  misc_feature (1)..(300): Xaa is any amino acid
MEINNGKLKYWSDVYLSNTTNTPVISYSVKIDDDNIIVFVLDLAMLNTFAQKFQSGDGSTMVRIMDNNGVFLANPDKPEFVFQQKNILNLGLYKNFISKGYKYRQITFQNAAKNSLNNIGVYGVTKKLQWYVVVKERYEYIFQTYFNIMYFLGLFIVVMIVLSMIVAVRLAKSILKPLDEVSLQMENIAQEKDIEGIDKNNYKELKKLINSFMIMKNKIHKRENDLHQLNQSLEDKVKEKTKELQILNEDLEKKVDEEIAKNMEKELHILESSKMIQMGEMIGKYAHQWRQPLSVINTAA

SEQ ID NO: 15489 - DNA, 654 bp, Unknown
  Obtained from environmental sample
  misc_feature (1)..(654): n is a, c, g, or t
atgttagctatacctacagctcaagttcacaaaacaattgataaaacaattcaagacttggcaaacagactatttaatagtagtaaagtaactcgagaagagttgaatgatattgcaataacttcttttgttgacttacatcaatttgacaaaactactcattttggtagaactttatcagaaggttttttcgatgaactctttataagaggctttaatgtaagtgattttagaggacaaggaacactttcaattaataaagctggagagtatttccttactagagatgtaaagctattaaataaggatgttcaaagtggctatgtactagtaggtacatatactatgtttgaaaataaaattctaattaatgcgagaatcatggataatcaaaatggaagaatacttgcaagtgctagagcaaattatgtaactaatgattgtagaatagtacaaaactgtaaaaaaccaagaatcattaatattgtatctgataaatataagaaaaatagttcaagagaaaatgtaagtgttgttgatcaaaataaaatctccctaaaacaacattttgtaaaaaatcaaccagtggaacaagaagaggtgttagaagtgaaaacaaaaacacaatttcctcttgtaaaccttataaaataa

SEQ ID NO: 15490 - protein, 217 aa, Unknown
  Obtained from environmental sample
  misc_feature (1)..(217): Xaa is any amino acid
MLAIPTAQVHKTIDKTIQDLANRLFNSSKVTREELNDIAITSFVDLHQFDKTTHFGRTLSEGFFDELFIRGFNVSDFRGQGTLSINKAGEYFLTRDVKLLNKDVQSGYVLVGTYTMFENKILINARIMDNQNGRILASARANYVTNDCRIVQNCKKPRIINIVSDKYKKNSSRENVSVVDQNKISLKQHFVKNQPVEQEEVLEVKTKTQFPLVNLIK

SEQ ID NO: 15491 - DNA, 420 bp, Unknown
  Obtained from environmental sample
  misc_feature (1)..(420): n is a, c, g, or t
atgggagatagtggtaagtttgtagataagatggattcggaagttcgcaagaggattaatgaattgattaaagttggctgggctgaactgggtaaacttaacttgattgcagtaagagaaactgccgaagaaatcatcactgtttccaataaaaacagctatgataaaggatttatggtgggctattacctgcatgggttggtagagataaacctaaatcgatttgatttagccctggacttctacttcaaggcacttaacgctatcttaaaaaccgatgataaagattcaatttccatctcctatgaaaacctggggcgctgttatggcaggttaggtaattacaacgagtgtttgcaatactttcttaaagcggatgaattatcatgcctccagcagtctgcttcaaaatgcagctga

SEQ ID NO: 15492 - protein, 139 aa, Unknown
  Obtained from environmental sample
  misc_feature (1)..(139): Xaa is any amino acid
MGDSGKFVDKMDSEVRKRINELIKVGWAELGKLNLIAVRETAEEIITVSNKNSYDKGFMVGYYLHGLVEINLNRFDLALDFYFKALNAILKTDDKDSISISYENLGRCYGRLGNYNECLQYFLKADELSCLQQSASKCS

SEQ ID NO: 15493 - DNA, 837 bp, Unknown
  Obtained from environmental sample
  misc_feature (1)..(837): n is a, c, g, or t
ttgtgtccttattgctcttttcataagtttaaatttgaagaggaaaaagcaagagagtactttaaaactttacgaaaagagatgaatattgcaaaatctatgggatatgattttatctcactttatattggtggtggaaccactactattttgcctgatgagttagtaaaaacaattgattatgcaaaagaactttttagtataaaagatgtttcttgtgagggtgatcctttgattgatgatactcttgttacattattatcaaaaaaagtagatagattatcagtaggggttcaaacaactaatgatgagatgttaaaaaaaattaaaagatataaaaagtttggttcttcaaaaacacaattagaaaatattacaaaagcaatagggaagttttcaattgtaaacacagacttaatttttaatcttccaagtcaaacccaaaagatgttagaggatgatttagatgagattataaagttaaatcctgaacaaatatcagtctaccctttgatgtattccccatctgttaaaaagaaaatagaaaaaaatataggaaagttacacaatgaaaatgagataaatttttataatatcataatggacaaattacaaaagaattataatcaaatatcatcttggacttttgcaaaaaaaaatattcacacttttgatgagtatgttgtagagtataacgaatatataggactaggctctgggtcatttagttttatagaagatactttatatatcaatacttttttctttagaaaaatacaaaaaatgtgtaagaaaagggaaatcttttcttttgagcgatttaaaaagtataatgga

SEQ ID NO: 15494 - protein, 279 aa, Unknown
  Obtained from environmental sample
  misc_feature (1)..(279): Xaa is any amino acid
MCPYCSFHKFKFEEEKAREYFKTLRKEMNIAKSMGYDFISLYIGGGTTTILPDELVKTIDYAKELFSIKDVSCEGDPLIDDTLVTLLSKKVDRLSVGVQTTNDEMLKKIKRYKKFGSSKTQLENITKAIGKFSIVNTDLIFNLPSQTQKMLEDDLDEIIKLNPEQISVYPLMYSPSVKKKIEKNIGKLHNENEINFYNIIMDKLQKNYNQISSWTFAKKNIHTFDEYVVEYNEYIGLGSGSFSFIEDTLYINTFFFRKIQKMCKKREIFSFERFKKYNG

SEQ ID NO: 15495 - DNA, 711 bp, Unknown
  Obtained from environmental sample
  misc_feature (1)..(711): n is a, c, g, or t
atgagatatctattttccctttttatcttcactacattaatttttgcagaagtaaaaatcaatctttctcacacaaatataaaacacggtacatcgtttgctgtgatacttcaaagtgataaaaacttatcacaagctccaaatgtgatttttaaagataaaacttatcagatgtttactatcaatggaagtattcaaaactatgaggtttttctccctgttgattatcataatccaaaacaaaaagagaatgtacaggtaagatacttagaagatgagcagttagtaaagaaaaatacctctataaatatcattgatggaaaatatcgacaaaatgagattataaaagttgccaaagggaaagtaacactttcttcaaaaaacaaagaaaaaacagccaaagagtacaatcaagtttttaaaaatgtttactcagtggttactttatatgatttaacaaacaactcaacttttcaacttcctatggatagtaaaattacaagtgcttttggaaatgctagagtttataatggtgttgcaaaaagttatcatactggaactgattttagagcaagtgtaggggatgaagtaaaagcttcaaatgatgggaaagtggttcttactatggatagattttatctaggtcgtgttatctacatagaccatggaagaggagcttatacctactactctcacttgagtaagatatag

SEQ ID NO: 15496 - protein, 236 aa, Unknown
  Obtained from environmental sample
  SIGNAL (1)...(16)
  DOMAIN (182)...(235): Peptidase family M23
  misc_feature (1)..(236): Xaa is any amino acid
MRYLFSLFIFTTLIFAEVKINLSHTNIKHGTSFAVILQSDKNLSQAPNVIFKDKTYQMFTINGSIQNYEVFLPVDYHNPKQKENVQVRYLEDEQLVKKNTSINIIDGKYRQNEIIKVAKGKVTLSSKNKEKTAKEYNQVFKNVYSVVTLYDLTNNSTFQLPMDSKITSAFGNARVYNGVAKSYHTGTDFRASVGDEVKASNDGKVVLTMDRFYLGRVIYIDHGRGAYTYYSHLSKI

SEQ ID NO: 15497 - DNA, 738 bp, Unknown
  Obtained from environmental sample
  misc_feature (1)..(738): n is a, c, g, or t
atgatttacgatttttggaaagattatgaggaattactttcttatgatcaagcttcacttttggattatcgactagataatataggtatcaaattaaatgatttttttcaaaggttaattataggtcatataaaaaaacgagatataaagtgctatcttgctggttcttgtttgaagtcggataattttgctgatttagatctgtttttcccctcaaatgaagatagagagttaataaataatgctatgaataaagattattttgagtatgagaataattcatatacttatagatacaaaaatgatatatatcaacttgtttatagagaaaggtttaaaggagctactttaaaagagcttgtagatggttttgattttgactcaacgaagatagcttttgagtgtaattataatacgaaaaaaagactatttactattgttaaatgtgatatgagaatagagtttgtcgattatattaatacaaggatcaataatttatcgaaagtaagtttgaatccatttgtatcactacaacgagccatttacttcctaaaaagaggagatgatgttccctataatgtatttttacaagtgtgttctaaaatagctgatttaaaaatagaaaataatgaagatacctcttttcatttcaaaaacttacaaggaaatccaaataaattaacaaatattaaagatgcaattacacattatattgaagaccacaaagaggagaactaa

SEQ ID NO: 15498 - protein, 245 aa, Unknown
  Obtained from environmental sample
  misc_feature (1)..(245): Xaa is any amino acid
MIYDFWKDYEELLSYDQASLLDYRLDNIGIKLNDFFQRLIIGHIKKRDIKCYLAGSCLKSDNFADLDLFFPSNEDRELINNAMNKDYFEYENNSYTYRYKNDIYQLVYRERFKGATLKELVDGFDFDSTKIAFECNYNTKKRLFTIVKCDMRIEFVDYINTRINNLSKVSLNPFVSLQRAIYFLKRGDDVPYNVFLQVCSKIADLKIENNEDTSFHFKNLQGNPNKLTNIKDAITHYIEDHKEEN

SEQ ID NO: 15499 - DNA, 549 bp, Unknown
  Obtained from environmental sample
  misc_feature (1)..(549): n is a, c, g, or t
ttgacaatttacgatttttttccctccaatttagtgcattatatgaaggcattaaacttgaaagtagatgtttttagaaccgatgaaatttccattaaagctattgatgcttacaacacaattattctctctcccggcccaggtttgccaaaagatgcaggaatattattagaagtaataaagacttacgctccaacaaaaaaaatattaggtgtttgtttaggaatgcaagctattggagaagtttttggcggaaagttggagaatttatctcatgtttttcacggtgtagcaagtcagcttaacgtattagataaatcagacaaactttttaaaaacttaccgcaacaatttgaagtaggcaggtaccacagttgggtggttgctcaaaacagctttccaacaaatttaattattactgctgtagaagaaaacaagcaaattatggcactaagacataccacatataacttatatggcgttcagtttcacccagagtctatactaacccaacacggtaaagaaatcattgctaattttttaaaatag

SEQ ID NO: 15500 - protein, 182 aa, Unknown
  Obtained from environmental sample
  DOMAIN (2)...(181): Glutamine amidotransferase class-I
  misc_feature (1)..(182): Xaa is any amino acid
MTIYDFFPSNLVHYMKALNLKVDVFRTDEISIKAIDAYNTIILSPGPGLPKDAGILLEVIKTYAPTKKILGVCLGMQAIGEVFGGKLENLSHVFHGVASQLNVLDKSDKLFKNLPQQFEVGRYHSWVVAQNSFPTNLIITAVEENKQIMALRHTTYNLYGVQFHPESILTQHGKEIIANFLK

SEQ ID NO: 15501 - DNA, 423 bp, Unknown
  Obtained from environmental sample
  misc_feature (1)..(423): n is a, c, g, or t
ttggctcggatctggaaaattaacgaatcacaccaaacaaaagatatcagttatgtgatagaatctcccaacatggtgcagaacaaaatgctgatctccggcaatattatctacattattcttctggttgttctggtggttgcgcttacctttgtcacaattcatttctacaaaagcggaatgcttaaatctcctttcaaatcgaataagaccgaacaaacagaaaagaaagaagttaagacgaaaaagatatctactcctaagaatgacattaaaagcaacgtgaccaaacagatgaatgatatgaataagaaagaagtaaagaaaatatcaataaatcaagaagcgttgaatgacaccactgattatcttaacgtattaatgttcaaagataaagaaacaccttacaagctggatgaataa

SEQ ID NO: 15502 - protein, 140 aa, Unknown
  Obtained from environmental sample
  misc_feature (1)..(140): Xaa is any amino acid
MARIWKINESHQTKDISYVIESPNMVQNKMLISGNIIYIILLVVLVVALTFVTIHFYKSGMLKSPFKSNKTEQTEKKEVKTKKISTPKNDIKSNVTKQMNDMNKKEVKKISINQEALNDTTDYLNVLMFKDKETPYKLDE

SEQ ID NO: 15503 - DNA, 663 bp, Unknown
  Obtained from environmental sample
  misc_feature (1)..(663): n is a, c, g, or t
atgggctcacaggcagttgaaataagcctcggttttatcgttgtctgctcagctctttatcttttttacggcagaaaatacaacaccggagaatacgctcttttgcatttacttaaaaatattgctgataaaagactgacagaaaatattcttgaggatgaactaagagagattgttatacaccgagatgaaattgaacaagataattttgacagacttattcaaaaggctgatattctggatcttgaagggccaatggattatgaacgcctcatttcaattgcagggcctaaaatagctcgctgtattgaagttgatgaggacaaagttatcaaaagatttttgcaaaagcagaaggagtttaatacagcaataacacaattccttgcaattccacatataatagttaatgataatgatgagatgtttctttttgttgtaagatgcaaacatggtataaaatttactgattcccatgatcatgtcaaggctgttttcctttttggaggaagtatggccaaaagagaacttcattttaaaaccctagcttcaatagcttctctggttgaacaaaaggagtttgaaaaaaaatggattgcatcagaaaatacaactgaacttaaaaacttcatgctctacagtgagcgaaacaggatacattaa

SEQ ID NO: 15504 - protein, 220 aa, Unknown
  Obtained from environmental sample
  misc_feature (1)..(220): Xaa is any amino acid
MGSQAVEISLGFIVVCSALYLFYGRKYNTGEYALLHLLKNIADKRLTENILEDELREIVIHRDEIEQDNFDRLIQKADILDLEGPMDYERLISIAGPKIARCIEVDEDKVIKRFLQKQKEFNTAITQFLAIPHIIVNDNDEMFLFVVRCKHGIKFTDSHDHVKAVFLFGGSMAKRELHFKTLASIASLVEQKEFEKKWIASENTTELKNFMLYSERNRIH

SEQ ID NO: 15505 - DNA, 813 bp, Unknown
  Obtained from environmental sample
  misc_feature (1)..(813): n is a, c, g, or t
ttgagttatcaaatatctcttcacgagagaatagaacgtcaaaaagtctcaaaaagaagtatgcaaatcataaaggcgatccaccttattaatattaaaaaagtggatgatctcttcttttccaataaaggattaagagggatttacaaggatcaattaaataccactcctcttggtctggccaaatggaaaacaattgttagcacgcatttaaccaagagctatattgatgctctcaatgaatcagtaaaagagaatttctatcctgtagaaaagctcatgacaaaatatctaaccgatgaattagaagtacttctcaactcattaaaaggaagtactctctataaagatcttgaaaatgatcgaatgtggagtgaaacactccttaccaataagttttggatagaattttccgacaatgccaatgaaaaagtgggggccattgccacgggtgcatcagcggccttcggagcagttgctggaaatattgcttggcgagaaggttatcttaaagaagataagaacctactcgactatgtcaaaaaaaccgtaagaccatttgatcttctcatggaaaagaaagcttataagtttacggatcttaccattccaggacactggggtcacatcggtgtgtatctaggaacaaaagagcagctgattgaaatgggaatgtgggaatcaaaatatatcgatccctttcgtgaaaatattgaaagaggaaaaacaatctttcaagtaagacgaacaggacttgtttttgatgcattagatgactttatgaatctagatgaaatggccatactcgtctga

SEQ ID NO: 15506 - protein, 270 aa, Unknown
  Obtained from environmental sample
  misc_feature (1)..(270): Xaa is any amino acid
MSYQISLHERIERQKVSKRSMQIIKAIHLINIKKVDDLFFSNKGLRGIYKDQLNTTPLGLAKWKTIVSTHLTKSYIDALNESVKENFYPVEKLMTKYLTDELEVLLNSLKGSTLYKDLENDRMWSETLLTNKFWIEFSDNANEKVGAIATGASAAFGAVAGNIAWREGYLKEDKNLLDYVKKTVRPFDLLMEKKAYKFTDLTIPGHWGHIGVYLGTKEQLIEMGMWESKYIDPFRENIERGKTIFQVRRTGLVFDALDDFMNLDEMAILV

SEQ ID NO: 15507 - DNA, 624 bp, Unknown
  Obtained from environmental sample
  misc_feature (1)..(624): n is a, c, g, or t
ttgtctaatcactcaactggagaaatagatttagcattacagcatttaaagcatttagggaagggagatctattaatatttgatagaggttattcttcttatttattagcggcggagtgtaagaaaataggtgctaatttcttgtttaggtgccgaagaaattggattaaagaagttaatgaaatgtttgaaagccatgaaaccagcaaaatcataacaattaaaaagccaaggcaacgtaaatatcgtgagggtattatattaccagagtatataaaaatacgattagtaaaagttatattagatgacggagagattgaagttttagctacatccttattagatgaagaattatacccaactgaagaatttaaagctttatattgggatagatggggtgttgaaacatattatggtattatcaaggagcgtcttgatttagaaaattttactggaaaaactgctgaatcagttaaacaagatttctattcatcaatactaataacaagtcttgaaacaatactaactcaagacgcagagaatatattagaagagagaagtaaaagtaaaaataataagaacacattaaaagtaaacaaagctgtttctttccacaccctttaa

SEQ ID NO: 15508 - protein, 207 aa, Unknown
  Obtained from environmental sample
  misc_feature (1)..(207): Xaa is any amino acid
MSNHSTGEIDLALQHLKHLGKGDLLIFDRGYSSYLLAAECKKIGANFLFRCRRNWIKEVNEMFESHETSKIITIKKPRQRKYREGIILPEYIKIRLVKVILDDGEIEVLATSLLDEELYPTEEFKALYWDRWGVETYYGIIKERLDLENFTGKTAESVKQDFYSSILITSLETILTQDAENILEERSKSKNNKNTLKVNKAVSFHTL

SEQ ID NO: 15509 - DNA, 426 bp, Unknown
  Obtained from environmental sample
  misc_feature (1)..(426): n is a, c, g, or t
atgagttcggagttctgtctggaatattctctttttaaagagaaactgcaggagtttataagctcttcttcctttgagagcaagacgcacgagtacaggctaatacttaagaagataaagtctgccttgcctcagcagagagaggtgtaccttcaagaatcgcccgactttatagcaactgcagaaaaaagcctcactatcatgcaaaggattgtctcgctgcatgatgagttggatcagatattcaagatggatgaaaaagaactcggtgcattttgtgatcatgatctgaaaaaggtcgaacttgtcgtttcaaagggattggaagaagtagctgaactattgtatcagtttgaaaaaatctcacaacagggaagaaagatcattgaagttttagaagacccgtttttgtcacagggttcttaa

SEQ ID NO: 15510 - protein, 141 aa, Unknown
  Obtained from environmental sample
  misc_feature (1)..(141): Xaa is any amino acid
MSSEFCLEYSLFKEKLQEFISSSSFESKTHEYRLILKKIKSALPQQREVYLQESPDFIATAEKSLTIMQRIVSLHDELDQIFKMDEKELGAFCDHDLKKVELVVSKGLEEVAELLYQFEKISQQGRKIIEVLEDPFLSQGS

SEQ ID NO: 15511 - DNA, 597 bp, Unknown
  Obtained from environmental sample
  misc_feature (1)..(597): n is a, c, g, or t
atgataaataatgaaaaatttgcagaggttatttattcaattctttctataaataattctacaaaaactgctttaggcttaaaatgtgctttatactctgttgttttagagatgataactaatattatctcagatgaaaacaaagataaactttattttatacaagaaaaaaaactaagaaaagaattacaaaaaaatttgaataatcatgcttcagaattttttgaaaaaaacgaaataggaatttataaagactcacctatcaaaaaacgaattgacaacttaaattctccaacaaaccaagataagttattagcaccttttaaaattttagaaattaatctaactgaaagtgataaaaaaattttaaataatagaaatatctttttacatgggaacaaccctttagagggtatagagctagaagaacaatcaacaagactattttatattagtctagaattgaattttttaataaatgctttaatcttgaaatatattggttatagcggtaaagtgaaaaatttatctaaaatatttttagattatgcagaattagatgaaaataaagatgaagaatactataaaatcatctaa

SEQ ID NO: 15512 - protein, 198 aa, Unknown
  Obtained from environmental sample
  misc_feature (1)..(198): Xaa is any amino acid
MINNEKFAEVIYSILSINNSTKTALGLKCALYSVVLEMITNIISDENKDKLYFIQEKKLRKELQKNLNNHASEFFEKNEIGIYKDSPIKKRIDNLNSPTNQDKLLAPFKILEINLTESDKKILNNRNIFLHGNNPLEGIELEEQSTRLFYISLELNFLINALILKYIGYSGKVKNLSKIFLDYAELDENKDEEYYKII

SEQ ID NO: 15513 - DNA, 447 bp, Unknown
  Obtained from environmental sample
  misc_feature (1)..(447): n is a, c, g, or t
ttggctgagagcagaaagtttgccctaggagaagataatcctaaagaaaaagcatttatatatttatattcacttaatgctggtgatccttattacatgaaaacaaatatcttatcaaaggaattaaataagataggtgcaaaatggcattatgataaatatcatgaaatactcctaattaacggtatgtttccacattatatgttaggaatattcgaagtagaaaaaaacaaaacttctaaatttataatcaacccatatttatatgagattttagaaaagaatgaacaatttgattacgtaaatggactatcaataaaccaagaaaattttgaagagtatgctaaaaaattgggatataaaaattattttttcactactcaagataataaagtaatgatagctaatatcgataatggtaatacaaaagaggtcattagaccttaa

SEQ ID NO: 15514 - protein, 148 aa, Unknown
  Obtained from environmental sample
  misc_feature (1)..(148): Xaa is any amino acid
MAESRKFALGEDNPKEKAFIYLYSLNAGDPYYMKTNILSKELNKIGAKWHYDKYHEILLINGMFPHYMLGIFEVEKNKTSKFIINPYLYEILEKNEQFDYVNGLSINQENFEEYAKKLGYKNYFFTTQDNKVMIANIDNGNTKEVIRP

SEQ ID NO: 15515 - DNA, 705 bp, Unknown
  Obtained from environmental sample
  misc_feature (1)..(705): n is a, c, g, or t
atgcctttttgtacagaatgtggtaaaaactatcaagatgaggcaaagttttgtcctcattgcggtaaacctaatgccttaacgaagaataaagagcaagaaaataacaaagctaatgactatagaaaatctactgaccttggtcaatcaggacagtatggtatgcctgaggattcaggaataagaagaaaaactaatattactcagggtgggagctatggactaaatgtaagtaatctacccgaaactactactttggaaaatggacgctacactattctgaaaaagctgggtgaaggtggattcggggtagtctataaatcttcagatgctaattatgatggtggaattaaagctttaaaggttatctatagtgaaaattatagtgataaattagtgatgcacaagctaaagattgaagctaaaaatatgattaaaatcaatcaccctagcgtcgttagactttatgatctccactttgacagtgaaattaaattcttggatatggagtttgttgatggtggcgatttagtggatttaatgctaagaagtccanactataaaatcccggaagagagagtctgggagttggctagccaaattgcccagggtatgcaagctgttcataaagtaaatcttatccatcaagaccttaaacctgaaaatatactttctaccaaatcaggtgaagtaaagattacagat

SEQ ID NO: 15516 - protein, 235 aa, Unknown
  Obtained from environmental sample
  DOMAIN (91)...(235): Protein kinase domain
  misc_feature (1)..(235): Xaa is any amino acid
MPFCTECGKNYQDEAKFCPHCGKPNALTKNKEQENNKANDYRKSTDLGQSGQYGMPEDSGIRRKTNITQGGSYGLNVSNLPETTTLENGRYTILKKLGEGGFGVVYKSSDANYDGGIKALKVIYSENYSDKLVMHKLKIEAKNMIKINHPSVVRLYDLHFDSEIKFLDMEFVDGGDLVDLMLRSPXYKIPEERVWELASQIAQGMQAVHKVNLIHQDLKPENILSTKSGEVKITD

SEQ ID NO: 15517 - DNA, 717 bp, Unknown; identical to SEQ ID NO: 8401
  Obtained from environmental sample
  misc_feature (1)..(717): n is a, c, g, or t

SEQ ID NO: 15518 - protein, 238 aa, Unknown; identical to SEQ ID NO: 8402
  Obtained from environmental sample
  misc_feature (1)..(238): Xaa is any amino acid

SEQ ID NO: 15519 - DNA, 777 bp, Unknown
  Obtained from environmental sample
  misc_feature (1)..(777): n is a, c, g, or t
gtgtctgatactcctggtatggagaaaggacttcttgccaaaatcatcaatattaaacgtgtcgatatgaattttgacgttgtttatgaagataaagagccagcgaaaaatcaaaaattttattttgaatttgaagaagaggctcaaacacatatttctgatgctgatgcaaaaataagattagaagaagtaagagttgatgaagaagtacgagcatatcaaaaagatggagatgcaaaaataaatgaacaatcatttatttgttatgaaggaggacattatactcttgaagcaatattgcgtattgatatgattttcacagttttgaatagtaaagatcaacctgttactggacaaacttttacatttgttcacaatggagaaacaagaacattagcttctgatgcagaagggaaaatgatgattccagaagtaaaagtaggcgatgaagttgttgcttatcaaatgaaagaagaaaataggtttaatgaccataattttatctgtgaaaaaaataaagaaaatattctaagaatagaagaagaggaagagccagaagtgcctgaagatccaatttttaatatgcgttttaaagtaattggaccaaaagggatagctattccgaatgctactgtgaaaataaaatacgacgganaaactgttgaacaaacaacggatgaagaaggatatactgttttggaagatgttaatcctgacacacaagtgaaagttattgcaattgggaaaaaacagaaaaaagagaaaaaacaaaaataa

SEQ ID NO: 15520 - protein, 258 aa, Unknown
  Obtained from environmental sample
  misc_feature (1)..(258): Xaa is any amino acid
MSDTPGMEKGLLAKIINIKRVDMNFDVVYEDKEPAKNQKFYFEFEEEAQTHISDADAKIRLEEVRVDEEVRAYQKDGDAKINEQSFICYEGGHYTLEAILRIDMIFTVLNSKDQPVTGQTFTFVHNGETRTLASDAEGKMMIPEVKVGDEVVAYQMKEENRFNDHNFICEKNKENILRIEEEEEPEVPEDPIFNMRFKVIGPKGIAIPNATVKIKYDGXTVEQTTDEEGYTVLEDVNPDTQVKVIAIGKKQKKEKKQK

SEQ ID NO: 15521 - DNA, 480 bp, Unknown
  Obtained from environmental sample
  misc_feature (1)..(480): n is a, c, g, or t
ttgattaaagtatctatttatatagttttattattaacttcgtatattcatgccgaacagtctgtatttggtgctggtgatttaaattctccgataccttatggactgacacccacagaagaggttatagtaaaaactaagaaaacaacaacgaataatgaaaaaaagataaaaaaagttgactctaaaataactcatatttatgataaagttgatgggctagaatctttatatgaaggtgatagcagaaagttaaataagctttcaatagactttacacaacaagaaactcaggttgaagttttagaagagaaaacaaaaacacaaaatcagncaatagaattatttcaagaagatatagctgattcaaaaaaacagttagatttaaataataaaaatatggaactgttaaaaggatcttttgaaaaaatagttcagtttgccaataaaataaataaggattatgtggaccaaagatga

SEQ ID NO: 15522 - protein, 159 aa, Unknown
  Obtained from environmental sample
  SIGNAL (1)...(18)
  misc_feature (1)..(159): Xaa is any amino acid
MIKVSIYIVLLLTSYIHAEQSVFGAGDLNSPIPYGLTPTEEVIVKTKKTTTNNEKKIKKVDSKITHIYDKVDGLESLYEGDSRKLNKLSIDFTQQETQVEVLEEKTKTQNQXIELFQEDIADSKKQLDLNNKNMELLKGSFEKIVQFANKINKDYVDQR

SEQ ID NO: 15523 - DNA, 432 bp, Unknown
  Obtained from environmental sample
  misc_feature (1)..(432): n is a, c, g, or t
gtgttgatgaagcctaaaagagtcatcacctatggaaccttcgatatgtttcatatcggacatcttaatcttttaaagcgtttagcagaactaggagacgaactaattgttgccgtttcaactgatgagtttaatgcccttaaaggaaaaaagacactcatcccttatgaacaacgagcagaaatagttcgcaatatccaatgcgtaacgcaagtgatagctgaagagaattgggagcaaaaagttacagatattcaaaagtacgagatagatgtttttgctatgggaaatgattgggaaggaaagtttgacttcttaaagctttattgtgaagtgtgttacttggtacggactgaagacatctcaagtacggaactaaaagtagccttaaacaaatttttacaagaacatggagccggttttggagtttag

SEQ ID NO: 15524 - protein, 143 aa, Unknown
  Obtained from environmental sample
  DOMAIN (5)...(125): Riboflavin kinase (Flavokinase)
  misc_feature (1)..(143): Xaa is any amino acid
MLMKPKRVITYGTFDMFHIGHLNLLKRLAELGDELIVAVSTDEFNALKGKKTLIPYEQRAEIVRNIQCVTQVIAEENWEQKVTDIQKYEIDVFAMGNDWEGKFDFLKLYCEVCYLVRTEDISSTELKVALNKFLQEHGAGFGV

SEQ ID NO: 15525 - DNA, 765 bp, Unknown
  Obtained from environmental sample
  misc_feature (1)..(765): n is a, c, g, or t
ttgaattatcgtaaagattnagagaagaaatcccccgttaagattgaggttccccgcaagaaacatatgatgtgtttgaatgaaagctctctaaacccttggtcggtaattgaagggaaacttattaatcggataaagggaatagatttcaaccgttacttcaatcctgtatcagaagagctgttagatctcctctgtcaatatacaaaattagataaagatatgattttaatggggaacggtgcagatgagatgctatattatctgtttacatcattgagagaatcttccaaatcctattgtgtagcaccagctccatcatattttgattataagagctattcaggtgctgttggaatgaagatcaagaatgttgatctggatagagattttcagttcaacattaatcagtatctaaccctgacagataatgaggattgcaaattagcaataatatgcaatccgaacaatccgactgggaatcttatcaaagaagaaactatttttgagattctggaaaattgtgataagccagttttagttgatgaaacttattttgagttctctggtgtgacatataaagagtattttgagaaataccccaatctgataattatcagatctttctccaaagcattttcttctgctggattacgattcggttatcttatttcaagtcctgctaatatagagcaaataaaaaaagttatgaccgtgttcaatctcaatttgataacccagggaattgcctgtgaaatcttatga

SEQ ID NO: 15526 - protein, 254 aa, Unknown
  Obtained from environmental sample
  misc_feature (1)..(254): Xaa is any amino acid
MNYRKDXEKKSPVKIEVPRKKHMMCLNESSLNPWSVIEGKLINRIKGIDFNRYFNPVSEELLDLLCQYTKLDKDMILMGNGADEMLYYLFTSLRESSKSYCVAPAPSYFDYKSYSGAVGMKIKNVDLDRDFQFNINQYLTLTDNEDCKLAIICNPNNPTGNLIKEETIFEILENCDKPVLVDETYFEFSGVTYKEYFEKYPNLIIIRSFSKAFSSAGLRFGYLISSPANIEQIKKVMTVFNLNLITQGIACEIL

SEQ ID NO: 15527 - DNA, 726 bp, Unknown
  Obtained from environmental sample
  misc_feature (1)..(726): n is a, c, g, or t
atgttaacaaaagtagagtatttttccccagaaactataagttttttaaaatctaaacaaagttttattaccgatgaatttttagaaagaaaccttctttctcaaactataaagagtgcaaacacctctgatatcaaatataattatcaaatatttttaaataacttatgcaatggtaatttaaaaaagcttcttacttcacttgttaaattaacccgcctttatattcaaatggagattccatatgttgtattattaaatgaattaaaccatttacaaagtattcttattgaactttttatcaactatgataaaaaaattgaaactattgccttatataaactttctgctgtatcacaaaataaagttgcaaaagagtaccttaatatttatacgacaaatttaatatctatatgtaacattagactctcaagcatacacgacatgcttgaacattatgttgttgaacactatgtagagcatataaaatggcttatcaatcttgcacaaaacattaaagataccaatataaattcttttcctcaaacagacaaaacattgtgcaattttggaaaatggttagcacaagatggatcaaatattattaaaaataattcaaaacttaaagagttagaaaaggttcattctcagattcattatatatcatcacaaattaaacatattttaacacttaatgatcataattatgactatgatatatgttaa

SEQ ID NO: 15528 - protein, 241 aa, Unknown
  Obtained from environmental sample
  misc_feature (1)..(241): Xaa is any amino acid
MLTKVEYFSPETISFLKSKQSFITDEFLERNLLSQTIKSANTSDIKYNYQIFLNNLCNGNLKKLLTSLVKLTRLYIQMEIPYVVLLNELNHLQSILIELFINYDKKIETIALYKLSAVSQNKVAKEYLNIYTTNLISICNIRLSSIHDMLEHYVVEHYVEHIKWLINLAQNIKDTNINSFPQTDKTLCNFGKWLAQDGSNIIKNNSKLKELEKVHSQIHYISSQIKHILTLNDHNYDYDIC

SEQ ID NO: 15529 - DNA, 681 bp, Unknown
  Obtained from environmental sample
  misc_feature (1)..(681): n is a, c, g, or t
atgataaataatgaaacagttattgtacaaactaaaaaatttgtgaaaataaaattagataaaagcgaagctggtcatgattggtggcattgtcttagagtatttaatctttcggaagagattgcaaaaaatgaatcagcagacattttagtagttcaacttgcagcactattacatgatattgcggattctaaattttatgatggagatgaagagatcgggccaaagattgcttctgactttcttatgcaattagaagttcctagagaaattattgctcaggtgatattcattataaggaatatctcttataaaaatagtttcgatcagaaaccttctaaaactattgaactggagattgtacaagatgctgatcgtctggatgcaattggtgcaattgggatcgcaagagcatttacatatggtggatttaagaatagagaattatataatcctgcaattaaacctattgattatctaagtaaggaagattacaaatctaataattcacctacgataaatcatttctatgaaaaattactaaaactaaaaaatctgatgaatacccaaaaaggtagagagctcgcagcgcagaggcataaatatatggaagtctacttagaacaattttacaaagagtggaatggagaaagtaagatttatcgtatttcatctatataa

SEQ ID NO: 15530 - protein, 226 aa, Unknown
  Obtained from environmental sample
  DOMAIN (27)...(130): HD domain
  misc_feature (1)..(226): Xaa is any amino acid
MINNETVIVQTKKFVKIKLDKSEAGHDWWHCLRVFNLSEEIAKNESADILVVQLAALLHDIADSKFYDGDEEIGPKIASDFLMQLEVPREIIAQVIFIIRNISYKNSFDQKPSKTIELEIVQDADRLDAIGAIGIARAFTYGGFKNRELYNPAIKPIDYLSKEDYKSNNSPTINHFYEKLLKLKNLMNTQKGRELAAQRHKYMEVYLEQFYKEWNGESKIYRISSI

SEQ ID NO: 15531 - DNA, 381 bp, Unknown; identical to SEQ ID NO: 11881
  Obtained from environmental sample
  misc_feature (1)..(381): n is a, c, g, or t

SEQ ID NO: 15532 - protein, 126 aa, Unknown; identical to SEQ ID NO: 11882
  Obtained from environmental sample
  DOMAIN (28)...(124): GTP cyclohydrolase I
  misc_feature (1)..(126): Xaa is any amino acid

SEQ ID NO: 15533 - DNA, 402 bp, Unknown
  Obtained from environmental sample
  misc_feature (1)..(402): n is a, c, g, or t
ttgattatgaaaacgctaaaaaagaaaataacgttaatagttgagaaaacagatactggattttcagcatattctgatagttatccagtatttacaacaggtaaaaccataccagaattgattgataatgcatttgaagcttgtgaattatacttagaaacagagaatgttaagttaacacatgaagacattaaatttgaaattgattttaaacagttttttaaatactataaagtattgaattcaagatttttggctgataagattggaatgaatccaactttattatctcaatatgtacaaggacataaaaaaccttcgagtaatcaaactgagaaaatattggcaggtattcatcaaataggtcaagagttatccgaaatcaatttaatacatagatag

SEQ ID NO: 15534 - protein, 133 aa, Unknown
  Obtained from environmental sample
  DOMAIN (8)...(65): Uncharacterised protein family (UPF0150)
  misc_feature (1)..(133): Xaa is any amino acid
MIMKTLKKKITLIVEKTDTGFSAYSDSYPVFTTGKTIPELIDNAFEACELYLETENVKLTHEDIKFEIDFKQFFKYYKVLNSRFLADKIGMNPTLLSQYVQGHKKPSSNQTEKILAGIHQIGQELSEINLIHR

SEQ ID NO: 15535 - DNA, 447 bp, Unknown
  Obtained from environmental sample
  misc_feature (1)..(447): n is a, c, g, or t
atgttacgaataatattttcagtaataactattttatatgtttcaaacatatactcacaaaaagatactatgcaacttactaagcttacaccagaagaagaacaggttataatttacaaaggaacagaaataccatatagcggcaaatatgtaaacaataaagaaaaaggcgtatatacttgtaaaagatgtgatgcggttttatataaatcggacgataaatttgattcgcattgtggttggccaagtttcgacgacgaagtaaatggagcagtaaaacagatacctgatgctgatggtaaaagaacagaaattgtttgtgctaattgtggggctcatttaggacatgtttttattggggaaggatttactccaaaaaatacacgccattgtgttaattcaatttcattagaatttgcacctgaaataaaagctaaagaacagtaa

SEQ ID NO: 15536 - protein, 148 aa, Unknown
  Obtained from environmental sample
  DOMAIN (22)...(142): SelR domain
  misc_feature (1)..(148): Xaa is any amino acid
MLRIIFSVITILYVSNIYSQKDTMQLTKLTPEEEQVIIYKGTEIPYSGKYVNNKEKGVYTCKRCDAVLYKSDDKFDSHCGWPSFDDEVNGAVKQIPDADGKRTEIVCANCGAHLGHVFIGEGFTPKNTRHCVNSISLEFAPEIKAKEQ

SEQ ID NO: 15537 - DNA, 753 bp, Unknown
  Obtained from environmental sample
  misc_feature (1)..(753): n is a, c, g, or t
atgaaaaactatgaaaatgatatcattggagttgtgcaacttattaataaacaagataaaaatgaaaaaagtgttgcatttacaaaagatgatgaagatttaattctttctatgtcttcacaagcagctatgtcaataacacaacaaaaacttgtacaagatttagaaaatcttttagactcatttattcaagcaattgctacagcaattggtgaaaaatctaaatatactcaaggacatatcaatagagtgtcagaaatttctttagctatagcaaatgctataaatgaagataaagatggtatttataaagataagtattttgataaagaccaattaaaagagattgatgtagctgcatggatgcatgatgttggtaaaatcacaacaccagatcatgtagttgataaagcaacaaaacttgaaaccatttacgatagaattgaaactatagaggtaaagtttgagttacttaaaagggaaaaagagattgagcttttgcgtaaaataaaccatgaacctaatgacgaaaaaatagaccacctaaaaagtgtgtataaaaatgagataactactttaaataatgattttaaatttattaaagagatgaataagggtagtgagtttatggatgaagaaaaaataaaaagagtccataatatagcaaaaaaacagattattatgcaccataaaaaacaaaacctacttacagaaaatgaagtatataatctcacaataaaaaaggtactctaa

SEQ ID NO: 15538 - protein, 250 aa, Unknown
  Obtained from environmental sample
  misc_feature (1)..(250): Xaa is any amino acid
MKNYENDIIGVVQLINKQDKNEKSVAFTKDDEDLILSMSSQAAMSITQQKLVQDLENLLDSFIQAIATAIGEKSKYTQGHINRVSEISLAIANAINEDKDGIYKDKYFDKDQLKEIDVAAWMHDVGKITTPDHVVDKATKLETIYDRIETIEVKFELLKREKEIELLRKINHEPNDEKIDHLKSVYKNEITTLNNDFKFIKEMNKGSEFMDEEKIKRVHNIAKKQIIMHHKKQNLLTENEVYNLTIKKVL

SEQ ID NO: 15539 - DNA, 549 bp, Unknown
  Obtained from environmental sample
  misc_feature (1)..(549): n is a, c, g, or t
ttgtttaggtataataataaaatggacactaaagaaaataactacatacaccttttaaatgagataggatatcttctatcaacagagaagaacttacacataataatgcaaaaaatacttactgcagcaaaaaaaataacaaatgcagatgctggtactttttatcttgtgtgtgatgatgataaatctttaaaatttactgcagttcaaactgattcattagatattagcctttcgagtgccgaagggacaataccctggccaaatcttcctttatataaagatgatggaacacaaaatgatataaacatatctgtaaattgtgctttaaatgataaacttataaatgtagaagatgtatacaaatcaaaagagtttaactttgaaggtccaagagcttttgatatagcaactggatacagaacaaaatcaatgcttgttgttccaatgaaaaactatganaatgatatcattggagttgtgcaacttattaataaacaagataaaaatggaaaaagtgttgcatttacaaaagatgatgaagattaa

SEQ ID NO: 15540 - protein, 182 aa, Unknown
  Obtained from environmental sample
  misc_feature (1)..(182): Xaa is any amino acid
MFRYNNKMDTKENNYIHLLNEIGYLLSTEKNLHIIMQKILTAAKKITNADAGTFYLVCDDDKSLKFTAVQTDSLDISLSSAEGTIPWPNLPLYKDDGTQNDINISVNCALNDKLINVEDVYKSKEFNFEGPRAFDIATGYRTKSMLVVPMKNYXNDIIGVVQLINKQDKNGKSVAFTKDDED

SEQ ID NO: 15541 - DNA, 633 bp, Unknown
  Obtained from environmental sample
  misc_feature (1)..(633): n is a, c, g, or t
atgttttcgatgtatgatgatgatggattaaattttagaagtactatagataatctttatacagtacatgaagttgctgctagtaaaagaattaaaaatgatacaaatgatgatagaaataatacaaacaacaagtttgatactttttacaaaggtaaaataaaccaagaagccaaaaacaaatataaacaaatagcgaatttagatacaaaaattgaaatatttcatgttgaacaagttatgtcccatacggctattattattaatgataataaaactattggtgaatgttttgagatgatgcaagaaaatgaagtacaacagcttctcattcaagctgataatttcaatcatctcaaaggaatggtaacaaaacatgatattttaaactatcttatgaacaatattgaaactaaaaatatcaatcatactccaatatcccaaattacaaaaaataaaattatcactacagatcctatatctgatataagaagagtagcaaaagttatgatagattttaatctcaatgcaatccctgtagtagatggggaggaaaatattttaggtgttgttacaagacacgatattgttgatgctgtatctaatacacctcatctgcagatttgggcgtaa

SEQ ID NO: 15542 - protein, 210 aa, Unknown
  Obtained from environmental sample
  DOMAIN (79)...(133): CBS domain
  misc_feature (1)..(210): Xaa is any amino acid
MFSMYDDDGLNFRSTIDNLYTVHEVAASKRIKNDTNDDRNNTNNKFDTFYKGKINQEAKNKYKQIANLDTKIEIFHVEQVMSHTAIIINDNKTIGECFEMMQENEVQQLLIQADNFNHLKGMVTKHDILNYLMNNIETKNINHTPISQITKNKIITTDPISDIRRVAKVMIDFNLNAIPVVDGEENILGVVTRHDIVDAVSNTPHLQIWA

SEQ ID NO: 15543 - DNA, 465 bp, Unknown
  Obtained from environmental sample
  misc_feature (1)..(465): n is a, c, g, or t
atgactatgattgatccaaatagtcgtattgcatttgctgtagcaattcctactaaacatacaaaacatacagctaaagttcttgaagctctaatagatggtgtttctactaatgatattcaaaataaattttctgttctatctgataatggttctgaatttaaaaaagagtttgatgctcttttagaagaaaaacaattaacacactactggacatatccaagaagcccaaaaatgaatgcacataatgaaagatttaatagaacaatacaagaacaatttgtagattataatgaagatttactctttacagatatagatgaatttaataaagagatgtctaattggcttattgattataatactaaaataccacatcatagcttactaatgaaaactcctgtacaatatcttattgaaaataatcctcagtgccaaatgttatggactaatacaaaagtttga

SEQ ID NO: 15544 - protein, 154 aa, Unknown
  Obtained from environmental sample
  DOMAIN (1)...(139): Integrase core domain
  misc_feature (1)..(154): Xaa is any amino acid
MTMIDPNSRIAFAVAIPTKHTKHTAKVLEALIDGVSTNDIQNKFSVLSDNGSEFKKEFDALLEEKQLTHYWTYPRSPKMNAHNERFNRTIQEQFVDYNEDLLFTDIDEFNKEMSNWLIDYNTKIPHHSLLMKTPVQYLIENNPQCQMLWTNTKV

SEQ ID NO: 15545 - DNA, 381 bp, Unknown
  Obtained from environmental sample
  misc_feature (1)..(381): n is a, c, g, or t
atgttttcgatgtatgatgatgatggattaaattttagaagtactatagataatctttatacagtacatgaagttgctgctagtaaaagaattaaaaatgatacaaatgatgatagaaataatacaaacaacaagtttgatactttttacaaaggtaaaataaaccaagaagccaaaaacaaatataaacaaatagcgaatttagatacaaaaattgaaatatttcatgttgaacaagttatgtcccatacggctattattattaatgataataaaactattggtggaatgtttgagatgatgccagaaaatgaagtacaaccgcttctcattcaagctgaaaattttcaatcatctcaaaggaatggtaacaaaacatga

SEQ ID NO: 15546 - protein, 126 aa, Unknown
  Obtained from environmental sample
  misc_feature (1)..(126): Xaa is any amino acid
MFSMYDDDGLNFRSTIDNLYTVHEVAASKRIKNDTNDDRNNTNNKFDTFYKGKINQEAKNKYKQIANLDTKIEIFHVEQVMSHTAIIINDNKTIGGMFEMMPENEVQPLLIQAENFQSSQRNGNKT

SEQ ID NO: 15547 - DNA, 888 bp, Unknown
  Obtained from environmental sample
  misc_feature (1)..(888): n is a, c, g, or t
gtgtggttgagagatgctgtatctatcaaactactaaaacaaacagagcaaatagaagatgaaaatgatctatgtgctattagaatctacaaagtaatgagaccaggtgagcctgtaacaaaagaagctgctagagaatttatcaagaaattattctttgatccagaaagatatgatttaacaaaagtgggaagaatgaaaatgaaccacaaacttgatgtacaagttcctgaatatgtaacagtacttacacatgaagatattattaaaactgttaaatacttaattaaagttaaggcaggacatggtcatgtggatgatagagatcacttaggaaacagaagaattagatcaattggtgagttattatcaaatgaacttcatgctggtttaattaagatgcaaaaagcaattagagataaaatgactacattaagtggtacattagaagatttaatgccacatgatttaattaactctaaaatgatcacttcaacaattacagagttttttacatctggtcagttatctcaatttatggatcaaacaaatccattatcagaagttactcataaaagaagactttctgcacttggtgagggtggtttagtaaaagagagagctggatttgaagtaagagatgttcacccaactcattatggtagaatttgtccagttgaaactccagagggtcaaaatattggtcttattaatacattatcaactttctctaaagttaatgagttaggttttattgaaacaccatacaaaaaagttattgatggattagtaactgatgagattcaatatttcacagcaacacaagaagagggtaaagtaattgctccaggttcaacaaaattaaacaaaagatgggaaaatagctga

SEQ ID NO: 15548 - protein, 295 aa, Unknown
  Obtained from environmental sample
  DOMAIN (175)...(247): RNA polymerase Rpb2, domain 3
  misc_feature (1)..(295): Xaa is any amino acid
MWLRDAVSIKLLKQTEQIEDENDLCAIRIYKVMRPGEPVTKEAAREFIKKLFFDPERYDLTKVGRMKMNHKLDVQVPEYVTVLTHEDIIKTVKYLIKVKAGHGHVDDRDHLGNRRIRSIGELLSNELHAGLIKMQKAIRDKMTTLSGTLEDLMPHDLINSKMITSTITEFFTSGQLSQFMDQTNPLSEVTHKRRLSALGEGGLVKERAGFEVRDVHPTHYGRICPVETPEGQNIGLINTLSTFSKVNELGFIETPYKKVIDGLVTDEIQYFTATQEEGKVIAPGSTKLNKRWENS

SEQ ID NO: 15549 - DNA, 624 bp, Unknown
  Obtained from environmental sample
  misc_feature (1)..(624): n is a, c, g, or t
ttgaaagtcataaatgcaaataattttgaagtacttgagtatataaaaacatttaataacacgaatgtcatagttgatgtaaactatagtttatcatctatagatgatatcatattacaagatatcaatatgtatcatgtaggtttggtagttgtctctaaagctagttttgaacaacgtaaaatgaggaagattctgtttgaaggaagagttcctgttcttaagattgcaaataaatcagtctcaaaacttaaagaggcagtagctattatttctgataataaagagttagaaaaggtggctacaactatttttgatatctccatgcagttagacttgaatatggaaatatataactatacattagaacatcaagagtcaaaaatacagacaatagagcattttaataatctctctacaatcttttcaaaatctattaaagtttttgagaatgaaaaaaatcctcttagactattaaaaaaacgagaaaattttctacactgtctaccatttacatcaaaaattgcacagtaccgtattagtacaattttttcaaccgacagtgacatgctttattaccttcttaacgattatcatcagatctttattccttcgcaaatttaa

SEQ ID NO: 15550 - protein, 207 aa, Unknown
  Obtained from environmental sample
  misc_feature (1)..(207): Xaa is any amino acid
MKVINANNFEVLEYIKTFNNTNVIVDVNYSLSSIDDIILQDINMYHVGLVVVSKASFEQRKMRKILFEGRVPVLKIANKSVSKLKEAVAIISDNKELEKVATTIFDISMQLDLNMEIYNYTLEHQESKIQTIEHFNNLSTIFSKSIKVFENEKNPLRLLKKRENFLHCLPFTSKIAQYRISTIFSTDSDMLYYLLNDYHQIFIPSQI

SEQ ID NO: 15551 - DNA, 537 bp, Unknown
  Obtained from environmental sample
  misc_feature (1)..(537): n is a, c, g, or t
gtgaaaattttaaaagctattttagcattaaataaagatgataaagaagtagaagatgatctgaaaaaatcttcacttatgtatgaaaagtttaaacttgctcttgatacagttgaatctacttcagaggtatatattcagcgtataaagcagatagaagagggtataaataagagtattaagacacagacatataagttattaaatatatcaattattgtgtcagttgtatttttactatttttcaccatcaaactgattgttaaaaaatatattattgataatgaacgtttttatatggcaaataaaatcattaattttagtaattttactcttatatttttgatagtggtctttaattatatagaaaatgttagttactttgtcacagtgttaggatttgcgtcagctggtatcgcaattgccatgaaagattggtttatgagtatgcttggatggcttgttatcgttattggtggatctattcatgtgggtgatagaatacgggtagatatggatgtctcgagccgattctga

SEQ ID NO: 15552 - protein, 178 aa, Unknown
  Obtained from environmental sample
  misc_feature (1)..(178): Xaa is any amino acid
MKILKAILALNKDDKEVEDDLKKSSLMYEKFKLALDTVESTSEVYIQRIKQIEEGINKSIKTQTYKLLNISIIVSVVFLLFFTIKLIVKKYIIDNERFYMANKIINFSNFTLIFLIVVFNYIENVSYFVTVLGFASAGIAIAMKDWFMSMLGWLVIVIGGSIHVGDRIRVDMDVSSRF

SEQ ID NO: 15553 - DNA, 705 bp, Unknown
  Obtained from environmental sample
  misc_feature (1)..(705): n is a, c, g, or t
gtgttacctagtagtttaagtaaatttcatagtttatttacagaagaagaaatcagagaaaaattaaaaccatataatccaaaatttgattttagatttgaaacttatgaaaatcctgaaaaaggaataaaagaaatatcattttttataaaagaagatgaagatactaatataaaaatttctagaggagaagagcgtatatttgtatggtgtttcttcttggcactttttgaagttgagggttgggcagataaacaatctaaacatttttttatcgatgatcctgtttcaagcttggatgatcataatatttttgtaacagcaataacactttttgacttaattgaaaaatattttaaagaaagaaaaattgtaataacaacccatcacattggactgttttctatcttatacaattggttatacaaaggagaaaaagcttccaaatttaaaaaaagaggtggaagttcatatgttaaatcttatatattgaatcgtaaagatgacaatactttatctctagataaatttgaaaaaagtgtatttctttatcacttacatttattgcaaaaattaaaaaaagcaaaagaagacgatgaattatatggctatcattttgtgttattaagacaaattttagaaaatatagcttcatttttgggtgttggacaatttgcatatgttttacaacaaatttggcattaa

SEQ ID NO: 15554 - protein, 234 aa, Unknown
  Obtained from environmental sample
  misc_feature (1)..(234): Xaa is any amino acid
MLPSSLSKFHSLFTEEEIREKLKPYNPKFDFRFETYENPEKGIKEISFFIKEDEDTNIKISRGEERIFVWCFFLALFEVEGWADKQSKHFFIDDPVSSLDDHNIFVTAITLFDLIEKYFKERKIVITTHHIGLFSILYNWLYKGEKASKFKKRGGSSYVKSYILNRKDDNTLSLDKFEKSVFLYHLHLLQKLKKAKEDDELYGYHFVLLRQILENIASFLGVGQFAYVLQQIWH

SEQ ID NO: 15555 - DNA, 750 bp, Unknown
  Obtained from environmental sample
  misc_feature (1)..(750): n is a, c, g, or t
atgaataatttatctatgagaccagtagctttggattatgatgggataaatataaaagagtttaataatatatatccctctataaaactagcatacttaataccagatttccaaaatccaaaagcttcattgtattcgcaaacaaaaagagatgcaatagtaaaaaccgtattaaaaaacaaagggtatatcatagaagataccccttatagtgaactctattttgaacaaaaagcaaaaagtataagtgccgaaactcctaataatagttttcatctagggtcattttcaaaaactctctcaccaagtcttagaataggatgggtacgggcgaatgaagagataatagcacaactaacgcagataaaagagactatagatttacatagcagtggtatatctcaatatatcttagatgaatatttaaaagatgaaaacagatataaaaaacatttagagcttttaagatatgagtataaaaataagatggagtattttgttacaactttaaaagaagagttacctcaatttgtatttgaaaaacctaaaggtggtatgtttatatatgggaaacttgaaggtattgatactaaagctttagtatatgaagcattgaagaaaaaagttgtatatgttccaggcgttgaattttatcttgatgatagtgtatgtgatgagatacgctttaactatacgcattcaacaaaaaatgagataaaaactggcttgcaaagattaaaagtatcctaa

SEQ ID NO: 15556 - protein, 249 aa, Unknown
  Obtained from environmental sample
  misc_feature (1)..(249): Xaa is any amino acid
MNNLSMRPVALDYDGINIKEFNNIYPSIKLAYLIPDFQNPKASLYSQTKRDAIVKTVLKNKGYIIEDTPYSELYFEQKAKSISAETPNNSFHLGSFSKTLSPSLRIGWVRANEEIIAQLTQIKETIDLHSSGISQYILDEYLKDENRYKKHLELLRYEYKNKMEYFVTTLKEELPQFVFEKPKGGMFIYGKLEGIDTKALVYEALKKKVVYVPGVEFYLDDSVCDEIRFNYTHSTKNEIKTGLQRLKVS

SEQ ID NO: 15557 - DNA, 645 bp, Unknown
  Obtained from environmental sample
  misc_feature (1)..(645): n is a, c, g, or t
atgattagttcttataataaatcaataggaaaaataaaatatattttagaaactagagagatgttcaataaaatatttatgcatgagatgaaaatgccaattgcaaaagggatgttttatctaaaacaagagccttctaaatatacacatgataaattcaatatcttactaaatagattgaataatgaactagatgaattttcagtaattgagagtttaatcgtatatcaaaataatatagaactaatacctcataatacccataatattttaaccttagctattgaaaaagttggcatggaaaacaaaaataatatattaatagaaaattgtgataattttgaaatacaaggtgataaagagttatggatattatgttttaaaaatttaattgacaatgctttaaaatatgcagatgataaaaaattaattataaaatgctcaaagaatagtatctcatttattaatattggtgataaactaccagttgatttatcccaagatctaaagaattggaaaatagataaaaatcaaagacataaaagttctacgggatatggttttggattatttattataaaaaatattattgcattaaatggttatgctttagaatatagttatagtgatagtagtatgaattaa

SEQ ID NO: 15558 - protein, 214 aa, Unknown
  Obtained from environmental sample
  misc_feature (1)..(214): Xaa is any amino acid
MISSYNKSIGKIKYILETREMFNKIFMHEMKMPIAKGMFYLKQEPSKYTHDKFNILLNRLNNELDEFSVIESLIVYQNNIELIPHNTHNILTLAIEKVGMENKNNILIENCDNFEIQGDKELWILCFKNLIDNALKYADDKKLIIKCSKNSISFINIGDKLPVDLSQDLKNWKIDKNQRHKSSTGYGFGLFIIKNIIALNGYALEYSYSDSSMN

SEQ ID NO: 15559 - DNA, 354 bp, Unknown
  Obtained from environmental sample
  misc_feature (1)..(354): n is a, c, g, or t
atggcagtagtgccgcgttatcttgaggccaacggacttgatgctacgcccgtgatgatagaaaagctggggcatcttgaaaacgatgagaaggctgaaaagatcatcgatgtcttgaaggtcatcctggaagaagagtgtgaccatgtctacaagggtgatgtctggttcaagtatgcttgcgatgtaaaaggacttggttatgaggtctatttcgatatcatagacgtctattatccgggaagttttccgcgtaaaaaagagttaaacatccaggcacgacaagatgcaggtttcagctgcagtgaactcaaacgcatgaacacacaggcccaatgcaagcaagagccttga

SEQ ID NO: 15560 - protein, 117 aa, Unknown
  Obtained from environmental sample
  misc_feature (1)..(117): Xaa is any amino acid
MAVVPRYLEANGLDATPVMIEKLGHLENDEKAEKIIDVLKVILEEECDHVYKGDVWFKYACDVKGLGYEVYFDIIDVYYPGSFPRKKELNIQARQDAGFSCSELKRMNTQAQCKQEP

SEQ ID NO: 15561 - DNA, 552 bp, Unknown
  Obtained from environmental sample
  misc_feature (1)..(552): n is a, c, g, or t
atgaatgaaaatttaaaggttggaaagtatcataaagatgttaataaatattctgatttaataaatgatgtatataacaattatccaaatggaattacattgcctccaatgtatgctcaatttgttgataaaagtatgtcgaatattctaatccgattaagcagatataaatttgtagcaaaaatgttaaaagaaagtgatactgtattagaagttggatgtggttctggattaggagctatatatttatcacaaaactgccaaagtgtctatggtatagatgttcaagagcaagaaattctagaggctcaaaatataagcaagagagaaaatgtcaagtttgaagtacaagatttatttttactagatgaaaataaaaaatatgatacaatagtttgtttagatgttttagaacacttaagtattgaagatggtagaaattttgtcaaaaaaatatcaaaattattaaagccaaatggtttttttgcgtgtggagtccctagtatatattcttatgaatttcagagcccttttagtcagcatctcatataa

SEQ ID NO: 15562 - protein, 183 aa, Unknown
  Obtained from environmental sample
  misc_feature (1)..(183): Xaa is any amino acid
MNENLKVGKYHKDVNKYSDLINDVYNNYPNGITLPPMYAQFVDKSMSNILIRLSRYKFVAKMLKESDTVLEVGCGSGLGAIYLSQNCQSVYGIDVQEQEILEAQNISKRENVKFEVQDLFLLDENKKYDTIVCLDVLEHLSIEDGRNFVKKISKLLKPNGFFACGVPSIYSYEFQSPFSQHLI

SEQ ID NO: 15563 - DNA, 468 bp, Unknown
  Obtained from environmental sample
  misc_feature (1)..(468): n is a, c, g, or t
atgagagcagatgggacagttgaaggcggatatataactacgaaggactctttaaaagtagtacatgagataagaaataatctagatttattagttataggtggagaaacagtaagaacagatagaccaactttagattcacgatttgcaacaacgaataatcctccagatattttaatatattcaaaaagagatgattttgataaaacaataccactattttcaattgctaatagagatgtagaagtttcaaataatttaaaaataataacagataaaaattttgtaatgattgaggggggatacaatctattagaaagtataaaaactaagctagactatcttgtgatatttttatcaacaaaagtaaaaaatggtaaaaaaattgatataacaaagtttggatttaaagaagtgtatagatatgaaatcaatgaagatgatactgtaatttttttaaaaaaataa

SEQ ID NO: 15564 - protein, 155 aa, Unknown
  Obtained from environmental sample
  misc_feature (1)..(155): Xaa is any amino acid
MRADGTVEGGYITTKDSLKVVHEIRNNLDLLVIGGETVRTDRPTLDSRFATTNNPPDILIYSKRDDFDKTIPLFSIANRDVEVSNNLKIITDKNFVMIEGGYNLLESIKTKLDYLVIFLSTKVKNGKKIDITKFGFKEVYRYEINEDDTVIFLKK

SEQ ID NO: 15565 - DNA, 618 bp, Unknown
  Obtained from environmental sample
  misc_feature (1)..(618): n is a, c, g, or t
ttgttgatttttacattaagtattacagagactatttttttactaaaatgtactaaaatgaaaaattcaataaaaagtatcgaaatacatactggaatattaaaaaacaagatttacctaatcaggaatacaaaagttatgcttgacagagatttagcaaaactttacaatgttgaaacaaagcgactgaaagaagcggtaagaaggaatattgaacgatttcctgaagattttatgtttgaaatgaaggaagatgaatttattaattggaggacgcaatttgcgtcctccaattctgaaatgatgggcttgagatatgctccgttttgttttacagaacaaggaatagcaatgatatcaagtgtactaaatagtagtagagcaattcaggtaaacatccagattatacgtgtatttacaaaaatgagagaacttttatcctcacataaagaaatacttagcaaactggaacaacttgaaaacaaggatattgaacaagatgacaaaatcatattaattttcaaatacctaaaacaactagaacagaccaaacaagaagaattgaaatataaaaatcgtcgcaaagtgggatttaagacctcagagggtagttcttga

SEQ ID NO: 15566 - protein, 205 aa, Unknown
  Obtained from environmental sample
  misc_feature (1)..(205): Xaa is any amino acid
MLIFTLSITETIFLLKCTKMKNSIKSIEIHTGILKNKIYLIRNTKVMLDRDLAKLYNVETKRLKEAVRRNIERFPEDFMFEMKEDEFINWRTQFASSNSEMMGLRYAPFCFTEQGIAMISSVLNSSRAIQVNIQIIRVFTKMRELLSSHKEILSKLEQLENKDIEQDDKIILIFKYLKQLEQTKQEELKYKNRRKVGFKTSEGSS

SEQ ID NO: 15567 - DNA, 486 bp, Unknown
  Obtained from environmental sample
  misc_feature (1)..(486): n is a, c, g, or t
gtgtccggcaatcataagattattaaattaataaaatctcaaagcatgataaaaatatacttttgcggctcaattaggggtgggcgggacttagctgaaaaatatgggcagatcataaaaatgctgcaaaattttgggacagtactaacggaacatattgctgacaaggatataattgaaaaggaggcggaaaatcaaacggatgaagaaatttatcttcaggacagaaactggctggaagaatcagatatcgttatcgctgaagtcaccacgccgagtctgggtgttggctttgaaattggctatgccattcgaatgaaaaaacccatcctttgtctctataataatgatgcagattttgacctttctgcaatgatctcaggttgtcctgatctttctgttgtgaagtatcaacaaacaggagaactaagggctgctgttgagaaatttatttataacaatagtattaaatcagtgagactatga

SEQ ID NO: 15568 - protein, 161 aa, Unknown
  Obtained from environmental sample
  DOMAIN (19)...(134): Nucleoside 2-deoxyribosyltransferase
  misc_feature (1)..(161): Xaa is any amino acid
MSGNHKIIKLIKSQSMIKIYFCGSIRGGRDLAEKYGQIIKMLQNFGTVLTEHIADKDIIEKEAENQTDEEIYLQDRNWLEESDIVIAEVTTPSLGVGFEIGYAIRMKKPILCLYNNDADFDLSAMISGCPDLSVVKYQQTGELRAAVEKFIYNNSIKSVRL

SEQ ID NO: 15569 - DNA, 567 bp, Unknown
  Obtained from environmental sample
  misc_feature (1)..(567): n is a, c, g, or t
atgcacgatattgcagagtatggggttgcagcacattggaaatataaaagcggaagaagcaatactacgagtgcaaaaggaccgagtttggattggcttcactctttagcctctagtgatgcgagtgtggaagagttttatgatgatgcaaaacaagatttatatagtgaagatattattgtatattcacctaagggtgatatatttatgcttcctcgtggctctactgcttttgattttgcttatgctatccatactgatgttggaaattatgctatggaagcactaattaataaagtaaataaaccactcttaacacagttaagaagtggagatattatttcaataattacaaataaccatataataccaagatgtacttggcaagatatggtacaaacaactaaagctaaaaaatctataaaaactttgtgtcataatagattaaaacatatagatgatttaagtagtaaaaacattataaatactatattttctagatataaagagtttattttagatcagttagaagatttgaaattaacaatcttaaaaaatagtatataa

SEQ ID NO: 15570 - protein, 188 aa, Unknown
  Obtained from environmental sample
  DOMAIN (55)...(118): TGS domain
  misc_feature (1)..(188): Xaa is any amino acid
MHDIAEYGVAAHWKYKSGRSNTTSAKGPSLDWLHSLASSDASVEEFYDDAKQDLYSEDIIVYSPKGDIFMLPRGSTAFDFAYAIHTDVGNYAMEALINKVNKPLLTQLRSGDIISIITNNHIIPRCTWQDMVQTTKAKKSIKTLCHNRLKHIDDLSSKNIINTIFSRYKEFILDQLEDLKLTILKNSI

SEQ ID NO: 15571 - DNA, 489 bp, Unknown
  Obtained from environmental sample
  misc_feature (1)..(489): n is a, c, g, or t
ttgatcgccgggagttcgatttttctcttatcaaactttacttacttaggcaaaggcaacactttaagacttggtttagacaatgctaaacaaagcttgatcaataatattgaaccaacatttttaaagctgcaacatgcaaaaattactaattgtgattttagaagtgtgattgataaaatttccttttcagaaaaattaattactaaagaagaagcctttgtttacttagatccaatctacttaaacacatcacattactacaaagtaccaaaatggactgtaaacgatactgaagattgttttaaaataatggctaattgtggtattccatctgcaatgagcgaatttaaaagtgaaataatcttagactttgcctctgattataaaatgaatgtaacacctcttaaaattagaaataatataaagaattataagcaagaaatattaattactaattatgagaataaacaaattaaattgttttag

SEQ ID NO: 15572 - protein, 162 aa, Unknown
  Obtained from environmental sample
  misc_feature (1)..(162): Xaa is any amino acid
MIAGSSIFLLSNFTYLGKGNTLRLGLDNAKQSLINNIEPTFLKLQHAKITNCDFRSVIDKISFSEKLITKEEAFVYLDPIYLNTSHYYKVPKWTVNDTEDCFKIMANCGIPSAMSEFKSEIILDFASDYKMNVTPLKIRNNIKNYKQEILITNYENKQIKLF

SEQ ID NO: 15573 - DNA, 390 bp, Unknown
  Obtained from environmental sample
  misc_feature (1)..(390): n is a, c, g, or t
atgagtagatatttatatatttttttaattttcgtcatgccactgagtgcaatgtataaccctttttttgatgttcaatcagaaaaaagcatgcagacatcaccaagaataatgcaaaaaaatattcctaaaaaaaagtcatataagcttctatattttggttatatagagactaataagggcaagtttgctctaattagtgttgaagatcaaagttttgtagttaaacaaggtgataaaatttatgtagatggcgatgagataaatatctattcacttaactcaaattcgcttgttgttaaagatggattcaacagagtgcagtctatatatttcagtaaaattgaggaagatccaggtactacgggtgggaataatgcaaaattatag

SEQ ID NO: 15574 - protein, 129 aa, Unknown
  Obtained from environmental sample
  misc_feature (1)..(129): Xaa is any amino acid
MSRYLYIFLIFVMPLSAMYNPFFDVQSEKSMQTSPRIMQKNIPKKKSYKLLYFGYIETNKGKFALISVEDQSFVVKQGDKIYVDGDEINIYSLNSNSLVVKDGFNRVQSIYFSKIEEDPGTTGGNNAKL

SEQ ID NO: 15575 - DNA, 711 bp, Unknown
  Obtained from environmental sample
  misc_feature (1)..(711): n is a, c, g, or t
atgaagattatagcaagtaactttaagactaatcacacacgaagtagtaccaaatcttttatagatactatcaatcaatttctagaatctaatcaaataaaaaatgaagtatttgtatttcctaccgcaacatcttttgataactttaatacagtaaataacctaaaaataggtgctcaaaatgcatactacactaaaaatggttcatttacaggtgagattgggacagaacaacttgatgaatttgatataaaaacaattttaattggacatagtgaaagaagacatatcttaaaagagtcacaaaaagatttaacactaaaatataactattataaatctttaggatatacaattatatattgtgttggggagcctttagaggtaagagaaaaaggtcttactgaaactttaggatatatctgggaacagtttgaaggtatagatttaagttatgacaaactaattgttgcttatgaaccagtttgggctataggaacaggtgttgtagcaactgcccaagagatagcgcaagtacataaaaaaatcaaaaagaaaatttcacatccccttttatatggaggaagtgttaaacctgagaatttagaagagatattaaaaatagacaatgttgatggtacttttgattggacaacatcttgggatgtagaacaatttaaacagatgattgaaattaccagtaaaaattaa

SEQ ID NO: 15576 - protein, 236 aa, Unknown
  Obtained from environmental sample
  DOMAIN (1)...(234): Triosephosphate isomerase
  misc_feature (1)..(236): Xaa is any amino acid
MKIIASNFKTNHTRSSTKSFIDTINQFLESNQIKNEVFVFPTATSFDNFNTVNNLKIGAQNAYYTKNGSFTGEIGTEQLDEFDIKTILIGHSERRHILKESQKDLTLKYNYYKSLGYTIIYCVGEPLEVREKGLTETLGYIWEQFEGIDLSYDKLIVAYEPVWAIGTGVVATAQEIAQVHKKIKKKISHPLLYGGSVKPENLEEILKIDNVDGTFDWTTSWDVEQFKQMIEITSKN

SEQ ID NO: 15577 - DNA, 1032 bp, Unknown
  Obtained from environmental sample
  misc_feature (1)..(1032): n is a, c, g, or t
atggaaatttcgaatatgaataggggtttggggttcaaaaaacaaggcccaggagccttaaagttaaatcaatttttttgcaatttgagtcctgagttaagaaccctttttaatgtatttttaggtatgacttatttaggcaaaaaggaggttcaggataaaaaacagcaggaccancttcatatattagagaaagcaccaacttcattattaagattgattaatgatattttagatagttcaaaaatagagataggaaagcttatatttgtaaaaaataacttcaatatggatcaagtattaaacaatgttaaagcagttgcaacatctaatattgaagctaaagatatagattttgagattcattatgacaaaattttaccaaaatactttaatggagatagtttacgattagagcaagttttaataaaccttgtgagtaatgctacaaaatttacacaaagaggctcagtacaattatctatagaaaatataaactacaataggtatagatttagtgtaagtgatacaggtattggagtaacacaagaacaaatagaaaatatttttgagccatttactcaagcagatgacacaattacaagagaatatggtggtactggacttggtctatctatatcaaaacaacttgtagagttaatgggtggaatacttagaattgaaagtaaggtaaaagagggtacacaaatatattttgatattgagttaagagaaataaaacaagaggattacattaacgagaaagggttagaaaaaacaaagaaaaaaatagagtttaatttgtataataagagagagacaatagtttttgaaaaagagaaagagttacttgaacaattagaagaggcagtattgagaaaaagaccaaatgtggtatatcctattattgatgaattagataaatataatttacaaatactaagtagtgtagattttaagaatataaaaacatatattaagagatatatgtttcatgaagcaagcgagatactaaataaatatgaaaaataa

SEQ ID NO: 15578 - protein, 343 aa, Unknown
  Obtained from environmental sample
  DOMAIN (21)...(86): His Kinase A (phosphoacceptor) domain
  misc_feature (1)..(343): Xaa is any amino acid
MEISNMNRGLGFKKQGPGALKLNQFFCNLSPELRTLFNVFLGMTYLGKKEVQDKKQQDXLHILEKAPTSLLRLINDILDSSKIEIGKLIFVKNNFNMDQVLNNVKAVATSNIEAKDIDFEIHYDKILPKYFNGDSLRLEQVLINLVSNATKFTQRGSVQLSIENINYNRYRFSVSDTGIGVTQEQIENIFEPFTQADDTITREYGGTGLGLSISKQLVELMGGILRIESKVKEGTQIYFDIELREIKQEDYINEKGLEKTKKKIEFNLYNKRETIVFEKEKELLEQLEEAVLRKRPNVVYPIIDELDKYNLQILSSVDFKNIKTYIKRYMFHEASEILNKYEK

SEQ ID NO: 15579 - DNA, 792 bp, Unknown; identical to SEQ ID NO: 7237
  Obtained from environmental sample
  misc_feature (1)..(792): n is a, c, g, or t

SEQ ID NO: 15580 - protein, 263 aa, Unknown; identical to SEQ ID NO: 7238
  Obtained from environmental sample
  misc_feature (1)..(263): Xaa is any amino acid

SEQ ID NO: 15581 - DNA, 639 bp, Unknown
  Obtained from environmental sample
  misc_feature (1)..(639): n is a, c, g, or t
atgcaaagaatacgatactctctttacagcatcttagcaattacagtttctactattattattttagttatgactctctctctgagctataactatattgatacaaaaaataagttgataactaatctagcagttgattctcaaactattttaactagattacaaaagagtatattaccttttgttgaatcgtactctgtaaatgaatatgaaaaactttttttgaacgaaatgaataataaaaatatatttgcaattgtagttgaggattacaatatgggaactgttttagggacaaaaacttttattacagggaaaataagagataaaaactggagcgtaaaagaatatgaagcttcacctttaaatacaaaaaatttagagaactctttctttactcaagaggtttttgtcacctcttttgatgataaacacttagctactattacaatttattttactgataaatttatacaatcagaattaaaaatgcttattgaaaaaagtatctttatcacttttttaatctctattatacttatattttttctatttatttttattaaaaaattgatattaaacccaattagtcaaattattgatactatctcccatcatgatagtatgggaataccttaa

SEQ ID NO: 15582 - protein, 212 aa, Unknown
  Obtained from environmental sample
  misc_feature (1)..(212): Xaa is any amino acid
MQRIRYSLYSILAITVSTIIILVMTLSLSYNYIDTKNKLITNLAVDSQTILTRLQKSILPFVESYSVNEYEKLFLNEMNNKNIFAIVVEDYNMGTVLGTKTFITGKIRDKNWSVKEYEASPLNTKNLENSFFTQEVFVTSFDDKHLATITIYFTDKFIQSELKMLIEKSIFITFLISIILIFFLFIFIKKLILNPISQIIDTISHHDSMGIP

SEQ ID NO: 15583 - DNA, 330 bp, Unknown
  Obtained from environmental sample
  misc_feature (1)..(330): n is a, c, g, or t
atgatgaatcaaataataaaaatcaccaggtttactcaagaagatatagacaaagtatgtcaggttcatcttgagagtaaaagtggttattttagaatgcttttggatcgtttgagtttacctcaaaaagtagctttaaaagctgtaattatttgtgatggtaccgagctatatacaaaagagaccctttttaaacttcaaacaactaaatcatcgcttaatactgcaataagaaatttatacaaagatgagataattgataaagagaataataagtattatattacaaacagatgttttgaactttggtgtagaaaaaagtttttataa

SEQ ID NO: 15584 - protein, 109 aa, Unknown
  Obtained from environmental sample
  misc_feature (1)..(109): Xaa is any amino acid
MMNQIIKITRFTQEDIDKVCQVHLESKSGYFRMLLDRLSLPQKVALKAVIICDGTELYTKETLFKLQTTKSSLNTAIRNLYKDEIIDKENNKYYITNRCFELWCRKKFL

SEQ ID NO: 15585 - DNA, 786 bp, Unknown
  Obtained from environmental sample
  misc_feature (1)..(786): n is a, c, g, or t
atgaaattactattattactttttttagtactattgaatgtgaatgcaaaaactttagatagtacacaagtattcaataaaacaacagttaaggtacaaaaacaaacattaggcttatcaaaagagttttatgctgatattgtacttgatgaaacagatatcaaagatattacactaagatttgatggttttatccaaaagttgtatcaagacaaaaaatatagctatatcaatagtggtgaaaaactatttagtatctattcaaatgaagtatatacttcactgcaagagtttttaactatagacctaaccaatcaaagaagatataaaagttatatggataagtttaaaaatcttgatatagatacaaaacaaatagtcaacatcttaaaatcaaaagagatgagagaaaatatagatatttattctccatatagcggatatcttataacaaaacaaatcaatacaggaagtgccgtaaaaaaagggcagcttctttttcaaatagcaagtatgaaacagctttggggaaaagttaaagtgtaccaaaaagatttatcatacattaaaaaagatatggatgtaaaactttttatagagggtgttggtgtggtgacttcaaaagttgattttatctatccaactatagatgagcaaacaaaaactgtggatgtacgagttctaatagagaacaacaatttaaaaatttatccaggtatgtttgcaaaagcaaaaatctatgaaagtagtagaacaatgttagtcttacaaaatcagctgtattga

SEQ ID NO: 15586 - protein, 261 aa, Unknown
  Obtained from environmental sample
  SIGNAL (1)...(16)
  misc_feature (1)..(261): Xaa is any amino acid
MKLLLLLFLVLLNVNAKTLDSTQVFNKTTVKVQKQTLGLSKEFYADIVLDETDIKDITLRFDGFIQKLYQDKKYSYINSGEKLFSIYSNEVYTSLQEFLTIDLTNQRRYKSYMDKFKNLDIDTKQIVNILKSKEMRENIDIYSPYSGYLITKQINTGSAVKKGQLLFQIASMKQLWGKVKVYQKDLSYIKKDMDVKLFIEGVGVVTSKVDFIYPTIDEQTKTVDVRVLIENNNLKIYPGMFAKAKIYESSRTMLVLQNQLY

SEQ ID NO: 15587 - DNA, 645 bp, Unknown
  Obtained from environmental sample
  misc_feature (1)..(645): n is a, c, g, or t
atgattaaaataacaaacctaaacaaacaattcggcagtgtaaaggctctcgataatattaacctcgattttagtaaaaatagagtctatggaattataggacacaatggagcaggtaaaacaaccctctttagatgtattaatagactagaaagtttccaaggtgaactagaaatagaggataatgttcttcactctgttggctatctacctacagaacctgagtttatgtcttatataacaggtcatgaatatctgcaactactctgcaatgccaaaggtattaattatgacagaagtgataaaagcaatatctttaacttaccactcaaacggtttgcttcaacttactcaacaggtatgaaaaagaaactagcttttactggtctgctcctacaaaagaatgatgtttatattctcgatgaaccgttcaatggtgtagatgtggagagtaacttcttaattttggagattattaaagtgctaaaagatatgaataaactagtaatcatctcttctcatatcctctcttcactcagagatatttgtgatgaatatatcgttatcaaagaagggaaagttgagaagaatctcaacaaagaagagtttcttaaacaagaagataacatgttgaaaaagatgtag

SEQ ID NO: 15588 - protein, 214 aa, Unknown
  Obtained from environmental sample
  DOMAIN (27)...(192): ABC transporter
  misc_feature (1)..(214): Xaa is any amino acid
MIKITNLNKQFGSVKALDNINLDFSKNRVYGIIGHNGAGKTTLFRCINRLESFQGELEIEDNVLHSVGYLPTEPEFMSYITGHEYLQLLCNAKGINYDRSDKSNIFNLPLKRFASTYSTGMKKKLAFTGLLLQKNDVYILDEPFNGVDVESNFLILEIIKVLKDMNKLVIISSHILSSLRDICDEYIVIKEGKVEKNLNKEEFLKQEDNMLKKM

SEQ ID NO: 15589 - DNA, 549 bp, Unknown
  Obtained from environmental sample
  misc_feature (1)..(549): n is a, c, g, or t
atgaataaaaaaatattaattttaatgataatcttgggtttagcagttgcatttgttgtatttggaaaactaagtagcaataaatctatgataggagaagtgaataacgaaatgaaagaagaaatgaaagaagaaatgaaagatgaaatggaaatagttaatgaaggaactatggcagcagaattttctttaaaagatttagatggtaatcttcatagtctttctgattataagggtgaaaaagtatatttgaagttttgggcatcgtggtgtccaatatgtttatcagggcttgaggaattagataaactgtctgctgaagacctagattttaaagttattacaatagtttcaccgagctcaaatggtgagatgaaaagtgaagaatttatagaatggtataagagtttaaaattgaaaatattaccgtattacttgatgaaaaaggtgaaattgcaagggattatatgggtagggcctatcccacatctgtttacttggttcagaaagtgtcttaataaaagtttggccgggtcttttgaaatatga

SEQ ID NO: 15590 - protein, 182 aa, Unknown
  Obtained from environmental sample
  SIGNAL (1)...(17)
  misc_feature (1)..(182): Xaa is any amino acid
MNKKILILMIILGLAVAFVVFGKLSSNKSMIGEVNNEMKEEMKEEMKDEMEIVNEGTMAAEFSLKDLDGNLHSLSDYKGEKVYLKFWASWCPICLSGLEELDKLSAEDLDFKVITIVSPSSNGEMKSEEFIEWYKSLKLKILPYYLMKKVKLQGIIWVGPIPHLFTWFRKCLNKSLAGSFEI

SEQ ID NO: 15591 - DNA, 798 bp, Unknown
  Obtained from environmental sample
  misc_feature (1)..(798): n is a, c, g, or t
atgaaaatgggcatatatatttcgatttttttaatagtaattttggcttttattggtactatagaaaaaaataaaagtattgcacaattttcagataaagtagattcttcaaatgaatatggaaaggaaaaaattatgaatgatgaaaacttaaaagaaatatatttggctggtggatgtttttggggacttgaggcatatatggagaaactttatggagtatatgatgttacctcaggatatgcaaatggagataccgaaaatcctaaatatgaggatttgatttataaaaattcaggacatgcagaaactgttcatataaaatatgatcctgaaaagacagatatagaaactttactttattactattttaaagtaattaatcctactagtttaaataagcagggaaatgacaggggtactcagtatagaactggaatatattacacagatgaaaatgaaaaaatgattattgaagaatttatcaaagaggagcaaaaaaaatattcaaaggatatagtggtggaggttatggcactagatcattattatttggcagaagaatatcatcaagattatcttaataagaatcctaatggttattgtcatatagatttaagtgaagctgatgagatttatattgaccctgcaaaatatcttaaacctactgatgaatttcttaaaaagaatttaacagatattcagtatagagttactcaacttaatgatactgaaggatctttttcaaatgaatattggaatttatttgatgatggaattatctcgagccgatcctga

SEQ ID NO: 15592 - protein, 265 aa, Unknown
  Obtained from environmental sample
  DOMAIN (52)...(207): Peptide methionine sulfoxide reductase
  misc_feature (1)..(265): Xaa is any amino acid
MKMGIYISIFLIVILAFIGTIEKNKSIAQFSDKVDSSNEYGKEKIMNDENLKEIYLAGGCFWGLEAYMEKLYGVYDVTSGYANGDTENPKYEDLIYKNSGHAETVHIKYDPEKTDIETLLYYYFKVINPTSLNKQGNDRGTQYRTGIYYTDENEKMIIEEFIKEEQKKYSKDIVVEVMALDHYYLAEEYHQDYLNKNPNGYCHIDLSEADEIYIDPAKYLKPTDEFLKKNLTDIQYRVTQLNDTEGSFSNEYWNLFDDGIISSRS

SEQ ID NO: 15593 - DNA, 678 bp, Unknown
  Obtained from environmental sample
  misc_feature (1)..(678): n is a, c, g, or t
atgaatatattactagtttcagcaacttatttagagatagaacctttattaacccaatttaaatttataaaacagtctaaccaaaaattaagacattatgaatttaaaaatcatcatatagatgtgttaatcccaggagtaggaatgacttttactgcttattggttgggaaaaaccttaatatctaaaatgtatgatatggctattaatgttggcttagcaggtgctttcgatgattcaataaaaacaggagaagtagttaatgttattgttgacaggatttccgaattaggtgccgaagatggagaaaaatttttatcattaattgatatggatttattagaagacgaagattttgaacttcaaaatggagaaatgataaacactattccgattgaaaatacggtttctgagtcattaaaaaaagtaaaaagtattactgtaaatactacccatggagatgatgattctattgaaaaagtaaaacgcttatttcagccacaaatagaaactatggaaggggcagcttttttatatgcctgcttgttagaaggtattccttgtctgcaaattagagccatatctaataaagtagaaagaagaaataaagataattggaatattaaattggcagtaaaaaatcttacagaaaaatctatagagatattaagaacttaa

SEQ ID NO: 15594 - protein, 225 aa, Unknown
  Obtained from environmental sample
  DOMAIN (2)...(223): Phosphorylase family
  misc_feature (1)..(225): Xaa is any amino acid
MNILLVSATYLEIEPLLTQFKFIKQSNQKLRHYEFKNHHIDVLIPGVGMTFTAYWLGKTLISKMYDMAINVGLAGAFDDSIKTGEVVNVIVDRISELGAEDGEKFLSLIDMDLLEDEDFELQNGEMINTIPIENTVSESLKKVKSITVNTTHGDDDSIEKVKRLFQPQIETMEGAAFLYACLLEGIPCLQIRAISNKVERRNKDNWNIKLAVKNLTEKSIEILRT

SEQ ID NO: 15595 - DNA, 414 bp, Unknown
  Obtained from environmental sample
  misc_feature (1)..(414): n is a, c, g, or t
atgacaacaatactccatgatgttgttaaaaaagggacagggagaaatgcaaatgttgctgatatagatattgttggtaaaacaggtaccacaaataacaatatagatgcttggttttgtggatattccccaacactacaaactatagtatggtatggaaatgatgataataaaccaatggggaaaagagaaacagggggaagaacagcagcccctgcttttaaatacttctatgaacattggctaaaacttcatccagagatgccaagaaattttgtaaaaccagaaaatgtttttatacaaaaatacaatggagaagatgaatattttacagagacttcaaagatgccaaaagagcaaacagatatagagatacaaacagattatctaaaaaataaaaatgttattttttag

SEQ ID NO: 15596 - protein, 137 aa, Unknown
  Obtained from environmental sample
  misc_feature (1)..(137): Xaa is any amino acid
MTTILHDVVKKGTGRNANVADIDIVGKTGTTNNNIDAWFCGYSPTLQTIVWYGNDDNKPMGKRETGGRTAAPAFKYFYEHWLKLHPEMPRNFVKPENVFIQKYNGEDEYFTETSKMPKEQTDIEIQTDYLKNKNVIF

SEQ ID NO: 15597 - DNA, 366 bp, Unknown
  Obtained from environmental sample
  misc_feature (1)..(366): n is a, c, g, or t
atgaaaaaagtattaatcataacttattattggcctccaatgggtggtggtggagtgcagcgttgggtaaaaaccactaaataccttagagagtatggttgggaacctatcatttacactacagaaaacggagaaatagctattcaggataatgaaatgctaaaagaaattcctgacggtgttgaaatcataagaaccaaaatatgggaaccatttagcttatataaaaaattattgggaaagaaaaaagatgaagctcttttacccggaatgagccagtctagcgaaggaaattcattattacaaaacctttctttatgggttagaggtaatatttttattcctgatgcctcgagccgattctga

SEQ ID NO: 15598 - protein, 121 aa, Unknown
  Obtained from environmental sample
  misc_feature (1)..(121): Xaa is any amino acid
MKKVLIITYYWPPMGGGGVQRWVKTTKYLREYGWEPIIYTTENGEIAIQDNEMLKEIPDGVEIIRTKIWEPFSLYKKLLGKKKDEALLPGMSQSSEGNSLLQNLSLWVRGNIFIPDASSRF

SEQ ID NO: 15599 - DNA, 468 bp, Unknown
  Obtained from environmental sample
  misc_feature (1)..(468): n is a, c, g, or t
ttgatggaatttggatttatttttaagaaagtcatatctgcgtttgttatgcctctatcaataggagttatttttacacttattggactcttttttttatacaaaaattcaaataaaaaagcaaaaatatttttaactgttggtactctctggattattatcttttcatatgtacctgtttcaaatctacttttagcacctttagagcaaaaatattcaaaattagaaaatatcccaaaaaatgttaagtatattttacttctcggcggagatatgcaaaatcgcggctgggaggcgttaagactctataataatatagaagatgcaaagataatcacttcaggctatgcaggacgcggagaggttgcagaggcaatacaaacagcaaatattttagaaaagctaggagttgacaaaagtgatattttagtttatcctgaaccaaaagatacaaaagaggaggcttga

SEQ ID NO: 15600 - protein, 155 aa, Unknown
  Obtained from environmental sample
  misc_feature (1)..(155): Xaa is any amino acid
MMEFGFIFKKVISAFVMPLSIGVIFTLIGLFFLYKNSNKKAKIFLTVGTLWIIIFSYVPVSNLLLAPLEQKYSKLENIPKNVKYILLLGGDMQNRGWEALRLYNNIEDAKIITSGYAGRGEVAEAIQTANILEKLGVDKSDILVYPEPKDTKEEA

SEQ ID NO: 15601 - DNA, 405 bp, Unknown
  Obtained from environmental sample
  misc_feature (1)..(405): n is a, c, g, or t
ttgttgaaaattagtgataacagcagatactatgcaaagagaatgaaagattttctaattaatgagtctgatatatattatgaagatgcgactattattaagatgcaaaaaacagtaattaaatcactgaattatctttacaaatgtatctcaaatacaaattgtgatgtagataacacatatgtaaaagttctctcagaagatagtaagattgatgatctctactctgttttagaaaaaaatattttaaataaagttgttcatgatagagatatttcaatggaatatgtaaatattataggaacgcttcataaatttgagagaatctctgagcgttgtgtagagattgcgaacttactctgttttgcaaaagatggtaaagcgagtgagatatataagagctaa

SEQ ID NO: 15602 - protein, 134 aa, Unknown
  Obtained from environmental sample
  misc_feature (1)..(134): Xaa is any amino acid
MLKISDNSRYYAKRMKDFLINESDIYYEDATIIKMQKTVIKSLNYLYKCISNTNCDVDNTYVKVLSEDSKIDDLYSVLEKNILNKVVHDRDISMEYVNIIGTLHKFERISERCVEIANLLCFAKDGKASEIYKS

SEQ ID NO: 15603 - DNA, 723 bp, Unknown
  Obtained from environmental sample
  misc_feature (1)..(723): n is a, c, g, or t
atgactttacttaactacaaaaaaataggcacaggcaataaaacaattattgtactacatgaacttatgggagaccatagaaattatgacccaattctaccttatatagatactacaaatttcacatatatatttgtagaccatagaggatatggattatcaaaagatatacaaggtgaatgcacttgtgatgaagcagcaaatgatattaaaaacctcatcactaagttgaacttaaaagaggtaaatctactaggtcactctatgtctactatgatagcccaaaaagttgccctaatagatgatagaattaaacaacttattttaataacaccaataactgctgctggtataaagatgaaaccccaagcacaagataaactaatagctagtatgaaaaaaaatgaaaacctcattgaatatgtagttgaaagtgcaagtataagatataaccaagcatggaaagattatagaatcaagatggcatatgaagcttcaactttggaagctagaactggatacatgactatgtatcttacaactgattttatagatgaagtaaaaaatataaatatacccataaaaataatagtaggtcatcatgacttacctgcttttcataaaaacaatgtgaaaaaacagtttgaaacttattataatgaatttgagataatagagtgcatggaagcaggacattatccgatgatagagtgtcctgtttaa

SEQ ID NO: 15604 - protein, 240 aa, Unknown
  Obtained from environmental sample
  misc_feature (1)..(240): Xaa is any amino acid
MTLLNYKKIGTGNKTIIVLHELMGDHRNYDPILPYIDTTNFTYIFVDHRGYGLSKDIQGECTCDEAANDIKNLITKLNLKEVNLLGHSMSTMIAQKVALIDDRIKQLILITPITAAGIKMKPQAQDKLIASMKKNENLIEYVVESASIRYNQAWKDYRIKMAYEASTLEARTGYMTMYLTTDFIDEVKNINIPIKIIVGHHDLPAFHKNNVKKQFETYYNEFEIIECMEAGHYPMIECPV

SEQ ID NO: 15605 - DNA, 528 bp, Unknown
  Obtained from environmental sample
  misc_feature (1)..(528): n is a, c, g, or t
atgaaaaataaaaaaatatcaccacaggcagttttagcattaaaagaggcattaattcatatctattggaaaaaaaatgacttgaaagattttctcaaactgacaataacaaactctttaattgtatctactatcaattgggacaatacaaaacgtgaagcagtttatgaattggttgaaagaatgattaatagattagatatttattatgatgacttaatatctttattaattggagtaacagattttactgatttttcacatttagattattgggatgaagatggaacaaaaaaagagaaggcaaaaaaaagcgtaaatagccttagagttcatacaaaaggatatatccaaatttcaaaagaaaaagaagaagcaattaagagaagaaatataagtgaacaaaaaatattagatagaaaaacactagaaaaggatattgaagatttaaagaatgctttttttgttattgcttcaaataataatttacaagaaagangttttgcttttgaaaaaattccttattga

SEQ ID NO: 15606 - protein, 175 aa, Unknown
  Obtained from environmental sample
  misc_feature (1)..(175): Xaa is any amino acid
MKNKKISPQAVLALKEALIHIYWKKNDLKDFLKLTITNSLIVSTINWDNTKREAVYELVERMINRLDIYYDDLISLLIGVTDFTDFSHLDYWDEDGTKKEKAKKSVNSLRVHTKGYIQISKEKEEAIKRRNISEQKILDRKTLEKDIEDLKNAFFVIASNNNLQERXFAFEKIPY

SEQ ID NO: 15607 - DNA, 432 bp, Unknown; identical to SEQ ID NO: 6983
  Obtained from environmental sample
  misc_feature (1)..(432): n is a, c, g, or t

SEQ ID NO: 15608 - protein, 143 aa, Unknown; identical to SEQ ID NO: 6984
  Obtained from environmental sample
  DOMAIN (3)...(108): Type I restriction modification DNA specificity domain
  misc_feature (1)..(143): Xaa is any amino acid

SEQ ID NO: 15609 - DNA, 519 bp, Unknown
  Obtained from environmental sample
  misc_feature (1)..(519): n is a, c, g, or t
atgaacgataaatttcataataaatatcgcatacaaaccaccaggttaccgaattgggattatggatggaacggtttttattatgtaactatttgcacaaagcatagggaatttttttttggtgaaatttgcaaaggtgtaatgcaattatccgaaataggagatatagcaaacaaatattggttaggaataccaaatcattttccatttgtgaaattggaatcgtttattgtaatgccaaatcatattcacgggatcattgaaatagataaaaatgatgacgtagagacgcaagatttttgcgtctctaccgaaaataaaatcggtcgcaatcccagaactggcatcaatattcgtggtttcaaaatggggtaccaaaaatgcaaaacaattaatcctgatttcaatggcaaccccggtttccaacccttattcgaaatgaaaaatcttttaatacctctcaattataaaaaaaaattcctgaaaagggggggagataaatttatgcaattcatctaa

SEQ ID NO: 15610 - protein, 172 aa, Unknown
  Obtained from environmental sample
  misc_feature (1)..(172): Xaa is any amino acid
MNDKFHNKYRIQTTRLPNWDYGWNGFYYVTICTKHREFFFGEICKGVMQLSEIGDIANKYWLGIPNHFPFVKLESFIVMPNHIHGIIEIDKNDDVETQDFCVSTENKIGRNPRTGINIRGFKMGYQKCKTINPDFNGNPGFQPLFEMKNLLIPLNYKKKFLKRGGDKFMQFI

SEQ ID NO: 15611 - DNA, 561 bp, Unknown
  Obtained from environmental sample
  misc_feature (1)..(561): n is a, c, g, or t
atggatattaaatcatactcaatagaagagctaaaacatgtatgtcataatatacgtgaaaaaatattaaacgttgttagtaaaaatggaggacaccttagttcatcgctaggagcaacagagataattgttgctatgcataaggtatttgattcaaaaaaagatccttttatatttgatgtatcacatcaatcatacgcacataaactactaaccaatagagaagaagagtttaaaacattgagacaatttaatggtctatgtggttacacaaaacctagtgaatcagaacatgactattttgttgcaggtcacagctctacttctatctctttgggagtcggcgccgcaaaagcgatagctcttaaaaatgagcaagattcaagagtgcctgtagttatgatcggtgatggaagcatgacagctggcatggtctatgaagcgctaaatgagctaggtgatagaaaatatcctatggttatcattttaaatgataatgagatgagtatagctcctcccatcggtgcactggagcagaatttaaagctctgctatggcttc

SEQ ID NO: 15612 - protein, 187 aa, Unknown
  Obtained from environmental sample
  misc_feature (1)..(187): Xaa is any amino acid
MDIKSYSIEELKHVCHNIREKILNVVSKNGGHLSSSLGATEIIVAMHKVFDSKKDPFIFDVSHQSYAHKLLTNREEEFKTLRQFNGLCGYTKPSESEHDYFVAGHSSTSISLGVGAAKAIALKNEQDSRVPVVMIGDGSMTAGMVYEALNELGDRKYPMVIILNDNEMSIAPPIGALEQNLKLCYGF

SEQ ID NO: 15613 - DNA, 480 bp, Unknown
  Obtained from environmental sample
  misc_feature (1)..(480): n is a, c, g, or t
ttggagggcgttaagaagagtgatgaaaaccaagattataaaatagaagttttagaggcaaaactagaaaaagtactcaaagtagtcatggagcttcaacaaaacggtagtgttgaaaatgatagttatatacctaaagcatctctaatatcaaatattcaaggtaacagttttaaagactcaaaagagtataaagagttacttcatgagttgagtgaactgaaaaagttaaaaatagaggttgctaaaacttctatagttagtaaaaaaactgagccagaattgaaaaaagattttagaatttatagagtggcaagtagtaatgttgttgtcagaaaaaatccactttcagatgctgaaattatacaaactctgaaaaaaaattctaatattaaaatagagtcatgcaaccaatttggatggtgtaaactttacaacgaagagggatatatagcacagttcttgataagagaagaataa

SEQ ID NO: 15614 - protein, 159 aa, Unknown
  Obtained from environmental sample
  misc_feature (1)..(159): Xaa is any amino acid
MEGVKKSDENQDYKIEVLEAKLEKVLKVVMELQQNGSVENDSYIPKASLISNIQGNSFKDSKEYKELLHELSELKKLKIEVAKTSIVSKKTEPELKKDFRIYRVASSNVVVRKNPLSDAEIIQTLKKNSNIKIESCNQFGWCKLYNEEGYIAQFLIREE

SEQ ID NO: 15615 - DNA, 834 bp, Unknown
  Obtained from environmental sample
  misc_feature (1)..(834): n is a, c, g, or t
ttgtttgcagagcttatggaaaacttgaaactaacagatagtgaatttcaaagtgaacgtgatgttgtagcagaagagcgtagatggagaacagacaacaacccatcaggttatctctattttagaacttttaacaacgcttatctttatcatccataccactggatgcctataggtttcatgaatgatattttaacatggagtcttgatgatataaaagagtttcactcaaaatattatcagcctcaaaatgctatcttacttgtttgtggagatgtaaaagccaaagaggtatttgcaaaagcgcaaaaacactttggaaatataaaaaacagctcaactatagagaatgttaaatttattgaaccagttcaagatggtgctaaaaatatcattgtcaaaaaagatagtgaagtagagatgctctctatcacttttcatataccaaactttcaagatccagatcagccgatactctcagctatgagtgaaattttaagcagtggaaagagcagccgtctatataaagttttagttgatgagaaacatcttgtaaatcaagtatatgcatacaacatggagaacaaggaccctggtgtttttctattttttgctatctgtaacccaggtgtaaaagctgaagatgtaaataaaataatcgtaaaagagatagagaaattaaagagtaaaaaagttacaaaaagtgagctagaacgtgtaanaataaatacaaaagctgactttatctactcacttgaaaactctacatctgttgcttaccttttttggaagctacttagcaagaggcgatctgaaaccgcttttgagttatga

SEQ ID NO: 15616 - protein, 277 aa, Unknown
  Obtained from environmental sample
  DOMAIN (66)...(244): Peptidase M16 inactive domain
  misc_feature (1)..(277): Xaa is any amino acid
MFAELMENLKLTDSEFQSERDVVAEERRWRTDNNPSGYLYFRTFNNAYLYHPYHWMPIGFMNDILTWSLDDIKEFHSKYYQPQNAILLVCGDVKAKEVFAKAQKHFGNIKNSSTIENVKFIEPVQDGAKNIIVKKDSEVEMLSITFHIPNFQDPDQPILSAMSEILSSGKSSRLYKVLVDEKHLVNQVYAYNMENKDPGVFLFFAICNPGVKAEDVNKIIVKEIEKLKSKKVTKSELERVXINTKADFIYSLENSTSVAYLFWKLLSKRRSETAFEL

SEQ ID NO: 15617 - DNA, 861 bp, Unknown
  Obtained from environmental sample
  misc_feature (1)..(861): n is a, c, g, or t
atgatttttttcagaaaaattttactccttttttttcttttattatcctgtcaaatacaaatattttcacaagatagtttattgattagtgaaattgtattaatcgggaatgatgttacaaaagataaaattatttacagagagttattgtttaaagaaggagataaaataaaagtatcagatttagatattctgaaaaaaaaatcggaagagaatttattaaacacatccctgtttaattttgtaacagtaaattataaaataactaacattgataatataagtattaatgtcgagctacaagaaagatggtatatatggccatatcctgtattggaacatgccgatcggaattttagctcgtttttaaataatcaagaatggtcgagaatcgattacggattatttattttgttaaataattttcgtggtagaaaagaaatattaaagtttaaaacaatatttggatataataatagatatgctttaatgtattataaaccatttgttgacaaaaaggaaaagataggaattggggctaatctagattattttaaaaatcgcgaagtggctttccaaataaacaacaatgaactagaatatttaaaattaaaaaataattatgctcgaagaacccttgaaatatctacttttgtaacatatcgtccatttatttatacaaatcatttagtaggtgtaaagtataaggatattactgtttatgattctgttattacattaaataataactacttctttaatcaggataataaatataagtatttatctttagtatataatttcgattatgataaacgagattcaaaagatttatcctttaaaaggatctcgatttttttc

SEQ ID NO: 15618 - protein, 287 aa, Unknown
  Obtained from environmental sample
  misc_feature (1)..(287): Xaa is any amino acid
MIFFRKILLLFFLLLSCQIQIFSQDSLLISEIVLIGNDVTKDKIIYRELLFKEGDKIKVSDLDILKKKSEENLLNTSLFNFVTVNYKITNIDNISINVELQERWYIWPYPVLEHADRNFSSFLNNQEWSRIDYGLFILLNNFRGRKEILKFKTIFGYNNRYALMYYKPFVDKKEKIGIGANLDYFKNREVAFQINNNELEYLKLKNNYARRTLEISTFVTYRPFIYTNHLVGVKYKDITVYDSVITLNNNYFFNQDNKYKYLSLVYNFDYDKRDSKDLSFKRISIFF

SEQ ID NO: 15619 - DNA, 633 bp, Unknown
  Obtained from environmental sample
  misc_feature (1)..(633): n is a, c, g, or t
ttgtatgtgaagaaattgattaagggaactgaatcaaaacttccaggagtatacaaacttcaatacatcacctcgggtgttcagaatacacctcaattcaatcttgtaacggcaagaaatgagatatcacatatgtcaaaaattactaaagatatgtttagcatgttccttgatgttttctttaatccaaatcagaagaaaggtggagaagttgaagaagttaagcaaatggaagattatacagaccagatgcaggaagaaatctccaaattcctggttcaatgttctaatgaaccgctgactgaagggaaccttaacaatatcaatgttctgatgcgtattactaatgagttagagaatattgctgacagctgtttaaagcttataattctcactcaaaagaaatatgataagaaaatcatacttcatgaaaaagcttccgaagagataaaagattttgcagatctggtaatggaattcattgatttcaaccaaattactgaacttcaacacattcataaaagagatttagatatagcctatagattgcaaaacaaaaataaacccgtccagagatctactgaaaaagggagcgcacaaaagacttcaagatgggcccccagtgcagtctga

SEQ ID NO: 15620 - protein, 210 aa, Unknown
  Obtained from environmental sample
  misc_feature (1)..(210): Xaa is any amino acid
MYVKKLIKGTESKLPGVYKLQYITSGVQNTPQFNLVTARNEISHMSKITKDMFSMFLDVFFNPNQKKGGEVEEVKQMEDYTDQMQEEISKFLVQCSNEPLTEGNLNNINVLMRITNELENIADSCLKLIILTQKKYDKKIILHEKASEEIKDFADLVMEFIDFNQITELQHIHKRDLDIAYRLQNKNKPVQRSTEKGSAQKTSRWAPSAV

SEQ ID NO: 15621 - DNA, 666 bp, Unknown
  Obtained from environmental sample
  misc_feature (1)..(666): n is a, c, g, or t
atggtttggcttggcaatagaacaaaccaagaagaatcaactaattttaaaaagtttatgacatattttgtatatggtgtattaatcaataatctatttcatgagtttttactcttttttgcctcttttaaaagaagtttagtacttacgatcaataaacttatgtcaaaaattcttattccaaaagagaacaaatccatatggaaatcatactggggatttttcttaccacacctactcaaacaagatgtagtagaatacgcttttgatatcaaagatacttttaaagtttttcgtgaagttatagatactattaaagagaaaaacatctatgtagatacccctattgaggtacgatttgtgcaaaaagacagttactggttaagtcctacaggagatactaacagttgttggatagggacaaaaatacattttccttatgggaaaaaaccagagtatttagaatatttcactacaatagatgagatacttctaaaatacaacggacgaccacattggggaaaacaatttcgaatatctcaagaggattttaaaaaagcataccctaagtgggatgatttttggaactttgcagacaaagaagatccaaataaaattttacaaaatgattttgttaaaaggttacgaaaaagagaattatcctaa

SEQ ID NO: 15622 - protein, 221 aa, Unknown
  Obtained from environmental sample
  misc_feature (1)..(221): Xaa is any amino acid
MVWLGNRTNQEESTNFKKFMTYFVYGVLINNLFHEFLLFFASFKRSLVLTINKLMSKILIPKENKSIWKSYWGFFLPHLLKQDVVEYAFDIKDTFKVFREVIDTIKEKNIYVDTPIEVRFVQKDSYWLSPTGDTNSCWIGTKIHFPYGKKPEYLEYFTTIDEILLKYNGRPHWGKQFRISQEDFKKAYPKWDDFWNFADKEDPNKILQNDFVKRLRKRELS

SEQ ID NO: 15623 - DNA, 774 bp, Unknown
  Obtained from environmental sample
  misc_feature (1)..(774): n is a, c, g, or t
ttgagcagccgagtttttttaacatcatttctgatcatagtccccctgacagctttaatctcaatatggctttatacgctgttaagtaagcttataaaagaaaaaaaacatataaactcagatgaaaatacaattccttcattggcacatgaaagagatatttattttgaagccctcctcagagcagcaccaattggaataggagtagtgaacgacagattttttatagaggttaatcaatacttttgtaatatgatcggatattccgaagaagagctgcttggaaagaaatctgtttttatctatcctgatcaagaagaattcgagatggtcgggaaagaaaaatataaacagatagccgcgggcgaaacaggtgcaacggaaacccgtttcaaacgaaaagatgggagtattatcgatattattcttagttcgacacccatagatcttgcggatcattctaaaggaataatattcactgctcttgatattaccaaaaggaaaaatggtgaagatgagaggaaaacactcacccaggctattgaacaatccctggatgcagtagtaataacaaagcccgatggttccattgaatatgtaaataaagcatttgaagataccaccggttatcacttatccgaagttaaaggagaaaacccccatatcctcaaaagcggagaacatgatcgctccttctatcagaatctatggaatacaatatccattaaacaaacctggggaggaagaataatcaaccaaaaaaaagatggaact

SEQ ID NO: 15624 - protein, 258 aa, Unknown
  Obtained from environmental sample
  SIGNAL (1)...(18)
  DOMAIN (126)...(167): PAC motif
  misc_feature (1)..(258): Xaa is any amino acid
MSSRVFLTSFLIIVPLTALISIWLYTLLSKLIKEKKHINSDENTIPSLAHERDIYFEALLRAAPIGIGVVNDRFFIEVNQYFCNMIGYSEEELLGKKSVFIYPDQEEFEMVGKEKYKQIAAGETGATETRFKRKDGSIIDIILSSTPIDLADHSKGIIFTALDITKRKNGEDERKTLTQAIEQSLDAVVITKPDGSIEYVNKAFEDTTGYHLSEVKGENPHILKSGEHDRSFYQNLWNTISIKQTWGGRIINQKKDGT

SEQ ID NO: 15625 - DNA, 525 bp, Unknown
  Obtained from environmental sample
  misc_feature (1)..(525): n is a, c, g, or t
atgaaaatggcagagagtcaaactcaaagagatatgtatactaaagatatgacaatagctaaatatctaccacaggttagtgtancagcaggatataactggagtaaaactgatggacagtttaactttggagatagtgtgaaaaaatatcatgactatggttttaaagtatatatgcctataaatatcaatacctttaaagatatagaatcatctagagttgattatttaaagtcaaaagttattgtagaagataaacttcaagagttaaaagcactttttgaacaagttatgcaaaatattgataatttagacaagaaaaaaatacttagcttagaaaacagagatatttatagcaaacttttaatagatacaaaagaactttttagtgctggttataaaactcagttcgatgtacaaactttagaaaattcagtttctatctctgagttaaattctaaaatatttgagatagataaacaacttgagctattaaacctttatgagatgtatgttaatgactaa

SEQ ID NO: 15626 - protein, 174 aa, Unknown
  Obtained from environmental sample
  misc_feature (1)..(174): Xaa is any amino acid
MKMAESQTQRDMYTKDMTIAKYLPQVSVXAGYNWSKTDGQFNFGDSVKKYHDYGFKVYMPININTFKDIESSRVDYLKSKVIVEDKLQELKALFEQVMQNIDNLDKKKILSLENRDIYSKLLIDTKELFSAGYKTQFDVQTLENSVSISELNSKIFEIDKQLELLNLYEMYVND

SEQ ID NO: 15627 - DNA, 627 bp, Unknown
  Obtained from environmental sample
  misc_feature (1)..(627): n is a, c, g, or t
atgaatgataagcttttgattttaatagtagatgatttaaaagagaataggttagcaataaagataactttaaaaaaagaaaattatatcttagaagaagcaaaaaatggtgaagaagcagtttctaaatgtatagagctaaagccagatgttatcttaatggatgctatgatgcctattatggatgggtatgaatctactaaagctataagggctatagaagagtttaatcgaacacctatcttaatggtaacagcacttagtgaaaaagatgataagataaaagcacttgaaattggagtaaatgactttgtatctaaaccatttaataaacatgaacttatagctagatgcagatcttatgctaatttgtcaaaaattaacaagcagtatatattagcatcagaaaatccatctacaaatcttccaaataaatcagcgttaattgacaatataaaactatgtacaaatccaaaactaacactctttagaatcgaagattatgaacttcttgaagaattttatactgaagagattgcaaataaaatagagtataagtttgcaaaaacaatttttgatttagttaactctaattgtaaagattcaattttatatcatacccagtga

SEQ ID NO: 15628 - protein, 208 aa, Unknown
  Obtained from environmental sample
  DOMAIN (5)...(126): Response regulator receiver domain
  misc_feature (1)..(208): Xaa is any amino acid
MNDKLLILIVDDLKENRLAIKITLKKENYILEEAKNGEEAVSKCIELKPDVILMDAMMPIMDGYESTKAIRAIEEFNRTPILMVTALSEKDDKIKALEIGVNDFVSKPFNKHELIARCRSYANLSKINKQYILASENPSTNLPNKSALIDNIKLCTNPKLTLFRIEDYELLEEFYTEEIANKIEYKFAKTIFDLVNSNCKDSILYHTQ

SEQ ID NO: 15629 - DNA, 861 bp, Unknown
  Obtained from environmental sample
  misc_feature (1)..(861): n is a, c, g, or t
atggtaacagcacttagtgaaaaagatgataagataanagcacttgaaattggagtaaatgactttgtatctaaaccatttaataaacatgaacttatagctagatgcagatcttatgctaatttgtcaaaaattaacaagcagtatatattagcatcagaaaatccatctacaaatcttccaaataaatcagcgttaattgacaatataaaactatgtacaaatccaaaactaacactctttagaatcgaagattatgaacttcttgaagaattttatactgaagagattgcaaataaaatagagtataagtttgcaaaaacaatttttgatttagttaactctaattgtaaagattcaattttatatcataccagtgaaggtgaatttgcacttttaaaagatgatgttgataatcttatttcagatgacaaagcatatgaaaattctaaagagctttataaaaatactaaagattatattattactttagataattatgaatatgagatatctatagttctaagttattcgcataataccgaacatctatttgaatatgctagagtagggctaaagcatgctgtaaaagaacagataaatattgtttttgcaaatgaaatagtagaacaagttcataaagaagctgcaaataatataaaaataattaagatgataaaagaagcactaaatagtaaaaaagtaatatcatactttcaaccaatatacaataataaaacaaaagaaatagaaaaatatgaatctttagttagaataattgatgagaatggtaacgtaatctctccatttttctttttagatattgcaaaaaaaggtanaatactatactcatataactga

SEQ ID NO: 15630 - protein, 286 aa, Unknown
  Obtained from environmental sample
  misc_feature (1)..(286): Xaa is any amino acid
MVTALSEKDDKIXALEIGVNDFVSKPFNKHELIARCRSYANLSKINKQYILASENPSTNLPNKSALIDNIKLCTNPKLTLFRIEDYELLEEFYTEEIANKIEYKFAKTIFDLVNSNCKDSILYHTSEGEFALLKDDVDNLISDDKAYENSKELYKNTKDYIITLDNYEYEISIVLSYSHNTEHLFEYARVGLKHAVKEQINIVFANEIVEQVHKEAANNIKIIKMIKEALNSKKVISYFQPIYNNKTKEIEKYESLVRIIDENGNVISPFFFLDIAKKGXILYSYN

SEQ ID NO: 15631 - DNA, 459 bp, Unknown
  Obtained from environmental sample
  misc_feature (1)..(459): n is a, c, g, or t
atgggaacttatggtataggggtaagtagattaattgcagcagtagtagaacaaagccatgatgaaaaagggtgtatctggacaaaagagactgctccttattttgtagatgtgattgtatcaaatgggaagaaacaaacagaatttgatatggctgaacaaatatataaaagattggctaatacatataaaatagatacaattttcgatgatagaaaagggaaaaaagatacatatggttctaagatggctgattttgaactgattggtttcccttatgctgttgttgttgggaaaaaacttcaagatggatttgttgaaataattgcaagaaaaactggagaaaaagcagaagtttctattgataatatagactatttatgtcaaataattaattcgcttaaaaatgaagattatagtatcaaagatgctgtaaattttgtagataataaaaaataa

SEQ ID NO: 15632 - protein, 152 aa, Unknown
  Obtained from environmental sample
  DOMAIN (37)...(131): Anticodon binding domain
  misc_feature (1)..(152): Xaa is any amino acid
MGTYGIGVSRLIAAVVEQSHDEKGCIWTKETAPYFVDVIVSNGKKQTEFDMAEQIYKRLANTYKIDTIFDDRKGKKDTYGSKMADFELIGFPYAVVVGKKLQDGFVEIIARKTGEKAEVSIDNIDYLCQIINSLKNEDYSIKDAVNFVDNKK

SEQ ID NO: 15633 - DNA, 915 bp, Unknown
  Obtained from environmental sample
  misc_feature (1)..(915): n is a, c, g, or t
atgtcagattggctgagagaaaaaggtggtgggtttgttagctatacagttccaatgggaaaagataaaacattagaaaaagtaagctatgttgttggtattgagccttggcaattatatataggttttggtgagactcttaaagatataaataaaacagttcaagagacaaaagaaaaacttcttgatgaactttataaggatattgttacgatattatctttaggtatactatttcttgtacttttttacattttattaaaaaatataagagtatcagtttccacagatacaaataatcttataaattctattgaaaaacttgtaactaataataaaaagataccacttcataatataaagtttttagaatttgaacaaatttcaaaacaaacaaatcaattattaaaaaataaacttgaggttgaaaataacctcaaagataaagaagctcttctttatcagcaatcaaaaatggcggcaatgggggaacttcttgaaaatattgctcaccaatggagacagcccttatcattaattaccgtttcaagcacaggtatacaagcaaaaaaacagtatggtcaacttgatgataagtttttagatgaatctttagaaaacataaatgaaaatgcagaatatctttcaagtacaattgatgattttagaaacttttttgtaacaagcgtaacanaagagtattttaaaattgataaaattattgataaaactttaggtctcatacatctaagagataaaaaagaagaggtaactgtaataaaacagatggaaagtatagaagtaaataattttaaaaaccaacttttacaagttttattagttattttaacaaatgctatgatgcacttgaagaagggaacagatacaaaactgcttttttatagaagtctttaa

SEQ ID NO: 15634 - protein, 304 aa, Unknown
  Obtained from environmental sample
  DOMAIN (161)...(225): His Kinase A (phosphoacceptor) domain
  misc_feature (1)..(304): Xaa is any amino acid
MSDWLREKGGGFVSYTVPMGKDKTLEKVSYVVGIEPWQLYIGFGETLKDINKTVQETKEKLLDELYKDIVTILSLGILFLVLFYILLKNIRVSVSTDTNNLINSIEKLVTNNKKIPLHNIKFLEFEQISKQTNQLLKNKLEVENNLKDKEALLYQQSKMAAMGELLENIAHQWRQPLSLITVSSTGIQAKKQYGQLDDKFLDESLENINENAEYLSSTIDDFRNFFVTSVTXEYFKIDKIIDKTLGLIHLRDKKEEVTVIKQMESIEVNNFKNQLLQVLLVILTNAMMHLKKGTDTKLLFYRSL

SEQ ID NO: 15635 - DNA, 723 bp, Unknown
  Obtained from environmental sample
  misc_feature (1)..(723): n is a, c, g, or t
atgaagaatatcctcagcattgcattagctgttttaatgattggaagcctccattcgcaaacgctggttaaaacacaaagtccgcaacctaaagaattgagtattgaaaaaatattcaaagaatatgagttttaccctcgttcagtcagaggaattcaaagcatgaatgatggagatcattattgcaaattaagcaaagaaggcatagaagaatacagctatcaaacaggcgaaaagactcgaatgattctggagaataagtctttattagttcaggacactatcgtcttaaaatatgatagttatgaatttagccccaatgaagatttagttctattatccactgaaaaagaggctatctaccgtcattcaagcaaatcaaacttctatatctattccttaaaagatcaaagcttaaagcttttaagcccaaatgggaaacaaagactggccagtttttcacctgatgccagtaaaatggcttttgtacgtgaaaacaatctatttatcgttaccctttcggatatgactgaaaaacaaatcactaccgatggaaaattcgaatccattattaatggaactaccgattgggtttatgaggaagaatttgcctttaccaaagcattcttttggtctcccaatggtgattatattgcctactataaattcgacgaatccaaggttaaagagttctggatgacctattatgggatcttatcctga

SEQ ID NO: 15636 - protein, 240 aa, Unknown
  Obtained from environmental sample
  SIGNAL (1)...(19)
  misc_feature (1)..(240): Xaa is any amino acid
MKNILSIALAVLMIGSLHSQTLVKTQSPQPKELSIEKIFKEYEFYPRSVRGIQSMNDGDHYCKLSKEGIEEYSYQTGEKTRMILENKSLLVQDTIVLKYDSYEFSPNEDLVLLSTEKEAIYRHSSKSNFYIYSLKDQSLKLLSPNGKQRLASFSPDASKMAFVRENNLFIVTLSDMTEKQITTDGKFESIINGTTDWVYEEEFAFTKAFFWSPNGDYIAYYKFDESKVKEFWMTYYGILS

SEQ ID NO: 15637 - DNA, 615 bp, Unknown
  Obtained from environmental sample
  misc_feature (1)..(615): n is a, c, g, or t
gtgaactaccatggaatgattgaatcaaaggaattgatagttgcatcaggtggtctctcatatagctccttaggtgctacagatattggttttaaaattgcaaaaaaatttggacatactatcaataaacttgatcctgcacttgttggttttactgtacaaaaaccagaattttggtttaaagaacttagtggtttgtcaattgatgcaagaattaccgttgcaaataagacactagagggaaaaatgctttttacccataaagggtgtagtggacctgtgattttaagtacttcattgtattggaaaaaaggaaatatctctgttgattttgcaccatacaaagaaagttatctaccaaaaagatttaaacaagctatcaaaaatatggatatagatattcataattatcaaatggcaccagctggaaattttggatatacaaaagcagaagtgacaaaaggtggagttgaaacatcagaacttacaaaaaatatggaaagcaagtatcaaaaaagtctctattttataggtgaagttgttgatataactggtgaattaggtggttataacttccaatgggcatttagtagtgcttattgtgtgtataattaa

SEQ ID NO: 15638 - protein, 204 aa, Unknown
  Obtained from environmental sample
  DOMAIN (2)...(200): HI0933-like protein
  misc_feature (1)..(204): Xaa is any amino acid
MNYHGMIESKELIVASGGLSYSSLGATDIGFKIAKKFGHTINKLDPALVGFTVQKPEFWFKELSGLSIDARITVANKTLEGKMLFTHKGCSGPVILSTSLYWKKGNISVDFAPYKESYLPKRFKQAIKNMDIDIHNYQMAPAGNFGYTKAEVTKGGVETSELTKNMESKYQKSLYFIGEVVDITGELGGYNFQWAFSSAYCVYN

SEQ ID NO: 15639 - DNA, 708 bp, Unknown
  Obtained from environmental sample
  misc_feature (1)..(708): n is a, c, g, or t
atggctcagataaaagccaaagtaaacctaacatttatccngtttaatccaaattatattacagattataaaggttatactttaggaatgaccaatgaagaaatagatagacttcatgcatttagagctactgatcaatgggtgaattctgtaagccaatttcaaaaagtgacgaaagtatctgattcgttattaaaaataatttctccatattttaaatttcctagttgggtaaaccaatctcaatctcaaaccaaggcatattcaaacgcatatgccaactttacaaaaccgaaaagttttaaacaaaaaatagatttaaatattgcaacggctgctcagctaaaaaaagtgtatggtgttggggaaaaactttctcaacgtattgtagcctatcgaaacaagtttaaaggaggttttattgcggatattgaactcagtgaagtctatggtttgtcgcccgaagtcataacacgtattcaaaatgactttacagtaaaaacacctagagtcataaagaagattcatctcaacacggcgacaagagatcaacttgtaaatattcagtatatagactatgaaattgcccaccatattatagaagaacgtacccttagagatggatttaattccttggaagaattattaaaagttgaagattttccggttaaaaagatcgagataattaagctatatttgcaactttaa

SEQ ID NO: 15640 - protein, 235 aa, Unknown
  Obtained from environmental sample
  misc_feature (1)..(235): Xaa is any amino acid
MAQIKAKVNLTFIXFNPNYITDYKGYTLGMTNEEIDRLHAFRATDQWVNSVSQFQKVTKVSDSLLKIISPYFKFPSWVNQSQSQTKAYSNAYANFTKPKSFKQKIDLNIATAAQLKKVYGVGEKLSQRIVAYRNKFKGGFIADIELSEVYGLSPEVITRIQNDFTVKTPRVIKKIHLNTATRDQLVNIQYIDYEIAHHIIEERTLRDGFNSLEELLKVEDFPVKKIEIIKLYLQL

SEQ ID NO: 15641 - DNA, 984 bp, Unknown
  Obtained from environmental sample
  misc_feature (1)..(984): n is a, c, g, or t
atggncagacttatggggagacaaaatagctggtgttttntaccacttttagatataaaaaaaaataatgttggatatatattttcaattagagatgatagttctgtgcattcgcttttcattagtcaattagtaaagtttattatcgcatttattgttattcttattttagtttatttttactttttaaatagacaaaaaacaaatttaatagaacaactgcaagaagctattgatcaaacaactttggtatcaaaaacagatacaaaagggaatataacttatgtaaatgaagcttttgtgaaaatatcaggatttacaaaagatgaacttataggacaaccacataagatagtaagagacccatctacttctagagaagtttttagagatatgtggaaaacaatatttgcaaaaaaaccatggaaaggaacaataactaatcgtactaaagatggtgaacaatatacagttgatgcaacaataatacctatactaaatgtttctaataaaatagttgaatttgtagctataagacatgacattagtgaattagaaaagtataaagagatactaaaagatcaacttgaggatacaagtaaatcattaaaagaaaatataaattatacagctcaatatgaagaagcaatcaataactcaactgcagttttaaaaacagatacaaataatacaattatatatgtaaatgaaaagttcagtagattaagtggttatagtagtaaagaacttataggtaaaaattgtaaagagttacgacatgaaaatcatattaagatgaatgattgtgataatattattgaaaaaatgaaacaaaaagagatagtctctttagtatttacaaatattgcaaaaaatggtgagttatactttcttgatacattaatatatcctatagtttcacttgaaaataatgttattgaacatttgcatttaatgcatgataatagtgaaattatcaatctt

SEQ ID NO: 15642 - protein, 328 aa, Unknown
  Obtained from environmental sample
  DOMAIN (143)...(185): PAC motif
  misc_feature (1)..(328): Xaa is any amino acid
MXRLMGRQNSWCFXPLLDIKKNNVGYIFSIRDDSSVHSLFISQLVKFIIAFIVILILVYFYFLNRQKTNLIEQLQEAIDQTTLVSKTDTKGNITYVNEAFVKISGFTKDELIGQPHKIVRDPSTSREVFRDMWKTIFAKKPWKGTITNRTKDGEQYTVDATIIPILNVSNKIVEFVAIRHDISELEKYKEILKDQLEDTSKSLKENINYTAQYEEAINNSTAVLKTDTNNTIIYVNEKFSRLSGYSSKELIGKNCKELRHENHIKMNDCDNIIEKMKQKEIVSLVFTNIAKNGELYFLDTLIYPIVSLENNVIEHLHLMHDNSEIINL

SEQ ID NO: 15643 - DNA, 765 bp, Unknown
  Obtained from environmental sample
  misc_feature (1)..(765): n is a, c, g, or t
atgagtcttttagagataaaaagttttattaaaaatataaaaccttttgataatttattaaataatgagcttgaagaggtgtgtagtcacttagatatattatattttaaagccaatgaagagattttatctcctgctaaaaatgctgaatatctttattttattattaaaggggtagtgcaagaaaaactagaagaggaggtagtatctgtatattctgctaatgagtattttgatcctataacacttatagaaaataagataaaaaatacttttgtcactgtacaagagtcaattttgtatgcactaccaaaagagatatttctaaaatatatgtatcaaaatgacgctttagagagttattttttctcaactatttcacaaaaattaaatagtagtatgcaaaatgaacaaaagaaaaagttattagattttgctatgtcaaaggttgaagatgcctatttacaaaaaccgatctatatagatgaaactgaaactatctatagtacagttgtacaactcactactaataatattcaatcaattttagttaaaagagcagacggtgagattggtattgtaacagactcaagttttgtaaaaaaagtacttcttaaaaggatggatgtagatggacctattagtcaaattacaacttacggttttaaatatatagaagctacagactttttatttnaatgcccactacaaatggcaaaatacaatattaaaagacttgtggtaagaaagagggtgagattgtag

SEQ ID NO: 15644 - protein, 254 aa, Unknown
  Obtained from environmental sample
  DOMAIN (30)...(117): Cyclic nucleotide-binding domain
  misc_feature (1)..(254): Xaa is any amino acid
MSLLEIKSFIKNIKPFDNLLNNELEEVCSHLDILYFKANEEILSPAKNAEYLYFIIKGVVQEKLEEEVVSVYSANEYFDPITLIENKIKNTFVTVQESILYALPKEIFLKYMYQNDALESYFFSTISQKLNSSMQNEQKKKLLDFAMSKVEDAYLQKPIYIDETETIYSTVVQLTTNNIQSILVKRADGEIGIVTDSSFVKKVLLKRMDVDGPISQITTYGFKYIEATDFLFXCPLQMAKYNIKRLVVRKRVRL

SEQ ID NO: 15645 - DNA, 567 bp, Unknown
  Obtained from environmental sample
  misc_feature (1)..(567): n is a, c, g, or t
gtgaaggagaactatatgtatttagcgattttctatgatgctgttgcatttacaggagataataagttattgactgatttaaaagagtatatgtatacaatatgtgaaaatgcaccatctttttatccatattttgcgaagcctattgtctcatttgaaacaccattaggattatttagtgattttgttgtggataaagatttacataaagatgaattagatattaaaaaaggtggaattttccctattgttcatggggtgagaactttagctatagaaaaaaacctacatgaaacaaacactgtagatcgtttaaaagaacttcatgagttagatataatagatgaagagtttatgaatgaattgactgaagcatttaactttttattgacattacgattacgatttaggcttgaaaaaatagataaaagagaagagttggataattatataaatccatctagattaactattttagaaaaagatttattaaaagatagtttaaaaatagtgaataaatttaaaaaatttatcacatatcattgtaaaataaatatgataagttaa

SEQ ID NO: 15646 - protein, 188 aa, Unknown
  Obtained from environmental sample
  DOMAIN (1)...(185): Putative nucleotidyltransferase DUF294
  misc_feature (1)..(188): Xaa is any amino acid
MKENYMYLAIFYDAVAFTGDNKLLTDLKEYMYTICENAPSFYPYFAKPIVSFETPLGLFSDFVVDKDLHKDELDIKKGGIFPIVHGVRTLAIEKNLHETNTVDRLKELHELDIIDEEFMNELTEAFNFLLTLRLRFRLEKIDKREELDNYINPSRLTILEKDLLKDSLKIVNKFKKFITYHCKINMIS

SEQ ID NO: 15647 - DNA, 726 bp, Unknown
  Obtained from environmental sample
  misc_feature (1)..(726): n is a, c, g, or t
atggaaaatacaaaactacaaagacttcaggacataggtggatgtagagccatagttacagatattaataaagtttatgaattaagggacaatattacaaaaaaattttctaatcatatattagtaaaagaaaatgattatattaaagaaattaaagactctggatatagaagtattcatttaatatataaatatcaagctaaaatacatacagattttaataaacacttaattgaaatacaaataagaacaaaattacaacatgcatgggcaacatctgtagagattttaggtacttatcttaatgaaccacttaaatcaagtcaaggaaatcaagaagttttagatttgctaaaaaaaataagtttattattttcttgtactgaaaataatcaacaaagttttactattcaggcaatggaatcccttagaaaaactattaaaaaagacttaactagtttagatatcattacacaattaagagcattttctgtaacaacaaattcaatcacaactataaaaaagaaagataatactggatatacactactttacctagatactgagaaaatggtagtaaaaataagaggatttaaaaaagaggaacaagaggaagcaattgcagaatatataaaactagaaaaagaatctaaaaatccaaatagtgataatattgtgcttgtttcaactgaatctgcatataatttaaaaaaaaacttaccctaa

SEQ ID NO: 15648 - protein, 241 aa, Unknown
  Obtained from environmental sample
  DOMAIN (5)...(92): Region found in RelA / SpoT proteins
  misc_feature (1)..(241): Xaa is any amino acid
MENTKLQRLQDIGGCRAIVTDINKVYELRDNITKKFSNHILVKENDYIKEIKDSGYRSIHLIYKYQAKIHTDFNKHLIEIQIRTKLQHAWATSVEILGTYLNEPLKSSQGNQEVLDLLKKISLLFSCTENNQQSFTIQAMESLRKTIKKDLTSLDIITQLRAFSVTTNSITTIKKKDNTGYTLLYLDTEKMVVKIRGFKKEEQEEAIAEYIKLEKESKNPNSDNIVLVSTESAYNLKKNLP

SEQ ID NO: 15649 - DNA, 411 bp, Unknown
  Obtained from environmental sample
  misc_feature (1)..(411): n is a, c, g, or t
atggagcaacagcaaatttatggtgaagaagccgaaaaatttgttttacattttgaatttagaaggcttaaagaacagaaggaaataggttggattgcagagtatatagttaacgaaggttatgatattgcttcgtataatgaggaagctgataagtttccaaatcggttcattgaggtaaaatcttatgacggtgaaaccccatatttcttctggtcaagaaatgaatatactgttgccagaattaagaaaaatgaatattggctatacttggtaaatcgaactgatataaataaatcaggttatgagccgattatgatacaaaatccatttgaaagaatattaagcgataataaaacttgggataagcaaatagaaaaatataaaatatctttaaatgggataaaataa

SEQ ID NO: 15650 - protein, 136 aa, Unknown
  Obtained from environmental sample
  misc_feature (1)..(136): Xaa is any amino acid
MEQQQIYGEEAEKFVLHFEFRRLKEQKEIGWIAEYIVNEGYDIASYNEEADKFPNRFIEVKSYDGETPYFFWSRNEYTVARIKKNEYWLYLVNRTDINKSGYEPIMIQNPFERILSDNKTWDKQIEKYKISLNGIK
